United States Patent 6,551,795 (NUCLEIC ACID AND AMINO ACID SEQUENCES RELATING TO PSEUDOMONAS AERUGINOSA FOR DIAGNOSTICS AND THERAPEUTICS) - sequence listing, part 9

SEQ ID NO: 24213 - protein, 448 aa, Pseudomonas aeruginosa
KPCFSPLASLPPRSRKARDSVLLLEVPLGDDGHRGAVVELQLPGSHYLLAALQAFEHHRQAFAAFADPDEAALDDLLRLALVILRHLALLVLLLPDDVDRVAVEGEGDRRLRHHDALFLARQHHLEVGEHARQQLAVRVLQGSADLQVAGLVVDLGVDGGDLGVEHLAGVGGDPDLHQLAAAEQGEVLLGQVEIQEQGGKVLQGGDRRPGRDVVADVHLADADGPGEGREHALLRQRRLQLGDGGAGLGPLRGETIEFAFRDGLAADQFAAALVLGPGQAEIGLGSAQGGFLDVAFQLDQRLVQLHLVAGKEQYVAYRAGDFGGEGHALECLEAADGWQAALPGTLFGQAGGHADRRFRCAEKGDLLTDGVDLVAGENRHHGDHRGEHDQHAAEQHNPGPWYAESAPFRGESDTLRAAFRACQSTGLAKDFKRVAGRFRLSRTGMARG

SEQ ID NO: 24214 - protein, 277 aa, Pseudomonas aeruginosa
GQRPAAARCDGLLQARRRTPPHSLWTAWRREGSLGKTETALSPEQQLRGHAQHHGRHHQVEQAPGGRARQPGGQPCRAEGEGEEPHQRGAGRAEGIGARRGLLGAERTDQKYGIEIDVGVEQGDRQCRQKHRLARAWPGFRGVAEGVRAQRAKQRLEPVPGQEGDPAPAGDGQQRRVFQQQLGQAEHAEADQHRVAEHAERGHREVMLAAQALREDEGILRADGDDQAGSHQDAVEIALPHVSVPPPPAAGARRGRAGPRRGRRTGGRGNSRPSRCN

SEQ ID NO: 24215 - protein, 299 aa, Pseudomonas aeruginosa
FCSTTSCSPRWPQWWSRAVSSAPHRRWGCRNRRYRSGSSCSRRGSASRSWCARRRRIPPISGAACSTMCSRCGCWRATCSAGCRTWMKAVPRSACASLLNADSLATWWAAAVGDFCAERRVLLDLVVEDQEVGLKRMRAGEVAGCVCGSARPVAGARSLLLGAMRYRGLASPDFIARHFPRGVEAAALAGVPAIVFGPDDLLQHRFLKDLGVEGGFIHHLCPSSEGFVRLTAGGLGWGLVPERQVQGELARGELVELLPGQVIDVPLYWHYWRNGGELLASLTEHLLARAGDGLVRVSG

SEQ ID NO: 24216 - protein, 375 aa, Pseudomonas aeruginosa
RAAPLLSPNASRAGGPQGRCSGMLCQWWRGSGLLESRHKKNNGRNAMRILVTGATGFIGGRFARFALEQGLSVRVSGRRADAVEHLVARGAEFVPGDLADPALVVRLCEDVEAVVHCAGAVGVWGPRERFLAANVGLADSVVEACMRQKVRRLVHLSSPSIYFDGRDHLDLNEEYVPRRFSDHYGATKYQAEQLVLSARDLGLEVLALRPRFVVGAGDTSIFPRMIQAHRKGRLRILGNGLNRVDFTSVHNLNDALFSCLLAGEPALGKVYNISNGQPVPFWDAVNYVMRQLDLPPVGGHLPYAVGYGLAALNEGVCRILPGRPEPVLFRLGMAVMAKNFTLDINRAREYLDYDPRVSLWTALDEFCAWWRAQGL

SEQ ID NO: 24217 - protein, 409 aa, Pseudomonas aeruginosa
RAGVLSARRLRGQQGRFRRRQRDPAEPAEALSQLPRRRIAGAGAGRLHRGDRIALLEVDIQRLFLAQASAHGAHAIQQGFVQLHASSGSRICPAKPRQAACHAGRGPAPACEAGNRWRPAAVCAGQRSLRLGAHGFAVERPGPAICFEQTLKGRGRTDIMRHSALSHRPPAGCRSPSQVFTMRNDAFDELDDVPSLTTDAADRDEFGHHPRHVYEPEQRRVVDTKERRPASTGPVLGPARGDADRPRRGGLVEPPANQPDGTAVGGDPGKLRKDQRGSRRAPRRHSRQGGRQRVQRHQRTRGAAPAGQATAGETRQPGTPAGRCEQPVRRPGQTPRPTGQRSQGPAGKRGATGRATGRQAADTGRRTGEAESPAGRTGKDQRATQGPRRRCRGAEEAGQPEPDDQGYPG

SEQ ID NO: 24218 - protein, 197 aa, Pseudomonas aeruginosa
PAGIAQPARQPPGPGRQYRRVRRLPHPGDAQHQHPPGPGAEPAAAAQYPLTPCAASRPSHRALAATVRRARRKSPLPLLWISESAAPPLRYCVLKRALSESRLDSRSPAREAIGPFLCLESAMSALQPSRSYRITGYSPAISNGYRQRLFSMGLLPGAALRVVRIAPLGDPIQVETRQTSLALRRKDLALLTLVPLD

SEQ ID NO: 24219 - protein, 203 aa, Pseudomonas aeruginosa
SKRRFRPWGKLARMNYLAHLHLGGPQPAQLLGSLYGDFVKGRLQGQWPDEIERAIQLHRRIDAFTDSHPLVHAAKRRFPLERRRFAGVLLDVFFDHCLARDWNDYADEPLPQFVERVYGTLRTASPLPERLARIAPRMAAQDWLGSYREFAVLREVLGGMSRRLSRPHLLDGSWEELAQRYDDLSADFRAFYPQLQAFALSQR

SEQ ID NO: 24220 - protein, 225 aa, Pseudomonas aeruginosa
RAVVQRWHPRQDAGSDTFHTGVRHVLATLARPARPPAHRRLPGRLARRRPGARRRSWHPGAGGARRTIGRESGPGLPRRLPGGPARALAGGAGRSRRAVRDREAQRAPGGPADPPGGAGPAWTKGFRHRWRQRLLVAGGRPRRGTGAAAATVDDGGPGRRPGGAPGGVAGAAADAGCAAFPPVARRCPLRAPARRWLGRLRQAVPPAGGCPCAGGAGRLALWGRP

SEQ ID NO: 24221 - protein, 386 aa, Pseudomonas aeruginosa
SCATPTTATGVSATTNSCAWHRRRSPGRRGHDPSPSLALPVRPGAARRPRVGLAEPHPPGGLSRHHRRLYGQGVLLLPLRDGELRGLLPGLYPTVRADQRLLRRRSPPPGDRPRPRQYADGRLAGPARGMPAHARGGQAAGLTGGACRGAGRGTAPARSRRWNACCIVCPVVAPQPSAVGGGMATGAGLLADQLRFRETREDGRGAALRSSQRPDRQAGRRAHRGAAGHPGQRPGPARRANEGQLLRNLALPRGHRGEPPGHGRLRRPAGRPVAGREARLHPRPARPAAPPEGRRAGHPPGRRAGPGGDPGAGAAEAARLRPGREAQALEGDGQYSLDHSRGTGVRRAELPRSAAGTVLTYRRRAARALGSTQWNRLPLSFAACRA

SEQ ID NO: 24222 - protein, 431 aa, Pseudomonas aeruginosa
PRPAGLASGPPANKTGAQSGQRRDGMARHRHIVAWLEEVADDLRSLRQDIHAHPELGFEERRTAALVAECLRGWGYEVHEGIGRTGVVGVLRQGDGTRRLGLRADMDALPIVEATGLGYSSCHGGRMHACGHDGHTAMLLGAARYLAATRRFDGTLVLIFQPAEEGQGGAEAMLADGLLERFPCDALFGMHNMPGLEAGHLGFRAGPMMASQDLLSVTLEGVGGHGSMPHLSVDPLLAASSAVMALQSVVARNVDPQKAAVVTVGALQAGEAANVIPQRAVLRLSLRALDGQVREQVLQRVRQIIELQAASYGCQASIEHYPAYPVLVNSVEETEFARQVGVELAGAEQVDGDTPKLMGSEDFAWMIQRCPGSYLFIGNGRGRPMVHNPAYDFNDDILVRGAAYWGALAETWLAAPAASGLRLTAANNGAA

SEQ ID NO: 24223 - protein, 383 aa, Pseudomonas aeruginosa
AAPAFPRLPGDSHARLPERYLAYPPGGGCRDRQRPGVVRLHRLRLPFQPDRQAVLPFRRRVHLAVDGPGHLRCRFLHASGRWGPARPVCRPQGTQGGDATDHPADDAVHRDDRLRPDLRGDRRRRTVADRDRANAAGFRHRRRVRQRHGFPGGKRAAAPARSLRFLAIVRPVPGGVRRCGDGRAGHPLPGRRVPGELGLAGAVPVRSADRSGGIVDPPLHGRDRGLPRSHPGARRAPGAALRAARIPAQRAGEHGPDGDRHGVLLRGAGEYADLRPQSVGPAAGRGVHGANGCGGADDPGDPVGWGTLRPGRAAPGAAGRDPGLHAHGLSAVRLGRRGAEPGAPAADATVAVHGDRRLLRPGADRGGRAVSGAGAFHRPGGGV

SEQ ID NO: 24224 - protein, 491 aa, Pseudomonas aeruginosa
RAAAVRGDPPTRTVLPRGHAGLPGADRTVQPAGQRHRLAAGGKPPARPGRRARPATGARRMAGLDARHAAGDQGPRRHLRHSYHPGFAAVRRAGAGARRHRRRAGEEQRCDRHRQDQRTGVRARLADLQPAVRHHPQCLRSGADRRRQQRWGGGGAGAAHAAGGRRQRHDGFAAQPRRLQQRLRLPPVPGTGAARPASGTVRPATGHRRPDGAQRGRPGPAAGHPGRLRSALSAVVARRSAQVRRRPRARFPQSPARLARRLRRLPADGGGRAGALRSRAGRFRRAGLRRRGVPAGLSPGAPVAHLAGPSPVAGAGLAWRALRRSRTARPAQAGGAVGSGVRARPRRHRGLSRLAGSQRLVSGAGASVRTLRFPLAAQRPGVSFRCRNGVAAAGRRAADGHLSPLDGGGDRPDPGRFAGDQRTDRLRRGGPADGIADNRPGAGRPGGAATGPCPRGPDPLGQPPSAGDARGSRGHRLGRGAMLAYSQILPT

SEQ ID NO: 24225 - protein, 205 aa, Pseudomonas aeruginosa
RRRALPLPDGGAFRAAAGGVERAHRAGRRFVDSRRRPPAGGGKLGARRPAQALPGQPAGGRPARQPVPFGHGQGLPGRTGRQRGAPPGAPAPGRRGPLVAHPRAGPRPGLRRAYRGTLGVSGAPAVPDPRGGLAGTRPGSPARQRGAALAARPGLRRTGAPPAPGNPGRYRQSVAARARLTREFACSQAAGLRWRRTQREPACTS

SEQ ID NO: 24226 - protein, 316 aa, Pseudomonas aeruginosa
RRAVLPAHAAGHRGGAAEHRAGAVPGGRRALRRTVSRRPAGCPPPGRRRALPVRRLRLPRPGQRLDPAPARGRRRTAAVQPAALEADWRQSLPRPSQAAAGGRAPRLCRRRRDHRRILGTGQRRQRLARGDGRDGRPGGGGLGGAVRAAMAGLSRRESLEAPRGHDPYPPSAAAGGGPWVGPGGLRRRPPAPRHPAIAGPRAERLAPTDLAGDAVLPADLEGSPGPAQGRPARRGGAPAAGRAAHRPRPGALCRAALLPAPAARRRAHPRIPAALPAPEDGHGRRLGERRLLQLRSLESTLQPRRQSRGPRPGLHQ

SEQ ID NO: 24227 - protein, 253 aa, Pseudomonas aeruginosa
RAPYRRAGALSRRLARLHRGGGRVAIVAALLPAVPGPAGGVLRAVPGARRGAGAQVAGAPADAGAGAGQGAAPGLRPFSRRTGLSTGGRPDPAGYAARITIRRGMEHAAQPVAGPVDRREPGRLQHARRVLRCGGRTGLRRPFERRCQPRHRLPLPSAEPVGGRGTRGAGDLPQQRTDRQPAEQRLPGVRVRDRQLQAGNAPAAGGQLLDPVRRRSDGFHPHRQLHARGQGRLGLLPALRRTQPATEERAPGG

SEQ ID NO: 24228 - protein, 482 aa, Pseudomonas aeruginosa
PACPLPRTRRSLPCPVRRRPAPWILDRLGDQIGGAADGHQVYRLVVLDRLDGDGTALGLADHAQQAGLFEDLAGELVHPGGGGGTGRADHLVADRIDRADVIDEAAFQVHRQRFALVQHVDHALVRGVAAGEHLAVEQQGLARFPALHLFRGDLVQVDAARGRAGFPDDLRVGVERRRFQFGGAGAVEHEVGVAGRGAVGDHAHRQRGGVGRVVHDLDVEHGGQAAQALGTDAQLVDLLEQLQAQFLDAVLRAAGLQFVDVDRVHEDLLRHHRCFLRGTADADAEHARRAPAGAHGRYGLQHPVDDRVGRVEHGHLRLVLRAAALGRDIDLDLVAGNDGVVDHRRRVVLGVLPRAGRVGQDRGAQDVLRQVVGATHAFVDHIVDAHGSAVPAHVHADPDEHGDDPGVLADRAVAGGAHARVDQDLRHGVAGSRRFFAQVGLMHGLDEIDRVVVGDELQGIGDALDQVVLLDHGHGARSSSGG

SEQ ID NO: 24229 - protein, 495 aa, Pseudomonas aeruginosa
LAVRSTRQPAGGRVHCGQVPLRDGAHAHRQASSETACAAKALAPPVRHGRRHLPARPGPALAGATQRLLPRSADHRGGQHHPGGGLPTGLPLAVRQRSQPALRRSQPDRAAGAGGDRLADLFPLPRRQPARHLHGVLRAGPAVRCVPTAAAGLRPLCGAGVHRFFRHLPGRGLAAASRATGPGCIACARDVHRNGLAEPVRQLHTGDAATHAPAPLCLAGAPGHAARHDAPTGRPGGHRRTHRSVQPPAFHAHGQPGAGRPAAEPAARPGADRPRSLQADQRPPRPRRRRSGPADLRRGGAFLSARWRRPGPLRRRGVRPAAAPRRRGTAGKLLRAPAPGVPTGGTGRGHGGYPEPFGGHDPAVCRRRSRRGLAAGRPGALPCQARRTKPLRRHLGGHQCLTYGSASDALPSPPAATCWMRCSPVASPCPIAAAPEVATPAWCIACRARWTTPSRRRSIRHGAKRAGGWPVSAGCSATSCCSLSILSATGCRLGS

SEQ ID NO: 24230 - protein, 391 aa, Pseudomonas aeruginosa
WPPAPGWRRSGGYFARPCARNTRRRSSCCTWRATTTWRASWRSWPGVIRKCASTWCRRRSCPLPWPISALFRGAAWPYSAANPPASNASPGISTWPAYRVARPWRTCSCPTPDAARWRCLAAIAAALRRIPGVTMSELIRVEREAGLLTLRLDRQDKKNALTRAMYSRMAEALLEAQADTAVRVVLITGGDACFTSGNDILDFLEQPPSLRDSPVGRFMSALLEFPKPVIAAVNGPAVGIGTTLLLHCDLVFVGRNARLKMPFVNLGLTPEFGSSLILPRMLGHARAAELLMLGQDFSGEQAAAWGLANAALEDGATVLEHARDAARRFLHLAPSAVVESKRLMKAPFIEELRRVIAEEGDIFSTRLRSPEAIEALSAFMHRRQPDFSRFA

SEQ ID NO: 24231 - protein, 981 aa, Pseudomonas aeruginosa
PMRRQPEQGYIDQYADHQVEGRAHRPQRAEGRAADQHAQRSDQQHAHPFAGSAGQRAQQPAEQRPAEQPGPAQRPGTQQHSGQRSIDEGDQQRPGFRRQLPQRDFRRTRRRGRRQRFAVDQADQLVHRGLDPAGVVTLAKCRGHPLANDPSGDHIGHRTLQAVADLDAHAPVILGHHQQQTVVDRLAAELPGLEQLVGEGFDIEGTGSRQHHHRDLRTASPLQRLELLHQALARRLVQRVGGIHHPLRQGQGDPFRRRFGVRRHPGQQPGQGEQQEDRRENTIRQGSIHERQSSHPERVSAKAATARRVAPARSLVATQVRRDRQVLQRARPLALAGLVLLELVDIGQHLGHGEIEPGGNLLVQLGGVVHRSRQRRRLHDHHLVLLGHLADLQGQEIVAFGQQQRRPAARRVVLQGYGEVGRVGDHHVGLRHRRHHPSLRHLALHLADLRLDLGLALGVLVFVADFLLGHQQLLAVVPDLVGHVHRGDQQQAASHPEGAPADHPHAVQDRLLERLVRQRQEGVAVGGEHQQGHRQHHQELDQRLAQFEQRLGGKHPLQPRQRVEPAELGLQGVHREQPAAEGDRPDDRRHQQHQQDRPEPLGSQVGRSAEQLQHALGIHRGFPGQLEIAAHQAQQGARQVGAVDQQAAGAGHEDGQGVQLPRTRQLPFLARLAAAFLRGFLCLVLPALALGHGYFARTSSRRNCRVSPASTWYWLSRSAVPIQRITRPSTRVNGKPMEKMFSCGAARVMAPKARFTTSSAVIAGSASSSAAPITQPSLPAMIQKWLPLRPSPTGRVTKLSAITSNTTRCPFIARNSSVTSMVKNWPSTGTETPLAGSTMEAKPRPICIEMICPAITKAWNNNCREKPSKAPTRICSPISSMAFMLSASTCGIGGRFGTSTTQTPSARYSRTRTGTSWVPITGMVISSAATRNSGSTKLAIQPPICALVSSSISRSAAGCCRSASGCIPSAAAAARGPARSG

SEQ ID NO: 24232 - protein, 457 aa, Pseudomonas aeruginosa
RPGTSPPRDRPAGSEPPARRRSSPSATTPRGTGRVPPQGSCLSPARQRRVKPAAPLDGAETARQRPDDQRPAIHQDEQHDLERQGNDQRRQHHHAHRHQHAGHHQVDDQERDEDHEADLERGLQLGRDEGRDQDGQRRRLRAADVGALGQADEQLQVGGASLRQHERLQRYLGLLQGFLGGNLLVQVGLQGLAVDLVEHRGHDEHGQEQRQPHQHLVRRRRLQAQRLAQDGEDDDDPGEAGHQHDERRDEAQRGHDQQDLQADRILLLALAVGGHGDRRDRCRVGGQRRPRRQQQKAERGERAGQGDARSHGLPLGSLFSSSSRRWANSGVAGSPSGRCTGSLSTCNGVIRPGVRPSRICSSPTCTSTSRSRGPSGWLARVRIKRLPRGPACCTRRTSQASRKIRPITRPRPSTSWASCAAAPEAAPTVGAAAPVVPSAAHSGALSEASAGRKPANR

SEQ ID NO: 24233 - protein, 321 aa, Pseudomonas aeruginosa
RQVALVGAQLDLEGGHAVGAHHHVFRHLHRDHVARLHVQDVAQLELAADHGGAERYLDVQHVLAQGLDPALVLVVVVGLETGVEHLADRLDHRIGHGDVQVAATAVQFDVEGGDHHHLAGTDDVGHGRVDLRVDVLEVHLQHRLPGFLQIDEGLLQHHPHHPQFGRGELAALDLGVAAVAAEEVVHQLEHQLGVEDEQRGAAQRLHLHQVEAGGNVQRVHVLAELHHLHAADRDVGRTAQQVEHADAGVAGETLVDHLQGRHAAPDDAVLAGQVIGLDRSRRRLDFGFHQAIVDAVQQRVDFILGKQILHGHGIPTAARNW

SEQ ID NO: 24234 - protein, 139 aa, Pseudomonas aeruginosa
PPSPSARSRCRSGSGSTPCSPNRRTTAAMRSARRSRLPSSSSRRTSPACWPATKTSSCPATSTSATSRTTPTCAAGASASWKACSFARKSGSSRPRRKSASCCCLSWSAPACSTSSPSSTRSPATATWWTTWSRRFPTC

SEQ ID NO: 24235 - protein, 632 aa, Pseudomonas aeruginosa
PPGRGFPKRSPGRDRHLPAGAADHAFPAPRGGLLHAQLAALLPLAGRPSTARPVDPRLSRRRRHPAQGQGLRHRPDVGQHRPFLLPGPTPLGPGLHADQRGTGQHLYPPPEDPPAARRLMARSGQRRIALAQRQAVAGPAPLGAQHGEAEGVPAVRAVDEHRTAVHARHRLDDGQAEAVVGLAVAARRVDPIEAFEQVPAVLVGDRHAGVAHRHPHFVAAPLDADPQRAAGGGVLGGVVQQVGHRPLEQGALDQRAGLAAHLDTDPGLVEDHLEEIHRGGDLAGQRGFLALAGQASLVGAGEEQHVVDDRPQPLQLLQVGLQDLFVMFAAAFAGQRHLGLADQVGQWRAQLVGDVGIERLQAHVGLLQAVQGAVERSHQLAQLGRQRRELQALRQLPRADPPGLLGQPMHRPQAQAGDPVAKQRGQQHTEGGQAEQPFQGGGPRLMERRAVDGGDVGQPRPPLARRQHADPRSQRVPVLRQLQFVAAGAIGDQPLHRFAEAPVVIARVVAVDPETDQLVLLAQVVQLALQVRPALGQVGMVEHPRDHVEAHVHLALLQALGLAVEDAIEHGADEGEDHHRGAGEHSRQAGRQGHAHLSPTPPAHGSPGRSPCPGWYAAACSRTDRRAWRAGA

SEQ ID NO: 24236 - protein, 214 aa, Pseudomonas aeruginosa
GHGSGSPPSSPRPRQSVPASIARSSVRLRIPGGTHACLHPSHAPPSRKAASVTPHVAVAPAVPPSEVVVPRRWNSRSRARYTTGVLNRVSTWLTSSPPTTAMPRGWRSSEPVPKPIIRGIAPSSAARVVIMIGRKRVRQAWYIACSALMPCSRWATMAKSTMRMPFFLTMPISSTMPISAMIEKSWPQAQSTNTAPIPAEGRVERIVSGCTKLS

SEQ ID NO: 24237 - protein, 269 aa, Pseudomonas aeruginosa
PATATSTVKAKPTSISRWCPSAQRRPRSYPPVSHSAKPFLGASACRNAGMKREASIGARVSEASTEIRIATVTLTANSRNSRPTIPPMNSRGMNAAISEKLMEITVKPISAAPLSAASTFEAPASRCRWMFSTTTMASSTMKPTAMISATRVRLLRVKPSTYIAAKLALRDTASTVATIRVADSWRRNRPITSTTRPMVSSRVSSTSCSDERMVRVRSLSTSTSMVAGSISRRRGNAAWIASAVSTMFAPGWRRITSATPGTPFGQACT

SEQ ID NO: 24238 - protein, 202 aa, Pseudomonas aeruginosa
SLSSISGIISELTRRIMIGLSAGLTLRQVGRFGMSTGSRPAAALIAAWTSWAATSMLLSRLNCRVRVVVPRALLEVISVIPGIALNCTSKGVATDEAMVSGLPPGNKALIWMVGKSASGNGATPSRRNASSPSSSEARVSSAVAIGCRMHQPEIPARGVTAAAPPPEPGSGAAPGYRPGRRASAASGRPPPPGHRWPGLPPH

SEQ ID NO: 24239 - protein, 282 aa, Pseudomonas aeruginosa
RPVAGVRLQCRGPLAARRRRRTPDRRQQEAVALAGPADQDARRRPRPRRTQGGLNVTAQAIVPRHLPVPRRRLQRQLRQQRGELPRAVARPVALPRPGRRHRPRPVPDATRGRPGDGATDGQLDLRQRLLRQHPGDRHQERQAAGRARAGACRAYGARLVRTPGGSPAPGWRRADHARLGTGGAGRGGQPSAIRPGAPVGQRPGQPLLVAGLRRGEPAAWRLAAAPPTAPARPDGAPGPCHQPAGIPQPAQAAAHAGAAPRGAGDEPDGGETSHAVRRGGCA

SEQ ID NO: 24240 - protein, 213 aa, Pseudomonas aeruginosa
PGLARLDRPGPDGAPPAALFPAGGGLPGHPARPPPQGPRASARPAGHGHRRRALPALDRTFRLGRAPGPGDARTEPGAPAAPSTAAGAEPVGRQCPQCADVCPATGPAQGASAGGAPADPGTGRAAPASRGRTGTPQPGPARTGLRSRPAAFRRPLQPDRQPYPSGVGLPQAGRLLPARRRPGRRQAVVHRSGLSHHPQHRSTVDRGTGGNPR

SEQ ID NO: 24241 - protein, 197 aa, Pseudomonas aeruginosa
TALPSRTALAMVAKLSSARTTSAASLAASVPLLPIATPTSARFSAGASLTPSPVIATTSPLACRACTRRSLCSGLARANTSTPGSTSRRRWSSSNSISAPVSAGRSMPIPSMAPIARAVSTWSPVIIFTAIPAAWHSATAATASSRGGSMMPTRASRVKPCSTSAKSSVRCSAGIARRAMASRRRPRAAVSVARRRQ

SEQ ID NO: 24242 - protein, 161 aa, Pseudomonas aeruginosa
PAPLTSITWSAVTIRCTVISLRVRVPVLSEQITVTEPSVSTAGRRLTMALRRAMRCTPRARITVMIAGSPSGIAEAVSATTSMNMSTIGWPCQRVPRTKVAPASSRIARASQRLKLAICRSSGVARVRTSRNSVPIRPSSVSPAVATTTPRAWPLVTRVPE

SEQ ID NO: 24243 - protein, 155 aa, Pseudomonas aeruginosa
AMQRRSPSSASMATATQPFSTGTDSPVRADSSTWKFFVSNSRRSAGTRSPEASSTTSPGTRRSASSAWRWPSRRTRACSESMSRMASSALAALPSWTKPISALTTTARRITALSTQKPSSAVTSEANSIMYSRTLWNCRSKRSSGPWRFGAGNRL

SEQ ID NO: 24244 - protein, 561 aa, Pseudomonas aeruginosa
KKTTGRNSRSSHAFPETTNERHCARLFFPVSPMPNSPLPSGRRLPACAFADIGEPYAVFQAPGGALLAVASAFHGQHPGRQLDVYEQSLRLYRSGDLECIAVLPDLGFPLNAIAWHPSRPVLVIGGGRYDGGAFFEGGLLAWDYASGKTQSLLADNREVLACDFEDDGRRLTFTVAPSDDLEDRPLFRQRHSLAFPVDAPLVLDDLPGTRLPFDWALYPASTQREAALPILENLALGKDRRFLHRPPVWDLCFLDGQRLAIARANPRLELWNLADDSLRSFELAERGQCLQVFHNATDDSLLVNLQLGYAAQRLFKVPLTPGQPLLLSDCRHLLAQSAQGGFLARQIALEGKDLEDLVLDPAGRIIHRRRLGHYDLFNHHLRIDRGEAFFYLAGNPPEQHQDKGLFRLDPQTFKTREVLRLERHPEHFNNLHGCLLGNRLLLNAKVYNSPHHAYGTQRLTCYDLESRGTLWGATLSAQVSAFAPLPGGQWIALALVDGQVEVRDLASGECRWRYRTADAIPLCLAVSDKLLAIGFSHGGVSLLQVAADGQLIGPPGANPRQ

SEQ ID NO: 24245 - protein, 225 aa, Pseudomonas aeruginosa
DGCADRCPRPSPRSAPRSGHRRVSTRLRGYAAPPVRRAPQRLLRWSTARPLPAPCAGDNATPCLRPGSPAAGPPGPGSGAGACAPCARCRPAPPAGGARRRPRRPSLPAHAPARRETAGRPGSPVPARSPRRNARQPAAPHCTSRGRPILRYSTRARPRWGAAGPAPAYATARRESARRGNGWRGERNARSGYVAWDDSWKGPSVPQAEGASSHSQKRHISDEWR

SEQ ID NO: 24246 - protein, 485 aa, Pseudomonas aeruginosa
FVSPIKNNDEFLSFDEKIQSSHPLNSRPSAPKTGMSPSLYPRIFLMFTRKYRQMNADLQQQLAAERLHMAALDRSMARVEFDPDGNITDANENFLTLLGYRRDEILGKPHRQLCDGAYAQSEDYRRFWERLRRGEHFSGRCKRITREGRPLWLEATYNPVRDGQGRLLKVVKYASDIDAIVHQEHEMQSKLDALSRSMAMIEFDLDGNVLAANDNFLATMGYGRAELASANHRQFCEPGYRDGPQYADLWRRLNRGEYVTGQFRRVHRNGQPVWLEASYNPVYDADGKLYKVVKFASDVSDRMRRYQAEADNAHQAHTLSTETRTVAEHGALIIQSAVEEMLKIANTLDASSLNIGELSQHSQQITSIVNTIREIAEQTNLLALNAAIEAARAGDQGRGFAVVADEVRQLAERTSKSTKEIADMIGRIQTGTRSVIDDMQHSQEQARRGVELANEAGAAILGIRESTHKVVEAVQQFSRTLNADL

SEQ ID NO: 24247 - protein, 325 aa, Pseudomonas aeruginosa
GSGQAHLRPQLVAEGLDQRLARAAATEDQGEWRLVAEGRRQQGAQAPLLDPRVSVVLRQVTDVAAGKDQDQLRLHALHRSRAVLESVPGQLGLAPVAAADHALLGDQIGGNSPPVEQRMPVAAVQPVLFAVQRLVDQSVHATGKGADSQVLAVLQHAQLQFVGALHQQVQVNRRVFAAEGADHLGQRQRRVAHRGIEHAEVQGAAQLALQRQRVAFEAFQFAEDAQGFLVEQLALAGQAEATAATVAEHDAELVLQLAHVGADRRGRQVQLLLGGGEALVAHHRGEDAQQAQVGQGVGHGDSGLRARISDSRPRQRPPSGLGGEV

SEQ ID NO: 24248 - protein, 520 aa, Pseudomonas aeruginosa
PTRNHTHRNLRGRTDSRPRTQRHAGRSVPHDLRRRQYLRHRRARQLSGALRAVLPGRAVGDPAGRHAGRADPRPDGPVRPAQRHQQRGLLRRALRRARAHRRLLPLAADRHRLLLALGVEFRRCPGRRRPAPGRPGRERTEPGPGLRPVRRAGADRMHLRLPLHAAGQQDRRVGRQPAVPARPVRLRRPLRRRLRRQRATRPAGLLGRLHRRHPAGHEQPDLLRRLPGRLGPLHPAPDLAGTDHAGGDRRAAGDPGSLPVRPRHRDHRRRPRAGLHRCQQLRRRPAGHRSRLVLPAGMPDRGDRRHVHRHHFAVRHRAGHVQRVPAPALAGAGHGADRGRLDRLHLRRPLRLQPGAERLYLRRADRHLHHPVDGDHADRPADPSRLLPPGRPAGVHPRPARRRLLVRARLELARNGCLDSQRGSRPGLRQPAGAIRRSARRTGRRHRPQPAGRPRPGRPALPGTAAPVPGTALRLWPARTALGARARHAEGTGDSHRLRWGTHTAGRQRPALPAPRRIQQ

SEQ ID NO: 24249 - protein, 484 aa, Pseudomonas aeruginosa
  UNSURE (202): Identity of amino acid at the above locations are unknown.
YGPRHIRRSDLRRGHDRAGLVRHAPRQDPRRLPGGRPQPRPRLLPGNHGRHRPRRRLHHRHRAPGLRPWHLRLLAVRRDRPRHRRPQPVPGQAAAEAEDLHRHPGPGASLQPRRAPRQRPDHAGLRTDDRRHLDHRHRHRHAGPVRPAVLGLDPDRRRRRGALLHHRRHVVADPDRHRAVPDHDRRPGVPADAAVDQRRRRXGRPGSQAAGQLLRLHRDRLGHHRHLLPDLLLRHLHRPGHLAAGVHRPQRDRGQGRRLRRRYLLRALRHGRGADRDGRQGPAAGPGERQQRLRQCGRAQPAERHPRPGHRRRPGGADVHRQRRPAGGVHHRHPGPAAAPAPRPRPVRQRRRAREPHRDPAAGPGSARHRPGGQRRDQRPDRGLQPAGRRHADPADRRDLLEARHHRRRHHQHDPGLPYRTGVHDQGRPRRQYADLLQPGGRPAQLRPGQPVLAAPDGCRQRRLNQAQPRQARDFPSPFPFPRT

SEQ ID NO: 24250 - protein, 508 aa, Pseudomonas aeruginosa
ATSAPSGHTLMSAGELLAVLARAFAVFDSERPRPVHIELPLDVITAPAEHLALRPRTLASRPAPALAPLREAAARLRNAKKPLLLLGGGCVEAAAEARALAAALDAPTALTINAKGLLPADHPLLLGSNQSCVPVRELAAEADVVLAIGTELGETDYDVVFDGGFALDGELIRIDIDPQQLMRNYTPSLAIHSDARLAMRVLLAELPGGEASPDSPGARRAAAVRQRLAEDFAGWSHYRQLFAAILAEWPDARFVGDSTQTVYSGNHLVDLDEPRRWFNASTGYGTLGYGLPAAIGAKLGEPGTPGGQPDGRWRPAVHPAGTGQRGGSQGRHRRAAVEQPRLWRDQALHGAARDHSARGRYIHPGLPRHRPRLRLRRRTRARSRTPARTDARRPGGPSADRRGAASRALPSLTRSPPWTIPNSTAPSARSSAPVACATVPRSPGRTPATIRRTSPEASWSCRKAPTRSPPWCVCAARRDAPWYPRADSPAWSAAAPRKPATCCSRCAG

SEQ ID NO: 24251 - protein, 183 aa, Pseudomonas aeruginosa
RTPPATTSSSCSSAPKAPSASSPVRYCAWSRCSVPAPPPCSACPTSTRRSPSPRACAASTPNACSPARSSGTTTCNAPPHPWATARRAWRPALSTCWWNWPRTATWMPARRSPPCWKTASRTGWWKTPCSPPTKPSAWPSGACAKTPTRPSTPASTACPSTYRSRCRPWPATSSASGGAWTTW

SEQ ID NO: 24252 - protein, 597 aa, Pseudomonas aeruginosa
PAPCAPRTSAGPPDRRSPAGRPPARHPGARPAATRPARRWARSAIAGSPPDSAGGIPPGAAAGGSPRCCTSSRGRSRPPVRPPAPPRAPPPAGRTAARRSPAGPCRPATVAGAGVRGGTGRRQAVPPVAAGASTGSTAPGAGVRRRGRWSLPRRPPGKSSTGRTPRLILQNRTSNSRLFIFTELPQDLTCCHSSPGRNPHMSRDFLRSPLVGLLACLLALVVAMGVGRFSLTPQLPHLIREGQLDLTGAGLLAAANYLGYLVGALDALFAREARQARLRLLVGLWACFGLTLASVWAEGFWPHALLRFGLGVASAWVLIMVTALSQRLAAESGRARLGALVFAGPGIGVMVTGLLAALGNALGQDSVFIWKLFADLALVLILMLLPLLPRPAARSAGHDAPATASENAGLGRLTWAYGLVGLGYIIPATFLSQMAAARFHGQWQADLFWPCFGLASATGVVLISLRRQRPDGTRRWLVGALWLQALGVLACLLPGIGGLALGVVLTGLPFLAGMQLVMQYARELAPHTPQRNAGQLTTGFALGQLLGPLLAALSTHFAGGLQPALALAGLGLVFAGLLLRRPHSLSVAAGVAATARR

SEQ ID NO: 24253 - protein, 210 aa, Pseudomonas aeruginosa
TLSMERPRRFLVLGGGILPSARSRQNGGGGQKGIDMAKIHVPLAPPGDYRRGELLGARAGPYCLSQSGSKGGFDEARQPAYVALPVRHGPGPAPEPGQRGLGRQAGSAGGRRPGSAGRPGRGRQPRPAQRATRPDPPARHRRRQRRPPRRVAPERAASPAPGRRPARAAGGRHRAARRSVESDRPAAARRGGKPRRPAPGPDPAEERPAR

SEQ ID NO: 24254 - protein, 955 aa, Pseudomonas aeruginosa
RTPGHPARPVVPRPGGTDRQPAPQPVQLADQQPRGDTVQPELLVDPDPSHRRRPAPAGQAEGGGPGRLRQRHRARTPLGLRRNPAGHRAGLELRPPPAGAHAYLGDDPLAAGRPPAAQRPGPGGRAGDHPDHRRRGVADALGPGKQRQPEPRHGQPDRSTGEPGDLLRLHRRPRPRPADAAATILAAAGDPGQDRQRPRPVPGDPRGGADAGGHRGTDQQRHRHQPGPDRRPQRPDRAGHRADLRRRPAALPPCAAQARPGAARRDRRADPLRRLGMDRSDPPRPVHRLPVAGLLPHRQAAVDQRDRGHHLPADRFLRRHLRNPALAQASQRPGAGQCARPVAAPPGPGQHGAGRGRPHPAAAHRAAAGLPSGRLEPQRTAAGLRPTGRKQQDPGQPEHRPAGHPGRPAAVRRRPVRPAHRQALAERAVAAGNQHGRRHARLAGDPGRLPRLRAPGDAGDVHPAHQPDQPDLGGQRPLGRHRLRPAGHRAELHFRPDPADRAAGESLRLGQPGRGRGRYPADQRARHRDPDGRPLHGDRAELAVHLPDRAQRDHGQCPRGGRGEPDPAAGHRRDEGPRTALAGLRRTPGDPRRAGALGDVQGSRQQRPGAQRQRLRQQPAFGGRRAQRPALHHPRPLAQRRHRAVLAAEPADDPGWRPGQRRACARDARLKRRGGLSVTQRVESAPFSTPNRHESRSPRYPPPAPARRAVPGAGGDPPSVPWSRPLLAGPGTIDRGLAAGRPAGDSVQGAAAGGTGGLASDPGATDHGAGLGCEPGPAPGPAAPLPPRQRLRMAVGRAAGNLGHRGKRTALPPRPGTQPEHRAIPRHAPGPPLGAGAGRRPPRAQPVRLHLRLLGGGHCRRRQPGGQPGHGPRPAQPRPRQSPPERPRPRPGELPRPRTVQVLGQAAQARPVRPGDRRSAELPERQLRPDPGLPQDPPPPAGTAGARRHPAGLYQ

SEQ ID NO: 24255 - protein, 254 aa, Pseudomonas aeruginosa
AVGMDMPDGFIPLPPRVEPQAAFRPLLDDLRRTLARPPFERAVHSVYLYGSVARGEAITGRSDLDLTLVLRDPPSPELAAQLETARLALQARHPEVSKIDFDIGHLDQARDPANRDSWGYWLKHRCRCLWGEDLASDLPPLRPAKAIALALNGDYAQVLEDYARRLESASSEEERRLQREAAKKLIRSSDILRGETESVWPETLEHYLALFRARHPGQAPALEYFKAVLDGQVTDPAVFIERLRAFSAWMQRQA

SEQ ID NO: 24256 - protein, 126 aa, Pseudomonas aeruginosa
TAPAAPSAAAARPLPAPPAAAVPAACGSWRGTPGFARNTAGRPASAGAAGPDAGVRRQGGCPARRRGRGRPVVRTSADCRAPRGPGCRAPNGKCARTAAPGPRRTGTASARAAAAIVRATAHRRRW

SEQ ID NO: 24257 - protein, 121 aa, Pseudomonas aeruginosa
IISVFRPRPTVGRGPPIAPGQPLRDRAGLPFGPCRPANSAKTRSLPMSDWAITYSKDEATERQVLPFPHKPSPEEVAEHLLEWAEANLKPGHYSTGKLESDEPAELLLRRFGIVVTGIAEA

SEQ ID NO: 24258 - protein, 213 aa, Pseudomonas aeruginosa
PGALQRRADRTRRLPADARRRLPGNPRPALRDRTPARRSSGRRLPPALRLHTQRPAVRHPGQRPAGTLRRERLLRIRRRAHRRRLVGDRQGGGRRAGSGDAAVVLRRQGTAGRPSTRYPRTAACAPPSAPVLRRRPGRAGARRGSPPGRSPRRSPGSWPCSAPCRCGRPCPPCHGTAPRAAGSLPRPPAPWRSPAAPRLPGPWRRTRRWARRR

SEQ ID NO: 24259 - protein, 252 aa, Pseudomonas aeruginosa
  UNSURE (133): Identity of amino acid at the above locations are unknown.
RPRRPAPQHESLPDVRPSARRADLPTEHAGATGAAGAPGDPRPPAPGRATHRDTLQQPALGGPEGGTGRRTHRPRHRDRPAHRRRPAPPAPARRQPVRDGRAGLRRRPECGGVPGGGPCRGDLAATRHLHRRXGPRPPRPDPPGAPALPALPVGGVAGGPGRLPADPDPRLRRPDQPRPGQPPAADAAGPASGDSESLLVAPGRRRSRQPLAARRTGGAGDAPALSAGAATRASPPWRGPSAATARPSPNTP

SEQ ID NO: 24260 - protein, 164 aa, Pseudomonas aeruginosa
PPVPSFPSTRTSCWSARARPPRKRCRRTRRNRACWPRPATTCASRSTPSACSPPACATPAWATRNGAWWTTSTARCSTSRNCSAPSSISTPSTTAGSSPSRRTSTWASCCATWSGATLKRRAGPGWNCACALAACGREPIRGCCRPCCRTCSPTASSTPPSARC

SEQ ID NO: 24261 - protein, 163 aa, Pseudomonas aeruginosa
SRPCCPTCVGAAAVISSMGGYITMPGIAYYCGSKFALEGGFRSLGQGGGRPRHRRHRGGPRLLPHRLGRPFDGPQPAHHRRLRRALRPGPPGSPGKERQATGRPAQGRARHAPGHRRGKPAGAPAAGQRCTGAGAAEAEGAGGGNRGVGRGHAVDGWMRFGKS

SEQ ID NO: 24262 - protein, 264 aa, Pseudomonas aeruginosa
GLPRGVRCSVRGGSSAIRRSLRSSLGCLATQHKRLRRARPAGRRSRFPCRAALAKLDLRTTKGRQHGPERPSQRNRRPHPARFRRLPRAVPRDHRRRPCPLRAGAVAGSAARLGAADQPLRGKGRRDRWPGCARGWPTASCWTWSAGRSSRAPTSRRSTCGWTTSWPRPGSTRSSAGCSATTTSATARCSCTPPGPRCAPTPARPTPAPTGRAATCARRWRRSSTTTASTCPTTTASATSNGSTHCCTATCRTGCARTRTWPSS

SEQ ID NO: 24263 - protein, 420 aa, Pseudomonas aeruginosa
STCFPIGGRRRLSSCSGRCGDRNRPSRTLLDQLRPQRPHHPLQLRPSTGGDAQAGDLAARRVVFAQGVEGGAAGGAVAGQAAAEGGIVAARVVYRAAQRGQRPGRVAAGVELQAGEPGFRQHVLQAHTFGDAAPGAVGLVDLRGAAQLAFQAVAGDVRGGDQAVRGQLGVGLRFAFPDVQRHFQVGAAFEQAAQGLIVDHRATAGVDQPGAGTQGGQAGFIQQVAGRVFAVAVQRSVQADHVGLGQQPFQRDEFAVRLACLARRIADQHFPAQPAQHLHQPPTDLPSADHPIGAFGQVGAAHLGHRQQAAEHVVHHPAGVAAGRAGPGDAGLGEVVEVEVVGADGAGADEAHRRAGQRGAADLGDRAHQQHVDLGQRRAVDGAPGQAANGALVGEEGVDHGNVFIGENTHADLRERGCTL

SEQ ID NO: 24264 - protein, 448 aa, Pseudomonas aeruginosa
LRPLTAIPTEQKDSDPHEQTYRRHRHGRGQPAGLRSRTHMATPAGRAIGHRHAPGGADRRPAHQHRRPGPRPCPGPAGRLRSRPAAGRQGTTQDGPLHPLRPGRRARGPGPGRLGAAERRGAGAHGDRHRLRGGRLPCHRRSGADHRRQGTAAPVALHHPVLSLQHGGRPCVDPPWLQGTAGRPGDRLRGGRAGIGDAARMIRAGEVDVALCGGAEATVHRVSLAGFAAARALSSDFNDSPERASRPFDQARDGFVMGEGAGLLVIEELEHALARGARPIAELVGYGTSADAYHMTAGPEDGSGARRAMQQALRQAGVEAAAVQHLNAHATSTQVGDKGELAAIKAVFGAGSGLAISATKSATGHLLGAAGGIEAIFTVLALRDQLAPATLNLETPDTDAEGLDLVRGEARRWPMEHALSNGFGFGGVNASCCSGAGCRVGDPSASRS

SEQ ID NO: 24265 - protein, 143 aa, Pseudomonas aeruginosa
RMKTYTAKPETVQRDWFVVDAAGQTLGRLATEIARRLRGKHKPEYTPHVDTGDYIVVINAEQVRVTGAKTTDKMYYHHSGFPGGIKSINFEKLIAKAPERVIETAVKGMLPKNPLGRDMYRKLKVYKGASHPHTAQQPQELKI

SEQ ID NO: 24266 - protein, 97 aa, Pseudomonas aeruginosa
LAMPVKSSVRKSVCVKRVSVRSTPSVNSTLAEKRPPLRSWAFFYVYALTLRQGVAWPKGAPYKGFGRFVSGYYLVIKGGFLYHLANFLRGSNFYLKA

SEQ ID NO: 24267 - protein, 445 aa, Pseudomonas aeruginosa
HQEEEGRERRTAGRHRVPSVLHREGHRRRGGVPVHLLHRDLLLPGNGRLLPREAQLRDGQPVQDPRAHRSGLVLHPVLRDPPRGSGQADGRGGDGCGDRCAVRPAVAGSQPGSLDPLQGLAEQAVAGDLRGVLRDPRLLRRPGSEPAGYYPVARLHRPVFRLLHPDAVLHPDGEDQTGSGKGDWLMKKQFAALILAVLPVLGFAAGGHGPQLDHVDIDLTDKAAMQDGARTFANYCMGCHSAKFQRYERVATDLGIPADLMMEKLVFTGAKIGDHMDIGMKPADAKTWFGAAPPDLTLVARVRGTDWLYSYLRSFYEDPKRPWGVNNVIFPNVGMPNVLAPLQGRQVIGCKQVQVVEDGKKQFDPLTGTPLTHEACDQLTVVPKTGELNEAQFDEKVKNLVTFLAYSANPNKLASERIGTYVLLYLAFFFVFAYLLKREYWKDVH

SEQ ID NO: 24268 - protein, 144 aa, Pseudomonas aeruginosa
TRYALRNMKMNSSRPYLVRALYEWIVDNDCTPHILVNAEFAGVKVPPGYASDGQIVLNVSPSAVRHLHMDNEAVSFEGRFGGVAQSLYIPALAVMAIYARENGQGMVFDLEQPGPVDDEPGDDDGGPSDEPPRPSGRPSLKVVK

SEQ ID NO: 24269 - protein, 204 aa, Pseudomonas aeruginosa
IQSSRGGDCPSLVSTVTTSKRQGHLAQRASCCRKSSAERIRRCRLRASMLSRAPPQARCRRERTSTNTTVSPSSMTRSSSPRRQVQFLPSVARPCRRRWAQASSSAWRPLSRELSLSVKSCWSPAAGPGHCGTRPIATGVRYVGSDSGSGYRSGRRSAGSARPSVQADAERGGRRRRPWRRGGPCCRWPGAIGRRPAGGSGRWG

SEQ ID NO: 24270 - protein, 321 aa, Pseudomonas aeruginosa
LPRYFRVSRHSVRNGDPDRQSRRHQPARPAGAAGGGPGGCGGYPPFDPAVPALRHRDAIGGLPRAQRARGGRALHLPAAGWGRRRADLGRRYPADFRSRLPPGAPGTGAGYPGGPGAGLLRADRGAVGGGIAVGPVHLRRFPARQGCGTTQPPPGGTGRAAHADFLRGAPSSAGKPGGHARRVRRGAPCGAGAGAEQDLRDHSQPAVGRTARLGRVGQQPAARRVRCAGGGVAGAGRRGVDRCGGAQGARPAACRAAVEESRGAGGGNYRGAKKPFVSTGFATPREELSLFFAPAPANLSAESRLDSRCRAIARWRKVRAP

SEQ ID NO: 24271 - protein, 184 aa, Pseudomonas aeruginosa
RRARIAGRRRPAGGDQFPFPGRPHRQAVHAQARQGRGGQPAARPADPFQGLRAAPEAAGQAAVRFGRRTQGQPALAQRGHARGGEAEMSRLFVKRLPTGSFLMLLLYIGLLLSAIAVAYSTYWNRQLLNSLYSELSVRDKAQAEWGRLILEQSTWTAHSRIESLAVEQLRMRVPDPAEVRMVAP

SEQ ID NO: 24272 - protein, 504 aa, Pseudomonas aeruginosa
SLPLRWMTWCSWLARVTRIIRRSTAYAIRSPTSSRPSAPWPPGRCRMLEPLRLSQLTVALDARLIGEDAVFSAVSTDSRAIGPGQLFIALSGPRFDGHDYLAEVAAKGAVAALVEREVADAPLPQLLVRDTRAALGRLGALNRRKFTGPLAAMTGSSGKTTVKEMLASILCTQAGDAESVLATRGNLNNDLGVPLTLLQLAPQHRSAVIELGASRIGEIAYTVELTRPHVAIITNAGTAHVGEFGGPEKIVEAKGEILEGLAADGTAVLNLDDKAFDTWKARASGRPLLTFSLDRPQADFRAADLQRDARGCMGFRLQGVAGEAQVQLNLLGRHNVANALAAAAAAHALGVPLDGIVAGLQALQPVKGRAVAQLTASGLRVIDDSYNANPASMLAAIDILSGFSGRTVLVLGDMGELGSWAEQAHREVGAYAAGKVSALYAVGPLMAHAVQAFGATGRHFADQASLIGALATEQPTTTILIKGSRSAAMDKVVAALCGSSEESH

SEQ ID NO: 24273 - protein, 456 aa, Pseudomonas aeruginosa
SCVEDEESMSLIASDHFRIVVGLGKSGMSLVRYLARRGLPFAVVDTRENPPELATLRAQYPQVEVRCGELDAEFLCSARELYVSPGLSLRTPALVQAAAKGVRISGDIDLFAREAKAPIVAITGSNAKSTVTTLVGEMAVAADKRVAVGGNLGTPALDLLADDIELYVLELSSFQLETCDRLNAEVATVLNVSEDHMDRYDGMADYHLAKHRIFRGARQVVVNRADALTRPLIADTVPCWSFGLNKPDFKAFGLIEEDGQKWLAFQFDKLLPVGELKIRGAHNYSNALAALALGHAVGLPFDAMLGALKAFSGLAHRCQWVRERQGVSYYDDSKATNVGAALAAIEGLGADIDGKLVLLAGGDGKGADFHDLREPVARFCRAVVLLGRDAGLIAQALGNAVPLVRVATLDEAVRQAAELAREGDAVLLSPACASLDMFKNFEERGRLFAKAVEELA

SEQ ID NO: 24274 - protein, 386 aa, Pseudomonas aeruginosa
AGTASTWTSRCWRVAWRCSASALVMVTSASSEVAAAQSGNPLYFSVRHLIYLVIGLISCGLTMMVPMATWQRWGWKLLLVAFGLLVLVITPGIGREVNGSMRWIGFGLFNIQPSEIAKVCVVIFMAGYLIRRQQEVRESWMGFFKPFVVLLPMAGLLLREPDFGATVVMMGAAAAMLFLGGVGLFRFGLMVLLAVGAVVLLIQTQPYRMARLTNFTDPWADQFGAGYQLSQALIAFGRGGWLGMGLGNSIQKQFYLPEAHTDFVFAVLAEELGIVGALATVALFVFVSLRALYIGIWAEQAKQFFSAYVAYGLAFLWIGQFLINIGVNVGLLPTKGLTLPFLSYGGSSLVICCACLGMLLRIEWERRTHLGSEEYEFNEEDFADER

SEQ ID NO: 24275 - protein, 107 aa, Pseudomonas aeruginosa
PGTQGRPAVAPDSGQRAARQGPEVAGQGAAGTAQVAVPGAAGDPPAEAGLRARPGWLCHRPGRPGCAPQRRAAGDPRAERRGRHRQPQPGADRQARLRGIPGYLPGQ

SEQ ID NO: 24276 - protein, 180 aa, Pseudomonas aeruginosa
HRTNRRHKSDRCRWWWRQRRQSHGQEQRRGRRVHLRQHRRTSAEEHRGAHRSATRPGRHQGAGCRRQSGSRSSGGSGRSRAHFRSAGRRRHGLHHHRHGWRHRYRRRADHRRSGEGNGHPHRRGGDPPVPVRRSQAHADRRRGHPRAGRERRFADHHPEREAADHPRQGRQPAGRLCQGR

SEQ ID NO: 24277 - protein, 152 aa, Pseudomonas aeruginosa
SSPPDCKSRKLPRSSSASSAKSAWKRATSAPSSFRSTASRSASRSISIIRSSVVAPSRPRSISPVLPSSRRSAAPVPSGSCATSSTCVRRTWHSAVAWRTRSWSTRTACSTKTACVTRTSSSSTRSWMPSATCICSATVLSASSVASSPAMP

SEQ ID NO: 24278 - protein, 375 aa, Pseudomonas aeruginosa
STTCAIPCCRQRTWARPSRNSARKPSAPPSTSTFRRSRCPSSGTSKAWRLRCTATSPCACRSSSGWTKTTSCTRKPCVARSSSRSSPPTTRRKSWPAPKPCAPSRSRCCCGCWTTCGRTTCRPWTTCGTASTCVATRRRIRSRNTSASPSPCSRSCWTRSSATPSACCPTSRSVAKTRPKRRPACVARRRNWPSACSSSTPRLPRWSRPWPARKKSFPRARLRSCRSSLCATSRRSAATSLARAVPARNTSTATGSWTKLPAWFTNAATGPAARGVCSNWRQPGADAFSVTPSRTASSPLFGKGARSHGCRSWPPVHPAPGPRFRTRHRFRRHQATGAQRRGGHALRRRLQRGRGVHPERVLCRAGDPGQTAFPR

SEQ ID NO: 24279 - protein, 316 aa, Pseudomonas aeruginosa
SVKRVHVAAAVIRGSDGRVLIARRPEDKHQGGLWEFPGGKVEDGEPVRAALARELEEELGIRVERARPLIQVRHDYADKHVLLDVWEVDGFSGEAHGAEGQPLAWVEPRELADYEFPAANAPIVQAARLPAHYLITPDGLEPGELISGVRKAVEAGIRLIQLRAPNMFSPEYRDLAIDIQGLCAGKAQLMLKGPLEWLGDFPAAGWHLTSAQLRKYASAGRPFPEGRLLAASCHDAEELALAASMGVEFVTLSPVQPTESHPGEPALGWDKAAELIAGFNQPVYLLGGLGPQQAEQAWEHGAQGVAGIRAFWPGGL

SEQ ID NO: 24280 - protein, 174 aa, Pseudomonas aeruginosa
NSSAGPARRSSGRCSFPGVPLPSRPGPDTPASPAPRRGRTGGVAPAPAPGRSPPGRDVRHALPAARQGAGPTGCSIRPPRRSPRCVDGSWAPGVRRPGRSRRGRRYGCRSSTIDCPWIQPSSSSPRRRLLPGCGRAGGRALACAGATASELSSGRRMLKQVPRPSSERTSIWPL

SEQ ID NO: 24281 - protein, 176 aa, Pseudomonas aeruginosa
LLVMMKYETDRPRPVPWPTSLVVKNGSKIRLRTSSGMPLPLSSTWTSAQGGVRRVRRTIRPCSPSSSSSRWWMAWAAFFSRLSRTCSTSLAITGTGPRLGSNSWTICNDLKSKPSARSKSLPAISTACSSSAGSSQAVICRWLRRLKASMWVTIFAAREPACWMPSSRRGMSRPSR

SEQ ID NO: 24282 - protein, 147 aa, Pseudomonas aeruginosa
TGSGCAAGGRRPPAGCPGRSAATAVRRCRPGDGPRWRRLPPRRRPCRPAAGAGWVARRPGFPRRSGRGWPGRLPPGSVRRPVGSGAGAGGRAGSGGRAGRRARGARPRGCRGYRRRGYARSWWLLRMADDRAKSSAVPVAGRLRSCR

SEQ ID NO: 24283 - protein, 279 aa, Pseudomonas aeruginosa
CMELNYDRLVQQTESWLPIVLEYSGKVALALLTLAIGWWLINTLTGRVGGLLARRSVDRTLQGFVGSLVSIVLKILLVVSVASMIGIQTTSFVAAIGAAGLAIGLALQGSLANFAGGVLILLFRPFKVGDWIEAQGVAGTVDSILIFHTVLRSGDNKRIIVPNGALSNGTVTNYSAEPLRKVIFDVGIDYDADLKNAQNILLAMADDPRVLKDPAPVAVVSNLGESAITLSLRVWVKNADYWDVMFMFNEKARDALGKEGIGIPFPQRVVKVVQGAMAD

SEQ ID NO: 24284 - protein, 145 aa, Pseudomonas aeruginosa
RSPQGPCHKGRLSYAARASSRNPATPASTKPAGLRSGRWKPLFGRVTTMKLRPLHDRVVIRRSEEETKTAGGIVLPGSAAEKPNRGEVVAVGTGRVLDNGEVRALAVKVGDKVVFGPYSGSNAIKVDGEELLVMGESEILAVLED

SEQ ID NO: 24285 - protein, 122 aa, Pseudomonas aeruginosa
TGCWANSAAGGPTMQGYQLTFITQQGRRHQGQPICDWLLEEARRLGVRGATALAASEGFGQSGRLHSMHFFELADQPQEILMAVDPEQSERLFESIRQAGVRLFYMKVPIEFGVLGADESSS

SEQ ID NO: 24286 - protein, 450 aa, Pseudomonas aeruginosa
STSHSPWPCCIRCMASATAWRRSRMEYKQSLARRIVIAFMLMTVAVGGLFSAGIVGVVHIIEERLISRDLGGELERILRDDLAQGRNPVLDPGMRFFISDGQGSYAMPPALDQLDVGFHEVFEGDLSFHALVRDIDGRRFVLLQDQSDFEAREQVLYASVLTGYVLSIALAGLLGWMLARKVMEPVVRLARQVRHREQLLGLAPPLAPDYANDEVGELAASFDETLGRLRDALKREQLFTSDVSHELRTPLMVIATSCELLAEEPSLGPRARGQLERMTKATEEMRDLVQTFLLLARAQKGEESLAPHGSLESIADDLVQVWREQVEARGLTLHYRNEGACAGQFNAPLLRAVMGNLLRNATHYTDAGSITLTLDEHGFSVEDTGAGVPEEQRERIFMPFVRGSSSSGRGEGLGLGLSLVKRICAAEGWSVTLSAVEPHGCRFEVLLDVA

SEQ ID NO: 24287 - protein, 294 aa, Pseudomonas aeruginosa
AHGGTAGSERGTDRLPEPLRVTSRNGRARVPRRRLRRPEASRFHPAVSHVAGLYLAKGITMAPDLASLQRISGDSAIDQWLQVPGSWVEEPNERRGGASGVQRVYTGDGRLLYRKQQTGHVYRDWQRPFGYPTAMRERDALRAFESLGIRVPRLIYSGCRKVDGQWQALLVTEALEGFSSLDECYARGDQDRWGEAKHQRILQQIGATIARMNLAHWQHGCLYPKHIFVRVEGEAIEVALIDLEKSRRRLTVNKASQHDLKQLKRRSSWTGAQWQAFIYGYQTAFGSAIKGLQT

SEQ ID NO: 24288 - protein, 840 aa, Pseudomonas aeruginosa
DRRRHGPNKDQASCATLPRRARLALGDLEHVLEVVDEVRVPALRLAGRIGDLRHRMAVAGAHLHHDVHRLDARQVAGEMRAYAEADVDPALQRAIDLQGPWQVEAVGEHQGLGQRVDAQLEVVGDGLFRPQQRVARVVAEAVEELGEIEVEVAQEGIGGDAVGQRDAEQPTVFADPAVQRGTLAVDQARTELLVGHQPFVGHGAEGLEVELACQVDVAGADEAARKVLLQTAHHRLVDPIGEAAAGTEVGHLEAGQFLGAGLPAQPIELFLQAFARLLDGGGRVAGAVAHLADHRQQRHFEEDHVQPGTFQAQEEFVVLDAGLHVARVEAEQPEEADEVRRQEGNPFEEGQLLVADRQARQVFQLFADGRQVQAPGLPGCGSGTPTPPRRWDSCAAPPASWSACRSRYPAGSARYVRKKRSRPCSSHHCVSAGNLLEAAAGGHRIAPGGLWDGATAPADSAVVAVRRFRSVCVCRLRHAWRGIRPGHQGVDARQDEQGEEGAHRHAGRDHDADVEATDRPGAGGEDQRDHPEHHRRGGHQYWPQADRGGLLDGLATPQPLFVAQLVGELDDQDAVFADQADQCHQADLGIDVQARHAEEQRYQRTADRQRHGDHDHQRIAEAFELCGEDQEDDRQGQSEGDQQCAAFLHVLPGSAGVVDGEATRGFLAGDLLNRLDGLAHADDGEAGDDRRVELLELVQLPWPCPFVGLDQGREGDQLAVAALHVVAAEPAGIVAIGAFDLGDDLVAAPVDGEAVDLALAEQAGQRHPQVLHGDAHLRGLLAVDVDHQLGFVERQVEIEEGELAGLAGALLHPLRHLQQRLVVVGGVEHELEWQTLAGAR

SEQ ID NO: 24289 - protein, 742 aa, Pseudomonas aeruginosa
RRQVEGEDLHAGNLVELRLHRMEQFHLALFAFVPGLEQHAADAGLDAVVAVDLERRVILREAAEDTFELGGVAIQVVEVGGLRRVGHEEHDALVLFRRQLLLGEHQQYRDQRQYQHGEHQDHRTGVQGAVEGALVALLQALEDQVEAMRQARGILLVAQQARAHHRRQGQGDDPGNDHRAGQGEGELLEQGASEAGEEADRRVDRGEGDGHADHRYGDLPRALQGSLEGRLALLDVAVDVFHHHDRVVHHQADGQDHRQQGQQVDRVAHGLHEEQYADHRQRNGHHRDQYRTERAEEQEHHHDDDQHRLAEGLHHFIDGGLNEARGVVGDGHLEVGRQLLFQFGHLRPHFLDHVQRVGAGRALDADVDRGNPIERTDRVVAGGAQFDPCDITHQHPAVAVGLHRDGGEGLGRLEVGGSIDAGDHQLALHLAGGGEEVVLLHRLVDLAGGDAERGHLHRVQPQAHGEHLVAEDLRLGDTGQGRQLGLDHPRQVVGDLRVVHLLAVEADVHQRRGVRGLLLQHRVLGVRRQLALHFVGLGQQLGDQAIGIGADPRVDGDGRIVLPAHRGHVVDAFGAGQALLQRLGDVALDGFRVGSGVERGHRDQRVLHLRILADHQLAEGLHAEQDDQQADHARQDRTTDERIGKSHVSVPWQAFRHGVGRRATQCSCWRSRSATMATAAPLSSFSCPEVTTCSPPSRPSSTTARPSRRSPILTKRRSTTCCGWPLSSFDTWPCSSFFCPTT

SEQ ID NO: 24290 - protein, 453 aa, Pseudomonas aeruginosa
PARIATTAITAASMINMRRSNIILVPGMPRAPRFGANPTHYVQLSGLVKAQDWRKISSVLQVASDFRGPVWREVDAALSGQVQVVVPEAGRQLQRLRGDALALAVVEAATALSGRDDEAVLHRAHAGAVRQRRVEAYGTAVQVPDEETVAARGGQGHQAQVVVDRHAGGVLGHRQALLLGHREGFEGTAGALDRQQVGMFVGIAHELLAGDDGAVATDRQVADAVHLLRQGFLGQQVAVAAHQHQAGLHGVEVHLDPAFRLGTNAAVGHYQGLAVGHPGNLVRPEAVGGDLAAVLQSLAVETVDAEHAATGIGSVVLGGVEPLAALVEHAVAVEVAVFLRDQGLQQATVVQVDQVAFGAWPAGDEQRQRQARVLDDVVAALGHAGGELALAVQAVAHRVMLAIGVVARRQHQRLATQAAEAPAAEGQGAEQQAAQADHMTSQHGADLSRHRWR

SEQ ID NO: 24291 - protein, 162 aa, Pseudomonas aeruginosa
ACRRRSSSAPGCPGPVAAGGCRWLPATGNSGPWWRRRRGRSCCRRGCIRRRRAPAPPRWPWPGPRRRPAGCSSATVRPGARPGPSCPARTAPARRGCPRPAGRSAAVAARPRPSARRGTRRGPWPGLPCPGSRPGRCWPGPGRPPPSGCRSAGSPVAPGRHW

SEQ ID NO: 24292 - protein, 212 aa, Pseudomonas aeruginosa
SPSCLDMSGAARMPASSSGAPSMSLTAIAFWVVLLLLAGYAVVLYNGLVRLKHAVGKAWANIDVLLKQRHDELPKLVEACKQYMQHERATLERVIAARNAVASARERADVNALGKAEGGLRAGLGQLFALAENYPQLKANESFQFLSQRISGLENGIADRRELYNEAVNLNNVRIEQFPDLLIARVAGFKAAELLQFSEAEKADVDLKALFG

SEQ ID NO: 24293 - protein, 94 aa, Pseudomonas aeruginosa
RCVPGRGSGRSASASAGPAAAWISPPASARRDGRCSPGAPPRAGTGLRGPASPFPGRGCRPPGWKGRGPSRGCVGRRCSPPAWPCRRRRRSARN

SEQ ID NO: 24294 - protein, 239 aa, Pseudomonas aeruginosa
RRCPGAPAHRCSTPIAWRPGGPPRWAISAPSGGCCWTLWWRTRRSGSSACARAKWPAASAVARGRWPARVRCCSEPCVIAAWPARISLPGTFPAGSRRPPWPACRRSCSARTTCCNTAFSRTSASRAVSSTTSARPRKVSSASPPAVSAGAWCRSARCKASWRAVNWSSCCPARSSTYRCTGTTGATAANCSRRSPSTCSPAPATAWCGCQADQPMTVIRPEPGNDSTQRAPSNRDGVK

SEQ ID NO: 24295 - protein, 263 aa, Pseudomonas aeruginosa
PPMLPTVMNSATTRGTFTNRSSAGSSTPRSAVRPLPAPFWALLGAMLIALAGVGWWSHQQISLMEQQLVATQESFVRISEEAAGRLDDIRGKVVASESSVTSEREALRLQVKQLQEKLGSQERQQADVSNQFGGQGKRLDQLASDLKAQQESAAQLVAQLDGKLQTLAAEQEKLKALQVELGKTNEQLKALGGDVAALKKQGNPSQTIKGIQDDLLVLRSQLDNRPAQGGNTAEFDAFRTQVMRNINTLQAQVQNLQQQLNTR

SEQ ID NO: 24296 - protein, 367 aa, Pseudomonas aeruginosa
PAHPHRYRRSGAASRLPGGAAGIHPRRWHRRTEGGHRLPTAPAGGAGGGLPTGHPGAGRLPPGNARSGGLGHRAALAGVAGAGRRHLQRPGAGLAARHPGTGAPGLRRGARAGDRRCALPAYRRDLRGGLRPPAGSAAPADPMARPGRPESLAGSADLPAGDVPDVLLRHQHRRGATADLRQGLVGDLHRRHPVAGYPLRPARLAHGVPRPGHRWRGQHGVAAGAADRLDVPVPLAARGFRLHGTRGLRHGPPDAGAGPAGQVVRAADRRFRLQRTVDHGRADPGRAARAADYHHDGAVHVLRRAPGDFRRIRRGLLRPGRRAGDLLPVPARHRRGDPHRAVAQAHFDARRGLAVRHGTAAVPCATP

SEQ ID NO: 24297 - protein, 226 aa, Pseudomonas aeruginosa
EPAAADLVAPARLRGAGRQGDHPGQPGDRRPEQHHPRRQAGAGRHRPFRAGQRQPASHSAAGAARGAAGQLAGHRRPGHRGDGQGSGGRHPEHPLHRRADPGRGLRLRRLRPARATARRPGRNLGRPGRYLQPQRAGQPGGGEHGRRRHGDRLDGHHGEQVRQPHRGLQLSGLRPALRALRDRHGRDRSGKQQGLDGFLGALGAERRLLAGDPLLPGRHLRRAPRA

SEQ ID NO: 24298 - protein, 101 aa, Pseudomonas aeruginosa
AGTATARPNGRCPERAGRMSLMATLMQIRAALEDGQARGLKQLSRQVDAPPALVEAILERLIALGKVERVAAQSSGGCGGGCKGCAQRDPCAEPEPYFRLR

SEQ ID NO: 24299 - protein, 378 aa, Pseudomonas aeruginosa
TGKAQSPPRQAWRALSWLARSGQGRIVQVAFGTAGIEGFRARRVQFGALAQAFDQVRVGDEGDAEGHRIGVALGQDGVGAVEGELFVGDVGSAEGFLQGYADAVVGLRFAGADEGDAALAQLTGDMAEGFQAVGIAHVVGVGTRRQVYADALGAPYGDRRVGDFQQQARAVLDGAAVAVGALVGAVLEELVEQVAVGAVDLHAVEAGGLGPLGALAVGLDDVGDLLGVQRARGDVGTLRAHQADVPLGGDGARRHRQLAIQVERIGNPPDVPELQEDAPAGGVHRLGHVAPATDLVIGPDAGGVGVAHAHRRDRGGLAEDQAGTGALGVVLGHQGVGHAAFIGAAASQRRHDDAVGQLEVAEHDGIEQSSHGTSSTRE

SEQ ID NO: 24300 - protein, 383 aa, Pseudomonas aeruginosa
TDRGSIEDRLRLGAAVSGKGDQGGQQRQRGQRGGGQRHAGQAQAVVDDAAADPGAERVADVEGADVQGRHQVRRGMPDADHVDLQRGHRGEGGGGPEEQGDFRRQQGLAGPAEQRRDQRHGGEHRGHGGAQAPVGEAAADHVADGQADADQQQGPGHAARADPGDFAEQRRDVGEQGEHRGGEQHGGAQGQPQRRVLQRGHFLAQVDLLFLAVVWQHPGQADEGDHADQGHHPEGRAPAGFLAERGTQRHAEHVGQGQAGEHQGHGGSAAVRRHQAGGDHRADAEEGAMAERGDDPRQHQQAVVGGHRAEQVADDEDAHQREQGFLALQAGGGHGHQRGAEGHGEGVAADQPAGAGNGYPQVAGDLRQQAHDDEFGGTDGKGG

SEQ ID NO: 24301 - protein, 169 aa, Pseudomonas aeruginosa
TTSRISTSAARNRPNCSAACTATSSRAACRDNGRTRSSGPSSCTGASTPSPTATHWCMRPSGASRWSAGVSPASCWTCSSTTAWRATGTTTPTNRCRSSSSGSTAPCAPPRRCRSAWRASRRGWRPRTGWAATASSRSCAKCWAVCRGGCRDRTCWTAPGKNWPSATMT

SEQ ID NO: 24302 - protein, 579 aa, Pseudomonas aeruginosa
CTSTGSGRVDRSMGPTFNALPMEVEDETNPGGDRPVLAFRAGGHARRGAGQGEECRTDRAERARRRPAAGADRAATAGHRQPAGSERTGPEGAPRRRVQGDRAGRRSGGGDQRGGRGDRRRPAGDGRAPAHAAARPVHRHHPGAGGTQCEDPGAARGRCAGRGVPPGAAGAGLLADLDARGADGRPARLPRRRQPHRAACLRAVRQRHDALFGDQGRPRRALRRPGGTQGQRRAARLRRRPGAGPRGHPVARRRRLADQRDHDRGTPPGAAVDGARHPGPDRLPPRADRQRGRGGPRRPAVRRAGGAAQARLGGAPGLRRGGSAEQRQAHRLLGLAGQFGAVQALAGDRFQQLDMHAAALAAQQAAEVAEQVVVADERRLRIGHAVAAVADRHRLHRHAGFQGAGHQATVEGAQAFAVGGGAFREDQQVAPTVQLFGQALVDQPAVARAATDVQGAGLFRQPAGQRPGTHLGLGQEGQRCQGAEQRDIGPGHMVGYPQHGLPGRFAADPDLEGQGRAEARQPPAGQALAQRRDVGAGQPLAQADPSGQAQSERDQPEQACAAQQQAQPRHQTAALKWRA

SEQ ID NO: 24303 - protein, 331 aa, Pseudomonas aeruginosa
CLYDIVAGCNAPLFNAGTLGRMPVPTHSTLESAMSWQRLLGPLDRLPTEGSLEDWHAAALARADGLGTLERAVLGGRLAASPGLAFLAGYQAALRALWPAAPEGLGALCVTEKRSVRPADLQTRLEGLVLHGQKDFVTAGDSASWWLVAARDEAPGQPPRLSMTVVLAGAPGARLEALPALPLMPDVPHSRLLLDGAHCERLPGDGWDDYVRPFRLLEDVHVLAALVGWLYGVGHECGWPSPLLLRLAGILGGCAEVARHPVACVGTQAVLAGLFEQFSALEGQLDAAFAANASTWEALWQRDRGLLAIANGARKVRLEKALTRLGLDPGQ

SEQ ID NO: 24304 - protein, 265 aa, Pseudomonas aeruginosa
ISPTMRREPIVLFDNGSHQCLCFDDLVSGEGVQSNQFLIVDNGQYLLLDPGGDLTYTPLSLELSKRFPLQELDYIFASHQDPDIIAALDKWLLHTRARVICSKLWARFLPHLTANYLAVSHGINTYDRVMPLPDRGQAIALGDCSLKAIPAHFLHSVGNFQLYDPVSKILFSGDMGASLVDDAAPVSDFAAHIQYMDGFHRRYMAANKICRLWARMVRDMDVEMIVPQHGRPFVGKEMISAFLYWIENLECGIDLLGPDDYRMPG

SEQ ID NO: 24305 - protein, 313 aa, Pseudomonas aeruginosa
RHGRLRRRNPAGPAAGPAFPLLQRRQQRAGGGPPRHARRGLCRVPLARAVRAAGHPFGGMGARRRRHVRRLVVRLHERPRPGARRPADAAPRALARAATAAAGMGRVQPDALRPLPAERGRGGRGGAGRPVVVEPCGERRAGALAGRRRDRLRRARPLGPGALRAARGEAGDRALRRRPRRAFPPQRIPAPGTGGVRRGGAAMIRRHPLLFLFVLGLLAALAWAWQNRIHLAAFPAIIGAYTAKEYCSCRYVMGNSADYCRAYTQQYVPISGFFDDEARRRVTARGLGSTQTAAWLGPREGCRLMPEADRLPD

SEQ ID NO: 24306 - protein, 216 aa, Pseudomonas aeruginosa
PAAHVGARGEGRRRPEAGGGMPVVLCVLLLLLSPLLSAAEWQLEPDYSRISFVSVKRAKMAEVQRFDRLSGQIDKQGVARIVVPLGTLDSGLALRDERMKDNFFETSRFPEATVESRLDMAGFDDLRVGQSRVEKLDFTLDLHGQQRRLKADVLVTRQGEGLVQVATLEPVLLKLLDFDLEEKLKPLKEMANIPSITPEVPVFAVLNFREVPPEQF

SEQ ID NO: 24307 - protein, 187 aa, Pseudomonas aeruginosa
RTGGGRRGPWVPPSGTAFRCPSPRAALSCDHARPALRPGLPPTRPERNPARGETAWLDIDTSWPGSRRSPTTCVACARTSTPIPNWASRSDAPPRWSPNACAAGATKCTKGSAAPAWSASSARATARGGSACGRTWMRCRSSRPRGSATAAATAGACTPAATTDTPRCCSARHATWRRRGVSTAPWY

SEQ ID NO: 24308 - protein, 460 aa, Pseudomonas aeruginosa
LPPITARHEPRRHSPGYQEIPMHACPSGTSRTRQVAAAVIGNALEWYDFIVYGFLSSLIARLFFPSGDEYTSLLMALATFGVGFFMRPVGGVLLGLYADRRGRKAAMQLIILLMTLSIAMIAFAPTYAAIGVGAPLLIVIARMLQGFATGGEYASATAFLVESAPPHRRGLYGSWQLFGQCLAVFAGAGMGALVTHCLDAESLESWGWRVPFLFGLLIGPVGLWIRRYMGETEAFLEAIREPGERQGLLCVLREYRRSVLVSMGLTVIGTVSFYGVLVNMPTFAHNRLGLPLDEVFMVQMAAVALMTLVIPLAGGLSDRVGRRPVLLVATLAFMLMVYPLFAWVAAAPSLGRLLLMQLLLCTAIGGFFGPAPTAVAEQFPVRVRSTGLAVAYNLAVMLFGGFAPFIVTWLTEVGGSPVAPAFYVLGAAFLGLLATLYLREGATPAPRPREPALGKPARSL

SEQ ID NO: 24309 - protein, 494 aa, Pseudomonas aeruginosa
MSATRHRSDGHEEIVALDALPLSAAIRRRELSCREVMQAYLAQIERFNPRVNAIVSLQAESRLLAQADERDRQLARGEWLGWMHGMPQAIKDLAATSGIPTTLGSPLFAGQVPEHDAIVVERVKSSGAIVIGKTNVPEFGLGSQTYNPLFGTTRNAYDPARIAGGSSGGAAVALALRMLPVADGSDMMGSLRNPAAYNNVYGFRPSQGRVPHGPQAELFVQQLATEGPMGRSVADLARLLATQAGYDPRCPLSLRDDPRRFADDLGRDFRRARLGWLGDYAGYLPMEEGVLELCEAALGDFAELGCDVEACLPDYPLERLWRTWLVHRQWLVQGSLGELYADPARRVRLKPEAQWEVESGLGLGATEVYRASLDRSDWYRALARLFERYDFLLLPSAQVFPFDAETAWPRQVAGRPMDTYHRWMEVVIGPTLAGLPAISVPIGFGAAGLPMGLQIIGPAQADLAVLQLAHAHEGLTRWVSRRPPAMLEAPGGID

SEQ ID NO: 24310 - protein, 265 aa, Pseudomonas aeruginosa
RSVDGGGVVMPEREEAGTVRSVERALAILDLLGQHQALGLEELHYLTELPKATVSRLLHTLLEQGWLYRGLTDRRYRLRSTRLYGDAAERFRCQMVERSAPLLVELSERTGLVADLSILDGDRLLVAESSVPGVLRKRYPANRLVVGQHASLFHSAMGKACLGELADSEVRRLARQHQVDEDLWLRTREQAHGQGYGERTEGHWEYPVRLPFLIRAVALPVRAQGRLLGSVALHWPRDQDCVERVRRRHLGTLADTVSQLQHALD

SEQ ID NO: 24311 - protein, 584 aa, Pseudomonas aeruginosa
GGAGRKGSPHAQVDLPRPGPPGLAGPGRLVPGLRVVATQFHLHQERYPFGSRPLPGHARQGRRQGAGAPARRAGLGEHRHPAARRTHPRASVRDQALRRGGDHRPARPGADRRAGRRRATGNAPAGDRQPARQAQELRQRPVGDPPGRASLPGGDPVAAGAGRRRLRPRPRHRDPAQAGRRRQHRALGAGRRRADLHFAVSGPVFPWRSDNRFALLNDGVRFFPRMLLAIEAAQRSIELELYLVEDGHCAELFLVALLDARRRGVAVRCLFDGFGCLGLGSAWIQRLREAGGELRLYNPLRWKLTGGNLYRDHRKLLLVDGRLGYVGGAGITDEFWEPVSDVSAWREVMVEMDGPVVADWAALFERQWLACLEEKAWKPREGMTLTRLPPQPGAARGLGRVAYADARQHRDILQSLVRALNGSRRRIWLATPYFLPTWKVRRALRKAAQRGVEVRLLLAGRLTDHAPVRYAGQRYYPRLLRAGVRIHEYQPRFLHLKMVMVDDWVSVGSCNFDHWNLRFNLDANLEALDPDFTNEAAASLLADFADSREVTLAMWRARPLWMRLHQRLWGWLDRVVVNFLDRRR

SEQ ID NO: 24312 - protein, 447 aa, Pseudomonas aeruginosa
NLPGSLRVYPGPPITMTKERCVATPDSKERFIGLEWLRFLLGLYVVVYHTLHTYPKEQKFPGLDELTSLGFFATSTFFVLSGFLLAHVYARSGRLRESARSFWTKRLSNLYPLHLFSLLLSILVLLALSHLGIGPELDKATPRFVIYDTNEVLGRTHPELFLHWMSNTELFVNSILQILLLQAWNPYYLTFNAPLWSLSTLMFFYLAFPFVAPRLMRSRHKWKVLALVWLVYLIPPALVVASESYGIPWTGLLHRNPLLRLPEFLGGILAYGLFRGYRDRGMVPGRGLLAALVALVVAAFLVADYLFTQGAKHWYFLLHNGLLLPAQLLLVCLCALPADPKSAFVRHWSPRLGAASLSLFALHVPMFTLFSRSERLIAVPGRCLDDWRACTEAAAALPSSLLYYPLFLVLLVAFCVLFQERGVVPVRKWLVRRLMPAPALAKVPRPA

SEQ ID NO: 24313 - protein, 208 aa, Pseudomonas aeruginosa
EEGWSMLRSLSLALSIVASLVGCSTPGAFFGAVDGPAFVAHSSADASHATVYLYRPRSQWADEELEAPGIFLNNELIGSLPSNGYLAFEFETGSYKLEMRRPLAGSFWTLFADGPMDFTRIASFMLEARAGSVYYLRYDELNPPPKSEHPAGEGDGPLQLVAADLGAAEIGATHQVQEPMQFAASGYRKRVQRSFWEGVGRALDKIGI

SEQ ID NO: 24314 - protein, 196 aa, Pseudomonas aeruginosa
LRRRAQADRRGLPWRPAAGRRRRPARAGVQRLSGLRPGGAAGRRRIRRPSAGPGPRRRSPGYRAGLAGASGVAGALPRGARHPHQPLRHRRPPRMCELYVKADPILYESRSRSLRIRGVVTTLRLENQFWDILREIAEGEGLSTNQLITNLYEEVMDYRGEVLNFASFLRVSCTRYLAQRREKVAELSLVGQRAQA

SEQ ID NO: 24315 - protein, 463 aa, Pseudomonas aeruginosa
GEGRRDRGETFRLVALPPPIRRRLVKYSLPTTATAPFCPSSVSHSVAVPADASPLRKLALFIGPGLLVSVGYMDPGNWATAIEAGSRFGYALLFVVVLASFSGMLLQSLCSRLGIATGRDLAQLSRERYRPGVARGQWLLAELSIVATDLAEVLGAALAFHLLLGVSITTGVVLTAFDTLIVLALQGANFRRLEAIVLGLIATIGACFFVELVLIGPYWPDVAAGLRPSWDTLSSQEPLYLAIGILGATVMPHNLYLHSSVVQTRVSGDDAASKRSAIRFSRLDTIGSLSLALLVNAAILILAAAAFHGSGHTEVVEIQDAYHLLDPLVGGALASFLFGFALLAAGQSSTFTGTIAGQVVMEGFLRAKIPCWQRRLITRGLALVPALIGVLWLGEAAVGKLLVLSQVVLSLQLPFALWPLIRFSSDRGLMGEFVNPRWVSALAWSLFGLISAANLTLLYFWFG

SEQ ID NO: 24316 - protein, 488 aa, Pseudomonas aeruginosa
EMNCRASATLWIRSSCLITAMEHGPLQAGNSDAGQGHGAGRSRGARRSGTGAKKARQYSRSGETGARADDQTLVGQPAGRPINPRSASWQFVRLGNPQGAGYIAARCHYGTEPMRTDKPPLKQRALQKLLLRRFGMAAGTYLLGLVLLWLALLSGFYRAAPTTAAASTTLVVACQLAFLWLFASGRNLRYADPSLTEPQVLVAIAWLTYFLYHVDSLRGTFMVFYVLALLFGVFQLPPRVFARCAALAFIAFSGIYLVEALQQRLELPGRAALHVLVMFIVMVWLSLFASYIQAMRQRMRQRRYALQAHQDTLRGMMRQLEDLVATDELTGLFNRRHFMRMASRALEDLLPNRQHGLALIDLDHFKRINDRHGHAAGDRVLQTFAAVARSCLRDGDVLARYGGEEFVLLLPHADAEQLESCCERLRLAFQQAEPVGVTVDTLSLSVGMTLLYADDDLDEALQRADQALYRAKRGGRNRCDATWEVTSA

SEQ ID NO: 24317 - protein, 75 aa, Pseudomonas aeruginosa
GPTRGRILPHPWRPCSRALLRQQDRCPQPLAARSAATASCQCRRRCPGQQECPDPLGLTQPGDMLPARLSVPATP

SEQ ID NO: 24318 - protein, 205 aa, Pseudomonas aeruginosa
PSMRGRIRLEPNSGVRPRLTNGIFNRALRPTKTRSQCSSRVVPIPTAGPFTAAITGLGNSSRALMKRPTGLSRRDGGCSRKSRMSLPLVKQASPPVISTTRTAVSACASSSASAIRLYIARVSAFFLSWRSRRRVSSPASRSTRISSLIVTPGMRRRAAAMAARHRHRAASGVGQEQVRQGLATRYAGQVEMPGEAFDAGGLAAE

SEQ ID NO: 24319 - protein, 271 aa, Pseudomonas aeruginosa
STGWCSGPRLRRFPGGCPRTGSPGAGWSPPRGCARNASAIHRGSDRLSHRVRTCAGVSCVSVADAGAERLEEARQPRRMRRPGRRGNQVTVDVGLVRRKVDVFAAGQPHLRGAGRIGAARPPLQDAGGGQQLGAMADRGDRLARGVEVTHQSQHLLVQAQVFGGAAAGDQQGIVILGAGLGKVGIEGEVVARLLAVGLVAFEIVDGGAHALPGPLVRTHRMHLVAHHLQGLERDHGFVVFGIVADQHQDLLRSHHAHSFGQGPVIPGMHLR

SEQ ID NO: 24320 - protein, 247 aa, Pseudomonas aeruginosa
RYRPGFPGAGGAPVRRNPGRAASAAPRCRAGDPGRVPARPPRGSGTAGAPDTPSVPRYARRSPGRGPARGCATRGPRLPGAGAPGGAPRCLPVRPGRPCPWPNGTGWRAGRPPAGWPGSACAGRRAPSFPPPAGGRRRESTNRRPARCARSTPPAAARNAPPSGSGSARRRHRRGGWNAAGSAGRSSRGTASPAPAGYAAAATPWPWAVRSGNAVPRAPAPGAGPADRGSPAPAPPNARFPPLLFPA

SEQ ID NO: 24321 - protein, 218 aa, Pseudomonas aeruginosa
AGRAVRDRRKARQASPAPATGDGPARCATGAPGDSPAGTPRRRSPARRNRPARLRKAPARPPPSAGSRRSRRASRAGLCGNRARGRRRTCADRRATTADSADRSRPGWPAAGPGRPRCAPSGLRWPVAGRTVPLAGRAAPVPGTGGSRRRCCRRRGCAANPSCRCRRPPAACAAPAPPPPHRCCRRRSAPDRRHCGWCRTAGCRSASRARTPVRWSCR

SEQ ID NO: 24322 - protein, 166 aa, Pseudomonas aeruginosa
LAACNSMIWRTRCSTCSRTWPSSARRLRRSTARWGMTLAASPACNAPTVTTAAFCGSTLRATTLCRAITALDAASNGSTLRCGIEPCPPTPSRVTLSRSWEAIIGPARKPRCPASSPGMLCMPNSASQGKRSSSPSASIASAPPWPSSAGWKISTRVPSKRRVAAR

SEQ ID NO: 24323 - protein, 416 aa, Pseudomonas aeruginosa
WRERPPGGCGSARPTRGRRAAPGRTGRARDGDGSWPRLPGERRLCQAQEFVVAETPVAVVGVAHDHQLLLGQHVERLAPVAERGEGGLGDVRPGRRRAFHRTVQPPLAARHRLALLFRARPVAGEGRQVELDPCQRQQLPLAPAPVALHQQADARQVAGAHVDVRRADERAGGVSLPYRRTDAQRLEQRAPGVLGIVRAEHAVEGRRQHVAVAAGVAETPARRPGLRGFGDEAGHVVTPTGVEHRHHGGFQWRELVVLLPVQPGRPVQQVAQRHLGMTGERRVVARHRVVELEAPFALGDAKQRGEQALAHRPGKVRGLCTARAGVALIDQTTVADHHYRVGADAFATNIVATTEGIALECLQRRPRGLLGTGPVGVGPVFGQGREGEYQGQRGEGAAGQRQSGHRRALSTVEGQP

SEQ ID NO: 24324 - protein, 126 aa, Pseudomonas aeruginosa
TAPAPCARPRPCATAYSAPSSTPSSKAPKTASTATTTTVTARTSASATSTAAPWWPPPGCSTIAPPNASGASTAKRSSTSPASTPCTARSWRSAAPASLPNTATAPPSRYSGANSPRSSTRAATAT

SEQ ID NO: 24325 - protein, 638 aa, Pseudomonas aeruginosa
CSGCANATCAPTTCRPSRRTRCRRWTSRKTSPPSCRRCSRPTCAWAPRSAASLAGTRISRSPTCSSCSSATNSARATPATSRQRSDGAAAPAAAQRTPARAGRARTGPGRLGQPARAAARRRRHAAAPAPDPLVAGAPLRGPALRGQGQRRSAPATHAVGSQPCVLDRYPAARRPGTADLPVQGRGACLAAGRLAGGKGRHPVHPSRLGRQPADQPALGRTTAPWAQPADLPGRHHHQRRKPAHLPRSPDGQRPGSRRGGAAGGDQLPPRRRARYAGAVHRRRRLAQPPRPPAARRARQRAYPAAGTDPQPGPGPRRTGPPGPAGGAPGAVRHCRPYANPARRLVALGRHRQHVARQVAEGRLGHAADQRAAEAGQALGAEHRQLRRLAAYLGHDHVDRQAFADAQLDVLAAQPQAGDVVAQLDVGLEFLLVDVMLDAVFLDPRITHHAFGERLEGMQRGEAGGVEEAELAGHLHRARRGRREVQRQQHPAVLLFRRTGRAQHRDLRIAYHPLQGGADEQVAQRRVPVRAHHQQVGADLLGHRVDHHHRIADPHDRLGLDAEALLQGLSVHFQQVGDGQPLRRDQHRRLVVVEHVQHGQFGIPRLGQRRGAHDRQLGTRGQVGRHQDSFHLPPPLAER

SEQ ID NO: 24326 - protein, 526 aa, Pseudomonas aeruginosa
FVPTRYGRPTDHRHATGHRRNHQGSLPPGATRHAALAEGTGEVLRRAGPPVRDRRLRRQVRPAYRSLPVHRIGTPRHPATRRSGDQPPGRPVELLQAQRGDHPGLPRPTRRRAVSSTRFHPTTSQSRSSTDAGVSSRPRFIRLCHRYHRIRHHGPAAAGRRRPAGIHSQRRLADQRLRLRRGLRRPADGHGHRPPGAQESPARADGHLHRRQPALRGGRQLRPADAGADRHRALPWRLLRHRLGGRRQPGGAEPQRFRRGPDVHRPDPGQRARRAAGYRARPGSRLARDLLGGDPDRRGRLRRPGQGAAKRPRGREGRPAPGNVRAEEPVAVAGPGHHRAVRRLDVRPVHLRRAAARRSHRGQPARRDLDPAADRRRPDRRQRDRRPPRRLAPGHHHGRGVRRHGAGLGAVQLDQPGPAAGGNHPVLLGRRRLRRGARAAGQRGPRRACRAEPGGDPEHRRLQRRQRARRLGRRQRHRPRPGPDPRAAGRRRAGRAGAAGHPDRLFRKRPRPGAAGPRLIPCPSIP

SEQ ID NO: 24327 - protein, 173 aa, Pseudomonas aeruginosa
PGPWLEQRDQGGARRRRAHLPATLARRADFRSALPEWRAAGGAERHRRRGARQPGAPEASLRHPARAGHRGDRRHRRGLPPGRRAGQGRRLRRRGDPRRQRLPARPVPPGQHQQAHRPLRRLHREPRAPAAGSHRRGDLRMGRPARRRTPGAACRLPRHGRFQPPGNLQPCRP

SEQ ID NO: 24328 - protein, 180 aa, Pseudomonas aeruginosa
AGQARHRLHLRPRSAGRRQHRRSPEESLRRTLHRQRKVHPRQRQRHPGQGRRRCGGLRRPLHRQPGPGRTPAPGRRTEPAAPGNLLYRRYRRLPGLSDPGLIAPARTEPATLAVAGSVLCPSSAGGNTAPAPRTDRAGRSPCNRRRNRPSFAQPPARPCRARSAAPGSPPPAPAARPPGG

SEQ ID NO: 24329 - protein, 467 aa, Pseudomonas aeruginosa
VSPSVTSSLPARGIGHSAWQLQYLLTAEQTQAGHQDQVEEQHHGDGQDATLGVRGEGGDLVAEGRQRVGDVQPPEHRESHPALAAFPSDRAHGGHAGHVEQDEDQIAVGRDGAAELARHGAHRAGLHVAVGHARLHRVGQHAEAEGIDQAVPGFDQGVAQLPGQVVAFVVEGLALDLLGGVEGVQGADHHFLGHRPGDQADGGLPVVRLHPERRQQRSETLADAGQRGMADVALHRLAVEGDAVQAADHQADQDDHLAGPHHEAAQARPGLQQQALKVWHMVQRQFHDERRGLAAHQSVLEQQPGEDRHDDAEQVQGEDHQRAALAEEGPGEYGENRQARAAGHERRHHDGNQPLALRVQGPRAHDRRYVAAETDDQRHERLARQAQRLHQAVHDEGRACHVAGILEQREEQVHQADLRHQRQHRVDPATDALGEEHREPIGQAEADTQPLDAVDEDRRRALVEDRL

SEQ ID NO: 24330 - protein, 136 aa, Pseudomonas aeruginosa
RPADVDGEEEHQVHHQQEDRQTQPAIQDDPVEPLGQPVRLSLLVVADRRADLADKLVARIDDRQLGLLAAAPARLFQGGGRQAQRRAVEDVAFQRLQRQPARLDGRGRRSARFQEVADLRLDGRWVIHRQRRLREL

SEQ ID NO: 24331 - protein, 224 aa, Pseudomonas aeruginosa
GVDGRLQFVDAIGAGGYQRHHRAAETPRQTVDIDADALATGDVEHVQRDDAGDAHLPQLHREVQVALQVRRIHHVDQHVHFAAGDVAAGDLLVQRGLGRNGVQRIGAGQVDQAYRVTDGMERTLLAVHGDAGPVADPLARAGELVEQGGLAGVGIADQAEGQCGHGDSGRGQSSGTRVSRARSLRRSARLVWRVSTWIGSPSGAMRTTRSAAPGRSPMENRRWR

SEQ ID NO: 24332 - protein, 317 aa, Pseudomonas aeruginosa
  UNSURE (292): Identity of amino acid at the above locations are unknown.
PESHLHAGRRTMASHWMIYGANGYTGRLVAEQAQREGLTPLLGGRNPAALHALGSQLGLECRVFDLGDPQACREALDQVKVVAHCAGPFSATSTPMIAACRAAGTHYVDITGEIAVFEQAHAGDAEAREAGIVVCPGVGFDVIPTDCLAACLKEALPDAQRLALGFDTGSGLSTGTAKTSVEGLKFGGKIRENGRLRDVPLGYKRRDIDFGRGLRHAVTIPWGDVATAYYSTGIPDIEVYLPAPPLLGLGMRLIDPLASAARSATGPGLAQGAGRQTHRRAPTRRPASACAXGSGARRATPAANAARRAWRRPTCTT

SEQ ID NO: 24333 - protein, 245 aa, Pseudomonas aeruginosa
APSRTRRPFRSAPPNVPPGIQDGLPDRHRTGPVNRSRASRASPDLRKNRRDTMAFELPPLPYEKNALEPHISAETLEYHHDKHHNTYVVNLNNLIPGTEFEGKSLEEIVKSSSGGIFNNAAQVWNHTFYWNCLSPNGGGQPTGALADAINAAFGSFDKFKEEFTKTSVGTFGSGWGWLVKKADGSLALASTIGAGNPLTSGDTPLLTCDVWEHAYYIDYRNLRPKYVEAFWNLVNWDFVAKNFAA

SEQ ID NO: 24334 - protein, 707 aa, Pseudomonas aeruginosa
GKQALPTGLSFALATNKEGPLKLDSRHSLSLKLLRVVLLAALAVGVVLSCAQIVFDAYKAKQAVSSDAQRILAMVRDPSTQAVYSLDREMAMQVLEGLFQHEAVRQASIGHPGEPMLAEKSRPLLDLPTRWLTDPILGQERTFSIRLIGRPPYSEYYGDLKITLDTAPYGENFVTTSEIIFISGILRALAMGLVLFLVYHWMLTKPLSKIIEHLVSINPDRPSQHQLPLLKGHERNELGLWVTTANQLLASIESNSHLRREAEDNLLRISQYDFLTGLPNRQLLQQQLDQILDGAGRQQRRVAVLCLGLDDFKGINEQYTYQLGDQLLIALADRLRGHSARLGSLARLGGDQFALVQADIEQPYEAAELAQSILDGLEAPFEIDQHEVRLRATIGITLFPEDGETTEKLLQKAEQTMTLAKTRSRNRYQFYIASVDSEMRRRRELEKDLRDALQRHELHLVYQPQVDYRDHRVVGVEALLRWQHPLHGFVPPDLFIPLAEQNGSIFSIGEWVLDQACRQLREWHDQGFDDLRMAVNLSTVQLHHNALPRVVSNLLQVYRLPARSLELEVTETGLMEDISTAAQHLLSLRRAGALIAIDDFGTGYSSLSYLKSLPLDKIKIDKSFVQDLLQDEDDATIVRAIIQLGKSLGMQVIAEGVETAEQEAYIIAEGCNEGQGYLYSKPLPARELTQYLKQARRLSQATSSERP

SEQ ID NO: 24335 - protein, 445 aa, Pseudomonas aeruginosa
LVCPWPPPVCWASPSPSPAAATTRKPKRPQHRRPTCSPPRPPPAPAAKVDEAAAKAVIKNYAELAETTFADALSTAKDLQKAIDAFLAKPDAETLKAAKEAWFAARTPYSQSEAFRFGNAIIDDWEGQVNAWPLDEGLIDYVAKDYQHALGNPGATANIVANTEIQVGEDKIDVKEITGEKLASLNELGGSEANVATGYHAIEFLLWGQDLNGTGPGAGNRPATDYAQGKDCTGGHCDRRAAYLKAVTDLLVSDLEYMAGQWKAGVADNYRAKLEAEPVDTGLRKMFFGMGSLSLGELAGERMKVALEANSTEDEHDCFSDDTHHTLFFNGKSIRNIYLGEYKRIDGSVVKGPSLADLVAKADAAANDTLKADLADTEAKLQAIVDSAEKDGVHFDQMIAPDNKDGQQKIRDAIAALVKQTGAIEQAAGKLGIQDLKPDNADHEF

SEQ ID NO: 24336 - protein, 486 aa, Pseudomonas aeruginosa
ACGLFPRSPGCSPMSLPSPSMPLACLLTALLLGGCGADDEPLRAEPGEHLSGGATTVLQSDRNAFSLPSANLAPSRRLDFSVGNSFFRNPWVIAPSSTTARDGLGPLFNTNACQNCHVKDGRGHPPGADAVSAVSMLVRLSIPAGPADGKTLLHQGVIPEPTYGGQLQDVGIPGVAPEGKVRVDYEPLKVRFEDGTEVELRKPILRISQLGYGPMHPQTMFSARVAPPMIGLGLLEAIPEEAILANADPDDRNGDGIRGRANQVWDAARQRTALGRFGWKAGQPDIPQQNAHAFANDMGLTSSLLPHDDCSAAQVECRRAPDGGEPEVSDNIFAQVLFYSRNLAVPARRKVDDPQVLAGKRLFAQANCVACHVPAFTTGSDASEPELANQRIRPYSDLLLHDMGDGLADNRPEFLASGRDWRTPPLWGIGLTETVNGHTQFLHDGRARNLLEAILWHGGEAEAAKRHVLGFDADQRSALLAFLNSL

SEQ ID NO: 24337 - protein, 357 aa, Pseudomonas aeruginosa
GAHMFRPRLLLTSLAIALGACSPQDPQAVTSAALAQQVILPTYSRWVEADQALASSALAYCQGKEDLAKARDAFHAAQKAWAELQPLLIGPLAEGNRAWQVQFWPDKKDLVGRQVEQLLKNNPQVDAAALAKASVVVQGLSAYEYILFDSKIDLADAATKARYCPLLEAIGTHQQQLAQDILARWKNDGGMLTQMSKFPNDRYADAHEAIAELLRVQVTALDMLKKKLGTPLGRQSKGIPQPYQAEAWRSNASLASLDASLSGAQALWEGIDGKGLKTLLPAEQKDLAGKIDAAYADSHAKLAALEQKPLSELLASEDGRNQLNALYDSLNVVHRLHEGDLARALGVQLGFNANDGD

SEQ ID NO: 24338 - protein, 366 aa, Pseudomonas aeruginosa
PTAGAVGARRRRWPALRGGLPPGRQVPVRHPRGPALPRHRPAPEPAAGAVRRPPARHRKLPDRPERRLPAADPGLAERPPLLRPRRVPPERRVALRHRERHYRSRSRRARRLPFRRRATAAQRRDLHPRPRAAPGFLDARRRDPGSGQRRHSYRGGKPGRDEPRRHGAQPGADAPRRQPAVQGNPGAADEQRPPPGDRSRRHHRRRPAVHGRCPRTCRPAGDQAPRPSLRSLPGGRGAAPGDGPVHRQRGDPRRPAPGGPDRPARQPFLHLGPGQRCRTPRRAVAGLRRRGRGEERLRRHVRTGPLPLLRLPGRAHRRATAGAAFRPLGQPPAPGLRARHQPLAIPVRESRKRPATRLKSFANPVL

SEQ ID NO: 24339 - protein, 293 aa, Pseudomonas aeruginosa
SSTTAPRWPSSPSGTSSKSTESRAFLLRGGRLAKGLKHGFYRSVHPSSGPGERGQPADRPARHAGLQQAGDPRVSANGERADHGDHALRRSQRGNHPGLHHPAAAAEPGQRRRHRLHDLGEPAELFDHLHLRADRRQYRSPGHRAAGQVQRSEEPAAAGRRGPGAAEGGRGRLGADVHQLLQRADEQPADHRLPVAGDPAQAGDPARYRRGGDPRQPGVRHAPVAGPGEDGRVRRHRRRDQPGGAAVQLPRRRRRGEGPVGGHQRQCFHRPQVAPGLRRHPGEDRRRPPGADG

SEQ ID NO: 24340 - protein, 1118 aa, Pseudomonas aeruginosa
SGEDPRRGGADRHRGGVPVPRRVPFGTDPGGDHSAVDDRRIVLHAGHGLLDQPADPAGDGPGHRPGGGRRDRGGGKHPPPHRGGQAALRGCPGGRAGDRRTGGQHDHHPRRGLRADRLPHRPHWRPVQGVRLHPGRRGDHFRDRRPDPVADDVLAPVAPRGESLGPGASPRPDLRGPEATLPARPPRHPGHPSGGPGVRRAGTGADPGTADVHQEGAGAGRGPGHRVPHDQLAADRQPRLPESLHRRVRRYLPQLPGVLLGVPDQRLQRRPGRHRRHAAQALGRTRKEPDGIAPCGAGEAQRDSRRANLRLQPAVATGHRRGSAIPVRAQHRQRLRVAAASGATGEAARQRVRQVRLPRSRPGVRQTRAGGRHRPREGRADGRLHAGPGGGAGQPARRGRDQPLHHRRAQLQGHRPGRTPLSRQSRLARQLLREEPQRPTGRPLDPDRDPRTGTATATEPVPAAQLGDHLRLPHRQHGRGHRDGSADRPRGSPAWLRRRLRRRFPAIRAGRQRIAGHLRTGPGDHLPGPRRTVRKLPRSAGDHGHRAAVDLRCADTAVPRRVEPEHLYPGRPGDTDRPDQQTRHPDRRVRQPVAPRTGAGASRGHRAGRRDPPAASTDDHRGDGARGDPADPRHRRRGGQSLRHRHRDRDRHVGGHPLHPVRPAVHLHPGGQAGCPARRDASGKRTLIGNGGQRQQRCPPALSPHPTALRARSYVRRQPPPVDCPLKRSGETSMAESAFSERIVQNLLDTDFYKLTMMQAVLHNYPNAEVEWEFRCRNQEDLAPVPAGHPRTAGIPGGPGDQRRATGLPRTDSLPGAGLHPLPRVVPLQPALRADRHRERRILPAPERSLAARDPLRSAAAGDDQRGAQPRPLPGRHRRAGARTPAGKVRLAAPGGQRRGTGRLQDGRLRYPPPLLLSGPRGGGERSEGGLSGLLRRHQQRPPGTQARPQAPRHHGPRMADGPPAARSAPDRQPECRVGLLGPRIPWAARHRADRLHHHRCLPARLRPLFRQALRRPPPRLGRPVAVGGKDHRPLPQAGHRPADQDPGVLRRPRPATGPEDLSRAAGPDQRQLRHRHAFHLRPAGRRADEHRGEDERLQRPSGGEDLRYARQGAMPGP

SEQ ID NO: 24341 - protein, 185 aa, Pseudomonas aeruginosa
RRFVAEFFGASLRPSGPGHRAHSTRRGWRNPPGLRSPAAPAIARRPCGSRNRSGAARVYRATRRPVAHRARAWRWDSRKGAASRGRRGRSAACDRAAVHRRCTPAARRSPRRGARWAPRPSCRVPATTGRWRSRRRYVAGMPDREPLLFLSQDIDPPHVIQRDEIEMLLDDEAGVAELALDRFGW

SEQ ID NO: 24342 - protein, 134 aa, Pseudomonas aeruginosa
ARRAGGQGSRRRKRPARRPRRWRSPAPTAAPDRATVRDAAPGAPGAPPAPSPCARASSQAGRPGRCSARSRSAPRRRAPARALRNRSGPAAGRSGDHRCRAPAHGTTSRPRTLRGNRHPVGPAPAAWRRSPGRR

SEQ ID NO: 24343 - protein, 226 aa, Pseudomonas aeruginosa
RALAPGPETGRAGEGDRPATPGQRLLGEDAGKPLGLAARCAWRGDPARGPAERSRRAWRRSLPRPGRLRRGRERLRQGSAELFHRIPLGALFRRTHALAADQPRHSARRPEAGTAPGLRTGGKGAAGLPPGLPALRNKKAPPKRGSSNHRSRSAYIMPPMPPMPPMSGMPPMAGLSSTISATMASVVIIRPPMEAAACRAERVTLAGSRMPISIMSPYTPVAALKP

SEQ ID NO: 24344 - protein, 156 aa, Pseudomonas aeruginosa
SEVVSSICLRICRTRASISACTPAPSMMVVFSLLITTRLALPRCSRVAPSRLRPTSSLITVPPVRMAMSCSMALRRSPKPGALTAATLTMPRMLFTTRVARASPSTSSATISSGRPALATASSTGSISRMLEIFLSTSSSSGLSSSAAMVSGLFTK

SEQ ID NO: 24345 - protein, 202 aa, Pseudomonas aeruginosa
PRSNCMPSTTDSSFSRPEPSSTVITPSLPTFSMASAMIWPMDSSELAEMVPTWAMALVSAQGLASSFSWATIATVALSMPRFRSIGFMPAATAFRPSLTMAWARTVAVVVPSPAASLALEATSFTSCAPMFSNLSFSSISLATETPSLVMVGAPKDLSRTTLRPFGPRVALTASASTFTPTSIFLRAESPNLTSLAAMFSFL

SEQ ID NO: 24346 - protein, 146 aa, Pseudomonas aeruginosa
RAFRSSAKARRRSACCSTRRRRPPSIRRRVKGIRQRMPKMSLMKPGSISRPPPTAINRPSSISCSGSSPRASRSRARQAVATPATRNNAAPMKALATIRNRVQPTPMTLPTLIRTASSTSGKSNSRKRKARISESLAGPVCPRYHQ

SEQ ID NO: 24347 - protein, 423 aa, Pseudomonas aeruginosa
PPASPSSVWASRWRSPTRWPTSSRTTTTPAAFSNWTAACACRPRPRKEKAPLSRGFFVQAGLPADPEADGIAALVDVAVVAAELVPFRLHAQRSPAGQLVADPRLGLQLVVQAGLQRLADLAVGEQLELLGQQVAVVVPLEARRIEVLLLAIGELVVVAVDQGGDGERAQLVVPELVAGAGTDGTLLRQVLDHVALVGDLALPEPVVVDEAVQRVLAGIIVGADLAVLLLAVVLALHVVAPESVAGVGLEIDVVVGHIVLGLLAVQREIDVAVPYPVLEDRLGRHHLLDAGQLHGLRLAVDQGHLARPGGLDALGVLASLGILLDQQVLLALEGGDLVPLERDVAAIVGLQQQLAAVEQGDLAGKAVTVLHPDRIGKGRGGTCKGSEAQQDSRQHEHKSTELGSKRPALSKCRAAEQGPGHGR

SEQ ID NO: 24348 - protein, 71 aa, Pseudomonas aeruginosa
AAPARWVGRTLSQLPVDTRLPWHRVLGAGGRISLPADSPGGREQRARLREEGVLLHNDRVDIRRHGWLTAK

SEQ ID NO: 24349 - protein, 605 aa, Pseudomonas aeruginosa
SARYFLRNGYPMTQQSWREALVAYKSPASLALLLLGFAAGLPTMLVFNTLSVWLREAGVARDTIGFASWLGLVYAFKWVWSPMLDQWRLPFVGRLGRRRSWLVFSQVLIALGLLGMALCNPQSHLPWLIGLALLVAFASATQDIAIDAYRLEIAEDSRQAALAACYMTGYRAAILLASAGALILAEWFGSTSLNYSQSAWGLTYALFALLILPGLVTSLLIREPAVDVPIHVNPSRFDFNHQLLSVLLLLILLISLPAMITALLDRAWPRAGLYALLMGICLSPWGRQQIRPVRELLATVRRPLLVAARGKEVPLFDFVHQAVSVMVLIILLVTVTAMCRAYYSGAWPRGTLFLLIAASCLSAPGRLLMAPVLTPITEFVQRYRWQALLLLGLISTYRLSDTVMGVMAGVFYIDMGFSKEVIASVSKVFGVLMTLIGAAAGGVLIARFSILSILFIGGAASAATNLLFAMLAQLGPLHAEALPSHDVISLVMALEPHVLMLVMTITLDNFSGGLAASAFVAYLSSLTNLKFSATQYAMLSSTMLLLPRFIGGYSGTMVESLGYEHFFYVTAVMGIPTLLLIGWLWLRRAPSSETPAPGHQNAEQH

SEQ ID NO: 24350 - protein, 195 aa, Pseudomonas aeruginosa
SATSRSPGSAAPGRPCRCTPARSAARTRSAAPVGRSSIPCITSISRKNTPPFRNGNGTGLQIPARTPWGDVSGPGYESAQRGRTDAAPTGADNAGEVAAALLPIAMPGMARGSEKPRQSRKLVNCNGMPSDSPRSRAMASCRSSRFLPVTRTCSPWMAAWTLSLRSLIRPTIFFARSLSMPSRKLTSCLTTLPDG

SEQ ID NO: 24351 - protein, 372 aa, Pseudomonas aeruginosa
PSPRERMPAGVAETDDFFPMARATAAGTRPPATNRALAGSVPAPILFSSPFMPNPDLSILVVDDAKFSSAMIGRALSQAGYQDIRFASSASEALQQLEQRPVSVLLADWLMPEMDGLELTARVRQLDESINHYTYIVLLTGKEGENVLGEAFDRGVDDFVSKAAMNEQLVPRIYAADRLCNTLQRLLVENRLLTENIARMEERNLVDTLTGLGNPRYLRQKLADSLRQVETRGGALCYLLVGMPEAPVLRQRHGEAFHRELLLGVARRLQQLVRPLDVLVRLDEQHFALITLVEDLHECSSSSFKRLHDGLNLKAFKTSEGFISLKAGIAMLGLDSGALPLGIDELLQRTEALLPDAYASGRIATCRLPALR

SEQ ID NO: 24352 - protein, 315 aa, Pseudomonas aeruginosa
TSPYRQPFAVATMTWHILGAGSLGSLWAARLGRAGLPVRLILRDRQRLRRYQQAGGLSLVEDGQASLYPIAAETPDGGQPIQRLLLACKAYDAEEAASSVAHRLAGNAELLLLQNGLGSQQAVAARLPRSRCLFTSSTEGAFRDGDFRVVFAGRGHTWLGDPRDTSAPAWLAQLSQAGIPHSWSDDILERLWRKLALNCAINPLTVLHDCRNGGLRQHPEEIAALCDELGQLLHASGYDAAARSLLEDVRAVIDATAANYSSMHQDVTRGRRTEIGYLLDYACQHGQRLGLPLPRLGTLLARLQAHLRQRGLPDR

SEQ ID NO: 24353 - protein, 302 aa, Pseudomonas aeruginosa
RRPGRKSRWKTTAAACPNWCASVSSSRSSPPRKSARAPVSACPSRISSSPTITRARWKYARNWAAAPASASACRWKAPKRSPRHKPRPCRPLCRNPVAACGGATKRKVESMGNRLSKIYTRTGDRGETGLAGGRRVPKSHPRIEAIGAVDELNSQLGLLLAELLEARGAHPGLEEIVQALAPVQHRLFDLGGELAMPEYRALDETEVARLESCIDRWNDELGPLKNFILPGGSRPVAQAHVCRSLARSAERRCQALDQEETLEGVGLRYLNRLSDLLFVAARAIARRQGVAEILWEAAAKPD

SEQ ID NO: 24354 - protein, 445 aa, Pseudomonas aeruginosa
EAHGPMANSRFSSIDEGSECLASGAVLCVDLHVFVGQVGGPDGLAAGAASQFDADADLGLGHHRRALFLGVTGRPAATAGDTDVAKEHVDLAHVQIGHAGTSDRGENASPVRVGGEQRGLDQRRVGHGIADIQALLVGGAAVDLNSDELGRALAVANDGLGQLHGNLHYRLLQRGEQRAAGLGDFRQRRATGGDQHAAVVGGGIAVDGDAVEGLVGGVAQQILQHALGDLGVGGDITEHGRHVRLDHPGALADSGDGHGHAIVHELAAGALGQGIGGHDPRSSFGPAVLSQVGQGRRQRRLDLGHRQGLADHPGGIWQHRSLGDPGQFGELGAGLRGGGEAGLAGTGVGVAGIGQQVAHLTEETLFGQGHRRGTERVQGEHPGHAGAFGAAHDHHVFAPRSLDAGGSDAEFETGDRVQGGQGAKTDSHGNALLYQTVDSMPSATA

SEQ ID NO: 24355 - protein, 437 aa, Pseudomonas aeruginosa
LITSIGLTTQERRDIQVIQVILRVQLGRGRRAAVRLVAHHGRTVEVAVVHRLLLALGRCGCLGCAALHSVVDDLHRFLQARAQAGGDYGDVQLIAHVRVDHGAHLHSGVLGSELFDDVADIGVLAQGQVRTRGDVHQDAARALQVDVFQQRVADCRLGGLAGTVRTAGAAGTHHRHAHFAHDGLHVGEVDVDHARTLDDVGDTAHGTGQHVIGLGKGGQQAGVLAEDGQQLLVRDGDQRIDALGQRADALVGDLHALATFERERAGHHRDGEDAHFLRHFGDDRRGAGTGAATHAGGDEDHVGAFQHFGNALAIFQSRLTTDFRIGAGTQPLGDARAELQNGARRDVLQRLCVGVGADELDALDVVLGHVIDGVAATTTYTDHFYDGGLCDVIDQFKHFPSPSFLVLSPTVTALNQKLPWTQRLSRSRTGALGSSLL

SEQ ID NO: 24356 - protein, 966 aa, Pseudomonas aeruginosa
RGSTTSARAWRDSSRGGRSPTLGTLMVSPAPASLGQGAGVADLDLFRVLGRRTQGHGDVIGDLVAGDRDHRGMADRAFGEDRDIGGAAADIHQAHAQFLLVLGQHRIGRGQLLEDDVVDLEAAAAHALLDVLRSIHRAGHHVHLGFQAHPGHAQRLAHAFLVIDHVILGQGMQHPLVRRDRHRLGGIQYPFDIRRVHLAIADRHDAVGIEAADVVAGDADERRVDTATGHLLGLVDGALDRLHGGLDVHHHALLQAAGRMSTDANDLQLAIGRHLAHQRHHLGGTDVEADDHLAALHACHGYYCLLNSLHGAGRGHRRGRDRLAPRNGEAVGVTQVDPRNVRNLIFECLVVDAYEAANLVYHVVAPDLDLDALGRGQRPTAAIAHFQAGDGEPEGTQQLAEQLVLLHHLLLRPLWTMQAGQMFIIRQFLWRKSLSLVVQQRFVAPPRDRQLLVQADHHLVRPHPAHLGVGDPGHLFQLPAHARQVDGEEARRQVRGDPLLHRALADVAEVALDTDLGDRPVGVRQDVLGAAIGAIAENGQQQRPGQVLEETEVGFRQAHAQRFLGHQTAGAARHRLARSAAESTGLLMTEQYAIHGLSPRLAAIGQDRQHQLLEIQAGGPRGHRHQAVVGHARCGVDFKQPETPFGVLHHVRPPPALDAQGVAGARGEFLQLAFLGLVETAGHLVAGIAGQVLGVVVVEGVRRAQADRRQHLPAQGRHGEFRAADPLLDQHLRVVAGRFAPRRDQFVEPADLGHADARAFVSRLDDQRETQSLRRFAAVILAGQHRVVRGRQAEAEPDPLGPQLVHRQRRGQHAAAGVGNARALEQALHAAILAATTVENDEGTVDLLLDQALQQVFADIDAEGIDPGGQQGLQDHRAGLQRHLALGALAAEQHGDTAERLGILGAVQQAIEAKVHAPFPPLPANSGFLISCGARPPTSPAPWQSRMSPARSSGLTSGARSASRSK

SEQ ID NO: 24357 - protein, 171 aa, Pseudomonas aeruginosa
LAAHRIAGGQTLVTGREGIRECLADAPGDRRQAAVGGAGHGVLLVDHQRHAVEARSQAARAGDIATQAEHADRPQLADHPQRLEQRLEQFQRRLDQRLQALAAQPADLNQVQRQAGLGYQVILDAARRPQPVHGIAARLELPRTGERREHVSAGATRHDQDITFHRQSPLR

SEQ ID NO: 24358 - protein, 188 aa, Pseudomonas aeruginosa
TCPGSRRPATTAPHRLRGPARRPAGLLRPALRRAPAVPRCPVPGQSARRHGQAVPPPGRSARPARAGHGNRRPCRLRRRAAPACRRCRHPAPRSPPGRRRRWWPWNRRSSSRPAARVPTGSDEPGRKTPSARRAWRRTAGRPHGPAPARRARWNSCGRHGSSVRQPAAACRTGTPATSGRLPRSGRKP

SEQ ID NO: 24359 - protein, 353 aa, Pseudomonas aeruginosa
RRDGSSQLLRHAHDRAARARVGLEFFFRSVLRLAQQLQARLEDLGTDRQVARQVVRLALGVLAHEQLDDAVFQGMETDHHQPAADGQRFERGVKATLEIAQLIVHMDAQALECAGRRILALLPGGVGNRDHFGEIGSSFERPLLTALHDGAGHPLGEAFFAIFLEDPGDFLFGGVGDELRCADALAGIHAHVQRTIVEEAEAALGIVELRRRHAKVEQDAIDPPFETACAHLIAQFGERALHNDEAAVFGRQCFSCLDGLGIFVESEQASPGAQFLEQGSTMAPSSEGTVQIAAVLPRGQCGNGLLEQNGDMAVGGIHSQRIRSRSSSGSPPGCLIAARSASAMAFQASSSHN

SEQ ID NO: 24360 - protein, 289 aa, Pseudomonas aeruginosa
REQARRTSSTLPLALQSLLIQKVFSHPGNFRRQRRGFLQRQLGKQQVEHPERLRTDRLLAFRRLPPRHQHNALAALLVAVRRDPIVQFGQRQAANGLEGLAQLPRQHRTALPAEHVAHVRQAFQQTMGRLVENQRARLFLYRLEAAASSRSLGGQETFEDEPVRRQSRRRQRRDQRAGARHRDHPDTQRLCLAHQVEAGIGNQRGTGVRDQRDVFPTLQPGDEAPALLALVVLVAGRQWRLDAEVLEQPDRMAGILRSHQGHLPQHPQGARADVVEIADRGRHYEQSAC

SEQ ID NO: 24361 - protein, 611 aa, Pseudomonas aeruginosa
MRHEKPYMIACLRPLSALILAGLLTACATSSNSGLGELPRTPNASIEQLLQQASQSKPEEAALLRLSAADLAYQQKDLARSTAILGQIPLESLKPAQQVFASTLNAELALARSKPKAALQALQHPSMQHLSELPVTQQVRTQRAKAQALAADGQVLAAAKERIYFAPLLEGPAVIENQEKIWTLVSSLPVDQLQPSANEGDLSGWLTLARITKTSPTLQQQQASIESWQQQNPEHPAAKHLPAALEKLKTLSQQPLTRIALLLPQQGQLANVARALQDGFLAAHFQAQQAGQNPPSIKLYDSTQVRSLDDFYRQAQADGVELVVGPLEKPLVKQLASREQLPITTLALNYSDNSQEGPAQLFQFGLAAEDEARAVASRAWGDGMRRAVALVPRGEWGDRVLAAFSQSWQSAGGSLIAAEHVDQPVQLAQQIADLLQLRQSEGRAQRLQGALGSQIATQPSRRQDIDFVFLAATPQQARQIKPTLAFQYAGDLPVYATSHLYTGTNNPTQDQDLNGIRFCETPWLLNPSDPTRQQVAAQWPQANGSMGRLYAMGVDAYRLAPRLPELKAVPSLQIDGLTGTLSLNPTQRIERQLQWAEFRNGQVQPLGTSSF

SEQ ID NO: 24362 - protein, 253 aa, Pseudomonas aeruginosa
FSPPNFFCNRRRAGPNAPVASMWSPSIPATDNHHRDWTGFRTHSTPDQPPHRRSLPMDMQHRIRQLFQASIETKQQALEVLPPYIEQASLVMVNALLNEGKILSCGNGGSAGDAQHFSSELLNRFERERPSLPAVALTTDSSTITSIANDYSYNEVFSKQIRALGQPGDVLLAISTSGNSANVIQAIQAAHDREMLVVALTGRDGGGMASLLLPEDVEIRVPSKITARIQEVHLLAIHCLCDLIDRQLFGSEE

SEQ ID NO: 24363 - protein, 254 aa, Pseudomonas aeruginosa
ARSAHRWHNPEAPLPRRTLRSPGYVACNRCRRSIHRARGPDRDGWNSSSCSLTHISFNGRQAGPEAFPGESALHVVEQRLGLPRQLDAQQRQTPEDRQQAAIHQAEILAEEICLVGEQRGNPGQALAQLLARLDPLGLLAARIQDPVHQGTPVPLDTMDQQAAVGTLHRIIGQQRRMRIAFVEVFHDHRRLVQRQVAIDQGRYAAVGVDLRQHRRTAARLDIDHLYRHVLLGQDQADAMAVMIGRVGIAGQLVD

SEQ ID NO: 24364 - protein, 503 aa, Pseudomonas aeruginosa
TPASPSSDRQECPGRWRHARNAGTWRYGSPCSSWRRYARHPAWPPCRSGRYRHDPVAAHGRQRRNPGLAVPPESVQRIAFSSASHPFRNRFGLLHPGVERHQDEEGEIQDGANARQGSTQRARSLGAVVAEDHEGHREDHQPQLAQPALVADRANRAAIQPRQDEQHSDRRTHRHHAHQLVRNRAEDRVERGEVPDRSDVLGGLELVGHLEVGLLEEVAAHFREEEDHGAEDEQEHHHADDVLHGVVRMERDAVQRYAVLVLLLLDVNAVRVVRTDFVQRQDMQHDQAEQDDRQGDHMQGEEAVQGDAGDQEVTADPLGQVFADHRNRAEQGNDHLGAPVGHLTPRQQVAHEGLGHQRQVDQHAEDPHQLARLLIGAVEQAAEHVQVDHDEERRCTGGVHVANDPAVVDIAHDVFDGSERLFGRRREAHGQPDAGEDLVDQHQQRQGAEEIPEVEVLRCVVLAQMVFPHLGRGKTRIDPSHELVHQAFSWSTPMVMTSSASNV

SEQ ID NO: 24365 - protein, 357 aa, Pseudomonas aeruginosa
FHEDTRMEYRPLGRTDLKVSALCLGTMTWGEQNSEQDAFAQIARAKAAGINFMDTAEMYPVPPRAETYASTERIIGNWFRRSSDRADWILASKIAGPGNGISHVRDGNLKFNRQHIVAALDASLERLQTDWLDLYQLHWPERRTNFFGQLGYQHQEESFTPLEETLEVLDEQVRAGKIRHIGLSNETPWGTMTFLRLAEERGWPRAVSIQNPYNLLNRSFEVGLAEIAIREQCGLLAYSPMAFGMLSGKYTDGARPANARISLYSRFTRYTNPQAEAACARYVALAREHGMEPAQMALAYVTSRPRPCKNAASDGDQLLSDFLSPRRPWEAQSGAIGDSDCMGTSGFGAPVERGQES

SEQ ID NO: 24366 - protein, 215 aa, Pseudomonas aeruginosa
PGGRSLPRRRRAPRRPLPRGSSAPRRRCLHARRAGGHRGAQRSLEAMADRHMGGRHVAEKGRDGEGRQAPRSLAVGGPHRFGDGMEAAHPGGDDGRRALLRLGALRRPAGLGQGLLRGGQGEEDEAVHLALFLGGQQQVGIEAGLRVLGTVGDLAADADGQVADQLRRERGDARLPGQQALPYGFDSAAQRADRAHAGDDDTFAHEGPSPSVPLE

SEQ ID NO: 24367 - protein, 193 aa, Pseudomonas aeruginosa
QSVDVTIIMKVTCGPALCEPRQGRTMQRKTFADAECPIARSLERVGEWWSILIMRDALQGLRRFDEFSRSLDIAPNMLTRRLNALVEAGLLERQPYSQRPLRYQYVPTAKGEDFRVVLMAFVAWGNRHYAEEGQSVQLVERTSGRPVRSFMAALADGRTVPLEQCTVQAGPAASEEMRQRLAAMPERSELPAR

SEQ ID NO: 24368 - protein, 214 aa, Pseudomonas aeruginosa
TPPGRPASRHLAGQRQPWRGGRQSGPAPPARRRRRPGSGAGRLGRRTAGRPRAGRALPDRHPAHRRLQPGRQAARHRADLPGLLRLARHRRTCEPARRAAGNLARRPATQPRLRPGLGAGHAVPRGIRPAQRRCRLPPQPDRRQRHPPRRLRRPAQTLPAAPRDHRPARRHRWTGGVAAGGAGAGGAVGLGACGWVDSCLRTYPSNCSGVSCRR

SEQ ID NO: 24369 - protein, 210 aa, Pseudomonas aeruginosa
PEPRGRESAISDRLVEPGADAYAGWPDSPGMTAMTAESPTIRLERYSERHVEGLTTLYNDPAVARQVLQMPYQSVEQRRKRLHDSADDDRLLILVALHQGDVIGSASLEQHPRIRRSHSGSIGMGVAVAWQGKGVGSRLLGELLDIADNWMNLRRVELTVYTDNAPALALYRKFGFETEGEMRDYAVRDGRFVDVYSMARLRRVEGRVGE

SEQ ID NO: 24370 - protein, 349 aa, Pseudomonas aeruginosa
LRYGGMSAQYAEISLSQRSESLVSLPDSMSASLPDSEAIRSADRQRMVALLENLAPQEGYNLTGLDCVRLLRSDRPLARTPVLYDPGIVIVCQGRKRGYFGEQIYLYDEQHYLAVAVPVPFTMETDATPERPLLAIYLHLDFPLAAGLAVEIDRQRALAQVEAPRSLMSSPMDAPLRASVLRFLEALGDPLETAILAPALLRELYFRVLTGPQGGAMRAALAMRGRFGNIARALRRIHAQYAEPLELAQLAGEAGMSVPSFHSHFKAITQTSPMQYLKCTRLHQARLLMVRQGMSAQAACHAVGYASASQFNREFKRLFGRSPLVEARRLRAGFSLPPAQGGEEYVSSH

SEQ ID NO: 24371 - protein, 216 aa, Pseudomonas aeruginosa
SSAVSRGHAEYPPAPAARGQDRGGRRSRRGPAPGWRRRAARFADPRPAFPRPDPHRDARRPAPPVPAHHPDRRLDGRRPAAHRRSDERRGRRLPRQEHRARGTRPGDSGHPRRGSAGAVRTLRPPAAAAQPGPGGAHRAPTGCPAPAGPGQEQQGDRPRPGHLPLHGAHPCVVAAAGAGRAVADRGGGEVSGAAGAGGCGVAPWARRGCAEAPGLF

SEQ ID NO: 24372 - protein, 124 aa, Pseudomonas aeruginosa
WRTLHGQGNGHMRSPLATIACACLLLGGCSKSAEDSANPLLGKDAECLELFARSNALYCDIREDERESQANGTPRRHTDYEVADAAYLLKATGERCAIDTTYVTECSAKAGQWLQKARAKAVKP

SEQ ID NO: 24373 - protein, 340 aa, Pseudomonas aeruginosa
  UNSURE (98): Identity of amino acid at the above locations are unknown.
SQRPRSAQARRQLRQFAAQPEAAGFVVGLARPVEIQSHRWQGQRHRQQAVAQAAVDQVGVASGQGQQVAALGHQQRRRQVVLAALAHLAGQAEVAEGXVFDADAASPRGHRDMVRRQVLLRTQVAGEARPGHHAQAVVEQVLAAQGGVGGPGDLDGEVDASGAQFRLQVRPVQAVAAYLDAWRGLAQVGEDRREHQRLQLLRHVQLEGPRVAPRVERLAAIHAAVQAGEGVMDARRQSLGQRRRRNPAPLADEQRVAELVAQARQGVADGRLAEMQEARRAGQVAFSIDHFEDPEQVQIETAEGRPFMWLIHVCARLSGEGASLAGMLADRTMHRLHGWR

SEQ ID NO: 24374 - protein, 1116 aa, Pseudomonas aeruginosa
PTRRRASSFRRPPDPLPGEPAVTAPFNALLIANRGEIAIRIARACADLGIRSVAVFAEDDAASLHVRKADVALPLAGRGVAAYLDMDRLVALALEQGCEAIHPGYGFLAENGEFARRCQRAGIHFVGPQAEVLDLFGDKAAARALAERLEVPLVAGINRAVSVEEAEAFLEGLGDGAAVMLKALAGGGGRGMRAVEEVAQLADAYRRCRAEAQAAFGRDELYVEQRVARARHIEVQVLGDGSGAVSHLWERDCSLQRCQQKLLEIAPSPDLPEATREALIDCALRMAGAVRYRGIGTFEFLVDDERPGRFYFMEANPRIQVEHTVTEEVTGVDLLHAQLRLAAGMELAALGLERPPAIGGCAVQLRINLETLAADGSARPAVGTIGAYEPPSGPGLRVDGYGYAGYRVSPSYDSLLAKLVVRGADYPAALRRAYRALCEFRLEGVASNLDLLRNLLLHPAVQANRVDTRFVESHLETLLAPIPASHPRLRAECPLAEDAAPARVEAPLGSLPLSAPSSGVLVALEVGDGERVRAGQRVAILEAMKMEFEVKAPGGGIVRRLAASLGEPLEEGATLLFLEPTEDDDEQAPTEQALDLAHIRADLAEVLERQAALGDERRPQALARRRKTGQRTARENVLDLLDEGSFSEYGGFALAAQRRRRSAEELLELSPADGLVAGTGTVGAASFGAQAARCLVLAYDYTVFAGTQGVMNHKKTDRLLGLAEQWRLPLVLFAEGGGGRPGDTDFVGVAGLDCHTFVGMARLSGLVPLVGVVSGRCFAGNAALLGCCDVIIATRDATIGMAGPAMIEGGGLGRFAAEEVGPTGVQGPNGVIDVLVEDEAEAVAVARRYLGYFQGLLPDWSCADQRELRHLVPENRLRAYDIRQAIEVLADRDSVLELRRQFAPGLVTALLRIEGRAFGLIANNPGHLGGAIDAAAGDKAARFMQLCDAFDIPIVSLCDTPGFMVGPEAEKQATVRHVSRMFVSAASLTVPFFTVVLRKGYGLGAQAMAAGSFHSPLFTVAWPSGEFGAMGLEGAVRLGFAKELAAEEDSQRREALFRGMVDKAYRNGKALNMASYLEIDAVIDPAETRAWLLRGLAVAGEPAPRAGRKRPFVDTW

SEQ ID NO: 24375 - protein, 233 aa, Pseudomonas aeruginosa
ARKCVDLECDGFIAFRHSHSGAFHERQAKPAISSRKQPQQARSSELVASILEAAVQVLASEGAQRFTTARVAERAGVSIGSLYQYFPNKAAILFRLQSDEWRRTTRLLGEILEDTARPPLERLRRLVLAFVRSECEEAAIRVALSDAAPLYRDADEAREVKAEGARVFQVFLREALPEVAEAERSLAGDLLTTTLGAVGKQFSEQPRSEAEIERYAEALADMLCAYLAALDER

SEQ ID NO: 24376 - protein, 662 aa, Pseudomonas aeruginosa
FSHMLCLDRTPMLSAVRRYKSMLSSALARCFPRTTAYLQAEREAREALLQPAKARSRKNAAKAPAKAAGKPAKGAVRGAPRKPAAASRRAPQGIYPAAALKVDESQERAMREQVAQAVTLGVVSPPSEEQWAMILCRQPLARIFAGAGSGKSTTLVLRVVFMLCHLGVEPQRLTVISFTNASCAQLREQLLRLLAHWQYPFDAAQARQCVRTFHSALGSLAREVLGNPRWFEQLDDRDPAAEPDNPLAAGRLRPAQQRLLKQAYQQCYAQSPAFRAKIHKLLELPPPAEPEEGARRQPKAPLEPFKLAGEFQALPLYEAFHAQAGFAESLGLRVERLDSGKLECGLREKIFVEAMALFWARFQALLREEGLMTFDAAFQQLGERMAGGALAETALAPFTHLLIDEFQDVSPQIVLWLQALHRRLATQGTAPSLMAIGDDWQSIYGWRGSSPELFIDFDRHFPSRGRGRKSALLVLETNYRSVEPIIRDGEKVLAGVRFKQDKTCRAFRPIQPGDHGVKLVQRFDLRAQLPKLLAEIRAQSEHAAARESSERTAVLLLSRRNEPLQAIQAELDRALPVKGMTIHRAKGLQAEVAIVVDDCLPGEKHPLRNALYAASGFFRNSYDQAMEDESLRLAYVAITRGVSRVLWYTRKAQGATALLARR

SEQ ID NO: 24377 - protein, 201 aa, Pseudomonas aeruginosa
SHRACPCRQPSDTPPARRSACVAEQQRLEARRGVDIGELRRILQAFDEVQRRRLAGGFLEEEVGADGRVIDTGQQGAAGHQQFRQAAEDPAVVLGQDEAAFLEARRIDDHQVVRAELAQLAPGLEQFVAEEAHPAEVVAVQAVIVAAAVERAAGHVQVDHLAGAAGNGRHREAAGVGEQVEHAAAGGLLLHPAAAQAHVEE

SEQ ID NO: 24378 - protein, 886 aa, Pseudomonas aeruginosa
RTVRPFASIGRRGRRRGAGRAAILDHQQALRRGQRDAFAAQAVEDGEEQVAARAGHRTRAVDEAAGVEHQAVAGEILERHRGRRRVEDRRVFGEGLQEQFADLHRVGVQRQGQVHPDHPEGIAHGHVAHGLGDELRVRHDHRGAVAHLDLGGAHVDPPDIALDPAQADPVADFHRPLGQQDQAGNEVLHDGLQAEADAYREGADHPGQAGQVDAQGGHHQHRQEHEAEVADQGHQRGAHAGVHVGFRQQPLAQPALDDAQGEQAADEQQQGDQDVLRDDVQVAQGPAAFAQLGEALQQFAGARADRKEGQQQRGEQQQGAADPGQHRAGLGLVARRQAERIGQRQAAGMLGREQGFADVAEESDQQVGGGRDHADPQQLAGEEVGQRQVAGEQGEEDRCDPYRGDEGDQPGDPAWPLQVVLAPHMVVAQQGGGEDQRGDQRGQAVEGDGQGQAGAGDAVDPFLGGHQHQRHREDRRERAEGAGDPVRDRRQPPGWSRQHQQGAAEAGDEGAEGRQAHQLIGQAGHVGAQAGVAFQAPAHQRHRADDGQDGRQPDRQGQGAAPQAAFRQPADHRPGKHALQQAAAEAPDQHGGQQGSGEGPAVSGRDGAVEGDQGLRLQLVQPAQVVVGGTDQGRPEARAERCRRAAADLRVEQAAAQVDDLCRQVAGRLAELGGLAFVIEQGVLLPGQGLALGGEAFRLVGLRRADHFQLIVEPLDVGHPQREQGVGLALDLQRALAQLGEEVVAGVGGDALADQVELRVELVEAGVLGQGGRRFQVDGRLRSRPGGPGLAAQAQEQAQGHGELAEQHMQAGAPHRIPLSILTGSSSMDRRGRRVIPRVDNRQAALKGHGFWPYRSLFGRRRRFAATARWAESLHQEQETCEVSPC

SEQ ID NO: 24379 - protein, 141 aa, Pseudomonas aeruginosa
PPRNICARAPAAPSPSAVRRAITPVATSWAATASSTMPPSPPRRSSTRVPGAWRSSMSTITMATAPRISSTAATMCCSPRSMAIRWSNTRTSSATQTSAAKAPARAATTTIRWPMAAAGTSGRRRSTTPACGSPATPRMPW

SEQ ID NO: 24380 - protein, 433 aa, Pseudomonas aeruginosa
FPLAWTPTRKTRSPSSSWIRRTTCGWASASPGWACRPCSSWKAAMRWKPSASTRSTCCRATKARPAEERSMQSTRKLLAGLALAVSAGLVQAAPEVRIYNWFDYIAPDTLKNFQAQTGIAPKYDVYDSNEVLEAKLLSGHSGYDLVVPSDSFLPNYLKAEVFQPLDKSKLPNWKNLNPALLKVLAGKDPGNRYVMPYMWGTNGIAYNLDKVRAVLGDDAPLDSWDLVFKPENLAKLQQCGVAFLDSPTEVIPEVLHYLGLSPNSHQPEDYRRAEEHLAKLRPYITYFSSSKFVSDLANGNVCVAIAWSGGAMQAANRAREAKNGIRIEYRIPKEGAAAWFDVLAIPRDAKNVEQAHAFLDYLLRPEVVAPISDYVAYANPNKAADGLISAELRDNPNVYPPEEVQARLYSVEMLPPKLERLRTRTWSKIKTGK

SEQ ID NO: 24381 - protein, 373 aa, Pseudomonas aeruginosa
AAAARWRVRRTDSVPQARPGQARQAGRNRRPRPAGGRFQASTGRAGLSIMALPDGRRWRPLPSMPACESAMRKSADAFAFQTMLLLCVIWGIQQVTIKWAATDIAPVMQAAIRSGIAAALVGLLMCWRGGWEGLRQGTLGAGLLTGTLFALEFLFIALGLQYTTASHMSVFLYTAPIFSALGLHFLLPSERLRPLQWLGVAVCFGGIAVAFGGGLSWAEMDGRMLLGDAFGLLAGMSWGATTVAVRGTRLSEAPPSLTLFYQLFVACAGLLLIALFSGQFGEVRWTPVSTASVLFQGVVVSFASYFCWFWLLRRYQANNLAIFSFMTPLFGVTFGVLLLGEPLSLNFVAGAALVLAGITLVSGEQWLRRLLRR

SEQ ID NO: 24382 - protein, 303 aa, Pseudomonas aeruginosa
IIVNYLFCFGELIVEFGQLRIFQAVAEEGSIARAAERLHRVPSNLSTRLRQLEEQLGVDLFLRERQRLQLSPAGKVLLDYAARLFALQEEARAAVQGGEPVGDFALGSMYSTAAIHLPPRLAEYHRRYPAVNLQLQTAPSGELVESLLGGRLDAVLVDGPLDFDGLEGLPMFEERMVLVTENGHPPVRGPEDVAGSAVIAFRPRCSYRLLLESWFASARVSMGRVMEIESYHSMLACVVAGGGVALMPVSMLQSLPGRESVAVHALAEPFARANTWLVWRKGMVGANLKAWIGLLQGRESALA

SEQ ID NO: 24383 - protein, 142 aa, Pseudomonas aeruginosa
TLPSASTASRPSTRWRMVPKRKARMPPALVATSPPTLALPRAARSMPGSSPASAASAWACSRVTPASRSRVWLAASSRCMRFSLRSESSTSPACAAPPPTRPVSPPWGTRARPAWRHRRTTAATWSVLSGRTRKLPARFCGW

SEQ ID NO: 24384 - protein, 165 aa, Pseudomonas aeruginosa
TSGAARRDRPGGCRCRRSGSSRRRSGRPATRRGSRRTAGDSATSRRSLRPGAGARRRRAGPRGCPARPRRPAVRPAARAWPAGRRCGWPGSACSCASVAAGRCRCGSTRHRGRSRRRTPRRSRFRPARCRWPAPRRPRRPARVPARRTGCCPAAAGGRPVAGPWR

SEQ ID NO: 24385 - protein, 1113 aa, Pseudomonas aeruginosa
  UNSURE (346): Identity of amino acid at the above locations are unknown.
PSAMKPAPLLVARGDMADTAAGQAAIELYGMHAGDAEDGLDAPGFELLDEEFAAGGHGRSFFMFSGMEKARESPSPVGVVPGSGGAGDTRRAPREQADQDEAEQADRQAVVDRRIGVEAVLDHEHQYGKEAQGHAGDGAGGGGALPVDRADQRDQHAAYQQVVGHGQGADHVADHQGDAEHYQAQQQGRDAVLVHVAVVGLAAAAAQARQQVLGDGGGRRQQAGAGGGHQRRQGGGDDQAADAVRQAVLDHTGEGVVDVLQVRQQDLGGHPDQRPGHAVEHAVDTGGGAGDLGHGLAAGGEHPLPDVLADEDAEEVDQEVGDDGVPADRGEVEVAGRQLGYQGVPXAGVVDRQRHQQEHQADGHDQELHDVGQGQRPHAADGGVEHHDAAADQDRDPERQAEQDLHDGADGDGRGGADHQCVDQHDQGAGVARGGVVATLQDLGDGVDLQLQQRLGQEQAEADDAEADRAAQPEAGDAMDVAQAHGADGGGAAEDGGGHGSQVEAGAEVAAGHQVVVAGLGAAHAVPAQRDHARGVDQNDEYVEGHIRSPKFLIVIVVSGEAPEARDAGVPPCVSPTSGGGYRRCPPRAVRAHPARSSRAIDARRFREQAQQCQVEQGGQAEGDRQAEVDAAGQFAERTDELPRQVDEGQAGCRAGNPGTHSAPVPAVLEPVGAAALAAGEHLQVVRAVEAATGQQADQHDHHPRGGAGDDQHGEGRDALHQVEGEAADEDEADRGDPDQHRGLHPREQAREHAGHVQPGAVQRSGAGGHAADHRDQAYRQEEPAGSDGQQAADVVVGSDVVRRADGDDGRGGEAEQEGNQGRQLRADHRQHDPCLRGLARDVAGPVAQEGAEGDRVAHGQQGGADEGGPEARLAELHAAGVGGVEGAGEGEQAEQEQQAGGPHGDPVDQQHEAEAVDAYGQHQHGEQAVGQAQVQFALFQADQAPGAADQGIAGTPHREREEGDGGQQREEGADDAPVHAEVRAGGDRVVGAVERAEQAHRGEDQRAQRDAQQDRPQPGLEGQPEEHRKAAEHGGGEGIGAAEDHAEQIDRRGVAFVVGNLFDPEGFDACDCVLVIVVIHDVLPGELASRWQVLRHRRQVLMAGQPTAFLLF

SEQ ID NO: 24386 - protein, 238 aa, Pseudomonas aeruginosa
WVKQITAIRRKYDVFASERKPPPPVAHWAPSRSRPMPRIRCERCARPASHCLCALIPSLPSRTRVLVLQHPSEVGHALNTAGLAVLGLCNAELRVGERFAEETWRVPGYRACLLFPGEQARALAEMAAEAAGEPLLLVVPDGTWRKARKLLHLNPALAALPRVSLAEGMASRYRLRKAPGEGALSTIEAIAAALDELEAPRTHEALLKPFDALIEGQIAAMGEDTYRRNHLSQERRRR

SEQ ID NO: 24387 - protein, 564 aa, Pseudomonas aeruginosa
CCRVCTAGFPSLARGPGGMHGIKGVSMTNTSTLTLDGVSFQLPDGSLLFSDLDETFDTRHTGLVGRNGVGKSLLARLLAGHLQPSSGSVRRQGRVRYLAQQLEPADYPTVADLAGVRPWLEALARIEAGSLDAADYECLGERWDIRQRLADALAAEGLGHLRADTPSERLSGGECMRVALLGAFLDDADFLILDEPSNPLDGPARALLRARLAAWDGGLLLVSHDRELLEGMQRIVELSTLGLRSYGGGYSFYAQSREEAREAAERRLDQRRLERKRQTLAMREQQQRQERCQASGRREGKTANQAKILLGGFRERSEVSAGKMRNAHQAERERLDREVREAAREVEEASPLLLDSPDAELAAQRRIVELKGAVLPHLRGPLREIDLLLSGPRRLALVGPNGSGKSTLLRLLAGQRAPLAGTCAVTVGAAYLDQRLSVLDHGRGVLEQLLEVNRSRGESWLRTRLAQLGLPAERLAQPCATLSGGERLKAALALVLYADRPAQLLLLDEPDNHLDLAARQALESMLGQYRGALLVVSHDPVFLRRLALDGELRATAAGWRLEDR

SEQ ID NO: 24388 - protein, 502 aa, Pseudomonas aeruginosa
FRRAQLAVALLGTAQYRLQVPLRQRRADCQQQCRRQRQQPGGVGPGAGPAGAGGWGHRAGSGRTQRSLRERRAACQRGVSGETDRIVIQGSGWGPAALLIKKNEVGRARPATGKGGQMQALRSGGGRVLVGVLAAGLVAFGGWAWLGGDAGAKAAPAPARVPVNVARVERRDVEQQVSGIGTVTSLHNVVIRTQIDGQLTRLLVSEGQMVEAGELLATIDDRAVVAALEQAQASRASNQAQLKSAEQDLQRYRSLYAERAVSRQLLDQQQATVDQLRATLKANDATINAERVRLSYTRITSPVSGKVGIRNVDVGNLVRVGDSLGLFSVTQIAPISVVFSLQQEQLPQLQALLGGEAAVRAYSRDGGSALGEGRLLTIDNQIDSSTGTIRVRASFDNRQARLWPGQFVAVSLHTGVRRDQLVLSSKAVRRGLEGNFVYRVAADRVEAVPVRVLQDIDGLSVVEGLASGDQVVVDGHSRLMPGALVDIQEPRPSLAQAAERQP

SEQ ID NO: 24389 - protein, 229 aa, Pseudomonas aeruginosa
MRVLIVEDEAKTADYLNRGLSEQGFTVDLADNGIDGRHLALHGEYDVIVLDVMLPGVDGYGVLRALRERRQTPVIMLTARERVEDRVRGLREGADDYLIKPFSFLELVARLQALTRRGGNHESHSQMRIADLSIDLLSRKVFRGNTRLELTAKEYALLCVLAQRSGEILSKTAIAELVWDINFDTDTNVVEVAIKRLRAKLDGPFENKLLHTIRGMGYVLENRALAESG

SEQ ID NO: 24390 - protein, 437 aa, Pseudomonas aeruginosa
GADLHPEMAARPVRPRCAAGLVAWPLDRPPGPVAGASAVRGGPADQPAAVVAALAALAAAGRAARAGGSVQRRPGPPGAGLRAPGVVQCRRRPRAAHAIDQPDRPDPGGVVPRTQRRTLRRGPAIQPGGAGAAAGDRQRHAVPRPRRPGTPGLRARGNLAGRRDRHHGGFPRGDLRRGRGRYRGARRGPRAGRARPVPAGGDQPAVQRRPAHRRRRHAAGRRRAARRRSAGGGEQPRRADRRRAPQAPVRTLLSGRRGAQQQRGQPRPRPVHRQGGGEHARRFGVRRQRGRLEHLRLHRAEPRAARARRPLAAGRGRSGAVLSGPSGVVRRAGLLAEDIDADQYRAGQHEALGPGASDQVAGKGDAGPHQADGVDLALERDAFAVEIVADPRAEPWMADQPVVEARRAAHEAGRREEQERRGRQHRQEDADHAQGYA

SEQ ID NO: 24391 - protein, 136 aa, Pseudomonas aeruginosa
CVRGLSRAGFSSGAWQSRNRLVSRSGICATMSSTRWRSRAISSNSGCSSNRPEPTMIGSSSSLTSSSACSNQTSSRRNTPSMKPMHQPRRSESSGSSPRSRSQGSSRSSSLASTRVMCALSCSREVSISWRSSSLR

SEQ ID NO: 24392 - protein, 476 aa, Pseudomonas aeruginosa
SRRDLRAKRACLLRRPGERFTDALGEVGPDLAPSLAQATMQSLRKWRIPMAVAPGVLLPPTPDVKPKAAAPKSQQKTPEPSNDKTSSFSDMYAKETAKKPAERADGPSKGSRDKPRDAGKEAAEAQPTDAAGQPAVAEDGKPLPADGQAKADGEDKVETPVDPLQLLGLGGAVPMLDENTQATLLPPAVPTASSAPASLTEASSDPTLVKLNGVPAVNMALEQGAQDAAQAAKGGPAKSADPRQANLGDALASLTSDSLPKAVDGKALEAQLQQTAEPAIASAASESLLESKAEPRGEPFAAKLNGLTQAMAQQALTNRPVNGTVPGQPVAIQQNGWSEAVVDRVMWMSSQNLKSAEIQLDPAELGRLDVRIHMTADQTQVTFASPNAGVRDALESQMHRLRDMFSQQGMNQLDVNVSDQSLARGWQGQQQGEGGSARGRGLAGEASGDEETLAGVSEIRSRPGASAARGLVDYYA

SEQ ID NO: 24393 - protein, 178 aa, Pseudomonas aeruginosa
RRIFGMAKKEATPADAGAPSGGKSKLKLILLIVVGLLLAIGLSVGGTWFFLSKSLKAEKTEEVASEAAKPGKQPALYEILAPAFVVNFNQNGRQRYMQVGVALMGRDKAQMDALREHMPLVRNKLVMLFSSQSFDSLVTPVGKEMLRQQATAGLQELAKKETGQLAIEQVLFTNFVLQ

SEQ ID NO: 24394 - protein, 468 aa, Pseudomonas aeruginosa
PDQPGPHRPGPHADPGDDQRAFRPLHPHQHVQPAAPFGRRRGRRRAGDEVRRVRALAVRSHQPQPGEDEAAARHRAVHPRRQAGVQAGGQLLRRRRPPRQDRGPRVHPDRTAGGADGAGAGLRRSEGSLAGGAGDELRVRQLGGQPGHGQHRQSQRGGGGLHLPHRTGRRWRRPAHHHALFDDRADPRDARRRFPVRPRRPGRALDQGPARGRAGRPGTARRHRGPPPAQAARHPAHAAGRRDPGGDAGTHGDARQRRARLQGQAGRPQGQPGATDSRSGRALALTASPGGKTNHGRRRKSDHRGTGTGRRVGGGAGRGGRRQPGRHRCADGPGRRDSRGGVEYPAGADGRVRRFAEGTDHFRPGGAQPGCDPGHPGDHFHGGRAYRHQHPQPAAAQPGVGDRTRSPGRRAAGRTGQRHPDRPRRGGGSEREVRHPPDRRDQSQRTHQEAALTCVATCSPASCRHSPR

SEQ ID NO: 24395 - protein, 98 aa, Pseudomonas aeruginosa
RAAGALERDMTPEVALDLFREALWLTAMIVGVLVVPSLLVGLVVAMFQAATQINEQTLSFLPRLMVILLTLIVLGPWLLRQLMEYTQTLIGNIPLLIG

SEQ ID NO: 24396 - protein, 441 aa, Pseudomonas aeruginosa
SSGSAPPTCSASTRCWPARPCNSSVNWCGRNSHGRERERAGQDRGTHGETPPRGARERAVAAFAGAEHPGHPHGRRRRPADLRRRPGGRPVAPDAQQFRAVPGNRDEYREHAAVARRFGLPGCPGALADPADAAGGGDRRADRPRRLAVLDGRPATQVQPAQPAVGAEADVFRQVAARTEQGADQVPGGAGGGPAGALRRPRRPPGAGAPAARAGDPAQRAGGRLERLLDGLQPAADRRGGRALPDLGQPPEAADDQAGSPRRIQGLRGQARGQVEDPPDAARDGAETDDGGGAGGRRGDHQPDPLRRSPEVRPGGRRGAAAAGQRQRFPGPEDPRGGPGAQGDGHGVAGAGASGVLLHRAGPGDSRRALSRRGPGAGLCLPAQAVPGRQGQAAEPVEGPADPAGPASRRVTWLELRAALWQPWPIPARDESFAVHGSNLV

SEQ ID NO: 24397 - protein, 69 aa, Pseudomonas aeruginosa
VGQLVVEYCLIHGARAVVRCCANKTDARSRWLQGLLQRRPANVVAVALANKNARILWALLSRETCYRPG

SEQ ID NO: 24398 - protein, 291 aa, Pseudomonas aeruginosa
QASRQPASRRAGSSASGRVSSTSPCRQCTRQAWQLPARQLWGTAMPPASSASSRLLPAATARRRSPTRMSGTGDLPGGVAAVSSAALGTVERLVGPLQGLVEIVVGIQQGHAHRKAQGIHRDPDRFRLLERQAQALATAFQLFRVGVGQQQDELLAAVTGQDVAIAQTGTRHRGEGLQDPIAGGVAVAVVDPLEVIEVDQRQAVLPVRQQVFQRPAGHAHEMPAVEQTGEFVGGHQVFQLAHHAAQRVLVRLQGIAALAHALPHRLYVAGEQAQPDHYDEHHEHMQCSPAR

SEQ ID NO: 24399 - protein, 473 aa, Pseudomonas aeruginosa
GLPARRIAGCPRLHGADPDQLAHVRHRPPPDLPGHRDRHRVRPGRHGRALGRRYHERRRYDQRRRASRLQPAGERPARLDPGRPGRRAEEHQGQHAGGDPLLHRSRRQGRGRCRGQGRRLGEQVEDGHAQPVRLDRRLGAEDRTDHGRRLVPAGHARHRHRRYRGESSGDGEGGPHGPDRHPRTEGPRPAEPHRGTAPGAVREGQPAGHRCPGPGRPDHRARRQDHGLPDPRRLAAGVHDPQLRRDPPRPLRARRLRPRRTGSAVARRLPGDRLGSRPVRAPRRPGQDHPGRGAKLETGRDPAAQRQDAHRPRRRAQAHGRHAEQGRNAAGGPERPLHLLRRPGRSGRRRGGRPGRSHHRHPDGQVHPPDPRTDRPAGHDRQVRARSHRHRGDQGQQGGIPDGRRRRRLSGRPGDQESKVLAFAELGMEAIYEFEVKDMPVTVAVDTNGESVHITGPAVWQKKIAESLAVEVK

SEQ ID NO: 24400 - protein, 634 aa, Pseudomonas aeruginosa
ACSVPEKARPRAGLFRTATGRSLGWQRRRRLGSAEPEIQQGQVRRRDQAEQRPGQRADPARVDELPHEAPVAAEANQRPQGERQLQAEHHLAEHQQLAYRGFAQPEHADQGRHQGQAAGDQAPLPAGNLRPEETLHHHLPGNGAGEGRALPRRQQGEAEQEAGQGAAHQRVEQVVGVLDLHHLGMAATVESRGGEDQDRRIDQQRQGQRADGVEPGKADRRAFARRVVAADPGLHHGRMQVEVVRHHRRAEDADRQVQRLLAAQGVPGRPQAGGDIRPVGADQHQFDEETRADGRDQPQHYGLQAAEVGALQGQHDQGIEGGEDHPGGNRDAQQQVEGQRRAEHLGKVGSDDRQFRQQPLATRHARAVALPGELREVAAGGDAQARTEALQEHPGKARQHHYEQQRVAEARARLDGGGPVAGVHVADRDQQAGADEQRQLAQRRGVGRHRHAVADRGGTERRGGRGGQGVFHEATPDRGRKCDQPKRFTPVASSLASGLGALADQAQLGDFLAPLRQVAGTTDTQEGGEVEHLAAIVHHFLVEIGDQLVGAQALAFGDFPEDVPELVLQAQGGHHPADAQGTRARFIEDRIGFHIEFAHARGSPVSQWLMRVPSASRKRASHAGCAGQAGAVTR

SEQ ID NO: 24401 - protein, 771 aa, Pseudomonas aeruginosa
TVTTRVPGSDADLVQGPPDAFPERALHAFPVAAGGELHGLLNLVGSADFRSAEIGRHQLQRAIALTRRVLALRWRVEFVVAQVVDRAGPGLEHEAGDAGEIHRTVGEQGPEAARQRPAHFQLVAAGLELERQVAVARQAADQFVVEEDPRRLEFLVRPLAPRTVEVDGGVAGIGARMGDEGRSVHRTEERAGRAAADQARDDRQGQRQAAQHAPSLFLWLSAQHNQPGRACHPSKVRFSGRTASGRARHLGQRRRRHQPAHQPLAHRHHAALLEQHAERHQQDQEQRVVEQRRWQRGRRLGAGAPVVETTPRHGDKALATGEQGEHRHMQGEQRQRGGPQARRPVADESALRVGGQRAKAHQQQLGRQQQAVVQQEVPMFGALGEQVVGHQEGRHHQRHQRGQQAASRHHATVAVAAEQPVGQDAAKEFRQAQQRIAVQQAGPGDPVALAGHYQRRRDQVDQPDQRQHLPLVPAAHQPRGDEGKRQVEEHQRRQRPQRRVEGQVIGIPGLQQEDLQDAVDEQFGVAHPVQEEFRVGAAEHFVGVVDDEARGGLVQLGTDSQVAEGQQHQDRQQQGEQVQRIEIGQSLGPEAAGAFAQPAAACVNMGQEEAGKHEEGTGGEEPQAGQFVETRKLLLFRIGMQGVVHHHVQAEQEAQPFQSDETFLGVGRCHASLLCHCNGRSGVDPQAPRQVSPGRPAATNGRSLAPAVEEIHHYPVQPTPQALVQAHPQGTRAPHRQGHLAAVGEVRQQARRRLIGEVRVEGLEIGVEVEA

SEQ ID NO: 24402 - protein, 998 aa, Pseudomonas aeruginosa
EESANTPALLRGLVDAPWSLEHRRRTAADPTGQALVGMGQLQHRQVGLRRADYLQSHRQARRAEADRYADRRQTGQGRADHHLHPAVIGVHRPPGDLPRPRRFCIERKHLGAGQQEEIVTFEQTRQRPIPVAAIQRGAIDLGGAEAEPGLHFPLRLRLEPDAPCGIGVKLAKRALHQPLAMDQPGAPQALQGIVRQARLDVAAQLGEIAQRGFAKLQHALLHRQVAGVVAEPAEPGSAEIAPEVVGEPARIVAQRQRTARIVAGLGGQQPGQVGHAAPHRAFGGQLLDEQFRLRAVRHPSLGRAEAVDVVVGGGVAQRTHHVAAVGHRQHAQRQRHRRPTAAAAGDPRRIVGIAGGAEQRVVGLRAEPELRYVGLADDDRTAALHPLDDDGVVLRHLPGEQRRTQGGRNAGGGGEVLDRLRHAVHPAQPFAARQLPVALVGLGEQAAFRLQRDDGVDPRVEPFDLRQVGLHDLAAGQFASADRRGQRQRVKRDDFLVAVASMAGGAHSQTPCRLAQGRFTGARGGRRALPQIEGGEQPEEGRAEHVERRRHWRAADLGEPGDDERSETAEQHHRQVIRHRQAGGTHPHRKLLGHRGRRRAEEAADRRAQQQLHQQQAPQARRRGDPGEQRIDHEHEGQGRDQQHRAPPDPVGESPSQRDHQGHQRHRSHLHHEHLVQRQAQPIVGEGRHIHQHPVEGHRADHRQAHAHQHAAPVFAQHAEQPLALAGLPDGFEEGLGLAHVAADPQSHRTDQQTEQERHPPAPALQGLGVQAMGDQRAHPRTGEHRQALAEQLPGTVETAPVRRRAFHQESRGAGVLAAGGETLQHSRDHDQQRCADADRRVGRGEGDHRDGQRHQQDDQLHRRLASPAVGIQAEQDPTDRTHEETDTEGGQGHQQRGVLVAGREEQPGDQAGKEAVDDEVVPLQGVADHGSRHLAGTRGTARASVHGNLLVTGGMPARLMPRRYWRQSVEGRTPRGRPARSRRARPNRPRPGPGCRR

SEQ ID NO: 24403 - protein, 602 aa, Pseudomonas aeruginosa
RSAGPGKPSSVPRGSPGARPPVPACCACRTAHRRESAPAARRRASPRRRPGLPRRAGRSVPGCRRNAASPPGSVPRRAASRCVRRGRRRACARRGSCCSRAPWPRRSATHPCPPAGRAAACRRPGGGRRPRRCGRSLRALRSPSRAGIRRPARRCVAPRSPVRDGRGCPGAGYAGRRRPPRARPRCVDVEPCRLSSGRIALRSCWREARTQGRPGVVTAKRGTRRRTTEGGSTGWNPRPAPPSAGTSELFRRHFAEVQHGEHRYLGSDRGNIGHLLQGLELLFQVEVEQLQQHRLQGRHLDQPFALAGDQHVGLQAALLAVQVEGEVELLDPRLADPQVVEAGHVQAALHGGLGEARGFEEVVLHSLVAQGQAAVQGAQRHHDARDALLVDLAAETIEALHLGHLRAFHGNEADPRVIRLQLPFRRRQQRAEEQQQDTQYNRHSTSGFGPAPSLAPRPDMRRRSVRQPVRLGHEPASLARAQPGGRLRTAEAAGGHPAAGFVVEEAADRHVLLGIGPAIVRGVPHHVAAGAVLLGRIGADDGGKGRQVDAVLPGPREGGEQPQDEQEEQGMATDHGRASPANAACARRRNSLWRKRPSRSSA

SEQ ID NO: 24404 - protein, 531 aa, Pseudomonas aeruginosa
PELAQQSRAAATRGAGPRRPRHDPDRHYPRTRRRTPPEGRAPERRPRPARGPGPALPRIQRRVRRQARRRRRRPRPRRLRPSLRAHRRPRPRQRRPGGHHPAARPSRRRTPRALLQRRGVPPLRPRRPARPGPGDRPHLRRSRIPQRRHHRGTLGRTRRGPQRGRLPLPDGLRQHSHARRRYAGQGGDAAAARTLPVHRLPAGRAEEPAADAGRPGKPHRRAAAAAQGLHAPGRQDLRRALLGPGFPGRRRVHPAQARRTLPALRPPLQGSGLMARLRLLLRSARLLGLVALGLGLAAWVSLRERLPGADVTPLRQRLTRWWLARLCAALPFEVRVSGEAPRQPMLWVANHVSWTDIPLLGALAPLTFLSKAEVRAWPLAGWLAEKAGTLYIRRGSGDSRLINQRLAEQLHRGRNLLIFPEGTTTNGESLRTFHGRLMASALEAGVAVQPVAISYRRDGVPDTQAPFIGDDDLLSHLGRLLRGERGSVHIQLLEPIPSQGLDRAELARQAQQAVRLALFGTAAPTQTRRAA

SEQ ID NO: 24405 - protein, 198 aa, Pseudomonas aeruginosa
RIMPLANGSKACSAVRLAASRKPSWPAICTARVEVGEKSSASSTRRYSSSGAPAARSTGIFALRTTRSRVVPMNRSRSGVCRCAPITSRSAPISSATALITTTGSPTRTIALDSTPRRSFRACPFTSSRLAMASRCGAISTGGWSSSSTFSTVSSAFLALASAAARMTASSEREDRSVATRIRFIFHLHWQSVERRPH

SEQ ID NO: 24406 - protein, 166 aa, Pseudomonas aeruginosa
CASSGCFGLKQLIGDSAGRANGRCARLSAGSGRKPGVAGRRRGNPRSGHRSAGPVLPRSRPAGAVATASATYRPALRARPRTRGSCPTSPGPPSAARCAPGAPAAARRCAGCRRPARRTAAAVRRRSRSSRAPGSGRRTRPAGRRRNAGAPAGSAAWPHAPVGGCR

SEQ ID NO: 24407 - protein, 176 aa, Pseudomonas aeruginosa
RSRRTGCRAVGPVAGRRGGDARGSSCGLAYPRDGTVVSIIVISPVDSDYRRNRSPYRPTPIYSSSQPDMDGQRTTAMPLDIDEIIKALSHPVRRDMLRWLKEPEKYFVEQDHPFEIGVCAGKFDQRTGLSQSTVSVHLATLQRAGLVTSRRVGQWNFFKRNEETIQAFLDQLGDEL

SEQ ID NO: 24408 - protein, 404 aa, Pseudomonas aeruginosa
AALASTPPPRSPGARPMPASLLVLALSAFAIGTTEFVIMGLLPQVAGDLRVSIPSAGWLISGYAFAVAFGAPLMAMATARLERKKALLALMGIFIVGNLLCAVAANYGLLMLARIVTALCHGAFFGIGSVVAASLVAPNRSASAVALMFTGLTLANVLGVPLGTALGQEAGWRATFWVVTLIGVVAFVGLARVLPNDREEEKVDLRQEMSALKNPSLWLALGTTVLFAASMFALFTYVAPLLGEVTGVSPRGVTWTLLLIGVGLTVGNVIGGRLADWRLGTTMAAVFAAMALVSALFSWTSQALLPAEITLFFWAAAAFAAVPALQVNVVRVGHAAPNLVATLNIGAFNVGNALGAWVGGSVIDHGLGLTRVPLAAAALAALALLATLIAFSGNGRAQAQPVLD

SEQ ID NO: 24409 - protein, 362 aa, Pseudomonas aeruginosa
SPVRLFPSGGCSMATLFDPIVLGDLELPNRIVMAPLTRCRADEGRVPNALMAEYYAQRAGAGLILSEATAVTPMGVGYPDTPGIWSDDQVRGWSNVTKAVHAAGGRIFLQLWHVGRISDPLYLNGELPVAPSAIAAEGHVSLVRPKRPYVTPRALDTEEIADIVEAYRQGAERAKAAGFDGVEIHGANGYLLDQFLQDSTNKRTDRYGGSIENRARLLLEVTDAAISVWGAQRVGVHLAPRADSHDMGDSNRLETFSHVARELGKRGIAFICAREAQADDSIGVALKKAFGGPYIANEKFTLDSANAILAKGDADAVAFGVPFIANPDLVERLRQGAELNPPRPETFYTGGTEGYLDYPTLA

SEQ ID NO: 24410 - protein, 220 aa, Pseudomonas aeruginosa
RVFRVPTTTSLAIAPVTRPTVACQLSGCTPSGASSGVRRWLTLASAEWPMSPCTGLPSRVMLFRPPITRLTRMITLPARTTKPRRRDQVCSSRLLRCGTWYSGSSMTNGEASPRIKVCLSNSPVRIATTMPSRYREKITSAPPWPKKAPANTAKIARRAPQDMNGAIMMVISRSRCASRVRAPMIDGTLQPKPTISGTNDLPGRPSACIRRSMTKAARAM

SEQ ID NO: 24411 - protein, 170 aa, Pseudomonas aeruginosa
SNKISFPNERSAGFVFLINRPRPHSPALFRSTRRGPTMAGETSLRTLLRTLTPELNPGDYVFCTCAAGALPNGAEPLASFREREGLTLVLERRQAERLGLPYEYVAAWITLTVHSSLAAVGLTAAFATTLAEAGISCNVMAGYFHDHLFVARDEGRRALAVLQRLAAEAH

SEQ ID NO: 24412 - protein, 297 aa, Pseudomonas aeruginosa
HVAELSQRHPGGCRPDHRHRRAECLRPRAEPAPRASPLGGRALRVLRRGAGQPRRVRPGQAAAGKPDAAGHRPLGRDRLPDLVRAQGAASRVAPGRPRQRRGNRATLAQGGASGGTGGHPAQPPRLSRYRTSDRFARRPAGRAGRLCPRRGQRLADVVLRPRPRRGMAGPLAGAPGHLAPARPDGGGHDAGHGRATAVPGITQFPSSRANPRAARQSRENAAVFAGELAEARRSAPPPAFAPTVAAWICPDTGAMIRSSRHWEPRLRVAPGALSGALRRTSPRGSRTGSRTGIGPAP

SEQ ID NO: 24413 - protein, 156 aa, Pseudomonas aeruginosa
PWPRPARATATSSTSPAWTARCVAAGNWKRTCATPCSATSCTSSTSRRWTTATTAWSASRRCCAGNIRCTASSRRTCSSRWRNRTAASSASASGCSTRPAGSCANGTTRASTTCAWRSIFPPCSSTTTPCHGWSATCCRSTACRRAAWSWKSPKPA

SEQ ID NO: 24414 - protein, 139 aa, Pseudomonas aeruginosa
ARPPAANGPDQNRRLNSQPANSALPRQSNAAPAAWRRSCTARSSSPWLERMKGCASPGLPSRWRVGAALLARCRSSASSRAARRTRFHSRSSSSPLPSLSKRASSPWKSPFHSRITAPCARSASSPWRPPPLLRNSPSA

SEQ ID NO: 24415 - protein, 395 aa, Pseudomonas aeruginosa
TWSTACTKATWPAPSACNWASTPTMATEVGTMLRRHVIGLGSLLLGALSFGGWSFSRLGSQPLVLSARDDADGQHYAVGYRLDGKCQFATRVAQRCHDIVQHPSLPLALFVARRPGTESYLIDLNDGCLLQTLVSQKDRHFYGHGVFHQSGEWLYATENDTTDPGRGVLGVYRFDGERLQHSGEISTHGLGPHQVSWMPDGETLVVANGGIRTEAESRVEMNLDAMEPSLVLMRRDGNLLSKETLAQQMNSVRHLAIGRDGTIVAGQQFMGDAHEHADLLAIKRPGRPFEAFPVAEEQRLAMAQYTASVAIHDDLRLVALTAPRGNRFFIWDLDSGAVRLDAPLPDCAGVGAVKNGFVVTSGQGRCRFYDCQGERIAAQPLELPSGLWDNHLHLA

SEQ ID NO: 24416 - protein, 336 aa, Pseudomonas aeruginosa
KLHVMCRIRPETGRSRHTRDQDYVAPPHVDHARRGDRRGGDSRRLQGLLHPSADRPFQRTETADQRDRQPGRKASLAEPPASHRQPQGIPGRDPHRRSLRHGTRRTVPFRRPGEAGPTADPVGKRRRGSHPAHCRGRSRPGQGRVPARPRTDRQQGHLEKRIRSSRRAVGQDQRHRRRAEGGAGEEARARALRRDHRHPPGGRRRLRLARDADRHLAGPFHPAPGFPPARAGLPPAQPRPAGEGPGRRLPRPGVRRRDRRHQPQGRQRDPQPAGPRCPGEPGRQAAAGHVRQPRGDVAWRGTTRRGAGDGDHLHPLRRLDLRRRAEEGRAGPGVEG

SEQ ID NO: 24417 - protein, 1019 aa, Pseudomonas aeruginosa
NMAFTDPFIRRPVLASVVSLLIVLLGMQAFSKLVIREYPQMENALITVTTLYAGANAETIQGYITQPLQQSLASAEGIDYMTSVSRQNYSTISIYARIGANTDRLVTELLAKSNEVKSQLPPDAEDPVLQKEAADASALMYISFYSEQMNNPQITDYLSRVIQPKLATLPGIAEAEILGNQVFAMRLWLDPVKMAAFGVTAGEINQAVQQYNFLAAAGEVKGQLVVTSVNASTDLKSPQAFAAIPVKTDGDRRVLMGDVARVELGAASYDAISSFNGIPSVYIGIKGTPSANPLDVIKEVRAKMPELEEQLPPNLKVSIAYDATRFIQASIDEVVKTLGEAVLIVIVVVFLFLGAFRSVLIPVVTIPLSMIGVLFFMQAMGYSINLLTLLAMVLAIGLVVDDAIVVVENIHRHIEEGKPPFEAALEGAREIAVPVVSMTITLAAVYAPIGFLTGLTGALFKEFAFTLAGAVIISGIVALTLSPMMCSRLLRHEENPSGLAHRLDLIFEGLKQRYQRALHGTLDTRPVVLVFAVLVLALIPVLLMFTKKELAPEEDQGIVFLMTNSPQTANLDYLNRYTAEFEGIFRSFPEYYSAFQINGYNGVQAGIGGMLLKPWDEREKSQMELLHAVQAKLNEIPGVQIFAFNLPSLPGTGEGLPFQFVLNTANDYESLLQVAQRVKQRASESGKFAFLDLDLAFDKPELVVDIDREKAAQMGVSMQDLGVALASLLGEGEINRFTIDGRSYKVIAQVERPYRDNPGWLGSYYVKSRNGQLVALSTLIETHERARPRQLNQFQQLNSAIISGFPIVSMGEAIETVQQIAREEAPRGFAVDYAGASRQYVQEGSALLVTFGLALAIIFLVLAAQFESFRDPLVIMVTVPLSICGALIPLFLGVSSLNIYTQVGLVTLIGLISKHGILIVEFANQLRHEQGLGRREAIEQAAAIRLRPVLMTTAAMVLGVIPLILATGAGAVSRFDIGIVIATGMSVGTLFTLFVLPCIYTLVARPDAPPGVTQAANAH

SEQ ID NO: 24418 - protein, 374 aa, Pseudomonas aeruginosa
CRRCCTTIPTPRWSGSSAAATRKTWRLYLPAIREQLEYLAGLAISDEQLAFLERIPFLAPDFIRFLGLFRFNPRYVQTGIENDEFFLRLKGPWLHVILFEVPLLAMISEVRNRARYPAATVEQARERLQEKFDWLRREASAEELAGFKMADFGTRRRFSYRVHEAVVSGLKEDFPGCFVGTSNVHLARKLDLKPLGTMAHEWLMAHQQLGPRLIDSQSAALDCWVREYRGLLGIALTDCITTDAFLRDFDLYFAKLFDGLRHDSGDPLLWAEKTIAHYLKLGIDPLTKTLVFSDGLDLPRALKIYRALQGRINVSFGIGTHFTCDLPGVEPMNIVVKMSACNGHPVAKISDTPGKAQCRDPDFIHYLKHVFQVA

SEQ ID NO: 24419 - protein, 279 aa, Pseudomonas aeruginosa
ASSAPGAVEGGMPSPVGKIGTKRGTYQRPEYAGSPEACQSREPFPFLRRSPMRPVLLLCCLFLSATAQAEDCSPQTSVGSWCELPLAALHPTQQNVGLLQVEDDQAKLAGKKPKALERYLRKKEIPVVIGPGGRFYLTDRHHLSSALWRLDPKQGVPVKVIGRLPQASDFWEKMQENHWVWLHDARGAEIPPEALPNALAGLGDDPYRALAGYAEDENAFDKDRQSYFIEFHWARYFGERMHWRPISRATLPDDLKQALHLACEPAARELPGYRQDCPH

SEQ ID NO: 24420 - protein, 331 aa, Pseudomonas aeruginosa
AAILGHSLQLQRSIYDSLHRIRRKRTGISKYVRRCRQGPLPETARGVPSNAIERQGHHHHRRLPGARPGNGRISRRQGRQAGPGRSQPRTSRRSRRCLQGRRRRRSRLRVQRGGRGTGYPHGGPGRQRLRRDQRPGQQRRHPPRRPDHQGQGRPVEQDEPGPMAIGDRRQPHRCVPLHPRSGGEDDRAEERRRDRQHFLDLPRRQHGPGQLLGSQGRGGRGYRGLGEGTGALRHPRGRRGAGLHRDRDDRRDETRGAGEDDRRHPPQAYGQAGGDRPLGGLHLRERLLHRPRSRTGRRPAPVGPGPARKKPRYRGAFSCRPAYQPTPRPMV

SEQ ID NO: 24421 - protein, 406 aa, Pseudomonas aeruginosa
SAGCGCAARRPARRRRRDTRTPSSTEARMKKAGIRRPFSWIARTSVGHRALHNLDHPLREGNADTFLAQRVAGLFVEHEHHVPVVGVLHPDPQGQGNRAFAEIGNHRHRCRVLQNPRIVGHGQENVLRILQIGVVVDADVEDHLAQRLGGVVGHRSVGQRPVGHDDPLVVAATQHGVEDQDRIHGTGHALCLDPVADLERAEQQDQHAAGEVSQAALQGQADGQAGGADGGDEAGGLDADHGSHADHQQDLQDDAHQAADEALQGAVDAAPGEQAADPAGQGVDQPPADRQGQQRQGDLAAVLQHDRQPGLGLLHQSVVVQFHALPPFLEKTPLPSATETGRACRFLPGRRGATFPGLDTNRRSADEPTLRRQGRTTRERSRRRYSLLRCPGWREVPKNLVNRGSW

SEQ ID NO: 24422 - protein, 139 aa, Pseudomonas aeruginosa
AWWKTARPASTRSPRKPRTAGNPSSACCWPARPTTRRKPPPAWPIAWPATPNCCCCRTAWAASRRSPPACRAAAACSPPAPKARSAMAISAWSSPAGGTPGSAIRATQAPPPGWRSCPRPGSRTAGATTSSNGCGASWP

SEQ ID NO: 24423 - protein, 369 aa, Pseudomonas aeruginosa
TAERVLHRNPHRQPGDPRRQRAALAAGGAADTPPDHPADPRSRGTVAAGHPRGELRPPRPARQRRRDRPPGRRVQHHADPHRGPRAAAQARPRRCPGSGRAGPEPGRGNPPLEPQAGTGSAGAQQDREEAHRFPALPQQHHRLHAFGADRGGRATLRHAVEPGGQPAFRHQPGRCGQPAGVPRLSLAQAVPSAAHPGCREAQRGACRTGHLGADRHATPLRPDLLPADGRHRPRRGDPHRRHHPAAEPGRSDGAIGEDALGRQPRRRHGPRDQQPARRDPAQRAEHQAAPVPGAGEERRAGGRGRSAAGRHQSLPRRPRHPAPAGRHPARRLAGSEDRHPHARLQPPQPPADDRLRTARTARTGGGNRR

SEQ ID NO: 24424 - protein, 408 aa, Pseudomonas aeruginosa
TGSPTCCSSPPAPSPGARAWRRFSGRRRQNRTDGERGLGIETKKRRPKPPFFFIPPSKAARPERTDTRHALGSMLPSLLGLLRTEATQQVDRLVEAGDQFGGLVPTQRRLAGMALGRLYRRKGDELHSHRGSQGQFLRVVAGGGQQAPFGERPTGAGVFAQLSGGQVPTGSREVAQPLQRAFQHQLRLAGAESLDIDGEIAVFGTEHVRRAQLDQADARLHRLAYAADQLARLQSVRGDQVVRRQARGLDDRRVGGGELVVGQLARLHPGQRLALGAVGFAGKPVDLPDIEQDVLVGIVVPDLDQRPGPLDTDAQFLFQLTGQRRAHRLAVLHLAPGKLPQAALVLVFRPPGDQHPAIGATNHGRGDMYSFHGSSPRYCRHAPQAADGHQLPACSRNAASYQARNAGH

SEQ ID NO: 24425 - protein, 218 aa, Pseudomonas aeruginosa
RTSPRKRCLARVTGAAQNAFRVNTPATLEPSAQRMTTTSLRPGRLMPAEAMPSSKPGTGCRVDRGPRPTAMGTRSFTKQWTRCRPRRRDGKRIGAGLAPIRTNAASGRTGRGVGEPGGKLSPAARGSACISCRNRTGKARCGRSSARCAQARAARPEPGPREALLPRRPRPAPSREPRRAGTACAWPVPPPRDAGGPPLRPGLRDGPGRGTARGWCRA

SEQ ID NO: 24426 - protein, 141 aa, Pseudomonas aeruginosa
SPCARSAGGSGSPPRRDRRSGGTRRPRYRRCRSCRPACCTGGSSSGRWWRPGSGSRPGSAGLPSPRWPGAGPRTGDGQAWCGRCARRSGGSGRPGRCTRRCGGTGCARAALRRRGSAGSGCAPSRGSRLRRAGRSGSAGPR

SEQ ID NO: 24427 - protein, 384 aa, Pseudomonas aeruginosa
VDWLMCLSASSCSSTSSCCSRVSRRAASSSSVAMNDGGAYALPSSGSSTPPWPTLREKSNSSGSTSASSVRRSPRASSRTRRACSSPRCTLSASICRCASSRALLISALCACSAASTSMPATGAGARNSQAPMKPPANRLAPTTQAPASISNRGCRWTERAAPWCRLRKMMCMTYPSYGPAVAKRFLLPFRLSNPQASRHVFSSLARPGIDPVAAPGQAAADAVRRSPAHLPPAATAGKPVATGGAPVLPCGFVARRLPAADRHRWPLGHTPALSAAAPAAAAAGFRRIRELSENPFQGATHHVHTTCGTSQLDPVCRRGGKPSRIRRDRRQSTPAGSARAVGKPRREKPARINPEIKRGHPEVASKYGKESFPTLPPPGAYRK

SEQ ID NO: 24428 - protein, 270 aa, Pseudomonas aeruginosa
FTDCCSRWAGAAAWVALPCTVLSTTFTGFSRRAPRPVATTVTCSSSRMSASITVPTFTVACSEANCSMMLPTSEYSPRDRSGPAVMFTRMPRAPCRLTSSSSGLRIAASVASRARFGPLAQPVPIIAMPISLMTVFTSAKSTLIMPGRLMMSEIPRTAPASTSSALAKAASRLASLPRMVSSFSFGMVISESTLSASARMPSSAICMRLRPSNGNGRVTTATVRMPISFATSAMIGAAPVPVPPPMPVVMKTMSAPSSTSEMRSRSSRAA

SEQ ID NO: 24429 - protein, 110 aa, Pseudomonas aeruginosa
GMPAHSSRPCMLPSSPPRPWRMMKARSIFSSTRRCSRSSPTSMPKASTPAASRDCRTIAPDFSDTSRSALLPPNSTATRPNALGSWVPFSRLSRQRFMRPSLPCRRTAGS

SEQ ID NO: 24430 - protein, 114 aa, Pseudomonas aeruginosa
WRIAGRISSGTCARASGNSLFSGSAPRLPPSTSRLTRRPVSGARACASRNSSPRTGLPVVRRLSLAGKVSGNASQTRLAIGARLRLAVPATAFCSWITSGTPLRRAARPPGPVT

SEQ ID NO: 24431 - protein, 428 aa, Pseudomonas aeruginosa
PRAWNSRAQASAGNTCPPVPPAMIRTLPFIGKVLFVELIFLATQVGSPFPFDAQQHPQTGTADHQRTAAVAEERQGQALGRQQADVHPDVDQELADPEEGQAVGHVGGEELLGLLGPDADVQRAQADEHEQGDGRQGADDAQLLCKHGEDEIGVRLRQVELLLDAVAQSHAQPAAAAEGDQRLAQLIAGAELVGPGVGEVGQACHPVGLGLDQQDHRADRQQHHQAEAEQPHPAEEQHGRGSAHHYHGGAEVRLAQQQAGHRQQHHEGLEEAHPAFPDLLLAADQVAGHEDHHADLGDLRRLDVEQAEADPAHRAVHLAADTGGDHQHQQAEGDQQQLPAPTLPGGHRDHHGQAAGNQADHQVDQVTDGEIQRVARLRRCHLGRRGSHHHQGRGRAAPGNPPAAGSPGRCRAGSTAATGRGATPTASR

SEQ ID NO: 24432 - protein, 466 aa, Pseudomonas aeruginosa
LLYGFGEQASAFFEVLEHVQARAGRRQQHRIAFAGQLGGLPDCFVQRCDAHQRYRVAQCLGNQPGVTAKQYHRPAEARDRLAQVMEIGALAVSAGEQHQLAVDVGTQPLDRRQGGADVGGLGIVVVAHALPLAYPLAAMSQAGKRLQRAEHGVERQADRMAQRQRGERVGIVVGATDLQFANRQQLVELERQPLLAVFLDQAESLEVRLVQAERPARHGIGDQRSGQGIGAIHHDLAGTAEDPVLGQVVVSHAVVAIHMVFADVQHGRHLGVEAIAGFQLEARQLQHVQLDVVGQQVERRGAEVAADGDTLVRGHRHFAHQGGHGALRVGTGDGDDRGLRLAGEEIDVTGDAHTFRGGLYQRGGAQRQAGADVEFAGGAEELGVEFAATHFHLRILGTQGGQLRRVLSGIDNGERQAAARQVAHQGHAALAEADNDAEVVGGDQAHALFVLNAASRWRGRSAPGSR

SEQ ID NO: 24433 - protein, 404 aa, Pseudomonas aeruginosa
RGVGVVAVVYHTQPAGGQLRYRAALDRLQRLQPGDDPIQRHAQCMGGSGGSQGIGDIVPPQQVELDLRFTRYALQPEAHAATRIALQIGGAEIGLGPVEGESQQRTAAGTGLPGVEGLVVQVQHGGAVGGQPFEYLALRLDDLLRSAELADMGGSGIGDDRHVRAGQLNRVGDLADARGAQFDHCATVLRRQLQQGQRYAEVVVQIATGSQHRLGIAGLGTQDAGEHLLDRGLAAGARHGRQRAGELAPVQRAQSPQGRTGIAHQQLRQGRVGDFALHQRSHRALGGNLGEIVVAVETRPTQGNEQLAGPDGATVGGNRRKDGVLADQAGVQRDRQLAEAKRLKHAAPPRRPGRARPARCRRTDGVRRRSPDNPRDPCQPGAPRHPPQRKRSDGRSPHRATAGR

SEQ ID NO: 24434 - protein, 278 aa, Pseudomonas aeruginosa
GSHGRSRAGRRFARRWRRPSPAAGRRSRRTAMGRGRPGNNSVSWRHHPDLGRVGNAHAQLFHRQAFDAAMGGPGALLENQPAPLGLRLVAHAQLGIQRVEQLPVPVGAVGHGNRREQQTYIKQQHEEAAGRQALDEETAHLSFSATRMTALRERGLALSSSSEAYCGLPSSFRRGSKTLERIGRSRGRLSASPLACLRMNSLTMRSSREWKLITTSRPPTASDSSAASRPRSRSPSSLFTWMRRPWNARVAGFLPFSQAGLATVITSARSAVRSNGRS

SEQ ID NO: 24435 - protein, 147 aa, Pseudomonas aeruginosa
RRCTMARAIRLAKRSSPYSLKTRAISSSVALAMNSAALMPWPGFMRMSSGPSLRKLKPRSGSSSCGDDTPRSSRTPSTRPSRPRARTSSPSSANERCTMTKRPSSAANAFPVWMAWGSLSNPSRRPPAPSFSSKARLWPPLPKVPSR

SEQ ID NO: 24436 - protein, 150 aa, Pseudomonas aeruginosa
SPPSMSTSRYNWRNRSPTCCNCARAKAAPSACRAPSAARSPPSRRAARTSTSCSSPPPRSRPARSSRPWPSSTPATFRSTPLRTSTPGPTTRPRTRISTASASARPRGCSTPATRPASRSPPNGPRPTAAWAASTPWASTPTASLRVCLN

SEQ ID NO: 24437 - protein, 242 aa, Pseudomonas aeruginosa
RTAGDLALLPARPQQRRLDHHQAEDPDAQRPQRALVADQGGHRERHRLHDGPGQPAGSRPGCPRRPGRRRGAEDRQAVRIHKLKNSERKKGDPSIAFFIARRLLDHLQGWPATGTRRLIGRSAIVIARLVVHRTRLLQIEDHALAVFPGVDGHYRQRWNVQALRHAAETPLEADRLVVHVQMPHGRGRDIEHDLPIAGITRRHLYPGELCVHQDMWRAIVVDDPFIERADQIGTAGIHLHVP

SEQ ID NO: 24438 - protein, 148 aa, Pseudomonas aeruginosa
AIPLNLQFLGLLSGVRVAGTLVHLQLAIHIATQRVLRQHAFYSGLDDALRGLGDQLLEVDRLDAAREAGVVVVHLVGGLGTGHTHLLGVDDDDVVAGVNVRSVLRLVLATQAAGNFGRQTTQGLAGSVDDEPVALYSFRFRGIGFHSL

SEQ ID NO: 24439 - protein, 164 aa, Pseudomonas aeruginosa
PGASRTASRTPSPRSPGPRPPGSISWIPPKCIRCRPAPRPTPAPSASSATGSAAAATAPTGSSPARSPAPATASAMCATATSSSTASTSSPPSMPAWSACRQTGWTSTSCTGRSGGPTSSASSATSTRKRASHRWRKPWKCSTSRCAPARSATSACPTRRPGAP

SEQ ID NO: 24440 - protein, 450 aa, Pseudomonas aeruginosa
YPESALQIGLNRYSREGMKMATPKEVRIDFSPSTKLEIFKRVNGRCSFPRCTNVTVGPFLGFDGAINMGVACHIYSAAEDGPRGRGGQTDAFIGSEKNGIWCCSAHASLIDKKKGNEFPSTVLFAWKELAEARIRKLLDDVPSPLGWVDAIEFSEYENLINPPRITLSRNTLIFGRNCSGKTSLMEAAASVSNSIYAENFCGTYKDGAYLKYKVQIKYSTVDTLNKTLELEMSNGSLVRREGKTPYLLPPGDLEVILCSERETRRRAHEDDVDFLMRYLNIDKAALFYLAEMGGGELLPGDIKFEQAVDRKYDEFDEEILTDICKPDGEPYMNLLFRSRGGQYWVSLARLATSEYGLLLVSFAVTKARETCKQKLTLFLVDGLIYNFDSYNFEKLLGVLSKSDFQSALVLPPYQESNILDKDEGVVALKELDYLVQWQLRVLERSEWGEC

SEQ ID NO: 24441 - protein, 194 aa, Pseudomonas aeruginosa
VASPPPARSGTTGRGVAHPTPSAGTTAGIHPAEAEAIGQRVFHRPAPGFAANQVEALGVGVGRFQVECGGGELVAQCQDREDSLDAAGGAQEVAGGGFGRADGEPAASAEHGLDGGQFALVAYLGGGGVGIQVLHRGRFHAGLAQRLLHGPAGTAAIFRPGGHVVGVGAGAVAHQLGDGPGAARQGVLQFLDDQ

SEQ ID NO: 24442 - protein, 261 aa, Pseudomonas aeruginosa
AGAFAHDEAVAGLVEGARGAFGAVVEIAGQGARGGEAGQADPVDGRFRAAAERHVDLSRADHPRRVADACTPAAQAVTGAPSGPLKPWRIDTWAAAMLQRKDGMVKGDRRRGPLPSVVRTASAMAWKPPTPEAMTVAVRSCASALCGAQPAWARASCAAARAKRMKRSILRCSLAASSRSGSKPACGSWARSGTWPPMLMGRSPISSAGSVAMPDCPASRRCHMGSTPQPSGLTAPMPVTTIRLLMRVRVLLFRWNSSQWT

SEQ ID NO: 24443 - protein, 563 aa, Pseudomonas aeruginosa
TRWWRRACSNASPTASARCAISTCPRPRARIFASCSWLSSPGAIATTQRKGRACSSSSEQAGGRCARSWRLSPMAERYRWSNAPCRPGLPPARKCASAWRPCRSGASYRLDERAPWRPPPGRGDGRGVRGSVPCSWPSFAVVVGKNAIVEACAWRWQVRLASRSATPRALGLLECAASFAEVCMRILADENIPVVDAFFADQGSIRRLPGRAIDRAALAEVDVLLVRSVTEVSRAALAGSPVRFVGTCTIGTDHLDLDYFAEAGIAWSSAPGCNARGVVDYVLGCLLAMAEVRGADLAERTYGVVGAGQVGGRLVEVLRGLGWKVLVCDPPRQAREPDGEFVSLERLLAEADVISLHTPLNRDGEHPTRHLLDEPRLAALRPGTWLVNASRGAVVDNQALRRLLEGGADLEVALDVWEGEPQADPELAAHCLIATPHIAGYSLEGKLRGTAQIYQAYCAWRGIAERVSLQDVLPETWLAGLQLNPGCDPAWALATLCRAVYDPRSDDAAFRRSLTGDSATRRAAFDALRKHYPPRREITGLRVATGGRAELQRVVRALGAQLV

SEQ ID NO: 24444 - protein, 227 aa, Pseudomonas aeruginosa
TCAASNSPSTPTTPRRWRCIASSASRPKERCATTRCGMGASWMCTAWRACGGSRGGWGNEGRARREAADRRDLLARRASVPRQVRPGLRAYGDSGQAARLLSGRRGRVTKDPATDSGLNVRLVAAFAGWKGIPWLCWAHSDLSPRLVLHADRVEFRVIRTRSKPYSSISRVDYRKWHYTENIVLEFTDSLTTFIGNTMNPAMARQAIRYLQEKGCPLSERASNLAMA

SEQ ID NO: 24445 - protein, 120 aa, Pseudomonas aeruginosa
YLCAIRASSPRRYSPALDPRVSRKPVVQDARDLEGTMTRQSVLATGPEASDWWCFGSGDEPARESFSAGGRSLAASRKPVGAQSGMAVAEQANRAQASGQDAAPGLRTFDLLPGNPPKNP

SEQ ID NO: 24446 - protein, 143 aa, Pseudomonas aeruginosa
TRSQPMRRIFIAPLLASLSLGGCIQMDTLPEVYARSQWKGRSAEEAIAFFGTPQNMERTADGSQVVMQWYTDTSYSRYEVVGSSSEMQGNVMVNTNYWDTVNHPNRCIISVTVDKSKRITQFEADDGELLLSHGCAGIKYGPP

SEQ ID NO: 24447 - protein, 138 aa, Pseudomonas aeruginosa
SRPSPRTAAALPRRPRSGRTRCRRSRAACRRSAAPGSAPASARWPGAAVWRRSGTGRTRQRSAGRSRPSGRAAGRSAPRRGSRRWPQSVAGWPGPARYSSRTSCAPPCAWERRAPFPLFRPLRHEDGRRVGPAGSGLR

SEQ ID NO: 24448 - protein, 223 aa, Pseudomonas aeruginosa
HARRKLRLLETTRMTGRIIVADDHPLFREGMLSILQRLLPEARIEEAGDLAGVLRLAGEGEQPDSLILDLRFPGLTRIEMLADLRRQFPRTTLIVVSMVDDPQLIGEVMNAGADGFLGKSIAPEELGQAILAIRAGEVLVRYEPSGLLPLQPSPGLEGLTERQLDVLRLLAQGKSNKEIGRALDISHYTVRIHVSSLLRALDVPSRTAAAVKYRALLGQGDAE

SEQ ID NO: 24449 - protein, 207 aa, Pseudomonas aeruginosa
  UNSURE (18): Identity of amino acid at the above locations are unknown.
CWQRWRTWRVRPRWPRAXSSMQMPRRREVTATWSAARYSSALRSPAKPGPAITHRLSSSRCWRRRAASVGRAISMARSMRPAPSSAFRSAQCRLLQRISMRGAAWRRWARIAGSTSGSSCSGMFSWKVRASRRGSNVWQRFMLRCRPARASWMPGASRSASGVGATPRPWRTNSGSPSWSRRRARAWLTADWLRCRRPAARVRLRSR

SEQ ID NO: 24450 - protein, 426 aa, Pseudomonas aeruginosa
PSIAPRASRPKWRSSSTTACRARSIRCATRCTRLRVSSATATTRPWRTKACAWPTWRSPVASAGCSGTRARPRAPRPCWPDAEDDRLGGLRLALHPGAECAQALDEHRRVGDLAVQHGLEIFQGWRLSGVPRAKQRQVMLQGLRPDAFRLPAKDVAGADQLLRRFSLQAALLLRGRAFQASRIVFQHLRIVAVEGQGDGFRRTQGRQVAGQVFAPQAAAAVLEPIAPAIAVGRIAGLVQVADIEIDLADFRVARLQCQARGFQLRGQFGAGRVAQDQGQVEVGAPRDGLAAGDAAVQVDAVHGPLERRPGQGSAQVVEQGAKGRLRFDAWRQGDEAIGHVHADSLATRRPRVDQPALRNSSALRPAAGSTSGNSGGFSRRSTKCSDGASRAVSSRRKSGPMAGSLIQASRVPPGTSSSGRRRRILR

SEQ ID NO: 24451 - protein, 238 aa, Pseudomonas aeruginosa
KRGGFYPLRDGQSAPSLQSGVAGAGAALAGPPSWIISRLCGEDSAMPSLRKRSRMVKSRSLRAPATERGLLTKPLALSTRPLLARSLNVTEGAGASRIAGCSAKACKSSSRTFIASVSSGRVRFTPTTPRALPMVTLRTVWEMNCEFGTITVERSPIWISVARTLIRRISPSTPPRLTQSQTFTGRSVSRIRPEMKFCTMACRPKPMPTERALTTQVRLVRLMRRVDITSIARSTKPR

SEQ ID NO: 24452 - protein, 428 aa, Pseudomonas aeruginosa
RDMDFGHIDPFLAAAAVLPRPRAGQNPSTKNKKPARSLHAERLQRRSSSALRPVGTGRRQAATLFRNAQPGRHRAGPGEVAEPWRGDRAEGFRPRAAAAHPRRRLPGLPPGRLGPLDRRRPQRRRGVHHLPRPPPAPRRADPHGADGRTGLLQLRHRGADHRRHLAGHLQLRPGRADRPGTYAPGRPQRLRPLPSAGPSRRWRLHGRLLLPQQCRHRHPGVPRPGCPARGDPRCRLSPWQRHPGYLLPPRRCAVRLDPWRSAGRIPVLPRLRRRARRRRRRGLQPQLSAGPWQRLGPLVGGARRRLRADRRLRPGCPGDFPWRGHLQGRPDLPVQAGFAGLPADGRAHRPAGPADPVHHGRRLCGGSHRHQRGQRAAGLRRRGPLRSEACNRLASCWPASRWPFPPGWFRPRRKYGSTTGSTTSPRTP

SEQ ID NO: 24453 - protein, 130 aa, Pseudomonas aeruginosa
TSSPARRWSSPASPWSAASSGCDACCDAERVRPAQQQAGEDQAEPGERQRRLQAAGEMRAERRQQRAEQLAEGETGGQLAGVALRRMRRQFAGVLHHQLHAGEERQAGQHYPQGQSADPRQQAGEHAEGL

SEQ ID NO: 24454 - protein, 111 aa, Pseudomonas aeruginosa
RPGSVSCKGGNRRWLDSGQGPGPVSRSKVVSKDGVERAESGTPVYSFLGRPDLSGRPILLPLDKGPVMKLWLQNLAWQLGVALGLIEPPRMQPIPVENDEQRRRLAARQRR

SEQ ID NO: 24455 - protein, 139 aa, Pseudomonas aeruginosa
VRPGVPGRVPPGGTDAPRRRPGRCFPAGPGSFRRGSADGSRGPARRARHCRARHGRRGSRRGSGRVRNRPWRAPGQGWKGAACSTSTISGRSAGAPRISSRRCSRSRARSAAQPKPRAMARKSGVYISTPSGVISRRSM

SEQ ID NO: 24456 - protein, 461 aa, Pseudomonas aeruginosa
SRRRRCPPRSASRRGRRRWPCCRDGSSPTRRGSRGGRSGYRSAGRCRCRGARRRRRHRGRRVRRGTGHGAGASWWRCRRSGAFHCRPGAGGDSCPRGGLTVVVVVLGVGRILFTAGSESNRWLQIISSEISKLTAKRLDFAAEPGRRPLPRPAVRNPRPQTGVAVSNALPDLRLLRIFAAVVRHQGFAAAQQELNLSTSAISTYMSQLENQLGIVLCHRGRGGFSLTSKGELFHQETLRILGELEGFERYALALKGELRGTLNLGVLDSTVSDPALPLAEVIGAFSREHPAVHLHLLVQSPYELQLSVLENRQDLAIGAFSSRMNGLVYQPLYREQHWLYCSDRHPLFDGRRIPADLITQQRMVGRGYWSQAELARHGFKHSAGTVESMEAQLILILSGGYIGYLPEHYAHPWVEQGRLRALLPATFGYQAPFSLILRRGRSREPLIQAFRDQLRTQMSLA

SEQ ID NO: 24457 - protein, 191 aa, Pseudomonas aeruginosa
RCSAHSSTTPTFSSSTNRATLSTGRHALCCGRAWRHGTAACCWSAMTANCWRACSGSSSCRPSACAAMAAAIPSTRRAGRRRARPPNVAWTSVVWSASGRPWPCANSSSARSGARPAAGAKARRRTRRRSCSVGSGNVARSAPARCATPTRRSASVSTARCARLPGRSRRRRRCCSIRPMPNWRHSAGSSS

SEQ ID NO: 24458 - protein, 343 aa, Pseudomonas aeruginosa
SGHRRALPTGPRPVPAGRRGLGAGRRRRRGPGLHRPEPGACRDALRRTRAARPGYRPTPARSCAGDLAAPERRCQRAEPAGLRLLSTLWVPPDRPLRDRLGGAAVPAAAHEPVGGRGTSPCGARCRATSGKVFPGQMLSTASIRLRQVKRCGAGLPDSSVHQNEAQESHERHPTPVFPRRPCQPAATGAGTIAQLRRRPGRGRSRPPPGGARLQPIARAETPGAAAALAAAVPQRPAVHDAVRLAGHRAARLLGGQCGNPPGGGGQRADRFRPGGQGGQRAGRHPRHAFAACPGPARRPAPGAGRRTPGTGRRGAAGLRRPGAGRPAAVRNEELPCRRVGPDR

SEQ ID NO: 24459 - protein, 302 aa, Pseudomonas aeruginosa
VGAGGEGLRRGGHRRAARRPPLHGLFRHPGDQRPGARSGGRHRRGYRTGPDRYAVARSPHPGHSAAATDRQLQSLAGPGDPAAGRRHFRPRHPLAGPADGGHVHAGGGADRLGDSRGTAGDHDGDPRPRRTAHGPAQRHRQPPAGGGDAGFGDGDLLGQDRHPDPQRDDRAAYRHRRPGNRGQRRRLRPPGWFQPQRRRPRSRRTRRSAGDRSRGAVVQRGAPAPGGRGMATGGRPHRRRAAQPRPQAGPRSAGAGGGTATQRCDSVRVRASLHGHPAPRPRRPGDGLPEGRAGAHPRHVRG

SEQ ID NO: 24460 - protein, 137 aa, Pseudomonas aeruginosa
TGGRLGAAAGPGLLAAPGHRHRRSRPAPAGHRPTGDAGGAAHAGFRRRGTWLHPAGPGGHHRPSARGSRGRGRRMPGGGYRGEDDHRRPRRHRAGDRRHARDRHRPAGADRRGDRVARRPAPARSAAGRRCVRPRQP

SEQ ID NO: 24461 - protein, 326 aa, Pseudomonas aeruginosa
AQAAPGAGPAGQRRGGGDDRRRGQRCAGAEARRRRRSDGQQGHRGGQGGGRGGPRRRQFRHHRQCRARGKGGLRQPEEIHPLHAADQRWRGADRDRRDPVPVDPADDAGADPLDQHGHLQHPGPGAGLRSGRARPDAASAASAGGAPVVAVLRLAGAAGLAADDGGRPGRVPLGAGAWHRAGERADHGGEQRGGVRDVLPAQQPAYLRFGAQPRGPVRQPPGLAGDRRLRGAATALYLRAAVAGAVRLGRPGPGRVGAGAAGRARPVLRRRTGKVAMSPGPCPAGLTPRGRPLGRGAVPLRVRRAQTSAPRIARPRAVARVAMGRQ

SEQ ID NO: 24462 - protein, 186 aa, Pseudomonas aeruginosa
PGNHGLVGGHPLGSAVQRDSRDHRDDFQQRPGHHHPDPAVQPRQEHRRRRPGGPGGDQRRGRAAAGGHAEPADLAQGQPGGQPDHDPAGQLGDDAADRTQRLRRDHPRPPAQPGERRGADLRGRPAAPGDPHPGPAGEARRLPADPGRPAPVVAVGQRQPGQGRALRRGAGVDPCGQRPVVQRQRL

SEQ ID NO: 24463 - protein, 358 aa, Pseudomonas aeruginosa
RPGGRLPPGRAGVPQGRGADRLGARGRLRAGLAERCARGGTGDPPPAWGEHRRYRRRDPGRIAAPARDAPGDHRGRRAQRSYPDHPLVAARGRTDPAADHWPGGAGDGPVPPPAVGDPDRRHGAGGVPERQLRGDVRARLHPQQPDPGGADHRRRLHRRRRHRGRGEHPPTPGSGRLEGRGGAQGRGGDRLYRDFHQLLADRRVHSPAVHGRDRRPAVPRIRGQRDGGDPDLGARFADPGADAGFALHAGIAACRRAEKGLRRMADRRIRARPALGARAPAADAGRLRLYRAGGGGRLRRDSQGFLPLAGHRLRLRHEPGCRGYLLRRHGRQAPATGRDHRQRPGGAELQPCGGRHRR

SEQ ID NO: 24464 - protein, 470 aa, Pseudomonas aeruginosa
PEPGQRTFLDRPQGPWRARCLGRRVHRPAAPATGEGAGNHALPARGAGHQPQFRTLADPVPVRPAQQRQHPAGALGATPHRAPEAGAGADGCVQRPAGRRQRHRAGHRPGGRGAFRPQRRGCQPDPLRRLRPAPGRRVPDRGQPVQGGPRTRCAPARPRGKPGLVLPALAAERRDGPAVGHRQGRGAALRAAADQPQRHVPGGQPVLQPGCRGVPRRGGAGGAARPGGDRHALDHYRRVPGRGAGLPELAGLATAADPRRADRGVHHPRRALREFRTSADDPLDPALGGDRRGVRALGLGPGLLDHGADRHRAADRHRQEERHPHGRLRHRRPARAGHERGAGDIPGLPDPFPADHDDHPGRAAGRDTPDDRLRHRFRAAPASGHRGGRRAAGEPGADPVQHAGGIPGPGAAVPPARDHDLGRRNRWGDGDMRRNGRGFPGRRRVARMQAGMRPARDAKANRGSGDRCGY

SEQ ID NO: 24465 - protein, 553 aa, Pseudomonas aeruginosa
LPRSTRCSACWPSAAARSCRRRRSPNWSGTSTSIPTPMSWRWRSSACAPSSTVRSRTSCCIPSGAWATSWRTVRWRSRAEVGMSLSTRLAGMFAGAAVVIFALIGTMLYCILDRQTERLQQGEVDVRFNMVSRMLDHPDLAERWPHLQGKLDNLSQEYELIRFWIDSDDPRYHYGRFSEPVQRLIADGAGRYELELPEHRYALTARVGVLPAREGRPRLTYVTAIDSAAFHEARTSTLKWLLGLSALGVLLASLLGHWIARLGLWPVHRLSEEARRISPRQLSQRLQLSPLPAELRELVGAFNGALDRLEQAYVRLESFNADVAHELRTPLTNLIGQTQVALSRERSGEHYEEVLQSNLEELERLRAIVNDMLFLARADQGRLACEREETSLAGEIATTVDFLEVIFDEAGVGIEVRGEARALVERALFQRAVTNLLYNAAQHTAAGGTLRVGVERRGDEVRVAVSNPGVPIADEHRRHLFERFYRVDAARSNSEANHGLGLSIVKAVASMHGGSVFVDSADGWNTFGFTVLSPERRGPGDRLPLGEGDPALS

SEQ ID NO: 24466 - protein, 366 aa, Pseudomonas aeruginosa
LRWARKCSASRRPPDCRNWPRRKPANWLSNKCCSPISCCSRYPMAVQDLLSQDEIDALLHGVDDGLVETEVEATPGSVKSYDLTSQDRIVRGRMPTLEMINERFARYTRISMFNLLRRSADVAVGGVQVMKFGEYVHSLYVPTSLNLVKMKPLRGTALFILDAKLVFKLVDNFFGGDGRHAKIEGREFTPTELRVVRMVLEQAFVDLKEAWQAVLEMNFEYVNSEVNPAMANIVSPSEVVVVSTFHIELDGGGGDLHITMPYSMIEPIREMLDAGFQSDHDDQDERWIKALREDVLDVQVPLGATVVRRQLKLRDILHMQPGDVIPVEMPEHMVMRANGVPAFKVKLGAHKGNLALQILEAVERSR

SEQ ID NO: 24467 - protein, 166 aa, Pseudomonas aeruginosa
PLPPEERRTMADEEKVTTEEQALADEWAAALAEAGDASQDDIDALMAQGGATPVAESSTPRAPMEEFGASPKAPTISGLEGPNLDVILDIPVTISMEVGHTDISIRNLLQLNQGSVIELDRLAGEPLDVLVNGTLIAHGEVVVVNEKFGIRLTDVISPSERIKKLR

SEQ ID NO: 24468 - protein, 305 aa, Pseudomonas aeruginosa
GADPARPDARPDHAVARAQGAGTPAGRRAGHAGIRPAPAGAAEQGPQGQAMTPRISLAGALAALCLLLLAPWPALAADPTSISAITVTTNGQGQQEYSVSLQILLIMTALSFIPAFVMLMTSFTRIIIVFSILRQALGLQSTPSNQVLVGLALFLTMFVMAPVFDKINSQALQPYLNEQIPAQEALQKAEVPLKAFMLAQTRTSDLELFVRLSKRTDIGSPEATPLTILVPAFVTSELKTAFQIGFMIFIPFLIIDLVVSSVLMAMGMMMLSPLIISLPFKIMLFVLVDGWALIIGTLAGSFGTV

SEQ ID NO: 24469 - protein, 385 aa, Pseudomonas aeruginosa
TGAGEIAMAESESGQDKTEEPTEKRRREAREKGQLPRSRELNTLAILMAGAGGLLIYGADLAGALLRLMRSNFELSRETAMNTESMLQLLGASAYLAAQGLWPILLMLLVAAIVGPIALGGWLFSMDALQPKFSRLNPLSGLKRMFSAKSLLELSKALIKFLVVLAVALLVLSADRDALLALAHQPLEQAILHSVRVVGWSAFWMACSLLLIAAVDVPYQIWDNRQKLLMTKQEVRDEYKDSEGKPEVKSKIRQMQREMAQRRMMAAVPEADVVITNPTHFAVALKYDPAGGGAPLLLAKGNDFLALKIREVAQEHKVMVMESPALARAVYYSTELDQEIPAGLYLAVAQVLAYVYQLKQYQAGKGKRPSPLKDLPIPPDLRRDE

SEQ ID NO: 24470 - protein, 322 aa, Pseudomonas aeruginosa
PGWSYAPRCGSLGRYPLGMRALPFMDRTLSDRIFPPVLLLLALAWLLPWMPAHAEAPAEWVALPLSERVVDATHTLDEATRQRLVEKLEALERRRGAQIAVVMLPTTGTLDIEAFSDKLFQAWKLGRKAVDDGLLLVVAKDDRRMRIEVGYGLEGAVPDVVAGRIIRERMAPAFREGDYAGGIEAAVDELIRLVDGETLPAAASSGAPKVSLGQLPAEAWALLVAFIYGSLAGVLLSARALRWPWLLGGALLCWLLGTLAGASGEWMSVLLVAPLCMLVGGATFGALWTVRPAFYLVIGVLVYVALLRLAAHWSTAPSSSPH

SEQ ID NO: 24471 - protein, 389 aa, Pseudomonas aeruginosa
NQDKHWQTGRSPYTNNRYAVIRRFRRLTANNAYGVIRPTDRRPAGPTAVCSGEPGEIRLAPVHEGAERLDRLGRAQSGTEDIAFLGDHPAKLLDKRRFHQALALHYRRGRQVQEAPGRIAGVLQHRGAILQRRIGQAPGRRLLAAEVLAEHQQFRSPGMTEHARQDQARAELRCQAEVDERHLQSRVATDEDQVAMQQQGGADTHRRSVHRGDHRLGEFQQGAHEAADRAVAQGWRLLEEVEDVVAAGEAGIAASDQHYPHSRIGLRLQQRLGHPTVHRAGQRVLLVLAVQAQGQQPRFAFDPNQLAHRHSRDAAQGRGNGCKAPPPRRVRRGAGTGPPGSGYAVRRPGRDAGRSVRRWRVGRRVRPCCAAEQGGDRPRQRATAPPTPG

SEQ ID NO: 24472 - protein, 154 aa, Pseudomonas aeruginosa
RALADDARPTPPTRSPGSGRAPGAATGSAPGVPRARPREVSPRAAPARCRRPSATAVAPASPARSATPRRATRPDAGARQAPGAGRGRRTRRERYSRCGTPAMGPREAGWPANRDAPRHRRSTAAGAARRDSARAAPAPGAGAAHRPASGRLRP

SEQ ID NO: 24473 - protein, 474 aa, Pseudomonas aeruginosa
RGPCSMAVIKQDDLIQSVADALQFISYYHPVDFIQAMHEAYLREESPAARDSMAQILINSRMCATGHRPICQDTGIVTVFVRVGMDVRWDGATMSVDDMINEGVRRAYNLPENVLRASILADPAGARKNTKDNTPAVIHYSIVPGDKVEVDVAAKGGGSENKSKMAMLNPSDSIVDWVLKTVPTMGAGWCPPGMLGIGIGGTAEKAAVMAKEVLMDPIDIHELKARGPQNRIEELRLELFEKVNQLGIGAQGLGGLTTVLDVKIMDYPTHAASLPVCMIPNCAATRHAHFVLDGSGPAELEAPSLDAYPEIVWEAGPSARRVDLDKITPEEVQSWKPGETLLLNGKMLTGRDAAHKRMVDMLNKGETLPVDLKGRFIYYVGPVDPVGDEVVGPAGPTTATRMDKFTRQILEQTGLLGMIGKSERGPIAIEAIKDNKAVYLMAVGGAAYLVAQAIKNPRCWPSPNWAWKRSTSSR

SEQ ID NO: 24474 - protein, 639 aa, Pseudomonas aeruginosa
PGECRRGSCRAVIGGSQSKAGRRGGGQPGLGERAPIGRAPDQDVVVEVIGRVVHHRPSSAVADEQVAAGAALYHPGEVLAAHQLRRVAVDLLRAGQLDPDLAGELGFLDAVDQHRIGRVVLDAGLAPIAGGLQLDDLANPLQHLLAHLAVERPQAQAQHGALGYDVGRLAGLQCADRDHRGLLRIDVARHHALQGHHRARRGEQRIDAQVRHRTVSTDALQGDAQQVLGSHHRSRAEAQVPGLQSRHVVHAEQRIAGKALQQPVGEHRLGAALAFLGGLEDQYQGAVETPRRRQVACRAEQHRGVSVVAAGVHAPAVAAAVAEPRGLDDRQRIHVRPQAEPPRAVALAEDADHAGAADPFVHFVAPAAQAFGDQRGGASLLEAQFGMGVDVLAQATQVVGDLLEPGHDVSMSSHAVSPLAGLRSGLVGGRPGRKAGRAWSQLSAARGEGQRKAVPLGGTQGPRRPPPVRQNCSGGTSRKFSTANTGTSGVIEGILAISFKGLSFSSRSKSSSFSSTGSRVATWTSPSPWRVTSTSAFRRRCWPCRSRVKSSFSTRDWPTRRSSKPAMSRRLSTVASGKREVSKKLSFIRSSRRARPLSRVPSGTTMRATPCLSIWPLRRSKRCTSAIFARFTETKLIRE

SEQ ID NO: 24475 - protein, 374 aa, Pseudomonas aeruginosa
PARKARPGLAANRPPSTARSRVPRPSARARAAACQSSREPSVGRRSSGPSKRCQDMADSSVECVGTGILPRVPALNNGALHPATMSYKHHAPVTGVTPRLPSLSLHNKAERPQPAAPAQGGPGMTQTAITREPVAGRRLKAERLNGARALREAQALRYRVFSAEFDAKLEGAEDGLDRDDYDRHCAHIGVRDLDSGALVATTRLLDHRAAERLGRFYSEEEFHLSGLDALHGPVLEIGRTCVAPEYRNGATIAVLWGELAEVLNEGGYRYLMGCASIPMRDGGMQAKAVMQRLRERYLCTDYLQAEPKNPLPTLDVPENLTAELPPLLKAYMRLGAKICGEPCWDPDFQVADVFILLKRDELCPRYARHFKAAV

SEQ ID NO: 24476 - protein, 144 aa, Pseudomonas aeruginosa
WPAPWKPAWRCSRWRSATAATACPIRRRRSSATTTCSATSAACCAASAAACISSCWNRSPARAWTAPNWPARPSRRCAWRCSALPPLRKPGAPPSRAWAAPPARRTAGRRGPPRPRCRSARGGSRSGPGCRAPSTAAPGGVPRS

SEQ ID NO: 24477 - protein, 160 aa, Pseudomonas aeruginosa
MASCRWRRAPSPPRGTSAWCARSVPTSPRARWTPRRSPTSSRPTARAPSGPRPPASTAWRSTAPTATCSTSSSRTAPTSAPTATAAPSRTARACCWKSPTRRSPYGAPSASAYTWRRVPTPTTWAIPTAWKPSAMSPVSWASAASPSSAPAKRRPTTASA

SEQ ID NO: 24478 - protein, 333 aa, Pseudomonas aeruginosa
  UNSURE (261): Identity of amino acid at the above locations are unknown.
TGAARGPDAAPRRTQPGRPARPRQPARAGVPGLRPGGSAGLPRSPGPGEGGGPLRRSVLRHQHADDRRLPRRRHPLRGYHWRDRGVRAGPRRRRRGPRGRHRGLPGRRLRCDPHRLPGRLPEGGAAGRATAGAGLRHRQRAFDGNREDQRRRPQVRRQDPREWPPARRAVGLQAPRHRFRPRPAARRDDSLGRRGHRLLQHRHPGHRGLPAGAAAAGPGHAPDRSAGVRCSVGNGSRTGSRGRSTNASPGPDQAARERLRXWVWGEARNARGERRTARLETANVYDLTLHGVLLAVRHLLDYQGPGGYFTPSRLLGARCVESLPGSGRITVIG

SEQ ID NO: 24479 - protein, 232 aa, Pseudomonas aeruginosa
WPAISTTTCSSPATRAGAPSPCSSGWRRRHTDMWQSYLNGILVAAGLIIAIGAQNAFVLAQSLRREHHLSVAALCVFCDAVLVSLGVFGLAKLLLENPTLLAIARWGGIAFLTWYGLKALLRALRPDALGNAAETGPRSRKAVLLAALAVTLLNPHVYLDTVLLIGSLGAQQAAPGAYALGAASASLMWFFALALGAAWLAPWLARPATWRLLDLMVAAMMLGMAAQLLFRG

SEQ ID NO: 24480 - protein, 559 aa, Pseudomonas aeruginosa
RILRRPEDHPGHRALRRELRHHFGNHLHLRHSPRPGHGPGAVPGLPLDADQAAVEDHRTPGQHQSRPPQPAPVAAAQGARTQRAGALGDHRQPVARLDRKQQPPAPRGRGQPAAHFPVRLPHRPAEPPVAAAATRPDPRRRRPPAAPGGSAVPGPRRFQGDQRAVHLPARRPAADRPRRPPARAQRAARFAGAPGRRPVRPGPGRHRATLRGGRTGAEHPRRPGSAVRDRPARGAPARHHRYHPVPRGRRDHGETAAEGRADHDPGQDPLAQPLPVLHRQRGQRDASPPGTGKGPARRPAAPRAAPRLPAAGGLPRPPRGRRRGAAALATSVARLRPAGPVHPAGGTERQHLQHRRVGARPGLPAVARMARPGLRRPAHGGQSFHRAAPPQRPATGGQQPAAGLPPAGAQPGAGSHRNRPDGGHLHCRPAPPQPAPRRRADRHRRFRHRLFLAELPEEPAAGQDQDRQEFRPGPAAGRGRRDHRSRHHPARQEPGHAGDRRGRGNRRAGGVHHRRRLQRRSGLPVQQAAAGQGTDPVPQAGATPEPGHQQRTALIRTGG

SEQ ID NO: 24481 - protein, 172 aa, Pseudomonas aeruginosa
PASSSRTTQKAIAVRLMDGAPEEDAGILAAPDMSRHDGDHAAPFSKMQIFRIMWQFFNALAGVSDKRAPLRHATNKAKESAMTRMPLATASLLGLAISLAGCGDDKKAEAPATPAANMQPAAPAAGPGRQGRRGRRQGGDQELRGTRRNHLRRCPEHRQGPAESHRRVPRQA

SEQ ID NO: 24482 - protein, 352 aa, Pseudomonas aeruginosa
RLAAGRRPDRLCRQGLPARPGEPRRHRQHRRQHRDPGRRRQDRRQGNHRRETGQPERAGRFRSQRRHRLPRHRVPPLGPGPERHRSGRRQPSRHRLCPGQGLHRRPLRPSRRLPEGRHRPAGQRPRIHGRTVESRRRRQLPRQAGSRTGGYRPAQDVLRHGQPVPRRTGRRAHEGRAGGQLHRRRARLLQRRHPPHPVLQRQEHPQHLPRRVQAHRRQRGQGPEPGRPGRQGRRRRQRHPEGRPGRHRGQAAGHRRQRREGWRALRPDDRSGQQGRPAEDPRRHRRPGQADRRHRAGRWQAGYPGPEAGQRRPRVLIPSCANSVRPMAARCVSGPRKRSSRAFTNANPSYFD

SEQ ID NO: 24483 - protein, 405 aa, Pseudomonas aeruginosa
PQLVSLRAVSTQSGMFADVVAVTFHAARLSPDGAPSGRMRRRRRTAARRARRTPVRGRDHGAAKRPQRLLPALRQPRPEPAPGLQRGQQFLPQPLGHRPFLHHRARRSGTAVQYQRLPELPCEGRPRPPAGSGRGQRGVDAGTPVDPGRPCGRQDPVAPGGDSRADLRRPVAGRRHSRRRPGRQGAGGLRAAEGEVRGRHRGRTAQADPAYQPARLWADASADDVFRPRRPADDRARPARGDSRRGDPGQCRSGRPQRRRYPRARQPGLGCRAAAHRARPLRLEGRPAGYPAAERARLRQRHGPDQQPAAPRRLQRRPGRVPPGARRRRAGSQRQHLRPGAVLQPQPGGPGAAQGGRPAGAGRQASVRPGQLRGLPRSRLHYRFRRQRAGAGQPADSSLFRPVAA

SEQ ID NO: 24484 - protein, 412 aa, Pseudomonas aeruginosa
HGRRLGGQSPGISRQRAGLANPAAMGHRPDRNGQRPHPVPPRRARPQSAGGDPLARRRSRSGQAARARLRRRPAQRPAGLPEFTLRSPHVPPTTALDQPRHRPRRLLAARPAGRHQCRPGATGDPADLQPLGGGRPGPGQQRPGLLPGQGRPGQGPRRVPRRAEGLGRAATAADRPAGRGQPRLAGAVLAGQEGPGRAPGRTVAEEQPAGRRRGPGQGQRGGAGALRLRIHPLRQQDRPRRRRHQGPLLPVAGSHRHPPAATGPGHPGALEERRRHAHPDEQVPQRPLRRRPRGDRRAAAGPGHRPGHAEEETRYSAGPAEQGHSPALPGRGLAQQRLAGQPGRQPERRPGALGRYRRQGPEDPAAGRTEGPGRQDRRRLRRQPREAGGAGTETALRTARQRRRAQPAQRPL

SEQ ID NO: 24485 - protein, 394 aa, Pseudomonas aeruginosa
CVGFAPKRGALGIPGTRIMLLRRMLIMLAAVIAVVAILAGYKVYSIRQQIALFSAPKPPISVTASLAEKRPWQSRLPAIGSLKAFQGVTLTAEVSGTVRDVLFLSGDQVKLDQPLIQLESDVEEATLRTAEADLGLARAEYQRGRELIGSKAISKSEFDRLAAQWAKTSATVAELKAALAKKRVLAPFAGTIGIRQVDVGDYVSPGTPIATLQDLSTLLLDFHLPEQDFPLLSRGQLVKVRVAAYPGQVFDAEIAAINPKVDNETRNLQVRAALENPDGKLLPGMFANLEVMLPGEEQRVVVPETAITFTLYGDSIYVVGQKKDEQGQVSKDDKGQPQQVVERRFVRIGERREGLAVVLEGLEGGEQVVTSGQLKLDNGAAVAIVAERDLQQEH

SEQ ID NO: 24486 - protein, 164 aa, Pseudomonas aeruginosa
ADRIELERLARALDLQGIQVIAEIGHAQLAAAATLGATQHRLDACGKFGKGEGLDQVIVGSGTKPLQAIVQLVAGGEHDHRGVAPCVFAQAPAQGIAVDSRQHHVEHDQVVVLGGRQVQAGQPVLRAIHGIALERQVIGQVGQDVAVVFDHQYSHVPLLRRKTD

SEQ ID NO: 24487 - protein, 326 aa, Pseudomonas aeruginosa
APLAHLRILHRRFTPALRSPPETAWRLPWPPIIAALRMRTNPGGGFNQRRSQENVNASVGDRMTQAAVHSPSRPFNPWLFLALPLGLAALLLAFEPVTLDLALANLMYDPGAGFIGRHSWFLENILHDRVKQLVIAISVLGLLVSIAGLFHRPWRALSRPLAYVFLAMSLAASIVTPLKALTAVQCPWSLAQFGGEETYSSLLSPRPPTEHPGRCWPGGHASSGFVLFALFFALRDRKPRLARYALAFAFAMGCLLSLSRMLQGAHFLSHNLWTMLFDWLICLGLYRLMLYRPETRGQRNGGADENRVQEDDSSAPSTPNSMGTFM

SEQ ID NO: 24488 - protein, 573 aa, Pseudomonas aeruginosa
KSPAEAGLFQPQEPVGLHHAAHAAHAAHVRHAAHGRLVFHDLGNHGFGGDHQTADGGRSLQSGTSDLGRVQDAHLDHVAVHAGSSVEAVVAGTLLDLVDHYARLVAGVGHDLAQRRFDGATQQGDTDVLLLVVTLQAFDGLQGTNQGYAAAGNHALFHRCTGSVQGVFDAGFILFHLDFGGSAYLDHGNTAGQLGQALLQLLAVVVGSGFLDLLADLQDAGFDISLHTGAIDDGGVFLVDHDALGVAQVLQGSAFQAQADFFADHGTAGEDGDVLQHGLAAIAEARSLDSRDLDDATHVVHHQGGQGFALDVLGDDQQRTAGLGDGFQHRQHFADVGDLLVDQQQQRAIQLGSHGVRLVHEVGGQVAAIELHAFDDGQFVFQARAFLDGDHAFFTDFFHGFGNDLADGLVGVGGDGAYLGYGLGVGAGLGQLFQLGDDSHGGLVDATLQVHRVHAGGNGLQAFVDDGLGQDGRGGGAVTGSVVGLGGNVFHQLRAHVLELVFQLDFLGDGNAVLGDGRSAEGLVQNHVAAFRAEGGLDGIGQHVHADQHFLASGIAELNFFGSHVLFPLNRIR

SEQ ID NO: 24489 - protein, 742 aa, Pseudomonas aeruginosa
DSLPLWQGPCGDRYIRSPQAISRACSEIFFSVARIVAALVLALDDVRPRRTLSVAGVQVVGEGAPAQRLLFDAAAQAAEHQATGERNQAEDAEDVADETRQHQQAAADGDQQAFEHFLLRQFATGQSFAGAPGGGHAGHAQQCSTDEGAGDDQEQGPADPDDTADLDQDGQLDQREEQQQKEESAHFRVLGGARLPPVPPVVGASRGKNSTLLRLDGRPALGPGQLHQRLAHGPGVAAGGGERQPVQALADAQVETFCINSRQLRRGMRRQSGQFHIVGDGGGVVAVHVLDHAALGFSGERIGQRHALGGQPVDRAETADETPLDRLQHPEVEIVDPMVVGGLGEIAVVTLGRRGDLLLRQLPRLGQQGEAADSLDILGAALAYQHRAARVRLQVVGVLGDPADQDQRPAFGIQAIGNHRTERKARPFLRVGGKDRTVFLEQQFSGILCSFNAQFMTPCIESVVNGRAYQSTFAGAGKVRFQKLLVGFQAMQLKDKVIIITGGCQGLGRAMGEYLAGKGARLALVDLNRERLDEAVAACKAAGGDARAYVCNVADEEQVTHMVAQVASDFGAINGLVNNAGILRDGLTIKVKDGQLSKMSLAQWQSVIDVNLTGVFLCTREVAAKMIELKNEGAIVNISSISRAGNMGQANYSAAKAGVAADTVVWAKELARYGIRVAGVAPGFIETEMTAGMKPEALEKMTAGIPLKRMGKPVEIAHSVAYIFENDYYTGRVLELDGGLRL

SEQ ID NO: 24490 - protein, 167 aa, Pseudomonas aeruginosa
LVTVPLDSAPLGTMIRLLSPLRSTVWKIRIESTVPATPCASIQSPTLNGRNSRISTPPAKLARLPCRARPMARPAAPMAATKLVVWMPIMEATLTTSRIFRTMLTRLPTKPCRVRSTLRLASRPPTRPVRVLISHQPIARVSSARATLPLYSSTIGSQDSVCCTSRS

SEQ ID NO: 24491 - protein, 628 aa, Pseudomonas aeruginosa
FNSMHYLHFSKKHPSLPQRKRDGLADSCPDAVGRRFRAWIRIGAARTNRRCADRGGQRGRGRGGATPYCDARDGERFRKTSSIAEVGELQRHAERFAAQQGDGLLQIVTLLAGDAHLLALDGGLDLELALLDQTNDLLRQVLVDALAEVDVLLDHLARRVGILDLHALAVDLALDQVGTQDVEHLLEHEIGFGGEGHRLVLGFETAFAFQVETAIQFLDGVVHGVGQLVFVQFGHHVERRHVISPDGRRDRVHRRNRAWLDGKKCPPIITEPSRANARRCGGDRRFLPDGARDRGRDPASRDEPGPCRQRTGAHPLLESVHAQPRSQHPGRRRRQVFQRHDRPRPQPGRLPGHPLRQQRQRGPAAARTTPGQRAPGRLADAGDGRPGTDRPGPPTGRKHQPLHLHRPAYRQGGRERPRRGLRPRRRRLRQQGRDERATGAAHLRSRPPVQHPATVAGGKPPAHRKHRADGRTQPGGYPHRPRQSPLPATEAGRQPAPGGNPRWSAVLPAGRHARGTGPAPAARRGLPSRAAARRGQAPATAGPAAGCAGAPGRAAFRPDHPGGGPARMLVEQLQAAARRAQPEGLQDQRRLHQPESRHRHARPRQRGIAAGHRRTAAAHRGPVARCLC

SEQ ID NO: 24492 - protein, 1009 aa, Pseudomonas aeruginosa
PRQPLGRAPRARRPARPPDPARPPAPAPLPTGRRTEPGGRRPGQPLPDRRGNPGRRATHPAPAAGLQGLRRGGSRLQRGPSPGRQRRTAVAAERPGQPAGGRRPPAAQPLPVHLQHRRRVPRWRFPRGLRRPGAHLARRSARHKRPRLAGAAVPGRDPAQLERRHPRTAVAQAGPELRDQPADRPPRLPQRRPAAAPGRDRRALRRTRPVAPRQRLRRRRQEPAGGCPGGDRRHRGQLFLDASGRHPRPAHGNRLPARLRLPARAAPGTTAAAPGNLARPPPGPSAPARFARPLKRVTLPAIPFRRGPPEPMNLRQRLDNLPVGQKLLAALLILLATVLLVANLAFISAAYWISQESVAPQAMQTIGRLIANPALSQPALSSPQTAEVLLRQLNDYQPLRAAALYDSNGLMLADLQRGDTLKLPARLDRLEHWRRGEYRLNALIELPQENARPGYLLLVASGELPSAFYTGTLTASLAILGVSVLLWLLVAQQIRRLITRPIRDLEELSRQVTREENYALRAQRGNGDEIGRLADAFNTMLTRIEAREQQLKRARDDAQEAVEQAQSLAEETRRSNRKLELEVQVRSKIEKKLTGFQHYLNSIIDSMPSALIAVDEQLYVTQWNQEASQLSGTSLDDAVNQPVFLAFPSLKPFLPQLTRAAEKHSVERVERVTWALIDTPRHYALTFYPLMGGTGRGAVIRIDDITQRLSLEEVMVQSEKMLSVGSLAAGMAHEINNPLGAILHNVQNIKRRLSPELAKNVELAAEVGVPLEDINHYLDGRDIPRLLEGIQHAGSRAAKIVTHMLAFSRRSHRQMTACELPALLEQAVEIAGNDFDLAEGFDFKSLQIVHEFDPNLGPVPVIANEVEQVLLNLLKNAAQAIHQRDDEEEGEQGRIVLRTRLTPPWAEVQVEDNGSGMPELVRKRIFEPFFTTKEVGQGTGLGLSVSYFIITNNHKGQMEVRSELGRGTCFSIRLPLESSEAVAPAQAKALPPALPQPGSSLRRGDEEEG

SEQ ID NO: 24493 - protein, 251 aa, Pseudomonas aeruginosa
IHGQSIVEDLHPYRRPRRDRPGRRTPGAQEPSTHRGDRRGGRIEQPVGPAPCRAAGSAWRTSRPGGDRPGAGAGATPPVRPRRGAGDAGVSGPGRDGSGTPGKLHRPLERRAGPAEEFHPPRRFPPGRPGPCLPQPGAQCRTALPGAGPGGNAGGRRPALPEPALRPAVRRRPRHRPAPGRGGDSLGGGGKTGLTASEGSASRRKKGGRSLLFSSFHRQRPPGQNARIPATPWAPCSQACSACCGPRPPSR

SEQ ID NO: 24494 - protein, 335 aa, Pseudomonas aeruginosa
SCRTWISGRARSTRMPSSSSSSRANAARTGSPSSTLPPGNSHRPPWCLSSGRRAISTRPSEPRITAAATCTRFTDHLLATAVTHRKRRTAINYRPARAMPRRTRRGTQATDKSSRHRSGRYPATPPHNCGNAPPPVRRTHPPGWRGRTGTDRPGRSAAGNPPRLRRYVEYPVVSPRTIPPMAAGAAGPSAARRATRRNRCAFPRKPNGPAPAPPRRAATGGPRGSARRGTRRWPGNPRCRHPRFSARAPCRSANIAGSAPGYRAAPAGRGSRRTPPRSCARPASPAATRTSHCDCQSRWSGPCASPLRPPDADGHAPENLRGARTDGKFPIFIHR

SEQ ID NO: 24495 - protein, 1044 aa, Pseudomonas aeruginosa
CRRKRCRVRNRGPGAGWTGGQDRQPWERAPLPNSGLDAVRDGVTENASAPGWRQFEQTPRAAGPVAALVNQAGSLVQLPVAVLVFLAGTARARLVAADLLLVAHRLERHDRSRALGKLFFLAGHGLLHRGSLGVLELHALGQFLRLATQAGLLFGRVFATDLDVGQHADGVALDRVQQLLEQGEGLALVFLLRILLRVATQVDAVPQVVHGRQVVLPQVVQHPQQHLLLEGAQGFGAGQLFLLVVGGDDLLEDLATQGFLVQLVVFVQPLLDRQAHGEVAVQRSLQAFDVPLLGQRLRRNVLVDGGAEGFLAEFLDGLAHVLCRQQGIAHVVDHLALLVGYVIEFQQLLADVEVAPFDLALGLLDGVGHHAVLDRLAGLHAQRLHEVLHPVGGEDPHQVVFQRQVEAAGTRVALTTGTAAQLVVDPAGFVALGGDHVQAARLDHLLVALLPFGLDLGDLLLGGVLQGRDFDFPVAAEEDVGTAAGHVGGDGHRTGRASLGDDLGFLLVVLGVEHLVLDACLLQQLGNVLGTLDRRGADQDRPAEGLALLDVGDDRRVLLFLGQVDQVVEVLARDRPVGRDHHHVETVDLAELEGLGIGGAGHAGQLVVQAEVVLEGGGGQGLALGLDRQAFLRLDGLVQALGQATARHGAAGVLVDQEDLVALDDVLDVAVEQGVRAQRCVDVGQQAQVVRRVEALAFAEQAVLAQQVLDELVALLVEFDLAGLLVDAVVAFLGRLALDLFDLALETRDQLVDLDVQLGAVFGLAGDDQRGTRLVDEDRVHFVDHGEVQLALELVVQAEGHVVAQVIEAEFVVGAVGDVGGVGGALVFRRLEGSDHADAEAEELVQRAHPVGVAARQVVVHRDHVHALAGQRVEVDRQGAHQGLALAGTHFGDLAVVQGHATDQLDVEVAHAHHPLASLANHGEGFGQQLVERFALGVALLEFSRFRLQLLVGERHHLGLERIDGLYSLGHALYITLVLASKEFLQQRRKHIDLVIHTWGMEGSPIRRPVPINGMKGNILPGNGYEKSTADQCASLTRKQTRVR

SEQ ID NO: 24496 - protein, 170 aa, Pseudomonas aeruginosa
RNAFCYHSDSVTPRLPAMSFRPLPAQASTQLLRQARPLQMLFAEAQRICRLQQLLESQLQPAARPYCHVASWRGGCLLLIVTDGHWATRLRYQQRRLQRQLQAFEEFANLAKILFKVQPTTSTQRAARRSLTLSAVAAENLRESAEIVGNPRLREALERLASRAEKSRQE

SEQ ID NO: 24497 - protein, 345 aa, Pseudomonas aeruginosa
KEATLRWPPNMERRVFLHCRRRAHIGNRRGTRVFEGHHFPSILVCDQRTQQLVVQGMAGLEATELADKTVAEQIQVADGIQDLVLDELVLVTQAVFVEHAVLVDHDRVLHATAECQVLRTQVLDVAHEPEGTGAADLLDEGSTGEIDRGLLGATTEDRMIEIDLEADLEAVERNEDGALVALFHADFALDADELLGSFLLLQSGGLDQEYERTSAAIHDRHFRSGQLDVGVVDTQAGHGREQVLHRIHFDVTLDQGGRHGGFADVLGPGRDFHYRIQVGAAEHDTGVHRRRFQGQVNLFPRVQTDASSPDDVLQGALFDHGFGRLSADCELFSTMAGDDSRTGLC

SEQ ID NO: 24498 - protein, 566 aa, Pseudomonas aeruginosa
RHGRSSPRPGVAAGLRRHRCRRHRPRRPAGIAGPSRRTSATPRARRSCRRTARRHGRTPWDPGCRSAGYRGKGSCALPSLAGEQRVLDQLRGQAADIASALAKQDVASAQQRLDQRRQVGVALEVDRVELAALADAVAQLAAVGSRDRLFAGRIDLHQQQHVGFAQHLHEVFVQVAGTGIAMRLVDHHQATLRPTATDRLDHRGDFARMVAVIVHQHHAATLDLQLAVDLEAPAYALEAGQPLDDGFVGDALVGSDDDGRQGIQHVVQAGHVHRDVQRLALRAQHGEPGAHAFLADVDRAHVGVFAKAVGHGRAGDLREDLTHNRIIHAHHRQSVERQVVEELDEGLLQLVEVAAVGRHVVGVDIGDHRDHRLQVQEAGVALVGLGHQVAAGAELGVGPGGVQPAADDEGRVQAAGGEHRGDQAGSGGLAVGAGYRDAVPVAHQLGEHLRTRHHRNPPFQGRCHFRVGPVDGTGHHQHVGAVGVFRLVADEDLRAELLQALGHRRGLEVRAGYLVAEVQQHFGDPAHTGAADADEMDAADTAHGPGDAIRFFNHGPPPGRHRPPSG

SEQ ID NO: 24499 - protein, 187 aa, Pseudomonas aeruginosa
RTEKYSGLPDCAAATSEDAEVTITRAEAEQRQATRQQREVQVDAVPAQQRRREGAQHRQHHASSSTALANRRPRSSKFLNMSRLAQAGDNSTASPSRASSAACRTASSSVATRTSGTALPSAWAISPASRPSSTTARQKRATGSRRSWKSAPLPSPPASSTSLPSMSAPSPSIAARAAPTLVALESS

SEQ ID NO: 24500 - protein, 389 aa, Pseudomonas aeruginosa
RTRDMPLLPRPTTMRKWSEAIRLMLSSSSTQLQGGEADQHQDHGDDPEAHDHARLRPAFQFEMVMDRRHAEDAASGQLEGSDLDHHREGFHDEHPTHDEQHDFLAHDHRDGAQRGAQRQRADVAHEDLRRIGVEPEEAEAGADQRGAEHDQLAGARYVGNQQVLGELHVARQVAEDAQRAGNHYRRHDRQAVETVGEVHCIARTDDDEVGQDHEEDAQLDLDALQHRHDQGGLDRGFGSHVEEHGGADAEHRLPEVLPAARQATGVLLDHLAVVVHPADGTEQQGNDQHYPHVAVGKIRPQQRADGYGGKDQGAAHGRGALLRQVRLRTVVAHGLADLADLQGTDHPGPQPQRQRQRGEHAENAAQGQVLEDAEALVELLQVFGQQQEH

SEQ ID NO: 24501 - protein, 536 aa, Pseudomonas aeruginosa
SWPSKRGPLRAMNSWPGPMARLSVETAEKTASSPIRRASSATVNWLRRRGSSMRHLPGGQGALGLLDVGERMAYAVDLLIILVTLASQEHHVIHRSGSDQMGDRLTARRQEGNLVSGSEAFADIGDDRRTGLGARVVVGDQHPIRQAFGDRSHQRTLAGIAIATAAEQAQQARGRVRTQGLQDFFQGVGSMRVVHHHQRLVAASQALHAADRPLQLRQGAEDIAQGITQAKQRTDRRQQVAQVEAAEQRAAQQALAVRSDQRRLDAGVAEARFAAIEERRAVGEAVGDQLRVLLLAGQSTAEIVVQVDHPAAQARPGEQLGLGGGIGFHRTVIVEVVAGQIGEHRDIETERRHAALVEAVGRHFHRYRAGAGLLQRGQRGLHRERVRRGVPAALQGAVETGAEGADDAAALAEQIQGLGHQLADAGLAVGAGDADQVQPAARLAVETPGDRRQLRGQPLHRDQRRIAGRQLSGAFRLVSHGSRALGPGHRRCAHDHPGARPAPPGTGRPDERRGYPGSARGSADRARPGETVGSGS

SEQ ID NO: 24502 - protein, 643 aa, Pseudomonas aeruginosa
ASATPSFCGRSIDLLLFGGRRQVIRRHVHQAQRASHDLTEHRRRHQAAEVARLARLVDHHDHRDARIGGRGETGEQRAIGVFPVALGADRDLARGPALAGGVVTRHLGAEHPAVGLDHLLQHALHGGSHFRRDHLHTIRHAVDSGHAQRHALAVVGQGRIGMRQLDRGYRETVAVGQGRGFRLRPLAVVGQVADALAGEAQPRVLPETDLLHDRVDGFGADVEGDLADADVARLDQDAGEIELPRIARYVANGVAADLQGARVDVDDIAGFPAPAGQRRAHRERLDRRARLEHVDHRPVAHGRRLQVTTIVRVVGGLVGHGQDLPGLHVHDHQAAGLGAVFQQSVAQFAMSQVLQAQVDGQRKGLARFGILGDLHVLDHAATAILEHLALARHAGQPFVESQLDTFATAVVDIGKADRMGHHFASRVETPKLLDGVHAGHLQGDHAFALLRGQPTDQIDELALGVLLDAVGEQLGILPERRRQLRPAFLGGHQLLGVGPQGGDRGAHRQRFAVAVSDQAPVRRDGDMPHATRVALALEEVMVDHVQVDDSPDDGADHRQQQADDHAEPPWVEGALEIIQFHGATILTSAGSGTRMRNCSTARLSMRLWAVQVLCSRINRPHSACALSRTLSSEYSELSSCRFQ

SEQ ID NO: 24503 - protein, 254 aa, Pseudomonas aeruginosa
LLPPGPGRWRRTGRRSTGEAAGQATRQPRATADHHPRTQLQRQQPGRPGAAVPVRPRRRGRSARGGQPGLGRRHAPGRGAGAARRMGRPRVGRLQPELAVRGRQPDRRRACRPAGTTGATDRRPAATAPERRPRPAPAGRPRQPDRHPAVAPPGHRLRVPRRHPAAGPPDQADPGLPVRRRPSGLRHFAPLHRDQQPDPGPGSQRHPLLRDPVAAQPQRPDPPAGRRPMAPGQRQHGPPLRHGRRRLPPRSASA

SEQ ID NO: 24504 - protein, 171 aa, Pseudomonas aeruginosa
TEGRAEPADRRPDRYPEPESDPTYRTPVAMGRVPQWPGPAAGDQQLLTDRESSRDKGRQAEELACAHLRRQGLATLGKNWTCRRGELDLVMLDGDTVVFVEVRSRRHRAWGGALESIDARKRQRLILSAELFLQQEARWAKCPCRFDVVTVDTSDGQSPPRLDWIQNAFDA

SEQ ID NO: 24505 - protein, 193 aa, Pseudomonas aeruginosa
RMSRTAFVAATLALSLALGGCSSFLSATRDKPIDDDRGTRTIGSKIDDSLIETKAAVNIAKADPALDKDSHIVVVSYNGIVLIAGQTPRADLKSKAEQAARTVQKVKNVHNELQVTSPSSLLARNNDAWITTKLKTQMLSDPNVPSSRIKVVTENGIVYMMGLVNQQEAAQAVRVAQGVDGVQKIVKLFEYIN

SEQ ID NO: 24506 - protein, 152 aa, Pseudomonas aeruginosa
KNAQLRRGGRFSASVELTLGVLRTLTRFTQTDFLTLDFTGIASHVAGLAQRATQGFVVLDQGTGDAVTDRTGLTAYATANDGNEDVELLDGLGQLERLTHDHASGFTTEELIETTVVDGNLASTRTQEDASGSGLTTASAVILSRRHNELSR

SEQ ID NO: 24507 - protein, 179 aa, Pseudomonas aeruginosa
SVQPRSRRSACVFSPMKTFPWSTPSSPTRAPFAACPGAPSTARRWPRSTCCWCARSPRSAAPRWPARRCASSAPAPSAPTTSTSTTSPRPASPGPARPAATPAGWWTTCSAACWRWPRCAAPTWPNAPMGWSALGRSVGGWWRCCAGWAGKCWSAIRRARHASRTANSSRWNGCWPRPT

SEQ ID NO: 24508 - protein, 481 aa, Pseudomonas aeruginosa
PALVEVDEQEAREFFREHVVGPHRIPGLGRHLVLGEARLGDVAEVHLGEVADLVVVVEHHPAVAGHAEVLQQHVAGEDVRRRQLLDRQPVVVQRLAGLRLAGVLQVDVQRGHAPLRPAVADQHHVAFHHHRRRRHFQQFCQALRLELAHREAEVGELLGVGQASDPVVVLHQLVLLDHRGVVDALRRVEAVLDDLEHRVEAGQGEHAHHHAAHPGGHDEAVVGGRQVVDQGAVELALALLVEADRGVQLGQVLARQQTLEEGHQLGRHRHVDHEVRTGEGEDDRDFRLVGDHRVELDAVALAVQQREHQRPLLVRGEQAAHQVGALVAIEHRADQLDGQVRVLAHPVRQVAVQQCVDPFEVALAVVVGHVEAVVVEDLLQRLAQVAARPVGAGVGRAGVGAQRGPGGVHEHRAVADVVVAEQPAEDRVEPGLGQLVVQPQVDLRDVGALDDRPALHVQQLAVGQPRAQPGHRSRRPFPRRG

SEQ ID NO: 24509 - protein, 283 aa, Pseudomonas aeruginosa
GRRFRWLGRSGPCWRPFVVRRSSLARAARQGKRDLRPAGRARRRRLCWVARQPRDDRNDRRIADDPPRTLQRTPRGRPHHPVQRPRRGPPGPADALPVGGAAPQAPARQRGRRPPADPRRLAPGGRHRQRQPRTAPAHPPQPQRQHRHGRRRRLAGQGRRQPPARRTAGHRRQLDEPAPRRTHRLHRQRPGAGAVSQVRLRDRRRDARLRGAGWALRGCVQHGALAEGRGAGGGMRGGRDERLRTGATSWLAGLPFHDRFVLGFGHTVTVDKQRGCYLGGEGA

SEQ ID NO: 24510 - protein, 320 aa, Pseudomonas aeruginosa
FRSHPLRRPTAHGRVARKPGAPGGLQPHRARLRPPAAFGSSAGADAGALRSGDRHRLPGAKARLFRRADLPVRRAALPGRGGAGAVHHGDRCHARATAAGDLPAPGFPAGGRAGGGDRPSARACAGRSAAQSDVQPYGRAAAGIGVALPGGAGRSAGDSDPRACATARAVLPRAHRPSGRRHARGTGHARALRQHCPGAAPHPRAIRRAARAGATGGRGGDERAVVPQPLQGDHPDLADAVPEVHTPAPGASADGAPGHERPGRLPCGRLRQRFAVQPRVQASVRPFATGRGPAPARGILAAAGAGGRGVRVVALVGSGR

SEQ ID NO: 24511 - protein, 471 aa, Pseudomonas aeruginosa
TPTTGIPSTTPIVASFPSPSTRASGSPSSRPTTASCCCPTAAPASSTARRRRFSTGLVSGSVAGGRRALAQGAQGGAQFRGAHRLGEQGDVGVFDASLDTLDVVAADHQRRYRLSALPPYPLDALDAGGVGAEVVVDDEYVAIGSPAVRLGFRLDRAAPAFEQRRGGAQDVAIIFHQAHPQAGEQAGLQGIVAAGQGLRGDRRQAVQGHRGAASDPRAQRHLDPGQLPQAADDGQPQADSLDVAVARLAYPVELLEHPRQVFLRDPPALVVDGYGQAVASPPHADQQRALGGVLEAVGEQVLQHGRQQPRIGSRPQAARAQAQFHPGPARRFSVAPDQVAQQLAQVDVLLLGLEPAVVEGVEIEDGAEQLRDVEQRAVDVVHQAPFLVAQAGVAQAGGEQADGVDRLAQVVAGLGQQARFLLVRLQRFLGGLARALQQEVRVEGNDGTGGHQHQHHERLGLPGRGQSIDDQ

SEQ ID NO: 24512 - protein, 212 aa, Pseudomonas aeruginosa
  UNSURE (43): Identity of amino acid at the above locations are unknown.
SGRRSLGSGSAGSRPGPPATPPTGSAGSAGAPGGSGRGGRGPXLRCRCRVAARSPRHGPPPGTPPHSGRRRSPARPSRTGCRRAGAGGAGRRRWAGRSRWRGRCVRRPVPPSGPPSAGCCSVSRCVARPGAGGRGSPGAPAAPVAPACSVGRSARRAEGRTSGSDSCCGAGRRGRHGCPAPVARPAASAQPRAPGGRTAGRRAGRAGAPGRG

SEQ ID NO: 24513 - protein, 569 aa, Pseudomonas aeruginosa
PAPRRTCRDRSLQRLADRQPRRDRHSHRPRLRRPGYPLGGGVRGRRCRVPARAQGRCRAAAGRPWRGGLSRHGSAGRAGPGAGLRGDPSGLRFSRRERRIRPSLPARGHPLRRAASGSARPVRRQGCRARPGRAPGGAAGGRDQPCGQRRRGRGVPGRAGRWRRGDAQGPCRRRRTWHARGGGGCATGRCLPPLPCRGAGGVRPGRVIRRATGSAGAAHRGAGARRRQRCGQPPLGARLQPATVPAEAAGDSPQPGPAGGHSRGADRLRPAHGRRGALSGDRYLRVPGRRRAPRALLFHGSQSAHPGGAHRHRGSHRGRPAARPVASRRRHGACRPRPGATAGDRRLRGATADQPGDPGGRRQRPSGGGHYRRLRTAQRSRPAGGRLRLCRLSGQPQLRFAAGQARRAWCGLSRRVAPGIPGALRIPPGGRGEQPGSAAQPSAASGGTGQPGRHPLRRKPPGDTAGAYPGEPSAAPRRVPARRGRRACAGRGATRQPAAVCAEQRGAGGPGSGRWRTGACRPAGRDPGSDEDGIRGQGTRRRYRPATRGEPRGASGGGRDAAVPRTDGG

SEQ ID NO: 24514 - protein, 586 aa, Pseudomonas aeruginosa
RRAGTDRTGAGPGAYPRRSRRGTRAPGSAGRRASSAGAGQAAQDRTAYRAGERARPAGRGQLQRIWRFRPGRPASPALRRGVAGAEPRRWPGRRHRYGGGRQLRRAGRALPGAGLRLHGVRRHPGGDEPQEDRPPARPGRTVALAAGAVRRGWRRAPGRYRFRRRRRSRLPYLRRHGPALWAGAAGGSGLRSLLRRQCRVAGLLRCDHRHPRRHHRHGRPGDDRGRRPGPFRRRGGRSDGRAGAQRSDRRTGGGRGRSGRGGQALPRLFPGPAARLELRRPARVAPPGAGEPPACLRHPPGDRGPGRPGQRAGTAAPVRSRPGHRAAAHRGPGVRPDRQQPWPSRRRHRCRGRRQGRALHAVVRRLRHSDRLALRHPWLHGWPGGGKTGHGAPRLADVRQRRQPDGAVLHRGPAQGLRTGCPGHGGGQLPFAAVHRRLAQRRVRRHGPGRRGAAGLRQGAGGRGRLPAARGAVPWHGGQGLPQRQGAEHGQLPGDRRGDRPGGDPRLAPARPGRRRRTGAEGGAQAAVRGYLVDGRPAVPWRLRTTAASPEPARRPPPCRSPTRRRRCARLRIRRRRSRRSVPAGR

SEQ ID NO: 24515 - protein, 191 aa, Pseudomonas aeruginosa
ATSETRYFLAQAAAAGPFQRVGGEHPGGGCSGSGQRRRATFHHRAGGGARRGEHRFAVPVFPEQGGDPLPPAKRRVAAHHASARRDPRGHRPAAAGALAPAGAGIRALGVRRGGDTRGAERRGAAVSRRRRGAGGEGGGRAGVPGVSPGGLAGGRRGRAQPGRRLAHHHPRRGRQAVLRTAAQRGGDRALR

SEQ ID NO: 24516 - protein, 770 aa, Pseudomonas aeruginosa
VIAQSLMGRLLVFAELAGRQGPKGRPARSRKGCPGAMGGPRPTVGRGRKTLMIQPHALSGPDPDAVCRTALQVDALQRPGALFPAYHRLPAGRARGSRSLVAAGQGPLQEERREGSGQGRRQACEGRRSGGPTQARCRLAARAAGNLSGCRTEGRRIPGARHARAGGAGRDARCGQPAVRGTVGDDPLPPAAGADLRRCRLGQVDHPGPAGGVHALPPGRRAAAADSDFLHQRLLCAVARTIAAAARALAVPVRRGPGAAVRAHFPFGARQPGPRGARQSALVRTTGRPRPRRRAGQPPCRRTPASGPAAPAEAGLPAVLRAKPGVPRQDPQAAGTAAAGGAGRGRAAAAEGAAGAVQAGRRVPGAAAVRSLPCPGRVRREPGPARRTPGQRQAGMRVAREDLRRSHGTVLGEVPGAVARGGPDDLRRRVPAARRADGRRGPGGNGAGAVHPSADRRVPGCLAADRPLATGVAPSPGDPGHRAEPDGHRRRLAVDLRLARQFAGAVHRLRPALPLAWAGTQERAAGAGNQLPLRRTDHSRRREGAGRGAFQAGQDLPRVPPDPAGRPWREAGAAFRPACATAEATGGNPRPERARRRSREQRAHRGAVAEPAQRAVAGDPGGVGSRAAGEGHDHPSRQGPPGRSGDRRRRLPAGREASVAQRAVRGFGFLPQQLRPGHGGRKPAPGLRGDHPWRQPGALVHAQGPGRHGPVGPTLRTTVSAGYAWRCIQALNARRRSMNTAGSVTWPSSTALKYSRAGACPGCRARNSAR

SEQ ID NO: 24517 - protein, 390 aa, Pseudomonas aeruginosa
SPGGAKGTWILAISIPFWPPPPFCRDRALGRIPPPRTRNLRGLSMLSVYSDDHRLHFGQSELVDGKLQPCFEMPSRADTVLARVKSQNLGEVIAPKDFGREPLLRIHDAAYLDFLQGAWARWTAEGHSGDVVSTTFPGRRLRRDGPIPTALMGELGYYSFDTEAPITAGTWQAIYSSAQVALTAQEHMRQGARSAFALCRPPGHHAGGDFMGGYCFLNNAAIATQAFLDQGARRVAILDVDYHHGNGTQDIFYRRDDVLFASIHGDPLVEYPYFLGYADERGEGAGEGCNHNYPLAHGSGWDLWSAALDDACVRIAGYAPDALVISLGVDTYKEDPISQFKLDSPDYLRMGERIARLGLPTLFIMEGGYAVEAIGINAVNVLQGYEGAAR

SEQ ID NO: 24518 - protein, 232 aa, Pseudomonas aeruginosa
GAKHAIDSQAAGRPRAGRFRRAGSGRAGSTDLQLVRLHRPGHPEELPGADRHRAEVRRLRQQRGARGQAAVRAFRLRPGGAQRQLPAQLPEGRGVPAAGQEQAAELEEPQPGPAQGARRQGPRQPLRDALHVGHQRHRLQPRQGPRGARRRCAAGLLGPGVQAGEPGEAATVRRGLPRLAHRGDPRGAALSRPVAQQPPAGRLPPSRGAPGEAAPVHHLLQFLEVRQRPGQR

SEQ ID NO: 24519 - protein, 462 aa, Pseudomonas aeruginosa
VRRCLRLPDHAVALRDLGHPAGDHQVGGDGHRAGHAGGHPFRHRRRPGRPADVLARRLGGLAPGHPGRRPADRHAVRPGVPVHRPRPAIHHGFAHVGVPLYRADLLCPRAALPASQRTPAALAVAGRGGVLRRHSGGLRRRPVVGGNGWADAARRRFRPARRDVLGRDHGGSARHPAVRGTAKPDAVLPIVRGMRRVIADRSFQRPVRRGPLDPGEHRQRAVPGRGGVVRQLLLLVLATASLPGEQPGDLLLHDPPVRRHLRCIAAGRAAQPELRRRRGAGPRRHHPGQRRAVAATPAATLSECGRRNSRPAKTRPSPASASAGCRPPAKCVLSAASSGPSNWPRAKPVVSWPALRCGVCGASSRAYCITSCMPARNGRPVSTTPRASPPIPGSRQASTPRACSQSAPTSQRRVPSGRCRRRLISTTPVAEARPKQGQNRSACHCPWKRAAAICERKVAGMM

SEQ ID NO: 24520 - protein, 413 aa, Pseudomonas aeruginosa
LAAASRPAPVRSSWPSRIRCGSCGVREKRPTPMATTSASRQASRPTSGERRKSRDMCGFLPGDEWQQVRSCGNSVKMNNRELLVLFWRINRGVRPVEDFPGGRRGRLHRPRRRTPAPGAVEPVDAPAATGGTAWRRPVPPRTPAPATVAGRQGPAGLRRAAVRPAGGGARGGAGGRTGGRLRPRLDVQHRGDPPAAAPGGIPPALSGGEPAIADRAQRRAGRVAAGRAPGCRAGGRPAGLRRSGGPADVRGAHGAGHREWPPAGARSRGRGRQRGDRLPPALLLSPAAGVLVRQRAGEHGPGDGDRVLPQHAGLRGGRRRGGADAGVDAAKPAGAGVGGGACAGRTVRPGEYLAGLAQGHGRRQPEGLDRSPARAGIGVGLIQVRVRGRFPAVKLFPRTEWNVRRVGRRSTLS

SEQ ID NO: 24521 - protein, 541 aa, Pseudomonas aeruginosa
RFSSRSLSVERLSQKDRRSGYDLARVEQPAGVEQFLDLRHQRELQRIGVASQGFLLLQADAVLGGDHASAFAQLAVEDFLHRLVQRQQRDVGGEHDVQVAVEEMAEEEDLHALHQVVQAPPDALDVAGQGRHRERYVEGQAVDAGVDGRVGVFAQAPDGQALGFVGGEQGVFHQPVLEAVFQQGGERLAGIQVAVLGQFHQQVERAGRQARRAVAHGCGGALQVVVPEDLAGEQAFGVLAAQARGDGDRRVDVGQAEQGGGAGTLQRLQAQYRTGDDAEGAFGADEQLLEVVAGGVLQQPAQVAVDAAVGEYRFQAEHALAHGAEAEGADAAGVGRDQPADAGAAARGEIDAGVESGLGGQRLGLFEGDAGVEVEGLAGRIQPMYAVQPAQREQHVAGLRGAAADQAGESALGYQGASRLAAQTHHGGDLVGAFRQDQEASGEVLRMVAGVLPGERGTVAHATGAEDLAEGAVEFGIVHGGLRVRDGRARLAAPRRSADGPPGRRASVRAGVRDRARVRRRSRSRGRWRGSPGCIYRPRAE

SEQ ID NO: 24522 - protein, 235 aa, Pseudomonas aeruginosa
SVSPSSVPMASTTSASAASSRTGTQDWLLPSSSGWSAGSRPLALIVRAVGASSAAARARASAAASTQPPPSSSSGFFALRRRAAASRKGARAGAGRLARVRGRRARCSAGAVMTSSGSSMCTGRGRSLSNTAKARASTASNSPALIRVWPEGADVAYQVALVRQLVQVAVAVGQARAFVDAGDHQHRNRVGVGMGHGGEDVGHPRAGDDEAHAGLAGDPCVAVRHEAGAPARGAG

SEQ ID NO: 24523 - protein, 366 aa, Pseudomonas aeruginosa
RRRNRPRHRCGRRPPPVGGRPPAPVRRGRRSWSRYGSATHHAREDAEHFIEQVGAQQRSVAGGVVGRRDFDQVAADQVQALAAADDFHRLDGGQAADFRGAGAGRPGRVDAVDVEAQVDGAAADLLADLGHQRLQRLVPALLGLHHAEALLAAPVEVLGGVALGAQADLHNTVAIQQVFFHRAAEGGAVGDLLAEHVVVDVGVGVDVDQADLAVLLLDRAEDRQGDGVVAAEGQREDAVTEDAVVFLLDDAHGFQQVEGVDRDVADVRHVQRVEGGGAGGHVVGTDHHRLGADLAGAEAGTGAQGGADVEGHADEGGIEGVEFGGGLDMGQAHHGGDAAEAGHFIAAQGLVEILVHGVASRSLWLF

SEQ ID NO: 24524 - protein, 179 aa, Pseudomonas aeruginosa
RSALRVRENCCTASTTLCVLSRMPRIAAPASLASSTPRRACSWLCCMSSMTLRVPVWMRPIMSAISLVDLLVRSASCRTSSATTAKPRPWSPARAASMAALRASRLVCSAISRMVLTIEVICCECCDSSPMFSEEASRVFAILSISSTALWMISAPCSATVRVSVDRVWAWWALSASAW

SEQ ID NO: 24525 - protein, 487 aa, Pseudomonas aeruginosa
EEAPSACGTLGPFQESSHATYPLRALRSPRQPLPLRADSLLAVAYAGAGPAAPQRGRARVEYRRIGRPRLVQCGAAGWRAFRRGDLAGTGLPGLPAVSRRAGACAGRDGRRGRRRAPPAGGAGRHLAQGAQAPAPEPGPGGPAAGEPGRRHGVALSPAQGAGRGRAVDHRSNRCGARRTGGAAYPRSLVETLRCPDRGADRGDGRGHLSAQPSQPGAPPPIAVEQFRDCRFAPELRADHAAGHAAVGVAREVDQGIVFQRMAAEALEGLAEQVFQGRCGSRPGRVRQLPGHFLPEVGVATAAPARGFLFEEFGDARSGHVGRSCLSETKSMPDWQGRMGGVDCRGLSFRTRCSSDAQLMLPCLHGRFSVPGPRARGNAWHQGGIHDEYVDPDARWRLFPAAGRQPSVFRSRRNVRHPAHRAGGTQRRWQVAARAPARRTLAAVQRQRPAPGARALPGAAARTGRLPDRRRSGRRPPMAGGAGADRGG

SEQ ID NO: 24526 - protein, 155 aa, Pseudomonas aeruginosa
RGQRRQDAQRPPGGARASRPRGARGCPGGRGGVAAAARFARCRTGGTAPDRRVEGRGPAAFARAVARNRPAPERSATAGAGRPERQRQVDPAAAAGRATGAAGGNLRGDGGRRLSRPAAERAGPRARRAGAVAGGQSQSRRKLAAHAPGATRLAG

SEQ ID NO: 24527 - protein, 155 aa, Pseudomonas aeruginosa
CPRRRLWMIRPAGSSTRSSRSLPSRAIWRARKPPWADCASRWRQSLRSSGCPGVSGTLNSRWAAYPSCRLTSRLSSVALWKTCRHWPRSASSKLRRLSSARFQSSSRGLARAMARRWPSRKHRSHTGGRCRNRRSLPRARFSRIGSAASRCVEAG

SEQ ID NO: 24528 - protein, 178 aa, Pseudomonas aeruginosa
FAPRASRRRTSAWRPAWRSRLPFVLPGIFRIKESSMHIRKRVDADNTALVDLWERSVRATHDFLSEADIVELYPQVRDLYLPAVEVWVLVDDDGVAQGFIGLNQAHVEMLFVEPGLRGRGIGRRLLDHARATWPRLSVDVNEQNPQACGFYRHYGFRQTGRSATDSAGRPFPLLHMSL

SEQ ID NO: 24529 - protein, 925 aa, Pseudomonas aeruginosa
DRSNVAAQACPIVLFIRTRRRNPMNGIPPLSSRDAHASPPQRVLERLHSSAAGLDADEAARRLAAHGYNRLPAPKRQGPLLRLLRQFHNVLLYMMLFASLVTALLGFWVDSAVILLAVVVNALIGFVQEGKAANALDAIRDMLSLHALVLRDGQRQALDAERLVPGDVVLLASGDRVPADLRLFETKNFHVDESALTGESVPVEKGCVAVAIDALLGDRRCMAYSGTLVTSGQARGVVVATAGDTELGRIGTLLREVRTLATPLLRQIASFSRWLALAILLLAGATFVLGTLWQGQPMVDMFMLVVALTASAIPEGLPAIMTVILALGVQRMARRNAIVSRLPAVETLGSVTVICSDKTGTLTRNEMTVQRIVTADQVIEVSGAGYAPLGGFSHNGEGLDPAGRDDLQEIGRAALLCNEARLHQEGEAWQLEGDPTEGALLSLGLKLGLDPQALAAERPRSDAIPFESEHRFMATLHHDHAGQAMVYLKGAPERILDMCEAERVGDSVRPLDPDYWRRLATDTAARGLRLLAIARRAMPAEQRTLDFADVEHGFTLLALVGIIDPPREEAVAAVAECQAAGIAVKMITGDHVDTARAIGAMLGIGIDRPALTGAEIELLDDQRLREVLPGVDVFARASPEHKLRLVQALQASGEVVAMTGDGVNDAPALKRADVGVAMGNKGTEAAKEAAEVVLADDNFATIANAVREGRAVYDNLKKFILFMLPTNGGEALIVIAAILFQLTLPMTPAQILWINMVTSSTLGLALAFDPAERGLMQRPPRPPAEPLLSLFFVWRVLLVSLLMMAGALGVFLWELEHGTGLESARTMAVNSVVVCEMFYLLNSRHIYDSVLSREGLFGNRQVLLAIAACVVLQLLYTYAPPLQALFGSVGLAPGEWARVLLAGLGLFCVAELEKWLCRRVRARQA

SEQ ID NO: 24530 - protein, 244 aa, Pseudomonas aeruginosa
EERSAMALVDGFLELERSSGKLEWSAILQKMASDLGFSKILFGLLPKDSQDYENAFIVGNYPAAWREHYDRAGYARVDPTVSHCTQSVLPIFWEPSIYQTRKQHEFFEEASAAGLVYGLTMPLHGARGELGALSLSVEAENRAEANRFMESVLPTLWMLKDYALQSGAGLAFEHPVSKPVVLTSREKEVLQWCAIGKTSWEISVICNCSEANVNFHMGNIRRKFGVTSRRVAAIMAVNLGLITL

SEQ ID NO: 24531 - protein, 218 aa, Pseudomonas aeruginosa
NYEICINSSASYLEEVKMIVQIGRREEFDKKLLGEMHKLRAQVFKERKGWDVSVIDEMEIDGYDALSPYYMLIQEDTPEAQVFGCWRILDTTGPYMLKNTFPELLHGKEAPCSPHIWELSRFAINSGQKGSLGFSDCTLEAMRALARYSLQNDIQTLVTVTTVGVEKMMIRAGLDVSRFGPHLKIGIERAVALRIELNAKTQIALYGGVLVEQRLAVS

SEQ ID NO: 24532 - protein, 136 aa, Pseudomonas aeruginosa
QDCHSGVRVGSRCAAYKEERSRPREAGHWERWTDAGVAQWWGTGPGGRAGGGPGRLRRLGMARRRRRGEGGARAGQGPGERGAGGAARRRATGQRHRHGDFVAQRGDPHPDRRPVDPPAGERRADGRGGRVAGDHR

SEQ ID NO: 24533 - protein, 1069 aa, Pseudomonas aeruginosa
PGGGGRPLAADARRPGRYPGAAPEPGSGGGAAAVTPRAGISGWCIRHPIATALLTLASLLLGLLAFLRLGVAPLPEADFPTIQINALLPGGSPETMASSVATPLEVQFSAIPGITEMTSSSALGTTTLTLQFSLDKSIDVAAQEVQAAINAAAGRLPVDMPNLPTWRKVNPADSPIMILRVNSEMMPLIELSDYAETILARQLSQVNGVGQIFVVGQQRPAIRIQAQPEKLAAYQLTLADLRQSLQSASVNLAKGALYGEGRVSTLAANDQLFNASDYDDLVVAYRQGAPVFLKDVARIVSAPEDDYVQAWPNGVPGVALVILRQPGANIVDTADAIQAALPRLREMLPATIEVDVLNDRTRTIRSSLHEVELTLLLTIGLVVLVMGLFLRQLSATLIVATVLAVSLSASFAAMYVLGFTLNNLTLVALIIAVGFIVDDAIVVVENIHRHLEAGASKVEAALKGAAEIGFTVISISFSLIAAFIPLLFMGGIVGRLFREFAVSVTVAILISVLASLTLAPMLASRFMPALRHADAPRKGFAEWLTGGYERGLRWALGHQRLMLVGFAFTVLVAVAGYVGIPKGFFPLQDTAFVFGTSQAAEDISYDDMVAKHRQLAEIIASDPAVQSYNHAVGVTGGSQSLANGRFWIVLKDRGERDVSVGEFIDRLRPQLAKVPGIMLYLRAAQDINLSSGPSRTQYQYALRSSDSTQLALWAQRLTERLKQVPGLMDVSNDLQVGASVTALDIDRVAAARFGLSAEDVSQTLYDAFGQRQVGEYQTEVNQYKVVLELDARQRGRAESLDWFYLRSPLSGEMVPLSAIAKVAAPRSGPLQINHNGMFPAVNLSFNLAAGVSLGEAVQAVQRAQEEIGMPSTIIGVFQGAAQAFQSSLASQPLLILAALIAVYIILGVLYESFVHPLTILSTLPSAGIGAVFVLWAWGQDFSIMALIGIVLLIGIVKKNGILMVDFAIVAQREQGMSAEQAIYQACLTRFRPIMMTTLAALLGAIPLMIGFGTGSELRQPLGIAVVGGLLVSQVLTLFSTPVVYLALERLFHRRGTTTSDGGTAGATAT

SEQ ID NO: 24534 - protein, 256 aa, Pseudomonas aeruginosa
QCSGQPDRSQQRPDPGQAQRRSGGEHGLGAGCPGRRAGGERRAGEERRSAPGEPRRCPCQPDFRLLAQGRRRQGARGPVAADRRAGHRQRRLREPAGEQGGAARRAFRGQAQRADPGHGAAGPDQPSGERYGARPAGGDTAERLERGGGGPGDVDVQPEPEVGGDPARPGRAGTPGRAHPHDRRPDPGDLRQSQRRRSRRPGKPDAPAARHVQPAGHEPARRERLRPVAGAGLAGPAAGRGRIGARTRLGRRGLGR

SEQ ID NO: 24535 - protein, 162 aa, Pseudomonas aeruginosa
SVPANASRSCADMRRYLFAGFLPALASLSAPLCAAEGTTGAAAPTVGAASGAAAQLAQLVLGLGLVIGLIFLLAWLVRRVQQAGPRGNRLIRTLASQPLGPRDRLVLVQVGEEQILLGLTPGRITPLHVLKEPVHLPDGEPATPEFAQRLLELLNKDPKGKP

SEQ ID NO: 24536 - protein, 344 aa, Pseudomonas aeruginosa
GGTRPVPRGVVADGDDRRRAGGSEPAGRSRGGDVPGRYPDQRTDPELPAAPDGDPAHPDRAGPLAAAAADGIHPDADRQHPAADRLMLELTNAQIGGWIASFVLPLFRVAALLMTMPVIGTQLVPVRVRLYLALGVCVVLVPNLPPMPQVDALSMKAMLLIGEQILVGALLGFSLQLLFHAFVIAGQIISMQMGLGFASMVDPANGVSVPVLGQFFTMLVTLLFLAMNGHLVVFEVIAESFVTLPVGEGLSGNHFWIIAGKLGWVMGAALLLALPAITALLVVNLAFGAMTRAAPQLNIFSIGFPLTLVLGLVILWIGTADLLSQYQVLAGETLQFLRELVRAK

SEQ ID NO: 24537 - protein, 240 aa, Pseudomonas aeruginosa
  UNSURE (56): Identity of amino acid at the above locations are unknown.
PRALRSSPPPRPRQLPRSLPLRRPTGGAADGSRDPGFEQCLGDLAEPAGRAGAGRXADAYLHRDRPPAVAGDAADLLGVAAARARRDGHRLAARPGPGCALRQPARAERADPRPDHLPRAVPAPAPAHVPGMAAVPGAGGGLRPGATAPALAQRPDRQSPADPDLPASGPGQRAALALGVRPAAVRPPASQREVGPLRSYAAADTSFFETGDRRIARRVSREPPCRRCISPPPRPVAVNC

SEQ ID NO: 24538 - protein, 139 aa, Pseudomonas aeruginosa
NGGCGKPRNATATDRPGFVRPGTGAAGAVRQPWPATGAAGGRIPPAAGGRSWQATRHTGADCRADGLLARLRASGGGARHPGRRRRTESAPGAGAAGAGPARQPAGAPGADRQPGAGRTQADPARRRGWPVEPGWPAAQ

SEQ ID NO: 24539 - protein, 272 aa, Pseudomonas aeruginosa
QAQRSPEAPAIPAADPTHLAAGQSTGGGAAGKRSVVAQRGRRDPAQFIGWWAESRCPPATAGWPTSGAARRRADRQRGLAAQQRQVLSQPAAERLGAMVAGWSDPGMEDRPGQGRRRLLVRLARRQGATAGGTAAGAAVEGVVCRAQAGGNQRPGHEPVLRSRSAGLEGSGRRPGGEFRRAALGRGGVAVASRPAEQRATLEAAGRPRRPDAPGAGDRSAGAAAGRGGGVGGGPEAEGHPAQPERRFLAAARGARAGQLRDQPGKGRYLGVP

SEQ ID NO: 24540 - protein, 254 aa, Pseudomonas aeruginosa
RCGPAARRRPAHRQLQGLRPGAEEPDRRPGPPGAGLATGAGQRPRIGAPGPAGCQGRADRGRSGPPEPAEVDPSRREQGGGLGPAGRRRSAQPAGGRREDRPGRPRRPAAGRLEPEGTAGQQRRGVQRPGPRPAWPARQRQPALGRQSGQYPQHLSGPDRGQEPGGCAQGLEFRAECHQRTFPHGYQRPVAGIAGLHGPEALQRQHGCIAAQGAVRRGRGQRPGAASVWPAQFQRDQPPAAPGFLGHPRQGTEL

SEQ ID NO: 24541 - protein, 500 aa, Pseudomonas aeruginosa
SATCSSLRIASRRREIQPWWWSSGKRRHDNESGAACPARPRGRPRQQESQQMSLHAAAVGPSVLPDLREQVEQIIAEARRQGASACEVAVSLEQGLSTSVRQGEVETVEFNRDQGFGITLYAGQRKGSASTSATGEAAIRETVAAALAIARHTSEDECAGLADAALMARELPELDLYHPWSLSPEQAVERALACEAAAFAADKRVTKADGTTLNTHQGCRVYGNSHGFIGGYASTRHSLSCVMIAEGEGQMQRDYWYDVNRRGEALASAESIGRRAAERAASRLGARPVQTAEVPVLFAPEIAVGLFGHFLGAISGGSLYRKSSFLEGALGQRLFPEWLSIDERPHLVGALGSASFDSDGLATYAKPFVENGELVSYVLGTYSGRKLGLPSTANAGGVHNLFVSHGDEDQAALIRRMGRGLLVTELMGQGVNLVTGDYSRGAAGYWVENGEIQFPVQEVTIAANLRDLFRRIVAVGKDIERRGNLHTGSVLVESMMVAGR

SEQ ID NO: 24542 - protein, 141 aa, Pseudomonas aeruginosa
SISLSSGEVAMSFEAHDPQALDHWYWLGTQIRCALDPDEPRLLDQYLGEARYLAGWEGVAAWPLFEKAYNLLLDTGRDPILPWHWRSLCLDYAYRPLCELQRLTTNGSQRRRLRQLSVRMARQDLAPSMSFDHPQQGNQDD

SEQ ID NO: 24543 - protein, 234 aa, Pseudomonas aeruginosa
ALPPCPGPGPGAAGTLGRRRRGGDGVRDFPSQPARLAPATGATGGDRRIPVRLPRAPVAGQRRPEAAAGPAPGGPASQPAHLCRTAVVHRRTRCLSAHRAPAQGTAERGGPTRVPRSAPLTSLSLTESFHAPRLAALALRLRCPGTAHRCADHGDPPQQAPPDLCEQPERRAGRHALCRAAGGKSAAATGWSAGEAAHPGCQQWRWACQPLAVLDRDVAPGRWPSRWRPGAGHR

SEQ ID NO: 24544 - protein, 193 aa, Pseudomonas aeruginosa
AVTGGEARQPFVQVADDVLVHFLDVRLGGQILADFRLQPRMIAQLGLPVGVRQAAHIEHQVGVDWHAALEAKGFDEERGAGLRLVQQAQFDGVAQLIEVEAGGVQLQVGEVGDRSEQLALVANRLRQRTGVGSQRVAPAGFRESFEQRLVVGVEIQHIAVDVVVPHFLQQFGEALQLAGQVAGVDRHRHLWLQ

SEQ ID NO: 24545 - protein, 373 aa, Pseudomonas aeruginosa
SEFAEKFVEDGELVFPALIEVLDAQVARAPFDHRSVAAGDDGGAHAGGDEHLDAMSVQGVEGLELAAVDEEIQLAVGQHAVDVEDRQAYPAGPDREFRGRMGIAHYITPARNRSCMFRAPTGRSSASTTTSAPILLSSMIFRASAARISARTVLPWTVITWSMVTWRTSMPRSRARRRSPSVKMPASLPCSSSTTVMPRPLRVISISAPVSEVPSSTCGSPSPTCMTSSTFSSSRRPSAPPGCEKAKSSAVKPRASSRAIARASPRTRVTVVEEVGARFSGQASWPTLASRFTSAALARGDSGLPVMLIRVMPRRLIRGNRVTISAVEPELDRARTTSSLVIMPMSPWLASAGCTKKEGVPVLARVAAIFLPM

SEQ ID NO: 24546 - protein, 331 aa, Pseudomonas aeruginosa
PGRDRQHRRLHLYRRRRPGTWPRDAGRPQGNRRSSYPPVRQGNPGWSRSVPLSGPRLPGRPAGRALMRRVSPLERIRLFGRAGLDVVAALGRSTLFLGHALLGRRTPGTGLHLLVKQLYSVGVLSLAIIVVSGLFIGMVLALQGYNILISYGSEQAVGQMVALTLLRELGPVVTGLLFAGRAGSALTAEIGNMKATEQLSSLEMIGVDPLKYIVAPRLWAGFISMPLLAAIFSVVGIWGGAMVAVDWLGVYEGSFWANMQNSVQFTEDVLNGVIKSIVFAFVVTWIAVYQGYDCEPTSEGISRATTRTVVYASLAVLGLDFILTALMFGDF

SEQ ID NO: 24547 - protein, 157 aa, Pseudomonas aeruginosa
MQTRTLEIGVGLFLLAGLLALLLLALRVSGLSVGNAGDTYKVYAYFDNIAGVTVRGKVTLAGVTIGKVTAVDLDRDSYTGRVTMEINQNVNNLPVDSTASILTAGLLGEKYIGISVGGDEDVLKDGSTIHDTQSALVLEDLIGKFLLNSVNKDEAKK

SEQ ID NO: 24548 - protein, 185 aa, Pseudomonas aeruginosa
SSTASTSASCSATSSPTPCRRTATTSRRPSPAGVRWSPRPRKPRKRKRPGRNEPGQPARRRGRRTAARRRARLQQRAGVARAGRSADPRQPGGGTGCRLLGGGALQQRGHFPVAGLHARRTQGRQGPERQGVAGRHAGDCQGQQPSGDPAFAGMTGRRNERPSVCASLPGVRRRRAFLYDGRPCA

SEQ ID NO: 24549 - protein, 86 aa, Pseudomonas aeruginosa
GARLRLSMQAEDVKSLLQEKLPGTQVEVEGEGCNFQLNLISDELAGQSPVKRQQQVYAHLNAWIADGSIHAVTMKFFSRAAWAERS

SEQ ID NO: 24550 - protein, 444 aa, Pseudomonas aeruginosa
KRLAMTAPFAIRRLNAADPDFGRHLDHLLSWESVSDDSVNQRVLDIIAAVRSRGDAAVVEFTQRFDGLQAASMADLILPRERLELALTRITVAQREALEVAAERVRSYHEKQKQGSWRYTEADGTVLGQQVTPLDRAGLYVPGGKASYPSSVLMNAIPAKVAGVSEVVMVVPTPRGEINEIVLAAACIAGVDRVFTIGGAQAVAALAYGTESVPRVDKIVGPGNIYVATAKRHVFGQVGIDMIAGPSEILVVCDGQTDPDWIAMDLFSQAEHDEDAQSILVSPDAAFLDRVADSIARLLPTMERAEIIRTSLEGRGALIQVADQAQACAVANRIAPEHLELSVADPESWLPEIRHAGAIFMGRYTAEALGDYCAGPNHVLPTSGTARFSSPLGVYDFQKRSSIINCSAEGASVLGRTASVLARGESLTAHARSAEYRILDEKEA

SEQ ID NO: 24551 - protein, 89 aa, Pseudomonas aeruginosa
STRPMSTSAARAPSPWSIATRTCWSPRRCPSRAPWPACGSAWRSAMPIWSRRWSGSRTASIPTRWIAWRSPARRRLSRTTLISVGPARQ

SEQ ID NO: 24552 - protein, 459 aa, Pseudomonas aeruginosa
SSAISSRRGSTSSCVSPSAVRSRTRRYWTPCTSSSDTKTAPEGGRFQWRGLLAAVLFLLWSRCRRRTQADLGGQVDLLSVAQHHDADLLSRTGARHLVHRAAAVAGFLLVDGQDHIARQQAAACRRTVAIDAGDDDPGGFAEAQRLRQFRGQRLDLDAEPAADHLAVLDDRLHDLQGQLGRDGEADTLGAAGLGEDRRVDADQVAGSVHQRAAGVAGVDRRVGLDEVFVGVQAELVASGGADDAHGHGLADAERVADGEADVAGANAVGAAEGHRRQVLKVDLQHGQVGFRVAADQMGDGFAAVAQGHDDLVGASGHVVVGQQVAFRAHDHRRAEARLHALLLRQVVAEEAAEHRVVEQGVGGLADHLGGVQVGHCRSRSTHRVGIGHRAFLQAAEQRRLLDVHLLAWQADQLGVVLDDQQGQQHADQHGPAEETQGLGHRENPWGCEAEKRPIRWRPL

SEQ ID NO: 24553 - protein, 191 aa, Pseudomonas aeruginosa
RRHELAVAHGAGIGTAQGQRVGAFLARLEEELLQFAAEEFRAARVGEGQGGQRIDDPRLAHHTPPAGFHADDADDDLRRHAVDARCPLQVGFVLVPEQHAVLYVAWRDELLPVAQPGAVRSAGWGIGRGLPVHQADHPVQALGLGEQVVQLLAVEAVLADHPVDEALCRRIVRVIAAQRQYRLHRLAYGAG

SEQ ID NO: 24554 - protein, 652 aa, Pseudomonas aeruginosa
PGRFDGRKETSGLFLRIRSMSHQSDLISEDILAYLGQHERKELLRFLTCGNVDDGKSTLIGRLLHDSKMIYEDHLEAITRDSKKVGTTGDDVDLALLVDGLQAEREQGITIDVAYRYFSTAKRKFIIADTPGHEQYTRNMATGASTCDLAIILIDARYGVQTQTRRHSFIASLLGIRHIVVAINKMDLKGFDQGVFEQIKADYLAFAEKIGLKTSSLHFVPMSALKGDNVVNKSERSPWYAGQSLMEILETVEIAADRNLDDMRFPVQYVNRPNLNFRGFAGTLASGVVRKGDEVVALPSGKGSKVKSIVTFEGELEQAGPGQAVTLTLEDEIDVSRGDMLVHADNRPLVTDGFDAMLVWMAEEPMLPGKKYDIKRATSYVPGSIPSIVHKVDVNTLERTPGSELKLNEIARVKVSLDAPIALDGYEQNRTTGAFIVIDRLTNGTVGAGMIISAPSAAHGSSAHHGSNAHVTREERAGRFGQQPATVLFSGLSGAGKSTLAYAVERKLFDMGRAVYVLDGQNLRHDLNKGLPQDRAGRTENWLRTAHVAKQFNEAGLISLCAFVAPSAEGREQARALIGAERLITVYVQASPQVCRERDPQGLYAAGEDNIPGESFPYDVPLDADLVIDTQALSVEDGVKQVLDLLRERQAI

SEQ ID NO: 24555 - protein, 481 aa, Pseudomonas aeruginosa
RTCCCHACRTDVVAPALLPSGAPFFSLPDIWYRMTTRILTGITPTGTPHLGNYAGAIRPAILASRRSDVDSFYFLADYHALIKCDDPARIQRSRLEIAATWLAGGLDVERATFYRQSDIPEIPELTWLLTCVSAKGLLNRAHAYKAAVDRNVEAGEDPDAGVTMGLYSYPVLMAADILMFNAHKIPVGRDQVQHVEMARDIGQRFNHLFGNGREFFVLPEAVIEENVATLPGLDGRKMSKSYDNTIPLFNPSRQLKDAIARIVTDSRAPGEPKDPDSSHLFLLYSAFASAEQVAAFRQELLDGLAWGEAKQRLFQLLDNELGEARERYQALIAKPDDIEDILLAGAAKARRIATPFIAELREAVGLRSLREPLKSAESGKKKAAKAARLVSFRDDDGSFRFRLLDAAGEQLLLSRAFADGKAAGAVSKRLLAGETADLRAEGNAFGLWLDGEAVAHIPAFADAAARDAAIERTREALAPQE

SEQ ID NO: 24556 - protein, 117 aa, Pseudomonas aeruginosa
ISPLSRHAPFGKPDQGLGPSSYGSGGFYAWNRVRTHMGPDKVFIQTGTEYVGQRETWVGVGGQGVAGMAPVSSEAVYRKTGYYENETILDYFCSITLYTDSRDIITNASVIDCRDSR

SEQ ID NO: 24557 - protein, 577 aa, Pseudomonas aeruginosa
RSVVPRGRSVLAARRLVPVVVEEGLQRQCLAEMPALAEGLGRAAQHVVGLGLCLDPFDDHADLQVLGHRAELVEDQFDGAAVADGLSEDLVDLDRVYRQVGQVDQVRMTGAEIVHVDLQAEFAQAVHPGQQAALGLGGALGQFQRDLFRAHAFPGHLAHGEIDETGVGDVLAGDVDADVEAPLFPQQRPELLQGAAEDETGQQFDVAALLQGADEDIRGNPPQAAIGPARQGLDPGAAAAGQAHDGLVVHLQGLALQRAQQPGRQFFVVEEAEQVAEQQHDAEQQPAADRRGHGRASGLGAKQAAFAEKGDHADVLRRVAQAYLPGADEARPAGPAERLEGLVVVPGETVVDVVAATADGRRRNARVRVVDIEIGVRGNEYDGVAATDQPGGQRLQRQGHALRPEAGAGGIYPVGRGQSPGRAQPAPDARAHDPVAADPANVAHEARLEHDGTQHFQVPVAAGRRAAGVHLAEHLVRRGGNLQCPLQRPLGVRAQVRAVVLAIQFVDDEDPTDTAHQGGGEQYRQDASPVDPAFCSRSTLGHTFFRLMNPWKARQIAEQLHGPCRAVRRTFSDLSRS

SEQ ID NO: 24558 - protein, 259 aa, Pseudomonas aeruginosa
SAIAGRRGASPRAGSSRGTARCAHGSRWPGAGANTPPRAAVPPRRGPSGAGRRHRPRGCSGAGRCARRRRRNRAAVFPASGCSARRGRPDRRRPARGRDRPPRRDARPRRRGRRGPRAWPARWLRPCRPSRRRRSPGAGSWPFLLVEAVAFGFHPHARPDDGLAGAALGPAVDGDQAAVAYAHAAEGAAGLAMVVAREPAQAHGIEHVEHGLTGSRRDGLAIEVDGHVCPREGLDIVLTFKKVHCPFIRERDSREPATL

SEQ ID NO: 24559 - protein, 119 aa, Pseudomonas aeruginosa
VGCRRSPRKSRTRAYPRVPSSKAGSPVGGPMLQSFQPPWWKPPGDLPGSTRVRSPDSDGDLPGLVARLDHLRRLGGDALWPSPVYRSPDPGAAAADRHHPSFRHVRLSARGPRRARGWR

SEQ ID NO: 24560 - protein, 165 aa, Pseudomonas aeruginosa
PLPGSALDRGAWQWWSRCKKGYRGQIHPPRCKGSPERGRILWQGRDMARGNITPRTRQLVDALNDCLGRGEHREMFHHSDDAGNPGSHMGDNFPATFYLPRAMEHRVGEESVRFDEVCVVADRKSFSLLVECIKGNGYHFTAHPDWNVPLRPSFQEALDFFQRKV

SEQ ID NO: 24561 - protein, 406 aa, Pseudomonas aeruginosa
RRPAGGPRRLAGLARRRGPAHRRGACRIPPGTSARRRATLLPGSLPGDALHSQRGPDQAGRRRLALWAVAASWRGTPAAAAGDLPRRTRRRRPGTQPRPALPAPAGQHRQRGSRRPQRPPLPAGHPATRPRPPRRGLPARSDRLQPRLRATAAAPVDHHSGAARAGLRPLLLPVARDHRQRRQRTCAQGPARALRQPAAAWRARGLPRTGEERLPPERGRPEHRAGDRRLRSRGRIAGHVRAQAPLRRRHAFGSLPDRRAHGEPVAGGARAVPGVSRLPRGRGLDPAPCRSARQPFLEPDRGRPGGDVRSLHSLRAAVAVRLDRWRLASPRSGGQGPACAAGGAGDGGRRRGRRAGRAATRAAAAIPRAGRRTPSRTDGPAPPPRTRRSPCHADVQPALEGRPCPA

SEQ ID NO: 24562 - protein, 242 aa, Pseudomonas aeruginosa
LPGARRWGLSAGTRWLLAEKTMRPPLGMASRALVARLMMDSSSWLASVRPRSRSRGKRVSIDTLGPREWISRSVIPRNRSGIAQGCGSRRCLRAKESIRWVRLAPRWAASRAFCKRSAVRWSPGRRFFSSPRLPMITVSRLLKSWATPPVRCPRDSIFWAWNSSWRARSSSRSASIRWVMSRVTLAKPISRPSLSRIGSITTLAQKRLPSLRTRQPSFSKRPSRSAAARPRAGSPASRSSGV

SEQ ID NO: 24563 - protein, 253 aa, Pseudomonas aeruginosa
YEERLPAARWLAPGTWPTFRKTPARPANSIRRNLVRSMAFDMQVGTSPFHRTDPGVPMRNLETATLKLGIFHPHDSLSQALIAAALQRQIEVSALQADLNSLQARPGLRCKPASLASSIEVSQAAAGLDLLFAPLSDYAAEALPPICAALIDGALRAEVPRLFLLGHWQWLVAPRDAGEEQLGAGLERSLTVSGLDWTLVEVPSLPAGLRIDDFSRAGDVAEVEAARVFACAEALLDEVRLGLHKRQCLRLAP

SEQ ID NO: 24564 - protein, 119 aa, Pseudomonas aeruginosa
GEPAMSGPDTLSQAFGTLLLALAFSAFIVFVRGYRPGGVSGAWYDLVLAFVAVWLAFWPEAGVLARSPSLANALGLVLQVGATLLGCLLGYGVARGLRRAMRETRQKRSASSPTSRRGS

SEQ ID NO: 24565 - protein, 208 aa, Pseudomonas aeruginosa
DSTPSSTASPARICTGQTPKLTGWAPPSATTRRVPSASTRLTIMAISSRCASSRTAARRACSRGRCGGLMRATRLPAASLPTSSQQPSSSRWQMALTSSSWPPGPRASRSSSSKARSSSRMPQAARFSRRAFSSFLCCCMAWPSCLRAAASSNCRARGNSSPSSSSMWCSRSSLSTLTRPANCTVSGRVRLRSGRTRESTVRCSSLAS

SEQ ID NO: 24566 - protein, 233 aa, Pseudomonas aeruginosa
RVPRRDGPPPARRRRPRAPCAPGPGERRQPRQPAAPGLRRTVERRWPPCAARPAHRRERRLLPGLPRAAALPGALPGRRLRLPGRSQPPRPAARRTECRPGAGRLRAVSAKPRPGRQPRLRRASQRPRRTPGVAPGDSAATARADDSAAVHGRGMRRARTVPVFHRSPGRTGGRGPRGTTQGVRRVRPLRRGRHPGFAPRPKRGGDLRALASRPGRLRPGLARLLPATAGNPS

SEQ ID NO: 24567 - protein, 681 aa, Pseudomonas aeruginosa
VTHAWPNWPPPWACNSTGRTPTDGRSGSTRRSSAACWKHSAIRRRVRNRSNRAWPRWPGCARTAPTSDCWSANAASRWSKRSAPPAPRASWSTRTARGSPCAWMPKAACRRRPAAAMRSCRWSSGNGRWRWRRRAVRPWPASPRVARVAGVWPPSLCPAPPRRRRPGRQRRPRGPAAQRRAAWRRRAGDQPAARPGRGQRTCLQPLLAVQPAVLQCPARRAGDHSRRGSGGTGDPSRRPGRGDGPPGEPGADRLDSGGGPAHAPAAPTPPRLHRARQSLAPRPRRIPPRSRRGPAAPLPLRDPAGAPGRRPRLETLAGAAAPPRRAGGGRVLRRSRRGSGLPCLRPVADPTLPATCPAPGARGRDGHRSGRRPGGGRRRRRQPGLVAAGRAARRSECRRAAGHPQPVRTGLGRFRVQSRRPAPPRLPGIPRDAAGQPGLARRATHRPCDGPATSLADPARPAAPRRRLPALPATRAAAPAGAGGQSRLGAGHRRGPRHRARRPARGTGTPPSAGYPRAALRAARRTLRAPGAMAGGRHGHHQHPRPAEPVRLVAGPGHPLARPRRTPQRRGMRGRPGTARRGAPGPGRQPRTAGRSRPRRRSTAGRLHRLCRGNPRAVGATAPGGRPGQPGAAEPARPRRRPPELAAALAGKRRADARNAAGRPAPAPARTQPPGCRGGRP

SEQ ID NO: 24568 - protein, 216 aa, Pseudomonas aeruginosa
AWTARPAACWRATASSASPSGRAVTRSCWKTAASRACQPWPAVSASAGRTARPCARCSVNWRLRSPRALRAQPSSARWANSRNATRRLANACTACSRRSTTAWPVGAPRRTTSTGAVSSTSANWSACGSSAARCSRPCTARPSSCSRTVCSMACASITSTAWPIRAAIADACAAAASGSAPVAAARRCCCTLRRSSVARSACPRIGCATAPPATTS

SEQ ID NO: 24569 - protein, 133 aa, Pseudomonas aeruginosa
ACPKCSPTFPSTCFTASPRRTPHERRRKTHTRVRLPDLGIRGLPRRPGRTPLGHGPATGRSGSRRGGTEEDPRSGQGRQGNPGPAASAGRQAAQAEGRVPGAARQRKTGGGQAAQPPQARSGRMRSPVHEQKA

SEQ ID NO: 24570 - protein, 158 aa, Pseudomonas aeruginosa
TSSPPTTVSPCATWFPTITSTTRPTARTTPTAATTTCPGTTAARAPPTTRRSAPCACARCATCCPPCCCPRAPRCWSPATSSAAPSRATTMSIARTTNWAGSTGGWTTRAVRCWPSPSACWPCANAIRSCAGGASWSASTTRRWVSRTSPGWRPAARR

SEQ ID NO: 24571 - protein, 171 aa, Pseudomonas aeruginosa
TAGKKAEPPPAPPVGTCRCRTRRPHIHPTQEDSMKISDIMTRNVQVADPQQSIREAAATMARIDSGALLVGEGDRLVGMITDRDIAIRAVAGGLSGDTPLGRIMSGDIHYCFEDEDVQHVARNMADIQMRRLPVLNREKRLVGVVSLGNIASCRDQASSATVLQGVAQAHY

SEQ ID NO: 24572 - protein, 437 aa, Pseudomonas aeruginosa
AFLPPGPPLPFRPRPGPNRENAMKAVVFHDIGDIRLEDVAEPRLQEPTDAIVRLTASAICGTDLHFVRGSVGGMRPGTILGHEGVGIVEALGDEVRNLQVGDRVVIPSTIACGNCVYCRAGYYAQCDVANPGGSQAGTAFFGGPRANGGFHGLQAEKARIPYANIGLIRLPSSISDDQAILLSDIFPTGYFGAELAGIAPGNTVAVFGCGPVGQFAIASALLLGAARVFAIDRHPDRLHMARQQGAEVIDFEREDPVQALRWLTAGIGVDRAIDAVGVDAEHSHGTATPAPRQEGTSWSPGNAPAQALEWAVQGLAKAGTLSIIGVYAEDSRQFPIGLAMNRNLTIRMGNCHHRKYIPLLLEHVLSGRIDPAKILTQVKPIGDAIEAFEAFDRRETGWIKVELVPQKRQVEGSEERLDERAVDELARRPTPESGARG

SEQ ID NO: 24573 - protein, 313 aa, Pseudomonas aeruginosa
CMSAPARLRIGISGWRYAPWRGDFYPEGLRQKDELRFASRAVNSIEINGTFYALQTPERFRGWAEDTPEDFVFSVKAPRYITHVRRLREIDEPLANFFASGPLALRQRLGPFLWQFPPSMRFDRELFADFLARLPRDGAAAQKLARHSAARLHREGYLDGDPAQRLRHAVEIRHESFVDPTFIELLREYRVALVVADTAGKWPLLGDVCADFLYLRLHGDKELYRSGYSEAALGQWQARIRAWAGGDQADDLRRASQDAPAKATARDLYCYFDNDVKVRAPYDARRLLQLLELDGGLRTVPGQLPDDLRESAA

SEQ ID NO: 24574 - protein, 477 aa, Pseudomonas aeruginosa
STSAVRCTRSACTWDCARRSASASCNCSANWWRACRSASRWWSPATSTTGASALTNCSPVAACAKSSSAPRAGRRAASRRAGRCCRWTAFTCAMPAGASRASSRGGPGRTCPTTCRWRWRWSHELPLARRQPRRTADQRRRVLSAPVPVHRRGAPGDPPGNLHHLRGRGRPAVAGSPQRRRRARCRGAGHGGRLRHRLAQPGLPGQAGRLRGSRAPVRPAPAPARHAHQPVSPVAPQAGGDRSPAGLRRRHQLRRGPPGTSRQHGQAGLRGARRGPGGARYPPGLPGAARTGRRLPAVAAVGRRAAGAGAPGDPRQRPVQRRHRARVPAGDPPGAATPADRQRLFLPRLPPASRAARCGAPRRARRPGTTGHAGHAAGAPVQPAALRLPAARGRAYPRILPASAARQGRGDRRRLVDHRLEQSRSPQPVAEPGGQPGDPRRRLQRPALPAPARAGAPPLPAHQPPPREARLLVASAR

SEQ ID NO: 24575 - protein, 416 aa, Pseudomonas aeruginosa
NRWSRVRRGAGRNARASGATHERQRSRSHLDAAAPLSLALAAQAADPGVLRAGPGAAVPAGEESRLAGSPPRPRRVSPRDPVPRAAAGGRRLYGVQQLRPAQPLLHRPLAAQAAGLHRGVRVQCVQPQPEFLGRRRGAALSPVQSARPGHRRYHPDPHLQPGDQLVRLPAARRHPVQLRPAGLAAGLEARQRRPAPDRRPAPGAGRRLPAGLPFRPTPRLGLARASADPAVLAAGGPARPARSEQLVADGAPAVQPAAAQRGLPERPGDPPDQQHRRGHHPYPGRARGARSGVHRPAPGAPVPGRAAGRVDRLPGAVFPPTPGAGLRGLPAVGAPGDPPAPQTAPPAPGPGVNQPAGRSSNVPSGGRSSTTDCAWPWAPHDSLETRPWLPAPEPANAWASLLSSTSQSPPCGTPIR

SEQ ID NO: 24576 - protein, 189 aa, Pseudomonas aeruginosa
SAARRLPAGPAAAGVRAAPAGVPAGAAPVPPPRPATVVAARSGVCRLRATVRRYAAPRPGRWLRRSRGCRRPDRPTRRPVRCASRRAGRRGWRRSRAVRRGCRIALRAPRWPRISRRARLAPGCPGSSSRRRPGCSGSPAGSSACAARHPRRPAVPRRATGRCRGNRGGSGSRRPRFPGAAPEGSCAAP

SEQ ID NO: 24577 - protein, 130 aa, Pseudomonas aeruginosa
TGSRRRRGRSPPRRGVARGPCGRTAAGWRRRSAGRPCDRAAGAPGPATEAGCRRAGRRRGSPAATGSAARRSPLRTAHSAAPPRPAERCSRAVAGLSRRRTSGASAGRPAASRLPGCSAMRPAAARRGAA

SEQ ID NO: 24578 - protein, 134 aa, Pseudomonas aeruginosa
RTSKPIAAICGRRRITSSKVPWRVGSPLSERGNSSYQLAKRASGRSTSTGYSRLRTRCSRGPTRRNSSPVCAASHSATRSSTLWQACRRSASGAQAAAISGPPRSAQRCSSSSPSRSSRSSGRRAPCLARNSRR

SEQ ID NO: 24579 - protein, 138 aa, Pseudomonas aeruginosa
LAAALPAKIFTRGTRSAVGSLRISWYSATVCSRLSNCRLYSWIRLICTSNSASGSIATPRLSSTRRARAVLFCRRCSAKRARSLASSTCSSRSGRRRSGVSSRSAPRVSTSSSVNPGLAWNSQRRNDTPLVLLLMRCG

SEQ ID NO: 24580 - protein, 72 aa, Pseudomonas aeruginosa
PFPYSGRSAPMQAFMVHFSDAGQPGRTVLTTFAPTLSTSEAHVRLQLCYPLLFPQRLSAVRVYPLLPAAARE

SEQ ID NO: 24581 - protein, 154 aa, Pseudomonas aeruginosa
ATRREASSASCRSGMARSSGRDRVAGGKGLLQRVVQLAILRHLGPGGAATGAIGVATRLALGVAAGAGRAAIVLAVAFDGIGAGLAGAFGTGTGFAVHGQSPVGFTCCVPARSPGASHGGRSSPRGPGRARAGAGSAVTSRACDWRSCRCGARC

SEQ ID NO: 24582 - protein, 149 aa, Pseudomonas aeruginosa
GRRAGPARRATSGSAGSLRACASTAAPGPGRGRGRNGRAAPGWPGWRSKYGIRCCPSAPRRPAPRRCGFATAADDRDRAPGRAGRCRGSSGAPRASGRTVRRRFRRGRAPATPGARAGRAGAGRRSAHGTRRVPACWPGSTGRSAAADG

SEQ ID NO: 24583 - protein, 158 aa, Pseudomonas aeruginosa
SSRCCGANGRRCPDACRSRLQDRACRRWPAGRGGLPRASRRTAAGLRLALPAAPPGARGAPPGRHRADPRLRGTAGRRGRTGCSRRDLPRRRSAGPGSPVDPPRRGRPVRRPANCAADRARPRPSPGAAGVRSSHGRCGSAGARGRLRCGSSADSRPA

SEQ ID NO: 24584 - protein, 187 aa, Pseudomonas aeruginosa
RCCRTSSAKSPVDWSSPARAWPSTSSSTPESSVPRRRTMDSILRAAALYLVLLVLFRIAGRRSLTDITTFDLLLLMIIGEATQQALLGDDFSLVNAVLVIITLIVIDVGLSLLKLRHPKLDTLIEGSPTLIVEYGRPLHARLAEARLREEDILLAARETQGLERMEQIRFAILEKNGKISIIPDRGD

SEQ ID NO: 24585 - protein, 154 aa, Pseudomonas aeruginosa
GSTGRRCRGCRTSRAGAAAPGASAAGRPAARPSPADTRRTAAAPAAARASPSAGRSMAPSRVTSSTSSERSSRLPKESTSSITAPAATFGCSLRSAPYSMAPLACPASRTSAAAACASAGAEARPSVATSAWRRPIPAAKLARKPQPPSASAPT

SEQ ID NO: 24586 - protein, 193 aa, Pseudomonas aeruginosa
  UNSURE (56): Identity of amino acid at the above locations are unknown.
PGRCAAARRRALASSHAACRSGGQRGAPLMARATQGSNNVWVIWLSLLVGLVLAVXPMPTFTEIGRPLWLAMLLTYWVLLLPERVGMVTAWLLGLAQDVLYGNLLGQNALILGLITFLVLSLHQRLRMFPAWQQCLVLVVVYGLAQLLQLWLNALTGNRPPTLTFLLPALVSALLWPWVYALLQFVRLRLNVR

SEQ ID NO: 24587 - protein, 164 aa, Pseudomonas aeruginosa
TADPDRRSAVRARHRYRRVPLAERSARRLRRAPGARQGGRRAGYAGRARRGRLCPGRGYLGGDRRANSRQARGPGRGAGHAGCAVRARTPGSHRRGPGRRWRRRGAGSGVPGALPPGRPGRSAALLAERRAGGQGGRICDPGPRSDIRQPHRRQLQCGGRAAFV

SEQ ID NO: 24588 - protein, 364 aa, Pseudomonas aeruginosa
  UNSURE (30): Identity of amino acid at the above locations are unknown.
GAGAGGAGDQGSDRHQGRTADHPPVDSFAXCGVHAAHQSCRDIPADRGRSRARAPEEGGGRLRGGGRHRGAGRLHSAHRCGRCGRGRDSRRHPLPSPAMGPDRRADPDRRRAFGDLRRPVPGDPYPARPGEPADREDPHRLARELPEDHFLRRRIDAGDFRSPRTLPGRATDLRSLRRRGRNPESPGAQGTAEVRRLPDRRSDRGDDHHRREHRRLRRPSQPRGNHLQDQPRGGHRDRPPTAPAQPGRDHHHRLHRHGGRGASPAGPAHPGEATGARPREDQHHRHHRVGPGADDPQTHPRKPGTDPLRAVPLLPGTRHAEDCGNHLLRDFPRDSPRGACLPGRLLPGAGQPEGGGPAARRGVG

SEQ ID NO: 24589 - protein, 1286 aa, Pseudomonas aeruginosa
RGPALRRMAEMADVGSLGTRLLRIVLGLCALVLVLLALYVSLGRQLVPLVAEYRQQLEDEAGKQLGIPVRIAELTGSWRGFEPLVVARDIQVGDGEQSLRLARVRLAPDLLGSLLARQVRIGSLELEGLKLTLREGEDGQWSLDGLPHSDKPSDPRKLLQFLLQTQRISLLDSQLEVAPRGSAALSLSAVGATLRSSSVGGQSLDARLQLPDGQPLALHAEGRIDSEDWPRSSARFYLSLPQSDWAQWLPAGLTQEWKIVRAKAGGDFWFDWRDGKAQRLVARLLAPQLKASYAARKPVEINDLGMNLFFDREAQGWKVRVGDLAANFGEQRWGEVELLLRRDQQNNEPHWKLQADRVDLTPLVPAIEALAPLPDAAAEWVAGLKPKGILHNLNADFWPQREVPERVSYATNLEKVGISAFHEVPAVENVSGTLTGTLAGGQLDASAQDFMLHLAKVFPEPWRYREARTRMFWSLDDRAFTLGSHLMRVEGEEGRLAGDMLIRLMRDPGAEDYMDLQVGLSDGDARFTAKYLPTQLPGMNKSLANWLKTAIRSGHVEQGYFQWQGSLNRGAAAEAHVMNLYFKVRDGELAYQPGWPALSKTVGEVFVEDSGVRVLASSGNLLNSRVSDVKVDIPLGRPGQTPHLYVDGAVDSNLKDGIKLLQEAPIPTRKIFAGWEGDGPLQGHLKLDIPLDHDEAGKTGVVVDFSTVGATLKMPSPKLDMSEVKGDFRFDLAKGLSAPAVQARVLGSEVRGRIVAEGRGDARTRLLLNGQVAVKSLSDWLGAGQRPLPVSGRLPFQLNLLLDGKDSQLQIDSDLKGAVVDLPAPFGKTAAQARPTQWRMTLDGAERRYWARYDGLASLAYAAPADKPLNGRGALRLGGDPALLPSAQGLRVRGRLAELDWDAWQATLKRYGSGDQAASSAAGLLRGADLRIDSFKGFGQELKNLTVDLARQERAWQLVLVSDLASGRLVLPDARGAPIVVDLDRLNLPKSTLPDENKVEDSDPLAAVDPRSLPAVDVKIGQVALGGQPLGAWSLKVRPGSNGVAFNDLDLDLRGLHVNGSLRWDGSPGNTRSTYQGRIEGKNLADVLKAWNFAPSATSERFRMDINGQWPGSPAYMALKRFSGSMDASLRKGQFVEVEGSAQALRVFGLLNFNAINRRLRLDFSDILGKGLSYDRVKGVLSATDGVYVTREPLKLEGPSSNLELNGTLDLAHDRIDAKLLVTLPLTNNLTLAALIVGGPAVGGAVFVVDKLLGDRVSRFASVQYSVKGPWQDPKISFDKPFEKPR

SEQ ID NO: 24590 - protein, 632 aa, Pseudomonas aeruginosa
IRRLCFRSEDRGGGYAGRPPRPDGLLRPAFSGALYRHARGRRGADHGAVGVHRGDRRGALAGTGPRPRHRDPVLPAGGRTGWRPPTGPGDVRPFGHRRSLGPGPGRAAAGRSGAAGGARRRRTGGYPPAHAGGGAQTIFPAGRTAAGAYGVNMSELLSSVSQQLLAPGGLELDSLPGILHELNGPGIDAADLYFQSQVSESWMLEDGIVKEGSFNLDQGVGVRAQSGEKTGFAYSNAITAEALKQAAVAARSISRAGQNGSVQAFKAVVPARLYAGENPLDVLSRAEKVELLKQIDAATRALDPRIQQVTVSMAGVWEQILVAAIDGSLAADIRPLVRFNVSVIVEQNGRRERGGHGGGGRTDYRYFLQGDRAMGYAREALRQALVNLEAIPAPAGTLPVVMGAGWSGVLLHEAVGHGLEGDFNRKGSSAYSGRVGEKVASSLCTIVDDGTLAGRRGSLSVDDEGTPSNCNVLIENGVLKGYMQDKLNARLMGVARTGNGRRESYAHLPMPRMTNTYMLAGESDPQEIIASVEKGIYCANLGGGQVDITSGKFVFSTSEAYLIENGRITTPVKGATLIGNGPEAMSRVSMVGNDLALDSGVGTCGKDGQSVPVGVGQPTLKIDAITVGGTGA

SEQ ID NO: 24591 - protein, 468 aa, Pseudomonas aeruginosa
ASITRNKETKMTDTRIERDSMGELAVPATALYGAQTQRAVNNFPVSGQRMPQAFVRALLLAKAAAARANVSLQQLDAPMGEAIAETCLQLLQEDFMQHFPVDVFQTGSGTSSNMNANEVVATLASRRLGGKVNPNDHVNCGQSSNDIIPSTIHISAALEISERLLPALRHLEQTIQSKAGEVHAYVKTGRTHLMDAMPVRMSQVLGGWAQQVRQAGVHIESVLPALQQLAQGGTAVGTGINAHPRFAERFSQELNDLTGLAFRPGDDFFALIGSQDTAVAASGQLKTLAVTLMKLANDLRWMNSGPLAGLGEIELEALQPGSSIMPGKVNPVIPEATAMVAAQVIGNDAAIAVAGQSGNFELNVMLPLVADNLLHSIQLLANVSRLLADKAIASFKVNQGKLSEALARNPILVTALNPIIGYQKAAEIAKQAYREGRPIIDVALENTDLDRARLEVLLDPEKLTAGGL

SEQ ID NO: 24592 - protein, 158 aa, Pseudomonas aeruginosa
GRPTTGGTAMRHWQRTIEQGNRCFVTGALIDAREHYLHALALAQVLLERWGDADEAVMAFVISHHNLPDLHLQLEQPEETAEYLCACHERLLRVSADQKLPLALRQAAQHHSRRTYVELLSFIGEHGAYPRTERLLKGPPNAEVRPEFLAPPPSLRYH

SEQ ID NO: 24593 - protein, 207 aa, Pseudomonas aeruginosa
RRVSMPHALPPLPYAYDALEPHIDALTMEIHHSKHHQTYVNNLNAALEGTPYAEQPVENLLRQLAGLPEKLRTPVVNNGGGHANHSLFWTVMSPQGGGRPDGDLGRAIDEQLGGFEAFKDAFTKAALTRFGSGWAWLSVTPQGSLLVESSGNQDSPLMNGNTPILGLDVWEHAYYLKYQNRRPEYIGAFYNVIDWREVARRYAQALA

SEQ ID NO: 24594 - protein, 312 aa, Pseudomonas aeruginosa
CEMAGRQPGGAAMKALLHGIAEGNGRTLRNLLGLLIFIGGGYLLGRHALLLAELNLPAPIVLALKGGLLCAFGTALGAMPVLVVKTMPARLSDALLGFGAGVMLSATAFSLIMPALSAAGDLGYSKFGAGFLVSFGLAVGVMGLFILGRLMPDVHPGCEGAPLSGGIPPRILLFVTAIVLHNIPEGMAVGVSAGAGLDEANGLALGIALQDVPEGLVVALVLAGVGMSRFKAMLVGAASGLVEPLFAVLCAWLVGLSALLLPWGLAAAAGAMLFVVTHEIIPESHRQGHAAEATLGLVFGFCLMMVLDTALG

SEQ ID NO: 24595 - protein, 119 aa, Pseudomonas aeruginosa
RLRLVVSSFRSARSAIGPSNWLSSPIASASERVSVVSGWRRRVSENRLSSVSSSASRYSTSQLMWLSRTSCNSSGKRCNWLGRLRASIDTATCGCSSSVCNRARCARSGSRLAGRLSMQ

SEQ ID NO: 24596 - protein, 395 aa, Pseudomonas aeruginosa
KEIFQLENAARRMHVFLRGDPRNGRFVHAHRFGDVVQDQRLHGFFAVVEETALVLDDLGGDLHQRFVAALQALDEPAGFLQLVAHEGIVGAAVGAADHAGVGGVDAQAWHRLLVQLDQPALVVLAHDDVGDDVFGFARFDLRTGPGMQALDQLDDLAQFVFLELHAPHQLAVVAAAEQVEVVGYQAQRFVQPGRGGRQLAQLQQQALAQVAGADAGGFQLLDAAQHDFHFVELDVQFRIDGGEDFFEGLFEVAIVVDAIDDGHRDHPIGVRHRCQVDLPEQVAVQALAAAGARGEVPFVIVVAGQAAGAGLVDVFPGGIHRQLAGYAFAPLVVVEAFDAGRGAFLEGALLGRAGRLFGAIGERVAVVEIVAVFLAFEHGIGFQRFLDFLLEVQGG

SEQ ID NO: 24597 - protein, 175 aa, Pseudomonas aeruginosa
EISSEAELVPQVDFLDQVVGEDALGIPLRDQLPIIDDIRRFTDVQGLADVVVGDEDADTLRLEVMDDLLDVADRDRVHAGEGLVEEDEFRRAGQGAGDFHPASFAAGQAHAEVVADVVDVEFLQQAFQGFLATVAIEVAAGLEDRHDVVGYRQLAEDRGFLRQVADAGPGAPVHR

SEQ ID NO: 24598 - protein, 314 aa, Pseudomonas aeruginosa
TAWCQALGQNPPQCYSPRPFDPSRMRAFATGQGVQHGRVASQGVLMSTDSAYAVELKGLTFKRGSRAIFDNIDVRIPRGKVTGIMGPSGCGKTTLLRLIASQLRPSKGEVWVNGQNLPQLSRGDLFDMRKQFGVLFQSGALFTDLDVFENVAFPLRVHTQLPEEMIRDIVLMKLQAVGLRGAVELMPDELSGGMKRRVALARAIALDPQILLYDEPFVGQDPIAMGVLVRLIRLLNDALGITSIVVSHDLAETASIADYIYIVGDGRVLGHGTPDVLKETDDPRIRQFVKGIPDGPVPFHYPARDYRADLLGER

SEQ ID NO: 24599 - protein, 119 aa, Pseudomonas aeruginosa
GGRQGQGNRESGRGRGEMSQASLREGAAGELQLAGVLDYSSGPALREQGGRLIRASQAAELVVDCSAVERSSSVGISLLLAFMRDARKAGKVLSVRALPDDMREIAKVSSLLEILPLQE

SEQ ID NO: 24600 - protein, 552 aa, Pseudomonas aeruginosa
TGEDHACLDPGAGPDAGALRRGRSGPAGRLRDRFASGRPAYPRSRGHGRADRGRRRLHQGQGARRRPAWRSLLLRYRQRDRHREPDDGRRAGQRPHRAAERRSRAGGGRPGQLPERHGRQRPRRWLRYHRHRRREAPRRRSLRRTARPYRDRHLPGGRGRDRRPGEVEGYRSDHPRGGPAEAGRGRCPHQHRQQLDRAGHEGQPAEGGQRAYRAVPGVPHRHAGPVHLHERGCRRHRRGHRDGLREPLHACLRNEPHGCADPRRRQHRHRHRRTQAQGRSGHGDRPARIREPGDRRPGGRGRHPDRSHLPHRPWLRVHRRETPAARRQDPPRTGLAEAVAQMLTIALSKGRILDDTLPLLAAAGIVPSENPDKSRKLIIPTSLPDVRLLIVRATDVPTYVEHGAADLGVAGKDVLMEYGGQGLYEPLDLRIANCKLMTAGAIGAPEPKGRLRVATKFVNVAKRYYAEQGRQVDVIKLYGSMELAPLVGLADKIIDVVDTGNTLRANGLEPQELIATISSRLVVNKASMKMQHGRIQSLIDTLRDAVEARHRH

SEQ ID NO: 24601 - protein, 98 aa, Pseudomonas aeruginosa
TPATTIPAVSPRPSDSASSGVSALTSTPSQPRITWPCSMIDCMTSRASLVGMAKPIPWEPPDLEKIAVLMPIRLPAASTSAPPELPGLIAASVWMKFS

SEQ ID NO: 24602 - protein, 94 aa, Pseudomonas aeruginosa
VFRPSWLRPVALMMPMVTVWPTPNGLPMARQTSPVRMPSERPRVIAGRFLRSIFSTARSVSGSLPTKWAMVSRPSRKATMIWSAPAVTWLLVSR

SEQ ID NO: 24603 - protein, 307 aa, Pseudomonas aeruginosa
VAMVDKLTHLKQLEAESIHIIREVAAEFDNPVMLYSIGKDSAVMLHLARKAFFPGKLPFPVMHVDTRWKFQEMYRFRDRMVEEMGLDLITHVNPDGVAQGINPFTHGSAKHTDVMKTEGLKQALDKYGFDAAFGGARRDEEKSRAKERVYSFRDSKHRWDPKNQRPELWNIYNGKVKKGESIRVFPLSNWTELDIWQYIYLEGIPIVPLYFAAEREVIEKNGTLIMIDDERILEHLSDEEKARIEKRMVRFRTLGCYPLTGAVESSATTLPEIIQEMLLTRTSERQGRVIDHDQAGSMEEKKRQGYF

SEQ ID NO: 24604 - protein, 245 aa, Pseudomonas aeruginosa
TSRPEPGSRSSCLSTREIPVSIDGPCGPLEALHLDLPDARGIALVCHPHPLFAGTMQNKVVATLQRSARDAGLATLRFNFRGVGQSAGSYGEGIGEIDDAEAAARWLLARHPGLPLTLMGFSFGSCVAGNLAGRLEAQGVGLARLFMIAPPVERFAVSLPARCPLTVVQPEDDDVVTPAAVYAWSESLARPHELLRVAESGHFLPWQADRSEGPAAATHAGLTSSRRPCYHPARHSFLCLTSGIA

SEQ ID NO: 24605 - protein, 108 aa, Pseudomonas aeruginosa
LRKTSPPCRAWTGARCPRATTTPSRCSTRPGSSRTPSHASSPTRARRASRKTRTVRTCSFFTRPSPAPNRSPRSARNCSTAWPGAKPSSDCSSCSTTNWARLASVTRR

SEQ ID NO: 24606 - protein, 376 aa, Pseudomonas aeruginosa
SDGPVFVALLPIMTPLERYQADLQRPDFFHDAAQANAVKHLQRLYDDLVAADHAKPGLFGKLLGRKSGGPVKGLYFWGGVGRGKTYLVDTFFESLPFEQKVRTHFHRFMKRVHEELKTLKGEKNPLTIIGKRFADEARVICFDEFFVSDITDAMILATLLEELFKNGVSLVATSNIVPDGLYKDGLQRARFLPAIALLKEHTEIVNVDSGVDYRLRALEQAELFHWPLSEQVEEEMARSFKALTPDCAKAQRDEALMIENREIRARLTCDDVAWFEFRELCDGPRSQNDYIELAKIFHAVLISNVEQMGVTKDDMARRFINLVDEFYDRSVKLIISAEVELKDLYSGGRLEFEFQRTLSRLLEMQSHEYLTRPHRP

SEQ ID NO: 24607 - protein, 495 aa, Pseudomonas aeruginosa
VRESGQKAAGSSYFLAQLSSASVGAFPYSRRPAACSQPDPRLFPGDHDDTENPVQLRPRTVSRQRAQVPRTGSRAFPSPMGKGWACRPRALEQGRRGRNALFAPAGRVWRDGRGLPLQRRGHRRDRSGRPDRDRFLPAFGHRCTLHPPLRQRGAEAQVPAEAGIRRDGRGHRHDRAGGRFRPARGEDHCGTGWRRVRHQWLEDLHHQRLPRRPGDRGGEDRSEGWRQGHKPVRGRGGYAGLQQGQAPGEGRDEGPGHLRAVLPGCADSPGEPARQGRPGIHLPDAGAAAGAPDRRYRRAGVGRGGPAMDARLHSRAQGVRQVGGGLPEYPLQACRDGYRDPGRPGLRRSLYGAASPGQAGRTHRRHVQVLDDGPAMQGARRMRAVARRLRLHVGISGGAGLGRCPGAADLRRYQRDHEGDHRAGPVRRAWSPGGADDRIARLSAEPAAAPGPWRLREPGSVAPGGLHRYRRAIPRPASGRRCRDWFPAVPARWRR

SEQ ID NO: 24608 - protein, 370 aa, Pseudomonas aeruginosa
PARRWRCCSGRCWRGAPGRCSGVAGGVSGMPPEPASGGGVDFLSPWVSPPPARYAMSRIPDASIIHSRLRLRQLRLMLALEELGSLRRAADEIGMTQPAATKMLHEAEDLLGVELFERLPRGMRATPFGETLIYYSRMIFAELSGMREELVALESGNLGRVTVGAIPALASSLLTRTIATLKQSHPRLSMSIQVDTSDVLVQALQQDQLDVVLGRIPSGARTDDLVFDSLGEEELCVVVGAQNPLSQARKLDWGELQELTWVLQQHPSPMRGIVNQAFHNARIDLPSSIVETTSIMTLLSLLQQTDMIGITPRSVIEDYPGKHLLAILPIQLEPRLPPYGLITRRNRVHSSAMQTFMASVHAEQARHLAK

SEQ ID NO: 24609 - protein, 84 aa, Pseudomonas aeruginosa
PRAGWTSNILRHFNGVNAMPSIKPFGLALLVLGLSACASLGQSGNRDNEVKVAAQKLIGQPAGKAFELFGGSCRDKGKIHSFGM

SEQ ID NO: 24610 - protein, 127 aa, Pseudomonas aeruginosa
GRGRGGNMIEIASASFRVTPYGEVDIAALDRMRAGFDTSQLLRLVEGLDACLSEMGGITALRDELLKLHAMALTIVEGTAPAAPTENACIWAEAESVQLGLEALATWIRSAQGFLTPLTSLEPEHQQ

SEQ ID NO: 24611 - protein, 156 aa, Pseudomonas aeruginosa
ESQHRRNTGRAGQYRLENHHPSLPERTRRRRPRPERGRIAAQRAAGQPGGPVGGSAQGGSAGRRGPGARATGTGTTRLPEPDSAGRKPYPAAGRSVRWAHGAVPGCPASTAAGTTAAPTGRGRECPPAASQPRPGSAPARPRRADSLAGGQASACP

SEQ ID NO: 24612 - protein, 88 aa, Pseudomonas aeruginosa
LMIQHTEVRSGVEVQMTLPYERTRSVVQAQEFLVELSRDTTLSESIRNEARRLLCHYPSKGDMLQAGRNEEQAAGSIFEPVFSSSIED

SEQ ID NO: 24613 - protein, 335 aa, Pseudomonas aeruginosa
IDSFFSPDPWPLPNSLRHGIPPRRHGGIPIRNVRPTLQGPDRRSRPTRSWNFHEETPRHHRPRPRPDLRPGPGRPPGGHPQGRRIARRVLRQQPAVRLRRRQEQADRRPRRRLCQGPGRQAGRPAASAADQPGQPHPAADGEQGRPGPGQLHHHPGACAAGGLQHPLLLLRPAVHRQERHPDLAGSPQQVAGRRGQGHGQRRRAAREVPRSQGHRLRRHALRFHRPAQRPGPGHHPGRSEADRPAGQRARPRQVRSAALHHFQRPDRRRYSQGREVPDRVRRQEPARAGAGRPGAEDLRHLVRSADQDPAGAPVQDRRQELSGPLRPHDPRASLR

SEQ ID NO: 24614 - protein, 250 aa, Pseudomonas aeruginosa
GAFFVLPDGIPHMFGELLAPQYLRWLLDGFLLTLGLALLSCLLATLIGAPLAIARLSRRRLLSWPARAYLALFRNTPLLVQLFFWYFGVPALLPEALVSWLNTPHETPLLDWPSFEFLAGAWGLTLYTSAFVAEEFRAGIASVRPEQRAAGLALGLTQRQVWRVVVLPQALRTALPPLLGQYMNALKNSSLAMAIGLAELSYASRQVETETFKTFQAFGIATLLYIGAIALIEAFGQALQQTRRYRQGGA

SEQ ID NO: 24615 - protein, 362 aa, Pseudomonas aeruginosa
  UNSURE (15),(241): Identity of amino acid at the above locations are unknown.
DGFLGHLGQPVIPAXRRIPGRPARRSGADPAAGVALRTGFGGARPGPRRGPRGAARQAAPAAGGAARLLPRDPGADADLLDLLPAADRLPCRRTGAGHRGLRAVADRRRLPRPLGVRRHPQPPRRAVGGRPRARTAAVAGIAPGDPAAGAAGDAAILPQPVGVADQGHFPGLRDRRRRAVLRRHPGEQPGDGPPDGDLPVRRPALLPALHQPRPGRRVPRPPPAGLSGGRWLRRRRAPARXRPGRRGNAARRAGRHRPSRRARPAPTPPWPTSPRRRGRSGGGSSSAPWGKAGKTPGTGFAGKAPAPGRRCRPPLRRTPATARTALDGRFPRWRKSGRGRPRRDSRAGGRYRTAGPPRPAPG

SEQ ID NO: 24616 - protein, 221 aa, Pseudomonas aeruginosa
TGASKSVEDMSSMNRPGSTPRRFTRATLSPMLSMALAIMKLPEIFTAIAPRGSFPKNHVFCPIISSSALTCSMASSGPPTTMFSLPASATSVRPNTGAATNARPWRWCAWSSASTQSSDRVDMLRWMRPGLARSSAPLSSSTPRIAWSSASMLMTTSRPNRSPTSSALAAPSATRGSQAAAERFHTVTSSPACTRRVAMAAPMPPRPRNPTFIRFTPHGVL

SEQ ID NO: 24617 - protein, 477 aa, Pseudomonas aeruginosa
VPDLPETGWPLAVPRGGTPGGPPGDRRRHRPSPCSAASVGAARWRRGRPSARRRRSARPRRGSGAGHRTGSRPRPATAARRPAAAARPPPPCPRAPATALPHGPPGSCVGSDAHHQLAEIASLEQAEEGLGGILQAVDPLFAVLDEAVGEPLRHVALEFIVAMAVVVEDDEALHLDALAQDRAHQRRQAVRPGWQLGVVVVGDDAADRDPGLGVEQREDGVEDLAADVLVIDVDAVRAGLGQSFGEVRGMVVEAGIEAEHLHGVAAFFRTAGDADHSAALELADLSDGGADRPGGGGHHQGLAGLGLADVEQAHVGGEAGHAEQAQGVGRMLRRLAQARQAAAVGKRVVLPAVGREYPVADLEPGMVRGFHPADRAADHDRAELHRRRVGRRVAHPSAHVGIERQVDGAQQHLARAGLRKRNLLDAEVIPGRGAVGARGEDDAAVDLRGLGHFQTPLSDECGERLIPCAGQIRPVNY

SEQ ID NO: 24618 - protein, 684 aa, Pseudomonas aeruginosa
SPSRGVRSVLGAVPGTARWIAGRGRRTPAAGCAACSRPPPPPRPGPRAGCGRTSCGRRSPRSPVPPIRRWPRGRRPRRGWRCPGACRRPRRCAGCRAWTVGRRRTRRSRRRRQSRCHRFCSCSGFRTEVLECGKRDRIDRETRPQPADVVASGGAAQAIAAVADAHPPLAVAHAGAGAHLQPGDVLHALFERALDVATGDLFAAADHRIGPRQFDLAGAALGVALDSGAEALDRLQAGEMGFSAFDGLGGRDGLALQEDRQGRDAPADHRRLAAADTRHVAGQVDVRLAALLPDVAFRAQVSVVAEAVLQTQLLAELGARDEAIADRQGAGLHRSRVFQVGPPLFVVGRYRHFRQFPLAAGLHHAPAIVQRNAVELEIAEHAQAVEEQLRLVQQRQAFPGHAAERAGLVDPGDTYPGRMQLAGHQWQQRAAAGDQGIAQGLHHAALDLQLQAAEEHHPGQGPAGERHAALMAAGGQEQVRILHLVQPFRLVEDHQALAVATDHAAVQAQVDVPGAGGEIAPQFFQHPGVARAEVGRIDAGPQGAAIDHPAGTRGLVEEDAGDPAPGQLDGCGHAGRAAADDHRAQVHGRSSWSKRLLSVSTRMPGRTTVWQARRLGRPSMATRQQWHTPMPQKAPLAWPWSLRASRRRPTALSTLSTVSPAAAATGWPLRWMVMSARERGWISC

SEQ ID NO: 24619 - protein, 882 aa, Pseudomonas aeruginosa
RSRRCIALSSVREIVGSRRHYESGRARTLIHDRWVSSPANSGRWGAGVRPGKVEPAPTPGCQAAKPAHPWEAPCCNPSSRPGGNPPVIYQGLPAFVHPTATATCPAWSRAWTTCAALAATPSGRHRCIARPTPALPPQIATTRRSVMSDSVRAGHAAQEVGAELVGVAGRDVGQRDDAYQALVAIHYRQAALLQLRHVLRHMVHFLVLEAVAQFTAHHLAHRAVGSESIGDAAHRQVAVGDHAGQALALVDQQGADIGLAHLLRRLAEGGLGGDGTYFATHDFPDFHRSVSFFRRAVFGAALPACESPAYGEFEVSSRRRSHLPSARAGSVRKTKNLPAFSDISPLPGFLFSTPSLAYAGKRTMRIDGHRQVVSNATAQPGPLLRPADMQARALQDLFDAQGVGVPVEHALRMQAVARQTNTVFGIRPVERIVTTLIEEGFPTKGFSVKGKSSNWGPQAGFICVDQHLSKREDRDTAEIRKLNLAVAKGMDGGAYTQTDLRISRQRLAELVRNFGLVADGVGPVRLLTAQGPSGKRYEFEARQEPDGLYRISRLGRSEAVQVLASPACGLAMTADYDLFLVAPSIEAHGSGGLDARRDTAVRYTPLGAKDPLSEDGFYGRGGIWPGETSLRARGNWWTPSMTAWAGGSTGRCFTTATMRATQAPIWVTTSRPPSTFPGPWSIGSEKSPFASTRSAWWRIGRAFPCWSSASRATAITSPPIPTGTCRCGPASRRRSTFSNVRSDVRRSLARPAFPGGMGILPPVRTGLSEAPDRLSSADVKTAHPVGDAPYASAVRHGQDERPPPWLCWPPLRPASEAFSRSLAKFPPLCWPPLRPASAALSGSLAKLPPLCWPPLRPASAARCGSLAKLPPLAWPPLWPISW

SEQ ID NO: 24620 - protein, 546 aa, Pseudomonas aeruginosa
NSLPWLLEVAAPPFCPASLVLMPCRLSVMLVSSSRGLKGMRRFSPRALTPKACAMDRSNSLRAPWDEKIISRSKAFRLPEYAGRRGKLRMDTPLAGGSGYRRIVHRMDQSASQGVFRTKDARIGHQVSRDVQAFRRITGVLGDNPGVKLQVVVEAHRIFRHPRMVHRAMQGPVERMEQELAVGTGAASLAGEEQDVAHRLDCTQVVGMYRHRQRAQEVVQGKAVAAFPAHGGDVDPQPLGLLWQDLGASVDQIAAGGRIDRPGEMDDVLLGHARLSFRIGSSTVCNAFPTEDCRTSAVSHRRDEWHPGSEGLRSSPASTTQRGAVASGGRYRAPPIPPNELRCCCARPTCTTHSQEQCHARPHLPRQPRCPYRSGCRTAPAGTRRPAASRDRHRHLRLRPTSLPGQDPDGRAGRHPRPRVHGRRRGSRLGRDRGASGRPGGGALRHRLRRVLLLPPEPARRLRDHQPGARRDPQQEADSAGRGALWLQPPVRRRAGWPGRIRSGAQGQQRAFRDSRRNGRRTRAVPQRHPPHRLPGGAQCRRPPGQ

SEQ ID NO: 24621 - protein, 368 aa, Pseudomonas aeruginosa
GAGRGGRDSPADVGHPRSRRFVGSRASAQVRTCQRIGHGVGAGAVCHSLQHLLLSLGQVHAGRAVASIHGRLWRLHVFPAITLVPGTARVALAARHVQVTPGELRHPLQLALREVRLDRVQGLFEGKLVRQLAGHEEGQRILDAGIVGEVDQSFVNDLRTRLGGDVGTQVRGRLADGIDVGRAPGYATGVHQGGPAAVKQRGDMRVVAASGQRTVQLGLLLHRFGQTPLGALVEHADDRTDDFQVAEFLGGDVHQQVLATGIALAEALGEIAHGGGQLALRPAELLQQQVGQARIGRGDPDGVLQSLVMYEHGSFLCGFVDLPSDGHSNNGYSKRRFHPAHGSSESRSGRWFRTFPQRVSPGATAPLR

SEQ ID NO: 24622 - protein, 183 aa, Pseudomonas aeruginosa
AKSFTTSSPCSSPVPAVRRGSGAPVPERPGSVIAGIGALAAKYVVAAGGVAEDEGNDERRASRPRPAGDFPPAAPPPAGAVPDGAPGPLRATSGNAATGGRRRSLRVTRRHAGRPTRCPGGPAAGTVARPFPASPRHLRSGRRRDSGRRNRNAAPANSFPPGRRRARPATHAGPRPALRPPAP

SEQ ID NO: 24623 - protein, 774 aa, Pseudomonas aeruginosa
TARPGSARRPGAGRRRRYAAPGSAHGMTAGSSTRPGHPRGCSRSRAAAPGGGDRRPRRARQEECSSSATRRRVPVDSSPGRCAGRRGTARMRSTPAAAAATATRAGAQPCGRGSAVSPHARAGRRPGCAGPPAPGPRTGGRSAPPGCFAPAASRRRDGCRRRASAGRSPWPDAPGVAGPDRGSARPRPGWRTPGWPPRPGIRTSPRRNARRACHGRPRRIRRGRSGRCPGRRHRAGRILPRCRSEGRWRPGRGSSAQLPGIVSGRRRSAVEVRFFRREVPRRAADPASETFFPWCHSHPYVWSPRPPPQTHDKERDMSLSSPLPASSASPSPRVRDLYHALLDEPREHLEAAGEFLDQQLSLAATHDDDLPEDPADWPAWLDAGARRTAEAHAEYLRARRRGEGRRYFQVPSQAMHFIRSVAPTKLVDGAWLYGLLPHHGEERLRPLLETFLEELGDGVPARNHVLLYRRLLASIGSEEVEGLSDLHYLQGTQQLALGHLAADYLPEVIGYNLGYEQPPLHLLITTQELRELGFDPYYFQLHVTIDNAASGHARKALRALYDNLPQLGGRAAFLERVRNGYRLNEVGLSTEQVIDGFDLEEELLAMFERKRPYAAGMHSDRCRIGGRTVNQWLAVPGRFPAFLACLEEEGWIRRHADPRGSRFWNLIEGDRAAMFGVFTPYERQLLYDWIAGDWQAPAPADRDPLAPLAEPATAGGDVDAEQVALRRELLRLSPEQGVARLLELMAPHLHHGPAGLLATRMFSQRWRAAHAQPE

SEQ ID NO: 24624 - protein, 190 aa, Pseudomonas aeruginosa
GRGSAGRSRATGPGCRGWRRSPPAPRIACRCCAPASPRSRSGPRHPPGAAPVAERRRRGPCGCESRRSRGRGSRSRRGRTGAPRRRSSWRYGQRCPGCGSRSRRPLRRAGGCAWPGSRGLSVFLWFSWTCSLVGCSTRAARHTQQGSTKNVFRPLAGSPQELGRPFGRPRRGRRIPFAGTLSGVWLSICR

SEQ ID NO: 24625 - protein, 108 aa, Pseudomonas aeruginosa
SRSRDGVDLFLALRELGRPDQMNLSYLYLKKILEEELRDHDCQCLLNSDFTVTISCRVDGPHGALYIVPNSDFLKSSSFSDLSAFILNLREEIRRFGEFEAELQTGTG

SEQ ID NO: 24626 - protein, 152 aa, Pseudomonas aeruginosa
AGSRRVRRDRGRSPGCCPAGACLRGSRTTRRAPRAAPDRRGRLPARRSRRCSRRRPARTARARRSAPDRCHPGPGQCRSCAARRSSRGRRSPRRCRRSARTRWPGAPRGPGPGPAARRSHRAPPAGRSRHRPVRRARCGSGAGDRGSSAGNR

SEQ ID NO: 24627 - protein, 217 aa, Pseudomonas aeruginosa
TRARRNRRADLRHCSRPGARRSPCRPGCGSGPGRGGLAGAIRVRSGRRTPASGLPPASAPGPGCPALRVRRPRDRHYGPPPVSAEGLRSCSAPPGWKPGIQGSGMGERGSSLGCSIGISSGNSWGTWLSWSGTGYSSGSLEGLRGVVAVAPDDAEVGKRMSASIVGMTSRWRGRRRIWFGPCVGRPGRRLTDPELKQPAQRARLMVRSLPPATRTLR

SEQ ID NO: 24628 - protein, 648 aa, Pseudomonas aeruginosa
GNRAELPRCGDARDQRLPLSLAAQRHALQGDGRADVLERLGGALQPPVPAPVEEYRSGPARGTPVMAIRRRFGAQFQGNGRTCFGLWAPDAREVRVETADGRDWPLEGSDSGWFEATLPCPPGTRYRYRIDGRPGVPDPASQFQPDGVHGHSQVLDHGAYAWRVDEWRGRPWHEAVIYELHVGLFGSYAEVEHFLPRLVELGVTAVELMPLGEFPGRRNWGYDGVLPFAPASAYGTPEQLKHLIDSAHGMGLMVFVDVIYNHFGPDGNYLAQYAAAFFRDDRQTPWGQAIDFRRGEVREFFYENALMWLLDYRVDGLRFDAVHAIPDSAFLVEMARRLRGAAGPERHVHLVLENDDNRASLLRQGYDAQWNDDGHHALHVLLTGENDGYYQDYPEPLRCLARCLAEGFVYQGEANRHGRPRGEPSADLAPDAFVLFLQNHDQVGNRAFGERLSVLAEPQALRLAIALQLLAPMIPLLFMGEECAAREPFLYFTDHQGELADAVREGRRKEFGEFGRFGEGATLASLPDPNAVETFERSRPGLADCDPAWRGFYRQLLEIRHEHLIPRLRGARSLGVTTIAGAALSARWRLGDGSDWRIDFNPSPLEAEVEPPAAATWVLFLDNLACAEYRRGRLSPRSIAVSLEPAHE

SEQ ID NO: 24629 - protein, 681 aa, Pseudomonas aeruginosa
RTPGRTGRRRGPATRLAGRQRTAAAGRPGGPARPAGSTRLSGAESATDRTEPGRAGPAARGQRQPRTAGRRMRPAAGASARPRRHPGRAGLRGRHADRPAPGCRRPPAGAGPQRLCAAVAGAAGMGGGDGAAELSVPGQPRPGSLASLGSGRPVYALRRPGDGGLGDSAALEDLLRSAARHGADALAISPLHALAEANGHAYSPYSPSSRLFFNVLHAAPATILGAAAVEQAIRRAGLAAEMARLESLELIDWTAAADLRMRLLRQLHRDFTERASPLRHDLAEFRREAGEALLHHCRFETLQAHLGAGPDWRRWPEPLRRPGEPAVAAFCADHAEEVDFRAFGQWLTQRCLQHAQRQAREAGMAIGLVADLAVGADGGGSQAWSRQEELLAEVNVGAPPDILNQSGQDWGVSAFNPEGLRRHGYRAFREMLRANLAWPGGLRIDHVMGLQRLWLIPRGQPPHAGAYLRYPQRELLRLLALEASRASALVIGEDLGTVPEGLREELARRQVLGTRVLLFERRGERFVPPAQWPADAMATTSTHDLPSLSGWWRGQDIHWRGRAGHRSAEECAADLELRAEERRALAASLEPPVDPDPAAEVPLDACIGYVGATPAPLVLLPLEDALGSLEQPNLPGPGDAHPNWRRRWPENAAQMLGTPQVDRRLRLLERSRRDAEEAAHD

SEQ ID NO: 24630 - protein, 343 aa, Pseudomonas aeruginosa
APRYPAPAIPRRLHPRRCPALAGLFRRPGHQPSLRLAAVPRAARLQPRLRRGRPDPDQSGTGRRAGAAAPDPGAAATRHGPAHGHSAEPHGHRRRRQSLVAGRARMGARESLREFLRHSVGIPRRRVARPGAAAVPAQRLRRGPGCRGDRPEPGPRGRPPAGEPRRAALPPLAGQLPGAAGRQRRAAPVSPGRRFPRVPAGPRGLARDAASTGGCARRERSARSPPAHAGRTPGTPRGGSPTPAPPARGAALPPGQLAHRGGRHQLAPFLRHQRTGRPAGRARRGVRGRARQGLPVARGRSARWPAHRSRRRPGRSARLLPTPAPPQRADPRPSRRRADAAVR

SEQ ID NO: 24631 - protein, 171 aa, Pseudomonas aeruginosa
PGEPRPGTFAGGAGRPGQPRPDPGRYPPRAVPVARALSGLPYLRRGLRSLGAGSRGVPLCRRGGPRGSRRSRPGGPRPSRTLARRAAAARAAARSAAAPARRVAGALPAVEFADRRQGRGGYRLLSLGGPALAQRRRLRPAALRRFRRGIPCRLRSQAPGQPTRPAGHRQP

SEQ ID NO: 24632 - protein, 411 aa, Pseudomonas aeruginosa
RRALAKPGHAVAPRPRRGAGAESRRRADPVPGPARQLAARRALRRRRPGPSVPRADARMAMQGLARSQAAHALDRARRRLRARLRRLSGTAPARATGPGPAPVAGQRGGATDAGRGPEWPRPMPAAPDLPGYPRSLPGARGLGLQPGRPGQPEAGGLRPARRRPGRADALPGTAGALARRSHQADPDRPRAGAAADAAGPVPRRRLPAPGGQRRACRAGPGLRPAQSSRLPAGGGPAPGLRPARPRHAAAGAGRGLGRHLPAAAAESLRMHLQRPVFHHAAAQRRAPEPVRSARRLSRQPALPPRPGGHPMSADEKRIREFAYQIWESEGCPDGQAERHWAMARQLAEAEAAAAAPKKTRGRAKAAKETPALLQAPAAKPRKPRAASPARPASEKPAAAKPRSRRKPEAGE

SEQ ID NO: 24633 - protein, 647 aa, Pseudomonas aeruginosa
GVQCMSRKRSPAPSRISEGHPFPLGATWDGLGVNFALFSAHATKVELCLFDARGEKEIERIELPEYTDEIWHGYLPDAHPGQIYGYRVHGPYEPDAGHRFNPNKLLLDPYAKQLVGRLRWSEALFGYTIGSADADLSFDERDSAPFVPKSKVIDPAFTWAERPPVRVPWDRTVIYEAHLRGLSMRHPQVPEAVRGTFAGLMNADLLAHIRRLGVTSVELLPIHGFVDDKHLLENGMSNYWGYNSIAFFAPHPAYLASGQVNEFKEMVAHLHDAGLELILDVVYNHTAEGNELGPTLCMRGIDNASYYRLMPDQRRYYINDSGTGNTLDLSHPCVLQMVTDSLRYWATEMRVDGFRFDLATILGRHPDGFDERHGFLVACRQDPVLSKCKLIAEPWDCGPGGYQVGGFPPGWAEWNDRFRDCVRAYWRGDDGHAAGTGATPNRLRRSLRPAWTAALRVGELRHRPRRFHPARRGFLRSQAQRGQRREQRRRQRPQPVLEPRLRGPHRRPGDPRPAPAPDAQPAVHPAAVPGHPDAGRRRRVQPHPAGQQQCLLPGQRTGLDRLAAGRRGPFAAGLHPAPAGPAPTLSDPAQGALPGRRVQRGAGCQGRHLAGARRRGDDRGTLARRARPLSRRAPRWPRATHRDPAQR

SEQ ID NO: 24634 - protein, 320 aa, Pseudomonas aeruginosa
TASRSTAPSTPCRRPSASAAGPRTPPRTSFSASRPRVTSPTCGDCARSTSRWRTSSPPAPSPCASASARSSGSSRRACASTASCSPISSPACRATAPPRRSSPGTAPRACTARATSTAIRRSACGMPWKSAMRASSTRRSSSCCANTGLPWWWPIPPASGRCSATSAPTSSTCACMATRSSTAAAIRKRPWASGRHGSAPGPAATRPTTCAGPARTPRRRRRRATCTATSTTTSRCAHPTTPGASCSCWNSTAACARCPDSCPMTCGRVPHDPAAPAGADGEHPQGFQPVQSALHPAGVARSGAQRRCRPGVPPGGPRLP

SEQ ID NO: 24635 - protein, 800 aa, Pseudomonas aeruginosa
PTARRLRPARSLRRRPGPAGAQLPGALAGAAAGPHLPAQCPRAPAAHPLAAALVAPVRPPAAGGGGGAMNFPWRDGNRVELLINGEEYFPRLFQCIAEARREILLETFIIFEDEVGRQLQEALSAAAERGVEVQVTVDGYGTASLSPDYLARLAASGVRVHLFDPRPRLLGMRTNLFRRLHRKLVVIDRRQAFVGGINYGEDHLVRRGNMAKQDYAVRVEGPVVRDIRQACLALLEPDADYPPLRPSGAGQPARVRLVIRDNDQSSDDIEREYLQAIRQARRRLLIANAYFFPGYRLLRELRDAARRGVRVDLVLQGMPDMPLVRLCSRLLYDYLLREGVRIHEYCQRPLHGKVAVIDDDWSTIGSSNLDPLSLSLNLEANLVIRDVAFNGQLYQHLRELARRHCRRISRRHARRGYWWRAPADFPRLPLFQALSGYRRLGTRPSATPEIAGAASVAALAGTPGPAGQPMNGSGHEATSTPPRRSHWRWLRRLLTLAFFVLVPVLLFLLVKNLDWQEVRHALDEYRPATLFLGLLLAAAGYTVFSSFDLLSRYYIGHSLPKRRVFTVAFVCNAFNLNLSSWVGAVALRYRLYSRLGLDIADITRILTFSLVTNWFGYLLLAGILFSCGLPALPPGWKLGSDGLRLIGALLLALAAGYLLACRFARRRAWGWREHRLTLPSWRLAALQGLLGASNWSLMALLLYSLLPHSVDYPSVLAILLISSIAGVITHIPAGLGVLEAVFIALLQGRLSQGVLLAALIGYRVLYFLLPLALACVVYLLLERRAIRLRRKQRRLRQGQA

SEQ ID NO: 24636 - protein, 1374 aa, Pseudomonas aeruginosa
NRRPPRRARRSAPRPRSARPPRLRDGSLARPDRRPVGGGCLRRTGRGRVRRATARRHRGLRFPARRPASARAGCSAVAGAPGGAGTSRCRGRSAPVRRASRRLRRAARRAARRAGRRAARRLRRRGRAAGRGRRMDRPAGRAAACPAPVASVRVRTSVRSSVLALQEVFGEFGQTGERHFQPVGAVVGFVEQFVGGLFQAGQGQRRPLAFATVPGVHEPPRGGPIAGQEGIAGFAAIAHGDLAPGAVGLFRAIGALRVAQDHRRRVVERAQHAADVLHRTVALAALFQAARRLALEVDEACVALDHQHLAQVQVAVNPDQQPAGCLPGQQRQAFEQRRQAFQQAPRPFRRLALQRSWRLAQAFAGFAQLFGDTQRPGLDAGFVALAAAEGRIVRLAGQYAVHLAEPGAEVGGEAAQFGEAVVLPFERLAGRGYLVAHGSLQVVQGPVPGVALVVQVALQDHQRVRLAIRADPPYLAEQRGDAGVTVAGQVAADLDFRVQPRKDLAQHLEDHALAEADRAVGLLHRERQDVFVGDVVHFRQSRRRDELDLAVAVGDHRLGAELREDLAGEQRQAGGVGQQADLATAPQARQGQQLRQAVAALVGVEEAQRQLVAQPVDLHFAQRTARLRLVQRNDVAEPWLAFLAGEPAALRQVGRQRLAFQDVPRCALQQLAEALLDHQGRQFRQALVGGHVPARHLRRVGQVEPVEAVGRQGQQVGQLADRRERHAADHLHRHLAGMAGEVQFHRLGRARQVGHAEDAVLPFALGVFAQVGEDPSVARREHLQAAAAEGLLLAAHGEQAAHPVEQRMRVARLRLDVDRLVAVQRVEDRRQHQLRRVGAGEAAVAVHRPLHRGPHAVAVAEVDVVAHADLVAVVQGRRARHRQQQAVQQLDAPPVTLHQRRQAPADAQVEARAAVGGIVVPEIVALVVGDHLQGQLVVVAQEDRPLAIGRDVRGLAQDVGDRIAILLGDGHVHARHQREVEGHVAFVALAAILAAEVRPGVFRPLVGLGQQHAVGIVRVQLGADALEHLVGLRQVLAAGAVAFDQVGNRVQAQAVDAHVQPVAHHPEHLAQDLRVVEVQVRLVGIEAVPVVLLGYRVPGPVGLLGVDEDDPRTLVFLVAVRPDVVVAGARSLLRVAGADEPGMLVGGVVDHQLGNHPQTASMGLGDEPAGVGEAAVVAVHATVLGDVVAVVAAWRRVERQQPESVHAEVGDVVELLDQPGEVADTIVVGVVEGFHVDLVDHRVLVPLRVVEKDRFLASGHGFLLMRRRAARARCRTAGARVRCASTGPCRARPSDARSSGPRPGGWRRRAGRTPTAAVRNAPPGLRAGPGRPPPGRSWRGPRCACRNTGCGRSRRCRPGTRGASAMPGFPGGCG

SEQ ID NO: 24637 - protein, 330 aa, Pseudomonas aeruginosa
RCPRTSSAGSPRSASYRPDARRTSRDARAARGGRGSTGWRSPAPVPCRARAPQRAAGGNPRGRPVRDGSPRGRHPRCRSHTGCRGRRPRHARNCCGPCDGCGRWGGSAGNRERRSPSRRSAAGAGSRRRRYRGVSGRRFPSEGTARTNWRSAPAVAPPPPGIRGCAPGARAGRPDATVRRSAPPATAPPAPRRSGRPAGVRPAAHRRRRSPDRRARRSAAAVRRPRAAPGPAAGVRHAWHAIRGGSRQNGRSRPRYGSTGGRRAACATARSRNRCLRAAAAGAAPRFPRHAARPPRHRVPHGHRRRFARPGAGRGRSRSSRDRHPLPPQG

SEQ ID NO: 24638 - protein, 141 aa, Pseudomonas aeruginosa
RSAIPALFHFSRRTGGETAFRRLLRRGAQLRPGLQRGPRPRRGRPSSPAPGSRRAGRREKPLQPAGDSRRAGHPSPVPGRGPGMAQPAGRAGVDQPDGAGQRAGGILPPRLRPSPGGPRTPSPGRLLVRPFIASRYPGRIR

SEQ ID NO: 24639 - protein, 940 aa, Pseudomonas aeruginosa
PAELATGGAVAAEHAVDGPGIHQEQQDQQREDQVGGIHRGPPRHLVARWRPCAPGEFRLFRGRSAAPELAPHGRADALAGAGVVGPGIVAGEFVEALRQTAQVPLVGALQRVEFLAEHRYRHRQPFAGAHRVGGHGAGAAAVAQVVDEDLADPVARPGNRRETLRHQARQVLGDGLGEILDLVPAMPALQRHQQVHALAAAGLEEGAQAQLVEQRQAQLGRFEHALPRQRRVRVEVEDETVGPLQVGQAGVPSMEFDAAHLHRADQRLGAADLQQRRMTGIERRVELDDAGDLQARRVLLEEQFAADSVGAAHQRHRALAQVAQEQVGVARMVLGEFQLAGLDRRVDQPLRMADAHAGGGRPRRTGAGLARAAQRRRAGGTLAGHLARRLVFAQAVEHCLADDPATGHLRIGNLAQLLRAHPLHRPGLARRRHLRQWAGADREGFQALTDLLQAGRGEAAADLAGIAQPALLVRAVEAEQQGADMPARALRLGIADDHELLAQLALQLDPVVAAARTVGAAQTLADHAFKTELAGAGQQVAGVFRERRGEPQRVFVSPFQQRLQARAALLQGDIAQILAFVVRQVEEDVQDVLAATFLEGVLQGLEVRSTLLVEDDQFAVQPTALQTEPGQGLLQVRQAFGPVMAVAGQQAHVAVFDAAHQPIAVQLEFVGPLPSRRLLDQAGQLGGDPFGHRRLPPALAESRRPGRGRGGFAMAGQQRTLAEHAVGTLLQHVEAIQAARLAVLGLDQEPLGLLAAQVGADQVPTPGEFLAIQGEAEMALFQALARIVQRRPGASVPDDDIAGAVVPLGDAAFEIGIVQRMVLNLHREPLHRRVEARPLGHRPALQGAIQLQAEVVVQAAGVVLLDAIAEQPGAVLARLAATGLRGLAEIALAGVLGERLAAGHGGLLGAQTPGQTGALCRTMSMAFPSSSRVTGLSSTG

SEQ ID NO: 24640 - protein, 342 aa, Pseudomonas aeruginosa
SRAPRRSSSSTAGHCTHAWPRPACARKTFSWPPARPRAWNAWSRSASPSSRRTARSRSFPIAATDAARVAHQQRLDAQTVQADAQGDEVQHQVAGGMRERRRQPLVQRVAEVVQAADAADAEPAEQAPLRRVHQPPADQQPDHRRPTHAEQQQRQRQRAPVPVLVGAWHRAGSPAALPASAPAGCRRRARRASPRRPPPSGVRCGRRRTRWRRWPALPRARRRRPPAPRPVPRRAPASPPRRGAGRSRRRSWRGSPSRPVRRRRHRTARSAPGRGSRWPTPRCRCAAPAGGWPGGRDHGPGNSPPAGRAESPRARRAAASPGRCGRTPRAGRRPDRSAAGRR

SEQ ID NO: 24641 - protein, 254 aa, Pseudomonas aeruginosa
AGSKEASRRSSRVALALSVRLASSSTSSFLRSARLRSSALTLPWSSIICLANTFTSAAVLFSSAILPASISATPAAEASLTKVCGAVLFMSWALAKGRARTSRSQAAPLRGRLIALFMVDSVGVTGKKCRDFGTTHLGIVAAVTAPPADRSDFSPTVPGRAPSPVTPGGSPAPRSAPGSSAGVRTAAVRPASAARSRCPGDRRPRSAAGRTHRPPRDLPGPRRAPVRGTGPADGAALRRPSPSDVLRGYTGNRS

SEQ ID NO: 24642 - protein, 213 aa, Pseudomonas aeruginosa
SAHRPTRFPGASMPSLYLASASPRRRELLTQIGVPLSVLATAIDESPLPNEAPAAYVERLARGKAAAGLAMLEGRGEDGYVLGADTSVVIDGRILGKPVDQAEGLAMLAALSGREHQVLTAVALAAAGGVEARVVESRVRFRQVAPEEALRYWQSGEPADKAGGYAIQGLGAIFVSRIEGSYSAVVGLPLCETAELLREFGIPCWQPVGGNPP

SEQ ID NO: 24643 - protein, 496 aa, Pseudomonas aeruginosa
  UNSURE (130): Identity of amino acid at the above locations are unknown.
RLTRRNKDSGRMSEEILINITPMESRVAVVENGVLQEVHVERTQRRGIVGNIYKGRVVRVLPGMQAAFVDIGLERAAFIHAAEISNREGSAVESISALVHEGQALVVQVTKDPIGTKGARLTTHLSIPSXYVVYMPRTSHVGISLRIEDEVERERLKKVVADCVAAEGIEGQGGFILRTAAEGAGEDEILADIRYLRRLWDQIAAQIQTVGAPSVIYEDLSLAIRTLRDLVNPRIEKIRIDSRENFQKITSFVEELMPEISDRLEHYPGERPIFDLYGVEDEIQKALERKVLLKSGGYLIVDPTEAMTTIDVNTGAFVGHRNLEETIFKTNLEAATAIARQLRLRNLGGIIIIDFIDMEDEEHRRQVLRTLEKQLERDHAKTNIIGITELGLVQMTRKRTRESLVQILCEPCPCCQGRGMLKTAETTCYEIFREILREARAYQADSYLVLANQKVVDRLLDEESGNVADLEAFIGRTIKFQVEAMYSQEQYDVVLL

SEQ ID NO: 24644 - protein, 349 aa, Pseudomonas aeruginosa
SAVRRSAARSSSSTSCSATGSRASPACNTASRAPGRIRRSASTSHSRSPAERRPVPRRGAFVRKEETMSIAVIQMVSQDDVTANLAAARRLLEQAAEGGARLAVLPENFAAMGRRDLAELGRAEARGNGPILPWLNSAARDLRLWIVAGTLPLPPDGQPEAKANACSLLIDEHGERVARYDKLHLFDVDVADARGRYRESDDYAFGQKIVVADTPVGRLGLTVCYDLRFPELYTAMREAGAELITAPSAFTAVTGAAHWQVLVRARAIETQCYLLAAGQGGVHPRGRETFGHSAIVDPWGRVLAERPQGEAVLLAVRDAAEQADIRRRMPVVAHRRFFPPAEPRPARTE

SEQ ID NO: 24645 - protein, 374 aa, Pseudomonas aeruginosa
TRCRRRGNTACRRSARRRRRRSPGVSGGPGPGVPRPNGYRSLHHSCAQQVVHVQGADRTVVRVDHHQCADLVVFHDLQGFRGENFGADGLAVDGHHLVDGDLADVDAPIQGATQVAIGENAGKLAMFVEHYGHAQALAGHFHQRAGQRGAEQHLRQPFAHVHDVFHLQQQSAAQRTARVREGEVFRGKAAGFEQGDRQGVAEDQGYGGGGGRGQVQWTGFLADTGVQVHFRSLGQGRLGVTGHADQGDAQALDQRQQGDDFGSRAGVGQGEDHVVLGDHAHVAVAGLGRMHEEGGGAGAGQGSGDLLADVTGLAHADDDDPALAGQQQFAGLDEIVANPRQQAVYRVALEADGALGGMDEIEVLAHVQRMWRLD

SEQ ID NO: 24646 - protein, 413 aa, Pseudomonas aeruginosa
SLSPRAYPPVRPRRPGRGRRARPLDPVPRPRPARPAHARHRVAPAGEATLFGRRAVAGDHRRLGPVHWHGAGPAGVQHPDFLWFRAGGRADGGPDPAARTGAGGDRPAVRRPCRLCAYRGNRQHEGHRTAFQPGNDRCRPAQVHRRAAPVGRFHLHAAARRDLQRGRHLGRGDGRGRLAGRIRGVVLGEHAEQRAVHRGCAQRRDQKYRIRLRGDLDRGLPRLRLRADLGRNQPGDDSDRGLCLPGGAGARLHSDCFDVWRFLNANPHPGNRCRPVPPGRPAGPVAAGPAGQRPERGQRRRYLQGLRLLRQHRRCYRARQGHPGRRDDRQGDGGRPGSRQLHWSRDHGDQPEREQPAGRFHGVDPDRRPAGREIHRHQRRRRRGRSEGRQHHPRHPVGAGAGRPDRQVPAELG

SEQ ID NO: 24647 - protein, 226 aa, Pseudomonas aeruginosa
QRRSQKVRFSSMLTLLRRGLLVFLAAFPLLSMAAPTPQQVVQGTVDELLSDIKANKAAYKADPQKLYATLDRILGPVVDAEGIAKSVMTVKYSRQASPEQIKRFEEVFKNSLMQFYGNALLEYDNQDIRVLPSSAKPSDDRASVNMEIRDSKGTVYPVSYTMTNLAGGWKVRNVIINGINIGKLFRDQFADTMQKNRNDLEKTIAGWGEVVAKAKETAKAEEAGAK

SEQ ID NO: 24648 - protein, 501 aa, Pseudomonas aeruginosa
EPSPGKTPRHPGGSRGRRVQFPTESDQRRTGRPEPGQASAAGLRPFERLDRRWQHPCRHHEILQPRRLGRAFLSPRGIIAMDKLIITGGNRLDGEIRISGAKNSALPILAATLLADTPVTVCNLPHLHDITTMIELFGRMGVQPIIDEKLNVEVDASSIKTLVAPYELVKTMRASILVLGPMLARFGEAEVALPGGCAIGSRPVDLHIRGLEAMGAQIEVEGGYIKAKAPAGGLRGGHFFFDTVSVTGTENLMMAAALANGRTVLQNAAREPEVVDLANCLNAMGANVQGAGSDTIVIEGVKRLGGARYDVLPDRIETGTYLVAAAATGGRVKLKDTDPTILEAVLQKLEEAGAHISTGSNWIELDMKGNRPKAVNVRTAPYPAFPTDMQAQFISMNAVAEGTGAVIETVFENRFMHVYEMNRMGAQILVEGNTAIVTGVPKLKGAPVMATDLRASASLVIAGLVAEGDTLIDRIYHIDRGYECIEEKLQLLGAKIRRVPG

SEQ ID NO: 24649 - protein, 377 aa, Pseudomonas aeruginosa
SGLRASSGSSAELGKCLRRFGQPARPRHHRRRTQPWRRRRGRVHPALRRSPGRLDGRPDPAARAPGAGSHPYHRSPARSPGSRRRARAQLPREAEAGFLALHRGRRHGARPAGHPAGPRRALCAGRQGVLPVLGADECDPGQGRRGVRSGHGCTDPARRDQRDRPRRRLHRRRRPCLHHRRGTGRGRVGLRHRKRAAGGQDRRPRQHLRGHRQASRVRPGRHRHDRRSLGNPRGLRWPDRSRLDRHGPVLPGRTRRRRPVDPGQSGCGVPGPRRGQHRSPAADHGARRDHPHLPGGARRADPGRRPGPGLCGRQPHRPGTPGAVGGRSGKLAAGDPPCRRDLHGPLHCRGPGRLLRRPEPRAADLRYRAFLFAAGGI

SEQ ID NO: 24650 - protein, 364 aa, Pseudomonas aeruginosa
CRIPHPRREGGLSMSKFWSPFVKDLVPYVPGEQPKLSRLVKLNTNENPYGPSPQALAAMQAELNDDLRLYPDPNGERLKQAVAAHYGVQANQVFVGNGSDEVLAHIFHGLFQHDLPLLFPDVTYSFYPVYCGLYGIAHEKIALDERFRIRVEDYARPNGGIIFPNPNAPTGCLLPLDAIEAMLKASPDSVVVVDEAYVDFGGESAIALVDRYPNLLVTQTLSKSRSLAGLRVGLAVGHADLVEALERIKNSFNSYPLDRLAIAGAAAAFEDDAYFRRTCQAVIDSREALSASLQALGFEVLPSAANFVFARHPRHDAGQIASTLREQGVIVRHFKQARIDQFLRITIGSPEQNQALLDALHFLK

SEQ ID NO: 24651 - protein, 256 aa, Pseudomonas aeruginosa
RGICMAIALSTLVEEADRYLDAARIQDYCPNGLQVEGRPQVRRIVSGVTASQALLDAAVEADADVVLVHHGYFWKGENPCVVGMKQRRLKTLLNNDISLLAYHLPLDLHPEVGNNVQLARQLGFEVEGPLEPGNPRSIVLLGSLAEPMQPADFARHVRDALGREPLLVDAGQPIRRIAWCTGGAQGYIDQAIAAGVDAYLTGEVSEQTVHSARENGISFIAAGHHATERYGVQALGDYLGKRFAIEHLFIDCPNPA

SEQ ID NO: 24652 - protein, 242 aa, Pseudomonas aeruginosa
GKRRHPAGPGRAQDVQELRQHHPAVQPVQAAQGRHRTHRHRLARAGRAERPGQFAPVPSLLGLRQRRTGRRVPPGTARRPGLGRSQAATVPVARQRTGRGSRALPGADRQARRYRGHSPRRRRQGAPHRHPIHRRVARGSRPALPARAAEKCRERQEEGRQGCAPGQLPRRRRQLPLPPAGRRRRTATAVPRLRRWQGRRCGEQAPAGWRDCRPAGRGQCLWPVAGWRGGGAYPGLRRRRRP

SEQ ID NO: 24653 - protein, 424 aa, Pseudomonas aeruginosa
GKAVKRRLDRLIFWRNCPVRRSGHFPTVEDLPRAANPIPDCFQVTTMIPRTLFSSDHELFRDSVRKFLEQEAVPFHHQWEKDGHVDRALWNKAGEAGMLCSHLPEEYGGMGADFLYSAVVIEEIGRAGLTGIGFSLHSDIAAPYILHYGSEALKRKYLPKLVSGEMVAAIAMTEPGAGSDLQGVKTTAVLDGDEYVINGSKTFITNGFLADLVIVVAKTDPKAGAKGISLFVVEAGTPGFSKGKRLEKVGMKAQDTSELFFQDVRIPRENLLGKDGQGFIYLMQELPQERLTVGIGALASAEAALQWTLDYTRERKAFGKSVADFQNTRFKLAEMATEIQVGRVFVDRCMEQHLQGKLDVPTAAMCKYWTTDLQCKVLDECVQLHGGYGFMWEYPVARAWADARVQRIYAGTNEIMKEIIARAL

SEQ ID NO: 24654 - protein, 337 aa, Pseudomonas aeruginosa
SIQISGGTSMKRFIQGEHRGQSSLLPESLDDYVADTNPVRVVDVFVDELDLGQLGFDGVVPAETGRPAYHPADLLKIYIYGYLNRIQSSRRLEREAQRNVELMWLTGRLMPDFKTIANFRKDNGKAIRGVCRQFVVLCQQLGLFSEALVAIDGSKFKAVNNRDRNFTSAKLQRRMEAPAGRAMQAVYGTSSNGPVPSAIWRIAGYVHAGLGRAEAWPSKDGYNVEPDRPISKTSRVVLVSEGGRTRFWPIEKCRFFEQTPDLYCDIDGERVTFWTGRGAVSTVMDATSTASGGSQRSAASAATGAQVQTPHSFQPQQPSQGTRVTVVSDNSRSPRTL

SEQ ID NO: 24655 - protein, 1005 aa, Pseudomonas aeruginosa
HMASLERTAYPVLSRSYSRAELQREFSFSEEEVTWVKSRSNAAFRLNLAVLFKTFQVLRYFPEIAEVPEPVVDFIRTQIGLRSKVALSPYKWMQLYRHMSAVREKLGVRPFYGSDGQDIASTHAQLMAPLLEQRADIINAIIDELLRQNYELPAYSTLNDLAEAARAEAQEKIFNLVVARAPIKVIYKLRDLLDTDFGRRQSDFNTLKQAPKKPSRKHLEVLIDHLAWLESFGKLDAIFDGIVDTKIRHFAAQAAASDVSELKDCSLPKRYTLMLALIYRMRVRTRDHLAEMFIRRISTIHKRAKEELEQIQARQRQKLEQLAATLDGVVQILVQEPDDQEAGSLIREYLSPDGNMDRLREVCAEVQATGGNNYLPLIWRHFKSHRSLLFRLSHLLQLEPTTQDRSLIQALQLIQDSENLHREWIDEHVDLSFASDRWVKIVRRPTSEGPPTNRRYLEVCVFSYLASELRSGDLCVQGSESFADYRKQLLPWEECLQRLPAYCEKVGLPTTAKEFVASLKSQLEETAQQLDDKFPSCRGDVSINDAGEPVLRRVMARDIPPSAISLQTALMQRMPARHVLDIMANIEHWIQFTRHFGPMSGNEPKLKEPAERYLMTIFAMGCNLGPSQAARHLAGNVTPHMLSYTNRRHLSLEKLDKANRELVELYLQLDLPKLWGDGKAVAADGTQFDFYDDNLLAGYHFRYRKMGAVAYRHVANNYIAVFQHFIPPGIWEAIYVIEGLLKVSLSVEPDTVYSDTQGQSATVFAFTHLLGINLMPRIRNWRDLVMCRPDRGVSYKHINRLFTDTADWHLIETHWQDLMQIALSIQAGKISSPMLLRKLGSYSRRNKLYLAAQTLGSVIRTIFLLNWIGSRELRQEVTANTNKIESYNGFSKWLSFGGDVIAENDPDEQQKRLRYNDMVASSVILQNTVDMMRILQKLAREGWQFTDEDVSFLSPYLTSNVKRFGEFNLKLNRPPEPWIKDSVFQQAAGSLRVNSTSKAAAEEAI

SEQ ID NO: 24656 - protein, 336 aa, Pseudomonas aeruginosa
EQTMARGGINKALVQKARQAILARGENPSIDAIRVELGNTGSKTTIHRYLKELEDADRGRNAAALPLSEQLANLVAQLADQLKEEAQADVAQEREQLARERLDYQNQIRQAESRIQQLEGQCAGLTEQFQAAQQALLQEQQLRQQAEVENARLQQANHDQEARLQDRDGQIRSLEDKHQHARDALEHYRQASKEQREQEQRRHESQVQQLQLELRQLQQTLIVKQDELTHLNRDNARLLAEARQQQKDQHAQQKLLTQKAQALEVAQNTLTSIERTNEALEQRCHALQDEVTRLGEASSIQAQQTQSLQERLAKATAQLKLLGQAPPTSSGGASSS

SEQ ID NO: 24657 - protein, 322 aa, Pseudomonas aeruginosa
DRSIHSFLPTLGPCQTPFATGYPRADMAAFPSGMSAPHCKALIVDRGRQGAGTFMKKLPAITALALALISGLAQADRLEDIRKAGVLRVASFDSNPPFGFVDAKSKQIEGLDVDYAKALADKLGVRLQVLPTNPANRIPLLTANKVDLVLANFTITPERAQQVDFSIPYFSSGQQFIVKKGTLTSPEVLNKWRVGVDKGTVNEGVLREKFPGAKVIAYDDTPFAFTALRNGQVQAITQDGPKLIGLLANVPDRDKYEVPPFTISNDLIGVGIPKGEKSLTEFVDKSLRELEQDGQAQKIYDTWFGPQTKTPLARLYKIGDKS

SEQ ID NO: 24658 - protein, 245 aa, Pseudomonas aeruginosa
  UNSURE (35): Identity of amino acid at the above locations are unknown.
SKLSARRCSRPAATAREVPEMDFSVISDNLSYLLXGAYPDGPLGGAALTLLLASLSGLASAVLGLVLGVALAVLPGKPRLLLVALLGFFRAIPVLMLIFWTYFLLPIVFHVDVPALATVVCALSLIGGAYLAHSVYAGIHSLPAGQWAAARALGLRPWQVLRLVILPQALPVMLPSFLNQWVSLIKDTSLAYVIGVGELSFVATQVSNRVMVHPTEIFLFVALLYFLLCTSLDLAAAFLARRRRA

SEQ ID NO: 24659 - protein, 501 aa, Pseudomonas aeruginosa
TSRLETIRSHEYSADGNCAAVGNRAERTPVRRPPRSADLPLADLAGRDRHGGRLRLEARGEERRDVQRQRLFVDQPVEQHPGDRRREDAGAEMPAGIQVALHFSHRTENRQFVRRARAQAGPGALEVDLLQLRHATHRALHQAGDFREGVADVEALVLGGAADQDLAIVLLRHVAVAGGQATVQQSWHALGEDDLALHRLHRDAPAGGHFAEFRGPGAGGVDQGPAMQHPGIVRAHPADPPALAQHAGDVGSRQQLDAVLARRLQVGVGQAERADLVVAEEFQRAVGRVADRRLGTTQFLAVQPAHLLGQMRDLRHDVLGVLAILVVLDHVFQPGALELEVHPVAFDQFSVQFRVQRVGLQGEVEERRRQDVRRARVHRHRRALGLAPVAGGHHAEEDHPAAQSHRFADGPEAAGRGAGGVARALVVDHGDAQVAAPGQLVGAGRADHAAAGNHDVIGSVHVQASVPRFWNAENGIGSIGKRGRSQPTSWRPVARRRRSLQ

SEQ ID NO: 24660 - protein, 448 aa, Pseudomonas aeruginosa
AIVATNGTQGARACVPRRPPRLNVVQWPPGAGIERHPSRRMNSGAAAHAPPARPTARSNAMRALTFHGSHDVRIDRVAEPRLQEPDDLLLRVTATAICGSDLHLYRGKIPMVEQGDILGHEFMGVVEEVGSAVTAVRPGDRVVVPFVIACGECFFCRLNLHAACETTNPGRGAILNKKQIPPGAALYGYSHLYGGVPGGQAEYVRVPKANSGPFVIPDVMEDERVLFLSDILPTGYQAVRNAGVRQGSSVAIYGAGPVGLMAAACARMLGAERIFIVDHHPYRLDFAARTYGAIPIDFDQEDDPAAAIIERTDGHRGVDAVIDAVGFEAKGSVTETVLTALKLEASSGKALRQCIAAVRRGGTVSVPGVYAGFIHGFLFGDAFDKGLTFKMGQTHVQALLPALLEHIGNGDLHPEAIISHRLRLDDAPEGYALFDEKREDCRKVVLRP

SEQ ID NO: 24661 - protein, 179 aa, Pseudomonas aeruginosa
ADTYTPRRTAMTSKQENLLDWLRDAHAMEQQAEQMLKAQAARLEHYPQLKTRIEQHIEETHGQQRLLEECLKRLDSSPSTLKDIGAKLMAFGQAVAGMTVSDEVVKGAMSGYVFENMEIAAYTVLIAAAREVGDAETLAALERILPQEQAMADWLRDHLPELTQAFLARDSQPDTEAKR

SEQ ID NO: 24662 - protein, 147 aa, Pseudomonas aeruginosa
AWPPPMTTTCRRTPPIGRPGSTPGPGAPPRRMPNTSGHVGAAKGDATSRFPPRRCTSFAAWPRPSWSTAPGSMGCCRIMARNACGRCWRPSSKNSATASRHATTSCSTGACWPASAARKSKASATSTTCRAPSNSPSATSPRTTCPK

SEQ ID NO: 24663 - protein, 341 aa, Pseudomonas aeruginosa
WPRTSTTDPPVSLPRGCSASAGGPPMPSLNDPRLDVLVSLGNWLRGQDYRFVTVTPATHERVNARPENRMARDLAGIFGWSRPFAGESLPADWLTLLAGADLIRREADGWRSQVRVSSLGEQLFVHSAFPTLAADAVFFGPDTYRFDRLIRSHLASSDPARIRRAADIGCGAGPGAIRIAMACPDAEVHGLDINPAALDLARVNAALAGVGNLTLARSDLLSQAPGRFDLIVANPPYLLDASERAYRHGGGMLGAGLSLAIVDAALERLEAGGSLLLYTGVAMVEGGDPFLARIRERLASREWDWDYQELDPDVFAEELDSPAYREAERIAVVGLRVTRPA

SEQ ID NO: 24664 - protein, 324 aa, Pseudomonas aeruginosa
GAPGLPPDPRSGAASARPPRPRPESPRGPRHPPTPRAGTGVPPRPGWRRARCGRNAASRACAGFRRWSWAPPEDRDVCLSALPASSGSRPWMGGRGPPGTPPEPPRAGPVQTPERHRKEVPVMTREMARLLISPSNAWPRLRQDYDHHPFAFLVPLLLLPLLPAACLFIGTTQVGWSLPGNDSVQHLSSGSALLLATMCYLGFVAGVVIMGLFVRWVLFRTPSRPSVPGSLTFTTAIAVPLMLAGIVALVPWRILLLLAAAAACAYSVRLLFTGLPLFMRMQERQTLFYAFCILGVGFLTLLTTAFIFIELWGQSLAGSGEYLR

SEQ ID NO: 24665 - protein, 1053 aa, Pseudomonas aeruginosa
GSAGLQRAGQEQVQLFLAERLGQLGQLCRRAFDLFREAGGQGHLQRPALGHDPLHQLAAVHPWHRLVGQEDVQLRRRRENLQGQAAGVGLEYRATEVLQHRRGVVQHQRVVVHHQYSTGQAHPLAFAGRLRRRAIARTGAFRGSRDGGYPDVRGGADARLALQGEPAAELLGEAVDDRQAQPGATPNSLGGVEGFHRTAQGFLVHAAAGVADAQADIVARCEAMGIVRRHPLVARGKDDAPAVGHGVAGVGGKVDDGQFELVGVGQAEVEIQGKARLDRYARSQGMDQQVGHPAQQVGDRAGLRIETLLAGEGKHPLGQVGAALGGLQGVLQEVGGALVAGQAFLQQPEAADDHRQQVVEVVGHAAGEVPQGLHLLGLEQLLAGPFQFAFGFDPVGDVTGYLGEADQPAIAVADRIDHHVGPEATAVLAHPPAFLLETPFAFGGGQAAGRLAGLAVFGGVEAGEVPADHLFRQVALDPLGAEVPVGDPPAVVEHVDGVVGNALHQQAELLLAAPQRLLGRAPFAEVVDQLGEAEQLALAVADGVDHHLRPESLAVAAHPPALGLEAALDIRLAQRLLRNAGVAVLAGVKAGVVAAEDLARVVAEQARRAGAPAGDTASAVQGVDRVVVDRFVEQAVARGLVQGDFRFSCGFHGRVHSSAARPGLQGTPSKVVRRTSSGRSLARPRNLADLSEDPGAAGEFHSPEPCPEYGFRYAGRDISFPPHRPRSSHAQSGNRNPEAGDIPSPRQPEPGADRRRLAATDRSQRLASRSQQPAGAPRAALQASQPGVVDRGQPGGCRSRPAVRAVVRLRRRSLAADLRRADRWRPARRGTAPVPAWPLAMAGGAARCRRGATGCRARAQPHGQRPGLDAGGGPEPARRPAHRRFQPRRRRRGSGGRQGVRLRRSAARRSPSRPAQAPVPAPGALRRTSHVRTRYPQPGLRHPAAGPGLQRLHRFRSRLPPGRGQRRLVRPGARLRRGMAGVLARSRRTRTLAEPGQCPGVGLAGRRYPARLPAWLRGGKGIAAGDAGNPAKKIGFFANEPARFLEEISRKSI

SEQ ID NO: 24666 - protein, 549 aa, Pseudomonas aeruginosa
SGTDGWPSSRPPLFDGPCARRRAHGYHGRFGGSSASSAASCRESSRWRSCRRCRRRVRCCTSSRSNCNSSRGSLSRPLTWQCPLNPRLTSRPPATALQARGKPPRARPKPARTSPAPMEASRSPALQVVRQAIGPSKWAGIRSWNSPCVGYRSGFVVRRLHEELDQRPPASLDALFQDDLETVCVLGRNADAADLRGLAVAQQRAGVRGEVHQQRRLRLVLAAFGGAQQAVGDMAAVITLGVAAVDDRVAAQPGAVFGYRWADFHRDADVARQSARGEQRAGVTLLLHGGEHQVEVAVQLIAAPGDLASHAEHCEQRCAVVEEVRGDAILEVQRAPPQTVEHHAGTRSHAQVRQLLGAAPGDHVYVAPVHRAREHVGALRRLAGSMHAAVGQHAVEYRLAGQDLYRTDAEAHRLGAAERHYAQGTVGLDALDDHGDLVEVREQPHRGPPRLLARQVRRADARDQVAGGIAADLVATALEFPLADGPDLVFLATGATCQQEFLEQGAVFFAHASGRPFFQARFQLFLVLLHGLAELLEGGGVEQLPGAWE

SEQ ID NO: 24667 - protein, 461 aa, Pseudomonas aeruginosa
GRCLRSGRRRPRCGCVRCSPSCLPRHRILEQEVAVFVGTAVDHPAVVRQALVFVDLERRGAHRGQPRIGAEGFQRGDLGAARAADPPGLLEHAEALPTVAIPALGNVVVAPRGEAAGEEDRRGGVEDPRVLDGLAHLAGQVQGQQLGVATARHQQVGAGIDQFAARVAGLVLVTVVAQQETVDPELADAVGDDALQVGFQYQALRQLTLLQPAEPSVQFVEVVRHVLAEAATGLRQLGPHRSFGEHASAGAVCVGQAEDADAIEHDVADLLREQRVPAFRRHAAARQRMDDGLTGDERVLDETAEQIFVTVHAQAHGGLPADQGAGRDQVEGASLVQFGFVAAAELQLLDFRQPARQGQVALHFVFGGRGIDTMGHHQSLPRVCAHVPLLLDGNRAFRAPVWARGALRWAVPSESLPGIPGGRGFRGQEPDIRPDPSRGCVEWSLSRPMMQKWENACPPPS

SEQ ID NO: 24668 - protein, 549 aa, Pseudomonas aeruginosa
TSGAPLRSPLARTSPMPRRDGVRPTNAKDNVRPEDDMGHSVAGVCLEEPAVLTAFPSLLHPQDPPQQRDRILFVTAELSDFVKVGGLGDFSAALPRVLKREHSVRVLLPGYRQVLERCRDLRIIGSLPGRAAIPPCEIGLVTLDDGLEVMLVLCPLLYEREGTPYMDDQGNDWPDNHLRFARLCLAAAEIAGGRGAQGWQPGLVHANDWPSALTPAYMAWNGVRTPSLFTIHNLAYQGLCDLQCSAELGLPDEALSHESMEFHGRLSFLKAGIAHAHHITTVSETYAQEITTPEYGCGLHGILKYKVEKRQLSGIVNGIDDSWQPHCDPHLVACFSARQWAGKRANTRYVEERFGLEPGKGPLFAVVSRLVQQKGIDLTLEISDALLQAGGRLVSIGRGEPNLEKAMLELARRHPGQVGVHIGFDETEARRIYAGSDFLLMPSRYEPCGLSQLYAQCFGSLPIARCTGGLADTIVDGVTGFLFREETAQSYLDAVMRAINVYHCPSLLNAMRCKAMAAPMFWSDSVEPYNRLYRRLLRNTAPALRGVRQ

SEQ ID NO: 24669 - protein, 158 aa, Pseudomonas aeruginosa
CGCSTIASTACASMPCTRFPIARSSSRWPAACAAPPAPSAMCTWSWRTTTTAPACCARATTHSGTTMATMRCTSCSPARTTATTRTTPSRCAAWRAAWPKASSTRAKPTATAGRAANRVPTWRRTPSCCFCKTTTRSATAPSASVSASSPNPRRCAWR

SEQ ID NO: 24670 - protein, 264 aa, Pseudomonas aeruginosa
VPAASRSAWSPPMSDARLAELAAAVGLQLDWQDANGRPQRVDPEVQRGLLEALGYPAQSPQQIEQSLAALARLREDSANLGLLVGECGQPLEQALGPAGTPGELVYEDGTRIALRLDAEGRLPAQARSGYAQLSLEQREWAVAMAPPSCPSLASLAPGRSRRWGLAAQSMPCAAPATAAWATAPPSRTCCAAPRGMAPTRWRSARCTPWPRPTDMPTAPTRRPAGCSSMSCTPRRRPFSARQRWNRRSVAPAWPRRWPAWRAWS

SEQ ID NO: 24671 - protein, 1150 aa, Pseudomonas aeruginosa
SRAASRPTPAPTCATRNASCCACWRWRPVAPRRWSSARTSAPCPKACARNWHAAKCWVPACCSSSGAANASCPRRNGRRTPWPPPAPTTCRACPAGGGARTSTGAAAPDTAAPRNARPTWNCAPRSAGPWPPASNRRSIPTPPPKYRWTPASAMSGQPPRRWCYCPWRTPWAAWSSRTCPAPATPTRTGGGAGRKTPRRCSERRRSTGACACSNAAAGMPRRPPMIEPRATLRLQFHAGFTLDDALPWLDYFADLGISHLYASPLFRARPGSSHGYDVVDPTRINPELGGEPALLRLIQGLRQRGMGLLMDIVPNHMGIGGGANPWWQDVLEWGRESPYASFFDIQWESHDAALRGQVLLPFLRSDYGEVLAAGEIGLSLDREAGRLLASHGEQRFPLWPGSYPELLEDSGEPRLSALAGGFRECRQDREALREMQRQLAAALAESAPRAALQRTLGELQERHEEARQRLHRLLEAQHYRLASWRTAADDINWRRFFDISELVGLRVERGEVFEAVHGKAFQLLEDGLLDGLRIDHVDGLADPRGYCRRLRRRSERIRARRGGAPMLLYVEKILGGEERLPEDWLCDGTTGYDFMNQVSLLQHDPRGERPLRELWQRVSGRPEAFLDEVYQARQLVLAGSLAGDLENLAQGLLRVARADLASRDLTLGGIRRALFQLLARFPVYRTYAGACGRSVQDREVFRYAAEAAREDLDEADRAVLDHLERWLGGQPLRELPPGPLRRLRGELLARFQQLSSPTAAKAVEDTACYRSAALLSRNDVGFDPQRFAASAEEFHAACEARRLASPRALLATASHDHKRGEDARARLAALSELAPWFARNVEHWQSLATPLRRDLAEGPAPSPGDELILFQALLGSWPLDAPCDGAALDQAFLARMREWQCKALREAKLRTRWTAPDEDYERACADYLEQLLRAPLAQALRQSLGNAAVRLMPAGALNGLAQCLLRLTCPGIPDLYQGREDWDFSLVDPDNRRPVDFARHAAALAAPTPFPELLEHWRDGRIKQTLIARVLGLRRMQPGLFRDGDYLPLEVSGEHAERVLAFARRSRHGCLLVVVPRLACALLGHATQPQVPAEAWGDTCLLLPPSLSECTYSGLFSTMPLPSDGHLSLSEVLADFPVNLLYRLAQEDTP

SEQ ID NO: 24672 - protein, 167 aa, Pseudomonas aeruginosa
AESVAPLLRGSAKGTPSPLAPPGTASASISRCSRPTRPRSSCACSTRAGKRRSSASNCPSTPTRSGTATCPTPTRGRSTATGCTVPTSRMPATASIPTNCSSIPTPSSWSAACAGPRRCSATPSARPTPTSASTSATARPSCPSRRSSIRPSPGPSARRYASPGTAR

SEQ ID NO: 24673 - protein, 323 aa, Pseudomonas aeruginosa
AASRPAGRNGTTVSAIACAPTGAATTGMLPELARRLTASGDLYDQRGRRPYASVNFVTAHDGFTLRDVVSYDHKHNEANGENNADGSDHNLSWNHGCEGPTDDPEIRALRLRQMRNLLSTLLLSQGTPMLVAGDEFSRTQQGNNNVYCQDNELGWIDWRLDDEGRSLLAFTQRLLALRQRYPILRRGRFLVGEYNEALGVKDVTWLAPGGEEMTEEHWHDEHARCLGVLLDGRAQPTGILRSGEDATLLLILNAYHDAVSFRLPEVAEGSGWTCLLDTQRPEDPLGERYPFASEFLVGGRSFLLFELQPPGAGSGRMNGGEKS

SEQ ID NO: 24674 - protein, 183 aa, Pseudomonas aeruginosa
VPHAAPAHPPYTGGQHEDQRHHDPQRPGRRPAAEHPRGGRHHGEDRQRRPAGRRRRPPGRDDHRSRHRHPRGGRRPVRGYPAGPHHERRHPLLLRRRRRPARGPQHGRHPDAPPAGAQPREAAGRRGFPGQHRQLPRPGLQRHRPAGRRPGPLLSLSSTRPAFAVPAEAGPQPGERHESRGIS

SEQ ID NO: 24675 - protein, 377 aa, Pseudomonas aeruginosa
GRGHRRGARRRSAQPSGRRPGGDSLDHRLRQLRVLPSRLLRPVRRRQPRRQPGRHRVLRRPPGQRRLPWAASRESADSLCQHRPDPPAQQHQRRPGDTPVRHLPHRLLRRRTGRYRPRQHRRRVRLRSGRPVRHRQRVAPRRRQGVRHRPPPGPPAHGPPARRRSDRLRARGSGPGPALADRRDRRGPRHRRRRRGRRAQPWHRHPGAAPGGHQLESRQRPRTGPGVGGAGPGQGRHPVDHRRLRRRLAAVSHRPGDEPQPDHPHGQLPPPQVHSAAARTCAQRTHRPGEDPHPGEADRRRHRGLRSLRPPRDRLDQGRTGAAEAPGRGQRGTPRRTRGGRTGAPADAGKRRPGVMHERTGTPAHRHFRLALCPLER

SEQ ID NO: 24676 - protein, 151 aa, Pseudomonas aeruginosa
LLSRGAAPEGRTALRLAGGEQHRDQRHLLRPADARALPRLGRGHPRGLRFQRQGPALHHPRAATARDRRAAGELLRLRPPRPAPAPRPVPLAVPAEHALRPRAVRRFPRPPAARRRRRAEARPAQRRAPAPRGLPRRRSGAAPAACRGNPP

SEQ ID NO: 24677 - protein, 251 aa, Pseudomonas aeruginosa
PAGECRMILPRLQVLTVNTHKGFNPFNRRFILPELREAVRSVGADLVFLQEVLGSHSLHAARLPSWPPAPQYEYLADSMWPQFAYGRNAVYPEGHHGNAVLSKHPILAHRNLDVSVAGNEERGLLHAVIDIGRPLHAVCVHLGLREAQRQRQLQLLCELVAGLPEREPVVVAGDFNDWRQRADQLLAGCGLREVFVGAQGRPARSFPARWPVLPLDRIYLRNARGRQPRILSRRPWSHLSDHLPLAVEVEP

SEQ ID NO: 24678 - protein, 86 aa, Pseudomonas aeruginosa
SATSPSTASSTSTCASWRAATAGASAAATRGAATGGERPLIFLGFHFSRHFPAIAGWVPAHLPRLKSLEPRPSRRWQERQGQRGNP

SEQ ID NO: 24679 - protein, 233 aa, Pseudomonas aeruginosa
SATGCCISSYPWRWPAWSTCCWSAGRSACAANSAACARARRESAGRTQQQRAQRRQVEHHRLRLAMGAARLAGDAALAACAGTGERLGVAIEQHVPVAALRYADPIALARHRGEIVYRQQRWLAGRVAQPGVDTVRLVVADQPFEAERLAVARMQCGEFAVQPVEGRHQVLYALMLRIAQQVPVQFAVVVPLAPLAELASHEQQLLARVRPHEAQVQAQVGELLPAVAGHLVQ

SEQ ID NO: 24680 - protein, 566 aa, Pseudomonas aeruginosa
RVLAMYHLVVGDRQDEMLGEGVEQAEGQLVVVIAPVQRVFADVRQAVVHPAHVPLMAEAQAALRHRTADAGPGGGFLGDHQRAGGFAGDHLVEVMEEVDGLQVLPAAMAVRQPFAFLARIVPEEHRGARIHPQAVDVVGAQPVQRRGQHEAVHLAAAKVVDVGIPVLVEAFEGMFVLVQRRAVETAQAVGVGGKMRRHPVEDHADAGLVAGVDESGEVLRRAVARGGGEQPERLVAPGAAEGMFHHRHQLDMGEAELAHVGNQLLRQFRPVRRPAVAVAPGAGVDFVDRQRCRIALALRAPGQPVLVAPLVAQRRAGLRSGSGRRLAGQRQGVGLQRQEAVVALQLVLVQFALAEARDEQFPDAGWIASSHRVTAPVPAVEIADHRDAHGVRRPDREAHALHAFVTGHLRAQTGGQLAVVAFGEQVEVEFAEQRPEGIGVFAFLHAVRPVHAQAVARWQGLQVALEQAAAGVALLQFGERRAVFVEQLDALRAGQVGAQHAAFAAGVALRAEEGEWIALQAALQLVQLQLPAFAFGHRFAHRFLPFRRCSVSSARPARGTSSQSGR

SEQ ID NO: 24681 - protein, 139 aa, Pseudomonas aeruginosa
TLISSPPAACRASSGRRSSSAGRRSSRRRARSAASPCNGRGGSLRRLPASRNCSAIRSAQAWTLASSLSRLPKAGSSDSPASTLCISPSRAPRLAAKPRSSARLSYCPSSASLAADISSRTARSRLSRVQFQASPWLFR

SEQ ID NO: 24682 - protein, 908 aa, Pseudomonas aeruginosa
ITASLYHCGSLRKTGFSRLAMGFSLCVDAPHAPDAERQVPGFDAHPLDLAVPDPAMPVHQVLALEAGVVGQAELPQRQFEMRLLGFVRVQADRHQDEVGEVRGALAEIQDAVVPGVVGLEPEVRLQCRVFPADAVEPGDLGDDVARRLVVARTQLVFLRVEVLLLARQGRRLAQLEAGVHAPQPRPHGRQGGTDEEAGAAGALQEPGIDVRGVDEEVRPVAVAPGWLVEFGEVLRQFLLVVAPGEIGVALAEADLAQARHHRRAGERLGKEDHLRMAAAHLGDQPLPERQWLGVRVVDAKQRHALLDPAQHHVAQGFPQARQGLFGVEVDVDDVLVLLRRVLRVAQATVRTPGEPAGMLAQPGVVGGALDGEVQRQFHAVLAHRNEQPAEILAVAQFGMDRLVAAILAADRIRAAGVAGLGTQGIVAALAMGAADGVDRREIENVEAHRGDLRQAPDHVVEGTVACRVAAFRAREQLVPTGEARQRSLHLHRVFAAAHQVLARADQTQQFAGLRRQPQRHPLLDALAGLQAFGQRRTGGGDLRTAALGAALQQFVALAQLQVQRQACAMLGTQFAAVAGKTVDPGLDTEVQAAAGRRAQLRAPEIVAFGQQRQAPLRGFPDTPPDHLGTEYLMAIGEDSRGQAQVAVALGLRGIGTLFHHRADRLDGDTGLLNGDDQRIIVAVADNRTHRGALLRDVGSAMGREASAGLEWPAARTVIDSEPAGDRLVQVDLPSGSPQALRREREAPDLARPFASAPAFSLPLSLPPPARERRLRLRRSVRSMMSAPLPATSSSSSTACSWPLAAFSSTSFMILSLKLSLYSSGSQWEAMSSTRRLAISSSRLSSFASVTLSSSSRPSRLRTCDGQRRVISTRASCRGRRSARCWRVCRTTLARATLPVRSRVSRSSA

SEQ ID NO: 24683 - protein, 957 aa, Pseudomonas aeruginosa
  UNSURE (756): Identity of amino acid at the above locations are unknown.
RTAPRRGLPACACAGRRPCRSARARSRVPRRAPPPAAGATRRGRSARSRRDRRTPRRGSSTTSPRRSSALYLAVAQGTATQAALAVEGFLTQSQRRLPAPVATAYQATQGHPGPPAESLGQPPFPAVTDETTGRCDRIRQRRSSGGDRLGRRLALPDPMLHQCLAQAGEDIGGRGAEHHAGVARQRKLAGQRLGIAGEGHWLQVLVCFQQVVQAAPVSADGLAAGRAARHEDRVEGYRRQAVPGSLRAQFGAVFSLHRRSAGRDQLGVRALLAERVAQVADVALGDAVGDQDRHLARTDVAGQQVHLAQRRRRLRLRCRVGRRGELHTDVRRDPGGQLRIDVEEYLVDFALKDRLPLDLGQFEAVGGDDMRLLGLAHAVPEQCGLAEMIGEGVGALAQLAAADWLVVGGEAAVARRRRGFLRPAAVDRVRFIGSPAAVDGLPVRRVALVVVERTQRAVDRDFVEVRPAQAQQLGVGIGEQPTLQQRVVGEVDSGDHVADVERHLFGLGEEIVGVAVEYHPPHHPYRHQLLGHQLGGVEQVEVEAVLLVLRDHLQAQLPFGIVALLDVLPEGPPVEVGVLAGELLRLVPDQRAGPGLRSPVELDQHALAGRVDQAEGVHAEALHVAVGDRNGAIGHQPHDHVRRLRGQRNEVPEGVVGRRSGGNLVVRFGFHRMDEVRKLDRILDEEHRHVVADQVEVAFVGIELHGEAAYVTHRIRRPARPLHGGETHEDRGTLARLGEETGLGQVAEVLVGLEVXMRRRATSVDHALGNALVVEVGDLLAHDEVFEQRRSALAGLQGVLVIGDAGAGIGAQGLSGGVVCYRPPAVPAWRCCCHGRRCRCRPPGCAARCSARSSVSSPHPGHENGADASLLRPIHFTARLSVPAVAALATFLASLGGPLRIVLEVAAAGLAALLAGLRSTFRVFREVAFTTLMLCHFYFLRIISSEQISWTHALRMP

SEQ ID NO: 24684 - protein, 148 aa, Pseudomonas aeruginosa
THSIINRRTLKQMELAMENSDEVRFQHYFISLVEQVAKPLFVDSCEEARSYGLDCNVDLDLDEDGHPRLRLEVGEPGGEKSHYSLLAIPGERVIHRQYLAGAQEWHSLPAELASINPMVLDSELAVFFRRAFDLRLEGPERRHPAGFW

SEQ ID NO: 24685 - protein, 519 aa, Pseudomonas aeruginosa
LPDIPGVFADRPVGAEPADPRHVEQRRAPPAIGLAPDFLDPALRMPVGLEVGAEHEAVVVHQAVHQPFVAAAVVGREQPAADRLQGFLQPRRGRDHPAHLQLPGLPALLHLLGAEAEDEHVFQADPLAHLDVGAVQGADGQRAVEGELHVAGPGGLEPGGGNLLGEVRRGNDRLGQADVVVGQEHQLEQAAHGGVVVDGAGDVVGQLDDQLGLVVAGGSLAGEDLHPRHAVGGRVVADLLVQRHGVQQVEQLPLVFVDTLDMHIEQRFRFDRHAEAVQHQARQGGLVLPTLLGEACPQPGVLDVFLEVRQAPFRGVQQVGAEGLHQQLGQPRVGLEQPAAERHAVGLVADALRIEAMQVMEHGVAHQLGVQCRYPVDLVRTEERQVAHAHPSAVALLDQADRTQQVEVVDVLGTQRVYMEGIDQVDDLHVARQQALHQRHRPGFQGFREQRVVGVGQGRHAQRPGVRPGQLVHVHQLPHQLGDGDRRVGVVELDRHLFRQATQVVMMAQVAVEQVLQRG

SEQ ID NO: 24686 - protein, 360 aa, Pseudomonas aeruginosa
DEEVLLAQAQFLTGLGAVGRIQHPRDALRLDHVDHRADMVAGVETVQLQVFLGAGAPQAQGIDAGTPPADDRRVVGDRPDPLVRPPDGSATVLAVDLHAAAEVDVVADLGSFELPGIAEIQPGLGLLLLPAVGQHLAEQAMLVADAIAMRGNVEAGHAFHEACRQASEAAVAERRVRLQGNDPLQVDAQLGKGLAGFLEQPEVAEVVQQQATDEELQGQVVDPLARGRFALRGGLLPVVDDVVAHRQGHRFEPVVRAGGGWVAADAVAQLGEDAGFQGLDRARGLVLAVGHRRASFRPAAAGRCLRGFLRRSCVPARRPPRFPGAGGRAGRGRPGSGGGPPSAPGRSRNAGRCRRAVAPG

SEQ ID NO: 24687 - protein, 144 aa, Pseudomonas aeruginosa
ALPRRLPITPSRPSLQALASRSRGSSASVAENRSGSSSRPSSSASRRARRSSRATSRRSSPSWYGRSKRTYRMFSPRPSSKAFCRAWKSGRPSSSRTTSSPSSQLRCRPSPAKAFSRCGRRSVQSWPLRVSRRTWPSSMRLISR

SEQ ID NO: 24688 - protein, 290 aa, Pseudomonas aeruginosa
APRSLDRGGIPRSARAGRRVLRGPGRSCFLRSPWFSLSDCQEGFAARFAPSAPLAPEQRDHGDWARTDRKVRSAECPEGACSSCRLPDPRGPLVSPPAPTTSTGVQPERPRAKEPAMRPAPEDAADDAFDQREYPIPERLESQRRAWRFERAGLWVLLGVILLALTGVFAGGPLSSRTLVSDSGRLTLAYERFERSGAASRLRIDLRGAPGTEVGVRLGGGLLQAHSIQSLQPQPLRSHSWRGGLELEGRLDEDGRLSLFLTLLPNQLGEVASRLEFAGESLAFDQFIYP

SEQ ID NO: 24689 - protein, 397 aa, Pseudomonas aeruginosa
EHGTEQGHQQHFQRALQQVAEGEHVEHHRAGRHLRVFAAVGAVLDGAAGLPCLAHVGGGRLRLGRCRGAPQRRHLGVAQADPGGEAGEEAPAAQCVGADIGQRDQRQGEEVVGRHRGVGVPRPQVDGQAAETMAQAIAHQQAERNRPEHVAQQPVQAAAVELPGQAAALTDQQQGGDDEGEGDAVVESRLAGYGVAQAVVVAGVVDLDVAGQHRIGGREDRRDQQGQPPVQAEQEMRAQGKAEDTAEQDWSGQQPGSGPGRRAQRQAQLEAADEQRDQQRRLAEVFEPAADVRQAAAPGVQPGRADGHAEQQVDERRADRQQAQVGRSQAERQQDAAQYQQPQAEAHAWPGSARGGVTWMGAPWPARGPFPGGASGPAGGSWRRPAVPGRSGCPRPG

SEQ ID NO: 24690 - protein, 432 aa, Pseudomonas aeruginosa
RRRRPTVQIFRRPCQAGRPPRSPLAARQRLDPRPALRPAYGQRRFDPHRRRDRVALEIDVPGRQPGERIVLLETFQDHAGRQFAAQGQQMAQHFGALRRATCFAGIPAIDLDHIGTGIENEVQVVVRRAEVVYRDAHAMFAQASDELPGRDSLAHGGLGQLQRQPPCHLRTGGQPSADRFPPGIHRRALARQVAGQAQGRLGVQPVEDRAQHAAIEQAYQAEPLQRQDQFLGRQRRLAAGGRDPEQGFPVERLPFRMPGMPYGLPVQAHPTARQGGMETPGEAQVAGQGGGNGRWVLVLASLWGTVHCRAFLSWRLTPLSSIQSNATSPRVPPSTRRGKPRRRCERGASSVPGRSRRVSPISSASPARDTKYGVGLSTRRVSSRSAKPSSAAASSACGCRPCGRYSTFIWVRRVTVSRGRPAASAVACGGIS

SEQ ID NO: 24691 - protein, 92 aa, Pseudomonas aeruginosa
IPVVKTRLLADDPLAALFLHPAGGLHRHQGAGPDRADRRPGARGRQLGRLVQQLAGCHRAVPLRDPETLSHLRGDDGHPARAVPVHHPGRDR

SEQ ID NO: 24692 - protein, 559 aa, Pseudomonas aeruginosa
GRRAWICPERCWLRARNDASACRGGWTAGRAARWRSTGSTTTASAARKGKLYSEQFPTGSPARAPTGRCRLPGRRPAPRPAFPCRPGARSGAPGLAGRTACRASGMGAALPGNPAQGHGRQRRAAVADPGTDPGAGAARPGTPARSLRAGHGPRPAERRAYLAPGLQPVAPERGDGCLVGSGLPMAGRPSAGGTEADAGADRDRRGRESRDPGVHPTPARTWRAHRDRRLRRGAQQPGLRSRCPSRCDQDRLPVYPRSTSLGEGRRSAAPSAGPVPRTGALRGPGRSRGGRCVRPAADRGRLSPGQRDRAADAGRTAAVRTPAEEPGADRGAGEPPGVTGEGARPGTVGEKSERSAGGAVTAATMPRCVVPKSRHFFPVTPTESTMNRAISLPLKGAAWLLLVLALPFANAQDMNKTAPQTFVSEASAAGVAEIEAGKMALEKSTAADVKVFAKQMIDDHGKVNAELRSLAERKKLEVEDDASLTDKAKATLLDLRDASFDPAYANNQVAAHEKAVELFTQAADNLTDPELQAFAKTHLPALKHHLEMARALAKAHPSK

SEQ ID NO: 24693 - protein, 388 aa, Pseudomonas aeruginosa
RPRGRSLARHELQPVVAGTGLHPADARPGFGLPAPAAGQHVVHLPAVRHGHRPGRAARLAQRPGGHQRLVRTPQRGGVADLAVHRRPQAAPAVALAGLDRCLAAGRTSPARLYPRPYPGRAFPVRPGLGAGLAGRGDPRAHRSGAGQRHPGQPRRRRRPPALRRIRRGGTQRRHRLPLRHRRPAADRSGRRPARGVRPQRPGLAAARRALGDSARPAGGLLPGPWSRPPGHPPAGAAHRHLGVGQRLPRPGADRAVLCRRRRTGRLGLPRQLRRRDRPAPRRGGDAGARLGTGRGAGGRRRRARGRAGQRRHRVRRRPQRTPEGGGRRGDARRALLRQPAGALAGSAAGDPARCHAPTSTGTGARCRWRCCCSACVGRRWSGCWSAGG

SEQ ID NO: 24694 - protein, 275 aa, Pseudomonas aeruginosa
PASANSEARRRTPRSAPGGSPRAGPTGPPVRNARRGAGFPGAPGSDTRAGRTHRLRRLLGQGAWLAPSLAVSQAGPRSTWLVPAGLPAVRAGRAICMMNRRLPGTLLIALCDQSAPNRRGHAAPAQAGRTARTLQRSLPDNPTGRTMVNGENKIVLVLEEHADQLWRIEEFLLDRGYAVLSAASRDEALDHLASDAVIDLFLLSEQLEGPLSGSMLIETSLPVRPRMRVILLSDSARVGIDPAAPYPVLLKPVTLEELGKAIDMVLHSAPVCPGV

SEQ ID NO: 24695 - protein, 133 aa, Pseudomonas aeruginosa
CRSVSRRFPGRATGSARSSSTTCATAAAPAPWPPTRCAPAKGCRCRYRCSARNSTRCRAPTNGTCAVCRSASTNSPATIPGPTTPAPASASARPCGASSGAADRPRKRRNSPGAQGLHRATRCRGGPRWIPPT

SEQ ID NO: 24696 - protein, 108 aa, Pseudomonas aeruginosa
PERLAATQTRSTAMKRDWGLIRDLLEHLESLGFGQHWEARELPGHCREAVAYHLQLLNQAQLLCGSVQHSWTGQEHWVVHHLTLAGHDLLDRLRQESAAAAVPVRKSA

SEQ ID NO: 24697 - protein, 396 aa, Pseudomonas aeruginosa
PASPLSAAHQQQDQRRVVPPLAVPGQPGVDRAAGGDPRRRPAGHPGTAPAGPRGTRRGRQAAGTLRRAASAEQDRPGAPGAGQPRRGDRTGSAVRCAYQAYPRIQAAVAQPAAHRGAVPGDPQRPDRRPRAAGEDLRRQGCRQLPPGQADHQAGQRHRPHHQRRPHRARPAQAGVPAQLQRQPGRGDHSRGGPLRADFHRRARGLRDQQHEVRPQRRADHRHPGRRQRRDEPADRPGTHVHLRPQRPAGGAAPAGRGAGDGRGDRGLAAAGGSPGGDPQRAVLGRRPQPLRRAGGRPGARRPLHALRRLRGLLACAVPGRGSLARARSLVALGVAQRGADRLVQRRPDDQRIRPGYLEAMKGLTRSRPGDGVRGPPGEGRRRGGRIPPARCPAPSG

SEQ ID NO: 24698 - protein, 74 aa, Pseudomonas aeruginosa
SEWGGAGRHPPHFHAQDEERKPMSEQNNEQRSQAAGTDTVDRGNSNAKLEQLEAYSRRRHRRGPEHQYRHPHRR

SEQ ID NO: 24699 - protein, 185 aa, Pseudomonas aeruginosa
GNLRLRALPALRCPALQRDTTPMSAWETLWKILGEEFADLADFEQTARAALRLLLAAALGAVLGYEREQSGKAAGLRTHMLVTLGAALFVMPLQLQSGGADALSRVIQGTVAGIGFLCAGTILKAGRESRVRGLTTAAGLWASTAIGVAVGLGHQGTAVLGTVLALLVLHVLACLNRSPPSSDSH

SEQ ID NO: 24700 - protein, 150 aa, Pseudomonas aeruginosa
PWRWSPTTSATISGTTMPPTAARASTWASAGAWRRWWSVTGGASSCCTACCCRCRARRPCTTATRSAWATTSTSATATACGPRCSGRWTATAASPAPTRRSWCCRRSSTRCTATRRSTSRRRRATRIRCSTGCAACSPCAASRRPSAAAA

SEQ ID NO: 24701 - protein, 135 aa, Pseudomonas aeruginosa
PCRPTASTGSTWPTRRRCRAGTWPPTSACRNCRPWWSSSASASCCRAHRGTSWKARRCRPTCRSAAGSPARKASHGSATSFRWTRRSRAVRCAKWRSTGCATSCRWASSTPTSAATACLSCWPWRACGAVARSAC

SEQ ID NO: 24702 - protein, 435 aa, Pseudomonas aeruginosa
RARTDERTDVRTRTLATGAGQAAARPAGRSIRLPRPAARPRRRRRRAARLPARRAARRAARRRRRDARRTGAERPRQRLVPAPPGAPATALQPARALAGRRAGKRRPLCLRAVARRTRPLPVRRRQPPPTGLLSGRASDPSRRRGGRALRGLGAERRARLGGRRFQRLGRAPSPDATTLSIRRLGTVRPAPRRGRTVQVRVAGPRRPPAAEGRPPGAGLRDAARNRFEDLRGVAPRVARPGLAGPARGAPGLCGTAVDLRSPRRLLAPPRRPAAALVGTGGGADSLRAPARLHPYRADAGDGTSLRRLLGLPAARVVRPHRALRHAGGLRRFRRRLPPGRHRRDPRLGAGAFSHRRPRPGPFRRHGAVRVRTSLRRLPPGLGYLHLQPWPQRGARLHAGLGAALAAHLPRRRPAGGCVPLDALRELFAQGRRMAA

SEQ ID NO: 24703 - protein, 146 aa, Pseudomonas aeruginosa
PSTVTCTSTPRSAAALRASCNCRPTSSSKMMKVSRRISRRASAMHWNRRGKYSSPLISSSTRLPSRQGKFMAPPPPPAAGGRTGATRAAARGCAAGARGHCAGKCGPAAAPASAPGSCAPAGPGRRRRLRAGRNRRAVGQRAGASR

SEQ ID NO: 24704 - protein, 584 aa, Pseudomonas aeruginosa
NPCGCSPSAPAGAAGSCGTLPQVIGQLSGHRAQAAVEFQQLQEAPGVVGCAHLDVVVEVAVQVARRRLRRGVLAGPAQVVGLVAAGPGADPCLPLAQGRFRIAAAVELLVAMQAQVEEVGADVAEQRPLAGGIGHHQGNPVFAQQLDERRVDEALMADFHGMPQALRRIAVEVALAVQARGAVPGELLRGGAVARQAGEEIGEQLAVEAHARRELPEERAEALAQGEGAGGEEVRQRLVDLAQSPHVGDVTRGLDAENEVLGGVLGPAAEALGRLQGVEGAVDLDAVHRPRGEAQFVLLAQPLGIEVTSPGGIAPAGNADAQACRCAHASPPGAAFRRRPARQFVHRAFVEAFLAALDLALLRHQFDLDPAGLAAVEGFEGLDGVADRLHLGEDLRRVDASAEHMFEQQRNVLAVVAVAHADGQVAVHRQADGKLPRVFGVDADDRQGAGLGQALHRPLQGLCGGVAGTPAGALLARRRGGGAMAVLGVHADGVDGAVHADPGGQPAQGLDRILALEVDHFGALLAGHVQAVRVAVDGEHPGGAEEQRAGDGELADRTAAEHGDGVAGGDTGQFGAEVTGGEDV

SEQ ID NO: 24705 - protein, 419 aa, Pseudomonas aeruginosa
QEYRLVVADAAGQADQADVGIGNPRFLGLQPMEAAVGPGAAEERGAGLAAAGVGDVALGVVAGSAIHAIAAGDGRGNHHPVADLKVAHFVAERLDDAHALMAEDGSRTHAADAATDEVQVGAADRRGGQPHDGVGGLLQARLRHVFQADVADVMKYHGFHGVLPVGARPRPERQRRAGWKKGSVVGLGDALQDGGAGGLVAAAGDVAQGNHADQPLLAVEHRQAAHLDVGHVAGHVLDVFVFEAIVDVAAHDAAQRGIPGQAAGHRADGDVAIGDHPDQAVAFADQQGAAVDPRHGGGRLADALLRVGDLDVAGHDVADLHAVLLCRVDVRAPRAAPTGSDWRCRGRFSFFPRRSSFRSRRPAVVARTAGNCGRRPGTRWRTGSVRRAGPPAAGYPAGRSSRCLRPPREDGRTPRRGRH

SEQ ID NO: 24706 - protein, 211 aa, Pseudomonas aeruginosa
APQDGRGRPRRACGHGWRWPAGRVGWPGAWLRRRHGIPRRKRRSAAGRSRRRCARAGPPSDSRRYPPRPWRRSANSTAGSAPATRRAGAAADRAAARAAAARRASVRDGRGPPGRLRRDPRGPPLRHSGTPRDPAPSDRRPRRRYGRPESARATGTARGGYRPGSGRGWPGRPAPPAKVPGRGSPGHRRGFPPGPVGEPGRPRRETPPGVR

SEQ ID NO: 24707 - protein, 181 aa, Pseudomonas aeruginosa
CRPPRCANWPGGSAAPRAGGAGVGEPPRGVPGVRPACAGGLRAERSRRAQPPVDAASRARPRGPAGTRGNRRPGLTGAARRCLPAAPGNCPARGGSAARRGSPAGGRPRGPGSGRSPRQPGPRRSRCAGTAAAPGRATRRRGIPTECRRNSRRDSRAPIRARPATRDWRRRRCPCGSALCP

SEQ ID NO: 24708 - protein, 242 aa, Pseudomonas aeruginosa
TGRPDPSDASDPGRGWPGTDSSAAPSPPPIPAAPATAAHSRCGPAPAGGLRHPGAGRSACRPRRPARPGCRRGRALAPAAGRIRRPAVRGWRCPRAAGPARPGSVRSVADSAPDSRVLPAGRAGPPGRPAAAVRWRPASRVAGPRRRPVRPGVRHSWAGSRLTAMLRGLRRPRRYSAQARLSRNSTQVAAAGGSTSASSGEGLKSIRQSLPSPSRQRADSAAPAMVVTPSERAPRRRGIRCS

SEQ ID NO: 24709 - protein, 62 aa, Pseudomonas aeruginosa
TRCWERIRRDLIIDQGPLQTRDSDYFRKRIDLLTFRDSDNQHLTHRKVLVAGGKLRTMSLAR

SEQ ID NO: 24710 - protein, 98 aa, Pseudomonas aeruginosa
AGCFSSGSVSRRPGLPTHGPNQIRLRPLHLEVIPTMEADMRFPTSASSGATATTPRNPSRDPDEYPVPDHESHVPQEFPEEIPMEQPNEEPLSPIPEP

SEQ ID NO: 24711 - protein, 529 aa, Pseudomonas aeruginosa
GHRPSAAARRRGAGRLEPAVRGEGPRRRAQWRQRLQPGRRTPRRRSHARRRTGAGQAGGGLWRPRPVRGARPRRTGRLARRAGGASVGAGPGTGSQPGEHRHPQRRPAPGQRFPAELPRSPAPDPQRARRTGLCRLRPAGGARWLRRAAGPGPGPRGAPGHRVRADLRHRRGDLLPRLLRLAAQLRHCPGPGWQRSGALRRARAVLAGRRREQRRDRRAGSLPRRSGAARGARRVVRDPRRQAPAGQQPGDLPRSRRTRRLPAQVCDDGGGMTANSERIRIGVGDDRIEGTFLSPRAKVPGVLFVHGWGGSQQRDLKRAQGIAGLGCVCLTFDLRGHGAESGRQALVTREDNLQDLLAAYDRLVAHPAIDSEAIAVVGTSYGGYLAAILSQLRAVRWLALRVPAIYRDEDWLTPKLLLDREDLSEYRSSLIPAASNRALQACAGFRGDVLLVESEFDSYVPHSTIMSFRAAFQQTHSLTHRIIDHADHALSSEAAQDAYTSILVDWITEMVVGERLSITPAYATIHPAF

SEQ ID NO: 24712 - protein, 122 aa, Pseudomonas aeruginosa
PAACSACRSASATTRGRTLRWTPNCRRTCRDSHGPCAWRRAHRREEGETMASHLFLISYILDDQPMTCELHSEADTLSREEARRHLEALHRPHDAEAISDIQVSKVERTHEPGTTPGHYQQP

SEQ ID NO: 24713 - protein, 676 aa, Pseudomonas aeruginosa
RAKSPFGAPYGHSKELFAHMVIWIFSIFPLGTSPARWRRSRSFLPGFPHRPPQSPCHPVAKQAAEQGSADLQDQPQGIGQARRACEYAGFGPERQPYRDEGEHQVVPGAADPARAVAANENDEGAEGQGQQQGAEGLAEGIGSGHGWFSSGRQAQALALVQAETDFVEQRFGAGEHPGGLHFRDVAGAAEIVDAQAGGQARDLHQRPVQAADREAALEPGTQLLLAGIARRHQPLPMAKQEQARYLGAQGAIDQRGADRRQGFGGVVGQRREQQVETGSRLADLDRRRQAGWLAAQPGARLQAVEIGLQGADFDLSLQGGGDQRLAQAVVGMEYPQLQGCGFQIAHGNSGVGAVERRCPYLHIESHTPDKVPANGIRRPRRGLPKGRPSSWGEPASGRKTFFVLPCWVCLAARVEQPTSEHVHENHKKTESPLEPGHAQPPARRSGRRLRDPHPGQRWPYRQLERRRGAPVRPRRERDPRPRLRLLSHPQGPRRRRSATGAAPGGCRGPLRDRGLAGAQQRQAILGAGGDRRHPRQPGPVARLRPADPRPQRRARGQGGAAAQPGAVPPAGAERYRLRHLHARPPRADHQLEPRRPADQGLPAGRGDRPALLLLLHPRRPRGRRAGPRPGRRRTRRAFREGRLAGAQGRQSLLGQRGDRSDPRQRWPADRLRQGNP

SEQ ID NO: 24714 - protein, 414 aa, Pseudomonas aeruginosa
HHPPDRSRTRTGTGPPGAVPGPEDGVPGAPHRRRGPRLQQPADGDHRQPRAAEETPARRPAHRRPLAERPGGRPARRQPDPADAFLRPQATSRSAALRDPRPVARDDRPADPFPGTERIDRDALSPGSRPRPDRRQPARTVHHQPCHQRPRRHAQRRAHRLFREQPAGAGGQSPSPRTGQLYLPEHQRHRQRHGRGNPAPCGGTLLHHQGNWAWHRAGPVDRRRPRRAARRPAHPGEPAGRRHHREHLDTRRPANPGKRPYGQWRDAAAAQRKRAGALVLSSTGGGRRPAGVEQHRGDAGGPRLLGTQGRLRQPGPGDSHGDAGAGHPPDRPGDATDERQPVGGAGHGPGPAAEDGPGHRLRGKDRRRGGTVAQAGQAVRPGRVVPVPDRHAEGRLSLSAGTRRCRPGFAPRAR

SEQ ID NO: 24715 - protein, 126 aa, Pseudomonas aeruginosa
RAPLFCGVQESGPARREGVQVACRAVRDRPSRALNRKTRGAPKDKRPCLPEEPMTTYEIQHMRGWRRFARTVRAASRAEAERLCLPWEWVDGEVLAVIPAEAEVAERWQRLNEDLVEGLERLRRDE

SEQ ID NO: 24716 - protein, 133 aa, Pseudomonas aeruginosa
PAGRPRRSARLRGRRGCPTLRRTRPGPVPGSPSPTPETPGVRGCGRGTDRRLRPSPPRYTTAGCRRLPGARGRHRRLPARARRRASRHHAGRRAPRHPGDRAGWPRSGRSDRAPGSAGRYAPGSGYRPPPAPR

SEQ ID NO: 24717 - protein, 461 aa, Pseudomonas aeruginosa
HARRAFRRGDVRMPGRGGQPGVLHPGRGRALPRSGPATPGASGHGLRPALALRRHPSLRRLAAGAKQPGGALRPPVRGPGAGGPAQPGLRPARACGDTAEPRPHGCAPARVAVAAAAAGVERILAVPRRPAQRPGELSTGTLRRVAEDEHSSCLARRGRLSPPPGAAARDRLHPRGWPGLVDDPAVIPCADPGAAYLRRLPAPGRRAEPGRAVQGAGGRSAGRGPACVAGRARRLPGGKLLAGAALRLRRPLSRRRPLRRCRGLAGNGLATVPAAGPPGQRVGLPACLRVTRRDLRRPPVAALPEVARSGPGAPSGTAPAGGGAAGGKSPAGLGRLARRSSFPSSSATPPAATTYFAARAPMPAITEPGRSGTGAPDPRRTAGTGEEQGELVVKDFAHPAYRLVTGQEIEGDSWNGDVFLRIDMAAELQGDFMGIADGNQAVVASQVISETVGNHAGRSHG

SEQ ID NO: 24718 - protein, 150 aa, Pseudomonas aeruginosa
GECSRESAAMSFSRFAQRLSNWAGRPPTFVVALGLILLWAISGPFFDFNDTWQLVINTSTTIVTFLMVFLIQNTQNRDTDALHIKIDELLRSTRRAHNALLGLDDLDADTLRELRQRYQHMGEQDGETPESVAAEEERQCGCGEERRRAD

SEQ ID NO: 24719 - protein, 193 aa, Pseudomonas aeruginosa
SIRWTIRLYPLPPASGVSILSFPRRPAYSGKRKALDRLMIFSSQGARKEFERSIAQAFGVSARGEKRRIPFNPREEDTSMTDKRQGMSTSEAGQKGGAATSRSHGKEFYQEIGHKGGQASGGNFANDPQRAAEAGRKGGQQSGGNFANDPERAAEAGRKGGQQSGGNFANDREKASEAGRKGGQHSHGGGRSS

SEQ ID NO: 24720 - protein, 81 aa, Pseudomonas aeruginosa
PSIRMVRFPAYAKEGVENKNPGSGEISENAGKFFVFRTLPARALGKWLRRREETSNSPYAGDSQAGRAAPKTARRKKETER

SEQ ID NO: 24721 - protein, 118 aa, Pseudomonas aeruginosa
CRRLPTISLTDERAMHLLERQHDIQPLSRADMTIHLNGQPVAAAAGETVLNVLNAVGLRRLARNDHGQASGAFCGMGVCHCCLVAIDGRPKRRACQTVVRPGMRVETESNRFDQEERP

SEQ ID NO: 24722 - protein, 352 aa, Pseudomonas aeruginosa
HRDCRRRRDRRVLRLPTVQARQPAHRRGRRQAPGQRHPRLGRRPLGHRRIGGTGLRGDLLPHDVLPQPARGPGRGGGGGREHAAHPAAGVLRPRPAIQRAVPGTAPRTDRTPRDGLQVRAHRAEIRDPGRRGSPVRRAHRGADPASGRAGALAGPRGTASCRAGGQPRGPRRAGIPLRPPGQPVPPGRRLPGGGAPERRRAVAGNQRHRRAAPGPADQRGAHGQCRGAALPDPDQRRRRLGRGTQRNGHRPAHPGEAGEGPDRPHRAHATTAERLPDHQRLLHGAEGQWRDPDRQHHRGQGLRRQQHLPGNRRPGAGRGALRAGAATGQPQAHLGRPAPGLAGRTADSRSGG

SEQ ID NO: 24723 - protein, 217 aa, Pseudomonas aeruginosa
RAPHENQLRRHPPASARYRIPDHGGQRLLRSRPQRNPADRGRSQGLVLPLLQIQGTVRPGPAGGLLPRLPGGHGPTLLRARAECPRTTDELLAEVAGQRLPALRRAALPGGQAQRRGRGPFGKHAHHPARRLRRDHRTPGRLPRAGPRRRLPRALRCPAHGQRAVPVVARREPAEQAAPQPGTAGDSHADHPQPAGNLRYRQEIPAPREAGIFSTRQ

SEQ ID NO: 24724 - protein, 81 aa, Pseudomonas aeruginosa
LTGLICPAHGMSRSPHSSDRGVWKCPNPRRSTAASSSPRAPTAPRPGITSASSRFRFLSPARARCCCAPSTCRSIPTCADG

SEQ ID NO: 24725 - protein, 209 aa, Pseudomonas aeruginosa
ATRRPTRRRWSSARSWSAARSAGWKPRTIPGSRSATGYSRPTAGRTTRFPTAAAWRAWASRRSIRPTPWACSACPASPPTWACSTSASPRPARPWWWPPPPGRSAPPSDRSASSRAAEWSASPAVRKNAATPCRCSASMPASTTMPRTSPNDWPRPARTASTSITRTSAARSSTPSSRCSTPRPGSRSAASSPTTTTPSCHPGRTACRR

SEQ ID NO: 24726 - protein, 188 aa, Pseudomonas aeruginosa
WARSCASASRCRASSSSTTTAIATMNSSATCRSGSPTASSSTAKSGSTAWRMPPRPSSACSRDAISASWWCASEPTHEPGGPCGSAVAGARGQGGGGRAAAAGLRAAVAGRGRLPVLCPAPEPRRGRALRLRRALGRPRRHRAAPTDAALQGDGRCRRRSPGGPPGVPPRGTASGQPVSGRSGTYKTP

SEQ ID NO: 24727 - protein, 295 aa, Pseudomonas aeruginosa
GVKRMKVGFLGLGGMGAAMATRLVQAGLEVTVWNRSAAACEPLVALGAARAEEVGDLFGLDVVISMLADDQAIRGVLLDSGALERARPGLIHLSMSTLSLDCVEALDQAHQRQGLAFVAAPVFGRTDVAEAGKLNIVVGGPEEAIEQVKALLEIMGQKTWFFGKDPRGAMAVKISGNFMIASAIESMGESVALVKRLGVEPGRFMELMSSTLFDAPVYRNYGPQIVEQRFTPARFRLVLGLKDVDLALSAGKRHNVPLPLASLLHDVLLEAIAHGDGESDWTALAKVALSRSGQI

SEQ ID NO: 24728 - protein, 535 aa, Pseudomonas aeruginosa
AEEGMSERGTAAEGRINWRRILPILLTTTLVGGICGIFVINELDRQHDGAHLRSYTERALERALEISSAADQMLREMNAGSAPACSDRDLEMLRSIVLESRFMSDVGRISGDRVMCTGVRGRLRAPWGLSAPDRVDAAGTRFWTEGMPLPLQALPTGLVSRGNAVVFIAPHAYFDVDHPDPGISAAAVSSGGDYIYHRFAWDDDQPLEALGRPGWPRFIGARQISLCDPTQDICVVSLLRERGLLGTEPGRAAMAAAIGGGLLFGVMLLLSYLFGFLNDEKLPARLLRALKREALEVHYQPIVRLASGRCAGVEALARWTDSSLGRVSPDVFIGALEESGDIELLTRFVFRRALKQLGPLLREQRSFYVSVNVTGKDIADPGFIDFAMRQMARESVRPEQVALELTERTTEAQGCLLAGMNRLRELGLKIYVDDFGTGHSNLVYLANLPVDAIKIDKVFTQSIGDSSAVELIFDKLCSMAEHLEIGVVVEGIETQAQADHVLRRSPEALGQGWHFGKALPLEAFFDYYRNQPAGR

SEQ ID NO: 24729 - protein, 402 aa, Pseudomonas aeruginosa
  UNSURE (328): Identity of amino acid at the above locations are unknown.
NRPSAGHHAALASAVHTGCGLDGRTPDRTERPETAAITTGRHARIPPHPGQPTRRSPAAMAQPGPHRPGAAKEHRPRRLESRLARTDRRARQVFPEPRLSPAVRRARARSPGKRLGLGPGRGKRQYAAAQGHRPGPGRRRTALHLPGDRRAVAGLQPAARRRPRQPARAGRGRLRDGAGPGAAHRPVSVRAATARHGRAARCPGAHPGAGRGGPAVRYRPPARLSRRGRPRPDFRQRGNLPSKAVRAVAGVLRRGGRQRRPGAGALPAKPVPGVFPAFPQGAEEDPPPDRPLRLGLVGHGGVGAGRALRLGRWRPARLAALPRRPGRXRAGARRRLSHRPPLRPAGGGRGTRRPGRGWCRAGSRAGRRTGRSPSGGPSPGCSPGWRRRTARRRRSRRPGKCP

SEQ ID NO: 24730 - protein, 152 aa, Pseudomonas aeruginosa
  UNSURE (144): Identity of amino acid at the above locations are unknown.
GRMAASPAAPAAGSPGAIPATAAVRARGRPPTARRGGCGCRRTPSGRGRRRRSATARRPRWPAPVRRHGRRSAAGSRSRRSASAPGSRGRSRAAPPAAGAACRAAPRGPRRGPGRAPPKPVRRATPAAGSAPLRRAGRPGMRRXAGMTGCPR

SEQ ID NO: 24731 - protein, 144 aa, Pseudomonas aeruginosa
ARAGQDSRRRRDSRAMARGAPIRVASRQLSRARPRVSRKPSSNQRRYCGARSSPNMCGIPSGRTKNAPQRSEARGSCGRSGPLSSCRRSCTGAPAGSWSADRTRCRRSSAPGRPAPARAGSCRRTRSGTSRPWEYRRRSGRWKW

SEQ ID NO: 24732 - protein, 305 aa, Pseudomonas aeruginosa
GVNDLRGVEGHQIGDALHRPCHLLWRPRCEACSRTKCQHFDSSASFSLTSTHDRSDGAMSTQTSIEWTEMTWNPVVGCTKVSPGCKHCYAENMARRLQAMGTPGYENGFRLSLRPEKLQEPLQRKKPTIYFVNSMSDLFHEQVPDTYIDQVFAVIHQASQHTFQILTKRAERLADYFSQRTPPANAWLGVSVEDREYGVPRIDCLRGINAAIRFLSAEPLLEDLGELNLTDIHWVIVGGESGAKARPMKQEWVDNIHRQCDAFGAAFFFKQWGGWGSDGVKRSKKANGRLLKGQTWDEIPLLTLA

SEQ ID NO: 24733 - protein, 445 aa, Pseudomonas aeruginosa
YQNKDDPMAKDDEKYRWDWATQTFPTIDPHSKIKHQIIDDYIQAYIDVLMRNQQMPLLGLSIVDGFSGGGIYNDSAGGHHFGSPVIALEAIQESEVRNNVGRIKHRPICSQHHFVDVKPKNTACLHAVLASRGHQARIGQDIHLHTAEFTKALPAIAQSLKAFGKSERVLFLLDQYGYGDVPFGQIKWIFQHLSNAEVLLTFNVDFLITYLADRHANRKAIASIGLEQYVPWEQLRHLKAHSSQDWQYLIQRYLSDGIKQESGAQFMTVFFIRPHGTNPMAYWFIHLANSYRANDVMKAIHWKYGNNFSHLLSPSCFFGYDANRDVGVTGQPDLLCEGEHQFDQVTDTRIRGELSELLPKQVFEVERRPFIQLMTELTNFTMADESRVKLALDVAVANGDIQAVDKEGKSRRRKGTSIKSTDILIAPPQKTFFFFPQQKKTSRDT

SEQ ID NO: 24734 - protein, 65 aa, Pseudomonas aeruginosa; identical to SEQ ID NO: 21243

SEQ ID NO: 24735 - protein, 469 aa, Pseudomonas aeruginosa
MDFSINPPQRIVFVGLGTIAQSFLPLLSKVHDLSTLEIYAIDPKTPPLIEYFANSFGLKFINSAIDQINYRDILVPILGEGTVLINLSTDVSSLALIELCRSAGALYLDTCIEPWKGGYDDPTIPLHKRTNYHLREQMLSLKKRLGSGVTALVAHGANPGLVSHFVKRALLDLAEEILGDCKKPSNKEQWAILSQRLGVKVIHVAEYDSQISQKSRERGEFVNTWSVHGFISESQQPAELGWGSHERSLPTDASMHTDGCGAAIYIEKPGASVRVKTWTPFNGPSLGYLVTHHEAISIADFLTLRTADETYRPTVHYAYRPSDEAILSVHEWFGNDCMTPEKTKVLRPGDILSGSDYLGVLLMGHEKSSYWYGSILSIEKAKELATLNTATTLQVAAGVLSGYLWILSHPSAGIIEAEDMDHEVALSYISQYLGELKGVYSDWNPTKNNPGTFSAIDSDSPWLFSNFVL

SEQ ID NO: 24736 - protein, 247 aa, Pseudomonas aeruginosa
TRSVQVSNVKSGIGLKSYEWSSLELLKGLSIEQIKSNPSKLEERRPFFWHDMSSEFDSINFLRYLFGRRDIQFSNEFIEFVCLWHLDEQNHYRGLRKINSVLYSMPEDMIDREIRSNSPDFSHIEDFMKDEFTILLSIAFDEVTSTRAYKQDVSFFDSFENESLSTWIRYAARDEAAHYGNAMKILRLNHSHRFDEVEAILDKIVEFETSESFDYQRTFIFDHDTDDFSHVLLKDSRDTILEVLRGK

SEQ ID NO: 24737 - protein, 160 aa, Pseudomonas aeruginosa
PRSEDAMSKNSNIKLISASIDDELLLVELMKKYHLYDGIEMTDEDRLAALRPLLSSSEKGNVWIICLGSKQIGYIATCNCYSIEFRGIEVWIDEFYIDEQCRGQGFGSEILEKVKSFLKSQGAAIVHLEVDENNPKAVSFYKKSGFEFRERFVMMSHSLK

SEQ ID NO: 24738 - protein, 136 aa, Pseudomonas aeruginosa
CRPRTSSTWPACATASSRASVSSRPSAPASSAPTASRYAASAATASPSTVPSPPAISWSCPPSGAISTRSNGAIRKSFPGCAAAMPREPPSAARRPGSSGWPRQVCWMARKRPPTGASIENSPNASRTCCSTRRST

SEQ ID NO: 24739 - protein, 139 aa, Pseudomonas aeruginosa
QGRRDDVSPACVAAAGPSDRSACHGKKCPLSATRNSSCGRARDSLQAYTAAGVTTSSSSGCTTVSGQRAGRLTAKRSTGGAIMNSRASPTPCASRRPARLPATQEPKEKPISVSGNPGWRASNQRAAASASSISPIPSP

SEQ ID NO: 24740 - protein, 669 aa, Pseudomonas aeruginosa
KASTDALREPADAHEKAPHPRGFFMAARRSDRLALAQQVEHLLHAVLDAQRLGIDHQVGIQRHVVGKGLAGDIVLARRIQPLWIAFAADLRRRLHIDGDQALGADQRPGLLAPFRARRDEGAEADQPGLVELLGDMGGAQPVLGAPGAVLRQPLVQVVAQVLPVQHVDRAAHIEQLALHGVGQGALAGAGEAAEQYGRRLLAEAAGTLLARHMGIRTVMSAAAMGRRRSGDDHAGANGAVGQAIDDDEGAGGAVLLIAIERDGRVQADLDPGDLVQLQLAARGPLQGIHVHLVDDARNRTRHIAGSALDIVLLARKHRLLGHPHQHGIEAVGDQRAIVGMHQHVAAGNVDLVFQGQGDGLAGTGLLQFALEGDDGFHLAALARRQCHHFVALAHHAAGQGAGETAEVQVRPVHVLHREAHVIEVAVGGDLDGFEDFHQRLAGVPGRTLGLVDHVVALERRHRHEVQRTGLQTDLLGKGQVVGLDLFEDTLVEALQVHLVDGDHDMPDTQQGRDETVPAGLGLHAVAGIDQDDRQVAGRGTGSHVAGVLLMAGRVGDDELALGGAEVAVRHIDSDALLALGLQAIDQQRQVDVVARGADFLRVAGDGLEVILVDHLGVVQQAPDQGALAVIDVAAGKEAQQFLAFVLPQVGEDVLADQIGLMRHAAYPQK

SEQ ID NO: 24741 - protein, 628 aa, Pseudomonas aeruginosa
TRSLARDFSSSRRAPPKAASKPYLSRACLSPSVFITSVCLALPWVNGLMPWATPSGLTWVIRSRPISSTIRSRNLYISWNFQRVSTCITGKGSLPGKKALRARCSMTAESLPIEYSITGLSNSAATSRMMWMLSASSCFRCVSLSTMATHGIAYGRPSGRRRTRTLSQRKALKDSPFIPKKYTHIAISAQPRSRRKHWRREVFQGRFADRADKAETASSRTGQSRRRDSEQTVRPLSAARLVRRRHCASIAGIVIPPRSPQMRRTALALPLFLLVSACSSEPTPPPKPAAKPQARTVISPRPVRQSVQPILPLRGDYANNPAAQRFIDRMVSQHGFNRQQLHDLFAQTQRLDWVIRLMDRQAPTYTPPSGPNGAWLRYRKKFVTPGNVQNGVLFWDQYETDLQRASRVYGVPPEIIVGIIGVETRWGRVMGKTRIIDALSTLSFSYPRRAEFFSGELEQFLLQARKEGTDPLALRGSYAGAMGYGQFMPSSFTKYAVDFDGDGHIDLWNPRDAIGSVANYFKQHGWVSGDRVAVPASGRAPSLEDGFKTLYPLDVLASAGLRPRGPLGGHRQASLLRLDMGRNYQYWYGLPNFYVITRYNHSTHYAMAVWELGKEVDRVRHRSVVRQD

SEQ ID NO: 24742 - protein, 407 aa, Pseudomonas aeruginosa
WAPPYRPLFGLATPRIFPMPKALRFLGWPVLVGVLLALLIIQHNPELVGLPRQEVHVEQAPLLSRLQEGPVSYANAVSRAAPAVANLYTTKMVSKPSHPLFDDPMFRRFFGDNLPQQKRMESSLGSAVIMSAEGYLLTNNHVTAGADQIIVALRDGRETIAHLVGSDPETDLAVLKIDLKNLPAMTLGRSDGIRTGDVCLAIGNPFGVGQTVTMGIISATGRNQLGLNTYENFIQTDAAINPGNSGGALVDAAGNLIGINTAIFSKSGGSQGIGFAIPTKLALEVMQSIIEHGQVIRGWLGVEVKALTPELAESLGLGETAGIVVAGVYRDGPAARGGLLPGDVILTIDKQEASDGRRSMNQVARTRPGQKISIVVLRNGQKVNLTAEVGLRPPPAPAPQQKQDGGE

SEQ ID NO: 24743 - protein, 493 aa, Pseudomonas aeruginosa
RRDSRICSCSGLLLVEDAVFGTTRVGGQRLAASQHRGGTTEDRSALGRAVDDRRTLLEVIYPQRRRETRGTGGRQHVVRAGAIVAQGLGSVAAHEDRAGMADLRQPAFRIGHRQLQVFRGDAVGDRTGLGLVGDLDQRAAPLQGGADDLGALHGRQQASDAVRDAVQERRIRTDQDRLGVFVVFGLGEQVHGDPVGIGLAIADHEDFRGTGDHVDADLAEHVTLGGGHVDVAGADDLVHPRHAFGAVGQRGHGLCPADGEDTVDAGDAGGGEDDLVDLAARGRYNHDHFGHPGDLGRDRIHQHRGRVGRLAARHIEPGAVQRGDLLAEHRAVGLGVAPGTLLLLLVVAAHALGGDFQGFALGYGDTGESQLQALARQDQVGHRGGLETVEALGELDHGGVATAAYGGDDVEDALVDRIVGDTFPAQQMIQMTPEVRISGIESTDSEGSGHSEPLLWMALSRAPLDYQAHRAGTRENLAMTRIGRCGAEPHGYQ

SEQ ID NO: 24744 - protein, 116 aa, Pseudomonas aeruginosa
VGTSVARTMSRRTSGRDVGMISLRLLSGFSDGTMPAAASSGRVSSRIRPLDKAMVSICATASASPVRGGSWRRAAGVSLRCTRSHGRCGRCDRSGCRPRPPGRRSPGSRMRAGRSP

SEQ ID NO: 24745 - protein, 477 aa, Pseudomonas aeruginosa
CRKAVRRPCPAPPVAGSAPPWKAAGKPPGTPAGRDAEESAWKKTSLFGFVFVNRVQQELADQVFQHQRRLGVVDGAAVLQNVLVAADADADVFLAQQAGGQDRRRGIDRQVVHVLVDLHGHATSVAVAIQVDRRHLADRHAGQGDLAAHGNTGDVVEVGVDLVGIAGVAHAQAADPQGQQQQGQQAGQEEQADTDFQGAGLHSEISKHQSSQNEVEPQHRQGGIDHGPSRRPADSFRGRLAVVALVDRDPGHHEGEYDTFDHAVEHILGELHAVLHVRPERPLVYAQPVDRDHRPAPDADHAEDRGEQRHGDETGPQARRDDVLERVDTDHFQAGKLFGGLHVADFRGKRRAGTAGEQQAGHHRPQFAQQGQGHHLPDRLLGTIGNQDVVPLQGQHHANEQARDDDDRQRQHAYRIELLHQQVQPGAWRAPAEQGVAEEQGRAAERGDHVQAGAAEQADTLEGRDSTHQRSPSRSAR

SEQ ID NO: 24746 - protein, 169 aa, Pseudomonas aeruginosa
QSIAVHTTLRRGGCGPTSQHGWCKRDTLSRYNPAFNPGATFVEHEPEPRFHPFRPAHHRPRARRGRQPAGADWRRFRQGLRTAAGRQGPGRRRRHGQVRSHRQEDRRYPGQHRHPLLLRASGRGQPRRHGHDHQGRRGPRPVQLRLDCRNRHPVASDQAPGHHPDQHDR

SEQ ID NO: 24747 - protein, 377 aa, Pseudomonas aeruginosa
PRVAPGQGCGSEPGRQCRPGSLSTEPGPDLLHHRNPGPRRRPGDRPARSPRLYRGRLRLLAPGRCAGPPTAAEGGRRHARGRRAAAGAARHLADRRADGNDPQGPGHDRSARRTWQACRHFHRWRPASRPGSGHRRPPGHHRPGDDRPRQDRPRRNSRRGSPEDHGRQQDRRTGGGRRGRPSGRRPEHARPVARRSDVMSDTHSAAELPVRARRIRLAIFDVDGVLTDGKLYFLVDGSEFKTFNTLDGHGIKMLIASGVRTAIITGRDTPVVERRARNLGIQHLYQGREDKLAVLDELLGELGLGYEQVAYLGDDLPDLPVIRRVGLGMAVASADPFVRQHAHGVTAARGGEGAAREFCELIMRAQGTLEAAQGAYL

SEQ ID NO: 24748 - protein, 178 aa, Pseudomonas aeruginosa
EVSMRFVNTLPLIFGLTAALGSSMALALPSDREQPIRVQADSAELDDKQGVAVYRGDVVVTQGSTKLTGNTVTLKQDKNGDIEVVTSVGKPAYYEQKPAPDKDVTKAYGLTIQYFVTQNRVVLIDQAKVIQEGNTFEGEKIVYDTQRQIVNAGRATGSQVTSPRPRIDMVIQPKKKAQ

SEQ ID NO: 24749 - protein, 142 aa, Pseudomonas aeruginosa
RRSCNRPYASSSYPPWTSSRKSRKRWNPIPCSNARKTATISTTATLSPMAPNRRPARPRRAPSRKAPRPASKASTTTSGANAYPASCRWIPPGKTSTRPAPAACPATTMTNGTSPRAPAAARACTATCSGRSTWHRCRTPIG

SEQ ID NO: 24750 - protein, 293 aa, Pseudomonas aeruginosa
TYRTGNDMRLIIVSGRSGSGKSTALNVLEDNGFYCIDNLPASLLPDLAQRALLHTELLQPQVAVSIDARNLPSQLQRFPELLQEVRDNHINCDVLYLDADDETLLKRFSETRRRHPLTTDTRSLAEAIGDESQLLGPIADLADLKLDTTSLNLYQLRDTIKLRLLNKPEPGTAFLVESFGFKRGMPVDADLVFDVRCLPNPYWKPELRDHSGLEPEVREYLAAQPDVEEMYQDIVGYLNKWLPRFAASNRSYVTVAIGCTGGHHRSVYLAERIGAALRDSLKNVQIRHRDLSS

SEQ ID NO: 24751 - protein, 188 aa, Pseudomonas aeruginosa
PSAVSSTIIRQKPNTRPSVASAACPWRWDSGMISWVTTKSIAPAAAASPQGRSSAERPTSQAQSTANSGSTRPDAAPTSIALKRDIPTPASTSATTRPSGTSCRAMPRARPLASSRPAPADTPTAMPSGMLCRTMAVTNSRMRGGMPPDSGAPSQPGWTSGISRPRMNSPITPTARPKLTRNPAPNFE

SEQ ID NO: 24752 - protein, 236 aa, Pseudomonas aeruginosa
PMIGFSAVTRIGLRANASLSLPWLTLKLAMALSASSRLTLASNWMLCNRLSATSGSITFSSKLPDWPATAMAASLPITWAATIAVASGITGLTLPGMIEEPGCSASSSISPSPASGPEFIQRRSLASFIRVTARVFNWPDAATAVSCEPIRAKKSSPGRNASPVRSFSSWLKRSANRGWALIPVPTAVPPCANCCKAGSTLSMCTPACRTCCAQPPSTWLMRTGIASIRWVRPVFT

SEQ ID NO: 24753 - protein, 152 aa, Pseudomonas aeruginosa
ACTSPALLWIVCSRWRSAGSRRSLISRAALMWMVEGMMSLLLCPQFTWSFGLTLPPRRRLARVATTSLAFMLELVPEPVWNTSTGKCCMKSSCSSCRQVSAIASPIGASSCCRETFARAAAALASSRARTKAWGMRWPLTGKLFTARWVWAP

SEQ ID NO: 24754 - protein, 198 aa, Pseudomonas aeruginosa
TGGNENASDERWRFIEGNPASAPGHHHRLDQYRTGMQVAAPFDVLADRDDTAEQVAQVGGDGDFLDRELDLAVLDPVAGGAAGIIAGHQVDALPHQLGDQQATPHPAYESGLVLVAMADEQVMHAAGVGRARQAELAPGIGAQDIGHQLAVLDEWLGIGRQAVAIEAGAAERADQVRPLVDAQPLGKQALAQRAFEEG

SEQ ID NO: 24755 - protein, 260 aa, Pseudomonas aeruginosa
DRPEEMAEQANSDFRSEQHRHFGGLHRPRAQSAGGALGGAPADRLGAGQGLATAVDVIPIVTLHLSFALGDHHAAEAVPGAGVTTDETVAVTVYPAALVGIQGGAVGLGHPLVGGERRCLASQGTFHGLLGTQAPWMIEVQLGQLAGHQRGIGETGAFVLGGMAGDRQRRRHRLADGRLAGRRGARRALALACVEGDAETLVTVELDGFHLALAHAGGQALLQRHRHFAGTGALAAGLGDDLLDLLAKVRKHGGTDCRGM

SEQ ID NO: 24756 - protein, 244 aa, Pseudomonas aeruginosa
RRDYSPTILSQPYSYTQPAAYIAIKGPGLTAPTVGQAHVGGNWGGWYSNWPGAIGLYRYVTLKRYPTCAVMTDTPHVQFPSITLAEIDSGGVREAPFELTFKCQSGMTNGTGAGATALGIRVSSGALAASPALGLVNASGGLSYLLSDRYGEPGIARGVGIRIYRDGTPMTLLANENSAGGSNAEATGWYPAIGGATQANGGSGGIDLYRETFRARLEKLALGSQPGVTAGRVEATAQVVIRVQ

SEQ ID NO: 24757 - protein, 463 aa, Pseudomonas aeruginosa
RCPRRRTGYRAGSVPAAAARIPPGAGTPAQPAPAGYRPGPGTGSRIAVLAEHLRDPPASHRRGRWPAPAHGHPANPDEGAVPPARPASARRGRGRRTGLRAARRDPAGGQPDAVLRVPGGAGAGDRGDAPGSARNAAGSALATTPRLAAAGGRRDARRGGVRLDRRQRRQPPGKESSTVNSSPQARQHEHPPAVAASLAGDLRLARRFHAALARGRVRLDWQAVRHAGHPEWEPLYRETLLRVTAASGEPPLPTQELILALERLGLVRLLDRCVLGTVLDRLNAEPTLRLACNLSRQSAAMDAWWEAVCRWLAARPQVARRLTLELTETAVGERVATREFIRRLREHGVRIAIDDFGAAHNNLDFVLDARPDVIKIDCRYTREARRSAKGAEVLRHLLALCRELAPCVVLEGLEEDDAFARLPTGDVYLQGNAIAPPMRVEPPLSVRRPKSRARIEALASRQG

SEQ ID NO: 24758 - protein, 614 aa, Pseudomonas aeruginosa
STTWKWPARWPRRTHPSNAPAGGAWPGMSFSLWLLVLGCILLTLGLASAYLRLLPVSTSFIYLLFGMAIGPAGLHAWRSGLADISGWFEHLSEAALLISLFIGGLKLRLPLRSPAWTAAWLLAGPVLLGCILGLTLGAHFLFGLDWGLALLVAAILAPTDPVLASDIQVNHAGDDDRLRYAVSGEAGLNDGIAFPFVIAALLLIGQGGGLPGEFDRSGLDWLLRDVLWAIPLGLLVGYCLGHGLGRLAIHLRARHTDTSVSANDFLALALIALSYVGADALGGWGFLASFAAGIGLRHAEVATLGRASAPAEAQAAAADVREAGQASGAIEYGADRSEHPKVAAGAVMLDVLSFGNLLERSLEVLLVTLLGAMLLPALGLARAAAGAAAVLRVSAGDGLAAGRPAADAPGAAAPARLVRHPRHRRPVLPQLRAEPGAAYGARAYRQRPGAEPRRPEHLLARSEHPAAADAPRAQRQSPRSGMIEILPFFSRMAKRICSMRSRPWVSRAARRMSSSRRRASARRACNGLPYSTMSVGEPSIRVSSFGWRSLSRDRPTSMTIRVMITSTALTSEKSSPSSACWVASPMIISSSRSKVVMSVSERRPAMRKSTSRTR

SEQ ID NO: 24759 - protein, 488 aa, Pseudomonas aeruginosa
APGTPRGPLQPIGEGAAGARDRVGAVGAPATAVRGFLCADDPWRDHPPGSVPRLARRQAGARGDRRASRRPAAAARRAQGRRRCVAGGHRRRAHQPSAAADRPVDPGQQAGTRRVPCALRRPAPARPARAPGVAGARPRRNRRRTVLPEARGAPEDPRHRPARPGARSRSSAAVANPQRRGAGRRGADGQHRIPYLERQPGQPGAARPFRPRPRPGPGAAVEAHARSDPAEPDVARRAGPARLPQDQRRQGHAPAGAAGAPAWLGRGQGFRPGHLPALGAPDAGAFLGGFRAAQPGRQDLRRLPAQQPRRQHRGRLLGARPRRVAGVGTGVPRGTRLAAGRQPMEPAQSAAAPRRTRRRRSLGRLRRHPPAHQRGHAAPARARLTVREKGGTPPAHRASTVQRDAEEAPDGYRLPDPRAAGPVAPGGCLGHQQRAPQRQLRQSQARLVTADPAPARARPGPLGLDRPPWLAPGDLAGTQQVNPTGDCP

SEQ ID NO: 24760 - protein, 188 aa, Pseudomonas aeruginosa
RRPFPPATRSRPEERAMPDLQLADEASRLVAYLRSADLSLITAESCTAGQISAELSAVAGSGKVMEGGFVVYSPAAKLALLGLDPNWLERFNLTSVEVAEAMARAALQRSPASAALAVTGLLGSEAKDGIPPGTVCFAWAFRLPAGLALFSRRERFHGDPARMRREATRWALRRLPEFHQRALRGERA

SEQ ID NO: 24761 - protein, 856 aa, Pseudomonas aeruginosa
PWPATTCSTACARKARRPPCRYARAPEKTPQAPACSGGPEGSPAMPDSQDQTPSTVQTLKASILAKLRYSVGRDPSTACPHDWFEAVALAVRDHIIDHWEEATPQGEAPARKRVYYLSLEFLIGRLLLDNLGNLGLLEETRQALAELGVDLQRIVALEPDAALGNGGLGRLAACFMESMASLDIPAHGYGIRYEHGLFRQVLTDGWQQEQTETWLDFGNPWEFERPEVSYYIDFGGSVQVDSEHSGRAIWRPDERIRAIAYDTPIVGWRRASVNTLRLWRARAEEDLQLDRFNAGDHIGAVVDVVKAESISRVLYPADSTEAGQELRLRQEYFFVSASLQDLLDRHLRHHHDLRSLPEQVAIQLNDTHPAIAVAELMRQLVDVHQLAWPDAWALSVATLSYTNHTLLPEALESWPVALMERLLPRHMQIIYLINAFHIDALRAQDIHDFDLLRSVSLIEEGHGRRVRMGNLAFLGSHQINGVSALHTELMRDTVFHDLHRLYPQRISNKTNGVSFRRWLFQANPGLTELLVETLGADLLDTPERRLPDLEEHVEDARLRARFAEQRRQNKTALARLVLDSLGVAIEPEALFDVHIKRIHEYKRQLLNLLHTVALYQEIRNDPTADRVPRVKIFAGKAAASYHQAKLIIKLANDIARTINDDPTVRGLLKLVFLPNYNVSLAEAIIPAADLSEQISTAGLEASGTSNMKFALNGALTIGTLDGANVEMSQRIGLEHMFIFGLSAQQVEQRRQAGELEMGGVIAASPRLEEALEAIRSGLFSADDRSRYEGLVDGLVHDDRFMLCADFEAYWHAQCRVEEVWREPDRWWRSALLNVARIGWFSADRTISEYARDIWKL

SEQ ID NO: 24762 - protein, 63 aa, Pseudomonas aeruginosa
RDYSEEIEMAQHQGGKGNFAEDPKRASEAGKKGGQASGGNFKNDPQRASEAGKKGGQRSHGGN

SEQ ID NO: 24763 - protein, 708 aa, Pseudomonas aeruginosa
  UNSURE (97): Identity of amino acid at the above locations are unknown.
ASRTTSSAARRPAPTPSTVATATPSWNSWRPIADDATGEALSTNTGTRIADNQNTLKAGERGPSLLEDFIMREKITHFDHERIPERVVHARGSAAHXYFEAYEDLSDLTKAGFLAEAGKRTPVFVRFSTVQGPRGSADTVRDVRGFAVKFYTDEGNFDLVGNNMPVFFIQDAIKFPDFVHAVKPEPHNEIPTGASAHDTFWDFVSLTPESAHMVMWLMSDRAIPIAYRNMQGFGVHTFRLVNAAGESVLVKFHWRPKSGTCSLVWDEAQKLAGKDPDFNRRTLWEDIEKGDYPEWELGLQVIPENQQDSFDFDLLDPTKLVPEELVPVRVVGRMVLNRNPDNFFAETEQVAFHVGHVVPGIDFTNDPLLQGRLFSYTDTQLLRLSGPNFNEIPINRPLCPFHNNQRDAPHRQTINRGRASYEPNSIDGGWPKETPPAARNGGFSTYHEPVSGSKLRKRADSFADHFSQAALFWHSMSEAEQAHIVAAYSFELSKVERQSILEREVNQILLNIDPQLAARVAANVGVQLAAPANPTPQPKPSPALSQMNLLSGDIRSRKVAILIADGVAESDVSDLRDALRQEGADAKLIAPSASPVQAENGAELSPEGTWDGLPSVAFDAVFVPGGAASSQAIGADGRGLHYLLEAYKHLKPVAFAGDAQALASQLSLPGDPGVVLGATATDVFPGLRQALMQHRIWQREAATKAIPA

SEQ ID NO: 24764 - protein, 95 aa, Pseudomonas aeruginosa
TVRRHLPIAIEESSVMFKDFDACTAWTDAMQERCQPVGLILYQPKRRGAAVRMLWVVTPGCSCLSDAETAADNLLQRITDIAADGRVRYADGGTL

SEQ ID NO: 24765 - protein, 200 aa, Pseudomonas aeruginosa
PGNSPAALRYPVLPGPRPARRQGLRAAPGDPGAHRQGRPGQRRPAHPPAPGAPAASAGRPGADHPALAVAGAQPGWPGAGRKRHRGETRQARAGDGQAPGGGHGFPLGAGRIQGQLQRQDHEAGRGKGRQGPAARGGGRGGGGRQGRRHHRSHRPSQAQPAFPRRRRQGQGQRKGRGRREGSRQVRCLAFAAQGLRRAAG

SEQ ID NO: 24766 - protein, 706 aa, Pseudomonas aeruginosa
INLNQSVAGGLGINDRPRRRPLEAGGSLATHRRTHVPEERASMSSIVRNSDDDPLVIAIQQPRIAIESVSPVVEEGAYPAKTESDRDLRLAARIFADGHEVLGAEVVWRRVGETAERRLPLLPEGNDFWSAQLRTPPCGRLYFRIEAWIDRFAGYRRELRAKHGARLPLDLELREGDELLQRCAERGGPEIAAACAPLAERLQACQSVEERVALWLAAQTGELLRLVGPREHLVRSREYPVEVERPLARFASWYELFPRSESGDPTRHGTFDDVIRRLPQIAAMGFDVLYFPPIHPIGRTHRKGRNNSLRAEAGDPGSPYAIGSEDGGHEAIHPELGDREDFRRLLVAVREHGMELALDFAIQCSPDHPWLREHPGWFAWRPDGSLRYAENPPKKYEDIVNVDFYAEQALPSLWEALRDVVLGWVEQGVTLFRVDNPHTKPLPFWEWLIAEVRGRHPQVIFLSEAFTRPAMMARLGKVGFSQSYTYFTWRNDKQELAEYFAELNQPPWRDCYRPNFFVNTPDINPWFLQRSGRPGFLIRAALATMGSGLWGMYSGFELCEAAALPGKEEYLDSEKYQLRPRDYQAPGNIVAEIARLNRIRRENPALQTHLGFQAYNAWNDRILYFGKRTADLANFVLVAVCLDPHEAQEAHFELPLWEFGLPDDASLQGEDLMNGHRWVWHGKVQWMRIEPWHLPFGIWRVRRVDA

SEQ ID NO: 24767 - protein, 642 aa, Pseudomonas aeruginosa
PAAHRAAAQPAVVDAGHADPVLRRRDRHGRQHLPRRPRRRADPDAVVGGPQRRLLPRRPGEAGAAADPRPAVRLPDDQRRGAGARPAFAAQLDAPPARRAQPAEGLRPRQPEDARAEQPTDPRLPARIRRGRTAGQHPLRGQPVARGPGGGTGPRQPCRQGAGGDDRRHVVPADRRADLPADPAALRLLLVLPGRRDADAELARGRRRAPAGTADPGGQAAPRRAAAGRIAEHPGRRDAAGLPAEAPLVRRRERPATALLHRSAGRGGAALCAVRSGDRRAALPVAAGLPRRRPARRQPASVAGPGAPAARSQGRPADRRRQPAAVRPQGPRATPRRGGDRPRRRRDPVHPGGGTGGNGRHRRRRRPAVLGGAVQQLDPLRRAHGPQGAAQDPSGAAPGNRGRRLPDPPRLPRHRPVARRGTAGRRGWRAAHADDPAGLPEQPGRRLELDPGQPGASRARRDIRGQRGARRAIRQPRRTARLRRQPRRPARRDAQRTGRRVGRSGLRQPRERRSQRPGLGAAYRRTVARSRQTPERAATTVAGRGGGTGAAPAGTPAGAARTPAAAGPAGSRRAADQGSRRPALGPGADGPGRRTLHRLRGRADAQPGRAPPAPQSDEGRRRHAALVRLRGGDGPAQRAEHR

SEQ ID NO: 24768 - protein, 823 aa, Pseudomonas aeruginosa
LGTGRQRPAQGRHALSQRSPRCLPGRLSGRRGGAHARLARSRRRGGGAGPGLPGKGRLRTALRSRLPPRLAGSASRRSGRTHRTPPEGQEPMSEPMSERERWQLELDKLQRGLQGDPFAFLGPQRDPGGEGGVLRAYLPGAQRVELLDEDGATLAELEQSDPGSGLFQRHLEPLPPRYSLRVHWPDGVQESEDPYAFGPLLGELDLYLFAEGNHRQLASCLGAQVTRHEGVEGVRFAVWAPNAVRVSVVGDFNGWDGRRHPMRRRYPSGVWELFVPRLGEGELYKYELQGHDGLLPLKADPLALACETPPGTASKTCAALRHEWRDQDWLARRAERQGYAAPLSIYEVHAGSWRHRDGRPPHWSELAEELIPYVRQLGFTHIELMPVMEHPFGGSWGYQPLGLFAPTARYGTPEDFAAFVDACHQAGIGVILDWVPAHFPTDAHGLGRFDGTALYEYEHPFEGFHQDWDTYIYNLGRSEVHGFMLASALHWLRTYHVDGLRVDACPSMLFGNYSRKEGEWLPNRHGGRENLEAIDFLHHLNQVVASETPGALVIAEESTAWPGVSRPVAEGGLGFSHKWNMGWMHDSLAYIGEDPLHRRYHHHQLTFGLLYAFSEHFILPISHDEVVHGKHSLLDKMPGDRWQKFANLRLYLSFMWSHPGKKLLFMGCEFGQWREWNHDGELDWYLLRYPEHQGVQDLVAALNRLYRELPALHARDGEALGFEWLIGDDQANSVYAWLRHAAGEPSLLAVHNFTPVPRQGYRIGVPQGGDWDVLLNSDAQAFAGSGAGSQGRVSSESCGAHGQAQSVVLDLPPLGTLLLRPAG

SEQ ID NO: 24769 - protein, 174 aa, Pseudomonas aeruginosa
GDRDCSSRWSTSRRRSPRPCRAADAGSIRGYARPRAAGSRRAAGCTGAPAACPACPVVPGRRARRGAPHRAAREAGGSRGRNRRWRSAGVAAPGGSPAGTRARCRRWTGRCRGSPGAPAPAARRPTAATAGSRRPVRAAPGRPGGYRAPPGPRRAPRSPAWPCCRDVPGGPRRN

SEQ ID NO: 24770 - protein, 290 aa, Pseudomonas aeruginosa
SAVLRGCRRARGSSWLHLHRQRQVVGQVRPGPPREDARLAPAGIAQVNAVQRQHRPARREAARRPALGADEDFAQAATGEQLVSALAPVVEVAGDHHRLALRQARHQFAEQLQLALALRLAQSQVHADRVQRTADVDHRMQQAAFLVARHRDVEVAVGEDRMLGEHGIAMVAFGIHRVAPVGELRPHAVGQILVLRRRRPGRQARGVQAMGAEDLLEEHQVGTDAAHRFAQLRQDEAPIERVETLVGVHRQHLQARQDHAALSRRSSGNCPGTVRRPPSSSSSCRRRRAS

SEQ ID NO: 24771 - protein, 136 aa, Pseudomonas aeruginosa
TPMIDRVPALARPCTAHSRACAGALPGLQLVPSWRGAGVAVPWLCSASTPTASMARSTPIPAVSQRRAWTGSSRSKSITSAPCWRAMCRRSGWRSMANTLAAPRSNALAMANWPTGPQPNTATVLPGAIPASSAPK

SEQ ID NO: 24772 - protein, 270 aa, Pseudomonas aeruginosa
LEQQETAAADQELAGERVAFAERVLRPLGIQQAGPAAAFGHLGKTEGHRVVVGIEDQQQGGILTAAQDPGGLRAAIEEHAETAGVLVVPVFLGHLLAAGRQPGDVLDTQRLVVLADQEAPPAQDRIALAQGQQALGEGQQRTALVVQPPVDPAQFVVLAIDIVVALLGAAELVAGDQHRGALGQQQGGQQVAHLAQAQGADLRVVGGALAAVVPGQVVVAAVGVVLAVGLVVLVIVGNHVAQGETVVGGDEVHRRVGPPSTLVVEIAGGG

SEQ ID NO: 24773 - protein, 851 aa, Pseudomonas aeruginosa
SAKERGYAFCSCTGLLIRPLRACGGCAAWPPPVFRWRAAPGTRPSACAAWRPALAAGPGFPWRPWPDRGSSSVPPRRLPLRPVAGPWPSGVRPGRRGSPRIPRSGRRTLVCVFRRRSWGVLLGEAVKQVDGKVGEHFGQAQVPVAGQRHGGKQAAVGAFGETRRQQQAGVAPGLGRHLRLRGVAEQGAGQARDHHQQATVTTAPGEGQDPLGMLAADLQGQVVAVAEQARLHPPQPQHAGDQGLLDATVAPVLQQFREGRRRGQGGGVPGEVHRPPVVRVDQAEVPVLAPLVEIGDTRAGQAQQALGEAIQGPGRHQSHRRVAQRLAQGLGQWRAQELFQIVGAGALVVFVGRGPARAQLGFAQGLALPFAHPREERLVQGGAVARRVERPTAEQGLEQDQLVAGTRRRPLGEVAAQRRGQALPVLDVTREPGRQFTERRKTGAGVLAALVVMAGGGQQGAWAGQAPGFAGGMEFLGGSGEALRVEADVVAREQGRRAIAGGILHGLGGGRRTQLLEARQQLAAQAPQRTGRQLAQRLPAEPAFEMVEDRPVGFVEILAGRLCGIAEHLAILHRATAGPGVGTVDRKAREQLEQRAADTAQGQVAAGQVGPRHPQKSLGEVLQVTGEASRQDQLASLVDLVEKRLRASADPLPEFAQRSFAARIVLQQADLVHEVVAGGAVAQPILGQALLATEDLLNVQQHRRAAATGADPLAAAAQASAIAARIGQAVDVIDAQAIEQTVLEQLEGLAVHGLEHLAALDPQADQFADVEETAPVDVVRRGAPTGQAVVLRLEQAVQALASLLVAFLEFAQRALEGCARSALGERSRQLTLHLAQGLAVLPALAETAGQG

SEQ ID NO: 24774 - protein, 380 aa, Pseudomonas aeruginosa
QARLAAVFQQLRVTARPEGEALLAVARQQAAGLAVQAQADLPGSQDLAVVAAQERQQHLAAQRGVVGFPLNVEETRVGTLAPPFEHVLPPGIGAAADAHVVRHYVHEQAHAALPQPLDQAQQRRLAAQFRIDPGRVDHVVAVAGAGPRAEQRRGVEMADAQVGEIVQPGQGIVEGEAGVELQAQGSAGLNHGRPPRHPGGCVRAGAGAGRPAAFRASARRFPASAAASSGGRRRGRAGSAAPGCPGRPPGAVAPTARGLPRHSRCRRPAVLRRRGRDRPAVRGWRPGPGAPRRAVPGRPRIPRRCGVRRGRASGCPGPATSRTGSAGRGCWWWPWRPPAIAPGARSVRRAARRAARGYPALGGVPVPRAGLRARCRGPRR

SEQ ID NO: 24775 - protein, 141 aa, Pseudomonas aeruginosa
AGRAAHGGHRRSTVRRSPGAAGWRGCRRSPGPGAHGARGRRRRAGGGPSRRGTRYRESRARHRSAGRRRDSRAATSGRSHRRTRGLRLDGNRWPGPRASAGRRGRTRRRTARGSCRPGRSGCRSRRRRPSGPCRERCRSDA

SEQ ID NO: 24776 - protein, 714 aa, Pseudomonas aeruginosa
VARACRRPTPGRTAARRRSPSCGDRETRPVASAPRRSRPVPPGAEGSARPRRRSRTGRRAARRSPLRARAARATRRRARRRRHGPAPGCVHARRRAGTARPGPAPRGDHRCGNGSGCRADRAGSPRTSRCRCLPAASRGRRRSRPGPHGRPEPRGRSRSGRCLGTGRRSGAGSPSLAYPAQGRSGIPQQAPVQAVVRLHRVAPEHRRGHRLAAHGVEQRGTVVDVDRAHHRIEVALRGFLTEQEAGDPVDDGIGEAAGAARDRQRAEALRIELTEPAGLITRGHEQEVAAGVDTAGLGLVETDVHADLAGMTPGEFEHGLLQVRLATADADQTAAGLEQGIADLQGQVDAFLLHQARDHREQRPLARLQAETLLHVARVGALAGPLAGAEACHQVRIAVRLPAIVDTVDDAAELTLLDLVLEDAVQAAAVFRGSDFLGVGLAHRGDVVGMGDAGLEERQAPVELHAFVAQRFVGEAQFGAALQVAEALVGEVVDGKQARRAHAVPGHVGRRQRRRPVVGVHQARLPALGAASTGDLGGGQAQAGEAQVVVRPVVALVVHVRRTLALVEQRAEHQHDFQAVVEGHQADLAGRDRRPAGQAADDPQVAAALQHLAIAGQQDSHRMLALEDPRQRGGKVAESADLDEIAELGGNEEYPIPLLRRVLRVQQRRKSGQYRGFFQANACNRMSHVILRSYVVLGVGRSDSVAPWHGRSPC

SEQ ID NO: 24777 - protein, 444 aa, Pseudomonas aeruginosa
KSSLRWRRTCVFPLLHHRARQRPLHATPRGIRTNIRFLTTKATSPRNSRKRFRWNSPTKSPSRPYRSPECPVSIQEERNMSADPRQRLVVAHSVDPAAAEHEVQGNLALARWLAEVQKLEFGGRYEPELHQRGPLYLVPTRTLVGRETAVRLGVNSDEDLLGGFVEHAFIAGKAIVHPLPRGGVAPEGWNPLFAEKVRDVVLNGVSVFSLADAHRAGARMLAEGPVRAKLAEACGGLGQYVAHDLDELDAWLGGLEERQLAQGLVLEANLESIVTHSVGQLRVNGFLLSYHGHQHQTRNARGELVYAGSDLLVARGGYAELLALDLAREVRQAIEYARIFDTAAAIFFPGCFASRRNYDIAQGRDGNGRERFGVLEQSWRVGGASSAEIAALEAFRADPGLPAVRAASFEIHEDKRLPDNSRVIYRGPDEHGDFLLKYAMTGEA

SEQ ID NO: 24778 - protein, 174 aa, Pseudomonas aeruginosa
PASALGRPEVTGHRQGRRGGAQRMRARRGCRQAPLPGGAGKIAAGGDPPGDRAPIPGRTPSPRPGPSPARRPRLSRPREEERAMSQSLAFLLIGLATLVGFYDLWAFVSVFRSDRSVNSKALWSLLIAVLPVLGVLIWAVARPRAGDRPSSRLNSAEERALSQRECRSTRITNR

SEQ ID NO: 24779 - protein, 159 aa, Pseudomonas aeruginosa
GATMNAIELLVHDHETVKKLLNELSETTERALKKRSELLGRLELELVLHTAIEEDIFYPAIRESGGKEELKMYYEAKEEHRTVDSLVLPDLKRTRPDTVQFAGRVKVLKELLEHHIEEEEGELFPRARQLLDAAALKQLGQAMQQHKKELKARLEKRAA

SEQ ID NO: 24780 - protein, 359 aa, Pseudomonas aeruginosa
GMREEDRALLEELLLARGPGGQEDEVRAICQRELEGCCDEVGSDAAGNLVARISPPHLPREQARRAAVRLLAHLDEIAMIVKRVEADGTLRVVALGGAQPVSFGVCPVQILAGEAVLDGVLSYGSMHATGESPQGSDVLSGAVHWRDVHVVTRRSAEELANLGVRPGTRVVLNRLWRRPLYFQDCVAAHFLDDRAPLLAVLGVAREIARRRDELHGDLYLVLTTMEEESNAGALFAARRLPGDISIAVEVGPTVAEYGTRLCRDPIVNSGDSKGYYSRHVTDRLLRAAERCQYQPQAALLVDFASDASALLSHGEAAQVGCIGIPTENTHGFEIVLEEGIEACRRTLVEFLVQPPDDEA

SEQ ID NO: 24781 - protein, 149 aa, Pseudomonas aeruginosa
PRTKTMKALKARASSRVPKAWLRVSGPDMAGSPQGARRRHWRLCRPRRTSSSSASAQANTLAASTSATSPARLKSSMRRPAGRLGTSTSVQSRPLTVRLRSSPAPSCSSPASRGATSHCQWPSRNRRGTSARRAPSISAAQIGGKASAA

SEQ ID NO: 24782 - protein, 806 aa, Pseudomonas aeruginosa
SDNGANSRSRPAAAWLTSIDDARLAGLQRSPGRACRLLRSACKALTSICRCKAAAISAWLRLSWGWNIPSFRVAVSRLRMGTPGSVRWKGDVPTCISKAILRTRFRRMEFAGRAGVFRKVGQVPGASQRAAGRRSSYYLAGCALQPGSSSRRVNTSMKTTRKPKVPLNQATRNRLLDEAVDDYAIHTLDSAGRIASWSAGAARLFGHDASEILGRDYACFHTRKDRDAGVPQQALRQADVEGRFETEGWRVRSNGKRFWAQVVIDAIRDSQGQLLGFAQLIHDLSEGRAAKEALRRSQEQFRLLVQSVTDYAIYMLDHRGRITNWNLGAQRIKGYLPEEVIGRHFSCFYTPEDREAGEPARGLAAAEREGRFEKEGWRVRKDGSRFWANVVIDPIRDSDGRLIGFAKVTRDITHRIEAERELERARQELFQAQKMESLGHLTGGVAHDFNNLLTVIIGSLGLLKKRLPGDQRTADLLQNALEAAQRGANLTQRMLSFARKQRLDPQPCAIPDLLRGMTDLLIHSLGPSVSIETRFPLDLDLGLTDANQLELSIINLATNARDAMPNGGRIVFSASNQRVPADNPHRLAPGNYICLSISDTGSGMDEETLRRAVEPFYTTKGIGRGTGLGLSIVDGLAEQLGGRLTLESQPGVGTTANIWIPAVPRTPESARTGNGATPQPPSESERVRLSCRVLVVDDDPLVLNNTAAMLEDLGCSVLKADSGSLALEILTATPELDILLTDQAMPRMNGSQLVERVMAQGRPLKMALATGFAEKIEGAAAQLPKLAKPFGQEELYLFLTGTLKAG

SEQ ID NO: 24783 - protein, 153 aa, Pseudomonas aeruginosa
RLRTSPPGRPRSGSRNGCRADRHGAGSSPLPRGRRETPGTARAPPATGSPCARRSGNDPNACRRRRGACARTWPAILPRDRSRRSPARCSGRPRSGGSRSSPVRGRPRARQAAAGCRRARAGPCAHVRWRRCRWSRATGSSRGRSPARAAPEW

SEQ ID NO: 24784 - protein, 539 aa, Pseudomonas aeruginosa
SASPGREPGSSVALRRADVPGGIRHAPRRCAGPRRRARPANRRGPPAGRRHGWRPGSIAGRGTRRRLRGARGARRAGRGTGRGPWAKGLHWRQGGVKTGSCRVPCRGFAGAAGATTHMGASDTRGKRFHWQDRRRAGEPHGGKNEPRRHSGVFPRQSPGAAPMTHDLAASGLRFGIEEEFFLLDASDLDIVRSAPAGFVAACRDTLGEHFAEEMFECQVEVASPVFSTLAEAARFHGQARQRLAHLAMDFGLRSLCVGTHPFADWRRARSNPAAHFARLFEDQGRVARRSLVCGLHVHVEIPPSHDRMAVLQRVLPWLPLLLALSASSPFRGGRRSGLASYRRALCGEWPRMNIPPALPDEDAYRRHLALLRETGCIREDGQVWWMIRPSSHVPTLELRICDACPRLADALSLAGLFRALVGEALGADPRALPVARDACLEENYWQALRYGCAGRYLVDGRCVGAGDWLEMAWRQCRPQARQGNEWAYQHACGLLEETSAARQLRRYRRLREAGQERHPALRRLVEELLEENLQPALAG

SEQ ID NO: 24785 - protein, 232 aa, Pseudomonas aeruginosa
AGAPAGPIARSTPRSPLGSSLGLGVRLRVAGKEGLGEFRQMVAQPVRHGLFLGQDAFQRGKGFGVADLAGGGDQHGVGGDLHVFEHIAAHGALDHFVADCHASHRLAEGHQLGADVLQRRRTAVQALQTLLEQTLLAMGFLDVLFDPRLQLRIVFQPRGLRFQHLLGLLLHGVGIAQPVQQVFLFARHRGSPRCVCVCSEVAAGRSVQFLFRPVAVSAAAPLRQARRVGEKF

SEQ ID NO: 24786 - protein, 120 aa, Pseudomonas aeruginosa
AGGVAANGRPHPLRPHGRSADRCGPGRWRGCRQSALSADARRRRASPGLHARHLSVEARQRSLEMTAKRETPETENTPLSPASPTLRPERGKRDQASEAQPEFAPDDPDVAGPGEARRPA

SEQ ID NO: 24787 - protein, 200 aa, Pseudomonas aeruginosa
SIPRPPLSPSSWSSSSRTPRTAIPTRCISRSTNCCAAPDVPTMRCSVWTTWTPIPFANCVSATSTWASRTARRRKASPPRKSASADAARSDGAPTEPPRRDGSWAQDDLAAILAFFVEQGVALRCVVQTQAVADDRLGMQVAVADVFEQGRQQCLYMGLAHLEGQALVEGIAEQEAMDEAGIHARHAHRATPPDSRDALA

SEQ ID NO: 24788 - protein, 248 aa, Pseudomonas aeruginosa
CLAAAGFELERGEHGFGDAALGLKAHRVDHRVDAAVPVGALDDRRGGIVLLVEVDGNRTVGARGEVQPVGMVVDDEDPLGAQHPRAGGGHQADRAGAVDRHATALADAGIAHRLVAGGEDVAEEQHAFVFHYVGNHERPAVGLGHPNVFGLATRHAAVQVAVAIERRARRNLLLVEDRAAPRVGGLAGGVQVQAAEEALAAGDDEGHHHPVARTHRGHGRADFLDDAHELVAEDVALLDHRDLAPVEM

SEQ ID NO: 24789 - protein, 188 aa, Pseudomonas aeruginosa
APAKPGRKAAQLPPGATARSSTRRSATRVARPAAATSPMTRSAPPKPGARVASRAEAISPMTRKEPPRRAARAASRAAGTSPTIGKRPPRQDARVASTATAADARPDRAEPLKRTAHPQRDAPFSHRPKRAGPGLRKVPFEQAAGCPCRRGKRALPTTFAHQTLRWKKSSASWKLGRSGTFQSGWAVK

SEQ ID NO: 24790 - protein, 202 aa, Pseudomonas aeruginosa
PSTSMASPSRRLPVRPCSTCSMPWACAGSRATTMARPAAPSAAWAYATAAWSPSTAGPSAAPARPSSGRACGWKPKATASTRRNGHEPAPGDRRRRLGRHGRSHRAGQARGPLRPLRRGLASRRGGLSRPLAGRRRSGLPRRALHPDAGKTAARFLRLRRAHRPAPEQPRGRWRRPAPDGPRRGGTAARGGVFAPAPGHRLP

SEQ ID NO: 24791 - protein, 765 aa, Pseudomonas aeruginosa
AQRAVPRLDPARGDAPRRPAIADQERRGEAPGRYPDRRQRPAAATGGLPAACGRGTCRRGLRGLRVRPHGQGKPGAAEQAATVPRRPEHARLSQAQRHSAALWLGRGGGQRRGGTDGSDGSALRRRVAARPGKRATGEGQHPGGRLWLHPAHPAQPAVGSGARLQRRRIPARGMQRLAAEQPTAHPPGRRHGGYPRRRGGDDRRAHRGLVDPPATRGHRARRGHRTPRIPSRPPGGDQALPRRSRALHPARRPPGRTGAGRYGDLPLRTGHPWRHRARARTGRAGHRRAEDAHPRRHGRLPGADVHRLLQRSPAPRHRTPRRRLAAAAFPDRSDPVFRIPEPRYGSLNMNRTYDIVIAGGGVIGASCAYQLSRRGNLRIAVVDDKRPGNATRASAGGLWAIGESVGLGCGVIFFRMMSSRNRREAQGAAVAVDASTPHILPPAFFDLALQSNALYPELHRELIERHGMDFKFERTGLKYVIQDDEDRQYAEHIVAQIPHLAEQVRWLDREELRRAEPAVSHAAHGALEFLCDHQVSPFRLADAYLEAARQNGVELLPGTNVTGVLRQGRRISGVRTDNAGVLHCRTLINAAGAWAAELSEMATGRRIPVKPVKGQIVLTERMPRLLNGCLTTSDCYMAQKDNGEILIGSTTEDKGFDVSNTFPEIAGLVQGAVRCVPELQQVNLKRTWAGLRPGSPDELPILGPVAEVEGYLNACGHFRTGILTSAITGVLLDRLVHEETLPLDIAPFLAARFQPEPAAVAVAAC

SEQ ID NO: 24792 - protein, 205 aa, Pseudomonas aeruginosa
TTGLIQANVRPMKTSYDDTRQHLLDTGYRIMAVKGFSGVGLNEILQTAGVPKGSFYHYFKSKEQFGQALLEDYFRVYLADMDQRFSAPGLNARERLMSYWQKWLDNACPPCDEQRCLVVKLSAEVADLSESMRITLRDGSDGIIERLVGCLGQGRDDGSLAPCDARHMASALYQLWLGASLLSKLHRSPGPLETAMQTTRSLLEI

SEQ ID NO: 24793 - protein, 258 aa, Pseudomonas aeruginosa
ARRGPGAAAHRLPVARSLHARTDERRAVLRAAGGARRGHGRRHGQPGGSLEPSRVQGRRLGTLGQRLAGLRAFRRQRPGAPGRVAGASVLRPGPARHARLHRLHGPARHRQAPGRRDPGGGRRHRAGRRHRRTDRQAQGLPSGRRRRRCGKMPPRRAGARLRCLPRPPCRGLRRTTGRGLPGRHRHLLRERRRQGLRRRLPAAQRQGPDPGLRHRRPLQRHRAATRAGPLAGADGHDPAQAHQGAGLHHLRRLRPSLR

SEQ ID NO: 24794 - protein, 165 aa, Pseudomonas aeruginosa
IPARHVEVVRRRPHPVPRRAGRRPGECPRGLLRPAPGTQFRQAGGARRSRRMNQAVRVVALLQAREGRAAEVERLLLACVQPSRAEDGCLSYVLHRSLDEAGRFVFVERWADRDAIERHRRMPHYRAMADAVADLLADRQVFLLEELPAASLSPVDPEPTRPHEE

SEQ ID NO: 24795 - protein, 324 aa, Pseudomonas aeruginosa
  UNSURE (316): Identity of amino acid at the above locations are unknown.
HRPSIPDAAWTAALRIARNGRKRPRSPQAAMHAFPLTLDNRLAEALPLWRNLARTDRAPRRNIDLADWKADWRELIAALDRFSRSHGYRQPFAAQGHAALENAWAWGQAAENASTLLLKAIDRGLAGAELRSIYLETAALWLDYSRLLGAARDSLREQGEVDFETVPALAPRTGQYPFALQLLAMGVLLDAQELIPALVEEVLQFDTDRLLDYLGAAALGLTSASEETFHPRPFGQLRAFFEEADGSDAQALAPYLQSQYREFFQLSPKAQKKTRRLTGPYAWGWWAMEVSALGVLYGWDDGVLRASPHYLGDLVXYARARGDA

SEQ ID NO: 24796 - protein, 220 aa, Pseudomonas aeruginosa
  UNSURE (217): Identity of amino acid at the above locations are unknown.
ATGRRSGPPAAGEERGGQVEAGAEQEVEQGDEQEDLRRVDHHPVAHLGGDEGQLADADHVGQGSVLDQRHPLVEEGWQHHRQRLRQDHQAQYLPRPQSERAGGRPLPGGEAVDAGVHRVGEVGAADQRQRADHGGQRRYVDMEDDRQQEVGPEDQHQHRDRAEEAEQRHQQQARLAGQHREGHAEDQAEHRRSQSGERRQQQGQRRSAERAVRVCAXQQV

SEQ ID NO: 24797 - protein, 172 aa, Pseudomonas aeruginosa
RSRFPPGAKRRTARPGRWPSPARSSSAHSCTARAAAAEPCAGPAAAPPRAIPGAGSAPGRGRRRAARGVPRRCRRGTPRRRKPRYRGSAPRHRRGTRRTASRARASRAACSASSPAPPAAARERRSTRRTAAPAAGYCGTAPGRRAPARTAGAGATAGRWPGGRRSGWRAGN

SEQ ID NO: 24798 - protein, 397 aa, Pseudomonas aeruginosa
AGQDRGSAGSRRATSAGTAGREVRRTCAGFRRVERKTRLSEVRRAGRAGEAGRSALVADLVQARQRGLGLRTEPGVVDLLRLAVLLQLAQALVDELGQGLLALGNTDADQVVGNGEGRHFVLVAVGHVGQQADQLRTVLGDGLDLAVAQGGESEGRVVVGDDLGSGELLAQHAFVDRALVHADPPLVEDFRRGQGAFLDDELLAGGEVGDAEVHLLRTLRGDGEVGQDQVDLVRRQQRDAVGRVGRQHLQPDAQLVGQGLGIVDVEAFDLLALGVDEAERRVAVEGRDAQYAGLADVLQAVGLGQAGDQGEGEGGDGGEFLHESSSSLSAAIDDQGLAMWGGHSGWECRHVGAGVSRGEGSLAGAKGREKRMNRSILFPDEIRGMKTRIQGNKKTIA

SEQ ID NO: 24799 - protein, 349 aa, Pseudomonas aeruginosa
PMIIQYDWQKRLLRGRFPVHKGHARAMKDVERYLQAGTRENTRRSYQSAVEHFEVTWGGFLPATSDSIVRYLVDYADTLSLNTLKQRLAALAQWHIRHGFPDPTKTPTVHQVLKGIRTLHPSQTKQAAPLQLQHLEHAVEWLEQEAMCLFQAEDLAGYLRCRRDTALLLIGFWRGFRSDELCRLQVEHIQAEAGAGMTLFLPWSKGDRDNLGTTHYVPALRRLCPVQAYLDWIGAAGIARGMVFRRLDRWGNLNEAGLNPGSLIVLLRQILQRAGIQADLYTSHSLRRGFATWATANGWDIKALMTYVGWKDIKSAMRYIDPAISFGGLAARPALELNASTLTQVPASH

SEQ ID NO: 24800 - protein, 72 aa, Pseudomonas aeruginosa
VIQGRIGGQLVVLAQQLVNDRINNVSALFEEGSHQLCMRGCYVLTIRAVERSNPKFFPNGTHMAVKLHPLVG

SEQ ID NO: 24801 - protein, 70 aa, Pseudomonas aeruginosa
RPPADLNRSNHSKVDANVFTQSGPFVTSNIIGATSLEQLETNLGSVDLRLDEELLAGIDAIHREQPNPAP

SEQ ID NO: 24802 - protein, 684 aa, Pseudomonas aeruginosa
ASRGLALPRVRRTTARCGRPPLPVTRRASQGPRDDLLHDLVGTGVDPLHPGIGPGPRHRIFPHEAVAAVQLHAFVEHLALQVRRPVLAHGGGGYVQLALEMLLHTAIDEDPADLDLGSHLGKLEAGILEVRHRLAERLALASVVERPLQGRLGRRQRADTDGQALLRQLLHQVDESLAVLAEQVLPGNPHILEEQLGGVLGLHPDLLQALALAEARRTRLDHEQAYALGASLRIGLRHHDHQVGEEAVGDEGLRAIDDVLVAIQYRSGLHPLQVGTGPRLGHGDGRDHLAGYQLRQVLALQRLAAVVEDVGCSDVRMQGETDPGQAGPTDLFDDHGAVEEVRAHPAILFRQVRTEHSGLAGLVPERAVDMPILFPLVMERHGFLFEELAHAVAKQFVVGAEQGSRYHRGHLETVWDRVGCTRQVFDCREMPRPTHWTVAPKNKTIQPPFDRFPLLTTTIKIHARSIRSGAETCRHRRHRRRLRLDPDAGQGLLPHGQPAPRQAAGPRSPAGLPHPHPQPRRPAGTQLQRRQHRRRRSPRRLRYRGPARLLGRFRRARTALSANRSLVAPQPCRGNRPLRRGDRGLLAGPGRSAGWQGSDHLLALLSRIRRTLPERAAQPGEAPDRCRRPVLRQRRHLRLRPLHLSDRAFLRRIGGPGGGPGYPLRSTAQLHPRAYRLRRTEAAP

SEQ ID NO: 24803 - protein, 349 aa, Pseudomonas aeruginosa
PGRPSRVLMNPQARRRRGRSEQRQERTFAMRLYLLAFLALFGMNAMAADNWKAFPYDQSAYDYPGDKLKEAWPRLTRGFGDYPYPDADWVVNMATAHPDALEKTVKAGTGFTGKPEEATQYAARLQDVWRLLFRGDYAKAKEQGLALGVGGQVPAMFAQVLYAMFLAPDQAEKQRLLEEVIDYTEQAGPLVKADIVAQFGSVYAKARLAEELSVPVVLKRGYTSEIPKELDALLARQPNQPFALALYGGYEAGVIRKVGKLVGKMTYGVSADKMEQYFARSFRQANDLPIGHYEYANALTYVYGDDEREKAIAQLKQAVAIKPINAMEALEVAHAKKLLAGFEQHTAQR

SEQ ID NO: 24804 - protein, 185 aa, Pseudomonas aeruginosa
SVAMQRKRGRHFSDDPVSWQSAIRRGCTGAAYSCGASASRVRSMAASRAAASAKAGICATASPSSHRPKALPSARRSAVSPASRRLLTAPAALPSAKARDSSSCSPAASSRRKRKLPSSSRKLTRRAALAAFFLPLSALFSGSRRERRPTASRNSAMNGVAMRRALAAPARRMSSISSGLAISAW

SEQ ID NO: 24805 - protein, 176 aa, Pseudomonas aeruginosa
LVARLISYFLPGSIGSSAIHTSMASKPSVTSGRLSACTSMSPRETSISSSRVRVTAWPGPACSSSPSKVTMDFTLLPLPDGNATTSSPLRTTPLARVPAKPRKFRFGRFTYCTGKRMSSRLRSAAISTVSRISISDWPAYQGERSDLLTTLSPLSADIGTKCSELVFRPIFSAKAR

SEQ ID NO: 24806 - protein, 295 aa, Pseudomonas aeruginosa
SPATTTAPTTRWPSGNWARKSTGCVTAPSSGRIRTVDEQVLDGEALAQVVAQRLYPVALGGMVSGGDEADAVLPRAVHGLLGNLAGQVGIDASGDRLVDIALGAAGAPGDAPDRLTGIDQQRLTPQRIAHMPSEIGRLHRLGKRTEEDDGTRVARLQRPFHFEAELPGELHVVAHLRMQIQRQVVSEQTDIVVQQGLQAPLLHADHAGVLTLPEVTVMHQHHVGVGLHGGIQQRLAGSDPADDPPHLRPAFDLQAVRAVVLDARGIQITVGLFDQGAQGDSHANSSSFRQGAPLL

SEQ ID NO: 24807 - protein, 501 aa, Pseudomonas aeruginosa
SACGSCPGSPTVRCPPLRAAAGYRRESGPWTRRWSAFARQPPLARYAADLGAEQLEFLFDALVATVDVVDAIDQGVALGHQAGDHQARGCAQVGRHDRSALELGYAGDDGGVAFDEDLRTHAVHFVNMHEAVLEDRLDDRAGAFGNRVHGDELGLHVGGERRVRRGTHVDRLRPVALHVQLDPVAAGADVGTGLFQLLQDRLEDGRIGILQLHPAAGRGRGHQVGAGLDTVGQYVVASAAEALHAFDDDGIGASALDVGAHGVQAVGQVDHLRLASGVLQHGAAVGQRGGHHQVLGAGHADGIEEEVTATQAAGGRLGLDVAAFDLDLRAHGLETADMQVDRTRTDRATARQGHFGLAEARQHRAQHQDRGTHGLHQFIRRDQGLDAAGIDFDVELLVDDRLHAHAAEQFDHGGNVVQVRQVADGDRSIGQQGRGQDRQRRVLRAGNADFAIEAVTAGNNQFIHCNDPPWAQERSAQAARLKNFMVTAWMLPSAIQAFKWA

SEQ ID NO: 24808 - protein, 137 aa, Pseudomonas aeruginosa
TAIQVTTKANTILLITPLSTSSVNCTLFCMFAQNDPSYTPSQSTATIAPPQMPTTLKIAASSGMEMKPAHRRGATMYLSGSTPIISRLESCSVAFMLPISAVSAEPARPANSRPVTTGPSSRSRVRATICPTACSEP

SEQ ID NO: 24809 - protein, 371 aa, Pseudomonas aeruginosa
RRRNRALQSIQHCAAGDADRLHSMAGVSGTRFPVIIPPLIQAPHSLNMSQNLDFIHSAQRTIGLERDAVDSLLARIGDDFVKACELLLAGKGRVVVVGMGKSGHIGKKIAATLASTGTPSFFVHPAEASHGDMGMITKDDVVLALSNSGSTAEIVTLLPLIKRLGITLISMTGNPESPLAKAAEVNLDASVGQEACPLNLAPTSSTTVTLVLGDALAIALLEARGFTAEDFAFSHPGGALGRRLLLKVEDVMHVGEGLPQVLLGTSLTGALMEMTRKGLGMTVVLDEHGKLAGIFTDGDLRRALDRGIDVRQVTIDQVMTVHGKTVRAEILAAEALKIMEDNKIGALVVVDADDRPVGALNMHDLLRAGVM

SEQ ID NO: 24810 - protein, 176 aa, Pseudomonas aeruginosa
RADRRPARSERCRQDHLLLHDRRPGPGRPGRGPHRRAERHPPTDARARPGRHRLPAAGSLDLPQAVGIRQHHGDPRDPQRPRSQRSQGSPGKPAAGIPHPPHPRQPRHEPVRRRTTPGGNRPRPGQRAEIHPPRRALRRRGPDLGRRHQADHPSPQGEGYRHPHHRPQRPRDPGHL

SEQ ID NO: 24811 - protein, 460 aa, Pseudomonas aeruginosa
HQQRWLPRRVPRRNPRRHRSGTGRRARRSGSRAAPHPATGTRRHRRPQPARVPAAATAPVAVHHALAERSAAPGIRLPRPARRPRLQPIDAAHEAQGRRTAPGHRADPVPASPARFADRIERSRIHRPRRHRAQGQRALAGRAEPGGDATPARQRHLRRHGPPRRQQRRQYLHAQPVAGSPLVHQEPAEPQRNADEGRHPDRRAPARFPRLRRRSHEAAGPARHRRSGGHARIDHFAGHHAEIHAYAARHFRAEIFLFKSRQYRRRRGMLVHRDPRDHQETGGRGKCEKAIERQQDRWFTGGTGHSSGSPHRRQIPRIPGHSPFERAQATGVTLIHAKVFRRQVANLPLTHGQQGERGMQVNISGHQLDVTDALRDYVGEKLSRLERHFDKITNVQVIMEVEKLKQKIEATLRIAGGEIVANAEHEDMYAAIDLLIDKLDRQLIKHKEKYLERQQGVGAR

SEQ ID NO: 24812 - protein, 81 aa, Pseudomonas aeruginosa
SRPPGRGRPLRGAGPRTNPRPSPPAGCRPARESPRGSPVPGAGPRGRSPWRDPPGGNSDSRCDRRRRGRRVRVGRSVRRSR

SEQ ID NO: 24813 - protein, 119 aa, Pseudomonas aeruginosa
SCRCAGRRRAAGPQRYWRPGRRCRSASGWPARRPSPVPPDARAPAAPVPRAATPGHRPGAGRRVRSAACPPGPHRPSWRGRRNAPSNAVRRHPGSSAIGSAAPGRPSCRTAPAGRRRRP

SEQ ID NO: 24814 - protein, 332 aa, Pseudomonas aeruginosa
RTAPAAPVPGRTNPGRSVAVAFRGFPHPPFQPYASEQDHVILLLRVHRLDLELDGAADERLEIGDVTRLLVEQPVHHLLVGQHQVGVGLVGTRLAENLAENLVAGGFRSLQHAASLAAGARLAEDLYQAFAGAFAGHLHQAQLGDADDVGLRVVALQLLLQGAQDLPAMLLVLHVDEVDDDDPAQVAQAQLAGDRGGRLEVGLEDGFLEVAMADEGAGVHVDGGHRLGRIDDQVAAGLQQYLALQGFLDFVLDAVEIEDRSLARVVFEAIGNLRHQFFDEGSDLLEVLSRVDADLLDPRVHQVAQGTDRQGQVFVDHRRRADGLDLRGDLVP

SEQ ID NO: 24815 - protein, 196 aa, Pseudomonas aeruginosa
  UNSURE (69): Identity of amino acid at the above locations are unknown.
PAKVADVGENLVLARTFRSGAQNEAALPLDAFRRHAVGHHLLQALALDFVLDPQGYPDMTGARHVHHIXRRNRQVGGQPCALGADRILGHLHHQRLPLMDQGTDAFHGAAFAIGYLGGMDERRTFQADVDERRLHPRQYPYHPPLVDIADDAAPLGAFDMHFLQDAVFHHRHARLHRRDIDQDLFAHASTVLISAR

SEQ ID NO: 24816 - protein, 308 aa, Pseudomonas aeruginosa
RSWPTRTPPAAATPRPPAGTPPSVARPRPTAVAAASTCTAKPSARAWRNSRSAASPASRRGESRPRRRWLSVSSRRALALLAMLCLAPTSEAGVTAERTRLVFVEGQREASLLLVNQNPYPVLVQAWVDDGALDGEPDTALAPFLPLPPVFRLEPGRQRSLRLLATGQAQARDRESLYWLNIYEIPPQATAEAAGRPRLTVTLRTQMKVLYRPHGLHPHAEDAAAELGFALRDETLRVDNPTPYFVSLAGLALEIGETRLDLPGTLLAPRSQRRLGLPRRVDGGTRGEVAFDWIDDNGVSRQERKALQ

SEQ ID NO: 24817 - protein, 77 aa, Pseudomonas aeruginosa
TVPHRLASTSTHRPLPPPWPATCASPGVSMPPWRAVGCAWTGRPYGMPGIRNGSRSTGKPCSGSRPPAASRRCRPRN

SEQ ID NO: 24818 - protein, 217 aa, Pseudomonas aeruginosa
TVGRRRRHSSDDAEVRCAEVPAFFPCHANGVDHEQSNQPSPQGSRLAPAGPGPAFRQRPGHEQDRATDLRQRGLGGRRSGNRSRQDGAGKEHRRRCEGIRQADDRRPRQGQRRTAQPGRAQETGGRRRRQPDRQGQGDPARPARRLLRPGLRQQPGGGPRESRGTVHPGRGQPDRPGTAGLRQDPPAGPEAPPGNGPRAGQGAPIQVTPPRAEPGQA

SEQ ID NO: 24819 - protein, 114 aa, Pseudomonas aeruginosa
PCSVPCSYQHWDWRALPLALLLFCVCRPAMVWLLVGRRLMHPAQRRLLGWFGIRGIGGLYYLSYALNQGLPTALAHTASDLVLNLVALSICLHGLSIQPLLMRHARSVSRRDRE

SEQ ID NO: 24820 - protein, 982 aa, Pseudomonas aeruginosa
QSDRENHGERRKQDRPGPRRTRRPALADRGIPPRSRLRGAQRGESRRSPRPPGLGRGDRPVPAQRAARRSSERQHAHRNQPAGAPADAGDPAQRQRSRRHRPGGTLSGAAQTGDPGGTGESHRHGPAQRAGLPRRLSTEEPTMPSSKPLAEYARKRDFRQTPEPSGRKPRKDSTGLLRYCVQKHDASRLHYDFRLELDGTLKSWAVPKGPCLDPAVKRLAVQVEDHPLDYADFEGSIPQGHYGAGDVIVWDRGAWTPLDDPREGLEKGHLSFALDGEKLSGRWHLIRTNLRGKQPQWFLVKAKDGEARSLDRFDVLKERPDSVLSERTLLPRHGEAATPAARPARLGKSGGKTPMPEWIAPELASLVEQPPRGEWAYELKLDGYRLMSRIEDGHVRLLTRNGHDWTERLPHLEKALAGLGLQRSWLDGELVVLDEEGRPDFQALQNAFEEGRGENILYVLFDLPYHEGEDLRDVALEERRARLEALLEGRDEDPLRFSATLAEDPRDLLASACKLGLEGVIGKRLGSAYRSRRSNDWIKLKCQLRQEFVIVGYTEPKGSRRHIGALLLGLYSPDEERRLRYAGKVGSGFTAASLKKVRERLEPLAVRSSPLAKVPPARETGSVQWVRPQQLCEVSYAQMTRGGIIRQAVFHGLREDKPAREVTGERPAGPPPLRGARKAGAGASRAATAGVRISHPQRLIDPSIQASKLELAEYHARYADLLLRDLRERPVSLVRGPDGIGGELFFQKHAARLKIPGIVQLDPALDPGHPPLLQIRSAEALVGAVQMGSIEFHTWNASLANLERPDRFVLDLDPDPALPWKRMLEATQLSLTLLDELGLRAFLKTSGGKGMHLLVPLERRHGWDEVKDFAQAISQHLARLMPERFSAVSGPRNRVGKIFVDYLRNSRGASTVAAYSVRAREGLPVSVPVFREELDSLQGANQWNLRSLPQRLDELAGDDPWADYAGTRQRISAAMRRQLGRG

SEQ ID NO: 24821 - protein, 96 aa, Pseudomonas aeruginosa
PSAKKAELPRRTGPPPCNEMPRRPPMDTAYLILALLVLLLLVDAWAINSVLRSDSSASRKLGWSLLILLLPVLGLVLWGWTGPRGLRPVTSPEHSK

SEQ ID NO: 24822 - protein, 340 aa, Pseudomonas aeruginosa
PAWRSPRPWPGRPCNAVRRAPRWRSRGCSAVKRRTASRPVPCASPGPSGCPPASPCSRAASASTATPRGCAGKPPAGRCGACPNSINAPCAANAPEASDREETTMSEQRQTLPAQHQDQRPGHESEMQPKPEFVSADYRPAAKLEGKVALVTGGDSGIGRAVAVAFAREKADVLLVYLDENEDAAKTREIIESLGRQCLAFAGDVADAGFCRQVVDTLRQKWGRLDVLVNNAGEQHPQARLEDISEEQWEKTFRTNIFGMFQLTKAALPLMGKGGAIINTTSITAYFSAEKVAHFGADTPMGRPGQPEELAASYVYLACNDSSYVSGQVLHVNGGTVVNG

SEQ ID NO: 24823 - protein, 142 aa, Pseudomonas aeruginosa
VAGTAGRDADKEHGDETRLGVDQGSAGASGKPWLRPALGSARAARSLPRGGGLPLAVAQPGATALRQRPAFLDRPGALGGPPPDPGRPRPARPPAPGKRGGRRAGTQERLRKPRKHRPAAAGRKEARRCPTAKTRPRARSRP

SEQ ID NO: 24824 - protein, 173 aa, Pseudomonas aeruginosa
PTAGSRSRPRPGWISAIPGSSNDPRSATTSTSAAACRSTASTVAEPSGGRTSGSGRSPTTRRSSAGGVPASIPCACGAPAPRKTCNWTVSTPATISARWSTWSRRRASRGCCIRPTAPRPVRNCACARSTSSSQPRCRTCSTATCAIITTCVACRNRWRSSSTTPTRRSPSPS

SEQ ID NO: 24825 - protein, 197 aa, Pseudomonas aeruginosa
AVATGAGNRRCDWVRKPSTASAACVAVPCATARYNADERLGDVVEDPRRGVRRSRRLRADRPRRVAPAAGGGARRGTRLRARAERQGRRPAHAHAGNPRRGAVRHAAAIAEWRGGRAEPGDPGHRRRHRLPLRRHHPQGRSGKPGQGPDHRGGSLGQHRHRRRGRTRSPGYRGARDGPGATGAACPGLPEPFAAIFR

SEQ ID NO: 24826 - protein, 332 aa, Pseudomonas aeruginosa
ATPRPPPTTCSSASPTSPPTAACVTRTAARCNHQEEETGMARAIWKGAISFGLVHIPVSLSAATSSQGIDFDWLDQRSMEPVGYKRVNKVTGKEIERENIVKGVEYEKGRYVVLSEEEIRAAHPKSTQTIEIFAFVDSQEIPLQHFDTPYYLAPDRRGGKVYALLRETLERTGKVALANVVLHTRQHLALLRPLQDALVLITLRWPSQVRSLDGLELDESVTEAKLDKRELEMAKRLVEDMASHWEPDEYKDSFSDKIMKLVEEKAAKGQLHAVEEEEEVAGKGADIIDLTDLLKRSLRSRAGGGKDKGSEKAGADAKGRAKSGASRSRRKA

SEQ ID NO: 24827 - protein, 154 aa, Pseudomonas aeruginosa
SGACRRSPRWASTFSISRRSTPSAAPIARAATIPCVPRPATPAARMRSAARMAATRRSIPNWATARISAGCSLRCASTAWNWRWTSPSSAPPTTPGCASIPAGSPGVRTVACATRRTRRRSTRTSSTSTSTPNRPCRACGKPCATWCWAGSSRA

SEQ ID NO: 24828 - protein, 200 aa, Pseudomonas aeruginosa
WRAWARSASARATPISPGATTSRNWRSTSPNSTSHPGATATGRTSSSTPRTSIPGSCNAPAAPASSSVPPWRPWGRGCGACTPASSCARRRPCRARRSTSTRRNTSCVRATTRRRATSSPRSPGSTASAGKTRHCRRTSGSRPTTPGTTASCISASAPRTSPTSSWWRSAWTRTKPRRRISNCRCGSSACPTTPASRART

SEQ ID NO: 24829 - protein, 1137 aa, Pseudomonas aeruginosa
TGIAGSGTARSSGCASNPGTCRSASGACGASTHKEKPMARREKPVFLNDPQWYKDAVIYQVHVKSFYDANNDGIGDFAGLIEKLDYIADLGVNTLWLLPFYPSPRRDDGYDIAQYRGVHSDYGSLADARRFIAEAHRRGLRVITELVINHTSDQHPWFIRARHAKKGSRARDYYVWSDSDEKYQGTRIIFIDTEQSNWTWDPVAQQYYWHRFYSHQPDLNFDNPQVLREVLGVMRYWLDMGVDGLRLDAIPYLIERDGTSSENLPETHQVLKRIRAELDAHYPDRMLLAEANQWPEDTRPYFGGEDGGEGDECHMAFHFPLMPRMYMAIAQEDRYPITDILRQTPDIPANCQWAIFLRNHDELTLEMVTDDERDYLWNHYAADRRARLNLGIRRRLAPLVERDRRRIELLHSLLLSMPGTPTLYYGDEIGMGDNIYLGDRDGVRTPMQWSVDRNGGFSRADPAKLVLPPILDPLYGYQTINVEAQARDPHSLLNWMRRLLAVRSQQKAFGRGSLKMLAPSNRRILAYLREYAEGERQDSILCVANLSRAAQAVELDLASHAGKVPVEMIGGMSFPPIGELTYLLTLPPYGFYWFYLADATQMPSWHVAADERLPELPTLVVKQRLGELLQGASRNILEGETLPAYLPKRRWFAGEKGQPRLCYIVPLDEAEPRCALCEVEIDGLRYQLPLGFLDADQRGDSLPQLLALARLRRGRKVGLLTDAASLPLFARKVLAQLRAEAVIAHGDGEIQFIPAAGLAEMDDIADEDVLPFSVEQSNSSIRFGERMVLKVLRKILPGLHPEIEVGGYLTRHGYPGIAPLLGEVRRVGADGEPHTLMILQGYLNNQGDAWNWTLDNLERAVRDEISAASEALEGQYDSLAELRGFAANLGARLGEMHSVLAGESDDPAFGSRESDEASVQAWALRIAEQLREAGKRLSEPPRPLQGEAAERARRLLERLPALLERLPLLARQAAGGLLIRVHGDLHLGQVLMVQGDARFIDFEGEPTRSLEERRQRHSPMKDVGGMLRSFDYAAAMVLRNAQSTDSSEQADSARRKVAMRYRSEARDAFLAGYRAAAGGLMHAWHGREGEGAALALACLEKAAYELLYEADYRPDWLEVPLAGLAELTEHLLKGKNR

SEQ ID NO: 24830 - protein, 453 aa, Pseudomonas aeruginosa
EEIQHPVADQRGQQHALGQAPLEQGDEHRFEHPEPGRDMGDDPGDAADQEDRQDARVIHAVRQQAVQQERHQRPVARSEQALQGRQPPGRQGQPMLAPAPGAASGETAGQQVACGQRQEQGADQAQAVAAELPARRQGRQAAAEQDAGEQQVAEPVGHQAEGEDPGDIGDVQAEPTVQAIAQRHGADPGTQVEVERIAHERHGEDPPLGQRVADVVAAEQVEAAEHRIAGGRQQQPEEQGRGAILVEGVADFLPVEILHQQEQQHRDQHEERQGQQPAQPAPVRAARRRRGGFVTAAVHGLPRWPWRSCQRRDGRGSSDFRRGRWAGTQPAIAGKCLEKWKPRKISGRSPPVAAPRVAAADAPAVAARQLAQVLVELAVEGDVADHQVGLQVQRQAEGIEIARADGRPVVVDHRDLAVQRTLAVFVDTHALAQQVVVEQPAAQAHQRHVRHAL

SEQ ID NO: 24831 - protein, 278 aa, Pseudomonas aeruginosa
YQVDAHAAARRIAQLAKQAVAGEEIGVGDQQASPRLADRLQVLALDVVAGLVVVADHQAHPRRLPGARRPQRRVVGVRFEQRQAGLADIAHHRALDAHRVVLLGHVAATYQVVLAVIDAADEGLPAIDHHQLAVQPAKQVGAHAEQARARVEQVHANPGGGQPGQVVRAERGGAVAVHRDLHLDTALGGGAEGFLQLPADLVLEDDEGFQEDLPARLGDALEQARKVLFAVDQQFYAVAVAPGEVHGSTSTASGRWSDRCDQGRRERMRGWRPRALRR

SEQ ID NO: 24832 - protein, 556 aa, Pseudomonas aeruginosa
RSPEAVRRRASSGSMPVVAAPVGAHAIAETVVPFRPAGREAAYLVAAGAAIPGFGDQLALAQHRVLAAGDEEAVALVETVRMAAEDGRQVEAEAVHAHFRGPVAQRVGDHLQHAGVAEVKGVAGAGIVDVVAALVGHQAVVRGVVDAAHAQGRTQLVAFRGVVVDHVEDQLQSGVVEVRDHLLELVDLAAGEVGRVRGEEGDAVVAPVVAHAVFQQVLVVDEAVDRQQLDAGHPEPADVRQQVGVHQPGEGPANRLRDLWMAHAEAAQVGFVDHRAVPGDAYRRALGPGEGRIDDLRLGHEGRAVALVEAEVGVGRADGVAEQRLGPAQAADQLLGVGIEEQFVGIEAVAGIRLVGTVHPVAVDLPRVGVGQVAVPDLVGVLGQFDALDLLFPARVEQAQLDLGRVGREQREIDAEAVPGGAKGEGVPFADPRRSGATLSAHALDSSFARFGLAAAARLGRRRFFAGGPRRGRGPRLARLGGRRLQQGRGFLGGLGPTAGLLRCRRGGFRFGQLPGHGPVAFGLAVGAALGFPDLVGELSYAFFVGAHGVSSWARR

SEQ ID NO: 24833 - protein, 176 aa, Pseudomonas aeruginosa
HQRRGGCPDIADAGVQRYFGGGVGIDRRFEAGGQGPALLGAQFQVGRAFLGAAVSGAAAPVDVLAPPPAGQARQVVGAGGGHGVRRPLRRGHEAFAAPLEEQHAGTQHLAACQFLAQAFGHGAEVLADDQRRGATGLQRQQAQQLALRVAQVGAGVGRLAARDQPETLQAHHMVDA

SEQ ID NO: 24834 - protein, 589 aa, Pseudomonas aeruginosa
AAAAILGTGEVVEEQHPGGGRRRLDFRFERRRVEVDSPVTAVTESPARRQRGAGDGGNAQRTGAAQARDQVFMTDFQQLPVEAAPGRVAIGQAGTRALEGLHRVWVGERSQGGALAEAAELAELLASSLADRVRQFALVIGEIQERFARGAFLAHEQQRNHRREQLQRYRQAQRLGFGEDAETLAEGAVADLVVVLQKQHEGVRRQVGTRFAARPAVAVGFALVDEAFGQAARQAAQRLGVVLVVAVVLAGEQDVQRMVAIVVPLCVVALAQQAGAVVVVLQDQVHMALGAGGAAQAAGHLDEERAIGNRVHGIEAQAVDAIVEQPHQGVLIEELADFASTEIDGLAPGRLPVVAEERGGVLREVVAVRAEVVVDHVDEDHQAHAVSAVDQMLELLGRAVGRRRGERQHAVVAPVAATGKLAQWHQLHGGHAQFHQARKEVLDLGVGAEQADVQLVDHRFVPGPPAPLVDAPGVGAMVQHLAVSMHAVGLELRGRVRHPGATIDAVTVAGAGRTGQGRLEPAAVAAFQRPVAAVGGLDPDLTGVRSPEAEAGPAVALELGAEAAPDRHHWRTPRRAGAVFLNRRRYRRL

SEQ ID NO: 24835 - protein, 134 aa, Pseudomonas aeruginosa
ATTVTSTRPATRAANWSMPAPTCWWRAVATPSCWPWTWPARCARPSSTRGSSTPPRRSSSPAASPRGATTTLPRAGMATVGSASACSSSPGGSAARAAPRSPRWKPSAPIRGCPRCAPRRSRSTKTSACRTTAG

SEQ ID NO: 24836 - protein, 454 aa, Pseudomonas aeruginosa
RGRHDGEQRTHPHRGRRRPDRRHLPQPPGEGSRRALRARLGRQPAARPEARPGHRRARLRVPDLRPARPRRGKRAPGTGDARGQPAGPARRLRPAGGPPGHRQRGDRGGRHQLWRLPGGDPQPVARGALAGLAGAGDLPRRGLADAQAAARPRGSQRIPQQPDPGRQQPSPAGLRGIPRRCAAGGVGVRQLCAALDHHEFPRRLPADPFADPPDHRPRRPCAQQRGGAGRLYLDPGGLDHRDGGRRTSQHHPGLRHHPSGFLNAPRRRASHLPWALVAAHVPCRQAPAPTDARNPGQLRAKESEMNQTNLDDTLDVLNDLLQTSKDGEAGFHACAEDLRDPQLKAAMLEQSRDCAAAADELERIVLELGGKPKDSTSFAGDLHRRWVDLKSLVTGKDEEAVLNECERGEDVAKHRYQAALEKSLPAEIHQVIERQYQGVLRHHDRVRALRDARA

SEQ ID NO: 24837 - protein, 123 aa, Pseudomonas aeruginosa
PTQGEFHERIPAHFDGPMACRTTCSAGERLASIGAGLVLAGFGLARGGLPRACKAVAGGLLVSRGLSGHCHVKGLLNEPREELQLLREEVQHLTRRLQRLQERQRDDSRQDAALDAELPPNLP

SEQ ID NO: 24838 - protein, 162 aa, Pseudomonas aeruginosa
SWRRRGQALEGLISSRAISRVMTGTSFLWRSGVWTGPARGGSGGVPGGPRPPIQGLEPEDAGSAERQTSLSSGGAHDHLRNPAHARLAAFRPHRARRQPGRGGTPVPALGVGGWRGPRGDSGRGRGGRALAAPERGSGGRPGAPQAGRVTRRPTTAIRSASR

SEQ ID NO: 24839 - protein, 410 aa, Pseudomonas aeruginosa
PQQLASQRDLLGVHVSARRRRLRQRRKRVPVRRSGGLPVASDPVVQQLPLVGSEDSEHRRPVALDQVPETAAARIGMAPDPALFLEAGEKRREPPGHRQPLVHRAPADPATIRMHAGGVGALALEHGQQFFLEIEAVDHLLGAQADLVQAVAVPHPFEEGRAPAKLRQVVVERAQGLARMSAGGVVDGHVQLEVVGVEAQLAQLLSGDQQVQRRLLVAEVVADHFGQVVRGEVAEGELLGALQVVEVAEAFDFLAADAGQQAPVEQDVVACRDAVAEFFEEGLQQRPQAFLAMMRQQPIEPGAVDQLGRGHAANEVHRLGGNLEVASPFAAPTCPEVFGMRLGGAPGPGVEPGRPIGGVLRQVVVMGGGQAQLLVEELAGGFEVLAGLVEQGVVQVADPGRRACTGGREG

SEQ ID NO: 24840 - protein, 352 aa, Pseudomonas aeruginosa
QSAQRRRCARRDALGKSSEPSPAAGFRASVRRMKAPLRIAVVRMSVGGKVHEPTEERTMFVHDKRLQYTVRVAAPDPGLANLLLEQFGGPQGELAAAMRYFTQGLGECDPGRKDLLMDIATEELSHLEIIGSIVGMLNKGAKGRLAEAVEEEAELYRSLTGGGNDSHITSLLYGGGPALVNSGGVPWSAAYIDTIGEPTADLRSNIAAEARAKIVYERLINLTDDPGIKDALTFLMTRELAHQLSFEKALHSIQPNFPQGKLQGMPEFARRYLNMSRGEGDTRGSWNEGDGWEYVEAPQPAMDGGDGTASVNLSETEQEVLQRMADRTRSDPMADPLTGADLGAGAAADKAP

SEQ ID NO: 24841 - protein, 139 aa, Pseudomonas aeruginosa
PSGASSRRRRWLMIASGCRSPLPMCSSKAGSSACTWVWPILKVKPLSKASPNRKPWMKPAYTPGTLTVPPRRTAAMHWRSALPLLASSLSAVSTVSVTLPLASKPTASITASTPRCPSVRSMIAAAGSSSWSKSMGIAP

SEQ ID NO: 24842 - protein, 81 aa, Pseudomonas aeruginosa
SAAPGGICFLLRIAPRPGLVVSQAACRFRRQKKHSPQAMTKGTTTRSPGRTAVTAEPTSSTTPMNSWPRMSPCSTIGILPR

SEQ ID NO: 24843 - protein, 314 aa, Pseudomonas aeruginosa
RCRSEPQMAVAVTRSSRSSGSCRRGSATRSIRTSWLPWKVRARMALLLAVGRAGGACAAAPEFIRRDGWRSIPAPGGHCTTLSRGGRRGTQALAPWVPFVATMAHGGRTAILCRESIADRRGTDTEREASMSKQHIIHFTGPINSSTCGNLINTCAKVLPQEAEGLRINIATMGGECSYGFTLYNFLRALPVPIHTHNLGTVESMGNILFLAGERRSASAHSKFLFHPFHWTLHGAVDHARMAEYAMSLDYDLELYARIVAENTRDAPERLDIPRYLMAYPRILGPEDALACGLIHTVDDSPIPAAACQWSIHS

SEQ ID NO: 24844 - protein, 172 aa, Pseudomonas aeruginosa
MAATPGRNFELPVCGRFTSRESRAENGAPEERDRTMKVREIMSREVRTVTPQTTLGEAAQQMRQADIGALLVNEGERLTGVVTDRDLAVRGIADGLGADRPVREVMSGELRYCFEDEEVDHVAKNMAQLEKRRLPVMDRNKRLVGIVSLANIATCNADKLSANLLRGVARAH

SEQ ID NO: 24845 - protein, 535 aa, Pseudomonas aeruginosa
DRAQRAQCRGPAPARAQRPWPGQRRLLRHGRMPLLPGRHRRPAQAPRLPDRRPAGHAGGNRKQPLRPGGTAMNLRPVIVGGGSAGMAAAIELARRGVPCVLFDEASRPGGVVYRGPLRAGVDPAYLGARYTRMLEKLRRDFSACAGHIDLRLNSRVVGGDGQRLMVLDEAERLHEVEYSHLLLATGCHERSVPFPGWTLPGVMLLGGLQLQIKSGVVKPLGDTLIAGSGPLLPLVACQLHAAGVRVAGVYEACAFGRMARESLALLNKPQLFLDGLSMLGYLKLNGIPLHYGWGVVEASGEGELTEVTVAPYDEEWRPDLENARPVKASTLAVGYGFIPRTQLSQQLGLEHGFSDDGYLRAECNVWQQSSQPHIHLAGDMAGIRGGEAAMIGGRIAALSILLQREAIAPAEAIERRESHLARLEAIKRFRAGVERYTQRGARQVELARADTVICRCEQVTRGDIERALEQGVQDIAGLKMRTRAGMGDCQGRMCIGYCSDRLRRATGRHDVGWLRPRFPIDPIPFSAFQNLGTEA

SEQ ID NO: 24846 - protein, 106 aa, Pseudomonas aeruginosa
SRTTRIASTPSTSWRRSRIWPSRCAGWTARNCVVPSRRSATRPTARWNSSATTRSARSAWPTPTWRRRARTASSCCREPTSPACCARAGGSAGCARTMPGCCIAGP

SEQ ID NO: 24847 - protein, 412 aa, Pseudomonas aeruginosa
ASCTAARDRWRQPCRPPAACWKSEVPPGNTRPARGGYFFDPSVVDWSNLPGARYEPFATFVRQRSLEMSQSTQVNRRIVLASRPHGAPTRDNFRIEQVPLPEPGAGQVLLRTVYLSLDPYMRGRMSDAPSYAPPVELGAVMVGGTVSRVEASNHPGFKVGDWVLSANGWQDYALSDGSGLARLGESPEHPSYALGLLGMPGFTAYMGLLDIGKPQAGETLVVAAATGPVGATVGQIGKLKGCRVVGVAGGAEKCRHAVQVLGFDACLDHHAADFAERLAEACPDGIDIYYENVGGKVFDAVFPLLNAKARIPVCGIVAHYNDTELPPGPDRLPALMGTILRKRIKVQGFIIFDDYGHRYDEFQRDMSKWFADGLIQYREERVDGLENAPEAFFGLLQGRNFGKLVVRVGADA

SEQ ID NO: 24848 - protein, 465 aa, Pseudomonas aeruginosa
LHDRQRHRKHGRKRRPGEAPGRRARPVHGAHVLDAFRCACLSQLRPADRRAAFHPGQVPPGPRVEGCRPGAVRRQAPQRAAAAGQPVARRVARSHRPWRRGIGLDGAGEGSVVTIGTNLKRFCARPGRAREAVRQSGVLSMDSLGGRRYVRAWNGCRRPDQLATHPADTAHHHPGGRYLWDLRHQRTGSPARRRAPALVHREGAGAGTGDFLRGGPDAPRDERRQRAGLQRPGPGNAAFHRARVALHERRWQDQRRPGHVHGRPGPAARALGIVRARPGRCRRHPLLDGGHAPAVAGAAHRAGQSRQRRRIHCPARLFRCRPPGPGHFGGGRQQWRRLHLPPFRLGRRPAPRGARPARLAALHRRPADKPVRPDAGHLRGLPSPRTRPAWHRARTRGHGRGDRRRAVVRRHAAAQLPVRLPQRRKTAGQAAARVEARGPGGALPAHRAPGQRPLRRGRGPGALDR

SEQ ID NO: 24849 - protein, 326 aa, Pseudomonas aeruginosa
  UNSURE (67): Identity of amino acid at the above locations are unknown.
VQKISISTGIARKKPSSATSSRRGLPGSTARATPRTRPSTAEASPESDASSRVSAAPPSGPSGYAPXSRYDRLSEMTEKSISGTSLAVAAGLLQRLAESFDQGDGADVEKGGDTEGLEGLEGLGFHLARSVGQLGQADGHRQRGVLQRIHVLPEQRRQSRAQGLRQHHHAPYLALGQPQGEAGGALLGAYRGDAGAELLGDESRGIEGQPPGTGEELEGRPVEQGRLVRRVQPAHQRLRQQRGNAEVPEEQLHQQRGIAEQRQVGARRPGQQAPARQPGDGQGGADQGGEQATEQGKTEGQQEAVEQPAQVLRGEKFAEHVRDSVG

SEQ ID NO: 24850 - protein, 312 aa, Pseudomonas aeruginosa
SRYHIRGTSRKMTWLVMALMAPLLWSLSNILDKLAVIHHANHWTTFIFLLSIGNLLYSALIFLLFTPSDFDTTSALLNLLSGLCIFGMYFLYAMPLKSVDISTAIALHQLTPLLVLVVSILLLGYSPTGIELLGIALVFVGVYFAVAIGKGRPGSISLSAVLLLIGSAVFGAVATLLYDHLLLSHSLPSVLMFNYAGYGLGGTLMLLVPKWRHSIAKDVSEMPPKGWAVYALSNLFDAGGYALFIGALSAGGNVAVVSVLVSLHPVYVLALSHWLAIVNPKILSENFSSSDAYKRMSAIVVIVAGVIMMTKI

SEQ ID NO: 24851 - protein, 334 aa, Pseudomonas aeruginosa
KSMRAQSAPVLKHVGIVAIDGVFASTLMQAKDFFHMASLRHGKQQGLGLQPAFRTRILSPDGQPVRSFSGDSIAVDGPLAACDIVVLPAFWGDFDALERRYPQIVPWLRRSHAEGTALCGEATGVFWLAQAGLLDGKEATTYWRFYREFAERFPNVLLNQEKHLTDADDLFCASGVTSACDLYIYLIERFCGGSVAQAVARDTLYEVQRSYTPGRIGFGGQKLHHDPTILQIQQWLEDHFADKFRFEDVARDHGMSIRNFMRRFQAATGDKPLHYLQRLRIETAKGMLSSTRKSIKTISYEVGYDDASFFARLFRQHTELSPHHYRRQFMQKES

SEQ ID NO: 24852 - protein, 158 aa, Pseudomonas aeruginosa
SKAVYRGRIRVEQSLTAWLLPALALVAGVAIGFLIARLLPNAAPNKVQRQMDDLQDRFDSYQREVVTHFNTTASLVKKLTQSYQDVQEHLSDGAQRLALDEQTRQRLLAALHADEAYPAERRERLTPPASGEVPKDYAPKSPDSPGTLDATYGLKGKY

SEQ ID NO: 24853 - protein, 330 aa, Pseudomonas aeruginosa
SDRIDETCCVSSEIALTFLFFHRTGLVMVDDPTLAFGSTRQEHFLDDFRQRGGAGLDRAGERVAAEGTEAHHALLDAGFLFVREMLEDALVVDHDQRAVLLDNLALGGEVQRDDRDAFQVDVLPDVQLGPVGQREYADRLALLHLAVVDVPQLGTLVLRVPAVLAVAERIDPFLGPRLLLVAARAAEGSVETVLVQGLLESLGLHHVGVLGAAVGERVDALGDAVRVDVGDQVQAHFLDHPIAEPVHLLEFPAGVHVHHREGQLAGEEGLAGQVQHDRGILADRVQHHRVIELGGHLADDVDAFRLQLFQVRQFVDHGYSRNCLWTAVGP

SEQ ID NO: 24854 - protein, 296 aa, Pseudomonas aeruginosa
EPAGDDPRPLRRHSHRRRLPRHRQPVRRRPDRDHGHHQRHRTQPARPEHLRKLHPDRRGDQPRQLRRRAGGRCRQPDRHQHGDLLQVRRLPGYRLRHPDQAGPGGHAVDHRARPGDPRLARRRGQGADPGTGGVAGPRRNRRDRRRRRLSRRSGGTRRPAAGRCDPDHRQAGSQRRPPLDEPGGAHPSGTEDQHRGAAQRTEGQPDRRGRPASAAGTGSTAETGRRRVIPAIENGRPRAPFSYHLRKCRASSSAWFCSGLPMVIRRNWSIRACLKWRTITPCSRKVDAICPASCRG

SEQ ID NO: 24855 - protein, 97 aa, Pseudomonas aeruginosa
TCMKRFSKTVSMTAPVPSATAFMEMNWACMSVGNAGYGAVRTLTAFGRLPFMSSSIQLLPVLMWAPASSSFCRTASRMVGSVSFNFTRPPVAAAATR

SEQ ID NO: 24856 - protein, 70 aa, Pseudomonas aeruginosa
RAPPRRFTPSMTMVSEPAPWTLAPMAFRQLARSTTSGSRAAFCSTVRPLASAAAIIRFSVPVTLTVSKKK

SEQ ID NO: 24857 - protein, 159 aa, Pseudomonas aeruginosa
PPSTSICAPMASRPRICRSTGREPIAQPPGRATSASPKRASIGPSTRIEARMVFTSSYGATRVLMLLASTSTLSFSSMIGCTPMRPNSSIMVVMSCRCGRLQTVTGVSASRVAARIGSAEFFAPEMRISPSRRLPPVIISLSIAMIPRGLRNARPRRRG

SEQ ID NO: 24858 - protein, 390 aa, Pseudomonas aeruginosa
SPATARLPNRVASPAGATRCLACAGRAGRGRGTGSSGRARRPRPGRRGRTGGYARGERLYASALSQQVGPVVAGRIMERNGTIRDSLDELADTRIVGFLEDVRRPVAKYPAVADDIDVVGDAGGLGQVMGNHDAGDAEGIVEQADQAHQDAHGDRILPHERLVVEQDLRVQGDRPGQGDAALHAAGKLVRHQFHGAAQADGLKLHQDDVADHFFRQLGMHAQRKRDVLEDVEIGEQRPALEQHAELLAHVEQVAARKLRQVLPVDPDLPLRRTQLGGDQPQQRGLAATGRAHDAGHLSARDTHIDVVENRPRSALEGQALQLDRVGTIGAHQDSLRCDPSMLDALPRCKGTHPGGVEWARTIALRRVLAQGLAPCRSAWIQLVRSVLSAL

SEQ ID NO: 24859 - protein, 264 aa, Pseudomonas aeruginosa
ASRLPWRRPARSAGDPPRRPGHGGSQCRPVRAPACPWRHRGPRRRRRRPRVLRTDHARPGYARSRPGRLSVEPTMPKTLRQKLLLALIALLLIVAGYYWNVGLELFNEQPTRPGQDNTIDYYAENAHSLQYQEDGSLDYEMTAVKLEHQKATDITFVTTPDLLLFRGNVQPWHIQSARAEVGPKGKEVELIDDVRVARTDAKGQPSILTTTRLTVFPDKNYAQTEQAVKIDAANGVTTAVGMKAYLKDSRMHLLSNVRGQHEVR

SEQ ID NO: 24860 - protein, 412 aa, Pseudomonas aeruginosa
YPPPYFRSDCRPRQLHGLGPAFGPRTTDPRPGRQRRTGRQAGRRGLPRRRRGDPGQHQADRQHRDPEAGQERRHRGRDLGRQACLLRAETRSGQGRDQGLWPDHPVLRHAEPGRADRPGQGDPGRQHLRRREDRLRHPAPDRQRGSCHRLPGDQPAPAHRHGHPAEEKGPVMATLKAQHLAKSYKGRQVVRDVSMSIDSGQIVGLLGPNGAGKTTCFYMIVGLVQADQGVVRIDEQNVTHLPMHGRARAGIGYLPQEASIFRKLSVSDNIMAILETRSDLDRNGRKEALESLLQEFHIHHIRDNLGMSLSGGERRRVEIARALASAPKFILLDEPFAGVDPISVGDIKQIIHHLKAKGIGILITDHNVRETLDICETAYIVNDGQLIAEGDAESILANDLVKEVYLGHEFRL

SEQ ID NO: 24861 - protein, 503 aa, Pseudomonas aeruginosa
GTKPSAMKPSLVLKMGQQLTMTPQLQQAIRLLQLSTLDLQQEIQEALESNPMLERQEDGDDFDNSDPLADGAEQAASAPQESPLQESATPSVESLDDDQWSERIPSELPVDTAWEDIYQTSASSLPSNDDDEWDFTARTSSGESLHSHLLWQVNLAPMSDTDRMIAVTIIDSINNDGYLEESLEEILAAIDPELDVELDEVEVVLRRIQQLEPAGIGARNLRECLLLQLRQLPSTTPWLNEALRLVSDYLDLLGGRDYSQLMRRMKLKEDELRQVIELIQCLHPRPGSQIESSEAEYIVPDVIVRKDNERWLVELNQEAMPRLRVNATYAGMVRRADSSADNTFMRNQLQEARWFIKSLQSRNETLMKVATQIVEHQRGFLDYGEEAMKPLVLHDIAEAVGMHESTISRVTTQKYMHTPRGIFELKYFFSSHVSTAEGGECSSTAIRAIIKKLVAAENAKKPLSDSKIAGLLEAQGIQVARRTVAKYRESLGIAPSSERKRLV

SEQ ID NO: 24862 - protein, 162 aa, Pseudomonas aeruginosa
APADLPSPMIRLEQILTPGRSLVNVPGGSKKRVLEQIANLVARELPEFDAQTIFENLVAREKLGSTGFGNGIAIPHCRLSGCQSPISAVLHLDAPVDFDALDGAPVDLLFVLLVPEAATEEHLELLRQIAAMLDRADVRDRLRSAPTAEALYQIVVDVQNGQ

SEQ ID NO: 24863 - protein, 145 aa, Pseudomonas aeruginosa
PLICNSCDRLYRRAPSFGLPRRADWRCTQGFPEERADSPPRSQQLAHNKKDRLPKMPALEITIINKLGLHARAAAKFVGVAGRYPCQVRVGRNPESCVDGKSIMAVMMLAAGKGTNLHLHTEGEQEDEALNALVELINNRFDEGE

SEQ ID NO: 24864 - protein, 140 aa, Pseudomonas aeruginosa
ALPSDSEKAANWRLFLSGDCGRRQFSARRMNPLAQRGIQHHHQAETEHQAQRSLGGMSLAVGLGNDLVGDHEEHRSRRGGQPPGQEQRREADQPGAEHREQRLDQARRGTDQHRLETRHTDSGQHQRHHQTFRHILQSDA

SEQ ID NO: 24865 - protein, 332 aa, Pseudomonas aeruginosa
RRHDQREGRRREHHAGTEAQQRIRQARRHGLHHQHRHRPESGTEGAEQAAFQRQHDGRRQVELGQQQRVAAEQVAAADEDQQAQQVAQRPPVTFGDAMEQRLHRCTARLPASHLASRVTLGQGLRIATRDLPPVDHVVESADVFRAAVLVLQVIGVLPYVQAEDRRIAVHQRAVLVTAALHQQAALGSHAEPGPAAAEAGQRSLGERILERLEAPELLIDGPPQVAIGTATALGRHHGPEQRVVGMPTAIVDNRGAQLLRQTSQLPQQIFHRLLGIGRAFQRGVQVVHIGLVVLAVVDLHGQRIDVRFQGIVGVRQGRQGVGHGNSPSVIAK

SEQ ID NO: 24866 - protein, 832 aa, Pseudomonas aeruginosa
GGRSEELGSDLRVRRSLEQALGARIGTVFADERQQFDIGAPAVMLGRLAQGQRQLLVGADPQQALVAGAQVFCGLLRLLQLQVQVGQVVMGNHERHHRLVGVAPAFQQHLGQGQGMEVVLTRIDQCAGDETAVALFDRSLPMTHGGTSSGGAASEAASREFFRIQQHLQARTVQIGVFQRHIDDRPSLAIGLLGDFRSLLVADDRVQRSDQDRVARQRLAELALVDLEAGDGLVRQQPADVGQQLDAVQQVVRHQRQHHVQFEVARLASDGNGGVIADHLGGDHRGGLRDHRVDLAGHDRGAWLQRFQLDFAEPGKRPGVHPAQVVGQLHQGHGQGLQLAGRSDRGVLRTDQGEEVVAGAERQPGQVVQLLAETFGEPRMGVDPGAHRGAALCQLLQGRKYALDVHAGLSHLLRPATEHLAHAYRHRIHQVGAAGLHIGMHFAGLALDSLLQVAQRRQQAFADLEGGTDVDGRGNDVVAALPAVHMVVRIDLAAQATTGQGRHHFVGVHVGTGAGAGLEHIHREMLHEVLLQQLQAGLGDRLAHRCIQLLQGDVRPRRRGLGQQQGADEGLGHALAADREVVHRALGLGAIEGGRRDRQFAHAVAFDAGVSHLGFLVAGDRSSSTAPGPAWPFVRRAGAAGVAGCRWWSVAEVRRGAGRRSRGRGCASARAISDRDRYRAGGCRLSRTAARRPHLPNRRDSAPRRGTGRAGAVRRDRARSGSACPASTSDPMLAGRAPRRTWQPHQTIMRLIIVFFLAKDKHGPHRGGQLNRRKRKRQRRALAIYRGKPGLSARPPSSTRPVQNRYAGCRAVRCPCRPRRYGGTGRAGWRRW

SEQ ID NO: 24867 - protein, 229 aa, Pseudomonas aeruginosa
SARPAREGPEARRDRLPRHVDSSVDSPVDVAAHAAGPDKRPLTRYHGGVFHWTTTMAEFHDDDSQFEEKSKSQIKRELHALQDLGERLTTLQPQLLERLPLTDPLRKALLEAPKHKAHIARKRHIQYIGKLMRDQDVDAIVALIDQVDSSTRQYNERFHALERWRDQLIAGGDAALDAFVGEFPECDRQHLRGLVRHAQHEAAHNKPPAAARKVFKYIRELDETKRGLR

SEQ ID NO: 24868 - protein, 485 aa, Pseudomonas aeruginosa
VSPRRRPGHASGAGAADGDRIDLQGRLADADRHRLTVLPAGSHATVQGQVVADHGHPAHRFRTVADQGGAFHRGGDPAVLDQVGLAGGEHELAAGDIDLATAEVGAVDTLLHRGDDFLRIALAGQHVGVGHAWHRQVRVGLAAAVTGARHAHQAGVELVLHVALEHAVLDQHVAVARRAFVIHAQRAATPGQGAVVDDGAQARGDLFADPAAVGGAALAVEVALQAVADRFVEQDPGPTRAHHHRQGAGRRGNRLEVHQCLAQGLAGVAHGAIPLEEIAIVGATAAAVAAAFASAVLFDDHADVETHQRTNVGGQRTVDGRYQDLLPDAGHAHRDLLDAGIERTGSGVDLLQQLDLLGTAEHVQRVLAGVQASRHHGLERLHAAVLSRTGNRTGRHRGLFQRLGGDRIAIGEAGLLARLRAYPDALVEIEAAFLDDAVLEHPRLGDLALEIQVGGIDARAVQFMKNAGQAVQFQTTGGQQLLADG

SEQ ID NO: 24869 - protein, 1218 aa, Pseudomonas aeruginosa
RATRSPCSSISSEQAFAFASGCPSGGSGNVPATIHNLRSRAAEFNHGRIGPFPRASARPSSARSRRPMAAKFSGSTASRAPPSAACSSRRRAAARLAVTSSWLTIWITAMDMVSSLRTKAPRRGTGRRSAGLLEWLVEADLRILPGALDAVLHAGEARDPVAEQLVDDEDRAADRRTADYQCRQGQVVGQWQGHQQLGVDPIVSQVQGTVQLQVARRSFQLQRLAGDVDAVGGGENPLHPVIAQSLAEDVREIQAQPAVDRVEIEQAKHSQRLGAALDLDELPLAQRCIHAAAEALQGHVGRRSRPLAVDIHAETFAGGTRREIPGLEHIRQVLALDPALIGAAGIARTAVPTQAAVDVQATQVEVQVVERHAVAARPYLQAPGAQRLAAEGDLADLHVYRRQAARIDGGQRVRVLHLVLVGKGRLRQVQAVQIDHDRRAPGIRQDQAPRCEVADQHQLPGPLLAGQVDGQVLQLLAEALEAVDAQVGAAQQARSATGGLVAAAVALQGGLPGVPVQFRQTPAHPQPLCRGQQRRVTAQAQGAASVQRLVRRGRIGQAGEAVVTRPVTPFGAIQGHPPLGRPRLGGRLAERRRQVDDGALEIRIDLQLAVLAIQQQVELERQASRDRQRTLASAEPVAQRLDRHLAVEQQARARIAAPLGDDPPAYLAAQHPGLHRRGAQSLGQVETEVALHFAHIQLRTGHLQGRAHGGEIHDHPGLAGLVVVQRNIQLQVALQGPIALPAGEDLAGRDRRFLEQLDAVLQVTVDGPIHIQVRRLSRTAEGNVDLDVADPGIQQIPAGGQHADSGILDEHLADRFAQGGPAGLVGQLAVADLEVEVHDVGFGRRAAIQRALPLEVALLDMATADRRLQPVRQAFVHSRQLGRQVLGGEARVAVAEADLQVHVVFSAGIAHQADQHVAGQAALLALDPHQVAAEGEGAVVQAPEHPRASLAVAPRLGKHLGQVQHEILRRCVELASSQGAGQGAADIFHCRNLMERRDTDLFQVGRVADPLGHLSLRPEIGVQVVQDALRLQARHPLRRRVRQRRQRFYRRHQGRQVDAVGLQLPVWLVVLLVATQQQLHLAPALLAEIRRQVADPNLPALRFAIEEQVHAQVVDFHRLARGIRRLQLRRQQPCHQPLRLAVAPVEPEVSAGLGPDDLPFLGQTSRQPLRPVALRQAEIEPGAAARPVLAVDPPFGVQRQRLAIRQLQAGIETLPTNR

SEQ ID NO: 24870 - protein, 266 aa, Pseudomonas aeruginosa
  UNSURE (211): Identity of amino acid at the above locations are unknown.
AAGASFGKGDSSIAVASTDSGTPIWVSSSRRRGEAEARYSDGMEAPGKRVGRCADHPFRRMTYPPQHSCEADLPHVETQADELQQGVHPGPEQRADQGRKQEGQGRRAIAGQGVEPELEQLRQAVDHHQHQALLPCREHAQALVQGQHEEGDQAEDQRVLPEQVAVEHILGQAEQPGGDHPDALGQQQHPVGQQHRQPQRAADLGEGRHRXYGQHQPDQQAQPDHPDIVRTLGRASHQRRPPLAAGAAGCVGAGEGAAAGCCAAPW

SEQ ID NO: 24871 - protein, 119 aa, Pseudomonas aeruginosa
TPPSVNPGKASREFSTVQKQVSDGPGLHPGRKQDGRACPNNPFCPPRAQEAGTEELSFLPELRLLSEVVQGFAPPGTPFVTASADKPGSRPLTCRGFRRAEDPKSGAALFIVTGRGASH

SEQ ID NO: 24872 - protein, 71 aa, Pseudomonas aeruginosa
QLPEIIERILSPLKEILDSFKCTLKEVCCSLNKLLNRTKNTVHISPHADKNTRTDSSAQNARNTAFKIGSI

SEQ ID NO: 24873 - protein, 142 aa, Pseudomonas aeruginosa
VGQLPPVGNVILARACPIGAFLISVQAFCSDSSKPGTLSLPNGLFFTNAQLSSLQPPCKPVPPPVPPPSPEPSPPPPVPPPSPPVPGVPPPSPPPPVPPSPPPSPPPPVPPSPPPSPPPPVPPSPPGPPEPSDFTHVVPDQL

SEQ ID NO: 24874 - protein, 68 aa, Pseudomonas aeruginosa
IQRRVRREGIAMRAERDDDFPPVRRATERRLAYEIALGIWLGGMALGLTSFVLWFFALSAMVGALKLG

SEQ ID NO: 24875 - protein, 162 aa, Pseudomonas aeruginosa
PMPSQHGDATMIDPADKQTQALPLEQPKRGRGRPATGKALSDAERARRYRANKKNRDAQSSRKEAPSIPADGVNEILDGWQRTQEELDQALQRIAELEAELASRVTKKEEAEAKTWAIQERKGKARWQTISKGLTRKAGERQFDKLLSGLTDPRYTYRMIEE

SEQ ID NO: 24876 - protein, 80 aa, Pseudomonas aeruginosa
QRNTCKNNDHPLLQVTVMSKPYRVRDKFVEEVKERRVKMIIETKDDVRESDLVNATLWKYLSKITTKDVLEFREEFGGKE

SEQ ID NO: 24877 - protein, 138 aa, Pseudomonas aeruginosa
SSASRKTAEVCGKLGVLQHPHPSSVIPVTHHANSAQSKACLRRPGLHPGRKQDRRALPYNPLLPPRAQEAGTEELSLPPELRLLSEVVQGFAPPGTPFVTASADKPGSRPLTCRGFRRAEDPKSGAALFIVTGRGASH

SEQ ID NO: 24878 - protein, 431 aa, Pseudomonas aeruginosa
KYISGHQPQVTRARCMPIELRQLQHVAGDDFLSTTNHHDRMTGHVVGLGDVDADPVQARPVGLIHAFLEVETDARAVHPFHRNIGGRISRLSAAYNPFRKQPFRNRLVIHRHHLELVESPQKLPMDRRKAAFIKKPPPLQPLTGQIFTLEFLLHAHDALLIAVRGQIEQVAEFGGVFAKVPFALRKQELADGLSLAVGLVIVVAGLPVAGPTIFVEVAVLVAHTLSTQGADVGQFIALPHRPIRRQVNPAQARTVADHPSFRAVLGLEVAPISASRERRQTVALGVLDLMKDVVIDRDALSNGLESMQVVQTVDCTRIPFNAELVPIDPNPNRRRVTALNLEARRRVAQLLAGLPVVVADASVANLRELVRECLLYREVVVEHPALMIGRRKHPYPCMPVTTLHVTYGAIYTAVTRNSATRARITTTPCYR

SEQ ID NO: 24879 - protein, 162 aa, Pseudomonas aeruginosa
IRCSNRAATPAPGLRDGSSFTSITGPAGDHVCACSALEKETMKILKGYVLGVVDKGEGDKRWAIVGIKATDKDRDGFDVDTTYKLRVFGDAVKNGLHNAYRNLAGVEVYAPYNDEFDEKYKRISYSLAGAPLALMEKPLGTAQAKPAAPAQPQAAQPVKQAS

SEQ ID NO: 24880 - protein, 120 aa, Pseudomonas aeruginosa
YMDGILSAIKQLIQTATDFFQRALKAIEDFFKWAQDAFDYFWELLPVLPEYVFHRLVSGIVKFFQWLPVPEFFTQAGNAFQAIPPSVVYFANAFQIGPGVTMVLGAYLLRFILRRIPIIG

SEQ ID NO: 24881 - protein, 398 aa, Pseudomonas aeruginosa
RCYRHAGVGMFPPTDHQSRMFYDYLTVEQAFPYQLPQVGDTGICYYDRKTGEQLRDTSPSFKVEGSHSTSIRVRVDGNKLRVEGNPSAVNRLDNLHGFQSIAECVAVYNDILHEIKDAKGNRLPPFTACTDWGHLQTEDGSKTRMIGNGARLRRVDLTTNRTVGKGNELAYIRALSTQRVGYKNGHLYEDGWTCDWQARDHYYKAYGKAQAIRKFLFPKCKRNFGEDSPEFRYLLDLAAYCDQQGVVRMEQELKSEYLARERLEWWGLFDEGRFAAIHGEFLRGFDKLEVMAMDYETIAERLLSEGVVGSTQAANATANIAMKWMHCPGISFDFKKRMNQTYRARLNRIGINIAQPYDVTRHSVVMIRRAEEIVTSDVLELPEFYRHAPRPRHLRLVA

SEQ ID NO: 24882 - protein, 83 aa, Pseudomonas aeruginosa
KSLRSKSMKNLKKLFVRGGSAVAVGAALVVSQSASAAGWDYSSLTSDVDFSTIATGVLAVAALLAAVYAGIKGARVVLGFLRS

SEQ ID NO: 24883 - protein, 464 aa, Pseudomonas aeruginosa
SRRVVGWGGFGRPFLFLAGEFDRWRIYMSSRSLLLALRVPGRSFRGGKMFRMLVLFMVFFCCSSASADAFWWQVNGIDSLRDKSFASPGEGCSAVLAYFQSQGSGYSFSFNYLRRNSDVEFSCSLKRLDQGEFVGEVGASIGRYGDACPIDTRYDDQTGECKPESKQCEAGQTDLFASAPSPVVQISGRNQVLSTPPTGCKGGCAYTPSSSKTRSCYFVPGSQTDGFCNYLLTSDGNSCAADSGNPGAVGPPLNPTPPTDPDEPPSDPNDPGCPTGYSWSGTTCVKSDGSGGPGGDGGTGGGGDGGGDGGTGGGGDGGGDGGTGGGGDGGGTPGTGGDGGGTGGGGDGSGEGGGTGGGTGLQGGCKDDSCAFVKNNPFGKDKVPGFDESLQKAWTDIKNAPIGQALAKITFPTGGSCPTQSVELFGKSVMFSSHCDLWAQIEPILKAVFLAFWALLSVRVFLSA

SEQ ID NO: 24884 - protein, 106 aa, Pseudomonas aeruginosa
RARPDSRSSRVARRCCNSDSRPGRVGSLMSAYSLQGVSLSSSERRSLQLRQQARAAVDRSVLQQTVAQALQALEKHKEEGGKASNPWITVINEKGTPWVGDAFGWS

SEQ ID NO: 24885 - protein, 79 aa, Pseudomonas aeruginosa
AGFLMISALSCDGSISIAPDGAPLCSGMWVLTHVPEQFDPSMLDTEALAQAFSVGFGLVATVLVGALGVKAVLDFIKRA

SEQ ID NO: 24886 - protein, 422 aa, Pseudomonas aeruginosa
CMAIDAYVGKPGHGKSYGVVEHVIIPSLKQDRHVVTNIPLEVDMLLMDFGGTIEQLPEDWFEREDLADFAPPGSVLVLDELWRRWPKGQKTNDAPMADKKLLAEHRHRVDKKNRSMRVVMVTQDLDQLASWATLLVETTYRMVKKSKTMFRVDIYNGVAKGDSPPKSKLLRSTAGRFKPDVYRYYKSATQSETGAVGDESKADTRGSFWRSWGFWGLVGLIVVCLSVGIPGVVRFFTPPQPKQASAPTPAAKVVEQVQPVAAPAGRAMQAVYGTSSNGPVPSAIWRIAGYVHAGLGRAEAWPSKDGYNVEPDRPISKTSRVVLVSEGGRTRFWPIEKCRFFEQTPDLYCDIDGERVTFWTGRGAVSTVMDATSTASGGSQRSAASAATGAQVQTPHSFQPQQPSQGTRVTVVSDNSRSPRTL

SEQ ID NO: 24887 - protein, 162 aa, Pseudomonas aeruginosa
LRTGDLHVTSVMRCRSGFFVTVTENPCFRSGRAYDSNIRYGNGNSKMAKDTRDTQTLDAFPAKPSRGRPRKADALSNAERQRLYRQRQAGKAPQVDADALVRLQNEFDRHVDNARALVAHLRKTIAQMELEVDLCRQERSDAMRVNSIYRERLELAGLPTDY

SEQ ID NO: 24888 - protein, 176 aa, Pseudomonas aeruginosa
TAPYGERPPHTRPVRRFAMPSRLSLIAALLLPLAVQAEPADTRALLADSLADSQAQVEAAEQAMRRSENKAVQLYAKRVLTEQQEFDHQLRALAGEKALALPSPRQTERQAAAPGGFDERGFLDAQIRQQDRLVARFEGIARDSADPDLRRFADEWLARFYHHRELADQLRSGRAD

SEQ ID NO: 24889 - protein, 480 aa, Pseudomonas aeruginosa
ELAVGESAADDQQGVAMLHQHAAGAGAEQADGAGHVRQVVGNRRLAQERLGHSGGQALGDRFQLPVRAQGAGTGEDRHAPAAIEDRRGGLQVGVARVGSRLDEAHRRHHVAVLVGLALRGRHLLHVVGHDHRRHLPLADRHAQGSVQHMEQLCRADHGLDIGGNVLEQALQIDFLLVVAAQRGSRLLADDGQHRLMIHARVVEPVQQVDRARPRGGEAHPDLSGELGVGAGHEGRHLLVAHADIVECLGAPAHGAHDPVDAIAWVAEDALHPPLAQAFEQLIGNRAGHSRLLVVSGVVPVRTGAAGQGFQGNRPAVPTAKSTELSDSRPGPGTGPRMGPSPGGCRHDPRHQDSGKRRPRVPAGKPNADPPARRCRRPKRPDKALPGPRPRNASGACERYLAFCTESSREQRQHAGECADICRLAALLLERRSPWAPAACELAARYALACAERCDGDEPLERECAGACRRFVEACRPLLPA

SEQ ID NO: 24890 - protein, 185 aa, Pseudomonas aeruginosa
TDRDVVLDDTMRTDKHIVADSDVTQYTREGPDLDAAPYGGVTLTGGISRYASCPQYHTSEDVTVITDYRCLANDRAMPMVQDESTANLASWVDFRARQELSTRGDQERGSLQRSLRIAFRCASQTQHVGKPVVQHCLERAVAKRNVGCPSLCGWILAGECLQVFLAPTSGFFEHRMSDYPLHQLG

SEQ ID NO: 24891 - protein, 102 aa, Pseudomonas aeruginosa
GLAQADEGLHRLGCLQQANHSRQHTNNSPCVTAWSHLRRGIVREETLVAGASLQIEDADLTFEPIDRAKDEWFSELGANRVDQVTCGEVVGAIQYQVIALNQ

SEQ ID NO: 24892 - protein, 136 aa, Pseudomonas aeruginosa
RCNRTATPCSPARCARRRLSSRSSSSSPTCTSSGGSPARSACSGDKAAEPGSASAGSSRRTALSSQARDSSGSPAAGVCRRWQPRSVQGENSSNPAGNGKPRAFSSRARDSARWPPAESPASSSRRGEWPASSNAR

SEQ ID NO: 24893 - protein, 609 aa, Pseudomonas aeruginosa
STRRRASTPRGRNHSQGTPARLRRSRTTPPAPSVARLSPRNTPRCSATGMGGRTSPRNNRRRQPRRRPARRRCGGDIRGASAGQVIVGKLRPARTPAIDEGVARPVVGVLAGGSLVPAVAATLPDGMAQPLLHLQVEAPLDLGLHVEVAQALLLELAQAAEHVGELAFQHVDDGVVAEVGVRPVKDEQVGEAADADALVGFRAIRPGLPQVASVEAEDAHRGEELGGGEAGTEDDRVDLVPAAVTADHGVFGDFANARVDQFDIAPGQRRVIVVADQDALATQRVVGNQPRAQLRIGDLPVQVTMEAQPHHLHQRREGREGEHPRFVVQVLEPPIQALQPRPARLQAAFPVGVGAVRLGDHVRRAALEQRQALHLRGDPRDELDGAGLRCRSPRPACRPARPRRPSSPSGTPDPGSAPGRAGAAAAAGSTGRWRRPGPVRAASGHRRSAPAIRRCRRRNGPPPPRSGNGSSRADGTCPRNAAGSRGFPPAGRTCATSRPSARRKTNRDARGRRRRRPGSGFPASNRRHRRPFPGPDNRRCLPVAGGSPSRDRRSRRRPPAPARGLQGGTRCALLCSRLLLATPSGAIPPSGGWQHPSSPGRLALWPGRT

SEQ ID NO: 24894 - protein, 355 aa, Pseudomonas aeruginosa
SCDFRSTSDATMPTPPWSPRRSAISAHLLIQFGIDRGLGLEQCLAGSGLDIRLLGDPSGEIDAAQELSVVRNLVRHLGDACAPGLAAGLRYHLNAYGIWGFALLSSPTFLSAAQLGLRYLDLTFAFHGIRLEVHDDEAHLVLDDAGIPEDLRIFLLERDAGGVLRIQRDLTGQRLPILRAGFRRPPPADPAPYVRELGLCPAFGQADNRVVFERRFLDLPLPGANPEVARACEEQCRALLARRQVRGGLAGRIRDRLLRTPGHLPDMQTLAMELHLTVRTLRRRLDDEGSSYRLLLDEVRQALAEELLATGAIRLEEIAERLGYGEVSNFSHAFRRWKGMTPRQYRQRRRLDAMS

SEQ ID NO: 24895 - protein, 425 aa, Pseudomonas aeruginosa
GRKASATQARERSWTSSQPLAQASSPACIGPCSSRPPASNSRLRRAATASWRPSPVVSRALPRRVTRRIAPRSSASSRLPLAQSTRPAAQSRAKAPRGSSFTSRRIAPRRSSRRRWAPSSSGRALLRAFRRRRLPSASNQSRRSPVPVASSPGRPMPAWTQRSRPAPPASRTNSPRAPPTKRRRLDGCSRARSTVALGWPRQGESCSGARLPSSCRNTSACSLDSAFQRSRASPSAALKSPDCRRTIHSMASSTMRCRSGFSLIPGIPGSSSARHPSSTGGCAPGTIRGVRRSARRSGLPAGSSGTLPWPARTGRRAGGRWLAGSRSASTAREATAAPPPAPRRGSAGRRAPGPCAASSRTSGVARWSRGTPAASGSTPGRGASRPAGRPRRRGLRRCGYSRSGRTASCTASRSSAGTTGRSGCS

SEQ ID NO: 24896 - protein, 158 aa, Pseudomonas aeruginosa
TVNWPVICNSDARWANGTRPRASARSCSAGAMPGAPRMAGSRRRSSGRPSNATPASSRNRLRQPQNSPIRVPSGTPSTSEATMPANTRPIARPRRSGATMATARVIATTTMTEALAATSSRLASNRAKLGAAALARLAPMNASSAPASRRRRSIPALR

SEQ ID NO: 24897 - protein, 360 aa, Pseudomonas aeruginosa
TSAYRLISNPARPWLTAKLAASSSSTPATTSSTVPTTKASPASSQTPTSALLRSVSPMAACLPVDGVAIAPEHDQQPCRHAERAEQDQRRARVGARAVVEVTQQPGPQADGDGEGEGLDRAIDHAEMAQAEVAADEVLGGAGLAAGAQADQEHRAPEQRRRSAKEQEQQPERRQQGERQGDARGVVAVQQVAQRRLRNDHADPQRRQHVGGDFPRQAALLQQRHAMHHHASDGEHAEDQVADDQPEVRRAPGLAWRRSGQRVGWRAPRLRQVAGSLAEQRIEQRQRQEAFEQAIDEEGGAPAEGVDAGAAQVQRQRPADAEAESEDAVGRAATTLEPAAENPRIGNVARRQQAEQREQQV

SEQ ID NO: 24898 - protein, 281 aa, Pseudomonas aeruginosa
TVRSAPGRGRTPPARLRRAGRRSPADRRISARWSPPSPPGLHADGARRRRRTSPRAPRTPAVARASPAPPDRVRRRSSERLPVAGEKPQQVLQHGVRHVLGKHVAGADGGALDLPGPGLPDFQRMLPGGVGALLPEHLDRALQAPAGVAIGLVGVGIDAHRGPVVLAHRMAHGGVAERPAVTFQRLRVVDVAALGHASQGVVEEVLRIGADQALRQVVRLGEEEPVIGVEGEGLVHRGPVVEDRHHGQRDEGRDRLRMVQRQAIADPRAAVVADHREAFEA

SEQ ID NO: 24899 - protein, 335 aa, Pseudomonas aeruginosa
CRPHGGSASGPGSAGRPGRRSGSPRHAGWAAACPVREPGGPARRPPVRTAASGRRRAGGRPARAAAPGNVGRGWPGNRSCAAPGSPAAGARAGPGAAGSCFPRRRSSAPRAGSIRTPPGGGRRTARALPGRPPCSSGPCVRASPAASGSAPGRRPRAGVAGRHPRHPAAALRRGPRGSAPGCIPAPPPVRRPPAAAVARARSCRPARGSRRVRGRSGRGRTGSRRTPRRPTRPTVPPWCARGPGGTAGRARRPARPSRAGRGPGAPPRPVPAPLPGRPARYGAAYRGSSPPAAHRVRPSCFARASGRSRGLRRGSPRRRSAGAARRHPARPPRRH

SEQ ID NO: 24900 - protein, 179 aa, Pseudomonas aeruginosa
SPRFPAGAAGAGRRMARGRPSPPGPGCSSARPAAGDGECADRWRPGTCAIPIRMNSYLRILCEQIAMRPCISHENSPKSRSLSFAGLPEKNNDFAPVLGHQSRPRPEHADLARRHAVPAGMGGAAGRAVPGQRRPDHPFAAYRRPRRRPPALPRRRPAHRPGAAGHLHGTVPGDPLYRR

SEQ ID NO: 24901 - protein, 831 aa, Pseudomonas aeruginosa
PGATAGGDRRGYRGGDAQPCQLQDRLPARHARGHPPGPRKRRPGDLGPGPLGRRAAAGPARGRRRLRHRLHLQVPQRRPRLAGLRVGRAAPARACLATAVRLVRSFPPVRHGAALPARRRHHPVPLRHPADHLAGPGRMRPGYLRPDRHAAPARQVAGPRRSVHRIGGKPLRTLRPGPGDPARACPARQPCQLRACPGLRHRPGPDRPGGNRRLPRAGHPALRLHPAVHPLRRGLGCGAGVAGNPPERSLERAALPGPAQGDLSPARADRAGIPGAAREHPPLSRTGARDRHPHIATDVPSAIHKNPNKIPEDIQMNDPQGFEAISRREQGLQRRLSAAQMSMIAIGGAIGTGLFMGSAFAIGFAGPSVLLSYAIGALITLLLMGCLAEMTVAHATPGSFGAFAEHYVGPLAGFLVRYAYWAAIVLAVGTEVTAVAMYMKYWFAGIPEWVWIISFSTLLIGLNASSVKAFGNFEYCFSTLKIAAIVAFILLGAYLVFGSANPAYGVHNYSAHGGFFPHGLKGMWIAVVVSIFSYLSVEMIAVAARPEGRASGTGGEVGVPLDHRAPGGVLPADPGADARHRPLGPGRAEPEPVRHGDAGDRPARRHRGDELRGAGGRAVGDEQPALHHHPDDVQPVARGARAEGPRRTEPPGRAAERAAAVERRYRPGDPAQPGLPRAVLHPDDGGVDVRRPLHLADDLLHPPLLPPPPRPPRRRAAGLPHAPGALVDIARPGADGGDPGHHLLHRGVPHDPGLRRAVPRAAQRTLPGLRPQARQGLSDRTGNALGALRPANLARTAKPDRRALSGPGGSVSHTFSVAQKALPAGRRDSVA

SEQ ID NO: 24902 - protein, 636 aa, Pseudomonas aeruginosa
GEHDASDLFAGPAGRRTGRRRQPCRRHRNPARARLERRATRLLVRRLARFAAAAAGLGPGAGASGQRGAPVLRRQRPAPRLSPAQLARRRTAPAARLRPRPAGRQPVLRHPPALESPPVVQRTLGRAELRRLPLHRHQLPRQRTDRRRRRHPGQRPGDLRRSARRAAPHQRRRRQVRALRRQRPRQRGQPGQPRAAEGRPGQTRGADRHPAEHVRDRPATRPGAPRRHRPVTQPRGNQLRRPPSASEPDRRADQLPGTVAHVADGQAAIQRIRAQRQGPRPQRPGLRPRLPGRRHRRGPGRLRRRGQPSAVRPGGLYIEHPRGQPDPCRGPDPQAQGAGLAEPAVRRPGQRQAGPGQAPLRGELRGLPCEHRPRRPANPDQGPPGAPEGPWRRRADRHRPVDGLQHLHLQQPQRQLLRPVPTVPRHPQRRRHRRADFEDRRHAGPRGVPDHARQERPAGRRHRRDHPRHRHRAADPARLRQPASGARRTIAAGRRRPCRQPGAEPRRRRSPHRQECAQGLLPEYRASIPRLHRSPAERHLGHRTLPAQRFGAVAVRPAAAPGATAGHLLHRQPRVRSEPGRLPHRARPGQRLPFRHPPGRQLQRRPRLRPRVRRKPAPGAARIPQDPVSRPRPHAQ

SEQ ID NO: 24903 - protein, 690 aa, Pseudomonas aeruginosa
  UNSURE (140),(161): Identity of amino acid at the above locations are unknown.
REPPDDPIATQPCHPFRPRRCPGIRRRQRRRPRPGLEPDPEDRLAGSRPGLADAAAGLAGGAGAARQRRTADVRCADPPVRLCPAHPRRFQREGGAGLRGRPQRRQRPDLHQAALESPAGLQGTLGRTDLQHVPHFAHQXPGHPADRLRRADHGRPRRLPXGDPRRPAEHPRRHRQVRALRPQGARRRRPGQRLQRCQQGTPAGSPGRHHRAPARRLALQPAARSRVRPGPPGRHRFDLQLGGLRTACQRADLRRRGRPRELSVPVERTAAGPRTVDRLQPEPHQRGRDRQPQVRRRRPGAQRRRGGRGIRRRQGAQPDPVGAAHRLPVEHQRRQPDPHRRPARPTEAAGLAEPAVRRPGADQGRRGPRAVPATLLQLPHAAGPQRPADPGEDRAHPPAGARRGRADRHRPVDRLQQHRPAEDRLRARQALPVLRRHRPARFLRQAGLCGGRAPGSGGPGPGRARPERRPGCLPDRRPGHLRRAVAAADQSGAGQPRRRQRRSDRRGRARRPAPGRKRRGRQRQGPAPGAVPGDDQRPDGLQGAPAERYLGQPALPAQRLGGDPLRPAAAAGPEAADLLYRQRRVRPGQRRLHHRCRRRQPLPLRQRQAGQRQWRPRLRQRAVQRAAAPRPGRVHEDPLKPLARPALPAASLNRRRPAARSRRSIRTGCRWHEAAKSATPPAPPAGGSLR

SEQ ID NO: 24904 - protein, 591 aa, Pseudomonas aeruginosa
NLQDFSYKAIGLVQVTSPIAPGTLARYTFQAPTGSPGLMLLRTISVETAEQTELNAALLCGFAIPASDRNFIAYSLNEQVDENDSRVYIASLFKTDDGFRLGRLDTDEACEAAIQVFRQLVREATTGNRRTSDLAYHLIDLQDAAIAHSRREEHRSLVLEREWVMKLVTFESPHGYGPALDGEEPCAEVPPLVQEALFEDAAPDVLAEDDADETTDGPAEPIDEPEAAEDETVTEAGCVEPEPRPEAETAAPEGGAPAEFAAKAEQSAKVADAEAIGAFVDNASHLREELADLAQMLHPALHAADATGSANLPSPDAAEESSMPPSPSPLAAPAPEPVSARVPSLSLRLRVPPARLAGAEGGANAREAPTQAAAIIRQPEDEAHVDTDTALDIGNDTEHLLQDVQGTLADLAGMAQQLSQQKQEALKQQESLESLQTQLHEKERQLQEKEKQLRQWHKRLQDDRQALERETEQSNRLLAERSAALQQLAESVEARERSSARRAEVLQIEQERLEELRSQQNLRQAELEKREASVQQRSLELGERFKKLESAREKLAQIVKGFNETVQFNTALHAISHTGLKRQEESAAELE

SEQ ID NO: 24905 - protein, 672 aa, Pseudomonas aeruginosa
PNISPSGTSARITFARRGILHALDQATPAVEVAHHVAHVVLRGHHLDLHHRLQEHRSALLRELLGGHRGGDLERHLAGVDVMVGAVVHRRLQADQRVAGEHAVLHLVLDALLDRRDELSGNHPADHLVVELQAFLPLVGRSEADPAMAELAAAAGLADELALDLAGVADGLAIGHLRLADIGFDAELAAHAVDDDVQVQLAHPGNDGLRGLLVGLHAERRVFLGQLAQGDAHLLLVGLGLRFHRHRDHRIGEVHAFEDDRLVDGAQGVAGGHVLHADQRGDVAGAHFLDLVALVGVHLHHPPDPLLLAFHRVEHRIAGSQHPGIHTGEGQGADEGVGGDLERQRRERLVVVRMALVVLLFVVRVGTPDRRDFRWSREIVDHRVEHQRHALVLERGAEHRRYDLVGQGPLAHPGLDLLDAQFLAFQILVHQFVVGLGGGLDHVRPPLLGQRPQLRRDLLLAVAGALVVIVPVDGLHLHQVDLPAEVFLRADRQLDRHRDMAQALLDLRDHAEEIGALAVHLVHVGQARHMVLVGLAPDRLGLRLDPVGAAEHHHRAIEHAQRALHLDGEVDVAGGVDDVEAIAVRELLGRALPEGRGRRRGDGDAALLLLDHPVHGRRAVMDLAHLVVDAGVEEDPLGRRGLAGVDVGDDADVAIKLDGSGASHDLPLGCCPG

SEQ ID NO: 24906 - protein, 161 aa, Pseudomonas aeruginosa
FRATASAGRACGATSTWCRKPRRPRCSAAPPASWPTSTTSAWSTSGRATTTLPRSAQGPSPACRSIPAPPSIPATASLPDPAASSSTRAGRWRSTGDRACSGRACNPRRTPASACCSASTASSPAGTTISAPRTTRTRWSTISTAATSMIAPPPSASPTGR

SEQ ID NO: 24907 - protein, 187 aa, Pseudomonas aeruginosa
RRSTPNSTCRCWTAWNSARRSATTSTATSAAPATRNIRSASSRSASWSCAAPTAKVSVRRRCTNCTTRPSPPIPAPTTTTRACAPAASRARAASPTATAPSSSTTPPAAIPTCDRKPRATLPWAWSTSRCATFPSAWTSGGSGSPTRSPSFPKRRSSPTRRPTPDASCARPTALSITSSPDWPTSAR

SEQ ID NO: 24908 - protein, 560 aa, Pseudomonas aeruginosa
RTCSTANRRSATRPTPSRAATTRATPIPTGASCSAASATASDAGAGARPVWPASPSTAVQLPDPVALPDFAGDQIWQVVGLPVPCNLLRLSPPTRSRKRTPHDHSRDHQQRPVRRLPGARRRDRRRRQRGALHPPEGPQGLAEPLHRLCARRGRHRPGRHRPHRLRLERRVRRRAAPRPLPGPGPRGSPRASRGPAAPAQADRRRDGQRQGQARRIRCLRPRQRAARQGPVLRPSRMPRPRRVRLLAVRRGADPHLRRPRRLPVAHRHPLPRRRRRGGPATRDQRRQPGLLLRAHHPPARLQAEPPRRQDHRPGGVRRRGKAAAADERHDPPGERPPARPLRRTVPALLRRLQRSAAATLRGGTPGGCRRRRATALRRPAGGHRPGARGAHRLRQPVPGRRGVRQRQAEPAPARDPRGPRCLRAALHGRRRPGPGRGGGGGLSRERYALPGAEHGPRAGRAQRRAECRDDRQPVPATGLQPAGQPDRDAGRSAAGKPGAGHVQGPHGVRPSRLVQPQHRLPSRRCQRQRLAQSAHGTHRVHAIRPGHRGRTRRGLLRWLA

SEQ ID NO: 24909 - protein, 255 aa, Pseudomonas aeruginosa
  UNSURE (131): Identity of amino acid at the above locations are unknown.
SWRCSPSAARSWSGLPYRVPEMHRLAFSAVLFDMDGVLISSREAIAAAWSRVAGEQGVALGPDCLRDHVHGRPGGYTLDYLFGHLPMERRRILKQRVDALEEGADCPLLPGVAAVIRQLRWLDVPLALVTXSWPARIYHVLRQHDLHAAFRTLVSRDDVVHGKPAPDGYRLAAARLGVAPSRCLVFEDSLSGVQAACAAGATCVAIGEESGLLAAGARWSVRDFRELRIVREDDRLYCQHRHPATTGSERSVGVP

SEQ ID NO: 24910 - protein, 658 aa, Pseudomonas aeruginosa
SSPQLADRRAPLGCPHRRTALAGPRPPGCAGSRSPSCHLRGNQRMHRTSRRTFVKGLAATGLLGGLGLWRAPAWALAGAGQQNLLAGDSFDLFIGETPVNLSGSPATAMTINGSLPGPTLRWREGDNVTLRVRNRLAEDTSIHWHGIILPANMDGVPGLSFEGIAPGGLYEYRFKVRQNGTYWYHSHSGLQEQAGVYGALVIDAREPEPFSYDRDYVVLLSDWSDEKPQRILAKLKKQSDYYNFHKRTVGDFIDDVSANGWAATLADRKMWAEMKMSPTDLADVSGYTYTYLLNGQPPDGNWTGLFRPGEKLRLRFVNASAMSYFDVRIPGLKMTVVAADGQHVEPVSVDELRIAVAETYDVIVEPGGERAYTLFAQSMDRSGYARGTLALAEGLSAPVPTPDPRPLIGMDDMGMGGMDHGAMGHGAATRPASEMDHSKMSGMDMKGMDHSKMAGMDMNGMDHSKMAGMDHSRMGMGAMPMQSHPASEDGNPLVDMQTMTPTPKLADPGLGLRDNGRRVLTYADLRSRFADPDGREPGRTIELHLTGHMEKFAWSFDGIKFSDAEPLRLTYGERLRIVLVNDTMMTHPIHLHGMWSDLEDEQGNFLVRKHTIDMPPGTRRSYRVTADALGRWAYHCHLLFHMEMGMFREVRVDEGDNA

SEQ ID NO: 24911 - protein, 455 aa, Pseudomonas aeruginosa
PGTAPTATAPTWPAPRARTTTRRASSPVSACGSERDRGQPLAVAVEQRRIVDEVAAFQRWQVARPVVGAFVQPPLHRTVQLDPGFLPDRFQRPRARPATRPAPGAVAAAAVPDQQRQPLGQAPGPGHHRQDRRGRVRALLRTCAQLVAAARRVDMQAGLQRLAEHPGKGHQSQPRVLRRIATADIGVHAGEPHLQHVGLAVLLAEPEVLPEEAAAFVDGQGLADHVDHFVVRGIRHGQRVVDPAHRGHGVEQAEEVHLHLPAEDLAEASQQAEVRSAATRAGPLVFVAGRHAGGEQGPGVVEEVRLVRIDQAHRAQHRGQHAHRVGPAGKAEEEYLVAGPVVLGEEAIGALDVALEPPAEGQAGDPRGKLLPLEQGFLQAEGADALVVVGQHSARIARQRAVQAHHVGRLVAEAVRGSVDADHQLARRVVVLGAAGRRQGGIGGEIVHWAHAGKA

SEQ ID NO: 24912 - protein, 218 aa, Pseudomonas aeruginosa
GRPPPRRRRPRGCSDRGSGARCGQRWRHRDRGREARGTAPAAPSCRPRCWTPPGWTPVPGGQRPGCRRSGSGYARCVRRRCRSGASRRSAPAPPADAAGVRRCACPPPRKARRRGRRPRPYRRSGGSPGSRNAGPARVRRRGSAPSAAARRAARRTTRRCPWARRSCVRRTTSSPPPGGPGRSPPCRWPAPRRRGTARRARAPVRRWRRCRSGCRVRC

SEQ ID NO: 24913 - protein, 383 aa, Pseudomonas aeruginosa
ATLRFSTRNSSRFISCPRIEGVAHRFADEHQQAEQGRQDHEHGQPEPGRLEVVTALPDQFAKARRAGRQAETEEVQGGQGGHRATEQERQEGQGRDHGVGQDVPEHHPGVAEAEGPRRLDVLQVTTAQELGANHVDQAGPGEQQHDRQQPADPGLHQAGEDDQQVKHRQTRPDLDEALAEQVDPAAVVALHRACADSQQRRGQGQAEGEENRQAQAVDHPREHIAALVVGTQPVLRRGRRRRRARVVDAAGVEADRRPQRPAVAGDAFAHEATAVVRRERQLAAEGGFRIVPQHRQEPLATVFQQQRAVVGDQLGEQAGDEQREEQPQRQAPAAVGAERGEAAAVQRGKDDGHLTVSSRRSRCAGRPGCRPGRRPASPATRAG

SEQ ID NO: 24914 - protein, 435 aa, Pseudomonas aeruginosa
RHHRVRRPAGNQPGAGFFGATPAMGGERLYGGLRRLPPARRARHRPARPAPHVRPRAKPVRPRVPRGRPGPERVAVDPRPRRAGPGWRAAVPGDPGADRQSLRRGPGAQSCPGDLEHRLGVRPGPRLGARRRAHRAVRLGLDLPGQRAAGRRRGAARPAPDPGRRPAPARSALRPGRRADGHRRRHPAGLHPGPGPRVGLGCALGTFRTLPFRPAATGVPRHRTLQPRPADAAAPAGQPQPAGGDAADRDLHEQLRRAVLLPGHLLPVGVRLQRVADRPGVPPGDSALHPRYPRRRAPAGPPRGTRDAGRRPAAGRTRARPAGSVPAAGARLPGAAAGHRDPQRRPGHDLDRHVGERRQRRRSRRTGRRLGDGLDDPADRRRARPGPAGGAGQRPGARRRCRQPAGQPGARHRMGDRAQRPARPVRRRPGLAAAP

SEQ ID NO: 24915 - protein, 494 aa, Pseudomonas aeruginosa
KIAIPRRLSSFLTKWQRRDPRKAAYSSACFAASTTPVPMSASLPNDTPPDEALPLVLAGPLLRRAEPGRLVFWLATSCPTTIELILASEGEAERRIRLAEGTHSAIRIGTHAWLHLLDVALDPPLPCARLVDYDLRLAADGREPAGIAEWAPHLLYPGRQRASLVLKPRLDQLLHGSCRKPHHPAADGLLQVDRLLEENLLQAESRPALLMMSGDQVYADDVARADAGGHPWADPPPRPVRRTPGRRAGGRQRGALRTPGHLLPARGPAARLQVQRSPARALLRRGEEADLHLGQRPQPSGRPGRGAGDVPAGLVAGALAPGQAGTAAGAGCAARAALRRRAPAHRSLPRWPARRGAGTGAYLVADDLRRPRHHRRLEPFRALGADRLRPSVLPADHRQRPARLPALPGLGQRPAALRRMAGAGRGPDGGCRGRRPAALRRAGPPARCPARLPALALPVAWQPDPDRPRHAHPPLAQRAQPGPALRADGLGGAE

SEQ ID NO: 24916 - protein, 247 aa, Pseudomonas aeruginosa
LPDPFRRRALLLRLRHPDSPPRARAPALADHQQRDQERIPATPAGLVRPPQPLALCALVAAELADPAAQPGNPPARSAAQPGRRAPVEQRRDRPGIHWRGRPSARGVAGQCRWLAGDRLRATSRRRRRTSGPVAGRAGSLRRQNKGDGRTPRRVIRPPGFRTAAPARPGSPPALARAPRRRPAGRRRTGTPAWQLHRSTRCATATGRRPRPPGAVRSAGNRARPGPPAPALAGAGRGGATGRCGREC

SEQ ID NO: 24917 - protein, 288 aa, Pseudomonas aeruginosa
PARHPDAGAADPPRDFLPPAAQRPGPAPARDRHRRQPGPPHHPRHRLDQPELRQAAAHRATGPGGQPQPLDPAPPLQGRDRDEPVAVPEAAALAGSTPADLQRGPGSGRRRLPGRLRKPVAVQPRVQPAVRRPAAARPGAGAQHRLGERGSGRDGQSGSGGIPSSPRPTLRNRTRHDPSPAPAPACPVPSRRGDGQRVVRPPLPGLCPCRRPAQRTTLARLADGRQGLPLQRWPQYLGRRCRRPRAAHHGGGRQRPGSRPELCLSALPGPSGGAAADQRRAPAEQYRQ

SEQ ID NO: 24918 - protein, 444 aa, Pseudomonas aeruginosa
RDAGRHRPARSLPSLRPGRLAGPAQARWLSRRPGHARPAPAGIPLCPVPVAAPGPAHARAARQLPERRPGLAAPLARSGSRGKPAGGAGRSQRRHRALHRDGRRRALPHRFRRGSATLSAGAAGVRPGLLRCQRDRRRRRQRSLRDRRAGRSAAGPARRRRGLEGSRDGRHLAAGLPAARPASGLERTSRRRAGARRALPARDGRHPPAPGRVAGGLRRPTATAAGDPATATHHRLRHGGQRGARGLLRPCRRAVPPGLPRRALECRRADPGRRRLSGGRRRGVLPGLRPFGADSVARRRLARRHAGAGRTRPARPPGDCSQPRRRADPLLRGGECSLRTDNGATMPGSPPQPRRGLAMKFLLIGLIRFYQYAISPLIGPRCRFYPSCSHYTLEAIRVHGALRGGYLGARRLLRCHPWHPGGYDPVPERQEQACACHRTAKPGK

SEQ ID NO: 24919 - protein, 682 aa, Pseudomonas aeruginosa
  UNSURE (35),(44): Identity of amino acid at the above locations are unknown.
SRRKDRNGDIPHITGPAGRHAELIKPIIQGPSPRXSPGAPLRPXTPGSSAQTFHPEAPMPRHPFSPSFLAASVFCAATPALAALQPIAEAPLAGETEFRCQFNADNSTDCVSTYSFTILKPSGREMLSRIDRSYAETDSLIVEKAELTQPGGKPVPLDQSQIDTRTAPNPDQGFLRERQTSLAFPNLRVGTRISYTLREHFTAKPLSTQFHYILSRPPMPVRDDRFVAEFKAERPIFVRSELMDAYRIEQSADKKTLKVSLKKPQYTNYINEAGNAYLRHTPRLELGSSLDLQDNFGPFAARYNEILAAELPKGAAAAVAAVKGKPAREQVAGLMQYINDTYRYLGDWRASERGYVPFSLAEIERNGYGDCKDLAILLAAMLKAAGIKAEPTLVSRGDVVWDLLVPGMYAPNHAIVRAEVDGKTWWLDPTNPVFAPGRTMPDIQQRWALVLGADGKVRRDEIPLEAPGDTLRVTRSEHYTHDGEARVESRVELSNAPLMQLSVADRQRGRTSTDQDLCRNFAKEGSDCVLERDDSQFVLPPSYTISARLTDRRALDRLGGEYFYNRQDLASQWDAFAKYRSEGQLAELYLGEPQITSYDISLSGGKTDEPAHSCEIRSPWFDIDLQAEPAKDGGYHYRYREVQKTSWLNHDEINSAEFGKLIEQSRGCVEQLRLVVKLDKRP

SEQ ID NO: 24920 - protein, 235 aa, Pseudomonas aeruginosa
CTRRPSRYAACGPSARPSASSTRPRCMRASQVSRSMAGKRAQRQSSTVLQGPAGRCRVLARRLASGKEGDDMRQLGKDGRPLGRSAAHRSKHAGAKRRNRPKAVSSVTQGSNQAALALRSSASQAAAVNSTSVEEFSAVSAESWRIAMMKPTATTCIATSLGIPNRLQASGISSSEPPATPDAPQAQIDATTLSRIAVGTSTAMPRVCTAARVSTVMVIAAPAMLMVAPSGIDTE

SEQ ID NO: 24921 - protein, 203 aa, Pseudomonas aeruginosa
PFRASTPDSAKVEATRPKMPSGAKRITTLTISETPLDSSESRLRVVSLAWRKAMPRPMAQARMPMKLAEIRALTGLSTTLSSRDWSTSAMPPGGDISPGWLASTRLEGKAKLAITATTAALKVPTRYSSTIGRIWVCWPCLWLAMDAITRTNTSTGATAFSAETKTLPMKPTLSAAAGKKLASSRPAIRPTMIWPTRLVRVSR

SEQ ID NO: 24922 - protein, 473 aa, Pseudomonas aeruginosa
IHSPLASLGRAQLALLEARRRTAEAASQVEQVAEAQSGPDQPHHQRGAFQVEPEHRDDGRAEQWQDQVVEMLLEAAVAPAAHIEMHDHREIDEGEGHQGAEIDQRGRGHQVEGDRRERHHAHDEHVDRRRTPFRMDEAEDPLRQHVVPPHHVQQARHAGLGGQARRQGIDEGGAEEDRLEQLAADVQGDFRQRRVGFLEAYVGREIGLQEIRHGDEDHPAVQRGEEDRPRDHPAGVAGFLGQRSHRVETEEGKAEDRRPRHHRREMRVLGEERLGTEHRGGPLPVVQAVNHQADEDHDDRQLDQHEDGVEIGDQVHALDVDEGHDQHEHHHPDPRGDLGEQCGQVDLRQQCVDHRQEQVVQQRRPADHEADMGIDRSLRVGIGRACGGELADQLAVADRGEQHAGEGHQVGGGHVSLGNPGYDAEGVEDGHRGQVGQPDHDDLPQLEGLAKLGSFCGGGRIRHGYACLDFFFF

SEQ ID NO: 24923 - protein, 210 aa, Pseudomonas aeruginosa
TCVEDWPRKAGRPPRRRQGPGRRRQPRLAGRWRATARAAPAQRTDHGLHRRSAPGADPRRADRRLPGHEPVRCVQRRLAGGYPRRPHGRTSARPAPGMPAAVDDLRRHRPRRGASAAGRSADRPAQRPPDHRRLPPSRRPRPAGAGAPGAMPARPAGTAAADGAGGGAPRASTPAGGLGRIGGFFERRRMASVHRTLVPSGGSPCPVACH

SEQ ID NO: 24924 - protein, 69 aa, Pseudomonas aeruginosa
QSSPITAVSPMTVPCPWSRMNRLPILHLGWISAPDRSFPREETRSAVASNALSGSPSDVLRRHSMWESR

SEQ ID NO: 24925 - protein, 321 aa, Pseudomonas aeruginosa
QQLRTPCRLIASNRAWSSRATSSKRPKRRTPAQLNSRRRRPSAQNCASASPTASGSLTSTARCQAPGSCAAKPRNASASMSSKPTRQPRRWNSRALAAPIPEAAPLIRMFCTYRPPRCIRRRTRPPRPTPGRRWPTRRHGPGTRASNRRSAAIAPRRPAHRPVAPGAGCRRAAVRPRRPVPAAAAAPPGRHAAATRRPSLAPRRPAAAGAPRFPARPATAAGRRPPACAGAGSRGRSRARTAATRPATASRAPSAPGPGTAPGGRPRSRRRAAAGAANGRPPAMPGRPPGRRRGRRGTDVPGRAGSPPRRPRRRNAGPGAW

SEQ ID NO: 24926 - protein, 305 aa, Pseudomonas aeruginosa
IGRSRAASGGAAAEASPLATGERHMGCQQHAWPAHAPEQVEAEVNYIRDNGQRPVAYTYPAPAGTPQHSALLQPTRVAIRNARLLAQPASLEREGFQLVREASAVGDFEDEAQVRERYYPESIALLRRLTGAAEAVIFDHTLRVDQAGREERGLREPVRYVHNDQTLRSAPRRVRDHLPAERAERRLAGRFQIVNLWRPFGHPAQRAPLALLDARSLAFDDLVASDLVYRDKVGETYSVKPNPEHRWYYYPHLLPEEALLLKIYDSREDAQARLGAHTAFDDPCTPADAPPRQSIELRCLLFFDE

SEQ ID NO: 24927 - protein, 211 aa, Pseudomonas aeruginosa
RGCRRSPRRAGGCLADRAGRPPRPRPGSGRGPPASRWPRHPLRPASGPVRAGRRHRTAGYVVPPPPAGVPRRWSAARCRAGSPGGSPRAPRPAAGCRWRSPPVRRRSRGRRRRAGPPSLPGASRRAAAPGVAGRRRAAVAPCSARSGAGGCRRPATSRGARRCRSPVRRADPCRPGPSAPGRRRRRAGRTARGRRRRSAGGSTAAPGRAAR

SEQ ID NO: 24928 - protein, 278 aa, Pseudomonas aeruginosa
GMLPGVSRPSSANSRYSCQPLRASARLARHRASAAVSGRTRARAPQRSTSQPFSGLLRATARPSRVTGSADWPRSQSRSAAIGSMNSEKLLITSPVGPKITPTTEASSTPQLATPNSPTPGAAGATSSMASRATPLMRRASGARSVGGASGCPRRSRWWPQAGRSRCRRDERPGSVPPPRRRCPPAPRRSCAARYSPPIRARPPAPAGRAGRARRRGRPAAMPPVRRGAVPEAVRKRPGGSARRCPGPPPDCRRGSPGSASRTSAAVPAPPPPRSACA

SEQ ID NO: 24929 - protein, 162 aa, Pseudomonas aeruginosa
SAATRSGAARPISTRAWATRSSSPPRPSSANGWCEVNRNTPCASRCRATHRNSRSSSGYSQCSTAVMLISSKRSASGGRSSRSPSSRRASTPAPRNCARACSRRSGERSMPHNRCRPGQRRAPPSSSEPMPQPRSSRLRGSMPARSSTQSWSRRCSSSLESW

SEQ ID NO: 24930 - protein, 670 aa, Pseudomonas aeruginosa
GQHPVACGALEQREPGIQQAVVEQLGFGDEEIADPRQQVAVGTGQGKAHEYPPLRKCRSEADVDPMAGQPAVQVQQVGQAGGRARRGTRAGQRRALFESLADPPGVHQFEQRRAAVVEQAADPLAQQRQVTWVGVGRETALAPLQDRLRQVPAQGPAQQALAFPGDALQRPGQVPYVLHQAVVAERHAHFQADRHAHPVLAFEHRRQPAAQRQVGDLALASLGGILAIQPRHFGEGLAVARPDVFRRRHPFGDLPPQQLPGPALAGQPGEAVVCEGARVVEERVAAEHLVGRLARQCHRGVLADLAEQQVERGVQLAPAGQVAGLEHRLVLFQHLFRGDQHGTVRRTEEVRRQLRIGFVPAALPGRRDEAAAFAGEVHGEGRQAPRVAIQRGHREGTDGAGVEPAGKQAAQRDVGHQLLGHRLAEQLAGAFGAVLGALFVTFRAQRPVDQLAHTIAVEAQRLARPDLAQALVQAVAGSRRGGQGEQLGDAAGVEHRVGLGVGEDRLGFRGEQHASGGRVVVQRLDPEAIAHQPQALLALVPQGEAVDAAEPGEGSLAPLQIGAQHHFGVRAGAEDLAQRLQLGAQLAEVVDLAAVGQRHPPASLGKHRLSAVLQVDDRQAPMAEQRVPRQPQAFGVRPARGQGTGHAFEDAALLAEVAAPVGPAGDSTHG

SEQ ID NO: 24931 - protein, 250 aa, Pseudomonas aeruginosa
IAIFEFCANRLPCDLAFRTKILRNLVHYHSLDFRRKTMTSLRYWDISPALDPNTPTWPGDTPFQQEWAARLDEQCPVNVGRITLSPHTGAHVDGPLHYRADGLPIGQVPLDIYMGPCRVIHCIGANPLVTPEHLAGQLDDLPSRVLLRTFERVPANWPEGFCAIAPATIECLAERGVRLVGIDTPSLDPQHSKTLDAHHAVGRHGMAILEGVVLDDVPAGDYELLALPLKFTHLDASPVRAVLRALPTAE

SEQ ID NO: 24932 - protein, 417 aa, Pseudomonas aeruginosa
PMTTRDDCLALDAGDPLADLRQLFALPDGVIYLDGNSLGARPRAAVERAAEVVAAEWGEGLIRSWNSADWRGLPERLGDKLAPLIGARAGEVVITDTTSINLFKVLSAALRIQEEDAPGRKVIVSESSNFPTDLYIAEGLTDMLQRGYRLRLVDDPEQLPAAIDADTAVVMLSHVNYKTGYLHDMREVTRLVHENGALAIWDLAHSAGALPLDLHAADADYAIGCTYKYLNGGPGSPAYVWVAPRLRERVWQPLSGWFGHSRQFAMEPRYQPGEGITRFLCGTQPITSLALVECGLDIFARTDMQRLRDKSLALADLFIELVESRCERFGLALVTPREHARRGSHVSFEHAQGYAIVQALIDRGVIGDYREPGILRFGFTPLYTRFVEVWDAVQALLEILQSEAWKEPRYQVRHKVT

SEQ ID NO: 24933 - protein, 245 aa, Pseudomonas aeruginosa
SRSPPARKAEHPEQAVKSAFRSTIVRLVVFYLLTLALMLAIVPWDQAGQSQSPFVTVMQAIGLPGATGVMNFVVLVAALSAMNSQLYITTRMMFSLSRAGHAPKGLGELSRQGVPLNALLLSSVGIALATLLNLVYPEQSFTLMMAVSMFGALFTWLMIFFTHLCFRRHRARHGGAPLAFRMRLAPWSTLLGLALMAAILVTTFFTEAFRMTLVFGVPFLALLSALYLVFVRKPGRDCPIERATP

SEQ ID NO: 24934 - protein, 674 aa, Pseudomonas aeruginosa
RSAQPDVPARGAPRPARSRQGRSGGTPSHRAHCIALPCGDADVVSHEGNTMHPTFSRVLLAAALAAAGSPAVATEIQLEQGWNAEQRASWYDASLGSRLLPLAWAQALERPDSEERLFSEDNARRLGFPLRNWQGGELRLPRGFALDQQDDSQFSDTRLRWKARQSSSEPWVGLNCAGCHSTDISYRGSELTVDAGATLANVQAIFDEVLAALRRTSDDGDKFARFAGNVLGSEDSPANRELLKAALVKRAALIDTLLSMSATDLQPGPGRLDATGQSLNRAAINSGARHLQANPTDAPTSFPALWHTLQMDKLQSSGFVPNVKVLDLNGQVFDLGYLAGDIGVVQGDYGDVVSHPLSGLEGYISSIRVDNLTRVEGLIHKLKAPAWPSQLFGAPDSARLAQGKRLYEENCAACHASIGRDDLQTPIKVRQVRLKAHGDDAPIGTDPWMACNTFTFSSPSGNYFGLFRPSLGTPSGVGIVGRTSKIADMQVPEVFQIMLGKKGQLADGIAEIIHAIVTGQQTLPGSDSLQAVPAGQLLLAGAAPADSQAQSLAAGEVPTDKSARKDYCLNTEHPFLGYIARPLNGIWATAPYLHNGSVPSLYDLLLPQEQRPATFYTGSHEFDPSRVGYLTAPGPDNAFLFDTHLEGNSNAGHDFAREYDESQRLALLEYLKTL

SEQ ID NO: 24935 - protein, 647 aa, Pseudomonas aeruginosa
  UNSURE (148),(170): Identity of amino acid at the above locations are unknown.
AGPAHMPNRENRPMTLSRLSLAILSVLAGAPAFADDSGVDLDQGWNQTQKTAWLEAGQGSRMLPLAWLVALEQRASEEPLMSDALIRQYGYVPHTLGGSSVKVVQGYAVDRSDDSDLTFTKLRWKALQGSREPWVGPTCSMCHTSHIXYQGTQLTVYGGQTMGDLAGFQXEILGALQSTRADTAKFERFARKVLGADGLVSGYNDANKARLQAALDATIVRLRDGSHFNLPHDPEFGPGRLDAIGSIFNSVGYELHANEQIYGAEDAPVSYPFLWNVPQLDRVQWTGFNPNHINVVEIDNRKFDVGALARNAGEAVGVFADVKVLSPIQSALHIGYPSSINVDNLIRIEDQLGQLKPPAWPNQLFGAPEPTRVAEGRELYRQHCSSCHTPLDRNDLRTPVKTVLTHLQARGEVAPIGTDPWTACNSIAQLKTGYVRGKPYLSFVGTGQRGFYGKQAYAVDVLQEVVVQALAARGLSVALGAFQTAALGIFDGQLPPLISPVPDSPDADSVEATAADAPGALLLAENVAAGSDKARRLEQCLAMTSDLMAYKARPLNGIWASPPYLHNGSVATLYDLLLPPDLRPRTFYTGSVEFDPVNVGYITDAGGANRFLFDSGKPGNANGGHDYGNAQFNEQQRRALVEYMKTL

SEQ ID NO: 24936 - protein, 91 aa, Pseudomonas aeruginosa
TASVSAERQGGYAEFFRIRSTAMLDHDLTVALLCRLNQNQSALGMALEELAIWAKRHEGGETYDVVMNHLQTLERNADFVAEAIVVLMADR

SEQ ID NO: 24937 - protein, 147 aa, Pseudomonas aeruginosa
RMPRPSAPSSTTPVIFARSLPTWRRCSTPRCTPPTPRAAPTFRLQTPPRNPPCPRAPPPSPHPRRNRYRPGSPACRCASGCRPHAWPAPRAGPTPERRPPRPPPSFANPRMKPTWIRIPRSISATIPSICYRTCRAPWPTSPAWPSN

SEQ ID NO: 24938 - protein, 161 aa, Pseudomonas aeruginosa
ASRSRKRSSSRSRWSRSRRNCTRRSGNCRKRKSSSGSGTSACRTTARRWSGKPSRATVSSPSAARPCNNSRKASKPASAAARGEPKYCRSSRNASKSCAASRTCARPNWKSAKPASNSAAWNSASASRSWKAPARSWRRSSRVSTRPYSSIPLCTPSVIPG

SEQ ID NO: 24939 - protein, 204 aa, Pseudomonas aeruginosa
ATCGLPILASTPNSRRMRSTMMSRCNSPIPEMMVCAVSSSVFTRNDGSSWASLLRAMPIFSWSALVFGSTATEITGSGKSMRSRMIGLSMAHRVSPVVTSFMPISAAMSPARTSLISSRWLACICTIRPTRSFLPFTELSTASPEVSTPEYTRAKVRVPTKGSVAILNASAENGSSSSAWRSSCFSSSSGSVPLIAGISDGAGR

SEQ ID NO: 24940 - protein, 223 aa, Pseudomonas aeruginosa
LGLRRAGGGSLQCLRGGQLRQAGAPRRQGPRLHLQLPAGTRPRLQLRHRLPRQLEPGRQRQQSAGRRRLQGRRPDSAQRHLPAEPVALPRPGAGNREDLGVQPRHRQAGRRAQRQPGVLLVAQRQRYPGRPRDPHRPADRSRHRLLSRQRHHSRTRRLRPRPEPAGGGQLATERARAAPAILAEHRPAPAARLRRPVRRLGLRYRRLVQPEQGGRPYPQRLRR

SEQ ID NO: 24941 - protein, 475 aa, Pseudomonas aeruginosa
SRRRPRHRQRDAEPVRAADRRRPRLPRQPCPERRLPYLGRPRQGPGCPRQPGDRRLVRRRAGGPGAGRRVPQGSVPPGHPGLRRQRAEPRRRSRRHGQRRAQPEGAVRRTQRAGAGQPGTQRGDPPRQVQRLRQHQQPEIFVPLPAVPPVGPARRLQRRFPCAVAVRTVQPDLHHLYQRQLRRPAPVRRRPAEPGRHRQPRLRPAVLQRHRRQYRPATGNRAQRYPGPGLPAAARPFRRPGLLVDQDRQPDRRVSRSGDLRRPAGLRRTHRAQGRRLYRSRRHRTGQPRQGKDQRRRPEPRLSFPGQPLRAVRARPARHLRVPLRLPAADRRPVPGQRRRLPGRRRDRPLEARRQRHLEPRRLAGHPEQPLHQRLQRLRPRQPRQGRFVEPLGPGRQLPPQPRAGADPRGEEPVRPRTAVQQPDLHLPERLRPALHRSLRAHPVRPPQLQLLMPARAPGRYGRQARRRLSSYQIR

SEQ ID NO: 24942 - protein, 610 aa, Pseudomonas aeruginosa
PCQISQATRSGRLLGSRCHATYYASRPPPVRARGHRMIILGITNNDLSGACLVRDGGIVAAASEERFTRQKDHKAWPSRSIDYVLGEAGIDLADIDRIAYGWNAGFDAGRHLDLYLDRVLEEARERPEGLPHLRKRIADEMANDKAKRGEFDAFVRANGLRGKVQYFDHHECHALGAFVCSPFDEALTLTCDGRGDFQSLTVTHYRADGGEAVLQRETSVDSLGYFYGRITRLLGFKPNRHEGKITGLAAFGDAEKLLPLMNDMIRLENGRLRARCGELYLPSYDGYSDPLLQRCAAERPADVAAAAQRHSEDLLVAIAREHVARTGCANLCLAGGVFGNVKLNQRLREIPGVRDVYVLPCMGDGGLALAAAVAVAYRENGTRFPAPSMALGPDARSAAQNAEMIASQYPQLAYSRPANLIETLVEALRENQVLGMFKGRMEFGPRALCNRSIVYHPGDASANDWLNQRMERTEFMPFAPVTAVEHAEACYVGWREDQVAADYMTMTYDCHADFRERCPAVVHVDGTARPQIIRPQADPFMHALLHAWHARSGQPALINTSFNRHEEPIVCAPQDALGALEDGMVDLVVLGESLLVWRKGENAFARARFE

SEQ ID NO: 24943 - protein, 353 aa, Pseudomonas aeruginosa
  UNSURE (16): Identity of amino acid at the above locations are unknown.
SASCVGWTCPWRWSPXVGRHASTTCCASTTCTRRSAPWSAATTWSTASRLRMAIAWPRPGSAWHRRAAWCSKTPSAACRPPVPPARPAWRSARRAACSPPARAGRSGISASYGSSAKTTGCTASIGTPPRPAARGALASHEPDPARCPAALGLPRPGPLPCALRTAGGMRLLRPAGLRPRLRTARTRPRRTPAVHRQHRALDAPSLGRAGSRAVRPPRQGARGKRQPHRDRAAGDQLRREHRLRPRAVPRPAPHDLRHQAQLDPPRGADPAGPLAGSGGTRGCARLRISRRHLEPGRRTRGDRRDGRRPRPHHALPGAGLPGRLPDPGAGHGRLGTPGGARFRPPLGEPAALS

SEQ ID NO: 24944 - protein, 409 aa, Pseudomonas aeruginosa
PLRGYPQPLASARAGRAGRSACPGYPEERLPRRRATIRRGLEGGHRRVDVGLAGVATEAQAHAAASAGGIVTEGEKHVGRRRPRRVAGRGAGHRQAGLQCLGDKGRVVEGQVQGMRDACVGAAVQAPAVDLRQPLQQTPLESGDAPALLLEKLAGEGEGLAHTDDLVGRQGPGTQALLVSAAVDLRLQPPLGARPDVQRADALGPVGLVCGERHQVHRQAAQVDRHLAAGLRRVDVEQRAALAHPFADGGDVGQGAEFVVDPHQRHQAGIGAPGRLHLFRPDQAIGAGRQPGHAPAVIGELLHGVQHRLVLQATGDQVAGCVQRLGHALEGQVVGFGGAGSPDNLPGAGADQRGHLLPGPLHCPPRLAAVGMGIRRGIAKTRLVAETLHHGPDHALVHGRGGGVIEVQR

SEQ ID NO: 24945 - protein, 135 aa, Pseudomonas aeruginosa
SRSPSRPACRHRRRSGFPLATVPGSSHVLGSKASRTASPMNTSRLSKVARTTNTVSPSQGAWRLSRPCPTSSPRLGEPGGRPKPRKSRAVRVVTAPQSRNGRKVRVATMALGRMCRNITPASPRPRVRAALTYSR

SEQ ID NO: 24946 - protein, 710 aa, Pseudomonas aeruginosa
SRSTGRNHWPRYSSSSGRSLAISSANRQVTNSARNSRSARRPRRLARNAARRRRCSGERTMAISLSPRGEVDARVDQAVGQVAGQLHQQPEQGEDEQAAEHHRVVAAKRRFVAHQAEAVEGEQHLDQQRPGEEHRDQRRRQPGHHQQHGVAEHMAVEHPALAEPFGASGGDVLPGYLVEEAVLGQQGQAGETADHQRTHRQRQVPEVIGEARQRAEALGALGSQAAQGEPVQVAAAGEQHDQDDGEEEAGHRIADHHQRAAPQVEGAAVAHRLGHPQGNRHQVGDQCRPQAQGQRDRQLLGDQVDDPRVAVEALAEIQPGVARQHQPEPLQRRLVEAVLALQGGHQLRIDAGLAVALRFQSAMPTLPATPQRTAAVDALQARDGLIHRPAGCGLDDGEVDQQDAQQGRQDQRQAAQQVAAHVTAPPGSARPARGLPTRCSAPGCSAAPAAVGRSDSSWRSRPRRHTRSGSGSSPIAAPGRGRARRFPGRPASRPRPPPGPAGRWPGPSGRCGCSRRDRRSWRNARSCTARCPANWTGRSSKRSCRSPAHVCARCIAKRPPGAGAYRCRSAPGCAGTAAARAPGPCPGAGGRSAAAVRRYPAGARRRHASRPRRAGGRPAPGARGYRRCRRSPAERRPGRRPPRGFARAAAPARPVRRRRAGRERPSPSCRNSCAGACSDRRRAAGWSIRSRTTGSAPGVPGGPRTAAGAG

SEQ ID NO: 24947 - protein, 168 aa, Pseudomonas aeruginosa
RRPCSGDSDRRWRRRRCARPAPGCRGTAPSPDRARRYGRPPRRAAVCPDRGWSAGHRSGCGSSRRKSRTCSTATRRSRSSSSARARTSGRACRSARSRPGRSCRRRRRLSRNRSSPSAPGSSRWRRPGRCSSGPARGSWCRSCRVAAGWSAGATPAPGCRWSAPRCDR

SEQ ID NO: 24948 - protein, 502 aa, Pseudomonas aeruginosa
LFSSVKGRRGYLSRFQHEKHWPRPTQTRSPAVTDRAAPSNWMLALLACAQLIIALDATIVFVALPEISRALDFSAQRLQWVVSAYTVAFGGFLLLGGRATDLLGRRRMYVLGQSLYALASLAGGLAQSELPLILARAVQGLGGALLFPATLALIGNHFAEGPARNRALAIWSIASAFGLALGSALGGALTELFGWASIFLVNVPLAGAAALLALRLIPADARRQRGRRFDLAGALTVTAGATLLVFTLVQGPESGWDAPSVRFGLYLSVPLLLAFLAIEHYSRDPLMPLRLLGNRNLQVAMLLTAIFMSSYGVQYYFLAIYFQSVYGYSVLQTGLAFLPATLLCTLGIRVAERLLARHGARATLVAGLLLGALGLGLLAACLPLGRGFLALLPAIVILSVGQGMTWTAMWVSAASGVDPAEQGVASGMASMTQQIGGALGLALLVALANAQVRGADAASLLASQARGIEWVTALSALLALFGAALALRLRREEPAALQPSRG

SEQ ID NO: 24949 - protein, 490 aa, Pseudomonas aeruginosa
AATRSTPTTSPGPMLVAIHGLIRRLGLYGEHLEGALVDDSEALYAHPATYYRREDLLPAFKSNEALRERFFGGVKKPIFTSANAHNHLVGLAEVLAMYLLVWSPAPWRLVRLEPPPGLDARHAQRFADERRHIEAFRDGLPGVARALAHISSLMIFDDHDITDDWNLSARWELTAYGHPFSRRIIGNALLAYLLCQGWGNDPQHCGEWLAPVAALMEGAAADGRLPCAEQDRLLDALLDFQHWHYRLPGSPTLIVLDTRTRRWRSERNLGRPSGLMDWEALSELQQDLLGEKAAIIVSPAPMFGVKLIEGVQKLFSWIGQPLLVDAENWMAHRGAASVMMNIFRHSRTPGNYLILSGDVHYSFVYDIRIRHREHGPRLWQITSSGIKNEFPRRLLDWFDRLNRWLYAPWSPLNWLTQRRSLEIRPRVPQHSQAGERLWNSAGIGQVFIGEDGRPRAVLQVNADGSPATAFERHRDVEDERADQSPVAPGR

SEQ ID NO: 24950 - protein, 337 aa, Pseudomonas aeruginosa
SCHRAARWMPVAATRASLGKVSPASPRMSENTPLLSVDLPAELRQRQSELAQSLLRHCPRDGIYGTAVEPLALIRADGPTLPARGMHKPALCIIAQGRKEVQLAEERYIYDPLHYLVVSVTLPLAGQVIDASPDAPYLCVRLDIDPAEITQLISDAGPMEVASRRGDRGLYVDRIDASLLDAVLRLIHLLDSPRDIPMLAPLILREIFYRLLRSGQGQRLHEIAIADSQAHRITRAIDWINQNYGKPLRIEQLAQVVNLSPSTLHHRFKAVTAMSPLQYQKQLRLQEARRLIFSEGLEVAAAGYRVGYESPSQFSREYSRLFGAPPLRDLARARNTA

SEQ ID NO: 24951 - protein, 480 aa, Pseudomonas aeruginosa
GNAAAAATVNREAAAYLRRPDRPCATVPAMTRALPLLLLALSLPAAATDSESFARRYLAYAHAVGQHSERLWPGWRMADKAFLYSDGRSTWVADAEGRAQRTTVAGDSDPDLDLSYAFPRYRGRPAVLLQISAAHLRSNTGNSETLAAIGPHEAFHHYAQEDWPGLRKPGGYRGDLATLDPRPREYRYALFQSLLQALRTPGQRDSYLSDAQGWLRRWREAAPEESRLAAQVDLSEGTARYIEMAAAARYRTDFAEDPQRYRQALREYALAFYDANEIGVGVDSEAYEIGALAGVLLDLRDDDADWKEAATAGTWPLDYLLRDQPPAWSELPDDARARGERYRREMGATRQRLVELQEAFADPRRPLLVIPQPRRTIGFATAASEVRGGFYVLADGPFRQAYLGARWNVGELTLDGVDYLEGDAEAYCPGYGRSALIPLRGGDWREGTLAPEEPGLRGRLATARSLVDGRTLYCAAENAP

SEQ ID NO: 24952 - protein, 138 aa, Pseudomonas aeruginosa
CSTSTTPTATWATGAPASAATCPSPWRRSSAMATATARTWRSSSPPCSRPPGSRPNRPWSAAATWSGTCWCPACTRRTMPSSAPRWTARPGGWTRPTRCSLPAAPCPTSSSAGRWCWAPTARCGATRFPWKRPATPCA

SEQ ID NO: 24953 - protein, 162 aa, Pseudomonas aeruginosa
CSSASPIASAAAPAPTRTCAATSPRKAATACWSATTASSCCRPAIRSVPGLPTAAPSTGSAESISTTARTWPASGMPSPSTVAKASWPSCTWANRRSRPTTSACPAARLTSRRTVARSAVPGSTSTCRPNRPRMAATTIVIGKCRRPVGSTTTRSTAPSSAS

SEQ ID NO: 24954 - protein, 279 aa, Pseudomonas aeruginosa
AAAGSRRGCPRRPAARDRTHRSGYPRRVPRGARAAGASCRSPDTAGSATSGRCARRPRCASRCSARPRLRACGRTARRAPGGSCATTGSPVAARPERSLRSTCRCAARGTAPGSARGCRDWSRTAPARRYAGRSGAAAPGRDCRCCGPAAPGASARRSRRPASPAGSAACPPPADARRGTGCAPRKESVPPPATRGNSAHAGLRDMPPAGPAHAPRRPAPGPAACAPARCPGRWPGNARRDSRARCSRDRPADAGCWRGDWRRARKETTCGNSGRTGDH

SEQ ID NO: 24955 - protein, 82 aa, Pseudomonas aeruginosa
DCRKYDTVMKITPPYSAVRKIARGITLPASRVSSDSVVTASKPRKEKQRIVAPATIAERCACSEKNGWVLSTVAVPSPLFRP

SEQ ID NO: 24956 - protein, 158 aa, Pseudomonas aeruginosa
ANPIMTICHSLRDLRSWVRSAVGGGFDMGMLASISSFSNAQQRKADGRKPQACRRLPSARVGTSTEERGAFSSPPPPISPSFFFPPLPSPPPPPPFLSLPFPLPPLPLPLLPLLFLPPPSFSSSPPSSSLPLPLPLSPPPLPLPPLSLSSSSPSPSCL

SEQ ID NO: 24957 - protein, 180 aa, Pseudomonas aeruginosa
PVLKTGRARLGGPRADGKALAAGDSLGWLADGARPRALPLPSERIMDCTGEARLELILGAQIGDFPAMSLFDAFNGDWQVDTRADRMGVRLLGPRLECRQQSMISEGIALGAVQVPPDGQPIVLLNDRQTIGGYPRLGALAPLALARLAQCLPGQPVRLLPTVQEAAHREHRRLLAAWDA

SEQ ID NO: 24958 - protein, 481 aa, Pseudomonas aeruginosa
FGENMPVKANIDTDSIFRFFLPEGPGLKYKRLAQGIEESIRNGVLRQGVKLPPHRILADKLGVTAGTVSRAYGELERMGLVEARVGDGTFVRNRGRERAREAGFRNFVDSTEMCNDMSRNMHIPGNETELLSRSLQQLSAAPELLQELMLYTPDTGLLRHRQAGATWLSHGEFQAEHQQILCVNGSQHGLLVVLMAMLRAGDTLVTEQLSYPGLISAAQLLGIKVLGLEMDEEGLLPDALEEACRTNRITALYCTPTIQNPTTAVMSGARRKEIAKICREHGLIVIEDETHAVLMAERPTPLCHLLPERGILIGGMSKAVAAGLRVGYVHAPASMVSRMAAALRNSCWMATPLVLEIASRWVEDGTASALLEYQRGEIARRQALVVDLLQGLTYRSHLCCPHFWVEVPAPWRAIEIEQGMRGQQHLVTTAEAFSTGRGTLPQAIRISVSNSPGGGNTLSDGFAVLAALLREGPQEMLTMRA

SEQ ID NO: 24959 - protein, 369 aa, Pseudomonas aeruginosa
SGCSAPIALHAAFDDERGRLVQRPVGAGQHAGMGLEHVPATGVALQSHRDALLTGPLRQAQAVVAQQFVLADLYQQRRQPRQVGMQRRQGGRAWLRVGRQQQAHRAFQPGPRQQRVAGRRRVQALAAEVGPGREQQQPGRQRQAARLQLQGQGQRQVAARGVAGEQQPARRMAGLQQCQVDRQGVVAGGGERMFRGAPVVHRADLGGATPGQVRGDRPVGRRRADQVGAAVQVEHPAPRLHPARPQPLAGHAGEAAALADDAAGAQRRQAQPAQHAALQRHWHGRTDQPAEQQAQAAAQETGAQALRRRHQGRFSGPGHSRQAPAGAYASDRRRCSPASCWCSCRRQSCTSCRSHAPRRYGATPVAPPG

SEQ ID NO: 24960 - protein, 151 aa, Pseudomonas aeruginosa
APDPGVAATASAPSGGVPSRRRCGPAWRSRKARCAGTATGVAPAGRSAGRTGWRWAPVPITATRLPASSTSASQFAEWNAGPWKRSRPGRRGSSGRLNWPVAQTRARARSVWPSAQRTCHSPLPASKRASSTSQWKRIFSRRRYLSAQCRR

SEQ ID NO: 24961 - protein, 373 aa, Pseudomonas aeruginosa
SAPGARRRRHSRGPADFPPRTRRRWRAAHPARPHRAAPADPPRRLPPPTARRSRALRARAGPVPGVRPGGQPGGLRTALPRPPAARRQSRGGARLRGAVPRPARPPPGARRSGRTHPRPLAEDARPLAGHADPGHGTAPHRAYPASPPGRRGQQLPPVARRGAPGPRRRAAGHRRDSPGGDRRAPRLRRGVQLQPCLQALERHDAAPVSPAATTRRDVLSRSGLIPRRQDASARCSFRRRLPAARLAVHARHPAARQRRHLRWQRENDTWVASNTHGRRTRRSRSRPKSTISATTANGRSPTPIRPPPGRRSTARCCSRPGWRSAMRVCWRNRPAWSARVSNWCARRARWAISRMKPRFVNATTRKASPCSAA

SEQ ID NO: 24962 - protein, 415 aa, Pseudomonas aeruginosa
GINRGAPRSPPCPPAAARTASRRRGAQRISAAPPQGERAHRHLIHQDRADEGAQGHAELDRAGVEADLDRRGVRAEFHQVFLDRRPRRHVEHAPEHHRAQQQRQAAGGERQQDQGQCVQEQEGDEGGRPRPAVGGASAEQRAEDAAAPVDQQDQADGRFVEGHAADQERHDVGVDGELAGHLQQRCQVGERHPAPGQRPQLLRRGDAGRAADGRQQAQEQRQAEQRDPGEQQEQATPAPELADQGAQRYAQHQRGDDAGEHQTDRSAAPFRRDNGHRQGDRHHHDDRGAGRHQQPARQQQGEARRGGAGQVGADERQQRAGQQAAALDTGAEVDQQRAEQRIDQRVQAHQQPGPALADGETGGQFVEHPGHHQFHRADHEGQSGQQPDADLRPAPFSLAHGCVPPRRWRSDSARA

SEQ ID NO: 24963 - protein, 197 aa, Pseudomonas aeruginosa
RRTRRGSGCRRSARSPPSARPGLASLRAARRLAGAAPAAGRRVARGTTHRAAAAPGGLRAGHRRGRWRASRRRRCRRCPGTAPAARRRRSRVRGCRRPRRDDARTSRRESAHRECCPASAGRAARTAGIAASRCAPAPGWPGTGPARRSAAGPGRARPSDPPASPSAGYSGLPPGPAGSPAAPTGRGPSPGRRRSAR

SEQ ID NO: 24964 - protein, 220 aa, Pseudomonas aeruginosa
SPARWGRRSPPLPRPAAPHNWPRRTRRRQAPPARRPPWPRGRRRSCVAPQALDQLAAQADVLGVLGGGLKLDDLDAGAMKGQDLFRHLADAAHQHPGEAALHGIRHPFAQGLRLQPGEPVALAVAGDLRRCRQFVEGPCQKQFESGLAVVLGDVQGRRRTVAEDHLEVLPELQPPSLLRRLLVQPALELRGLRGAGEVAGVDVGEAHRQALCLRRGAANG

SEQ ID NO: 24965 - protein, 1114 aa, Pseudomonas aeruginosa
RRARPLDRQEAAAGVLQPVELAVVVEGFAAFQGAGEDLQVLHGAPVAFVLVGEVAVAAHVGVAGADHQVYAGAPVGQAVESGQGARGNGRLGAPRSVRDGGAHARRRGQSPAGDQPGVGPGSGNGEQRAVEAVRLFQAGLLLDVEGAHRATAGVRQETRGLAGEGTVADDRGGAHAAAQFDAHGSSSLEGVGRAEVVEGAVEADLRGIGVVLVEAEVGALGRQLVGLHVEQIVGPGAQGQVAARRIAQGNVGDVLGRVLEAVEDRGRIGMLAGVVVQFGNRLAVARFAQGQAPAPVAPVGLQADLAARRGAGDPGLLLVVEQRLAVAPAMIPDQLRAIDVGAQAPVDPAPLAEPGQVAGGEVEAVGTGVGAVGHVVGADLGQSGRDADPAGAQRIDRRLSGIGGTVDDAVADLDAIGVDGQVQVRQGIEHQAEVVADRFFRLQVFGAEQPGRRRVDRQQAAGDGRRDAQACVVLLGQRRRAEAAAETGPRRYLGAEAVAAGELAVGGAAEVAVVLVARRRLQLPALVEGDGQVEIGAEHVAAPLSGGGRRLPGECLGTAVVVGPGIAGLDLVELAALLQAPGEIQRRRQPGEVEVAAQVEIVGPLGGLVARQVEGARRIAGLAVEGEVDRMVHADLRAVGTVGRTEVPVPGAEQLAATGAEGQRIVVLVAGDARGEAVRIESRRQGRQLVDLRRGHRAMGIGGEAVQLDVVVQRHAGVVGQRLAVQRRVADGRVAVVPGTLVDAGADGPRLFAELRAEVEETALAETQAAIHPAVLGQAVAIAVATVVVGEPAAVVGRLEDDVDHPGDGVRAVLRRGAVAQHLDALDGGERDGIQVDPGGAALQPAADIDVGGLVTALAVHQHQHVVGTQAAQRLRVGQRRSVVGLGLARQRGQQAHQGVAQVAAATVAQLLGADHIDRCQALAGLDIGLAGAGDHHRGQGPGGLRRRQRGIRRRGALQAEHAGGAADVFQAAALQGPLQRLLDAVGALDRRCRQALHQVLVEGDRGATLADYAQQYLGQFAGRDVEALDLGAAGGADLLCRRLAGLAKAGQADRAEHGDKSKTWRTRVGHGRFILDRLRMPPSAIARTDFQPRGRPIAHKVMPRPPEPGSARH

SEQ ID NO: 24966 - protein, 179 aa, Pseudomonas aeruginosa
ADIAACTSNTRCRQSVACAAGSRSTALIGAPPGGWRETPAGAPARRPARPREACGWRRWRRPRPARPRSSRFPADAARRRRGAPARAPGPGIAGAGRRRDRPGRRRHRRPPRPGSPRTSHGARRGRGTPGGNFPAPAGGRCRGPGPCVAGCSRGSAPDRRRSGAPAGRTAGRGGTSDRR

SEQ ID NO: 24967 - protein, 99 aa, Pseudomonas aeruginosa
PPNTSPASSTTCPRGCCYGPSNGSRRTGRKASALSLRPPSSASPSAASGWSASTPRRSTPSTPRPSTPTTRWAATAWRSSKAWSSTTCPPATTNCSPCR

SEQ ID NO: 24968 - protein, 163 aa, Pseudomonas aeruginosa
CSAMSTTRPATCTTCARSPAWSTKTAPWRSGTWPTRPARCRWTCTRPTPTTPSAAPTSTSTAAPARRPTCGSRRACASVSGNRCPAGSVIPASSPWSRATSPAKASPGSSAAPSRSPRWPWSNAAWISSPGPTCSACATSRWPSPICSSNWWKAVANASAWPW

SEQ ID NO: 24969 - protein, 224 aa, Pseudomonas aeruginosa
NGQRPRRSPPCEPGAHGEARPARPFRTGRFRFPYLFRRTKSITRRPPRLRSVVPNRTFRPAARRGRRAPVRDEVAARPAIERTASLCPVGTQTSSAMRGTRCIRPFRGSCWPPHWPPPAALPSPPKSSSSKAGTPSNAPPGTTPRSVRGCCRWPGPRRWSVRTARSACSPKTTPGASAFPCATGKAANCACRAASPSTSRTTASSPTPACAGKPASRPANPGSG

SEQ ID NO: 24970 - protein, 134 aa, Pseudomonas aeruginosa
RPMATTRRSAPTRGWPATPSPSAAPAATTSACSDRPSAPPAASASSGGLRRSPTCRSPRCSRSCSARKASWPTASPRSSTPSSPGSRPCPAPTACKRCPPDNCCWPAPPLPTARRRASPPAKSPPTRVRARTTA

SEQ ID NO: 24971 - protein, 105 aa, Pseudomonas aeruginosa
TASGPPHPTCTTVRCRRCTTCCCPRSNGRPPSTPAATSSIRAGSATSPRPARTTPSFSTPTWKATPTPATTSPASTTKASAWRCSNTSRPCEPAPPTCPIERTAR

SEQ ID NO: 24972 - protein, 148 aa, Pseudomonas aeruginosa
RSSPSPMSRVSALASAMIFTARQCTTLPTSVRLTPAGPRTNSASPMCTSSAWICRDSDGCETCSTSAAWPMLPYSATQAKYISWRNEGIAFDQLMIGKLASVTDIAYIPLAGNTGRIGTDRETPGRRDERPPAAFIRKPFRGRRTKDR

SEQ ID NO: 24973 - protein, 406 aa, Pseudomonas aeruginosa
WRIAEARRPRTSGRACAVCWARCAVKSSRFFLQGNRTRPSYLAHSSRYPRPLHLSSTNGISRAYASSNHQCGNCRADGTECGLVVWFRHSRQRPQLHRLQPQRTGRRKRLARLHRLPVQDRRRLPPGPSRHRRGLRGGHPGVPPTGPRSHHRQPPDQRSGLPPHRPAGRGHRPFAAGRTPLPGARTRMGDEARHLRVPPWLRPRPGWRGTLRGSPAARPGGPFRRRRSRCPRRRRCGRDHGRAGGAHRRARGGGRRNRHRGRMRRARAAAGGGNGSARGWGASRVRGESGAVRQGSGCRGHRRLRRQRQSSSRGACRPGADAPPRAARRRRHGQRQPSVSRRRRGILHAPEPLPPRRTRAGTGIGQGPQPVAAPPGAARTPGRRRGRGQRQRGAHPGRRHHSPTRG

SEQ ID NO: 24974 - protein, 270 aa, Pseudomonas aeruginosa
SPRGYGYRARYRQRYRASATGRAGHPGRPRRHGPATEPAEAGSAQAAGVAGVAPDATAREGAAIAGKGKAAPAVAQAPAGRPPGAGAGNRAEQPSPRRAQRGPATTRGKRRSPRAQQRAASRSTADRAGTPRRVAQPAEPAPGRTGKARSQRPTAQPGTRRALQEAGKRPREVGADRQGFQRDRTVQYRSARHQSYRVEAPGRERSRTGIRFSSGKRARRRYWPAPFFIRPAAPGRSPSGRGAAGQFTGAQSSCAPDSAGRRTHSGNSKS

SEQ ID NO: 24975 - protein, 915 aa, Pseudomonas aeruginosa
QTITAIRPKRVATTGAVPGTRPWEGRSVGKRRREGNQSGQIISSAFSEPYAGRSLNRGPPRHRVRPSDARSRPARSMAFGGNLWRLGLPRLALQQIAQALRIQRSAEQEPLQFVALLVAQDVHLPFGLHALGGDPQVQGVAEIDDGLHDRTVAPGLLHAGDEALVDLDAVEGIGAQVAERGIAGTEVVHVEADAQLLEGRHGPQRAIDIVEHDVLGDFQLQPASIQAGQAQGLAHLPDDIAGHELRRRHVHRDHHLAWPAGGGGAGLAQHPVADLHDQVAFFRQADELVRADQPAARMVPADQRLRRGDRLFLRQETRLVVQLELAVLQGGAQLGLAQLLLGEMGVHRFQVETPGIAPRGLGLVHRHVGATQQAPRIAAVLRRQGHADARADMEAVPFVGDLAVDHVDQPATELLDFQLRRHVGTDHHELVAAEPGNHVLVAGRGAQPFGDGVEHRIAGGMAVLVVDRLEAVEVEHQYRYRRLASLFRQQAFEELEQLVAVRQAGQGIVQGQMLDLRMGFDLVGDVGRRAAIAAGDAVADRAGAQLADPRLALAVAESADQAGRRTGIGQPFQPLDDVHRIAIQQLVQPPPDPGLRLVAGDVAEAHGEIGEDEMPVDFPDPVRGRLGYRLETFLAGQQGLVAAFQDLLLAIHRAGVEHGAAAQPEQQPGGEHEDSQQRQRGLPQHGATRTRRHPGQAMGSALQGKAFLVARRAAGQQVQVGDAVVAAELGQLRRGQPVDEDHHRGLGQVDGRMIAGGLDRRGDQDRRCAVEVDVAADRRFVHRGTACGAEDVPGVGVQRVGQRAFGKLALEHGVASATVVDDEDAVVAVGGVEHRAEVVLGEGPVHVDPVSQIDVSIGPEGIGGGELLGIFPAILQRLFHVEMALLDGDVVLVPGDVQDRPAACTEGEEKGGQEH

SEQ ID NO: 24976 - protein, 109 aa, Pseudomonas aeruginosa
  UNSURE (41): Identity of amino acid at the above locations are unknown.
LSIQGASKTPLGKRIGAEDAAAAPAKARAAAGLGGARRLSXALPGDDRLGHAGRYLGIADELHRVARAPLGHRAHVGGIAEHFAQRDLGTDHLCPPGYPPCPGSGHAGG

SEQ ID NO: 24977 - protein, 903 aa, Pseudomonas aeruginosa
AVPGKSPGSTDIPGHTGTRDAPTMHRSLHTDAPLGAALLLALQLAPGSAAAAEEQAPVDPPTVQLQRIEVTGSAIRRVDAETAVPISVLRAEELRQQGVTSTEELIGRLSGNQGVYNSSRSVGSATGGASFADLRGIGANKTLVLLNGRRLANNAIDGSAVDLNTIPFAAIDRVEVLRDGASALYGTDAIGGVINFITRKSLNEGRFDSGYASPTHDGGGNQRNVSASWGFGELEEDRFNVFAVANYDKQERLGAKDRGYTYNYQPGRGLDYSSGTAFPGNWSQGANASNPLAAGGCKGADLIPRNGICRQSLWRYLDLVPETEKTSVFSRATGKLADEHNVSLEYFWSRNDNATQVGPGTLTGLQIDPGTAFYPGNGITPGPGGFVLDPSRPVEVNWRQSVLGPRLQSSQNTGQRLLLGFDGQFAGWDYDIGASYNQNKVVDHIHSGYVDDRAAALGIANGTLNPFGPQTDAGLAYLGSHALSGDFRTSVGRVKGLDARASREIGDWFGAGPAALALGGEFRKEAFHQDIQDFAGNVQSLGVDPAATVSGERNLKAQYAELNVPVLDSLELSAAIRHDKYSDFGSTSNPKYSFRFQPFRQLVLRGAYSEGFRAPSLYELYNPTFTTYTSANYDDPRLCAGGQPSQGGIANRDCAQQFYNATGGNTDLRPETARNVTLGLVYQPLRDLSVGLDFWWIRIANQIAEFPEAAIFADPQAYAGRIVRKADGSIDHVVTGLANLGKVKTSGVDLSLDYRFPASRYGQFGLDLQGTYVSRYDFQQQIGGQYLDNVGDFQGVGVIARWKHVANATWSRDAWQATLSNRYTSGYNDYDRASHGKVGSWNLWDLAGSYRLSHALGLTLGVKNLFDREPPFSNQTYTFQSGYDPRYTDPYGRILFGRLSYSF

SEQ ID NO: 24978 - protein, 149 aa, Pseudomonas aeruginosa
SFSGSPTTTCPAPAWCATAGSSPPPARSASPARRTTRPGRAAPSTMCSARPASTWPTSTASPTAGTPGSTPGGTSTSTWTGSSRKPASVPRACRTCASGSPTRWPTTRPSAANSMPSSAPTGCAARSSTSTITNATPSARSSARRSTRR

SEQ ID NO: 24979 - protein, 455 aa, Pseudomonas aeruginosa
STPPSTATRNRSSAPRRTPSARWRTGWSTWWCWASPCWSGARARTPSPGRASSEAQTAANRHGDAGTGMYLIFSGYFAAEGLIYPFWPTWLASLGFGASQIGLLIAAAYWPQVIAGVALTYVADWRIDQLRLATLLAALAGACALLFQLAEGLPLFIALSVLYGAFWTSVLPLTESYLLKRDKAALQNYGRVRAVGSLAFILTATLGGLLLGRFGQQLVPALVGLTMLLTALACLFLRRRSLRRPDSPLPGARRRPDLRGILRQRPLLLAIAAAGMIQLSHSLYFTTASLGWQTLGYSSFSVGAFWGLAVIAEISFFAVSNRILDRHPALQVMLFSSLCAALRWGLLAGSEHLAAILLGQCLHALSFAAYHAAVMRYIRDHAPESARVLTQGIYYSLAVALPMGLASPAAGWLYEGLPQWSYLIMALFALGGAVLVWLALQSARDASTSVFSRSV

SEQ ID NO: 24980 - protein, 434 aa, Pseudomonas aeruginosa
  UNSURE (98): Identity of amino acid at the above locations are unknown.
HGRRPDQLPRSHRRGLEPGRRRTGRGARPGLPARPRARSPGRLHPGLSVRPPADGAPADPQATGRCAGGRRRLSPAARRRRGDPPVALAGRALGAGHXQLAGTHLPRAAPARPARGVPHPGQPRRRGPRQAGSGWLSPGRGQARRGTVALPGVRRLPQRRAGRLCRRRDLRGDRRGERPARRRRALVGPGFPRATDRPRRRPAVLPASAPRHDRQREERWRPMSPTLQDARLLWDFLGQGRCHVPCELLVVCGSYDLRVCDHACELLERGLAERLLFTGNTGHWTRHLWVEPEAELFARHARARGVSDSLIVIEPRATNFAENIAFARELFPDLRRTTFVTKPNSIRRVALTLPVRWPGLEGHVDAPDYAFPDGISNLVGVLGVIDEMVGDLDRIMRYPALGFQVACPIPAQVMDAWERLVARGFDRHLVNPPR

SEQ ID NO: 24981 - protein, 400 aa, Pseudomonas aeruginosa
ADSTVIFPTACRQARAARVSASPHRPGGAATSRLRRLAQSVLPPAWKPADAQNFATHLRQRPRRHRSARRTGSLARPGLGPGRGGPAEPARRRQFRPVHRRDPGEPQRLAGHRHDHQRFAARPDPALARRRQRDPAGAQPPRRGHLDPLARHHPAGQHGWRAGPQLRGHRSWRSLRIPLQGPAERHLLVPQPLGATGAGRGLRRPGDRRPRAGTVQLRPRLRGAAQRLVGREAAAHPRQAEEAVRLLQLPQAHRRRLHRRRQRQRLGRDPGRPQDVGRDEDESHRSRRRQRLHLYLPAQRTAAGRQLDRPVPPRRKAPPALRQRLGDELFRRPHSRPEDDRGGRRRTARRAGQRRRVAHRRGRDLRRDRRTGRRARLYPLRPVHGPQRLRPRHPGAGRRA

SEQ ID NO: 24982 - protein, 613 aa, Pseudomonas aeruginosa
RAGADARSAPADRHGRHGHGRHGPRRHGAWRGDEARQRDGPFEDVGHGHEGHGPFEDGRHGHERHGPLQDGRHGPLQDGHGRHADAVPSGFGGRQPAGRHADHDADTEARRPRPRPARQRAAGADLRRPAQPLRRPGRPRAGAHHRAAPDRTHGEVRLVLRRHQVLRRRAAAPDLRRAPADRPGQRHHDDPPDPPARHVERPGGRARQFPGAQAHHRHAAGHPPQLPGHRRRPGTLGLSLPPAVPHGDGHVPRSAGRRRRQRMSRQPKPARLAAGALALGLLLGLPNPVEAARDNGMDHSAMDHGAMPGMDHGQRTSAPAKPMDHQGMGHGRMPGMDHGAASPAPAQPMEHQGMDHGRMPGMSRAARQPPAQAAPSQSRTPIPVPTEADRRAAFPPLEGHKVHDSALNSFFLLDQLEYQDADDGSALAWDASGWIGGDINRLWLRSEGERLDGKTEDAEVQALFGHAIGPWWDLVAGVRQDFKPGSPQTWAAFGVQGLALYDFEAEVTAFLGENGQSALRLEGEYDILLTNRLILQPSAEVNLYGRNDPARGIGSGLADSELGLRLRYEIRREFAPYIGVTWNRSYGNSADLARAEGEDDDEARFVAGIRMWF

SEQ ID NO: 24983 - protein, 573 aa, Pseudomonas aeruginosa
EKRRGVWKEPFGTSLESAWFPASDSQPGHPQMLFQAQRGYRSEQLAGIGVARLAEQRSGAALLHHPAVLEHQDVVGQGAYHGQVVADEQVAQPVATLQPTQQLDHLALHATVERRGRFVEQDQRRLQHQRAGDGDALALAAGKLVGIAFQARLVETDLAQCLQHPRAAFAGIADAMDTQAFADDLFHAKARVEAAVGVLEHRLELPAQWQQALAVQPVEALALEQDLPFGRQQAQQRLAEGGLARTAFADDPQGAATAQPQADLVHRAQSRAPAQPAAGRGVVEAQRAHLQAGLAARHRLRQPTRLGLDQQARVGMPGRAEQRLAGVLLDDLAIAHHADPIGDPAHQVEVVADQQDRHAQPSLQALQQLQEAFLHGDVESRGRFVGDQQLRLASQRHGQHHSLSLAAGELVRIGLEQASRLLEAGQFEQFQYPPAQRGATQAAMQAQALADLAADALQWIERGHRLLEHHADALPTNRQQCLRRQGEQFLAVQAHAAAQARRARQQAQQGVGGLRLAGAGLANQGQGLAGAQAEVDPLHDLRVAIGDAQVFHSQQFPVHLMSSDRRRRAPLRR

SEQ ID NO: 24984 - protein, 515 aa, Pseudomonas aeruginosa
PPMSLRLPARRGPLADFPPGVQPQAVARRLRRSAEAIPAGDPDLVGIPGRDQVVAPLQHPVEGAHGGFQGGPRVGLDHRLDQPVDGRVLQADAVVAAGIGVAGGMPEAVLLVARRIGLGEARNDHVVVPRTYALDVLRSVHLAQAHIDADPRQVALERQQRALQALALEQEVEAQRPSGGIQQAPVDGMPAGLAEQAVGLHQALVDIAAAVVHRRSVGLAEDLLGDLPAQRLQQGQFVGAGQAASGHLRVVEIAAQALVATAEELPVGPFEVEQQAQRLAYPAVLEQRPAQVEHQALEAGRVRVGKALLAQPAIAQGRRVVAAAPGLDAGLDIDVGLPGLERLQGHAAVAVVVETDPLEVVQATPDRQVASPPVGVAPVAHRTPRLGLLQPVRSAAQRRLHAAAVEVASLPPMPGQHVELGQHQRQLAVAGMTEIEADAQAILHHRLADLLVVGAPERAALLDQAIEGKLHVLGGDRHAVAEARPRIDMETHPAVVRGFLDVARQVAVFGERLVQ

SEQ ID NO: 24985 - protein, 400 aa, Pseudomonas aeruginosa
LEAEGFVDQRGLGHADRRAAVGEGVQRVEAAAFHPPQAAALGRLRVDEVEVLETRRIFRRLVVERDGMARLAAGQAGEQAASEDQDASGHGSTTEVIAEVQPPLAAHGVVVAGGIVRPAIGVVLLDLVEQVVHRQADAGAFVEPVAGAGVEHRPRAQAPAASGVGNAAVAHREERRGELCVVPGQAGVEFAAPVVGVEAVALVLAGVVVGLLVVVGQHQGVAEGRGEGAVVTGAPADVAAQVDAAGALLGRVDGIDVDLVQAIRIDAGVAGVALDPRQGVAALRRVRIEPAATAGRLVAQQFVRIEGGQQVIDLDVVVVGGKVEPARRRPDEAVAPVAPALGLQVGRAALHVVDPAVLAGAVDAFLATVVVLLRRVVAVGVGLVDVVQVRRAEAGAVAAA

SEQ ID NO: 24986 - protein, 333 aa, Pseudomonas aeruginosa
GEWPLAAIRRSEHGVIRPAALGSVRQRPAPVRALQFLVKRADLQRALPRRRVDQRHRAQRRFEGLEDAYQSTPADRLLGHEAHHLDDALADQRRVDQRVGHVQHQVAAHRQAQRLAVALELPFQQLAGVQVAHRRAVVPGELLQALRRAVTAQVFRRRHRDPAQRRQWPGDQAHVADPTETHGGVEAFLGEVDQAIGHRRLDLQLRVAPRQFAQHRHDHDPPERLRGGDLQRTARRALAVHQQLLDFLQFRQQGCAALVEQLAVRGQADAAGGAVQQTHAEFGFQPADGARQAGLGQTERNGGLGEATGLGHAGEQLDGIQVHGDLIDDYFHQ

SEQ ID NO: 24987 - protein, 165 aa, Pseudomonas aeruginosa
SGWLSISTAPGSLKAHAKVQAIVDQRRLQGVLGQLLEAQLDARIALIERIHQGAHQIAGEGRRHAQAQAAATEVAHLVDRPLRRFQLAQGTPRMKQVQLAGIGGTHAPAGAVEQLHAQLLFQLPHLLRQGRLRNVQRLGGAGEVAMLGDSEQVAQVAKQHGNIQL

SEQ ID NO: 24988 - protein, 252 aa, Pseudomonas aeruginosa
TRPMTGIINRSWTLWLNPRILAPPFDGQEPSAMRDIIDGFLRFQRDAYPARSQLFKSLATRQAPKALFIACSDSRVVPELLTQREPGELFVIRNAGNIVPGYGPQPGGVSASVEYAVAVLGVGDIVVCGHSDCGAMGAIASCACLDQLPAVAGWLHHAEAARAMNSAHEHASEAARLDALVRHNVIAQVANLRTHPCVARALEQGRLNLHGWVYDIESGRIDALDGASRRFVSLAEHPEVRAVGGEPGQAVA

SEQ ID NO: 24989 - protein, 169 aa, Pseudomonas aeruginosa
IPSLTTTRKESHLMQHSQVSPNARQQLAETVVLNKARLGLSWQDLADGTGLALTLVTAALLGQHALPEAAARKVAAQLGLDDDAVLLLQSIPLRGSIPGGIPSDPTIYRFYEMLQVYGSALKALVHEQFGDGIISAINFKLDIKKVEDPEGGSRAVITLDGKYLPTKPF

SEQ ID NO: 24990 - protein, 183 aa, Pseudomonas aeruginosa
RSPAPGPGRSPAAPRRARTPGVLAGHVMPDDHRTDPRQRRRGGASDPPRGRNPLGHPHRHPCLAAPAGCRARPAVALRPPGRLRPAPGRRRPGARGNRRMGAASALPRSPARQPGAQATSRPVAPRLLPQAASPGGRWPAAGRPAAGGKPAAGRKPPGVADDERRPGLRRRRRPGRCWWPSMG

SEQ ID NO: 24991 - protein, 93 aa, Pseudomonas aeruginosa
AMPFRVTGAVRRCCCRSAPRTCGAIPAIARRWPPSARTKPSITTPRKTGRACASPVAIAATWPRSTRARGNTAMPCSSRCSRPCARPGSATAT

SEQ ID NO: 24992 - protein, 915 aa, Pseudomonas aeruginosa
RAGAQLRDPQSLVRHRPAGRTGQGWRLPLSLSGSAEDQLAQPRRDQQRRVRQADRAEPRLRRATAPGGQAGQASLSDPRPLRRARPAAPAGDPSTRPRSPPGRAPVHRNAPCAPGRRRTPAFRWRACRLHLPIEPQPGFERTPLPAQRVVEAQPPGQQLERPQVVVGAALGVQQLGIEPIVLDTRAECREVHAQLVLLAGHRIQPVAPPAAVALDDLDARLAVRLALAFAHAEERLAGHQAGPAQQREVQLRQGRSDRFVALVDAPLAEQRLVAPAAAGIGREQHQPGGMPVDPVQRHQVAIAGAAGQPRQERLLDVAAGRHHRQEVRLVRHQQMLVAVQDARLERNRCLHRQLAEIVHTQAFAICRLRAQRTPLGVQHPAPLHARQPGVPVDGRETRAETVEHGAPGTGRQMQGAGAETGVGQGRRRHAATREGRATIRPQRGAQVKARRGETKKPPEGGFFRDPGIESGGARLALFRLAGGCGEQHVGRGVQRGLRGVLEDRDDEAYRHHLHRHLAGNPEQAAGQRDQQQRTASHAGRAAGADRRHHAEQDRGRYVHGDAQGMHRCQGQHGDGDRRASHVDGRAQRDRYRIGVFVQAKALAELQVDRDIGCRAAGEERGHAAFAQAGQHQRIGIAADLQEHDQRVDHEGHEQHAAEQHHQQVGIAFQGLDAGLGEGRGDQAEDAQRGEANHHLDDQRDAVGQLGEQVAGGIAGVAESDAEADGPGQDADEVGRDQGVDRVVHHAQQQGLEHLGDAARRRHLARMAGQHQARGEGEAGDHRHHRGAEGADQVQQHDRPDMGLLALPVVGDGCHHQDEHQYRRDGLQRGNEDLADEADLERGGREEAGEQQAGDQADDDLAHQAGTRQQMKQGTFRVCHADFYSYRCVEGRPRQLPCRTTLCRSAPAKGWFERAG

SEQ ID NO: 24993 - protein, 146 aa, Pseudomonas aeruginosa
GTCEAGFVLRWGEDSTWVCLPRFLLFLMHSKGRRTGGNRRLAAVYLQQGWEPRRKNGGLSPPLLPLSPPLSFSLPFPPPPPLPLSSPSPFPSPPFLSLSFLFFSSLPLLSPLLPPPPLFLSLSPSPLLPFPFLPSPSLPPPPLPPA

SEQ ID NO: 24994 - protein, 586 aa, Pseudomonas aeruginosa
RQEGEGEEEERERGGRGRGGGERGRGRGREEEGGEEEKEGGGRKRRGRRGRGRGGRGKGRERKGGGGGGEGRGGKKKEGEIGGGGEEKAPRSSVEVPTLAEGRRRQACGFRPSAFLCCALEKEEIEASIPMSNPPPTAERTQLRKSLKLWQIVMIGLAYLTPMTVFDTFGIVSGISQGHVPTAYLVALAGVLFTAISYGKLVRQFPTAGSAYTYAQRAINPHVGFMVGWSSLLDYLFLPMINALLAKIYLTALFPEVAPWIWVVMFVLIMTLINIKSVNLVANFNTVFVLVQLAIIVVFIGLVIHGLNNGEGTATVLSTQPFFSEHAHLSAMVAGATILCFSFLGFDAVTTLSEETRDAGRVIPRAIFLTALYGGVIFITVSYFLQSYFPTNVRFKEPDAALPEIALYVGGKLFQSIFLCATFINTLASGLASQASVSRLLYVMGRDNVLPERIFGFVHPKWRTPSINVLIVGMVALSAISFDLVTATALINFGALVAFTFVNLSVIVHFYVRGGRNRSLKEHFHYLVLPLLGAAIVAVLWLNLESTSLVMGLIWAGLGFGYLFYLTRSFSRPPPRFQESELSPTQ

SEQ ID NO: 24995 - protein, 427 aa, Pseudomonas aeruginosa
TSPASSADAYQPGGPDHRRPDRRPAARQLLPGRRAQGRLHRQGLRFRAEGRRAGTGVRPGDGIHRQPQARPADPYPADRAAVPGRHLQRRGGGGDRQLRLPLEPGAGQPSGRDVASGRHRRGAPVPAAERGGQPGQRPDLGQLHRHPGLGHRPRHRFPPRQRYHPQPALRAVQRRLADRQGGDSLRPAGHLRPGRLDLRRVRRRGPERLCPPAGGVARLHAVRGLRGQPADRVPEDPPQSLSAGADLPARKRHDRVLHPQLGSQYPGQPAALRAPWPARRHLFGIDPAGRDHQHGWRGDHHHRADPGSGAYPGHRRGRTDRDPAQRGGVDLRLRRVRRGWRFAAADPAGLQPVRDSQRGGDAGGGGRLHHRDPPGLRGDRAELLDRRAVHRSRLRGGRAQGERRLIRSLGHGRNRLRAVSSFRPGVL

SEQ ID NO: 24996 - protein, 344 aa, Pseudomonas aeruginosa
WSPVLPELPHVVSFLARRQSPRQHPASAGRSLEHRARLSLRAFPGHRPGHLAGAHAAGPGAGRRGACAGPAGGISRRPACALFPRVAGGGTDSFRGAHPVPRRASAGGGQAALPAGDAGRRLRRADAPGAAGPQHRQSRPGAAAPDRPAYRRAGAVLDQSRQPRALPGAVPRAAHRQVLRSDRSGLAATGLPVVAQDPPGARRAVLPHARRRGRAEQRDAHRGRRAQRPLVALPAVSGDRQEAPAARAPRGTRRGYPERWVLSRAAGRRGQPRRLPAAAQAAGQGAALRRPAERGEAYVRIRAAARLAGVGDRLASGMLAYVADPERMARFYEQALGLEGCAGE

SEQ ID NO: 24997 - protein, 495 aa, Pseudomonas aeruginosa
KDRPLVRLDAPAGAGAGRSGTLVQLDHQAQLLDATAALLDQLAELGAVDLVVVEPTGLLHFPITIVVAAILGRFGLQVDVEPGTADLATVRRLVSLAAGQADVVGRDLRFAQVQLGQLAFATVLGEGIPLAGQVLAVVEILSAEPVEGAAVGKPGTDRIAGRQHELAVVALQHAVAAFLGEVAAQVLVGAGAAALAIGDAELHQRRVGKLHARLDPGFAVMGVMLAAGHAQGVAGRFQGNLVAPHLAVGAQHQRPALLDVGHGAAGSEHRVGRVQPPGLAVHLGADDGMVRRVHAGHQQVPDHVAAADQGRFGLDPGGLEHGGEEDRQVLAVAVAIALDLRQGEGHVAALAGAPVAQVAVGVVDVLHQAGDLLAGRLALHRGDGRRGALGQLRGEDLVVARGERAEVVLQVQRTAQLQARGMAQVGVAGFVDVVGVLRLFQADLEGLLVGALFDAIGVHQLAAHEDRPLGLELGDEAVVAHRHRRAAEDVVELGA

SEQ ID NO: 24998 - protein, 228 aa, Pseudomonas aeruginosa
YSFLRSGFCGILPSAQARRPAIAVCGRDTCNPTSAPPPADQGFACHPDARWRRPVARECGMGMDQTRNRLVGLMFQNDYSWLSGRLRRYLGCPHSAEDIASETFLKVLALPDPASIREPRALLTTIARRLMYDGWRRQDLERAYLESLAGLPEALAPSAEEQAQVVETLLRLERMLAGLSSKARAAFIHSQIGGLTYVEIAGLLEVSVSRIHQYMVEGFKQCYQVLAE

SEQ ID NO: 24999 - protein, 247 aa, Pseudomonas aeruginosa
SEPSRRRPPVAGFSSAASPLAAFGVATLALGRIGIVGFPWPGDLYTGTGQRQSFRLEDGSQLVLDARSRVRPEFDGYRRRLRLREGRLLVDVARDPARPFVVDTGRGQVEAQGTRFQVSDDGASSRVVVLESRVRITTADGRQCLLERGQSARFDASAIIARGPAEGGESAWLDGRLEVRDRPLGEVLEALRAYRRGIISVADDAAALRVSGIYPLDDSGAALALLEQSLPIRLDYHGPYWVSIASR

SEQ ID NO: 25000 - protein, 147 aa, Pseudomonas aeruginosa
GKGFRRPPARVRRLPRALRDARRGRRSAGWRRRGRRCGRFRCRRPSRAGSADPAPGRGRRRGGCAGWPLGRSRCAAPGRPAAPPRRRVRGRCSSPVRPRRGATSRPPPAAGRDRRRKRWRPSRRSPSGRRPRCRRPRAPPPRIPPRR

SEQ ID NO: 25001 - protein, 209 aa, Pseudomonas aeruginosa
RCSGARAATPVPRAWPSRPWRWNSAPSWATPERDQPRLGCNAAGSSRRSRKARAAPNRASRALSAVTHSMPRAWLASRLAASAPRTWALASATSRARPSAPPICWVIEAIPEATPCSAGSTPLAALTHMAVQVMPWPTLRITMAGSSARKPRPSGRHAASRPSPSAPSSRPATSVARAPWRASRRSATRIPRVQSRVAGRNARPVCNTL

SEQ ID NO: 25002 - protein, 291 aa, Pseudomonas aeruginosa
LHPGRRFSRSDPVRPVARHRPAGSRTRRASAAPHHPQRQPDPGRPAVLRALRTLAGGTGGSREVAGGPPVRAERSAEDHHPAGARADRDHAGAARTDAALPAIADRGGDDRSPGRPHRGRLRRRRASRSGRRRAPDRPAIGGVALGHGGVAGIPAQSRHAGAPGATRRAQLPDGARPAHRQAAGMAVPARRPAAEPGGARRPGAGRGRRAGRRGAGRPGHRPGDGLHGRGGDPPASTGTHPPALRTAAVPGVADLPAVAAVLAEDRRALRGTEERALVRGADVLTRGRQGG

SEQ ID NO: 25003 - protein, 656 aa, Pseudomonas aeruginosa
FPPRRCARPYRRRKCNRWPAKAEQTLERVVVTGSRIPRAQQGRAVAGHGDQQRGNPEPWLPQRLRCLADADPEHRHDPGRGLRQHLATGGQRPQPARSRPQPHAGADQRPARRRLPDRLWRLGELHQPGEHPGGHDRPHRDPQRRRLGHLRLGCHRRGGQYRPEEEIRWRRRQPARRHHRARRRRQPAPATGRRRRDGRLRRPVRPAGRAAPAGLGQPARFHGQLPGRQQRRLPAEPAERTLPRRRLLRRPRRPVRRQRGAGAGRQGWLSLHDRPVLQQLLDPTDQEGKLRRLRRRHLAPERQRQAVRRPAVRLRPPAEQYPRAVLHLAGLHQCLQRRPGALVPAVLARGDRRQEQQQQQVARGVLDRHPRLQRPRRQYFLGIRTGRDPLRVPQRPHYPLHPGGRDPRPVPGPQARRTRRLPGLRSRSGAPRTSAERGRVAQPAAQRDPAQRVLLADLQLHRQRRAVRPAGRPGGLRRRAGGGQAGLQDPSRLAIQRRLSLQRLQGQQLRRLARPLRRRRRIQHPAARHAAGVRRRPLGPVQVQRSHRGADHLQPGAGVAPADQPAATRQLRHQLPRAGPELHLPGRRQRLLPGAEGLLRLRERRRRRLQERPGRLRAERHARPEVRARALLELRLRLVAVEQVRLFRRLLPHPDR

SEQ ID NO: 25004 - protein, 472 aa, Pseudomonas aeruginosa
PGRAGQPVLARLLQGGPRAGGGGSPAHPLRFPSCRQPRAAAGAGPALRAAQALVAGTRLQPQQHAAAAGQRTLPAGEGRGGAFGELPAQPRLVGSRPAGRAWPVQLRADPFRLLPRQRRGLAGVQGRAGRHQCRDQRQGLEQRLRLAGPARWPVAPGELSLPVPGQPPGPGVQPAPAAVRGPPGTPGAEPVVRLRMDQPAALRRSLQAPAQLFRQLGDGRSRPARRRRTGLAGAAARANPRGGLRPGLRSAGERRQRRYPRAPGAGLPPARRGRLACRRRAPAGYRRTAAALRPPAPGQGPGARAAAVPAQPGADRHRYAPAPGGRFAIHRAHTCAGLRHDRFELLPVQFAGQRAVQLLAFLQLRRSRRLQPHRPEGPGHRPAGPGGGRGRLAGRPGNRRARPRPGAAMGLLPDPDLVCRRGLDRQLESLRPTAAGAALQPGAEHLVGSPRAGRAEPGGAVTWAATCCAAWR

SEQ ID NO: 25005 - protein, 361 aa, Pseudomonas aeruginosa
SWPATWPTAWSTRASTSPRGDSEMAIVLSPLHRRRLAAFRANRRGRLALRLFLALFVTCLFAELIANDRPLLLEYRGQWFLPVLRDYPETAFGGELPFPPDYRGRFMSERIARDGWALWPPIRFDARSINYARPAPAPPSAENWLGTDDQGRDVLARVIYGLRLSILFALGLTLASSLLGICAGAVQGYYGGWIDLFGQRFIEVWSGLPMLYLLIILASLVQPGVGWLLAIMLLFSWTSLVDVVRAEFLRGRHLEYVKAARTLGLGDAGVMFRHILPNAMVATLTFLPFLLCGAVTTLTALDFLGFGLPPGSPSLGELVGQGRDNLQAPWLGLTVFVVLATLLSLLVFIGEAVRDAFDPRT

SEQ ID NO: 25006 - protein, 371 aa, Pseudomonas aeruginosa
DEPGTVASGKPERRLWRHAGREGDRLQPARRRDPGPGWRVRLRQVADRPRPAAPAAGRGAPGRQRAPGRRGTARPVAAGIAGDSWAAHRHGVPGADDLAQSIAAHRPPGRRGPAPASPPAWRRAARAGTGTARTGRPRAAATPARGLSAPALRRPATASDAGHGAGLRAATADRRRTDHGSRRHRAETPPGAAAKLAATAGHGDPADQPRPQPGAPGRRSGLRDARWPDRRGERLRDAVPLAPASLHAPADRGRAGWAGGAGGVPRDLPGGARAEPRLPRARRLAAPARGTARGARGQPAAAPWQHPGDRRRKRFGQVLPRPGAAAPVAGRRADPVPGRAPRPAARQAPVAIAPAVPGGVPGPLRQPQPAP

SEQ ID NO: 25007 - protein, 136 aa, Pseudomonas aeruginosa
RAVPGGRAAASVAASPRAELPVHQPRPGRGTRPGPRHPGAQGRPGGGAGQRRCAVQPAAPPLYPRVARSDTRAAPGRASAGGRAGNLRRETMLTLRMFRKVLSRRPGAFLKIGLRARQGQGAMSASGSVRSIGGMR

SEQ ID NO: 25008 - protein, 459 aa, Pseudomonas aeruginosa
PRSGYSPCGSRGFSSLPPFPGNVRLADHPGWVSCVAIPIHRRRKSGFACVSPMDDLSPDSALPPAGSAQDNDAPRQLVVCIDGTSNRFGDQPTNVVRLYRSLSRDPRRVLAYYDQGVGTFGLKETLFEWQKFPSRIAGLAFGWGLKRNVEGAYRFLAEHYRPGDQIFLFGFSRGAYAVRVLAAMLRAVGLIDAHQPHLFDYAWTLLTTRMPPRDEDKRAGTRRRGPDFGLLGRFRKVFGRQVKVHFLGLFDTVTSVGWVYDPLTVPYSSNNEMVDVVRQALAIDECRCFFRQNLWFGEKDRKSDVLQVWFPGMHSDVGGGYAPKDSRLALVAFTWMLGEALEAGLHVDPARSRDQLRARSKQGPDPTAPILPVMTRPWRLAEWLPLLVWDRRSGNRAWRWSRGRPRSRPLEPVGQETRVKLHRSVQRRLDECPDYRPCNLPALERCDLIDDSPLLDGYR

SEQ ID NO: 25009 - protein, 644 aa, Pseudomonas aeruginosa
CRRRSSRWRPRPARYRRRRPGIPTGRAGRSCSARCRAPCAPPAAERRHGGRPRSAPGSAYGSGWARPAPEVAAQRGSSPASGHGPFPGAPWAVPGRAMRRRGPSPASGHAPSPGGPWVSPGRRSSGRGPCQASRRGPWPSGPCHCPARPRRDSAGPAADPGRGHRRPGGRVSAGGSCVVSFVYPHFAEHAHLHVEQQVAVIGPASQGVGGDPVAAAGARRHVDGVLAHQEIALLVLQVAPHAVQVDRVGHHGVVDQDDPQALAVGQAQRLGVGELDAVEGPGELLHVSGQVQLDGAPRLAAVRVGEAAAQVGVGQHPPPVVAQAEAGVGELRCRRHGLHVDQRVAVLRSRMGLHRHGAHAHPGVVHAGHLGVVHAVHVHAGHLRMVHALHVHARHLRMVHLAGGPRRRAMPHGAVVHAAHAHVVHADQRARIGRRHRRAKPFGQRQGAAGVTAAVHGLGEEGIGALAARFDDHVVGLGHGDAQLVDADRLDVLSVGGHHGHLQAGNADVEIAHRRGVDEAQAELFAGAEQAGPVAVRRLSVEQVGIGVAADVGEIGGTHLHLGPHLAVGQGRGPAVGADVVDEVADGALVEVVVVGLLLQLGEDALRLLVRPVAEQHHVVAVVAERFRLAGVDHQGAVDPGLLL

SEQ ID NO: 25010 - protein, 205 aa, Pseudomonas aeruginosa
TGAGPRPAGTAGRRRRPGPPAGSPGATGRCASRPRRSAPPRRSPAASRPRRSTGRSGWRRSPGWPARSARTDRSAPRRRSSRKRSGTCRFPRRRAGSLRFAPHSKRALAKAFSPLRQTSRDSPSTTRSTIPSSSAPRASCGAQTIGSSWRLKEVLISAGWPLRACQACSRACMNGSACGRMICGRAVPSTCTTAGQRSRKSAWQS

SEQ ID NO: 25011 - protein, 900 aa, Pseudomonas aeruginosa
  UNSURE (857): Identity of amino acid at the above locations are unknown.
SAPRFPHRPGGSRCRSPRFVATGPWAGRQAPVPPPRRRCRERAAGPAAGRRPAARRCGAIGAWSGHPLFRCVQGCPSSRGIFQGRLRPLRHEFMSAGNKPCRRAFRRRAGAAEPVPSAEVEKQASRRCCGVLSSATFFFQQSFPSSRAAPKGQIMARTTPIELYRNIGIVAHVDAGKTTTTERILFYTGVNHKMGEVHDGAATMDWMVQEQERGITITSAATTAFWQGSTKQFPHRYRFNIIDTPGHVDFTIEVERSLRVLDGAVVVFSGADGVEPQSETVWRQANKYHVPRLAYVNKMDRQGADFLRVVAQIKQRLGHVPVPIQLAIGAEENFSGQIDLVKMKAIYWNDDDQGTSYREEEIPAELRALAEEWRAHMVEAAAEANDELMNKYLEGEELSIEEIKAGVRQRTLANQIVPAVLGSSFKNKGVPLVLDAVIDYLPAPSEIPAIRGTDPDDEEKHDERHADDDEPFSALAFKIATDPFVGTLTFARVYSGVLTSGDAVLNSVKGKKERVGRMVQMHANQRDEIKEVRAGDIAALIGMKDVTTGDTLCAIDKPIILERMDFPDPVISVAVEPKTKADQEKMGIALSKLAQEDPSFRVKTDEETAQTIISGMGELHLDIIVDRMRREFGVEANIGKPQVAYRETIRNTCEIEGKFVRQSGGRGQFGHCWIRFAPADEGQEGLEFHNEVVGGVIPREFIPAIQKGIEDQMQNGVLAGYPLIGLKATVYDGSYHDVDSSEMAFKIAASMATKQLSQKGGAVLLEPVMKVEVVTPEDYMGDVMGDLNRRRGLIQGMEDTPAGKGDPCRGPAGRNVRLCHRRALDVPGARELLDGVRPLCRGTGQRGRGDRRQAGPXRAAARRRGQRRRAPLRERQPHLRRRCACQAGFLTPPGCLTIRQ

SEQ ID NO: 25012 - protein, 368 aa, Pseudomonas aeruginosa
PADRRDQPRGRLRRAQLPCRREHRRGPGAGARRRSAGPAALRRRGDVRGQGRGAQYLAFLLGSDGLPSRREEAARDRVARRLAERRVRVVLPAAFPGAGTDDRLGGGVDPLEPSAPRADRPGRVHRPGGRKRPDRADRQLGAARGLRHRRQLARRGDGLGERVAGAVHDRRYRLAGARGPAPGPPGCSPAGAGSHRERHAQRCRWRAADHDGPQGAGRPPQHGRLRYRLFLARLPAHLSLRQHQDRQALRRQHGEDRARPFDRAGHHQSRQRPEPAGHRRGRGDRRADAHPARRAMPRTARVPAQPTAGCAAPARSAGARGGADPGATGFRRRPCCAPALSGRQKGARGASAALGSAIALRMVQKMLN

SEQ ID NO: 25013 - protein, 450 aa, Pseudomonas aeruginosa
QMLGIVADIERGIRIHVGFILGLANDGGGLGGRLSGVGPALGAGQACGRHPEAQRQAGDPGRYRFRRGCGEGGGARGHGGFLGGVWRRKVGAARGVGGVQRGVEHLRQVGKLLAKMTGVVDEGADGLGIRYLGGLLRFRRELGWRPTLGRCRFRLRPRLGLDASGLGDGFVFRRLGLVDGLRRPVRGLVRIVFGEDIGSGVFEKGLLDERRDFRAGFLAIQGGAVAMGGLEGDELHHPFAFEHQGAVFFPPRMGDGRVLQVDEVVGQIAGPAVAGGGFADQLAEHLDGRLAGLVGVETAQAEAVVGLEQGGDVDARVVFVDLFVEAVGDEVAVAGGNGETTQQGRIQFRLLGSFHTDGSKKHKPWRSRWCLKGVTGEGTGSYGRGNLDESYCLVRKILKILLRTVPSTPRRLVRSYGGGALQRSAIRTTMASATKSALRSRVCRWFMTTS

SEQ ID NO: 25014 - protein, 74 aa, Pseudomonas aeruginosa
PPAASDRPGKGTYPNGEGGPRWWRAAWPVSHAAWLYWRRGNKTPSMKSVPDPNVALPVISATYLSFFCRETAFG

SEQ ID NO: 25015 - protein, 314 aa, Pseudomonas aeruginosa
NTTRRTMVERNADFTACSGCSAFRAGGDRDHLHAEITEDRHHHGDPHAFQAVREEAAVGAVVVHAVGRVGGAEHQVGAEQDEGDDGGDLQCREAVFEVAESFHAAGVQADQQGREGDDPDPFRDTGEPVLHVHGHRRDLGAHRQDDGRPVGVAHQEPGQRADVVLGEGAERAGGGMGHGHFRQAAHQQQGDQRADGIAEQDAGAGETDGEGAAHEQAGADGAADGDHAHLRGREPPLQALFAARDGLEALGVVHLDVLWNLIGVLMNCRGNVGGDVRVPVAGSCARERWVLAGRPGNTGAVRAGGTQVTLCRTW

SEQ ID NO: 25016 - protein, 370 aa, Pseudomonas aeruginosa
SGSRANWSAAAATSSSISSATARPGTSSAKPVMSCATVPRACASSRGRSAWTTRPSAPSGASASFCEAPPMSTDPLLPGFDYLTLHTSAARLRVAVKGSGPPLLLLHGYPQTHLAWHRIAPRLAEDYSVVLADLRGYGESRALDEEGADYSKAALARDQLETMGQLGFERFAVIGHDRGARVGYRLALDHPQAVAAFVSLTVVPILDNWAAVNKAFALNAYHWFLLAQPYDLPERLIGADPEHFLDYTLRRMAQGRDIYHPQALESYRRAFRDPAVRHAMCEDYRAAVGVDADADQADRDAGRRLQCPVQVLWQERPYAAGQHPLEIWKTWAGQVEGAAIGASHMLPEDVPDAVLEHLLGFLASHREALR

SEQ ID NO: 25017 - protein, 421 aa, Pseudomonas aeruginosa
SNSSSSRARRITGSTTGRAPPRGSIARWNRRGGAIRPAPPTVWHARPRSTVRVSRCRPRLTGARYSTTVTARSGTTASAPAPEACRSPWSRPAPIAPSCCRRSSPPAIAAPTGGSTKSRKATAAYGPSRRTASTKEQAYMNAIIEQARSLDGYQDSSELLQRRDQDWVLDRAGIEPRSLLDLGCGIGSLLLGGARRWPGLQRLWGIERSPLRLEQARAQLRGAGVEARLLEGDLLDLPPLAERFELISMTAVLHWLYPDEERLFRWVARHLEAQGVFLFTSHHPFAEDGLGGEDDLVAQALVEMGLAAPERVAALYAEAGLLPMGTRTRGREALRERVERHFRVDSIVSRPAVLRVADSAEYQRFHAATFGTYFAPLVPATRLEEFFVRLGRIAERRMQADGQVSEIPVSVWRCRAREGEA

SEQ ID NO: 25018 - protein, 1225 aa, Pseudomonas aeruginosa
TDHVQPAFATSSTCPRALRGRPGLPWPARRVGGRGGPRHQQRRDPALRHPGRRTGPGTAEHSPPESHPDRLRPAPGGGPAGTGDPGLLQRRAGAAAGLAGQRPGIHPQRRRRAQPATRHGAGCRAAGGEARRDPGHGGGHRHPQGRCQGRREPGTDRCGQRRAIARQWQRRPARRPGAPAALAVAPGPGLQRFGADQRAVAARPESQPRAGAGERQAPSRDRQHQCQRRAAERLHRGRPGYHPARRHRAHRGAARRRLGAVRLGRHRRGDQRHPQVGRPRRPARLRQRSLRRWRRPDPERRGEWRPAFRRERFPQPQRAVPRTGADHPRRHRPAYRALRQPVHRRPFAAPPGAGLQRRRGAGRQRRAVQLRHLYPSLGVLGADLPVAVPGAATLSERLHPAHHQRRGRLFADPRRPWRRAVRRLGLGPQFDLRCRPPGDRHGPFDQPRPLRRDRRFAALLRPGALQGHPVDQQSRPAPRLRPRLAAGAAEFLLGPGAAPRALRGRGRRSLVLLQRRFQGTPRAGAGHRRTVEPRRARRLSRPVHRPRRALATGDGGALRALQRLRQHHQRQARQPLPLQPRGIGAGQSQQRLPRAVAGPGELHKPGRLADHRQRPAGGQLAGGQAARRRRPGAGKIDQLQPRPGARSLAGPEPGHRRLSHRDPRPHRRRCHLFRTAGDRCAARRRDQHPGRTDPGQHPLHDQRRRHPYPRPRPHRQLPDPARRVGPDRLAPGRQRQSHEAGQESSRAQRPAAAQRPAAGLDHQLHAAQPGQPAGRLELPALGPDPARNALQQDGFRTGLLHRRACLFDHGLQPLRELAQVHHRRCPALCGEPQPDPERRGQQSVRREARQAAGRERLPRLQPVRHLCLADQLQRRLLLPRRGLHLLRRTNHEHRTARRRARLRGHRRQCLRPPGRAFPAGHPQSRGERLRHPAEGPPGRGGRPRRRAVHRFRCLARPLAGRRLGFGRGAAHARHRRAPTGERPADRCRARPGHSRRPVQRARRRTPGDRLQRRRRAPRRRLRRQGRTLPARRGVPGGLHPRPGKPRTLRLPRRVLPAGGRRQRLPADPAAAPAAIRWRLLGAGTTPGGALRRRLRRPLRQPHADRGAQAQAERGGGGAGTAAEVLEALPGDPRRQSGGGPGHRRALPPGRFRTASGTAPRRTGGIAAGRPRRRARPARPAGAGGLARMGGEYRAAQLRRGAGGQRRRGGGTDPGLSSRRHRDRPA

SEQ ID NO: 25019 - protein, 450 aa, Pseudomonas aeruginosa
GHHRERRGHPLAPPTDRAPEARRMSGVAREAMEDVAPAAPGVGEFGVASCGVLLASVVGVIFGPTGLVISSFSLFIEPIAADLDWDRGQSALPVTLLGLAVALSSPLKGWLVDRWGARALVLPLTAALALCLASLALARSGWQLYLLFALLGLLTPGNIPYARILGGWFERRRGAAYGILGLGFGVGGPLALYLGSACIDAFGWRATFLVYGLLEGLLALPLLYALFRERPGDLPQARRPPADALPGATPGQAWRSADFWLIVGNLILGVFAVTGVMVHGVPLLQERGLSREVATDVLAALWVGMIVSQPALGYLLDRYDTPRIALPFALLAALGLLLLLLGGPPALLWGAVFLIGLGAGGETGTTQYFVSRYFGLRHFSVIYGSIQPFTFAIAISLGSWLLGYFYDRAGSYAGSTLVLLGAFGVAAGLLVMLGRYRYAIDGEARSHGRD

SEQ ID NO: 25020 - protein, 205 aa, Pseudomonas aeruginosa
PVPAARRGRVARPAAAPAPAAGHPRRARHRPGGATAGAGPGPGAVRPPGIAVADDRPVHRLHLHRAVPGRQHGPRQTDHQPGPAGLRGRRHPRRAARRTRRRPLAGAGHLRRLPAPARTGPGPAAVRHRRPAAAAGRGGVLVRVQHGAGAGDPEIPGGTQPGHRGDPDQPQHQRDPARRGPGRLHRRDPGGSGGGARAPPGGAPR

SEQ ID NO: 25021 - protein, 233 aa, Pseudomonas aeruginosa
RMPCTAATGDSRNEREAGTATHRRGGHRMDGAPAIRRLQRRRGRCPGTLEGAVERACRGVPATAWQPRAATGLALARPAERYRAARPGAAVEPPALRRRRPRAVRPARRRRRPGALGPGRHGSARRTGDRHRRAPRLVAGRRQPPAPERAEQGATAARRRPATPGAAARRDAPGSEGGPARRLRPRLRRRTGGLRQRQPAAGRGARGDPPGDPARQRAADHRRGTPAGGGGTT

SEQ ID NO: 25022 - protein, 310 aa, Pseudomonas aeruginosa
SAPEPSAIQFVPRIAPQVQRLSLFQRSAPYVIAKPDRTYADWERRLKARWPWLQRLDRGLKYLHHESRMLAFATFPALMKVMRLSFHRHLHRQIADPQLRARLVPDYPLGCKRILISNDYYPALARSNVELVDTGIREVTEDAVVGRDGRRHEVDAIIFGTGFAATEFLAPMRILGLDGRDLRQAWADGAEAYKGISVSGFPNLFILYGPNTNLGHNSIVYMLESQFPYVLGCLRQLQEQGLRYLDVKPEVQRRFNLEVQQGLRHTVWERGCDSWYKTAAGKNTNNWPGYTFVYRWRTRRPELADYDLAR

SEQ ID NO: 25023 - protein, 260 aa, Pseudomonas aeruginosa
SAPDVAAATPARRSPARLPAPVVPRAGPSAHASGAATRRVARAEPGDAGRRRRRPRAPQPRRRALRVVAAARGGGAAPGALPARRRLPDRLAGDPPGDHHAPGPALRRRGLRGGLPARPGTSVPRRPRRRPGGLPGIAGGRPFAAPAAARRRLRGRPPGAVPGPGAEGARLAVAGRVAAVLALDRPRLPAPAHAGGRRPAAVAGLAGKRGAPAAAGRRGARLGRLVAAACRPGGAAAAAGTGRRGRTAARRQPAPGATGR

SEQ ID NO: 25024 - protein, 251 aa, Pseudomonas aeruginosa
VQNILISGAASGIGAASARLFHRRGWRVGLLDIDAEALRGLAAQLPGAWHRAVDVSEPDAVGEALAQFCADGRLRLLFNCAGVLRFGRFEEVALEDHARLLAINLHGVLNCCHAAFPFLRATPQAQVLNMGSASGLYGVPEMAVYSASKFAVRGLTEALELEWRRHGIRVADLIPPFVRTPMVAGQAYQPPVLRRLGLRLDAEDIAEAAWRQAHSRRVHRPVGGLFTALYRAGQLSPPWVNRAVMAWLSRG

SEQ ID NO: 25025 - protein, 210 aa, Pseudomonas aeruginosa
RGLISNKGRQSKNNMGERRAAYVNSSSDYQQAAGTCGQPGDRCSISSGVYQLGDYLARHQDRRGERAAANCRRIALSDRISAFPALCAAAPRDDLFPAATPGLLRLRDARLLQRALLPAELWRAIRRFRSYRAAVQQHARVHPDLLRDLPARAHLPVADPWYCDWLRQPVHDHQVSRAASGLHGVVRRTCHPARGDHARTQLRHHQKARC

SEQ ID NO: 25026 - protein, 473 aa, Pseudomonas aeruginosa
KVKTVIFPEVLVRAAQLEGGRLEGAGLTVGELLAGLARKHSSLLGHLYYENGQLKEHFLLTHKGSLVNLDGELSDGDEVEVMLATSGGSGVEALSDEEVQRYVRHITLPGVGREGQQRLKQARVLIIGTGGLGSPACLYLAAAGVGTIGLVDFDVVESSNLQRQVVHGYSTLGMPKVESAQRRMQDLNPYIEVVTHRYAIDADNAQSLIQSYDLVLDGTDNFATRYLVNAVCAKLGKPLVFGAIYRFEGQVSVFNLEGGPCYQCLFPNNPPPEMAPSCNAGGVIGVLPGVIGLLQATEAVKALVGLGKSLSGRLLRFDALLMHFNEVKFNRRDDCPACGKTAAENPRHWREGLLCQASAAPSQRLDDDRYIDPGCLLQLMKSNSENYALLDVRDAGELEVCQLPGIVHVPLNELASHFANLDFSKRYILVCYAGTRAERAAIQLMGAGFSNVQVLDGGMKRWAKEIEQHMPMY

SEQ ID NO: 25027 - protein, 311 aa, Pseudomonas aeruginosa
TIGRESMIYDSLLDLIGGTPVIRLSKLSARLGVSVFTKLESFNPGGSHKARIALWMILDAERKGILVRGKGQTILEPSGGNTGIGLAMAGNILGYRVTLVVPDNYSPDKRQLLELYGAHVVLSDSRKGNNSHGELAIQILLEHPEFVMLNQQRNPANPQAHREATALEILRDFAGQPPPDFFFAGIGTGGHITGVGEVLRNHWPDMAIYGVQPEQCDLLDDRHAPHEIQGLSIGIVPEVCNLGIVTGMVGVSKSACLSMIREVLQNDSVSMGLSSAANLVAVLNMASAMPSGARVLTMIYDGVESYMDAFR

SEQ ID NO: 25028 - protein, 258 aa, Pseudomonas aeruginosa
SCRAEHGDNACMVEMRSHAMDKLVGNLMRAALMECCSPQLVERIVAHSMFEEARRWCEEDLQAFASKDPAAQGRTSDIAFGYSSFKAVLHYRLSHMLCLRSTSEGDPERALEATALLVSSRGKLLSGAEIHPRCKIGSRFILDHGHGTVIGETAVIGDDCYILGGVVLGATGISANPAGKRHPTIGSRVQIGAFTRVLGDIAIGDDVFVGPHCVIKDDIPVGSVVTLRSELQVIRGPHIVQQLQPAATQTQIQPMEAS

SEQ ID NO: 25029 - protein, 858 aa, Pseudomonas aeruginosa
VLKTPTCSLAVEPMWRIPKKLGWCAFPKWRKNQRAPVGWYWYWVERLPSTWPSVSHSTPQVTLATPGSSMQCQRASGRQQRPTGLDEAPAGTRTFALQRLVAIATLRACQGIARRQLAGGRRPWAAALQQQSGEAADVGALAGVLALFPAGLGAKRQVALARAGCIPGTRARQGFIRALRTAAPPSRGVGVRFPSRDPGSSFPGILMAGVMAATSWGRAHAGPCSWARSRIRQFSRFRRRHRRSIALKPLPRGASPHWYDPRHDQEARMSSTVADQLLERLSQWGVKRVFGYPGDGINGIMGAMGRRAEAFDYIRVRHEEMAAFMAGAHAKFTGEVGVCLATSGPGAIHLLNGLYDARMDHQPVLAIVGQQAATALGSDYQQEVDLQSLFKDVSAYVETVVSPAQLLHVLDRALRVAVGERQVATVIVPNDVQQMAAPKRQPHEHGHVMSAVGFVQPRPYARDADLEAAAAILNRGRRVAILAGAGALGAHRQLEAVAERLAAGVAKALLGKAAVSDDLPYVTGSIGLLGTRASSMLMEHCDTLLIVGSTFPYSEFLPKAGQARAVQIDLYPRNIGIRYPIDQALLGDAGETLERLLPLLEQKKHGAWRRRVERAVTASREEARRQAEEPADPINPQRVFRSLSEQLPDDAILCGDSGSHTNWYARDIRMRPGMLGSLSGKLATMGSGVPYAIAAKLAYPQRPVVAMVGDGAMQMNGNAELVTVQQYWQRWDSPTFIVLVLNNGDLNQVTWEQRALAGDPEFSPAQEVIDFPYARYADMLGFKGIRVDRPEDIDAAWAEAFAADRPVLLEVVTDPNVPPLPPHISFEQAKHLLGAMLQDDPKRWGVIRQSARQVLARH

SEQ ID NO: 25030 - protein, 76 aa, Pseudomonas aeruginosa
PSSTPSASYPGFPRDTCPPPTWWPSPACCSPRSATASWSASSPPQARPIPTRNERSIPMSASWSAGRRCWTTCSCR

SEQ ID NO: 25031 - protein, 478 aa, Pseudomonas aeruginosa
NPRRPDPVRWPWRGSPVSAGRCFLWCCASFPRLPGSLEPSLRGGGTAQGRSAWKLPGPAFDTPIRVEICMTYPERPLLHLLTRTSLVGQIIVGLIAGLLLASFFPAAALKVGFIGKVFVSALKAVAPVLVFVLVMASIANHRQGQQTHIRPIVLLYLVGTFSAAVVAVIASFAFPSSLVLASHPGEMSPPGGIAEVLQSLLLSVVDNPVNALISANFIGILAWAIGLGIAFRHASDTTRNLLSELSNGVSLIVKVVIRFAPLGIFGLVASTFAESGVEALKGYAHLLVVLLGCMLFVAFVVNPLIVFLKIRRNPYPLVLTCLRESGMTAFFTRSSAANIPVNLQLCERLGLHEDTYSVSIPLGATINMAGAAITITVLTLAAVHTLGIAVDVPTAILLSVVASICACGASGVAGGSLLLIPLACSLFGIPSEVAMQVVAVGFIIAILQDSAETALNSSTDVLFTAAACEAEERKASAA

SEQ ID NO: 25032 - protein, 340 aa, Pseudomonas aeruginosa
FDPWVTEETAFGRFLRFAPACFDLCAALRPNGRPSFPSCRMSSPSLPDASLRASTLHLPAGPWSTVLDCLCARFPAIDRDTWLARMQRGRVLDAEGRALGPQAAYREGLRVHYFRELPVEAPIPFEARILYRDEHLLVADKPHFLPVMPAGGYVEQTLLARLARSTGNRDLVPLHRIDRHTAGLVLFSTNPGSRGRYQALFRERRIDKCYEAIAPALPQLDFPLLRRTRLVPGEPFFRMREGEGEPNSETRIEVVERNGRWWRYRLYPVTGKKHQLRVHLAALGAGIQNDGFYPELLDAEGSPDDYLRPLKLLARGLRFDDPLSGERRTFESGLRLDWQV

SEQ ID NO: 25033 - protein, 277 aa, Pseudomonas aeruginosa
KRISPISRNFMASPRRGCGGEPGIVAPLSVLKEHSPPRNKGSARRRGCEQSPGGRAGRVLPAPACLRANRLRATESAPNGRSPGSTPRRRPPDSRRRPGSARRHSSARRGRPGGTARRQGRRSPRAPRWPPWRSRWCVAVAGSPAAVAVGRRRPPATRPGAGGWRPSRAGSARRAPARRREVRSRPEAGRAAGSPAARCRPSRLPSSPRRRRAGPAALRPARRSRRLRCRRRRRSRWHRRRPGRTPAAPADSVADPRRNRCGSARRRPSRCSARCLR

SEQ ID NO: 25034 - protein, 478 aa, Pseudomonas aeruginosa
PTWRSPACWRFPSAASTSTWSRASSSATRCLPNEPGKARTHPRRSGAVDGAAAIRPCRRRGAPGVPAVAPGRCRARCGVRPAQHGLAVVSRRAHARLARRAIDRSPRGAVRPSPVSPAQPRPWRRSAWRRWRWGGSASSASPGPATCTPAPDNARASAWRMAANWCWTRAAGYAPNSMATGVACAYARAACWLTWHGIRRGLSSSTPGVARSRRREPASRSAMTAPAREWWCSSRGCGSPLPTDGNACWSAARAPVSTPRRLSPEVLPKAARAPGWMAGWRSATARWGRCWKRCAPIAAASSASPTTRRRCASVASTRWTTAARRWHCWSRACRSGSTTTGPTGSASPAAEARARRRAGRRDASERLGRQVLAVEGDHRPRAAFRVLDLLDVQLEVDRADDAVAELFVDQRLQGAAVDLQHLVEAIDGRVAGNAAGNAAAQRDALQQEHRVVVQAELGGDLARRRLWQGMLAEQGGGD

SEQ ID NO: 25035 - protein, 331 aa, Pseudomonas aeruginosa
LDVSMLLRHLRYLLAVAEHRNFTRAAEALHVSQPTLSQQVRQLEEQLRVQLLDRSGRSVRPTDAGELYLLHARRALRELEAAQRAIHEVRDLSRGRLRLGMTPTFTCYLVGALVDPFNQRYPGIELSLEELPQDALEAALIDDRLDLGVGFQRAGCGGDRQPAALPGTSGPGAGGGTPGGDAPVGRRSAGGVAVGVAARRLRHAPAHRRLHAPARGDGAGGAGGELDQRHRRRGSPRKTGQHPAGGGGAPAGRVALRGAAAGVADPPGSAVLAPGQPPRCRAPGLPGPGAGTRRRAGRRLSGISRDSAATPRVPHGAAARPGRRRTGRAGR

SEQ ID NO: 25036 - protein, 357 aa, Pseudomonas aeruginosa
SVARRRAGRASSWKGRHGPSRRDSWSGLGAASVSHAGIVINSLSVLSLMKIIIDEIAMDLNAVKLLARVAETRSFTQAAVSLGLTQSGLSRAIGRLEAELGVRLLHRTTRSVSLTPDGQLFYERCAPLLAELEEVEKLLVDRQCAPSGPLKITTPQALGRIVIMPVLRELTRRYPQLQIEAAMTDRLVDLTEEGFDAAVRLGRVGDVRLIARPLAALRWVTVASPEYLRSHGTPERLEQLAGHNCPTVRDLHTGKLLEWQFQRDGQPLSLAVRGDLVLDVADALVDAALVGQGIVQVMGFMAEEAIRRRRLVRILQPFEPPLCPVSLIYPPSRQCSLKIGALYEELKSAHWCGALTY

SEQ ID NO: 25037 - protein, 844 aa, Pseudomonas aeruginosa
PARGFPAPSKEGPSPVTVISSEEIQNRGYRNVFDALQTQTQNTGMTQGEDYGNTWQPAANALNLRDLGPNHTLVLINGRRVADYPTAYGGSVNFTNLANIPAVMIDRIEILSGGASAIYGSDAIAGVVNIVLKKKFDGVDVNLRAGTTERGGGDNQRLQLVGGGATGDFEGLFGLQVEQRQPVWANQRGFMDSYPDGNNVGYRLNPQSGRYLGDASCAGLGGLFGGNVAPVPGARGGYRCMTDQYYNNYWTLQTKKENYDGYAGGTWHLSDSGKLFADLLFGFDHLQNNTRGPSFTSPDFINASSGDLERWYRLFSPEEIGGKSSNNSKWREVSWTGTLGYSDHVANTSWEYELAATRSEYRSDRTTRYTPAAGILDLYLGRKLGERDGYPVYDPDPARLGRPLSEEEWRSLRRNVTQHSESYSQTYSFTGNGELFDLPAGPVAFAGVLEVGKQGYRIRPDSQYNDGSLYNVSKASSSGGSRDRYAAGGEFSIPLHDTLLASAAGRWDQYRFSGRTEEQTTYNLGLEWRPLTSLLLRGSYGTSFRAPDLNYIYQADANGYYPAQKDYYGCEKGVDGACKNGRVDYVQSGTPDLKSERGRYWSYGFVWSPSSRFDFSADYYHIQIDDLLTTLDPDKLLRDEAACRSGGLDPDSAQCRDTLARVERNAGDASVDPNRLNKVYVNAINAAKERTSGIDLRSNIRWGAGDYGAFSSTLGYTLVLSHDYKQSDDYPSENQRDSLDSHDWRSKLNASLTWDYAQFTSTLFAVRYGSVTNAAGSGRLSPWTVFNASARYRLNERASVGLTVNNLLDQIKEDDSDGWPYYPTGNYDAMGRQWWLDFSYHFGG

SEQ ID NO: 25038 - protein, 603 aa, Pseudomonas aeruginosa
AMPGRILVFACCLLASLARSEPRHAITLYDEPAKYPPGFQHFDFVDPQAPKGGSLRRMESGSFDTLNPFANRGTPISMTQAALIYETLGFQSLDEPFTEYGYLARYIEKAPDNSWVRFHIDPRARFSDGVAVTAEDVKFSFDSLVEQGSPFWRAYYKEVREPVVEDRLRIRFDFRHAGNRELPLVLAQLYVLPRHWWQGRDFNRSSMQPPLGSGPYRLEKAEAGRSVSYRRNPDWWARDLPVGRGLYNFERIRFDYYRDSGVALQAFKAGQADINVETSVKAWSSGYDSPALRDGRLRQESFPYPYPASLQGLVFNLRRPLFEDRRVRQALSLLFDFEWTNRQLFGGRYKRLRSYFDNSEMAARGLPGADELALLEPLRGQIPEEVFGQAYAPPVNDGSGDIHERLVQAYRLLGEAGWHAVDGRLLDTAGRPLRFDLLLQGKGLERALLPFQRNLARIGIDMRLRQVDASQYIERIRARDYDMIVSSFSQSNSPGNEQYSFWHSSSYADPGGYNRIGLKDPAIDRLVQAVVEADSRAALETAVRALDRVLQWGYYLIPTWYADEVWIASWNRFGRPPQAPRYSLGLNTWWEVRERAAPSREAQ

SEQ ID NO: 25039 - protein, 399 aa, Pseudomonas aeruginosa
HGRLPVAPPGADPADPAGHPADQLRHRPGRTRRAGGSGHRAPAGRRRRRSAGAWRGGWAWRSGTAAPRRDRHRSAAGGRPGAPVRLRQAAAATALADAVELRPAGFRRELLPRRAGHRPDRREAAGLAVPGLVGDTDHLPGVDSPGGGQGGAPRQRLRPVEQRAGGGRLCGARLPLRHRPDRAVRRRQLPGLVPPARPGFRGRRAPRPAGALRRLPLAPGAAGGFAGGRRFRQPDPADQEQLPRRDIQAVRRHRSRQRAQRAPGALRPCVPQRHVAGGGRAAGGAGLGVLHRVAADRGAVLPRRPRPDGLRSGAWPRLPGGVRQPVHLHPARVAGEAGRRPGLQPGRPAHRLRREETVRWPSSFPRCTAAASPRSAPTAAGAWRCGCSSRCSSPACSPS

SEQ ID NO: 25040 - protein, 565 aa, Pseudomonas aeruginosa
PCSWSWRPCSACWCSSAKRCATPSIRGHEMNRELLRVENLSVAYGDTQVVKGIDFSLRAGETLALVGESGSGKSQTAHALLRLLPGAARLGGSVRLDGEELLALSPQALLAIRGQRIGMVFQEPMTSLNPLQRIGRQVGEGLRLHRRLRGAALRGRVLELLELAGLEQPRRLLEAYPHQLSGGQRQRVMLAMALACEPQLLIADEPTTALDVTVQKRLLELLQSLQRRLGMAILLISHDLNLVRRVADRVCVMRDGQIVEENACETLFRSPRHPYTRLLIEAEPGGLAEPVACRETCLEVRALSLDYPAPGGWLRRRAGLRAVHEVSLRLRRGSTLGIVGESGSGKSSLGQALLRLLPAEGQILFQGERLDRLHGKRLLPLRRQFQAVFQDPYGSLNPRLSVEQIVGEGLRIHGIGDAGERRARVLEALREVGLDEPCLERYPHEFSGGQRQRIAIARALVLKPALILLDEPTSALDRSVQCQVVELLRRLQRRHGLSYLFISHDLAVVRALAHDILVLKDGRVVEQGSAAALFSQPRHPYTRELLGAIPALRLEEHLRVAGLGI

SEQ ID NO: 25041 - protein, 467 aa, Pseudomonas aeruginosa
PGPGAWPSGCRCWSGTAAAATAPGAGRVAGRARGRWNRSGRKPGSSCTVRCSGGWTNAPTTGRATCQRWNAATSSTIRRCSTATASGWPRSRSEPHADTGDEARLVVVLALGAGQVGAVAVGAVPGHPDVGRELATDLVAQAQAQLAIGKARTDAAGGIVPAVQVDLGAGLEDQPVGQQDVVLALQAQRALAVLAEEGGDFRLEVVERQALHAERRPGLRRAGLEILAHAGDQVPPGTDGVPEQRLDLGVLGLAVEPFAFAAQPQAVDVAADPAAGVPGQRATVVGVLVFQLVEQEEAVQRAVVHLVPLQRRKGGTAVGLGRHRDRRTALAGRGLRRRLPRSAAHPRHPAMVHSLVLHGLCRGGRCGAVVHPRHPAMPHPLVVHGFRRGGGPLAVVHARHRAVVHGRVVHAIVPRGLDGIRQAQQQTQGEGTGGQAGGFRLAAHALSPSSTRTSRNMPISMWNSRWQ

SEQ ID NO: 25042 - protein, 473 aa, Pseudomonas aeruginosa
RPPGAMPSKLRPGTPSMLAGRMMPCQWIEVSSARRLRTRRVTLSPSRQRRVGPGSEPLMVMAVAGEPLRFTGVSPMNRSKLSPASRFCWPAPARAQAGARQRPSPPSRPVAARPLTKVRREVLCIRWFPRRWQDGLREPAQPGGRGPARAVRRCGHPSGARLSASCGEDYSAVSSARRVHQVAVETARHQAFPGVHDLRRDRAGDLEAQRRVTHDAVEVADHLVDHPEYADQVRDAVGKCVVGRIHVSLQTRPADRQGQRHAADRVGLGDEGRAAQVGEQLAGEGDVLGEVGRPRLDHDEAVAYPARPGVAGEQLGFRLDPEMARPVPGVAGEQQAFGEAAFEQFAGVVADPQVVGAAYHQQFAGHMAAALAEEVPEQPGILQGRAHGTPTLLSLPVVAGCRCWQYSRSSSRTIRSSRKSRTDQRAPAASRPLSSPIATQVAPAAQAACTPLRESSNTRQRDGATPSLAAARR

SEQ ID NO: 25043 - protein, 434 aa, Pseudomonas aeruginosa
GKPDQDRAAEGEQRHDQIGPLRQAFVQPAGGRTGEAHGQRYRQRVVDPLGQYPRAFRRVVADVTHHRGVVGGEAEGVQALAEEDRGEVFAAGQQAPAQRRAKAGEEHHLERRVAVQDAVGDGEEADLGDHRQAPEGADRERRVAQRLPAQRGGGEVQRVAQLDHSRRGDGQQQGALTEDPAQVGTAPGARQRRVRTAQAAATEEQAGQRGEQHRQADQGGHQLLAEPTEQQAAQGRGEDEGQRTDCAYPPVVLQGGLVALEQVGFGERQHAGPERAVEHAQGDEQGQALGQLEQQGAGAGQGRQQGRQAQLVDAPVGHVGQRHPGDHLRPVGRGDQQADLAGAEAQAGQPGRPERIDQPLGGEVAGKDQVHAGSRVAVPVRCGLRLTRSAPWRRRSRPCARPAGTRPAPPGRPSRPPARRGRPAGRRRSVPRGG

SEQ ID NO: 25044 - protein, 1175 aa, Pseudomonas aeruginosa
SCGVLLRERVGGERRNRLHGTGSPTTCQIWSPAKSGRATGSGSWTAVDGLAGHTGRAPAPASEAVAEAAEQDAPVGIGVARVVAALEGVGLVAERRFAVEQVLHPEGQPQRVAEAVAAGQVPEVPRTDLAVAGAVVVVVAAGVAVAQGGLPGVAAPGGVGDVLPAGDHADALEVADVVQVLAADLLLEVVAGHVGALQVEPELPVAAGRETIIEAQVDAAGLYLAEVGQSGDDVIDRAVGLAHDASGVGLRVGEDRRFGKLGDLVGDPDPPEVQADGKVAQRLVDQAQGNVARGFRSQVGIAAGGVVELLGAVAVGDAALARLAAGAQARVVVVGAGIGGEGRVVQFVQRRRTETFAVGAAQDQLAERLEAERIFRVAGAAEVAVLVVADRRAEFQAVQHRHVEFGVLRLQVALAADRGGGIDAEALHVAGEVLDVLVERFLAELAAQRQGRRPGAEPVADLPAGAGIQALDAADRGTEVAAQGMAAEVGEAGVGLRPERVQRPVGDAEGGGAIIDVAAVDMVDHLVLVVRGADIVVPAGELAVEAEQQALAGVLRGLQARPEHALSPVDLHRPARVEDEAAGSGSDAVAGIEGGAGIDLQAGEGPWADLGSVVVARPEVLQADVVLVGQLAGGAAEHRGLLGFRHQVEVAPQALPADAVARNQVGALATAGGQRIAGVGALAPVAGEGGAGAVVEAASRLVVVGVAAVLGAEALLLVVVGHREDIEAILLQLAEAPASADVALVAAAVVGGGGVAAVEAAFVQALAGDEVDHPADGIGAVQRGGAVAQHLDPVDGGEGNGVEIHRGAVDGIVRQAPAIEQHQGLVRADSAQVGERGAAGGAADRATGVVYALVAGKPADQFLGAGHALLAQLLGAQDADRHRGFRIDPADRAAGHLDSLQLDRGRVDRRLFLRRGGAAGSELQGQQQGGAQRRVGVERSVHGRGIPCSGVSRDVRRAGGFSRDGLDLCAMSLCPLGTSPAVAPFVGGPERQNQSPLPRSKSRRRGGAVASFLQLHFSFSSRSHHPGQHPRGRSWLAPLPSSFIATSASSPTSTPARPRRPSGSSSTPASTTRWARSMTARRPWTGWSRSRSAASPSPRRRPRPSGRARPSSSRTAIASTSSTPPATSTSPSRWSARCACSMARWWCSAAPTGSSRSPRRSGARPTSTMCRAWPT

SEQ ID NO: 25045 - protein, 63 aa, Pseudomonas aeruginosa
  UNSURE (63): Identity of amino acid at the above locations are unknown.
SRAWRIPRRAKVIRAEVPLGEMFGYATDVRSMSQGRASYSMEFVRYAEVPASVAEAIVARQGX

SEQ ID NO: 25046 - protein, 880 aa, Pseudomonas aeruginosa
DSDQGPHLYGHKDGESMLASAIASGTAVSQVSKHLLMFLAALFLALGACGWAILHIARHQDDIAIEQSHFYVEKALQNRRENSEQFSTTYSFWTDAYVYLGNRVDVDWAFTKNNLGSVLYTTNGYDGVFVIDDRGTRYAMLEGELSERSLADSLNADTGDILRSARRAAVDEAAISRYVDFDGAPAILVASAIKPTSDHAPIDLAKASVMVFVDRLTPAKLAKLGGDYGIANLHLLAGGAAGDKESLALEGTPHRLAWVSSRPGSAMLRETALPLLGIFVLAAGLLFWLSRSAVLNARAVDRQQKVLKRSNQALLASEERFKSIAEAASDWIWEVDGHFVFTYLSVRFRDVTGYQPEAWIGRRLDELLDSDTVNIVKWLEGLPDAGAPSSLVCAFRDSQGQARVGKLSASAIRNGVASGYRGTAADITDEVEAHAKIQHLSLHDALTGLPNRNKLFQFLERLLAEKAGKSPVAVLMLDLDRFKPINDQHGHPAGDAVLYAIAERLRASTRDQDMVARLGGDEFVVVSTHVSSKLEIEKFCSRLIDVINREVAYEGHSFHVGASIGVALAPEHGGDPRGLLRCADVAMYEAKAAGRNTWRFYLEAMDSHLAEKKLRETELRAALQNGEFELYYQPRFLAQEQTIASAEALIRWNHPRRGLIGPDEFIGLAEESDLIVQIGNWVLREACATAASWPGEVMVSVNVSPAQFMTGDIVWQVREALRLARLDARRLELEVTENVMLNDVDGALRTMTALKELGVRLNMDDFGTGYSSLGYLRTYPFDSIKIDKRFVASMEKTGRDRSIVQAIINLGNALNLRVTAEGVETEGQMHILRDEQCHELQGFLLSRPLDAQRLRDLLEREAGQTQAPQVSAEGHAARRP

SEQ ID NO: 25047 - protein, 291 aa, Pseudomonas aeruginosa
LMACRAVLNCTVSLKPLTICANFSRALSSFLKRSPSSRLRCWTLASRFSSSAWRRFCWLRNSSRRSCSICSTSARRALLRSRASTLSASCCRAALRSARRRLLCSVSRSSAWRSSCRRLCHCRSCFSFSCNCRSFSCSCVWSDSSDSCCLSASCFCWLSCWAMPARSARVPCTSCSRCSVSLPISSAVSVSTWASSSGWRMMAAAWVGASLALAPPSAPARRAGGTRRRSDRLGTLADTGSGAGAARGEGLGGMEDSSAASGDGRLALPVASAACSAGWSICARSASSSRR

SEQ ID NO: 25048 - protein, 403 aa, Pseudomonas aeruginosa
RASRTRTSRFLSSPLPIFRSSAAKRLSDEGGRRSLVAPSRGFPVRADPTRVASEGYVRNVRDRCQFPDHQLVEGDAFVAPADVFRLCRRVRQHRPGRRGAARFAAVAVAADPGARSAHRRGAVRPRSGRGEPDRSGQGGALPRGEDHRRGQGADPRHRRRRRPSVAHRFQPLSRSRLVRRAGPATEGSAGVQRRFAILGAIAGPAQPGPRVVPGRGDHRRAAEGGARIRADGDRQLRARHRPVGNPVPATGARLVAERPDWRAAAGTEGLAVSRLQPVHERCDGCRRLRAPAQRAAERPEHSPGPGRQRRRLRLPAVVADQVRLSGGGLHRSAGGGQRRLPPAGGAGGVADFAASCQRHPVRMLRRDRAAGRRRLRDAAGSAGRARGFRGSSCTRPGRGAAAR

SEQ ID NO: 25049 - protein, 139 aa, Pseudomonas aeruginosa
CRWSGSRRNSARPRVRWTTGGLSSAGGCRRTGCRPAGRGRSRAAGAVRRLASCAGESRGAGRCLRRTGAPRCPDAPAPGPRPAAAAANRARRRTRRRVARRSSLARAGFRWRRQGCRRRPVRRPAGPAKRSDASCSPHG

SEQ ID NO: 25050 - protein, 802 aa, Pseudomonas aeruginosa
RVTARNVIHVWNHRLDRLEPRPRRAAQHPRTHDPYPGPARAGRRRPVAVAARAARPSAPGDHRPGERRSTDACRGWRAGGADLQRRGLQLPRAARRAGDAGPGLPHPLGHRSGAARLSAMGRGFLRPAPRHLRLRPVGRARAEPVAGARSLRGQAAVLLPDRRRRAVRLGTQGDLRQPRGQPGARRQRHRRAVRPDHRADSRPRPVQGPAPGPAGPGAALRPQWCARVGLLGAARGTSRRGRRGQRRTRRPVAPRGGGRATGGRRPAGQPAFRRARLQRHQCLRGGRAGWRRAAPADLLRGLPRRRPRLRPDALAKQLGRTLCAAGGELPRYAAPYRAGRPGRGAGTGRGGAPGPRPARLGRAGRLALPAVPPGPRAHHGGTVGRVGRRGVRRLPVLPRPERPRTRRLPLAGRQERALATAAAGGRRTGGGAGIHPGALPRGPRRSAAAGWRGCRPATPARGRLPGAEPLAAGDARTQGPDEHGGRPGSARAVLRPPPGGVRMEPALGAEERRRGKQEPAAPGPARAPAAGDPGAAQERFPGQPRPTLPGAAARAGRPPARRRPLAAVRTGGRRAGPPGSRTGHAAAQPACLGEPDRRPGLPAEPGPLADPPWGRHQPLSGTFLAEDTHEPCLVPSRQRPAGAGQRFPRRRSRAARRPPAGYLVRAVRARRTLPGAALTGATGRPGAGGQPVHHRRRPRAPARAGRQHPRRAYLDGAAALAHPPPGGQRAAEAGRGRTGQQPQQLRRPSVPQPRGLELRRRSQSCPARRSRGLAHRLAGDPPGPRDHQRPAAHQHHSVRRRP

SEQ ID NO: 25051 - protein, 1086 aa, Pseudomonas aeruginosa
PPCCTGCIPMKSGCSGGSRGTSRRRGYSCSPRTIRSPRMASAARTTWSPRPWSRWAWLRRNGWRRSTRKPGCCRWAPAPVAGRRCANASNDTSGSTPSSPARRSCVSPTPPNTSVSTPPPSAPISHRWCRRRAWRNSSSASGGSPSGACRPTDRSAKSRSVSGAAGLGRARHNLMRNRSAARLKIGTGNCTRWHPQPIKDEPTMSNPRSPRLRLVPVLCAVGLACLGQPGESAAEEVRATSSAEIQRFDIPAGELAQVLLSIVRQSRTPIAFDQHLVEGLPAPAIQGSYSVEQALQRALQGSGLEYIRSAAGVLSLQRATAPDAALPAAKPAGTLATVVVTGTRKADVKAGESLAPIDVVSAEQLRDSGSGDLRDALVRLLPSLSRQAQAYNASALTNAQSLRGLSPNHVLVLVNGKRRHETANINVSGGLQSGSTGVDLDTIPLAAIERIEVLRDGASAQYGSDAIAGVINVILKSADHGGRLAYDNGRYGDGDGLTQNGGVNGGLRFGESGFLNLSAQFREQARTIRAGIDQRTGHYGNPSIGDPSLHRQALAYNAGVALDDNVELYSFATYTHRSVSSAQIYQLPSLAPRLYPNGFTPRITSDEDDYSLTLGARGGELFGAWDWDLSSTYGADRPEIGMDHSINLALYGETGDSPRSFDLARYKATQWTNNLDLRRDFDLAWLPAPLNFSWGLEQRRELYEVEAGDPWSYYNGGSKALPGQAPATAGQWSRDVLGAYLDLSIALDERWQLETAARYEHYSDFGSTTNGKLASRYRFSPEVSARASLSSGFRAPSLAQENYTSLGVSPTIASGLLAVNSPAARLLGAEDLEPEKSISYNLGLVLDPLPDLNLAIDAYRIEIRDRIVDGATYSGQPAIDALRAGGISIPAGLTQVSTHYMTNGADTRTHGLDLTASYLTRLGEWGRIDWRLGANVNRTKLVRNHRGRNGQPLLNDQQQAWITSSTPRSQVSLQADWSYRRWGLTLRETRYSKTVSELDYYTGEHAYSTTVFNRFENSPKYITDVALRYAASRNLTLSAGANNLFDVKPDKLPAESAYLGFNQYDTYASQISFNGAFYYLGAAYTF

SEQ ID NO: 25052 - protein, 363 aa, Pseudomonas aeruginosa
GGRTMSIELRGGVRASAVIGDSAFARQAARFLPDTRSRAVSAFDIQQKARLEEADGLDGALFTVSAAWPDPWLVAGWALAAAPRMRATVAHRPGSAQPTVAARALATLDGLSNGRAGVHLVIGSSDADVRRDGDFADKDERYRRAVEYLEVFTRALESREPFDYHGEFYRLEDAGSGFLPIQRPRPPLSVGGSSAQAQRLAVRFADVYAGHFASPTQTAELKRRLNEEAAEQGRRLKFWKHFQVILGDSPAAALDIAEHYRQAAFELLLARPLDELAASPQVARDGERDRLARLEPEALREWVANTVQRSFAGVLVGSVGEVAEQILAFHRAGIEIVQLEATTENAEDIRLRRQLIERLRRDA

SEQ ID NO: 25053 - protein, 500 aa, Pseudomonas aeruginosa
SMARSSPSPSPSPSAWGPGCWVTSTTARAPTRARRWSCSARSAWRQGCWSCSGAIATPSTGRHAAMGETERSRAEVGVWLLAGLAFVVGTVELVVAGVLDELAASFAVSQGRAGLLMSLYALVYALLGPLLVYLSAGIERRRLLAGALLAFIGANLASAAAPSFALLLASRLLVAASASVIVVVAITLAVAIVAPERRGRAIGLVFAGIVASLVLGVPLGTLIGEFWGWRSLFLLLAGVALLGLPLLLRLLPAIRGAPGIAPAEQLRALARGRVPFAHLASLLQMTGQFTVYTYIVPFLVGSMALDKPTISLVLLVYGGGGILGALLGGRAADRWPGPATFVAFLLLHALALVLLPFATGGLPLLLGAVVFWCVFNMAPGPAIQKYLVELSPDTAAIQISLNTSAIQLGVALGAFIGAILVDQVAVRALPLGGRRADPLRPPPAAGCPRSGRRAGRTAGSASIDSLPRGHGNSPGGRSSTSRLTTAIRGVACPAANAYHG

SEQ ID NO: 25054 - protein, 453 aa, Pseudomonas aeruginosa
PQRRRPRRRGLPAGLDAPRPGVDPLAAGVPRDHRATPDVRELAAQGPGARLPADPRRGAGGGAAVASRAVDADREPASHRPPARRPVRAGQGSVPDEPAGRPDLRADRRTPRIVPGAHPPVDEGCLALLLPGIPGMSEKPERQRIVEEAIEWMVRLQSGDFSAAEGDALERWKALSSEHAEVFRQLLGSLAPLQDSPWRGQPSATVLRALEQPSSRRRFVGGALGLFVLLAGGAGLERWVQAGMGLPGELATGTGERRDWLLADGSRLRLNARSKARPLLDGAQRRLELRRGAMRLEVKEDPRGAFALDCAAGRVDCASGSLLLAEERGAIRLVTLRGSARLTTGEGRQLAVAARRSLLFDAGGLLEQGPMQAGEDAWASGWLEVHDRSLAWVAEAFRPYLPGILQLDAEIAGNRVSGLFPLDDMHTSLDMLGRSLPIRVLRYSDYWISLRPA

SEQ ID NO: 25055 - protein, 149 aa, Pseudomonas aeruginosa
RSGSVRPGAVRRVPPAGGRGPGAAPSAGSGRCARSAPVRAGRVLRARPGRRAACGRRSPPRRRRSGGGAGRCFPGSSVHEPGLHPRNRPPRSPRAPVGNPRAPGWPVAPADAHCGSPPGSAATARCAAASRRGPDRCRRPAVGRCRGYS

SEQ ID NO: 25056 - protein, 204 aa, Pseudomonas aeruginosa
SPLAGAGGRRRLRRSRLGDPPATGRHRRLSGPGKGRRCRRLLAGKPLPGRRLRRPLASLFVFLRAEGRLVAQVRPAGGNPRLPAALRGQVPSAREDPFPLRGGGGPFRRRQRRMAGALRRWPDAARTGPGLRHRPVEPAAAAAPARPGALPGSGVPLGELGRRGRAGRQAGRGDRHRSPAPSSSSRGSPRRCNACRCSSAARLT

SEQ ID NO: 25057 - protein, 376 aa, Pseudomonas aeruginosa
SPRSSGASTWRCNRGCAIPSGSVAATAGTRLPPARTPTTGRATPSSIAGVRAGRSLPTMTWPAEAPLMSPPQRLRAGLLRGCLRLLFRGLVRPPMPVALQRGVLRGLSLATLGAGGVVRERRSLAGVPCEWLRPRGVEARRRVLYLHGGAYLIGSPATHRAITTHLARRCAAEVCAVDYRRAPEHPFPAARDDALAVYLALLEAGHSPRRLLLAGDSAGGHLALSLALELKARGLPLPAGLLLFSPWTDLGCQRLHTPAAGDPLLSRAWLESAVRLLLPADAEPGSAALSPLHADLAGLPPLLVQVGEDELLRDDSLRLAQRAGEQGVAVRLQRYAGCWHVFQAHAGVLASADRALDEAAAFVVECSVEGDRCRTS

SEQ ID NO: 25058 - protein, 327 aa, Pseudomonas aeruginosa
AIKGVNQRITWGKDVQLMSIQALTINRRQVRVASLVTAVLFLVVCISWGTTWLGIKIAVESVPPLTAAGLRFLIAFPLFLLFARLRHETIFFPRRLLAFFVFVTLGYFSVPYYLLNYGEQYVASGLTALLFSSMPVFILIFSAIFLRERIYLSQILGIAIGFGSLFMIIRSQGLHLDYTELLGVLAILLAAIMHALSYVITKRQGADIGVITFNTLPIGIAGLGLFMAGLVMEHPNLSAVTSRSWAALIYLGLVASVGGFIVYFFLLKRLSPVVLSFVFIIFPVFAVIIGAWYEGVAISRELIGFTVLLLAGFAITKLPIEKLLGRR

SEQ ID NO: 25059 - protein, 500 aa, Pseudomonas aeruginosa
TAASLRFPPVRLPLLCIRKRRNRGKHTHVESSPHRRTNPASQVPQAVADRHDRVGLPDPDDRLRHLRHRIRDFPGTRAHRLPGGPRRRAVHRDQLRQAGPPVPHRRLGLYLRATSDQSPCRLHGRLVVAAGLPVPADDQRTAGEDLPDRIVPRGRPVDLGGDVRADHDPHQHQEREPGRQFQHRLRAGPAGDHRGLHRPGDSRPEQRGGDRHGAQYPAVLLRARASLGDGGGGDDPLLFLPRFRRGDYAVRGNPRRRQGDPAGDLPHRAVRRGDLHHRVVFPAVLFPDQRTLQGTRRGAAGNRPVRRRQAVPVDLPLRHLHQYPGVGPGLPGQRVAPAVRDGAGQRAAGADLRLRPSEMAYAVDQRAHRGHGGALGDLLRPGDRDRADQFRRPGGLHLRQSLGDRAFLCARRAQPQPQGAFPLPGPAIARRGHRRGALAQPGKHLAGDGADLGRTGLRLPVLPDSQLQPSAAALPGERAEPDPVRRAVNGFSGNVKEKDW

SEQ ID NO: 25060 - protein, 869 aa, Pseudomonas aeruginosa
RRCRSSRSILRRAIKGPPVDEAASSRQAAAQAGFFRRQRAFAPIASAQRNQRRTAVARAVRLGVALQIVDAVQGQLADIPARAEVGLAERPVGKDVEAPAHLAGRRGEADGASRLRDHQQRSPWVGEGLLQLDQALAGGAHLAPVALAARPRVVGKFAPGRRLVAQQVVQRPGAGRRGFLPVRVVVAQVQQHSGQRADLVGFAVDADADLVGIVEGQGVLPQRLPIALRILGEIGAVARGGGHLDVARGAFAEIDLRRQPAFLGSRFAPAAQPALGVAQVAVALPGRAQGLEQRLEQGIAVFPRARVERGQVAAIATGLAQARPVFLGVVMEGFVRADGGQRLAIAGIAPQVRGADLQQHRRTAPVTRKGIAQVEIRVAVARHRGALRAAFGIGDPGTAAIAVEEGLVGHPPAGPESFAVLADGMGIGQVAAGERLAVRRRGGKGQGKQEQGQGSGHGGYGCARSVGATKVCRRFPIDRRGRCRVPLGGVARPRQVAQRRGAEQPAVLAAELRRAFVADPVAGGGHFQALAEDQPACFLQAQLLLVLQRAHRGHGLEAVVQGRGAEVDHLGQLLDAQRLAVVLVDPVDGAGDAVGLAVGDGDLVQALALAAAQQAVENLAEDQRRQHRDVARAIQQMDQAQHRIQQAGVDTVDVEAAVAAPAGHFHGPGVGDQLGDFRRVDIQPDAEVGCVRRGVDHLAGQRQGDRDHQVVQRIVDIAFLGQLHLLAALGDDAQGRFVHAARRQGGAVGADQGEGFDGGAVDTVAGAMPEQRLRQFALALAQFGGEIDGKKRGVFAHAGTRGGNLPKTSARRGDRHPSRCAMAGSGKHSPGTGKPARFTGRKRMRKNRNAAVSGKNPTVSVYRFPAPSP

SEQ ID NO: 25061 - protein, 140 aa, Pseudomonas aeruginosa
SEAGHMRHPYTPQRPAGVLAPPALPLLVPLAQRRIHVEEAESMPAFNRASHLVSIRARSGQSHRLGLRLQELAQAGQAAPGCLRYELRQADGDADLWLLHSEWSDEAAMQAYLSGDAQRVFAEVLWQALAATLDVQERPF

SEQ ID NO: 25062 - protein, 550 aa, Pseudomonas aeruginosa
RGAASARPPCSGVSATRRDRRLVRSFVFDVAMSLEGGRRRAIGIDLQHRARTAVLANEYLADPGAVPQALAGLAVLRNARADFQAAPLGQPVQRRPGRIEPAVEAVEPVQQASREFVLDPAAGDLPEPGPVLAVANPDVVDEGVMHVAGKDQVVTRRARVAEDVHHHRGRAAMGHPVFRIDQQRLADPAKELLHALDQLDPEHRRRRHDDRRLFAEQILLEFTQRLPVHQPGGPAQVALAAPAAGARVEDDQGRAARQPVVPVLEVEQGIEQAVLLGAGQPAVCRGTLHQGRDRRQPFAAMLRVVAPALAEQVGEQGVADDPPGERMAVGGQLPARGKVPVVGDVVVVEDHQRRDMRQCPRHAGQAIAEGFDVPALVGEALRVPRIQPRRRFQPDQAPGRRRPDQQVHRQHLGQADQMVVGVGRGEDRLLHPAEEALAQGFVGLEGGQQVLAPVVGGRVCVERLAVVHQRAFQVFAVQAEAADQPMDGHQHRPGRRRRRRPGRRSSSATPGGFRPAAGFPPAAGRPAAGHRPPGDAACGRSRGATGRDVA

SEQ ID NO: 25063 - protein, 198 aa, Pseudomonas aeruginosa
PDRRTDLRGDRRLAGGFRQPHPPVHGRGLQAVLPGACRMSQGRRERILDEAAQWMALLQSGHAGAEERLAFQQWRQADAEHGAVFDRLSMGLQSFRDEPMHGLRAEQLIGALEAPSARRRFLQRSLAPGGVRRGDAGAGADRHRRLPLARRPVHRHRTTPELPPGGWQPTGAGRAQPGTPRIRWLPASPALTRGPPAG

SEQ ID NO: 25064 - protein, 165 aa, Pseudomonas aeruginosa
TQPCRFSRPCSRARATQGWVRRLATWAITLCRTRASSRAASEACSWALFIARAASAWCNQPATAGSWSRQAQEAMAPIAPQSEWPQTTMSPTPSTATAYSTEALTPPGCGPYPGTMLPALRITKSSPGSRWVSSSGTTRLSEQAMNSALGACRVARDLNSCERAG

SEQ ID NO: 25065 - protein, 159 aa, Pseudomonas aeruginosa
STIAWTLAWAFSEPGAVEIDSQPLYRERLGLVLGAEPRGGTPPLAAAALAELPLALLRDDFATRRHIDAYMRQQGVTARVALEANSISAIVDVVRRGRLASILPEAVARQQAGLRCVALRPALPTRQVALFWRQGSHPGAARLAFQALALELGAELGDA

SEQ ID NO: 25066 - protein, 233 aa, Pseudomonas aeruginosa
AGSAATRLQRRGFLTAQPQGQGGAEQGEQGAERGHPFDAARLAGQQAGGIGAAHLGVGQRHQQGQAERAADLLGHRGHPRGDALFGGIDAAGGAHPHGGPGHALADAEDHDGRQQRQEAAPQRQARCQQAEPECAQQQAGDQRRACPVAGQQALGDADTEGAEQSRREERQAGLQHAVAVHRLEVDGQEVVLHAVAAHEDRGQQHRHLQVAVAQQAQRHQRVAAVVFDGEERQ

SEQ ID NO: 25067 - protein, 258 aa, Pseudomonas aeruginosa
QRDGKVKSETYRGRIPARLGALDQGEDQQGGAGGDRQRAGQVEAPTALAPGVGRDQAQGEQRRGAGQRHVDQEDRGPAEQLGERAAERRAEGQAERRGDAPDRQGTIARRALGEVIADQRQGRREQQRATQALHGAGEDQRQLALGQAAREGREGVQALPEDVHAAPAEQVGGAPAEQEEAAEGHRIGAHHPLQALRRKIQRPADFRQGDEHDGGVKGDDQLRAGEQGEHPVGRGGTVRHGGTPGLGWARPVFLMLES

SEQ ID NO: 25068 - protein, 205 aa, Pseudomonas aeruginosa
  UNSURE (99): Identity of amino acid at the above locations are unknown.
RRRRYPPLCLFARAYKLRTKRSKPALQISRAHRSSPGNHVFGGNRTMPHHAPSTRLPSSLALAALLAAAYAAPPEARAETPAPAAKALTFDVAAGPLDXVLLGISRQSGLLISFEQSLVRGRQAPAVRGPLSVDQALEQALRGSGLQFRRSERGAVISAAPLRAAVPAAKVQPLAGESGADPGAGGGDRLADSPRPARKGRRRSR

SEQ ID NO: 25069 - protein, 134 aa, Pseudomonas aeruginosa
ATAASCSPTCCSASTTCRTIPAGRPSPRRTSSMPPAATWSAGTGCSRPRRSAARAATTASGARCPGPAPSATATTSPILPGNTNWPRPAPSTAATALPATPRRPGSSTCTWAASSANATATRSTIPIRRASDVR

SEQ ID NO: 25070 - protein, 103 aa, Pseudomonas aeruginosa
ATGATPTGGLATCRSGVACTTSSGSVSTTTATAAWPCRRSRPGRPTSMSRPASRPGAAATTRRPCAMAGCARRAFPTRTRPASRAWCSTCAGRCSRTAGYARR

SEQ ID NO: 25071 - protein, 87 aa, Pseudomonas aeruginosa
TTAAAISTSAWCRPTACSARPAGMPSTGACWIPPDGRCASTSCSRARAWSARCCRSSATWRGSASICACARWTLRNTSSAYVRGTTT

SEQ ID NO: 25072 - protein, 375 aa, Pseudomonas aeruginosa
TPGGKSASGPRRAGRRSDMGGYLLRRLALILPTLLGILLINFAIVQAAPGGPVDQAIARLQGVDGGGPLGRGGEGGHGALEPQRHGETGIDPQLVAALERQYGFDKPPLQRLWLMLSSYARLDFGESFYRDARVIDLIAEKLPVSLSLGLWATLITYLVSIPLGVAKAVRHGSAFDLWSSALVVVGYAVPGFLFAIVLIVLFAGGSYLDWFPLRGLASEGAERLGPLARFADYLWHLALPVGSLVVGGFASLTLLTKNSFLDEISRQYVATARAKGLSERRVLYGHVFRNAMLLVVAGLPAALVSVFFTGSLLIEVLFSLDGLGLMGYEAALGRDYPVVFGSLFIFTLLGLLVKLAGDLAYSLVDPRIDFAARRQ

SEQ ID NO: 25073 - protein, 300 aa, Pseudomonas aeruginosa
DGHRPFPAAPPPPRRVPRQPPRAPGAAAVPRAVRHLPVRRADRQRPPAAAGIPWPVVPAGAAGLSGNRLRRRAAVPAGLPRSLHERTHRPRRLGAVAADPLRRPQHQLRAPGAGAALGGELAGYRRPGPRCARAGDLRPAPVDSLRPRPDPGLVVAGNLRRRGAGLLRRLDRPVRPALHRGLVGSADALPADHPRQPGAARGRLAAGDHAAVLLDQPGRRGSRRVPARSSPGVRQGGADPRPRRRRGDVPAHPAQRHGRDPDLPAVPALWRGDHPDRPGLPRFRPAARLAEPWRTGRAGP

SEQ ID NO: 25074 - protein, 158 aa, Pseudomonas aeruginosa
ASTTPRPAAGCAGARDCARCTRSACGCAVAAPWGSSAKAVRASPPSARRCCACCRPKGRSCSRASASTGCTASACCHCAGSSRRCSRTPTAASTRALAWNRSSAKACVSMASAMPANAARGCWRHCARSVSTSLAWNAIPTSFPAASASASPSPARWC

SEQ ID NO: 25075 - protein, 418 aa, Pseudomonas aeruginosa
DRPAGPSGTRSHVGFRVRPIDWGNAMSSLPLYFDYAATTPVDERVIRAMVECLGYQACFGNPASNSHAYGRQARRAVERAREQVAALVGASAGQIVWTSGATESNNLALKGVAQALDAPGHLITSRLEHKAVLDTVQQLADDGWSVTWLAPGTDGLIRPEQVEAAWRADTRLVSLMRVNNELGTLTDIAAIGERVRERGALFHVDAAQASGKVAIDLGRLAVDLMSFSAHKTYGPKGIGALYVGPRAERRLKAQIHGGGHEQGLRSGTLATHQIVGMGEAFALAGELFEEEGRRIAGLQRRLLEGLAQIDGWRLNGSADARIAHTLNLTFDNPAFVPQALESSLAVSSTSACNSARPAPSHVLLALGHDAASAGRSVRLSLGRYTREADVDAAVAALKAAADSGAPAWQPFLGVSRAG

SEQ ID NO: 25076 - protein, 510 aa, Pseudomonas aeruginosa
AAGSTRPRRSQGLRITAKRLFALRLQGLFVFAAISRQCALGGSSRLGIMRRHSHPPPTEVRLCLREPNGRSLPRFRLAACRQRPGQRRAAPVGGLHRRNLEPLRRPADQRGAPVPLAVARSAQSAGLLRPGRRHLRPEGNPVRVAEVSLADRRPGLRLGAQAQRRGRLSLPRRALPARRPDIPLRLFPRGLRGARAGRDAARGGPDRCAPAAPLRLRLDPAHHPHAAPRRRQAGRHASPRTGLRPAGTLPQGLRPAGEGALPRPVRHRDLGGLGLRPADRAVFLEQRNGRRGPPGPGHRRMPLLLPAEPLVRREGPQVRRVAGVVPRHALRCRRWLCAEGLAAGSGGLYLDARRGAGGRPACRPGAQPRPVARTFEAGPGPDRADPAGDDPALAPGRVAAAAGLGPPQRQPRLALVAWPAALAAAGTGRAGNPGQAAPFGAAAAGRMPRLPAVQPASAGTLRPHRRFAVARRLPLAAGRDRVQNHMRIPATKRASSSSSPSARARSALLP

SEQ ID NO: 25077 - protein, 163 aa, Pseudomonas aeruginosa
CRRRTRRTSPCVRSGAARWCAPARGRPGRRSGCAGRRRSAPAARCRAGRGRGRRASVSASWSACRPAGCRPPKPDGTASAWRPCPSWSGPCRPSWSGPCRSCPCRPSSNGPCPSCPCPTSSNGPSRWRASSPRHAPWRRGPCRPCPCRPCRSAGADRASAPAR

SEQ ID NO: 25078 - protein, 659 aa, Pseudomonas aeruginosa
PEKIRYMPVPASPCRFAAVCASLEARPGEGVLALAPDQQGLAQHHQVDHPVLQRAEGVLRGADDRFLVAVEGGVDQRRLAAAGMPGMQQGVHERIGLRPDDLRPGGAVDMHHCRAALAEIRMAVVGHGHVVGRHLVFTPANVASLGVFYRGDRGEWHELGAFHALIEPVVGAGIAGMVDDAAVAQGARAELHAALEHAQHLVFPQRFDQRLDQVGRPAVGQLRVLAGDHLGILRGAARVRPEGHARRREARTVLAIGHRHRRGQGQAAVAHAGQHVDIADPGDLAQALVQLDVAEHPAGQAQVGAAGARHVLPGDGHQQVFGVPLRGGGDIRRAFRRAALQQRIAVAVVGGQVQFAAAGAQAAVLQADHVVHQRQQLFRVAERRQAGDLAFVAVRLEAEQAGDAPVEVAQAVDAGLALQDRLAAVGAVVGDGERLEVAAAVAGEGQRLVERRADERAEGVAFVMVEVLDLAAQPVGADEGIEFAALGLVVGHLVGDPLAQVRQALGTLAGFLEDPVQVEVEVPPGVEPGVPAVGDAVDVGQVDAGLAEHIVDGAARPGLVVLLAGEALLAGGGDDPAVAHQAGAGQVVVGDPENDHAVSSCANGWGARGVIGCMAPGAQQPARSGRLRNLAGLPDLVAGQPSTGLPAIPAGRPRRHQKL

SEQ ID NO: 25079 - protein, 210 aa, Pseudomonas aeruginosa
PLSKRPSFRLLRVMKLITPPMASVPYSAEAPSRSTSTRSMAAKGMVLRSTAEPSMALFARRRPLSSTRVLFAPIPRRSANEAPPVALPTERLELYTPWLPESRPISSSVLVTPCWRSSSARRTLIGTAVSASTRRIALPVTSIRCNWTVGGSTGACSSAAAALPGASCRASSRAAPSGASVWSDRCMVGASLVPVCPGMSVEPGDFPGTA

SEQ ID NO: 25080 - protein, 385 aa, Pseudomonas aeruginosa
RPGHQLPRGGDPGGVAGAGRGVAGAHGRGRRRGQRRTDEQVSGRRGTEHRGDQGRGAPADPGQPDRTGGARLLVQEQGRASGARRGDRLSPGSIGNPGDQGYRPGRRREARRAPCGRRRAVLGAGVQDRHRPLRRHPDLRPCVFRGADFRRCGAQLGERQEGAGRADGADARQPARRDQGSARRRHRRADRHEGRDHRRHPVRHRQADHPRTHGLPRSGDLGGGGTEDQGRPGEDGHRPEQAGPGRPVVPREDRRGDRANHHFRDGRVAPGHHRRPHAPRVRRRSQYRQAAGGLSRDHPQHLRDRGQVRPPVRRPRPVRPLLDPLRSGRRGAGRPGVPQRGGRRGDSPRVHPGDPEGHRGPDAERRARRLPADRPEGDGVRRLLP

SEQ ID NO: 25081 - protein, 113 aa, Pseudomonas aeruginosa
FPSRLRLPTLRPSHGLVPGTAPVVATRFGRIAVMVCYDLEFPEWVRLPALSGAQLLCAPVNWPAAPRPEGERPGAAGRMKKGAGQYRRRALLPEENLIPVRLRSLPGASTRYD

SEQ ID NO: 25082 - protein, 141 aa, Pseudomonas aeruginosa
WRRPGWAPLWRWPRPRRRPGVRAAPGGAATGWGPWPIPVPARVRRGGRGSGAWRIPRRRLETEGWRCPWRRRRAARGGASAPGRQAPREDDWRCRRRRRWPRHPLPWRTAPLSPRTRLAPHPRALPFPPPAAARARRIRPR

SEQ ID NO: 25083 - protein, 576 aa, Pseudomonas aeruginosa
LGRVLLPCKKNLEDFTAHRAQHTAQARPLVRGRRASAIRHQDDDGLGDEVGIALQGLQVVHDDIVGFAAFMALRPDRQLLQGHAEGTLVLVETAEQGDSQVVIQHGGTPDPEKLSVAPLALRRHGSGSRKDEAVQPLPTGWPAFVAGAHGAALSIAPGSFGPTWQGDLSERRGWPAVVARRMASFPCRLAILAAREQDAVHEERPGPERRASCHLRYLSFVLLPRNGFRMKAAGGRSSRRPGVSLSVPIRPVLPARGMYAMSVTDASFPIINWSKAMPSLRQLMYFACVAEYGSIGQAAEVLHVSQPSLSRQIQALEVHIGEALFVRGPAGVSLTEVGRVVHCRAVKIIAEAKALTRDIGDGDDRQLHIGFSRYLDPGWSGELARQLKEARVCSAVSPSWAPSLDLLSLVRESSLDAAIIGAPPKVVREYELMEIGSYEHVIALSETLYRRLAPDWSLNDLIGEPLLVPKDSLFPAYSQFMNDAMDAAAFAPRRSVRPNDLSILLAQVASGDGFAFLPLSLTKFAYPGVAFTALPAAVNEGFRLPVGLAVSPTSRLRASDTQFECFVETARRVAAG

SEQ ID NO: 25084 - protein, 644 aa, Pseudomonas aeruginosa
  UNSURE (491),(513): Identity of amino acid at the above locations are unknown.
GTRPGAPAARGASEGLHVLDQGAALLLVELRVAVVVAAIGVARLAAVEEEAVGAAGIGDVADVDRVELDAAGIEGPRPQVRRQQQVVEGRHRAVVQVGRAGPDTVQRARLVGHQVAGHRQALLQAPGLVAAGRDVFGQEQGAWRVRGGRFDAVGVGAVRHRTDQRRQLPVEDAQGGGLEGTQGDAQAARGQGLDHHFLEHVHRIGLLAVETALAGADEGQVGLAAHVAGLQLGDAVAGGPRVGADRRDLAARLQVGEHGLHRGPQVVAVQRRVAAGAMLPVQLAALGDPGRLRGAEQLVRPGRRLQLAELVFDADQVVDVDARRVADVQRRLDRAEHLDVGEYPDRLAGVARQGADVELAVVDLDHVDVVRVEAGPLYAVQLRYVPQERIAHGGVLGAVDLLVGMQFVAHRVEDRTDGVQAARAELGIVRQVEVRAVAQAHDGGVQGCLQACLVGIVVAADQAVGAEHLAGEALELGGVGAGALQGAEDLXLEAGEVAHGLPAVDGQLGALVXDVRSVAHAAGRSDPGFPGALQGFPAQLGEGQVAVVAAVDRVALHHLHAGTAEGVRDIAVLADQRIGHQRFFAGALLQRHQPGQRQHPRALAGFQPGGLLGLVPALVEVDAAVVGECRGTGEDGKDGKAESR

SEQ ID NO: 25085 - protein, 412 aa, Pseudomonas aeruginosa
GHRAVLSIGHVGGAGSQGLEVFEQRQALAFVVLAGEVVAGVGVAFQVGVEKEGVVRAGRGEVADPARIELVAAGVEGGRPLLLGQQQVVQRRHRTVVQVGCGGPDAVQRASDVAEEWMLGIQAVVLARTLVGGDFAGGEALRLAVGRGGAGQQQLSGGHRLQAVGAGQGLLPGDDGVDDLGDAVGQLAFLAEHDLEHLGDLHVGDLRSPPDDADAAGGAEGRSEQAEVVAAGAAEGEGVAGHPRVGADRRVVAMGLQAHLADLDRGLQVVAADARMAGRAVLLVEALALGQPGAVRGAEQLARPGRRLELVDQALDTGQVVHADARYIALQAGQRMADHVAVVALDHADVAGQVAEVEDLAVEVEDLDVGHESAGLQLVHLQRVPQCREAGRRVGRVRLQMAGAGVDCRAVE

SEQ ID NO: 25086 - protein, 572 aa, Pseudomonas aeruginosa
LAGGVEAPRAGLQVGRGHAQQGVDQRRAFDQGGLQQLAVGRAVLAAEDVAGEARELVAVVAGAAQRGEHFVEDRLDVGQGGAGVDGQFAAAVTDVGGVAAGAIQPDPGFAGRLAGFPAQAGVGELAVVLLVEGEAARQAQFAALPVAQGKAEAPGVVFGEQALLAVRTLQRLGPGQRQQPRTERGVVPGGALLGVPALLELDFGGDGRAAGGGQCGGQQDPRKGRMHRVPLMADDVCVPTGQSDAVRSMAGRAATSSLTGARRPRRAAGRNVRLGTTLRSRGGRRVMLFVRRKRYGKRNRPVRKGRAGRASPCAPGSQGGERLGRCPFYRTIPAGLADEDQVECAEQREERHAEDQGHAERLGEEGGDQDRRHQRQAEQCRPGRQAHAEGQRRAAVAGAVAAEAEVGEEDHQPGEEGAEHRHRHHQGEGLLGVDQVEQGRQGDTDARQQQRVQRHALAAQFAEALRRVPRARQAEHHPGGDVELAVHRRQRGHQHHEVHHPGGAGQADRLHHRDERALALPGLVPGDDGEHQRQGQQVEHHQAHDGRAERRLHRLFRMLGLPGGRRPRSSPR

SEQ ID NO: 25087 - protein, 161 aa, Pseudomonas aeruginosa
ELHMSLDAIDLRILRHLQQDGRMSNQDLAEKVSLSPSACLRRLRLLESEGIIRGYSVELDAERLGVELEAIVHVSLRQDVEGWHEAFIARVRDWPEVVTAYVVTGATNYVLRVRARNLKHYSDFIVNKLNRAAGVTDIRSEIVLQEIKAGADLLDLVNLKS

SEQ ID NO: 25088 - protein, 425 aa, Pseudomonas aeruginosa
AVSEYIETDDASYFRVRRQAYVSAELHRRELHEIFDDSWLYAAHLSELREPGDFITRDVGGRNLIIQRRADGEPAVYLNACAHRGAKVCAERQGNSQRFTCPYHGWTYDSHGSLIGLPDKAAYQHAGQCHPELSLTRVKHAVYRNFLFIHYAARQPSLETYLGQAKDYIDLICDQSEAELEIIPGGFEHSIKANWKLLAENGVDAYHLPFAHKRYLEYLNTLGTDPESHKRHGRGEALGNGHALIISGPPSTGRPIAYWSPLFPEALKPSIAAKFERLVERFGQARAEDIAHTNKSLFIFPNLVINDILGLNIRSFFPTAADEVSVTVWGAGFADETREERAARINGLISFIGPGGFGTPDDVEILESCQRAYAHAALGYSDFSRGMGPATRRHVDEEQNRGFWREWSRRLGQQPAALRLLAVAV

SEQ ID NO: 25089 - protein, 639 aa, Pseudomonas aeruginosa
AVFNHRSLQIPARRPGYAGNKGSLQGTSSMCGITGWTDWSRDLGEQRSILERMTRTLAPRGPDAEGLWLSRHALLGHRRLAIIDLENGAQPMLAEAGGRVALTYSGEVYNFRELRAELETLGQVFRTRSDTEVVLRAYLQWGEASFARLRGIYGFALWDEREQSLWLVRDRFGVKPLYYYPTAGGVLFASEPKAIFANPEANPVLDASGIAELFALTTAPTPGHGLYKGLRQVRPGQALRFDRNGVRELVYWALRAERHEEGAEDSAERAGQLLREAVAEQLVADVPLGSLLSGGLDSSAISAFAVAALDGDARRLPTFSVDFPGEGRGFVPTPWQSSWDEPYAQLAANFLGTPHRTVLVAPEEVLEQDEAVLQARDLPGWGELDASLYLLFRQVREHTTVALSGESADEVFGGYPFFHDPSALAHDGFPWLAGKSGPWQLLRREVAERVAAPEYIRARYREALAEVPRLDGEDAAQRRQREVAYLALSRWLPAMLERKDRMSMAVGLEVRVPFCDHRLVEYVWNLPWALKSVAGESKSLLRRALRGHLPQAILERRKSGFPANPDPRYLALLRERVGRLLDDGRSPLFELVDAGRVRQALEQGTPLPSPRASASPTAGLAYLLNLDRWLTRHGVDISL

SEQ ID NO: 25090 - protein, 173 aa, Pseudomonas aeruginosa
RRILMSLALSRPDSDLLARVSDFLVAEAELLDDRLLDTWFALFERAARYRVLPLQEQLAGQAPEDSLYIIDDDHVRLRERVDSILGGHTWMEQPRSRTRRLVGNVRLKRVEGELVSSRSNFVVHQFRNREAWNFVGEASHVLRDGPEGLRIVSREIRLDHETISAQRRISIIL

SEQ ID NO: 25091 - protein, 521 aa, Pseudomonas aeruginosa
GAAHEHRSVAARLRLPDPAHLRRAPPRRREGQRPAAAAVAWLSADPPGLASHRSAPGRGLQRGPRRPARLWRIAGAGRGGRRLFQGRAGPRPTGNDGPARLRTLRGDRPRPRRAGRLSPGAGPSASGRGLRLADRGADPRQLGRGEQGLRPQRLSLVPPRPAVRPAGAPDRRRSGALPRLHPATHGPGPRHLPPAGAGKLPPGVPRPRRAPCDVRGLPGRGGRRCRRRPGRSRRRPAPAMPGPGALAGAPLRRRAASAGNLEDLGRAGRGRRHRRQPHASRGRAGRRAGAPAGVSRQPPGGAPMSAVERDPAAQATLWRQRVFEVHAAMSAYVAERHRREDLGDWVATSARIFADLPATDDLRAEAWQAVFFRAQALIEQFIVARPADYRLDDWARATARIYRALEPAGRGDPASAADRLARQAALYGSRFEVQAEADGRAVFHNRHCAIWDYRERARARGVPITLESACTYCTKLLSAFVAASDCRADWRLYEEPQGHGCVWTITADSLNQGAGVHERDH

SEQ ID NO: 25092 - protein, 172 aa, Pseudomonas aeruginosa
RAAVPVGRAAPRGAGGIPVHLAPSVRRGWPRRRGRPGRPGPGRDGPGCAGTGGGALRGSRAAADGHPHPWPGGVARTRRTTLPGRLHRLPPGGPACRRLRRIPAFPRRHLRHLFRTAGAGDAPGGILRPPRADRRAAHAGRRTGQRNPGQCLALPGSGGRGITLCAIGLPRG

SEQ ID NO: 25093 - protein, 161 aa, Pseudomonas aeruginosa
ISPGAWSSAASSTRSRPAIPGPTTTAVPRHSPGRRRPPPDSGAATCSAPISTCPSPSTSAGNWRRRRATSTTATSAAPPTASSPAATASAPRYRRGPVSAAASARRRWPRRTTQAWASRRPSPAACWRSTRRRPGCSAPKTWSRKNRSATTSAWCSIPCRT

SEQ ID NO: 25094 - protein, 392 aa, Pseudomonas aeruginosa
PAEGLAGGSLGRARPGPAADRRAGPVPGQPGAGAQRLAAIPAVRAARPADAGQHSLCADSRRLVRASSRRGLRHPRTRLRRRRAAGAVPGQRLHRRLRLARHLPRLWPARRPPGAAAALCVVPRATRRPAAGAAPASRRAARSDARPGLALGGLLADRRQPDPRRVRRHWRDGAWRAAVAGARPVAGSRHRRAGGAVGRHDRFATGAGLPAGPLRHPAHRLAVRPAGGARAAAPAPWRTAGAALGRGVPDRPGRRRRDRHHPVLRQPLLRPAPFQRDLWLDPALHLRHRHQPGVLAAGLLLRPRGLLRGLDAGPARRVRRGGRAAGHARALSLRHRRGGTQPWARLNGAGRRSASGCWPDWPSWSARWNWWWPGCSTNWPPVSPSARAGPGC

SEQ ID NO: 25095 - protein, 382 aa, Pseudomonas aeruginosa
PASSPSTPTSCRSWSAAWPSTNRPSAWSCWSTGAAASSARCSADAPPTAGRGRPPSSPSCSCTHWPWSCCRSPPAACRCCWARWCSGACSTWRRGRRSRNTWWNSARTPRRSRSASTPARSSSAWPWAPSSARSWWIRWRCARSPWGGAALILCAPRLRLAVRAAAGGQGGLRGAPRLIPYRAATGTAPGAVPQPPGSLPLSVAWPAQQRTLTMDSQGSIKNTLIAQLFQQNYDWLCKKLSYQTGCSHSAEDLAAEAFLQVWMLPDPASIRSPRAFLATIAQRLMYESWRRKDLERAYLQILAEAPEAVQPSPHEQWMLIESLQAIDRLLDGLSGQARAVFLMSQLEGLTYVQIGERLGLSLGRIHQLMKDALHCCYRGFQE

SEQ ID NO: 25096 - protein, 414 aa, Pseudomonas aeruginosa
PPARDASWRWRHDVACCSMPAACSNRARCRPERMPGPAAGWRSTTAPWPGSRRPSGPICQASSSSTRRSPATASAVCSRWTTCTRPWTCSDAACRSACCATATTGSACAPPDSFVEEQQATQFDTLPRRRIGRGAGIVEGGVRAEAGLRVLPRIVDLQQQRFLRQQVRVVVPAVLRVGLDRVGFAHLVAVHQVTGHQVVERQAAGVQQRQRRALRRVAERTPQVDDLEASGQAPFGAFRRQVVADPARRRAQGLVVVHVAHRFAQAAFFAPGLVDAQRVVEDHRLGGAGQAAEQGDAFRVVAFTNLGFILEIAHRARLAHQLETLALQAGRLRQQTRIADRHPGRLQQRAVLRRPGGGRIGVGDRPLAVVADIVDFGLDLLRRVRRPCVLLATHVSFSRCQRRCLRCRAAGCRA

SEQ ID NO: 25097 - protein, 351 aa, Pseudomonas aeruginosa
DAAIRRWAESRRTAWQATNGSTTMHNESRPEAPLRVLVVGAGFAGLGLAIRLRQAGIDDYLVLEKAADVGGCWRENRYPGAACDVPSHLYSFSFEPKADWSRKFAPQAEILDYLRHCADKYRLREKIRFHCEVEEARFDAGSGEWQVRCADGQTLRARALVCATGQLSRPLLPRLPGLERFQGPAFHSANWDAEVELAGKRVAVIGTGAQRHPVRPADRPAGATPVAVPAQRALRDRQAGPHLRRLGTPPEGALAVAATPGSGAQVPAPRIADARLRDLPGADEGDAAELPSSPAPADRRSATARAAGSRLPAGLQAHPDQQRLLPGAGQEQCRTGRHGHSRSHRRRRGRP

SEQ ID NO: 25098 - protein, 399 aa, Pseudomonas aeruginosa
RRAACRCRPGCCCSRPGPTSAASACTRRRPATRCCRGPGWKARCACCCRPTRSQARPPCRRCMPTWRGCRRCWYRSARTNCCATTACAWRNGPVSRASRCDCSATPVAGTCSRPMPACWPAPTGRWTRRPRSSSNAAWRAIGAEHPDQWCRFRNRRRQRAAVPPPGLAGRFAGHRCRGVARLGRATARRLAPRRGRQRARRGRRGACAVLCRWPPAPAVQLRRRPAFRPLRRGRPGGPRAVAGDQPAWRPQLLSRGLSVPARDAAGAGAQHGLGIGAVWRTGDGRLLGLEVRRARAYRGAGAGMAPPRYSCGRPDSAVRSHADGRRAGLPAAGVASPGAETGRRGYRRSGLAAGAQPAGTPAGGRVVHGAVPGWAVVSAVGEPSGDGVVVAGLGSAQDG

SEQ ID NO: 25099 - protein, 178 aa, Pseudomonas aeruginosa
LASPCSYWLDLPSPSFPSRSCSAGGDMNTNVLTEHALSVIYRHACRTYPRECCGFVLADAKVKEGTNIQDELHMADPRRYPRTAANGYTFSVTDTVFLNSSFKTCSPVSVIYHSHPDVGAYFSREDIDKALYAGEPMLPVDYLVVDVAAGNVRGAKLFAWRNGRFECTREFGPSSQDE

SEQ ID NO: 25100 - protein, 272 aa, Pseudomonas aeruginosa
TTGHPRPPHSSATTAGSHADPNSTNGGIMTQTASLFLQDSYREECLARITDLVEDGLLLDQTVFYPQGGGQAGDSGWLTLADGTRLRIADTRKGTEAGAGRDAILHIPAEGQATVLRAMKPGEVVLAQIDWVRRYRHMRLHTAAHMLCAVLPYPVNGCSITDEHARLDFVTSEPLSREAIDSALAAMVEAAHPVSIDTMSDDALRARPDLVRTMSVQPPMGAGQVRLVSIKDTDLQPCGGTHVANTEKVGVVRVSKMEKKSARTRRVVLVLG

SEQ ID NO: 25101 - protein, 917 aa, Pseudomonas aeruginosa
ATTVDMAVGFPFYATGHPRHARQLHAMPEGLRPATTADRPRRSAGRHPHIRAPAARRHRNAPRMPGHSAPPARRRPAPMGCGAPAAERRGGRCRRTRRRAGVVPCWTRCKTPGSARTRRMHSWDAGPAGLYPGASDGGTAEPGGRRSVSQQGPGVFVSRNLDGGGHGGNLLGKGPCGALFLGPVENPTVQSISPSAPPVDCLETLAPRRQSSLVRPQTRPGGENVQHGCRSIARTLEPVGGEARLRLPRRWHQRDHGRHGPARRGIRLYPRAPRGDGGLHGRRPRQVHRRGRGVPRHLGAGRDPPAERALRRAHGSSAGAGHRRPAGGYRVGQRLPAGSRSAELVQGRFRLCRDRGQPGTTAPCAGPSPARGGRRAAGGDGDRAQRRATDGGPEAPAPRARPRDVGGGLRPAATLRARRRPGGRRGDPQSRPARGDPRRCRRPGRAPATGSGRRAPGRRSGQGAPGQGGGFRRPAVRDRLHRPARHPRQQHADGALRHPADRRQHFPLQRVPTQGRPGAGGADRPVSAQHRYPLSDRPGLARRCRGNPGAPAAAARAEKARRLAPPGRAGGDGQSRGSPAPGRRASRPDQPAAGIPFLVGATAGRCDSLRRQRLAYQLVRPRHPHAPGHARLAVGQAGDHGQRRALRHRRQARLSAAAGGGDGRRRRHADERQRRTGHRAAVLAALGLADLHRAGAEQRRSQPGDLGAACPGRRPGVQPGAGSDRFPLRALCGHARLQGHPRGSPGGHRRRLGRGLRRRPPGAAGGGHRPERAAAAAAHQFRAGQAPAWRHAAGRSQALGGDSPERPAGPRAALSKAVAALSRRGRYATGRPVRGGGRSAPAIRRRSGAGQDRRSPGRFPRSVRPDGPAGESARRGNRARRSRRERRPAVRSGAARAAPRPFPRPGRATDGRTPAVR

SEQ ID NO: 25102 - protein, 246 aa, Pseudomonas aeruginosa
PGLPASTARRSRATGSGGWPKEQIPPGWPPALKWPWPPPASKLPHPGHRLACRWPPVGVSPTATSSRPRSGWAATVWRSTRTWSTSTALPAPTTRSSASWPSCGTRSPSGSTGCRSCPARRCRWTTARGRRRGCRGRTATASPGCSWPRCATRGAVSGAWSGSPASRCGQNCTSRPGATSAARAATWCWTTSRRACSSPTCTSPSSTRCLPPRWRTTRWWPTRPGSGTRTARAPWRAPLATPRPRR

SEQ ID NO: 25103 - protein, 150 aa, Pseudomonas aeruginosa
RPPVKRSASDDVTPGMPLATCSTSAAMRSITPRSLPVTFTPIGLLMPVASISMRLRIGGIQILDRPGIFTARSSSSTSFSGVMPGRHCSLGLSLTVVSNISRGAGSVAVSARPALPNTLSTSGTVLIMRLLSCSNSVARCAESPGRAEGM

SEQ ID NO: 25104 - protein, 181 aa, Pseudomonas aeruginosa
SSFSGTCLCARSECRAGTAITIGSRQIGSATMPSPTSAACANPIVKSPDRRPRICSVSGTSERRISTSGSSARQRARNADSRGSIAPSEIAMRRLPLRPAAMALAFSRACSRTVKSRRVSCKNAAPATVSRVPLRSRSNSVTPSSSSNSLIARDKGGCSICSLSAARVKCNSSAKTTKHRR

SEQ ID NO: 25105 - protein, 202 aa, Pseudomonas aeruginosa
RKANMRFCFMLRTVLTESVRATAMPRRSPLTSVTWALFIATSVPVPMAMPTSAFAKAGASLMPSPAMATMRPSFCSRSINMSLSAGLTSPCTSSMPRRAPTALAVVCPSPVAMMTRRPAAFNAARASGVLPLTGSDTASKPASCPSTARYMTLAPSPRRASAWGTSGSTDTPDCSISTVLPNASCRCSTFPRTPMPVPDSKL

SEQ ID NO: 25106 - protein, 70 aa, Pseudomonas aeruginosa
SKAGRPSVRVPVLSMTRVSTLRRFSIAAASRNSTPCVAPRPVATMIDIGVARPSAHGQAMIRTATALISP

SEQ ID NO: 25107 - protein, 178 aa, Pseudomonas aeruginosa
PATTSAMRCIGALERCAWATIWTICDRTVSEPIRSERMTSAPLVLSVAPMTLSPTRLLTGSGSPVSMDSSIELLPSCTMPSTGTFSPGRMRSRSPTCTWLSGTSSSLPSALMRRAVLGASPSSDLMAAEVWERALSSSTWPSSVSEMMTAAASKYTPTRPMDMKEAGNTSGATVATTL

SEQ ID NO: 25108 - protein, 244 aa, Pseudomonas aeruginosa
AAIFPRRSDFMGHAMKLLVVEDENKTADYVRQGLMEAGFVVDLARNGLDGHHLAMGETYDLVVLDVMLPDVDGWRIVRALRDAGKQVPVLFLTARGGVDDRVKGLELGADDYLVKPFAFSELLARVRTLLRRGSAPSQPDRIQVADLVLDLARRRATRAGQRINLTSKEFALLELLARRQGEVLPRSLIASQVWDMNFDSDSNVIDVAIRRLRAKIDDAFNPKLIHTVRGMGYTLDAPDDAPAP

SEQ ID NO: 25109 - protein, 139 aa, Pseudomonas aeruginosa
CSAQRQRSHRELAPGRCSVMCSVAARLAPMIRIDALWLSTEPLDMRAGTETALARVVAVFGAARPHHAYLFANRRANRMKVLVHDGIGVWLAARRLNSGKFVWPRDAATTATLSRTQFDALVLGLPWKNVGEAGVITVL

SEQ ID NO: 25110 - protein, 158 aa, Pseudomonas aeruginosa; identical to SEQ ID NO: 23073

SEQ ID NO: 25111 - protein, 103 aa, Pseudomonas aeruginosa
SEFTMKTQVSAQAKKLFASLALAAIVAPVWAATQTVTLSVPGMTCSACPITVKKAISKVEGVSKVDVTFETREAVVTFDDAKTSVQKLTKATTDAGYPSSVKQ

SEQ ID NO: 25112 - protein, 135 aa, Pseudomonas aeruginosa
TTEPEPGALGSVVSAMGCAACFPAIASLGAAIGLGFLQEYEGLFISKLLPLFAVVALLANALGWLSHRQWHRSLLGMIGPAIVFAGTVWLLGNWWAAHLVYTGLALMVGVSIWDLVSPANRRCGPDGCELPTKQG

SEQ ID NO: 25113 - protein, 578 aa, Pseudomonas aeruginosa
RREPAANTEKERLMTTLKITGMTCDSCAVHVKEALEKVPGVQSAEVSYAKGSARLAIEAGTLPDTLTAAVAGLGYRATLADAPVAPAGGGLLGKVREWLGSDDKAGGDSGKLHVAVIGSGGAAMAAALKAVEQGARVTLIERGTIGGTCVNVGCVPSKIMIRAAHIAHLRRESPFDNGIQAVAPVIQRTALLAQQQARVDELRHAKYEGILEGNPAITVLHGAARFKDNRNLVVQLNGGSERMVTFDRCLVATGASPAVPPIPGLKDTPYWTSTEALVSETIPKRLAVIGSSVVALELAQAFARLGAKVTILARSTLFFREDPAIGEAVTAAFRAEGIEVREHTQASQVAYINGERDGEFVLTTAHGELRADKLLVATGRAPNTRSLALDVAGVMVNKQGAIVIDQGMHTSSSNIYAAGDCTDQPQFVYVAAAAGTRAAINMTGGDATLNLTAMPAVVFTDPQVATVGYSEAEAHHDGIETDSRTLTLDNVPRALANFDTRGFIKLVVEEGSGRLIGVQAVAPEAGELIQTAALAIRNRMTVQELADQLFPYLTMVEGLKLAAQTFNKDVKQLSCCAG

SEQ ID NO: 25114 - protein, 512 aa, Pseudomonas aeruginosa
ACISCATTCCADCCGRWRARQAATACSTRRPCSVCASCDPPSKRASASMRWRGCAGRWMQRTAAKRPRSLPCCASSSNTGAKRWPIWKRSWPPCRPSRHSTRRVCHERPGTPADQDTQAVHRLPVGRAGRAHLSLSFADSRRCAGRNDSRRIHRGALGYCSPHADRLVCSVRDAATAGLPGRIMTTSQPAGWTATELAQAVVRGQLELHYQPIVDLRSDQIVGAEALLRWRHPRLGLLLPGQFLPLVESSGLMPEIGAWVLGAACRQMREWRMLAWQPFRLAVNVSASQVRPDFDGWVKGVLADAELPAESLEIELTESVAFGDPAIFPALEALRQIGVRFAADDFGTGYSCLQHLKCCPITTLKIDQSFVAGLADDHRDRTIVRSVIQLAHGLGMDVVAEGVETPTSLALLRQAACDTGQGFLFAKPMPAAAFAAFVSQWRGATMNANDPTATSCCVCCKEIPLDAAFTPEGVEYVEHFCGLECYQRFQARAKAATETSAEQNTCDSPPSG

SEQ ID NO: 25115 - protein, 223 aa, Pseudomonas aeruginosa
RDVEADYRRFGWHLHDQYRNVLLVGVGAGRVGAAEFLDDHRLAVVGWTDQQQVGHALFVRPRIQGFQPIQRLDCSRIADPAVSAKAMDAFVRRKTGQALGHRHQVGQVDDGIFFHGYHSSIWSNGLAGGWLSACGSAMSASGGGVVLKRTAVALRCWRRSASRRALRVAFCAVDTISRIWPIMRNSADSSTCSRPCCRNFASACRCSQRVTAGCDKVRYGISR

SEQ ID NO: 25116 - protein, 106 aa, Pseudomonas aeruginosa
PSRRRVALSGSRPAIRRATVLRAGARSFCALQACATSRWNAARLRFCLVRKRFCSNSRMMRSTDSGKRPLPFPPPDRLRARSVTSPAPCRARRIRTYTCRLDRPSA

SEQ ID NO: 25117 - protein, 372 aa, Pseudomonas aeruginosa
GFLIRDMSTCQSSSCSSSCNSQTVDEAPSAIASVESTFSVPGMDCPSEENLIRMALGGLTGVGPMTFDLAHRQLRVVHSGEPARIAQKLTPLNLGAVLLTSERRTEGGQWKTRFSVPKMDCPSEENLIRMALADASAVAALDFDLKDRVLTVQHGGSTQELLGRLIPLNLGAQVLDSVQSDESTAPDAEGNASEARTLKLLLAINGAMFVFELIVGLIAQSTGLIADSLDMFADAAVYGLALYAVGRAAALKMKAAHIAGWLQVVLALGALLEVVRRAVVGSEPASMLMMSIGLVALIANVTCLVLIAKKRDRGAHMTASYIFSANDVIANAGVIVAGVLVAWTGSSYPDLVIGAVIALIVLSGARRILNLR

SEQ ID NO: 25118 - protein, 161 aa, Pseudomonas aeruginosa
RDSRQPCWRMVMQLIECAKAAGVTPDTLRHYLRVGLVVPDGRGTNGYRAFSDRSVARVRFIRNALALGFTLKDAAEFVEMSQRGASPCPRARALLSERLDEQARRLKEATDLHRRMQQAERDWKRLPDGVPDGHSVCGLIEGADADVQRNSVRAKSRRVRA

SEQ ID NO: 25119 - protein, 611 aa, Pseudomonas aeruginosa
LGAALVAGRRQRLRGTVHDPQRSPHRTAQHHAAAGGPRMVPPASAAERLRPDGDRRHRPRRVRLGRSRDGGAVVGLRGWSFAGHRSVPGTPPLHHRRSAQGIRLPRCWNQCRAQPAAGGEPPGRPDSASAVQRGCSRSLRAVARTRRSGRTTAPARSAASSPGAGPCPGAPPGGGPQTSGSAVACCGPGRGLANGGTRRSLRGPRPSQPTAASAGRQSGRAAQQPHGPDIGPAQTPRLHARTGPGGGRRWRRDHGAQRRSGGQRGAGQQGRHQLGRLLRGICRQDAGRAAPGNPVRATSGAGRHTTRMAVGGHGCDVPHLGERQERAVAPGSDAGRSAVGRNVRHLARVVPGRCQQCRCGAARGLRLAWPVLDAGRSQAGRRQPVECRAGRTLGRSGWLGGETLRRPRRVAGCHRRIPATAGPACGAAPRSRWTSDRSDLRHRAGPLQSTPRRTRAGLCGRRPGLARPVPGDCRRARHRLAHATRADAGPDASDRYRGAADPCLGLPGARRDTRCGRHAVREPLHVGARRGGGGSRARCRSAELAERRGVGGRAGAWRPARHHGLGLTPFQHDPRPDADCADALCFFMCVARSHWVRMSDEWLWDRWPRRA

SEQ ID NO: 25120 - protein, 477 aa, Pseudomonas aeruginosa
LIAVSGQAQGDGKASSSHGRVRREHSPCERPTAQRHQQDKFGDLIDGCGDEQGQGGRSGGDGALGHQAANRERDRIDVHQTRGSGGQHDASIPEAIGKKAACQHHRGQEGCELERGAQLQWVAKLKFGQVVGGRPRRQERPQNTASHGHGHEDDHRVPADAGGCDGDESRHARKHGCAGERRPRRCQWMPAWRLPGPARQRGRGGGARHDPAEQRCEYQPSFPAERAHQDEPSERQHCQQDNGPPKAIGIQRLIGAKATIREYGQYDHADQQQLRAAADLRLGQLADAGVQELLETQQRQHDHGGDRRNAPSATGRQRPDGESRKGGDGRGQSHHGMHMRRHQVAHHQIHPDEYEQRDEHAGSPALGQQPAKAAEQADQRKGANARDAMSLGPLALLPSPFQADQKSRSECQPEPDQRGIIEFTHRRTWTRSRMKSRCSPSEASVRAIDTWGSVSMPLKARMASMVSGITIAWLKTW

SEQ ID NO: 25121 - protein, 64 aa, Pseudomonas aeruginosa
SCTTSATPASAMSSWSATASATRLPITPYPFTATLTLFMPDSLLDEAPQPRLRAMENVNRIASA

SEQ ID NO: 25122 - protein, 255 aa, Pseudomonas aeruginosa
PSSASTGMSPQRGPTPCCINKLDAMYRPSVTSASATRRPRRSIPLSILASGLIDSCSRSPCRKTLCRRRAIREGRAWAAFPSSYGRRCDAADLGSSKTPVVVWREMASMMENSGASSRTVPSSNNRVRVSTRRSLGSRTSWVRPAATSCARAPESDQSFSGLCAQSATRARTTGTNTARSVPSPSRPRSSQASTTHSASCSTKARANATSARRMLPSTRPTMPKSCTHMRPSSITKTLPGWGSPWKKPSRKIWAT

SEQ ID NO: 25123 - protein, 458 aa, Pseudomonas aeruginosa
DGQHVAGLQCRADPAADRLLTIGDAQGHVQADGAAHLLQAPTERRRGLRAAHFGGGTHGQVDQHMGRARSGLLGQDRGDELALAVQVQRPLDADEDVVGGAEPYRAAPDDAAARAFDHAPHASHIQVHRRQHLHCVGRPGRRGDGARGGLGHREAAGGHDGHHEQGRAVAGQAADAMLVHHQRAPPIDAVTDANHGFRERDGLREVQAIAGAGGDEGGQMQVRVMARRDVGDDGAELGIAQGIAVDLGPDMAERIQRRCMGHRDQLARLRPQRRPCRFGQASDVLGQPIPIDDAERRHDAAAAGRQLHARLGRETLRPADRAVAPHVDHRLLMGVDAGAPRLQRVHAILSGAGAGLVQVRRHTRSTVCRYSGTATDQPSSWSIRARSASAASGSPWVTKVRRGVCVKPRIHARISSASAWAERLSSEATSARIGTSWPWMRTVDAPCTIAAPRVPPAW

SEQ ID NO: 25124 - protein, 386 aa, Pseudomonas aeruginosa
SVRRLPAMPPSKSPWRRRGVITSSMMRRDTTSLSAPSMPYPTSMRTVRSSLATRSNAPSSTLRRPSFHCSTTRRVYCSTGSGRVERTISTAICTPLRCSKARSCASSAATRSAASVPVRSVTRACSGGTATNSCADATERNRLSSSQARAWASRRGAAGESTAVLGVLMSGARRRRRGAEIDLWRRRHGLLVGDREIGLDDVAEQLGRDVGREAAREHVVILHRLHVAPTRHGDAVLRALKLGTQVLKSLVRLELRVVLAHHQQPAQRAGQFALCRLELLERLGVVDEFRRGLDRGRLRAGLDHPGQRLLLEVGLALDGRDDVGDQVGAPLVLVQHLGPGGLGLLVQPLEVVVAASAQRQGKRCEQGTSGSVSWFGFRGSEKSAGR

SEQ ID NO: 25125 - protein, 159 aa, Pseudomonas aeruginosa
SRHLRGRKERACRPARTASGSRRTSSPSGNRRTREWRRPGPRRSDCACPEPCPASSPTRGPCRASCRPSQGRLRGPGAQHGRRASWPQPSRVRPWRGHARGAPHAPSLAPDVRVRRDGRAPHGWGRQRRQRRARTRAWASARHGSDSRIRRCAGADPRH

SEQ ID NO: 25126 - protein, 146 aa, Pseudomonas aeruginosa
STSWLFFLFAVFVVSTSESARVQAVLRELEDDLPVGSDDLVLLAGVVQPGEDVSDQVEPRQPFVVGVHDRPGRRGRMGAHEHLVARPCIAVPVLKRDGIHRARLPLFEGITAAFPEPAALLLLADVEVILQQLDTGVDQHLLELGH

SEQ ID NO: 25127 - protein, 145 aa, Pseudomonas aeruginosa
TVDRSMNEGLGDWMTVGRLAKVAGVGVETIRYYQGRGLLPIPKNAGSFRRYPASMIQRIGFIKRAQSLGFSLDEVKSLLDLEDGRNRRAIQTVTRRRLDQIDEKVGDLQRMRGALRDMLERCEDTGEALPCPIIAALMGPLNTSE

SEQ ID NO: 25128 - protein, 89 aa, Pseudomonas aeruginosa
RLQACLLQYMIHAETMMKQRSVRTATPTTVVAKPFATERVPIVGDVASLGGVTVSNVRFYEAERLIHATRTAGNQCLYGPVSSTYASFK

SEQ ID NO: 25129 - protein, 220 aa, Pseudomonas aeruginosa
SESCLKPAWEITMPNAIEFIADHLPRVTVEDVRRFADTVEIRDATAFAAELQAFVHERVEAVKLPASLEAETVQEALARKAGALRAETRWAPSETDVQRGRAALLETFNQPHNLAIPEYAKLADKSRQQIYKDILARRLLALNVGPRGQKLPDWQLDPVKQQLTQTVLQEVEGIDHWTIYRALSEPLEGLGGRSPVDTVTHGTIDDVAEAVFNVLGVQVH

SEQ ID NO: 25130 - protein, 214 aa, Pseudomonas aeruginosa
GKTAMSRELPLFLIDAGELLQHVSRVVYRGSPLYYGRSGTNRYDDPARTYGVLYLGRDLPTALMESVFHKHQWLADEKRSIALKEVESRLLRAVGVLDDVRLADLTAEGVMAGYFGLNLEQLASRDYTHTQQVSAQVHAMLGDDGQPLFDGVLYPSRNNYPAKSIALFERAAAKVGVVDDIDLVDHVDWPRFVATYRVGVEPDPGPVEPDDEAS

SEQ ID NO: 25131 - protein, 457 aa, Pseudomonas aeruginosa
APPRLHRGPGPAGPQRCGDLPGPGRPARLCRRLQLGQALRGQVAARGARAVRPAVVPARRGDAGGLRRGGADAGAGDGPLPQAPAVRGHAALLAAQFPARGLEVQPAGVGRTARAGLALLRRLVPLRGAGQPQGGRAQARPVRARAQPGVCRHAGALRGGGRPGQGQGPEPQGHRGERHWPHPGHGAEGKALRDHRGPERASGALGDALGGPAHPRHRAPPGAGHVRGRTRPPAAAAADRHAVLQAGGAHRLRRWLRARGPQQLLGPSDGHRCQGPGAHLRAAHRDPRADHGAAGAHPRARRTAGHGGDAAGRARLQSLARDALHPQAGRPDRPPGGTPVPHAVRHRRPGGPAQAARHRQPQPTLPKPLRERRLRGRHRAGHPQLQARQGADRAPGGRGPRIHRCRRRWDRPWPRRSRPGARTHPRHRGVRLAVQPGRHPGRRRYQRGKAACDLDRD

SEQ ID NO: 25132 - protein, 363 aa, Pseudomonas aeruginosa
AWRWPAAPGSDWPPTIESAWRSWLHLFDGGDHVALTLLGEGESHLLPNRKTRGELRAAQLEAHGHGRPLEGWHGLVRQRQLGGRHLLDHAAHHESVGGRGRWRRGAVPVVRRCRRGRRGTCRQHAPQAGFRIDQELRRGHHLLSRREPAVDHQLIAYLRAHLDLHGMELAGSIDHIGQCALAGADDRFAGNKQRGLFVAFERDLAGHAGLQALAGIGHFKPHSHRTGVAVGFGQDAHDARLEHFTGKRRQPDLRRLADLQWSALCFGDGRFDPHRGQAIHPDQAFPGGNRHALAHHQFGHQAALRCCDRVQPLGLACALHLGDQGLRHAEQQQPLAGSCGQRCVAHRANREKLALCGDPLRQQ

SEQ ID NO: 25133 - protein, 232 aa, Pseudomonas aeruginosa
GLHRLRRHAEARAVLRVFIRVLRHQRHVHVGRLAGLVELLGRHHRVVPIQHLALGRSACNGDVGSGGAAEVAGAPLGDAPSNGNTGSNQRQAGKDVSRRGIHGEGLHSVRDQAVQSGDEAVALRSKVDQTHARLQHLGACTEHSAQVPLGGSVVAQCKCRSVPYQLQAGGLQAVDLAVQRLEFGGAVVQLLQMPPRHVFAFGVQTFQLVPFCLDHGHLASILLPRQIECHLK

SEQ ID NO: 25134 - protein, 119 aa, Pseudomonas aeruginosa; identical to SEQ ID NO: 20090

SEQ ID NO: 25135 - protein, 656 aa, Pseudomonas aeruginosa
ASAWPCAAWSFCACAWAATLTRARSVVASARVGSALDILGLPCALGSRHHDFAEHAGIHVEHQVAVPRPAAERVGCHQEADALCRLHRQGVAARKEATVGAFQLAPHAVQVHGMGHHGVVVQNDPQPLAVFEVHRRGLSELQPVQGPCVAFHVAREVQFDLPAGASLVQRPRRGMQIREGQHAPTVVAQSDAGVIEVGARHVNAHVRAGTILGASVASSSAGHGQSPRRRGVLAVIHRHATVVHGAVIHACHRPMIHPGHRTRAHPGHPGHARHARHPGHLHGLAGPAMVHAPHHAAHHVVHGQPFDRIEGRHGSLKTFTHGQRGTRVACPVHRLGEDRVSVIPWLDDHVDGFARTESELIDGHRLHVNTIDVHHREFQSWNAYVVEGVARTVDHAQPHALTRSEQRRPIAGGGDAVGQIGQRGGRQICEIRRIHPHLVPHLALVDRSGRAFARGVPEEVEDGRLVVVVIVALGLELGEHPHRVFVGPIREQQHVVTVGVDGLGASGVDDDRPVHAREFLEAGVRVVPVGAALLNLEAVREGLAGSDAIEADARHAIHLIRQDDPVPVNGCGFTQLVGYTDCDGVTLAPTQCRCRQRAVDGRSHAWLAREVHGRFGDHQVELGALQHRGGTARRGALLGKCLERRRGQPSENAAGG

SEQ ID NO: 25136 - protein, 497 aa, Pseudomonas aeruginosa
TMRSIRSSSTPCVEWDTRSMRPMMPLRHKPRQSRPASLALRVTALVGIATTLVFLVFNWVILRSLEHHFAQQDAHELEAVTTALAQPLHQLASDIASDELKQHLANAVAGHHGMTYGVYDGAGNSIYATPGPDLSKLASSKKLVNRITADDLIVWQEDQRSYRGVVLQLPADDSAAPGYRIVAAMDIGFHLDFLAEFKRMLWWATGLVMCLALGVAWLAVQWGHLPIRKVNEEIRAIRSSKLDVRLDPRDVPIELAELVFAFNDMLARIEEGFTRLSHFSADIAHELRTPVTNLVTQTHVALGQPRSNEEYREILYSNLEEFDRMGRMIGDMLFLAQTENDPRNLRLSTIDLSELVRSLFDYFEALAEDSGITLGVKGAIGSIAADREMLTRALNNLLSNAIRHTPRGKSITVLLSQDEQWTTISVVNPGERIPERDLPKLFNRFYRVDPARQRNTAGAGLGLAIVKSIAEAHGGSVAVTSSELVTRFDLVLPHLRQ

SEQ ID NO: 25137 - protein, 140 aa, Pseudomonas aeruginosa
TQCRGIVCTMNITHTMANDTIAQRPKRHYYSPELKGQIVAECQVSGASVAGVALAHGINANIVHRWMREQADSLLPAPRNEFVALNLPPPVEQLPATETSSPPVSRAIRVDVRRSASVVTVNWPLEDAASCAAWLRDWLR

SEQ ID NO: 25138 - protein, 585 aa, Pseudomonas aeruginosa
IAASSSGRAMPPPPPHSAERSSMRSCWACPGRTSARLESSLYFECSGRWPGNQRLHRCANVMLAASSSPVITADHLDTLEPQQMRAALLSLMGELAERDGVIARQGQEAVFKQAQIDKLTHENALLKRMKFAAQSERFSAEQKSLLDESLDEDLQAVADEIEQATPPVAGRQDKQVPKRAPLPANLSRREIRHEPESTTCACGCQMKRIGEDVAEKLDYAPGVFTVERHIRGKWACAQCETIHQVPVDPHIIDKGIPTTGLLAQVLVAKYADHLPLYRQEAIFGRAGLAIPRSTLAQWVGSCGVQLQPLVDAMRTELLQRRVLHADETPVSMLKPGNGKAHRAYLWAYATGAFENIKAVVYDFCESRSGEHARRFLGDWRGSLTCDDFSGYKALIASGVTEVGCLAHARRKFFDLHAANQSQIAEVALQQFARVYEIEREVKEIATDQRQTIRQQQTKPLLDALHQWMVLQRQKVPEGSASAKALDYSLRRWEALTRFVDDGQLPVDNNWIENQIRPIAIGRSNWLFAGSLRAGQRAAAVMTLIQSARLNGHDPYAYLKDVLARLPTQRVSLVHELLPHRWFAPS

SEQ ID NO: 25139 - protein, 133 aa, Pseudomonas aeruginosa
RRNQRARNIPLSGMAGAHKIRQDGLHARQVGHLFAHVLELVLSQAAGFLAVGAIVEPQQLGNLIQAEAQPLGRLYKAHPRYIRRAIAANAAVRLVRFRQQALALVEPDGLYIDPGRLGKNANGQVFQILFHTT

SEQ ID NO: 25140 - protein, 187 aa, Pseudomonas aeruginosa
CRGERAYRARLPAARTAAAGGVHARRLRPVRRGGLAASVLRAIRLRSGHRPRCAGEAVPGAGCSGRRRSGHAACRAAPVRRTPARSVGRSGSAVGHPADRAGTARGESAMNGPERLPTKTRKPFTGYLWGALAVLTCPCHLPILAVVLAGTTAGAFIGEHWGIAALTLTGLFALSVTRLLRAFRGGS

SEQ ID NO: 25141 - protein, 588 aa, Pseudomonas aeruginosa
FLAGHCGGCRCLPCAGRCPFKGAWRLLLPLIDAMDARTNSQGIAAAPLGLFAAYWGDMLWRTVASGEALRQRANNMTEHEAAGMPPLLHFESEQVADGHDLQPASNYRLLRVTRCGTDALEKHVRKGAAPVLVVDPRAGHGPGIGGFKRDSEVGMALLEGHPVYFVVFDPEPVEGQTMGAVVQTLATFIDMVAKRHRGKAPIVYGNCQGGWAITLALSHCEHRAALAVLNGSPLSYWAGERGINPMRLLGGFTGGIWPAHWASDLGAGRFDGAWLVQNFEALRPEGVFKKYDTLFAQPETERDRFLEFERWWNGFYQLAREEMLSIAGDLFVGNHLESGEVVVDGHCRADLSRIGAPLVVFCSNGDNITPPHQALGWLKAVYPTTADLVAAGQRVVYLLHQHVGHLGIFVSAGVARREHRAILHHAESIQALKPGLYEMVLEDSASSESAAAAQFQPRRLEDLPYDANPAGFDKVEALSEITERFYSQWVSPWVRFAVTPDSARELRALHPMRVSRKVWSEQVTPALALLPWVQRWLEQWSAQDPHRVENPWYQLERTGADAIGQAMESWRKSRDLWAELVFEQAYAN

SEQ ID NO: 25142 - protein, 456 aa, Pseudomonas aeruginosa
VVYPLRSIRCTRASEAPPMSHLTTRDRTVSPDGYAAALRILRRLLAGIERPPALRLGDMLLHELESHPEYTLIIRDPGLLRRLVLRPDPLLLAEAYFRGTIDIEGDLYTALGLKAHFERFSLSWRDKLALLRDALLLRVSDQDGLKPSRSLASRVARRFSHRHSRQTDQAAISFHYDVSNAFYGLWLDAERVYSCGYFKATDDTLDQAQRNKLEHICRKLRLQRGERLLDIGCGWGALVCWAAREHGVRAHGITLSQQQLEYARERIRSEGLQDLVTVELRDYRDLEGTAVFDKVSSIGMFEHVGLANLPAYYAVVQRVLRPGGLFLNHGITHDEEGWSRTVATEFINRYVFPDGELDCVSNIQLGMERSGFEIHDVEGLRPHYALTLRHWVQRLEARREEALREVDEVTFRIWRLYMAACALEFEAGGTGIYQIVASKRDGGSWPVPLTRSDLYG

SEQ ID NO: 25143 - protein, 848 aa, Pseudomonas aeruginosa
HSHERYMAVPLARERRSQTPAFPISPSRLPACRLSRTFHMNHELPWVAERVRVFRESDPEFARWARGHGPITHNDLTQLRVHDLAQVLVAEGKASDTTAVYRTLWSADRLAVAGMWLTVHMTYADRVYPDGREMRAEDFKETPEGHTGGALNIVPAYVGYLAANALSGLTRGWLMGQGHCVAGIDACNLLVGNMTPRHAERYDRSESGLTRFARDFYSYAIDAQGRPASPLGSHVGPNTAGGLSEGGYLGFAELQYVHMPLPGERLVVFLSDGAFEEQRGSDWAPRWWRAEDSGFVAPFMILNGRRIEQRSTMQQQGGREWFHQHLRLNGFDPMEIDGTDPAAFAWAVHAMEERLSACAAGVSQGTVQYPVPLHYTIAEAPKGFGFPGAGTNAAHNLPLEGNPRVDQIALQQFNEGARALFVPSHELDEAVALLRRHEVQHRPLERDHALAHRQVAAPRLPVPQWHVAGQGEVSPMAALDGAFAALVQANPQLRPRVGNPDELRSNRMGQTLDLLKHRVFTPEPGLAEAVDGAVITALNEEAVVSAALGNKGGINLVVSYEAFAVKMLGALRQEILFARHQAQAGTPPGWLSVVTVATSHTWENGKNEQSHQDPTLAEALLGEMSDTSRVLFPVDANSAVAALRAAYASHGQFWTLVVPKRAVASQLSAEQAERLVDQGGWVVKPCDAPDVLLVAIGAYQLQQALLAARRLEAAGHRTAVTCVIEPGRFRAPRDEREQDFVAGDQALRALFPETAAVRVIVSHMRPEPTLGLMRRIDTGARQTRALGYQARGGTLDVAGMLFANRCTWAHVAAEAAQGLGVDPQSLLSAEEWAAVQGRGDPRVITVSA

SEQ ID NO: 25144 - protein, 283 aa, Pseudomonas aeruginosa
VNHRSAFMSRHWFLTGASSGIGRHLAEIILASGDDLTATVRRPETLDDLAARYGDQLVVERLDVTVKGDIAPVVQRAEARRPVDVLVNNAGGGIIGATEEFSDADIEGQISLNLLAPVHVTRAFIPAMRTRRAGRIIQISSASGQGSLPTSSLYHAAKWGLEGFSECLRQELEGFGVFVTLIEPGGARTSFSRNLQYAPANPAYQDTPAGQIRAMFENAGDELYTLDPQKIAHRIFDTATSEKPPLRVALGGDAFGVIQAALKGRLSALEAQESLARSVAFDS

SEQ ID NO: 25145 - protein, 150 aa, Pseudomonas aeruginosa
ARGGPWAAGLPGSGPPPRAAREHLRATSPSAASVRSLRPGHARQARTRPDRCRRRAGPGRARHRPPIRHPARRRPGRTPPAPAACCRRPGPRCRSRARICGHRPSRRRCRDGGRRGRSHRGRSGRRSCPRVCPRPPPRWTKADRAGELRG

SEQ ID NO: 25146 - protein, 423 aa, Pseudomonas aeruginosa
RSAWPGAAPSVALGGPQDARWKRGGSVASWLIQPVAQAARMPGCDVRDGLVEDARDRLRRIEPDMRCHEHTRMRQQWAGCRPAGIATQSAAARGHFGRQIPFLFQHVQSCCGDGTCLQCVQQGGVVDERTPCRVDQYHARFHAREGLAIEKVVRGLRGRNMKAQNIAALQDLLPRHHADAGDGCCRDVERWGEGRVVRENFHAEAQGDTGHVAPDPAQPDDAQRLSFQLEAGEAAVSERTLARPLVGLCQMASHAQQQREGMFGDAGGPIVRHVAHGNAASAASLQVDVIEARGARCHEPHARQQPEHRFVNARAHEDAQHLGVFIADIGYHQAFVLDEVRVPVGRKPLLQRGLVRRCDVGEQNGQTVLCGHEPSSITRCRDRMQNAAMKCPVLVPCASSACANTVGSRPATASRMVSNPSSN

SEQ ID NO: 25147 - protein, 357 aa, Pseudomonas aeruginosa
ASSPGAWACSVKSGCPASTWSPRRACTSMPAAAAVGAPASLAARASSRLSIRETRPVDGDATVCRCVATGMLRRPPCSAQIASNVAQARPSASTCVASVRPPPAGAAPPISRMSAASRNARSRRSAGASGVPCRTASTSRASSAGPIPRPTGCSPSVTRKATCRPMALPTSCRRRPSAAAACALRTLAVAPTGRSISTWVEPAAAFLDRTEATSWPSLSRSSGRSTRMRMSSAGLSRTEPPQTMQPPVRSTTRRMLRTSRFTGASTSIVSAVPAGEVMAREEVLGIVRPQAATMGTTSRVVRLPGRPPTQCLSTTSGRPQSMRSPTPIMAFVSETVSARSRRSPAQAVMKVARCRSE

SEQ ID NO: 25148 - protein, 381 aa, Pseudomonas aeruginosa
RGRWDTDTRRHALDPRQARALEHQRIDRDDRGTARHGQCSDLGRQGERIQHPGRQREGDHVVGHGPPEVLVHLAQRRPGQFDGPDHVVGVTLHQHHLGAFHRNVRPRANRKAHVGLRQRRSVVDAVADHADLVTLLLQFLDLGGLLPGQHIRKHDVDTQFLADALGGRLVVAGQHRDLHAACLQLGDRLARGRPHGIGDRDEADQPATARDVDHSAPPALQPRRLAGKGGQIHLFRLHQQPVAQEHRLAPDSGPCALPIDVGEVLGDLRRHVSRTLEHCEREGVLGELLHRGGRRQKPRLLDTGRGHHLDDIGLPQCQGAGLVEHHDRQLGGVLQCGRILEENAVHCAQPGPDHDGHRGGQPQRIRACDHEHGDGQGECEQ

SEQ ID NO: 25149 - protein, 479 aa, Pseudomonas aeruginosa
CLSHHPVPDAEGQQANHDRRQHQPLGCVVGQQLAGGLRVLGLLDQLDNLRQGRVRADLRGLVAKAPALVDAGAYDGAAHALLDRHGLARQHRLVHLRRALDDLAIHRDLVAGLDHDQFPGCNLGGRYLGLHPVAHDRGHGWGEIHQRANRVGCARAGAHLQPVPQQDEDQQHRCRFIEHLTLVEEGRADAEQVAGAHRQHDQRGHVGDAVAQRAPRRHVERPTWIDDRGTCEEEKKELVVQPERRLEVAEHLPHRGIEEHGNGEDQGHEEAIAHVPSHVLHRARPVAHVVHHVVHRRVACVGLVRSMGGGRRGRSLRACGRGGGMRVVPLMPHLLRLTCGCAVMAVHRMAGVGRDASGGRAHVLGRLLATAVIAAFGDALAQILDTELSLIEMDRCASRNIVDICMMDAGKLQQLAAYSLRAQARYEPSDFNVDRLHGCSSCSLCSWSQRASRPESRQSCENSKTISRSGAMTLCFLPA

SEQ ID NO: 25150 - protein, 347 aa, Pseudomonas aeruginosa
  UNSURE (308),(341): Identity of amino acid at the above locations are unknown.
PELTRAERRAVVRQQSLHGDAQAGVIGHGIAQEQDRLRRLLIGMHGGERQPCVIIDGHEQRLPACTIDRVATVACDAVAGPHDAPELLGVDVQQVPGRLVLVAHNGFDGLQVAQPGHARSRQNAADRGLRDAHTACDASLQHSTFAQLDDEQSLARIDGPGRSQRPGRGIGQGGLATGQVTTEPLPGRWRSDAVRGCGSHGIQAFQRHLLDHLESAGKGKSGMLMGVHPVGRPEWIGCLATSSLSNPIRMNTGYHLLELPTSSHHFFETALIAMLPALPPTALGSPVAQRSLGSLAGANARQTRAMIXKRGQFEEHRARVQHREPFPKTLFRAPTGFNWFXAGPAET

SEQ ID NO: 25151 - protein, 121 aa, Pseudomonas aeruginosa
IRFYQRKGLLPEPDKPYGSIRRYGAADVTRVRFVKSAQRLGFSLDEIAELLRLDDGTHCEEASSLAEHKLQDVREKMADLARMEAVLSNLVCACHARKGNVSCPLIASLQGETSLARSETP

SEQ ID NO: 25152 - protein, 356 aa, Pseudomonas aeruginosa
LNDPAGEFFRKRLRMGSPSVHMQITVIFAVQCDNHLLIPITKELESLMTAGVDRFAGIDAFVSTAQAGNFTAAAQALGMTPSGIAKSVARLEARLGVKLLHRTTRRVSLTPEGEAYLETCHQVIEALQSTEGALSPIDRAPRGRVHLQLPGAFGRRHVLPELLALANKFDGLDLSVAFTERTVDLVEAGYDLAVRIGDLADEANLVAKRLGTQRLVICAAPSYLQRYGAVLTPEELMHRDCITGPRGRQRPTWLLRVSDQRVRRQEIYPRHEFSDGEAMLAAGLAGCGIMQMPTWLVAEDIRQGRLIPVLPDWAGGEMPIHAVWPQSRYLQPKVRAVIAPAATQTPPLMATPNSAT

SEQ ID NO: 25153 - protein, 820 aa, Pseudomonas aeruginosa
VDRGQEVRAGAVGTCWQDTLNWVFPREGQGVNVLKPNKRATILTLLERGKSQREIARLTGIDRKTVKGYRERWLAEGANSPGVATGSEVAVATPGQQTPPPWPPAGMPVATSRCEPHRDFIEAQVRLGRNGVAIYQDLVDQHGFAGAYNSVKRFVAKLRHEEPERFDRLSFLPGEEMQVDYGEGAPTRVPGTDRYRKPRLFVATLRYSRRSFRRVVWKSSQQVWAELHEQAWRYFGGSCRYVVLDNLKEGVLKPDLYEPELNPVFAATLAHYEVVADPARVRDPNRKGTVESAIGHTQATALKGKRFETIEAQNEHLERWETRWAAQRIHGTERRQVQAMFEDERAHLQRLPLTGMQYFKQEERTVCDDGCVRVDHSSYSARPMAIGAKVLVRIFERRIEIRELTTGRLVRTHERAERPGTVVMPQAERVFNPSRETRFILKQADQIGPQAARLCRMLFGIEGRVGQRKLHGIVNLSRRYPSRFVNAACAAAIEQGIHSYKHVKALTERLVAEALASIDAAGDGTDPGRADLAQEHVLIRDTEEYGSLFNLAATQAGVDTSEGRRPVTLIEIDRTLRQLRLSGFADTLNTRIMQAQAAQQPFVETLAALLQDELDRRRTSQTERSYKRSGLDERPTLVDFDWQFNPKLPRAACFELHTLKFVAEGANALIVGKPGTGKSHTAKAVAYQATLQGLHVRYIEADTALAQYALASAQEQAALIKSWSEPDLLVLDDLFLARRIPEAAAELLQAVVHRRYKLRRSIAITSNRVVTDWGKYLKDVTMATTILDRLMHRCSMLEFEGKSYRLKEAASRLALNTEPS

SEQ ID NO: 25154 - protein, 134 aa, Pseudomonas aeruginosa
QFFSRWVAPIGATFRQGLLQIDEHHHAELRRHTCQRNESHAGGDGQVVIQQVQEPDAPREREGQGRHDQARFVHTREGQVQQNEDDQQGGRHHNLQACIGPLHVFELPGVGDAHTRLQLDLLPDGIAQFVGHRG

SEQ ID NO: 25155 - protein, 219 aa, Pseudomonas aeruginosa
RRHAGNALGDLLDLCSDAIDHAQVVAGHLHPDRALDAGSQHIDAIADRGNPDIGQARDLHGTIQLFHELLGRHAWTPLFPGLELNRGLEHLQGRRIGRSFGPSCLAEHLVHFRYGLDHAVAQLQQLRGALRRESRQGRGHVEQVPFVQPRQKLTAEPRQGPGRGRQGQHGDQQRRLGPAQYPLQCWPVGCNQDAGDGVLLLIRDTPANPVAHEYGNQRH

SEQ ID NO: 25156 - protein, 93 aa, Pseudomonas aeruginosa
GVELIKVSFQDELMRLDGALARTGTRCKSTGKGGHRTWLSCFTRLGNSQGSKLKSISYKIRLSRESLQVRNDLVGAIGYWARADSALASGFDA

SEQ ID NO: 25157 - protein, 69 aa, Pseudomonas aeruginosa
FSAVAFAGQFVAQNQWVTLKFVQRNLLVRKKRVPRWHGDHNRVSPDRFSHDAFANIRRVCKSDREVARP

SEQ ID NO: 25158 - protein, 181 aa, Pseudomonas aeruginosa
ERNAEIRLAPLQRRGTKETVCWAIAGSCSFRKKIRSQSARSQAQGVANDRRRTQAHRQCCDQRRQQPAREGIENPGGDGDAQRVVEEGEHEVLLHVAHGTHRERASDSDATQVTLDQRDLGAVHRHVGSRSHGDAHVCLRQGRRVVDAVSGHGDDASFFLQSLDQHELVRRLDLTMHLVDA

SEQ ID NO: 25159 - protein, 276 aa, Pseudomonas aeruginosa
ACTDGFGGGLPVPGGHDDPQARSLQRGQGLGGAALDRIGHGEQARELPVHRQVHDAGPFAAQSFGLGYERFHRYARLFHQHCVAQRQLPVLNLSAHADAGSRFKALRLHELEALGTRGLHDGVGQGVFTALVQAGRKTQHLIVRKAGGCDDLIESRSAFGQGSCLVDDEGIDLAKILDRRGIAEQHALRGATARCDHDRHRRGQTQRARAGDDQDGHRIDQSIDPGGLWPEESPYKERRYRNGDDGHHEVAGNDIGHALHRCLGTLRLGDHLDDLR

SEQ ID NO: 25160 - protein, 285 aa, Pseudomonas aeruginosa
NGVRADPLRTHDQRAAGVECGPDDLVAHALADGQRFAGQHGFVNRAAALVHDAIHRHLLAGSDAQQVADVHMAEWHVFLAAVRIDAPRRLGCQPQQRLDGCRSLGAGLEFQHLAEQCQRDDDGGGLEIHADPSHGHEGSWKHFRRNGCHNAVDECRTRSQADQCPHVRAAVDHGQPAAGEEGPAGPQHDRQRQHQLDPALCSHVHQVQPLAQHRQRQDHERQRQGPPEATREVTQLRVVVIEVGQQRLQRHPALGAGSRMILADLRVHRAGVDGSGRGWRCRRGR

SEQ ID NO: 25161 - protein, 98 aa, Pseudomonas aeruginosa
GVSDLAKLVSPCSDAISGHETFPFRAWQAHTRLDRTASMRARSAIFSRTSWSLCSAKLLASSQWVPSSSRNSSAISSRLKPSRWADFTKRTRVTSAAP

SEQ ID NO: 25162 - protein, 234 aa, Pseudomonas aeruginosa
TRTWGARQRCFRDGLRRVLSGHRQLGRGHRPGLSTGIRRIVHLQAAAAVRCRGFAGERIGLAQSSPMAPQSARHDRASHRVRRNCLAAWQLVGSTPRIHRPGADGRRVDLGLGFAGKSPLRPGRLRTSHETRLTAGAGSQYRKGTINDHPQNYRHDLRLLRGSRQGGSGESARRAIGGGFLCQGQRQARHRGRHIAGYADRCRGRTRLSGYACRCARGSGGRRIARQGARMAGQ

SEQ ID NO: 25163 - protein, 197 aa, Pseudomonas aeruginosa
RRQRTAHRRAGGCTGSRRADPDGGPGHSQPHDGAGTGRPVVPLPDDGRGLEARGADLQQGCEAAFLLRRVRKRRCSMNAYTVSRLALDAGVSVHIVRDYLLRGLLRPVACTPGGYGLFDEAALQRLCFVRSAFEAGIGLDALARLCRALDAADGGEAATQLAVLRQFVEHRREALADLEAQLATLPTEPAQHAESLP

SEQ ID NO: 25164 - protein, 135 aa, Pseudomonas aeruginosa
QRSPTLVSGCPIAAIASRSLAAVILNGRPPFRPRARADARPAIVRSAINSRSNSASAAKMPKTSLPAAVVVSMAAPCPVSTFRPIPRPVRSCTVLIRCRRSRPSRSSFHTTSVSPGRNAFRQATKPGRSSRLPDA

SEQ ID NO: 25165 - protein, 67 aa, Pseudomonas aeruginosa
DSSQQPCSGQLSIRGSFHASSTAWFAGSFRQSGQARCIGWLGSQARQLVMDRVLRRSFGSSTESWNA

SEQ ID NO: 25166 - protein, 156 aa, Pseudomonas aeruginosa
RCCRPGRCAIRRSPACARRPCVAVPAPIAPFPAAVGAGAMARPSRQVARRRSGLPTVRMASARPVPECAPGRRRSWPGGCGGISRRSSTCRCWLDRPTAGWACVVCSATHTGLPADSAPRLLADSRSSGQREGDGCVRPPEDGPSPGPPASGGTSR

SEQ ID NO: 25167 - protein, 290 aa, Pseudomonas aeruginosa
WDILPRLPLLNLVERFGRWLVVCLRVSHVRVRWWRGFEKNCRCLEMLASIRVAPRLARSFLRGGHDFAHLADHAKQRRLIHLFAPLLPQFRQRLSLFPEGDSRVRQGAVWNFQIVLPLRLQHPNAADVARVAPDQERRQAVAPSYPRLERIGVVMDVVDDEAGAGQRAADDGQKIDQKSRGASDDGWHAGPRDSFGPARCRRLEQAVVHGAVVGADRQCEPALQLTQRQGGLVFGIVVAALVRVGEGRPWQFVVDHLHRRADDPFHDAAVVRLPERAIVKPDAMLLAASA

SEQ ID NO: 25168 - protein, 60 aa, Pseudomonas aeruginosa
RQAPTSCACVSHRYVHTAREGLCSAAIRSQFRTPFVDSLRSVPNVCLLGTSGARSLGGVR

SEQ ID NO: 25169 - protein, 105 aa, Pseudomonas aeruginosa
NHRSIIMETIELKVAGMTCASCANSVSKALKRVAGVQDVHVDLARGAASVTGDQTAQKTPELIAALAAAGYEASADSSPGIAAGAGASHAPAAARSKGHGGCCCR

SEQ ID NO: 25170 - protein, 381 aa, Pseudomonas aeruginosa
RSSDMRVLAINAGSATLKFGVFESARTLPLIDSAIDHPAVDAATFEEIERHLHRAGVTTLDGIGHRVAHGGPLLSNAVLVDEEVEREIGKASALAPHHNPAALAGIRLTRERWPGVRHVAVFDTAFHDDMPEYAHSYAVPPSWRAAGVRRYGFHGLSHQGVLAAVSTELKRPPSELRIVSCHIGSGASVCAIDRGRSVDTSMGMTALEGLVMGTRCGDLDPGVPGFVARALGLTLAQIEAALYSDSGLKGLSGESSDLRIVEKRAGEGVAAAQLAMQVHAYRVRKYIGAYAAAMGGCDAVAFTGGAGENSAALRRRIVDGLEFIGLELDEERNRAYSPNTEVAQLQSSRSAVAVLVVQAREQLAIARETFRALNDQASGLV

SEQ ID NO: 25171 - protein, 219 aa, Pseudomonas aeruginosa
SPRGVWPRASHVASPIAIRVKPIRPRSPFTTMCPTRSMDSGSMPRGSTHVAISRRRMTRWTRLSATSWSTSAASCACSEANACSTSAAAGARSCAGRQENMASVRTASRSANSNSNTRASASARRACRISSPLNCATTVTSKARPFSTRCQALACSSTWDSRTYRPTTRWSSGFCGQEDSSSTTGSPMTRRAGAEPSRPSSSTATSSPTANWTASAISS

SEQ ID NO: 25172 - protein, 258 aa, Pseudomonas aeruginosa
RGTSHPWSSAPRPAARSMSWSTTPAAASSAPPKSFPTRTSKGRSASTCWRRCTSRGPSFPPCAHGEPVGSSKSPAPVAKAPCRPAVFTTPRNGVWKASANAFARNWRGLGSSSHSLNRAALARASAAICSTRRRTPPIRTRPLDRFARCSRTRVTSCTRSIRRRSRTGSSTRPRARSHRFGWRWAVTPSASSRRRSRAGCLPLKRRRVWRDRWPSIADRCFRSSPGRRQSQQQPWPRTTGALSMRAPYRPATSTGQVW

SEQ ID NO: 25173 - protein, 501 aa, Pseudomonas aeruginosa
ERPVLQRPLCAVCDQGTHDRHEHGPIGAVAEQAQVEPGIDHPFGILLDEGQGERHQRPPHVAVDPAHDAEVVHAYAAIVHHEDVAGMGVAVEEAIAEDLGDVAVHEFARGRHRGGRRQTVQVSSVAELLDHDGRRAQAVHHVGDHDVGRAAPGVGETSHGSCLARQIHLVAEVGRNLVHDGCQPPATQRGHEPLHDQDDAAQDAHVGLGLLGRARAADLHHHFRPVRQGCTMNLGDRGRGERVHVEACEELLPWAAERRLDLLDRLLGRKRRHIGLQAGQSLLRIGRQNVGPQAEMLAQLHEGRAQSLQHFGEAVGRPVGIAAHQAPVPGHPEQEPAQGHSDLRGPAQRRALRWAARKTHGGNGAVRSRHGSSNLLRRRPACQAAMFEMVSSRMRAIASDVLNPTCGVTSTRGCVSSGLDADQPVSQPSPPQPVGTSGDRSPSCSSTSSPAAATVPASSACSRAASSMSAPRAVLISTMPGFMRAKAWPSRRWCVACVAGT

SEQ ID NO: 25174 - protein, 193 aa, Pseudomonas aeruginosa
IWPEDSSWHGQPRSGLTELPQHDEAEHSGKEAPHRDEPGCIEHVGGDCGDKGGHPKSRHAPVARNHQACAGADQIQGHRGHHVEVRRVVEDVLADHAGRDGQLHQHRQQVQTDERARDCNGHQNPTAPTDALQRQRSQRDVDRPQDVREERVEMRQRHVQQGRAVGERQPQHAFEQLLDPEQQRDGGIRQFAP

SEQ ID NO: 25175 - protein, 145 aa, Pseudomonas aeruginosa
RAAVPLRPGRPGAHARRCRRQRRSVLRRAWPPARAAGCRFGRPVPWTAMRRCADALPPGCCAGRPAQRRSPRTWPRRGRRPAPAWRASGRRRRALHRPFRGCPPPAATLAPAGRPGPRASLVGRPARRGPPVPGRSRGRPAAHHR

SEQ ID NO: 25176 - protein, 465 aa, Pseudomonas aeruginosa
RPRCLPGLRPRSVPAQTGLPCAGTQPTTFRHRNRHGCRDRPRSPRPGRPAARRSGRRCCAPYPTHPGVRTGPAPARPAIGCATVAIRPAHPRPRSAVGPHAGTLPCGWPARSHPGHAGGRRGGLRDPWSQGGEEVVACSSHHRPDAPPPPKPPPPPRNPPPGQPPPRWRPCRPPWPPMPMPSSVTRNPASPATAATAKVPTNSHAAAPSTPAVTREPGRRPRALRSNPPSIRARTNMNGHACPMSLVCPCRRGSPAGRASPSITRMICSAPAGDAAVEIALAQARRDHLVDDAPRYHVAQRTLDAVSDFDAHGAVVLGHQEQRAVVHLATAELPLLYHPQGVLLDGFGPRRADHQHGDLHALALLEGPKLRIQRGDTIGGERSREIGDARLQRGNGDQLLRGRDRKEQAQQQPGQSVGQPKRGRRREHRCSGRSHVRGAPPATRRRNRPVAAPPWPSRRRPRNWA

SEQ ID NO: 25177 - protein, 310 aa, Pseudomonas aeruginosa
PCCCSSLILEAFCPGNTSASTMSIPSSLPMRSAVAWLSPVSIATFTPRACSLAIVSREVGRTASAIAMRPISRPPRATWTTVRPPPCSRAASLARGARSTCSDCISSRLPRSTVSPPIVARAPCPSMLVKFSVTSVGMSPARLSTASARGCSENFSTAAAVARSRVSSTPGAATISTTSGCPSVKVPVLSNTTTVNLVAFSNAAAFLKRMPFIAPSPVPTMMAIGVASPSASGHAITNTVMVKVSANSNVCPITQYQTLKVSRPITIAASTSHWDAWSASSWPGAFEFWASWTSLTICAKAVSAPTFVAL

SEQ ID NO: 25178 - protein, 114 aa, Pseudomonas aeruginosa
RKLPLLLMLAPTTVLPTPFLTGMDSPVSIDSSTCDAPSTISPSTGILSPGLITTSSPAATSAVGTLVSTPLRTTVAMGGARSINARIASDAPARARISSQCPSRMKTSSTDAAS

SEQ ID NO: 25179 - protein, 210 aa, Pseudomonas aeruginosa
RASISADFRTCVRSGSGPWTRRSGSWIRAGRCAVTPLQPSCEARNLALSVLRVSWPMERLFPRIILALRCGKWFCSAPQGRLPYVAGEDVARTAAAVLRADPVPPGELAITGPQALTAEALVNSINIIFGASIDLVPVSEEALALHLQVSGFPKSTVREALIIEEVSKRGLAPFSDGVIEQMTGQPPRSIEAVLVEHRLDLLLSTSTPRL

SEQ ID NO: 25180 - protein, 123 aa, Pseudomonas aeruginosa
QETTMNTTTRISTAERLGRTFGRGWRAYARGERRASNWLVSKGVPAAIATALVRVVKLVALGILVYTTFWLALLLVCVMVVAWMARNADLGEGLPEPEWRNGPAGFGLYTYDGFRIDPHVEDD

SEQ ID NO: 25181 - protein, 512 aa, Pseudomonas aeruginosa
CGSWCSWSSLATEAYSSLVHFILFGASMCSLAASGRFVIRFHRAGVGFHADAIRGNEARPVHMVHQVDVIDNANLCCRTLEQGDALGGIVVARRIEHPVEQRLAVVSEHRMHLRGHLLRVRVVAAGQLFQVQAEVTRHDTLGREIGQPHVVQDAHGAQEPALDFLQRDRALFIRQPLVLVKHRLHQRRGQVAAQVEHAVGPRRVVVAIGAAAAIVQRAAPIDDAAHMLEQFTRIDQEQRQFAAHGSLASMHLDAQHVEHRFGHVIDRAMRHRIHRRASAQAFERFGQRAVDRPVVDALDLLKHGLGQLLLHRVELPVGQLLAARPHIQRQQPAREDVLVDLLARLVRQLGVLGDRQVVRLVEGFQQRSAATLDVGFTRRPARLGAQRARFACQGLLHRLRFQAGGQLHRLHTLVDERLQLGRESRGIPDFDGIREAAHILHRDARQMVGNEFNGIGHGDLPGRFETGFTLVSLVAFVNFVALRTCLAEVASRQHRAATGTGSLSNPFQRVPH

SEQ ID NO: 25182 - protein, 156 aa, Pseudomonas aeruginosa
ANSPARLTRLGCEPRMTVGEVSQRSGLPVSTIHFYESKGLIQSERTSGNQRRYSPAILRYLAIVKVAQRAGLSLDEVLDALGQYQPGVHLTAAHWRRVASRWREDLDDRITQLMRLRDELGGCIGCGCLSLKECPLRNPGDILAGQGPGARILERE

SEQ ID NO: 25183 - protein, 156 aa, Pseudomonas aeruginosa
GFVRLRRHRFRPNGRHPRLKEREMKFTHSIAAIVGAALVTLSAFAQDNHQAHHPAGASPTAAETPRAPTTEGMDAQLKSMQAMHERMVAAKTPAQRKALMAEHMQAMRAGMAMMGAMKDGAESAPTAERQQMLEMRMDMCQSMMQMMMDRMPEPAK

SEQ ID NO: 25184 - protein, 297 aa, Pseudomonas aeruginosa
SPATRPNGEPMAKNKKGAKGAKHKADVDGTGTAHGSARDETATRSIGREDYEAQLHMLQIELVKLQRHFIKCNDRILILLEGRDGAGKDGSIKRLVEHLSPRETRVVALGKPSDRDRTGWYFQRYVPHLPVGEELVVFNRSWYNRAGVEPVMGFCTAEEHEEFMNSVPKFEEMLVNSGIKLLKYYLDIGKKEQSRRLGERRRDPLKQWKSSPVDAVALKHWDGYTRARDEMFMRTHTAAAPWSVVHADNKRLARLNLIRDILSRLHYAGKKHKVIAPDREIVFEFSQDCLDSGRLAR

SEQ ID NO: 25185 - protein, 458 aa, Pseudomonas aeruginosa
RRVSVSQRPRQPERRATMVESRAMRSPRESGPTRQQDLGVAQLGWLAAAVFVVSAGYGALMPLIPDWLRPLMGDADPAALARHVGYLSGIYTAGILLGAPLWGMLADRLGRARVLLVGLIGYVASLLPLLRPESLGVVGIYALRGATGFFVAAVVPVVPALVAQYTPESIRARRFAWLGAMSLLGFLFGPGLNAAAERLVGLGFLSVLVQGSSTTLVIALSAALGALMMLGLAATLPAPSSLGEADAADHDGAPRSRSLALWILNGVVMFVLAGFELGIVLQGQRHPDLSSREVSLMFAECSLVMLGVNAVLFFTGLLERADPRRVLACGMVLGIAGLLMLARHGSEMWLYVGVSFTAAGTGLVLPTLAYLAAGTSARRLGIAMGGLAAAAGLGQTLGSAATGWLFGAVMQSTFAWLSIPLAATLALLLIPRRWWPANPVLVSASPSRTFLTSTETEP

SEQ ID NO: 25186 - protein, 198 aa, Pseudomonas aeruginosa
CPLLAALALSLSGCGYNDFQRLDEQTKSAWSEVLNQYQRRADLIPNIVATVKGETNFEQETLTRVVEARAKATSIQATPELVNNPEAFQKFQAAQGELSGALSRLLVVSENYPQLKANQAFQDLRAQLEGTENRITVARGRYVKAVQDYNVLTRSFPTNITAKLFSYVVKPNFSVADEKAMAAPPQVDFGASSPAARP

SEQ ID NO: 25187 - protein, 256 aa, Pseudomonas aeruginosa
CWADCCATPSAAFQAPWSRLACWVPLRGCWWAPSRWPRWLDWRDSSSRCWASAWVATAACTGATGEAAGRAEDSAAAAAASVAAARQDGGEMNMQRLLRHLATTDRAVRRAFPPRALDAIEQAIRTGEFQHGGQLRFVVEGALDGSPLWRNQSPGERALDLFARLGVWDTAHNSGVLIYVLLADRAVEIVADRGIHACCGAERWSAVCQRMEAQFAQGRFEAGALEGIVAVSHLLVQHFPRGADHGNELPDRPVLL

SEQ ID NO: 25188 - protein, 532 aa, Pseudomonas aeruginosa
TGLVGCRARVPADGGSGMTAHLHETGTGTGEDGVNTLQAWRTGIDTHQEPVVYMRRDCPVCRSEGFTTQARVQLTAGRRSIVATLSVVDGDWLAENVAGLSESAWASLGAQPGQLVTVTHAPPLDSLSHVRAKVYGNALGDAEFSAIISDVAAGHYSDLHLATFITACAGDRLDLAETVSLTKAMIGVGDRIDWGRPLVVDKHCVGGLPGNRTTLLVVPIVAACGLTMPKTSSRAITSPAGTADTMEVLAPVNLDVRSMRRVVERTGGCIVWGGSVRLSPADDILIRVERPLDLDSEGQLVASVLSKKAAAGSTHVLIDLPVGATAKVRSAQAAAALGRRLQEVGSAIGLHVALRVTDGEQPVGRGIGPALEARDVLAVLQGTPEAPADLRERALRLAADILEMGGAAPAGGGLTLATQVLADGRAWATFEAICAEQGGLRSIPVATHRHTVASPSTGRVSRIDNRLLARAAKLAGAPTAAAAGIDVHARLGDQVEAGQPLFTLHAQAPGELAYALQFVRSRPPIFQISENL

SEQ ID NO: 25189 - protein, 182 aa, Pseudomonas aeruginosa
WKPARHEPLRRARHDAHDRGEMTAHVLFRTRQFHGRSGSAGPGDRHHAPGPLTARTAVCRHPAAVRGPATARRHAVADVPRPRALAERGADASLLVLLARPVADLRPAGCAGAGERPLAPSGSGGHCSRGRARRSVPAGDAGEAAHHGPRGRPAHPLRLSALLRDDHDGPVSDRHLRKPDGF

SEQ ID NO: 25190 - protein, 92 aa, Pseudomonas aeruginosa
APSEAGRAMTNPPARFKPALAYADCGRTQGPMRRAAFFTVQLLDGFETMRDAVAGRLPTVFAQAELAQGTKTGHFIAAFCILSLHRVIEEGS

SEQ ID NO: 25191 - protein, 478 aa, Pseudomonas aeruginosa
HRMSGSIRRRRSRASSTRPSRTSQPGMRAACATGWMSHDATEPPRFHRASCGPPNATLGAAPGHADRYGPERVPALGGLAPGPDALRYPPGGRPLRRSAAAIGHDLREAGPASQPAGRHSGARCARGSGQPAGQCGAVSSRAGGPGGRGGARPPMAAALRTLRHARARRGLDRPDSSCSPAGRDGSGGEDPPPWRGRAGRDRHAHPAPHRPGHAGARALAASLGAGSHRGRGCGQLPLRDGFVARGSFRATFRRRLARLCRHRDPRRGGRPVHADRHGPAVQPRSSPARSAFVHRGGGRGQTRGQLRRPDLPRWLLPRRPPSRQRLRDGRWPHMRARLRHRGPGRRQHAAGAGGVRPGLRRAGCRMGGRCLARPGPARRRHRSGRVRACRACPGRRLRTEAAEGLVALRCSRAARGGGPDPGSPAAQGPPRAHAYPVVARRDGATAGTRVFHHRSHLSPHDHGRLRRAQVCGIAASAI

SEQ ID NO: 25192 - protein, 426 aa, Pseudomonas aeruginosa
PRPGSTMSEFDDPALVGLGLALASGLLIGLERGWQQRERPEGHRVAGVRTFALIGLLGGLGGLLAQRWGAGMLIALLVLVGVYLVVGYLVTAHMHAVMGLTTSVAALATFAIGALATSGAWRVSAVAAVVVLALLRFKQLLHAGVGKLSEAEISSGTQLLLISVVVLPVLPDRGFGPYEALNPYRLWWAVVLLAVLSFAGFVLMRSLGRKRGLVFTALLGGIVSSTATTATLARWAGQTPGWHPLAAAGAALACAAMFARMAALVAIAAPGIGWDPVVIFVAMAVAGGVLGTFLAARSPADDLPELQLGNPLQLRSALQFAAFLAAVMLAGRFLADRFGDAGVMLTAAASGLVDVDAITLSIGRLVTEGAVTAASATLALFIAASVNQVTKLVLLMSLGGRALAWRVLPSYAAMAAAGFAVALGLT

SEQ ID NO: 25193 - protein, 105 aa, Pseudomonas aeruginosa
SHGHRPDRGGRARPATDWPSVSDHRHRRVYPLRARHGRHAGSAVICFGRPVPCACRLRQASLAGGSEHRNGVADERQAQAALPGQRGRVQERSATPRLRAAWHPA

SEQ ID NO: 25194 - protein, 145 aa, Pseudomonas aeruginosa
AGALAHIGGRHLPRLRAQRPAPAAGSALGRSYRADRRANRHHSHHGFSGRFSAHHPPHADPHRLRHRPHPLLRRCAQAVDSSARPLACVPDPARPARHQPHLGAGAGGAALSGNSIPHLVAPGCHPLGTTTGAGEIAAARARTGG

SEQ ID NO: 25195 - protein, 306 aa, Pseudomonas aeruginosa
GVVAVEEYPIIDLSHLMPVAQGLARLPADERIHRLRADRWIGYPRAVEALNRLEALYAWPNKQRMPNLLLVGPTNNGKSMIVEKFRRTHPASSDADQEHIPVLVVQMPSEPSVIRFYVALLAAMGAPLRPRPRLPEMEQLALALLRKVGVRMLVIDELHNVLAGNSVNRREFLNLLRFLGNELRIPLVGVGTRDAYLAIRSDDQLENRFEPMMLPVWEANDDCCSLLASFAASLPLRRPSSIATLDMARYLLTRSEGTIGELAHLLMAAAVAAVESGEEAINHRTLSMADYTGPSERRRQFERELM

SEQ ID NO: 25196 - protein, 374 aa, Pseudomonas aeruginosa
RRRIASVLFGAGFGRGLGACLEALIALQSAEVLDVLHAFRGKGGIERDFLAAHAATGGSRIICIHGGTPPLTDKGGECRRRHWLGEQEALSRIARRLPQQCETGRRFHALGHHVHAQPVRKLNDGAHDGSVAVVVGESGDEGLVDLERSNRAALQVLQAGIPRPEIIGGEAHTDLSQGFQGGEDRRITERDRFGQLDFKRLGGQLGVSQHALYPSVEIRSHLARRNIDGQPERLPCQHPPLAHLAAGCAQHPSTDFRHQAGRFDQGEKLARQQQAEPWVPPAQQGFRTDNLVTAQIDYRLVVQLKLPAHNRLRQLGRRPSGGLRGRHDPPRKARSSRVTDRANKPVSVRAAIPQCSPMNAPAVVPASTTARIGK

SEQ ID NO: 25197 - protein, 431 aa, Pseudomonas aeruginosa
PVNGLRVLVGRRSGPFMADSPRAVPARSAGWPTALPDRPTLRAGVRRTGAARQAAWPLRRRPLHPAPGTASPAHRGRCPLRRRIARSTDAARPPRRTGRSRLACTPPAAAVRAAGSRARYARSPRHQGPAGTPCRRSSNTSFFSPGAAGKLLHILVEGLRRELQALDHRQVGEQLVGQFLHRHAVANGQGRRLDQLAGFRCNRLHADEPSAAFFNDQLDEAACVEVGERARHVVQRERTAVGLDAVVVRFRLAVAHGGHLRVGEHHGRHGGQVQGSVATGHVDRGTGAGRRCHIDELRLIGAVAGGVDVGATRVHSLVDDDRTLLVHHHACHVQCQAARVGCTAGGDQQLVGAQFAVRRGEHEFAVPFTIDVRDLAGLGVFPHLDAFGTERGRDGFADGRVFAEEQRAARQDRHLRSESSERLRQLQRHHR

SEQ ID NO: 25198 - protein, 277 aa, Pseudomonas aeruginosa
ANYGQALRDRFADQCLSGSPVRGVFQAGNRRHGRTRAGGDQTAVKRHHALTAAVELHDQVAVVFEAGSAMQHGNGRVALQDAFVFGVTQFIDAGLLLGQQRRALDDRRYRLDAVVERAFPAQVGDMGGADHDLRRHAADIDAGAANRAALDQRDACALLDGLQCCRHCGPAAADHGDMELSTIPASLVITAQPFAHLAEQSAARRSHGRIGKRSPIAESGHGSGQRIRQCAGLDGEPGAALGIGNLRRLHAGHFLQSLLDVNRAGVAGHAGNFEGGH

SEQ ID NO: 25199 - protein, 241 aa, Pseudomonas aeruginosa
KAQADGRAQAGDGRKARGATHRGNNAAERPRFGFSGSLLDAGGIARIGGCFGELLDAGLGIIESDNRFAGLEGHVNLADAFDLGNRLLDGDRAGGAGHARYGQRDGLSGGPHGGNNGGEGEGGKQFFGLRRNLRFHGELRSVEKWHDVGKSECDQDQHGHDPENELVSRSHLGNRADLTRFAGLRRAVDAPPGEEQRHQRCADENRAIRLQHGQVADPCPAEAQGNQNQRPEAAGRGEDGS

SEQ ID NO: 25200 - protein, 232 aa, Pseudomonas aeruginosa
TADGYIDDVAVAVEIHVPYLRRDQRPWKDLPLATGQELKQRELLAGEIDALASARCAPARQVQHQIGNLDAIRLARSASASQQRPHPRQQLREREWLDEVVVRSQFQSLDTVVYTATRRQKEHRDLFTGISKGTHDAPAIDIRQHDIQDHQIVCLAHGQVVSVQSVARQIHDESRLHETLADVIRRLVLVFNDQQFHRMSHEIATARKNSRSRCTHSSTFNQQFTGCQLPRT

SEQ ID NO: 25201 - protein, 143 aa, Pseudomonas aeruginosa
PTSCVKPHPFTGTGSSCRIRWMACRASASMASLPARPSRTASRFSRAAPTGTTRTPASRNSRACTGRSSSTPLAPRPSTPTVTTCCCSRIGPTKTRCGCSPSSSPKATITTTTNLPSSTSSGTPRAKARPLRSTSARCGTRCG

SEQ ID NO: 25202 - protein, 218 aa, Pseudomonas aeruginosa
CSTWMPACSAKSWCLEPSAQGRPRMSKALPTRALATTLLALVSVAAQAQAQNDHAAHGQADAQTAAPSTQTVAPAADPHAGHATSASGSTAAPAMDHGNMQMQGGSAPPDARDPHGYSNGLTLGSGDYAVPGVPRLMLADEHRFFSLRGETLERRFTRKGDDSTAYDLQAWYGTTYNKAVVKAEGDIAQRKARRIAYRASLGARRRTVLGHPARRSGG

SEQ ID NO: 25203 - protein, 518 aa, Pseudomonas aeruginosa
SPPSKRCSHDRQADSMVGGQSLPGAAGHRHAHGMGRVGRSQHARGCAAGLVRRAGHHSHQLPRTGAADRREPGHLPVGHHHAVGARGQDRARLLVLWRLVRLCLVRGRNRPVLGPLTGTGIPEPGPGPIARHGEAGPGSGRHRRRLDLPVRARGSHGQERSGATACVAGLVPEVRTQEPAQRGRGGIGGGHGQAVPGRARPDQVGVLWPQSGSSPRCPDGGQPGDRRLRPGIVRRGVHGPRERLPQDPGRVPGDPLDGTRRCAGAAGGCCDAPDRPGDAAWHCRTRRRRRGRRRRGGAALRQECPGDDRCRQGQARGAAGQPAAGRRDRHHLRPQRADRAGHSQSHDQARRRVSGGGAGLRTVPLASSFCAGGHHLATSGRDDGVLGHALPGHQRQHHVAGGDCHRRGGDGGCSGGDDRERPQEAGGLAARAPRSTAAGQGTVGRDHTGRGGSRSCALLLAAHHHALVHPGLHPRSAGRPAVRPAGVHQDLRDGRGRRAVSDADSRTHGLLDSRAYPG

SEQ ID NO: 25204 - protein, 169 aa, Pseudomonas aeruginosa; identical to SEQ ID NO: 20992

SEQ ID NO: 25205 - protein, 638 aa, Pseudomonas aeruginosa
RPKGRNGKGMGCKGKGPTSKRRKGLPAGPPEDTRMLSLFQRKRPPVAAPSPAPATDLPKGLLRPESAASLLATPRRQKLLEHIWQRTSLSRRQFATLYRTPLEHYAELVQQFPASESHHHAYPGGMLDHGLEIVAYALKLRQSHLLPIGASPEDQAAQSEAWTAAVAYAALLHDIGKIAVDLHVELADGSLWHPWHGPLHQPYRFRYRDDREYRLHSAATGLLYRQLLDRDALDWLSGYPDLWGPLLYVLAGQYEHAGVLGELVVQADRASVAQELGGDPARAMAAPKHALQRKLLDGLRYLLKEELKLNQPEASDGWLTEDALWLVSKTVSDKLRAHLLSEGIDGIPTNNTAVFNVLQDHGILQPTSDGKAVWRATVTSATGWSHSFTLLRLAPALIWEAGERPASFTGTVAIDAAAIEKDAGSEAAPPMTAAKPVLEEQTTPPWEGSSPANLASPPAVQPLPDVMEDMLAMVGSGHLLATRQDAEPVPAFATSSLVLPVPASKSSASTQQPSGEHFMGWLRHGLQSRKLILNDAKALVHTVDDTVFLVSPGVFQRYVQEHPQVPALAKQDAVVDWQWVQKRFEKLQVHRKQPSSLNIWTCEVTGPRKSRKLHGYLLDDPGQLFDERPPNNPYLKLA

SEQ ID NO: 25206 - protein, 81 aa, Pseudomonas aeruginosa
VGREIAENSFGIFVQRTVRTTITNEVRQASFAFLGSRLFLTARNHSDVFKGPMSAAMIGQGSASPVSSHLSSMSLRAPRMR

SEQ ID NO: 25207 - protein, 227 aa, Pseudomonas aeruginosa
QGESTVPGRAQMNHDAPAYGLWLLVLVNSAVFIMFAFSFFKPQTSRDWRTFGTFAAFIVALFVEMYGFPLTLYVLSGWLQTKYPSLDLLSHNSGHLWSTLLGESGDPHFSPLHIASYIFIGGGFWLLSSAWTVLYHAQRHAQLAVSGPYARIRHPQYVAFVAILFGFLLQWPTLLTLLMFPFLVVMYSRLAVNEEKDMRKQFGAEFDAYAARTPRFLPSLSDTRQRG

SEQ ID NO: 25208 - protein, 192 aa, Pseudomonas aeruginosa
SGIGAAGLHPAGALAGDARPRGRIRRDSRVDGSRPTHGHGRAQRGGDQGTDRRGCSRGTGRDQARRQDPGGWRDRRGRVASGRVDADGRVHAGQEGRGQHRRRRQHQQERELSLQGHEGRRGHGLGADCQAGPGGPELEGPRPAAGRPRIPVAGAGGDRDWPADLQRLVLGDGTDITVRTHLDHHRVRDRMP

SEQ ID NO: 25209 - protein, 352 aa, Pseudomonas aeruginosa
RRCRITTCSRAASRPTSRPSCSATSSSPISRSPTRRPWRRRHRSISAPRRRRRAPDMRTPRTAVLSPAAPLRLAHALAWLLLSLFLSVASAQELVAVPPLQARVTDLTGTLAADRVAALDAQLRAFEQRKGVQIAVLMVRSTRPEPVEQYTLRVVEQWKLGRRKVDDGALLLVAKDDRTVRIEVGYGIEGALSDVVSRRIIDEVITPRLRQGDFDGGIAGRRRTDHAGDRWRSPACGGPTAAGADQRHRAGVAIHVRPGPDAGRIAAQRPRPPSRLPGHGWRAGCRCVAVGGHLRGGRGGWTGGIPRHAAGHRHGWPRRPARAPPGRRLAGRRIPRRRRRLRWRRRVRTVVR

SEQ ID NO: 25210 - protein, 541 aa, Pseudomonas aeruginosa
STCCWPTGPWRSWPIAASMPVAVPKGGRLCASAWKPSLRRDASRPEPWKASWPSATCWCSTFRGARTTATSCRIGRSFFERQHPWRPTMQLQFLGATGTVTGSKYLLCHGDATILVDCGLFQGFKQLRLRNWEPLPVAPKTVDAVVLTHAHIDHSGYLPLLARQGFRGRVYCTSATHELCKILLTDSGHLQEEEAKFANRHGFSKHQPALPLYTREDAERCLKLFAPRPFSQDFEALPGLTARLTPSGHMLGSAFVHLNDGRRSVLFSGDIGRPNDPVLRPPVQVPGADYLLVESTYGNRKHEASDALAQLETVINNTAARGGVVVIPAFAVGRAQSLMYGIYQLKKQGRIHQHLPVYLDSPMAIDATRLYHAHRDEHRLSPEECEGMCHAAKIVNKVEESKALSAGRGPMVIISASGMATGGRVVHHLKSFAPDHRNTILFAGYQAGGTRGAAIVHGASTVRIHGQDVPIRAEVASLDNLSAHADADEILAWMRGFTQTPRRTFVTHGEPEAADALRARIDHELGWSVAVPEYLQTVDLV

SEQ ID NO: 25211 - protein, 335 aa, Pseudomonas aeruginosa
RSPRRCWPTAAPGPRSRRSALSRAACAASRWQRIGTPSHRRPRDGSPESTTGCSRGRPSSPEHRPPLPPASTCMRAWATRSKRDSRSSRCTPRRRASWPMRCSSSARAHRSSRFRRTYETSRFSPAGRRRLRRWTDPGVGRAAGCPATAPVPGRRVAGAAGRRRHRPHRRDRGQPGTAGRQGAALVVRRGRSARPRRHPRVAGCPVPGVPASGPALQHGRSHHVPHVRCAGVDGVRRYRHRRSPSAPLPLARRGLPGADPCGPVRARHRGLGRSPCGPSRVDRTRCGKRAMGPGSRALGWRAVHGVAEDPPGRQGRGGQPSRHRGPGRPPACAHR

SEQ ID NO: 25212 - protein, 216 aa, Pseudomonas aeruginosa
LPMCFSAPASFTAAAVLLGLGTVTMRRARSRRELPYAAIPLLFGVQQLLEGMLWLTFPDRAPLLNVALTHLYSFFSHVLWPIYVPLAALALESVRWRRRVLVAIAVAGALVGLYLLAMLVKLPITARVVGQHILYDSPHFYVMTTMALYLIGTCASLMVSSHRRVAAFGVAAFVSAIAAYMFYATWFISVWCFFAAVLSFIVLWQFREPRARLAVP

SEQ ID NO: 25213 - protein, 541 aa, Pseudomonas aeruginosa
AMTRPNRPVSTVRLAGRPTQRSALRRATQIAMALSGFLLWVAWHRGLMRCDTHRAADRFAEVLQRLGTTFVKLGQHLSLRADILAPDAQEALASLQANVAPFPPEQAVQEVEAALGRPWQQLFARFDMHALAAASIAQIHRAALPDGTEVVVKIRRPGAAEQAETDMRILRRIVLVMQGLVPSLRRWGLAAIVDEVAANFRYEMDLSREAASVRRFADAWRGSADIVIPDVVDGLCTPTVMVQQFSHGAHLHGLPSSTAVAAAGKLVDSYVAQIFRDGFFHGDPHPGNVFVMDDGRICVHDFGIVGRVDGNMRRALVAFALAFVEQDAEWVVDAWLDLGLLGDGTDRAVFVPVVRALVADCAQRPLKDWSLSGALAQLVAAGRTQEVRLPRDLLVLTRTLLLLEGTVRLLAPEFSIIEAISRHTTTGVFDEPKSAASQRLPYELGNAAHALPSLMARRLHSVLRQGDLLQLSIKPDARMLSGIDRLGRRVALALVTLGLYIASSLLMQHGVGPRWGDMPVLALLGYALAIRFTFSIARSRG

SEQ ID NO: 25214 - protein, 360 aa, Pseudomonas aeruginosa
GASSSKESGMNKVRVAVNGYGVIGKRVADAVALQEDMALAGVADVVHDYRLQVAAQRAFPIYAATAEAAQSMRAAGLPVAGDLADLLANADVVVDCTPKKVAAVNKRAYDAAGVKSIFHGGESHALTGHSFVAQENYATAIGRTSTRVVSCNTTSIVRTLGALRTAGLLKRARGTLIRRASDPWEAHAEGIINTLVPEKTIPSHQGPDARTVIPDLDVVTIAVKAPHNSSHLHTWWVELTRPATRDEVLAAFRAAPRIAFVRSSDGLVALNSTVELMADLGRPRGDLWEVALWEDVLSVDGDQAYYTYQVFNQAIVIPETIDAIRALSGIETDPQVSMARTDASLGLQRDFIRDRVQVRR

SEQ ID NO: 25215 - protein, 167 aa, Pseudomonas aeruginosa
WGRGRAPSGRTRDQTRGTRGRARRPREARGSCGKSLRAGTQVSATARLGRLASVIVFRAPAARPCSVHGCVIHKDQSGSRARASFRRRVWTRRSGRSQSPRPRIPVHTPPCTSARCGRSPHRPPARPPPGALRVAGPNDARSARSGVEDLRRHGSRSRSAPSLAGYC

SEQ ID NO: 25216 - protein, 153 aa, Pseudomonas aeruginosa
FQADELQAINDAPTQRGRIFSSSASEGHSIATAHRGGVGADVFAHAVRVNLHCQLGGCDSFSRALLHNPQVRTLTRQSFESTVAVKRRLDLRQRQTQCACDEAGYARVEVSTARAHHKTFKRGHSHRCIDRPSAIDRADAGAASNVAAHDTKF

SEQ ID NO: 25217 - protein, 198 aa, Pseudomonas aeruginosa
RRPFQLGADGGQYTLVGQAMEAVSPYPCRAPRWRNSIGMGVFGHVVMESGVEDRDVAHAGPTLTGQAYAGQCGRIVMRRQSRSLADLAFDFFIHEHRVAQQWATVCDAVTNAIERCDTRPVQVPLDLLEGRSIHRRMINRRVDQWQGTSRLENSELQGRTAGIDGEDAHVGAPSAPVSADVAAIGNVHQIELPSFARR

SEQ ID NO: 25218 - protein, 597 aa, Pseudomonas aeruginosa
RGVTPDVQATPDNAISEVICTNLDYAQYSCAPKRGVSMASDTSLIAEQGVATLPDAAWAQARQRAEIIGPLAALDVVGHEAADAAAHALGLSRRQVYVLIRRARQGAGLVTDLARSRSGGGKGKGRLPESVERIIRELLQKRFLTKQKRSLAAFHREVAQACKAQKLRAPARNTVALRIAGLDPLKATRRREGQDASRSLQGVGGEPPAVTAPLEQVQIDHTVIDLIVVDERDRQPIGRPYLTIAIDVFTRCVLGMVVTLEAPSSVSVGLCLVHVACDKRPWLEGLNIEMEWPMSGKPRLLYLDNAAEFKSEALRRGCEQHGIRLDYRPLGQPHYGGIVERIIGTAMQMIHDELPGTTFSNPDQRGDYDSENKAALTLRELERWLTLAVGTYHGSVHNGLLQPPAARWAEAIARTGVPTVITRTTAFLVDFLPIIRRTLTRTGFVIDHIHYYADALKPWIARRDRLPAFLIRRDPRDISRIWVLEPEGQHYLEIPYRTLSHPAVTLWEQRQALAKLRQQGREQVDESALFRMIGQMREIVSTAQKATRKARRDADRRQHLKATAVLFKTTPPPDADMADPQADNQPPAKPFDQIEEW

SEQ ID NO: 25219 - protein, 178 aa, Pseudomonas aeruginosa
MTERTMVRSRWSSASPATKDWSILSVVIGQHFRCCRQEYPVPKSSAAKRTPICRKASRAGKIAGSPNATDSVSSISRDSAGNSASASTPFTHPSKSGLTWLAETLTASRNGCHASIRHSRIWRQAAPSTQAPISGIKPDDSTKGRNWPGSNKPSLGCRQRNRASAPTIWSLRRSTIGW

SEQ ID NO: 25220 - protein, 168 aa, Pseudomonas aeruginosa
TACVSWSAGVPGRSWQTLRVLCRLGRQGGQLRFQIGQRFAPVFDELAQHGKLRGRFAAVRCIQRPAQPRQRIEADARFEGGSHEAQTLQGRLVEQAVAAWRARHRPQQSAQQVVAHDMHAHPGIKGQPGHRVGVHRTPPFSHPAQQESCFTSLLKVCAASFKPSTIVR

SEQ ID NO: 25221 - protein, 145 aa, Pseudomonas aeruginosa
MLELLVCIPWSMTIAPCLFTITPATSSARLRVLGARPVATSSLSARSSPCAVVSTNSPSLSPLMYATWLAWVCSLTSMPSARNAAVTASPMAGSSRKNSVLRARIVTFAPSRANACASSSATTDEPITARRLGIVSLTSASVEVQ

SEQ ID NO: 25222 - protein, 73 aa, Pseudomonas aeruginosa
LSQPNAFASKATTANSGSSLEMNNPSYSCRKPRPMAAPKLAMAGKHAAQPIAETTLPSAPGSGSVVHCLTLEG

SEQ ID NO: 25223 - protein, 62 aa, Pseudomonas aeruginosa
PASVVALVSFWTLVLASSKVTTASRVSKVTSTLLTPSTLEIAFLTVIGQAEQVMPGTDSVTV

SEQ ID NO: 25224 - protein, 141 aa, Pseudomonas aeruginosa
ANMKIGELSSLAGCSVPAVRFYEAEGLLQAPLRAANNYRQYGQQHVDRLAFIVRCRSLDMSHDDIRALLQLQDDPAMSCDEVNALLDDQMRLVEQRIAELQALRKQLRAIRSTCAGGVCVGDCGALESLRSATGASWPTVR

SEQ ID NO: 25225 - protein, 146 aa, Pseudomonas aeruginosa
PSMQATLDGFAAAYGAGASSGASSVYPIPRTVWMSFGLNASSIFARRRRMATSMTLLSLSKFMSHTCDAIRDRGRTSPWRRARSSSNANSLLVRLMRWPARVARRRAKSSTKSATWMRSGWLGALPRRSSVRTRASNSENANGLTR

SEQ ID NO: 25226 - protein, 169 aa, Pseudomonas aeruginosa
RPKAISPKGKLEESRTELLWGHAVAPYWDTQLGVRVDNGEGPSRQWLAFGIQGLAPYWFELEATGYVGSGGRTALRVEGSYELLLTQRLILEPRAELQFYGKDDPERGIGKGLAEASAGLRLRYEFSRQFAPYIGVERAGSFGRTADYVRAEGGRAQQTRWVAGVRFWF

SEQ ID NO: 25227 - protein, 833 aa, Pseudomonas aeruginosa
RRRALVTMNSPSKSSGHEHAGMAAGATTSGPHTHHHHASHAGSDDAGGSSSHTQPDAATRDPVCGMAVTAASEHRSTHLGNTYLFCSTGCKAKFDADPARYASGDAGIGTGSGHAPHHHASTAVSPAPAASPTAPGTIYTCPMHPEIRQDHPGTCPKCGMTLEPLLPDLDDDNPELRDFSRRFWWTLPLTLVVLALAMLGERLHLMDMATQSWVELVLSLPIVLWAGWPFFSRGWLSVVNRSPNMWTLIGLGTGAAFIYSVVATVAPEVFPASFMSMGRVGVYFEAAAVIISLTLLGQVLELKARSQTSAAIKSLLGLAPKTARRINADGSEEDVPLSHVHVGDLLRIRPGEKVPVDGIVHEGSSSIDESMLTGEPLPVSKRVGDKVIGATLNTSGALVMRSERIGSDTVLSQIVQMVAQAQRSKAPMQRMADVVAGYFVMAVVAIAVTTLLVWGFFGPQPTWVYGLINAVAVLIIACPCALGLATPMSIMVATGRGATQGVLFRDAAAIENLRKVDTLVIDKTGTLTEGRPAFDQVVAAPGFTNDEVLRLAASLDQGSEHPLADAIVQAARAQGLQLVKPQSFESGTGIGVRGKVEHRQLALGNTVLMEQSGVSVEPLVPQAEALRGEGASVMYLAVDGQLAGLLAVSDPVKGSTPEALAALKAAGLRVIMATGDGQTTAKAVGARLGIDEVHGEVKPADKLMLIERLQKEGRIVAMAGDGINDAPALAKADVGIAMGTGTDVAMNSAQVTLVKGDLRGIAVARTLSVSTVRNMKQNLMFAFLYNALGIPIAAGVLYPLTGWLLSPLIAALAMSLSSASVVGNALRLRASRL

SEQ ID NO: 25228 - protein, 175 aa, Pseudomonas aeruginosa
PDFLSETTGACYRPANRFFRSTPLQRCKPYLGISFLNHTSHIQVETSMTRSHFIAKLVAPIAAGLFATAAFAHPSLVSSTPADKSQVSAPATIELKFSETLVPQFSAASLVMTGMPGMASHGPMKINASVAAAGDGKTMVITPAQALQPGDYRVEWRAVSSDTHPITGNVTFKVK

SEQ ID NO: 25229 - protein, 119 aa, Pseudomonas aeruginosa
ALCRPPASTFNDAAQVVVVFTKESIMKSQIVIAALLSALSVPAFAGHAAAQAAKEMVPLADGGTLYIFKDGKMAQESRFGRAVYLNVGASVSTKDGRNIAITSNEVARLGSLLQKEHGG

SEQ ID NO: 25230 - protein, 313 aa, Pseudomonas aeruginosa
FVHGTSGANENLRGARFMELRHLRCFVVLAEELHFTRAAERLHIEQPPLSRAIKELEDELGVTLFDRDRRGTRLTVAGAAFLQDTRRLFTVLEQARENARAIAAGLRGSLRIAISDGAMDPRLSAFLARCRAEEPEVEIRLSEVPLTEQIRGLRSGDFTIGFAHAADVGEGIVAEPIWRDPIVIAVPARHSLLAHKQVPLNELQGHPLVLCDKLACEGYCRELNRLLQVLEHRLNVVEEVSSLDMMLTLVGAGYGIGFMTATKIPISQRPDVVIRPLAQDTAVITTYLLRPESSNSSVSLDRFIERLRGPPDD

SEQ ID NO: 25231 - protein, 262 aa, Pseudomonas aeruginosa
FLGDGLVGQFASPCLEASNSPNNLTTLRLTQTSYHEDFPSLSYRFLGPLMHDATSPRPQLRLAIAPGVASSYLAALLALQRAEEPEVSMEFNEVTASDLITGLYKRRFDVGLSLKQVSDSSLKSLSIWFEATALATPLRYPLLRQQSIRIDELKEHSVFRWKAEYSPSLDQYLSSMSSTERPNVQHVSSFEMLLLWVAAGYGVGISSRSRIETASQCGICTRPIADGPYEVITHLQRLSGQTNLVADRFELRALRVAEARKA

SEQ ID NO: 25232 - protein, 1051 aa, Pseudomonas aeruginosa
GLRDHRHRKGAAMIAKLIRWSVANRFLVLLATAMLTAWGVWGVRSTPVDALPDLSDVQVIIRTNYPGQAPQIVENQVTYPLATTMLSVPGAKTVRGFSFFGDSFVYVLFEDGTDLYWARSRVLEYLNQVQGRLPATAKPALGPDATGVGWIFQYALVDRTGKNDLAQLRALQDWFLKFELKSLPNVAEVASVGGMVKQYQVVLDPIKLASYGLSQAQVRDALMGANQETGGSVLELSGAEYMVRASGYLKTLDEFREIPLTARGGVPVRLGDVATLQIGPEMRRGIAELDGEGEVAGGVVVLRSGKNAQETIAAVKAKLAELQGSLPPGVEIVTTYDRSALIERAIRNLTTKLGEEFLVVALVCALFLWHLRSALVAIISLPLGVMTAFLVMRYQGINANIMSLGGIAIAVGAMVDAAVVMIENAHKKLEAWQHAHPDQRLQGKERWDVITQAAEEVGPALFFSLLIITLSFIPVFTLEAQEGRLFGPLAFTKTYAMAAAAGLSVTLIPVLMGYWIRGRIPDEQKNPITRILIAAYRPALEWVLRRPKATLLIAVLALATTAWPLARLGGEFLPRLDEGDLLYMPSALPGLSAQRATELLQLSNRMIKTVPEVDKVFGKAGRAETATDPAPLEMFETTVKLKPREQWRPGMTPEKLVEELDRAVKIPGLSNIWIPPIRNRIDMLATGIKSPIGVKVTGNDLGVIDRIAAEVEQVAKGIPGVTSSLAERLTGGRYVDVQIDRVAAGRYGLNIADVQAVIAGAVGGENVSETVEGLARFPINLRYAREWRDSPQRLAELPIFTPMGQQITLGTVARIAITDGPPMLKSENARPSGWVYVDVRGRDLASVANELRDAIGQQVKLEPGVSITYSGQFEYMERANARLKVVVPATLLIIFVLLYLTFARVDEAGLIMATLPFALTGGIWFLYLLNYNLSIATGVGFIALAGVAAEFGVVMLIYLKQALAERCPDGRNPTREELLAAIREGAVLRVRPKAMTVAVILAGLVPIVWSSGTGSEVMSRIAAPMLGGMVTAPLLSLFVIPAAYLLMRKPR

SEQ ID NO: 25233 - protein, 915 aa, Pseudomonas aeruginosa
AAVHEAVEDGGGHGDVLEVLAPVGDHAVGGDGDGAAQLVAAMHDGLEQLGRGLRDATGQEQVIQDQQVRFAPGLDQGGLLLGTGQCVLSQRGVGLDIAHMQPLQRGLVGHCLGRVAFAGAGLAHDQRVGALGDELQRVQLEAGRARQLGVELPVEVHERGPLVQARALVAALGLAGAASIQFVLQQGREGLDEGLLGGLGLHDAGVQGVGEARQAQLAQGTVNLDQGHRPPSLAGIDAGLGGGQVEQRAVLLGVADEYVLLGEIGAARVGPIAGGIDGCEGLGHQALGQRLDVLVAVDALLDGGRAGGVHEAAWVASAEVDDAVQLALAHPAFDAEQHAAQACRLGADLVGLLEDEARLARGIEDALGLRHHHRARPFGALVGAHQPPRGQLADLDAPLEDAHQDLGTDGHRTGRVAAVVHAHAAIVANGALLLLEVLHAGQRQPLQVGAFVLEHGLHLAALGAVDALGRPARLPALQMLVLGLDGLEALSLQRRGLGVANGALHGALAVRVPDPGRVGHHLVVRQRGGKHRVELGLVQVGLEHALLEVVQHHVAARAAEVAPGLLVQFCPHLLAGLPDHAPETAPRVAQRGHEQPGLAVAVRPRHPRRRPLAVVHLHLLAGQERQPVEPLGLLVPQLGHEALDRVVGAGKAVLVDQVLVDRHTVAAQPDLGLDEVAVGLTPTGGHRHASRWPGWGSLLAGGGHGHFRAGGHPGGICSFGQPPLPVALDRLAVDAGKPGYLPLGLSAFEQRQDRRALIGLQDIHSLAFPREDPVQCVLPTGADGAGSYLLSPINSGGGVWGGHQWGSLGGRRGYDSPNLGLQVTRLRPHCMDRHLTTCPVRQHGDQAPLPYIFGHQPCRHLHDAAAGQTRRQHCFTITELMARIDFLPTYALVRDAEQPSGSLPSPRTSDAVPMH

SEQ ID NO: 25234 - protein, 332 aa, Pseudomonas aeruginosa
ETGSRQTPNPLRTPNRMNTHKHARLTFARRLEMVKQMTLEGLDAVRAAAAHGVTAPTARKWLGRYLAGGQAALADASSRPLRSPRAIDAGKALLIVELRKRRMLQARIARSVGVSESTVSRVLARAGMSRLSDLEPVEAVVRYEHEAPGDLLHIDTKKLGRIVRPSHRVTGNRRDSVDGAGWETLFVAIDDHARLAFTAMHPDEKTAQAVLFLRNAVAYYTRLGITVQRLLTDNGAAFRSREFRSTCVELGIKHNFTRPYRPQTNGKAERFIQSALREWAYGWTYQNSAHRTDALASWQHHYNWHRPHSGIGGIAPMSRLNSSRNNLLTLHS

SEQ ID NO: 25235 - protein, 339 aa, Pseudomonas aeruginosa
SRDRHRLAVQSIPAGSPLTLEPHPMPRYTETVKGQRAETAREWGARGKALPRKGEKASRPAPQRTPACSPCSSENGPRSLPRRQRPPPTSRKGCCGPNRPHRCWQHRAGRSCWNTSGSARRCRGGSSPPYTARRWSTTPSWSNNSPHRKAITTLTPAACWITGWRSSPMRSSCGSPICCPLAPVPKTRRRSLKPGLPQSLMPRCCTTSARSPSICTSNWPTARCGTPGTARCTSHTASATATIENIGSTALRQVCSTANSSTVMPWTGSVAIPTCGDRCSTSWPASTSTPACWANLSYRPTALPWPKSWEAIPRALWPPPSTRCNASCWTGCATCSRKS

SEQ ID NO: 25236 - protein, 155 aa, Pseudomonas aeruginosa
DHRCQWVNRPHMRTLLNHRRIRAIAWMVLGVWLFALGAGVANACLLESPQQHRHAVGYEHVPSSGHGNHEGLHGEHEEGSHDPSKAPCLKLCGDVNQSAIQKAPTFAFDLVGLAPPAYGDQLLAPTLALRAIPSRGHQRPPPKRPSWLLFERLAL

SEQ ID NO: 25237 - protein, 911 aa, Pseudomonas aeruginosa
ALGRLYTGARRDVHAHPYGRGALVCRARRQQTVGEAQPDQRHPLPAALRRQEAQGHRSRPGDRLRVLAGLPGLGPTRSLRPRTQRTGRTAMKSINVEVGGLVSSLSAEGVRRKLLQLPGVHHADVNYVAGSATVHLDEGQLSVEDLRQRIAECGYHCRGEQTPKHVCAPAAGVSADPSHAVHGHHGAPARQAQEMGHEGHHAHAPATAARAKAAATTPAAHAAHQAHAGDPAMDDMMHDMGHGSGSMQDMARDMRNRFFVALVFAIPVFFYSPMGKMFGDFQTPFGLDDKLFLFFLASAAIIYPGWPFYVAAWRALRNGVANMATLVVLSVGTGYLFSIGATFFYEGEVFYEAASVLLVFILLGHWLEMRARAGASDAIRALMDLAPPMATVVRNGVETKVPTAEVAAGELVVIKPGDKIPVDGEIVEGASQVDESMLTGESMPVKKGVGSTVVGASINKSGSFRYKATKVGADTALAQIVKLVQEAQNSKAPGQLLADHASQWLVLAAIVIGLLTFSVWYWVMGQTLLFALTLTITVFVIACPDALGLATPMAIMVGTGLGAMNGILFKNAAALENATKLTVVVFDKTGTLTLGQPDVVEMVAAPGVEETRLLATAAAVEKFSEHPLALAVLKRAGDMPTEVTENFTNIDGQGARATIGGETVLLGNRLLMQSEQVDLAPLASEAARLQGGGRTVVHVARGGRLIGLIAIADAVRPTSRETIAKLQARGVKVAMLTGDNQATAERIGKELGIDIVLADVLPGQKASKIKELQQQGHKVGMVGDGINDAPALTQADVGFAIGAGTDVAMESAQVVLMKSDPYDVVGAIELSRATLRKMHQNLWWAVAYNVIAFPLAAGVLYPFTLSPEVAALSMSGSSAIVAINALMLKRTRLPGIKRVTSRVSVPAAASA

SEQ ID NO: 25238 - protein, 315 aa, Pseudomonas aeruginosa
TRHRAAGPAPPRSLLPRGVVDVRRVQSGDAGRQRGAVLHRPAGARRPTPRTGLRHGPGHRRAPDAGPPWQRDVAVRRREFHGCGHGSRAPHPGLPRCRHLGAAARYRDGRARRGSRPRTNTGIGRHRMAIRRCDAEHLCVAVDSTGRHPRAAAHSAALVASQPRPGERFTVPHFSHFHGNRTMRLILMSPARSACPVAERMRLQRLPAAGRADQVRLVRGAEPVPAARRPDPQHRRDRQGRDQLRAGDADPGGRGPREGDLDPGHAGTRQQPRGVPEVPGGTGRTVRRAEPAAGGERELPATQGEPSFSRPACPT

SEQ ID NO: 25239 - protein, 146 aa, Pseudomonas aeruginosa
SRRACARAISTAASPAGAEQIMRVIDGEALPAGDPRRQGQTNDIGQAWPFMFVRALMLGGLLRNALGRLPGSLVTAGVLGAAAWLLVGTFAVAAVAGLAGFLVTLLGIGMGGHGGLHGRHRGGGWPGGGFRGGGGGFGGGGASGRW

SEQ ID NO: 25240 - protein, 167 aa, Pseudomonas aeruginosa
CTASTSSRSKGASTSTCPCTWTARWPSMPHGCTTPIATSTGSRPRNARACAMPRRSSTRSRSPRRSAPVVDRWSSSPPVAWPLEDAWCTTSSHSRPTIATPSCSPATRRAAPVAPRSCTARPPSASMARTCRSAPRWPRSTTFPPTPMPTRSSRGCAASRKHRAEPS

SEQ ID NO: 25241 - protein, 395 aa, Pseudomonas aeruginosa
AGRPAQHPGGNASAHRRIAVHGTGLPNRQPAARAGGQARRSTDRRCRRHRRACAPGRPGRSGTAALHAARPGAGRAGLCAAVRPLAPTDLPDFGEPMKPLVFHLPGDEDFADGLIRALGAQRAALQLHRFPDGESLVRLDADVTGRTVVIVASLAQPDAKALPLLFAADAARDLGATRVLLAAPYLAYLRQDRRFNTGEAITSRTFAALVSTVFDGIVTVDPHLHRYRSLGEVYRVPTRVVQSAPAIAAWVAAHVDRPVLIGPDAESEQWVQEVARLAGAPFTVLQKIRRGDKDVEVSLPDTAALADRQPVLIDDIVSSARTMIQAIASVRSVGLPPPVCIGVHALFAADAYHALLAAGPQRVVTCDTVPHVSNGISVVAPLATAVQELMEAGAP

SEQ ID NO: 25242 - protein, 485 aa, Pseudomonas aeruginosa
WFLATGAWRLLGWPPLSPQSPPTCSMQPGSSRCGASLPLCSASSCCGSSVSPERGWPCHDESSGQIQARTGLRGLRPHAGPDAPRGVLHGSVARRIRDHARCGRRPAADGIRASGTRARHQDRALHRRVLHPVPAPGNRGGLMTAQNRLSVLFSDIAPADQAALQQRLPTHWHAHFVQNERLVVSDVGDEDTEVLCVFVRTRVDESVLRLLPRVRLVATRSAGFDHIDLQACRRRGIAVCNVPDYGSASVAEHAFALLLGVARHLTQAHERARQGSFAYRGLTGFELEGKTLGIVGLGRIGRHVARIALGFGMEVLAYDPALAPSLDITAAPIAGVRVVTWEQILQSSDVLSLHVPATQATHHLLDGQAFARMKPGMVLINTARGALIDDAALLHALEAGTVAAAGLDVLEQEGDLSPEVPTGCGGLGCDTGWSASSPLLTHPRVLVTPHVGFNTSEAIARILDETISNIAAWHAGRLRNRLDEP

SEQ ID NO: 25243 - protein, 318 aa, Pseudomonas aeruginosa
GARMESAPVVRGHGCCWLCRRPGLDLKQRSAIEGHRSRQTLLRFKGRQPALERRLDDAEGVTAQRHPKRWLLARGRVEDPVRDLLRIERVQLVTRVLEHRANLSSGRVLIGGVRRRVLQIAAEARASAARFNECDEDPKPLQFLAKAFAEAFQTPFRGVVKTAGRQGALATGAGDLDDPTGSPCAHGGNEGPRDVHRRQQVEADLPFDVRVGKLFGGADDAAAGVVDQDIDRAAGLGALDHGCDVPLHGHVEPFDNELVTVACCQVVERLGTPDGGREVIPRSQDDFSKMATDAAGCAGEEPMSGHKCTPVVYLPTSL

SEQ ID NO: 25244 - protein, 202 aa, Pseudomonas aeruginosa
RPMAKRRPAETQQMLLDAALGEFADNGLAGARIDRIAAAAGISKPMLYVHFGDKEALFDAVLSREILAAAQDERFDADDLPGYAGRTYDLLTERPHLWRLMTWFHLERGQEVLLLPAGHSVLEAKHAAITAAQAEGRITADFTPDEIVRLVATIVQTWCMAPAARDSQEHEARRRAIQLAIARMLSPGKSPLQRGKMVDASR

SEQ ID NO: 25245 - protein, 476 aa, Pseudomonas aeruginosa
FHGLPNRVCTSSLKLIPRIFDPMGILRTPLLKPSLHPWQQRQGRGHLLGPDLATDAHGVQRAKFTSRVGGDGEADPRRHPLRIEALGDLRECFDLVEPRRVGVVRQVFQPPRLELRSGGRLRRGAVLQNHLVESRLECLDRFGMMQDGAVLASRHPRGDEDAKVANMLVQQVHHALARRHQVCGRRIYRFEPAERLVGRCDVVAVGAKDHQRCANAAEIRAAVAIDHDLAALQVITYEKIACDRQHFLAGKLVEAIPPTLELQEAIALSLRLREERVVFLEHALGPQRLEVLDQPGTVESPGAEVRRPVRRPDAAREPTEQPHGVDASLACPVRQRRAIEHCQGGTVLAVRQRQRDRPTALAVAVDDRGLASVALGHHVDECGQGLDDCAHGLALDGLRIEHYEVHGMAFEQCHANFRIAFEAANARAVAGAWIDHQHRRGAFAHMLLQGVGATASDTQEPVVARRLQVVAVSHLL

SEQ ID NO: 25246 - protein, 101 aa, Pseudomonas aeruginosa
PAAAKAAISSGVFWAVWSPVTLAAPRARSTCTSCTPATRLSALLTEFAQEAQVMPATLSSMVSMMMLRWFQWWCPDWSTDFGRLRSSDWRAGEPPSSPRGG

SEQ ID NO: 25247 - protein, 239 aa, Pseudomonas aeruginosa
PLDRLSASSRGAESAGSPVCVAEQTTHAQPAVGRSNQQRQVDDRREIPPHPPGQLRRRPGAHSGTGRADAIRTVGNPLLRRATCRDGRAIAPAPTAAGNGAIGAGTATQGRRAHAGDRRIAQRPGRQQRQPPGIPQPAAFPRQRAAHPAGRGWHTRCLLGDPLGRPVGKPLRADDAAGVGGQRRLLLTAGQLRGFAPAAATLVDCHAGYGPLPAHAQRGHHRRAGAPVDGGGRRCRGER

SEQ ID NO: 25248 - protein, 433 aa, Pseudomonas aeruginosa
GSDQPSHAQHGRLHRSQRAAAAIRAGTDVKPAPHWPLHPAPREGEALSSWLNRVALCYHMEVSELLEHDLGHGQVDDLDTAPPLALLAMLSQRSGIEPDRLRCMSFAGWVPWLLDSLDDQIPDALETYAFQLSVLLPKLRRRTRSITSWRAWLPSQPIHRACPLCLNDPANQAVLLAWKLPLMLSCPLHGCWLESYWGVPGRFLGWENADTAPRTASDAIAVMDRRTWQALTTGHVELPRRRIHAGLWFRLLRTLLDELNTPLSTCGTCAGYLRQVWEGCGHPLRAGQSLWRPYETLNPAVRLQMLEAAATAISLIEMRDISPPGEHAKLFWSEPQTGFTSGLSAKTPKPEPVDHWQRAVQAIDEAIIEARHDPETARSLFALASYGRRDPASLEQLRATFAKEGIPPEFLSHYVPDGPFACLRQNDGLSDKF

SEQ ID NO: 25249 - protein, 224 aa, Pseudomonas aeruginosa
RPELSGAHCHIIERICDRCKMLIGYMRVSKADGSQATDLQRDALIAADVDPVHLYEDQASGKREDRPGLVACLKALRPGDTLVVWKLDRLGRDLRHLINTVHDLTGRGIGLKVLTGHGAAIDTTTAAGKLVFGIFAALAEFERELIAERTIAGLASARARGRKGGRPFKMTAAKLRLAMAAMGQPETKVGDLCQELGITRQTLYRHISPKGELRPDGTKLLNRI

SEQ ID NO: 25250 - protein, 151 aa, Pseudomonas aeruginosa
PRHGQSKQAGQREGCNTPMLPDECAGCRSGQHNGENRQMTGTGEHGQRAPQVAGERLACLGRQAFRAVHGRLSACCAGSVGRVANCASRSANASRRCSTNWRSTASCVAASPPSAASSARHSLASASRPMPASKADRTKHRRCKAASSNRP

SEQ ID NO: 25251 - protein, 151 aa, Pseudomonas aeruginosa
SCTESSGMEKNLENLTIGVFAKAAGVNVETIRFYQRKGLLPEPDKPYGSIRRYGAADVTRVRFVKSAQRLGFSLDEIAELLRLDDGTHCEEASSLAEHKLQDVREKMADLARMEAVLSNLVCACHARKGNVSCPLIASLQGETSLARSETP

SEQ ID NO: 25252 - protein, 81 aa, Pseudomonas aeruginosa
RCIFQGPVHGDYAGAAPNINANRTRHGRRAGLGCWELFNWWRQIQRNELIPGRWQQGVCLLAHPAMNDVGVDSVCKRYAGH

SEQ ID NO: 25253 - protein, 645 aa, Pseudomonas aeruginosa
NDFRVIYGGFQAMPPRSPFFIVPTQGLSRRRFVQGLAAGGVLAGLSTPAFKAFAQQGSATRGAAPVLKGTEFDLVIAESPVNFTGKPGVATTINGSLPAPTLRWREGDTVTIRVTNKLREATSIHWHGIILPYQMDGVPGISFNGIAPGETFTYRFKVQQSGSYWYHSHSGFQELTGMYGAIIIDPAGAETIHADRDHVLLFSDWTDEDPMRVFTKLKSQSDYYNYNQPTVFDFFRDASREGTAAAIDKRKMWNEMRMNPTDLADLSATTLTYLANGVTPAGNWTALFRPGERVRLRMVNGAGNTFYDVRIPGLKLTVVHVDGVDVEPVTVDEFRFGPGETVDVIVQPRDDAYTIFAQAMDRTGYARATLAVREGLQAPVPALDPVEWLTMNDMMGGMMGGMDHGGSGQAMEMTGMTGMTGMTGMTGMGSGSMSGMDHGAMAGMNHGAMNHGGMAMDHSQHAAAAGGLAVPSTTARHARTEYGASTDMRVDMARTNLDDPGIGLRNNGRRVLTLADLHTPSGPLDKRGPGREVELHLTGNMERYAWSLDGLEFGKSTPVHFKHGERLRVILHNDTMMTHPMHLHGMWSELESPDGRFLARRHTLPVQPAQRISFLVTADALGRWAWHCHLMFHMDAGMFREVVVS

SEQ ID NO: 25254 - protein, 168 aa, Pseudomonas aeruginosa
SSDERRSMNMHYDRSQGKVPRRQALIAGLLVMALAGPSLAQSRPIAKVWKDPSCGCCKDWVSHLQGAGFDVQVLDTGNTAARTRMGIPQKYGSCHTAQIGGYAIEGHVPASDIQRLLREAPQAIGLAAPGMPVGSPGMDGPAYGGRKDAYDVLLIGKNGSSTVYQSHR

SEQ ID NO: 25255 - protein, 101 aa, Pseudomonas aeruginosa
PSINPSPWRYAMQHQHTQTPSDRPRFWRSRYGVAFLIIAAVAAYFLLKEHTAHVAGYLPFLLLAACPLMHLFMHRGHGHGGHDHAARQGKEGAAASKEQKQ

SEQ ID NO: 25256 - protein, 311 aa, Pseudomonas aeruginosa
SKPMAGDWLTIVLRLALYLDLAAAFGVAMFGLYALGNDERSSTISRRYRVLIGASAAIGIALSMWGMTVMAKAMSGAQSYAELSTHVFDMLITGTHMGIAWCIRILALLVCVLVAMLKLNATLRFAVMALSTGVALATLAWAGHGAMDDGVRGYIHLASDITHLWAAGAWVGALVAFLMLASHKQDVAQDPVAVLSRTSNGFARIGTAIVAALVVSGILNYLLIAGPSFDPLISTLYGRLLMVKLLLFAGMLALAAANRYRLSPSLEAALKAGNRAQAVIKLRQSLFTEATLAVLVLASVAWLGILSPTGT

SEQ ID NO: 25257 - protein, 442 aa, Pseudomonas aeruginosa
IPIPRTTMFTPFFGAPEGRPSAYGRGTTPASMRVHRLKAISIALAGSALVSPVAYALDFAEARLIAEQQSPRISAQQLQVNVAESVQKAAGSLPDPKLSLGIENYPISGMDRWSMTRESMTMQRLALMQEVPNRAKRDAQVASAQARVDRERAALVLQRLQIRQELSLAWIAAQAVEQREILLTELLAENQRLQDSLPARVAGGTAQAGDLLVAQQEALTLTDRRDDLQRDRAKARAALRRWVGSRADEALQGDPGPLTRPVAQLRTELANHAELELYPAMQSMARAESREAQSETRGDWAWEIAYSRRDRRWGDMVSFQVTFDLPWQKDRRQVPMIEAKRHELERLDAEREDVARRHLQELDDSAAELQALNSQIDRLQTAGLQLVRNRAALALSNYRSAKGDLSAVLSARAQVLETRMRLIDLGAQRDSLVARLNSLIAD

SEQ ID NO: 25258 - protein, 510 aa, Pseudomonas aeruginosa
VETLAMNTSSRNILTGLTLVAAGIAVGWGVAQWRAGHLSGSPAANVTVASAPTERKVLYWYDPMVPTQKFDKPGKSPYMDMPLMPKYADEDTQDSTGLSVSAQAVQALGLRTAEVLHGKIGADVNVVGTVLLNDRDVSIVQARTAGFVERVYARAAGDVIAAGAPLADLLLPKWIAAQREFLSVRAMGDAPLTAAARQRLLLLGMPQALIAQVERTGEPKGLYTVTTPQGGLVAELMVRQGMTVSAGESLVRVNGLASVWIEAAVPEAQSGPLQVGQTAQVRLAAFPGEVLQARIVSILPEANRDTRTVRVRLEMANPGQRLKAGMSGQIALKGNEQPALLVPSEAVIRTGKRALAYVVDGPGKFHPVEVQVGAEVGDQLVVNGGLAAGQQVVASAQFLIDSEASLRGVLPAGAAASAPASPHNGHGTSSPTAAATNAFVVRGVIEEMSPTELTLAHEAVPALQWPAMTMGFKLSSPQLAAGLSVRQQVRFTFSKQGEGYVITAIEKVQP

SEQ ID NO: 25259 - protein, 107 aa, Pseudomonas aeruginosa
LSHCTAKITVICMWTLGEPMRSLLRKNSPAGSFSYARHPIFEQVMEAQHLTVGLILPLETHAGPAPTMADHLAMVSFSEDDCTQCQKSAARSFLMLGMFQKAENKAR

SEQ ID NO: 25260 - protein, 98 aa, Pseudomonas aeruginosa; identical to SEQ ID NO: 25161

SEQ ID NO: 25261 - protein, 165 aa, Pseudomonas aeruginosa
GLCSVKLQRTSCFLFHSYSEKQAKPAQTLLLGVRGSSERLSETVCHCMHSGACTHARTNTHTTPMTTPTLTSTSTPALTPTHTYTHAYIYLHAHTYTHAYIYLHTHGYTHRYIYLHTRTDTHAYMYVHTHTHTHPHLHPRLHLRPHPHSHPPTLTPTLTSTSTPT

SEQ ID NO: 25262 - protein, 382 aa, Pseudomonas aeruginosa
ARMRDHLQSLGDAPDLRWRFAELQPPLDSANMTQGNWLAMRDAIVAALDAGHDGVLLLHGTDTLAYSAAALSFLLLDLPIPVLLTGSMLPAGAPGSDAWDNLVGALRVLQEGHARGVQVYFNDALLHGARVSKLRSDAFDAFAELPRPRHAEHAPAPAALGYRQPRREVNLAVLPLYPGLRAAHLRGLLDSGVEALLLECYGSGTGPVRRRGAAGAAARSPRPRRAARRGQPVRLRPGRVRRLRRRQPPARRRPALGWRNDPRGGPGQAFRPARRRPRTRRSATLVRPRPVRRERRLTALRPPAGGRFLQPSPRYATTPAARPCPAPIVKLQRTVFPAFPGLSPGGESTGCRLPLPAPPASAHKEETPACTPSPKTPFPHAY

SEQ ID NO: 25263 - protein, 194 aa, Pseudomonas aeruginosa
SAARCWNSAASWCRSTASPVTTACRPGPPGAPPWPEPEEPDDERLSQRSTGTSLAAARRTGQPAALRPAAGARPPRHARRRAAGAVAQGPGSQPPPAAPARLRRLRRRREPDPLLPRLRRSHAVAVRRGARAGGTGRRRGPHLRQQLRAAALGRHVPGDGPGIPAVPLCRRARRQRRRPHHLQLDPGGAATGRQ

SEQ ID NO: 25264 - protein, 603 aa, Pseudomonas aeruginosa
RAGTLASRQRPVPAQRGALQQPLGGTDSRAPPAPRIPHPAFLRTAGRGRRQLHQPLRVPLRRHRPGTARRTARQPAPLPVPPTGALRPPLAQRRPGDRRQPDPAARSRGLRPPRAAPPAAGAYPRRAGAAQPAPAARLTAPPAVRATAGVPTRNQHEPFRPQRADDRRRLSRQPARRSPGLPQRRTGRRRHPAQGVPQRLPQHRRALRRPPRRAARRPHPGRCPGPPQPPLLHPRAERRGPARRARGDRLLVAHDLRLHGAYPGLQGGVHVRAGGRRRLLRRLPAERLRLAPRLRRPRAVPQPRDHQSAAGPQQGDPRDARRVRPRRTRDRPGYRRQRGEDARHRQRHHQRHLRRPGRLGADGGRQGRGLRPGVLRPHGQPRPAPDVPAILRGAREQPLRLPAVQSFRRERQRAAVRQGADSLGGRPGLPRPAPRHRLLCRVGLRQPVQLPVRHPPRGEAGTDDRPAFPRRARQWHPGLPRDTGGPRRADRPAAPAAGADHRHGPRPGAQRRRVGGAAPGVRQCPAHPGAADLEACPRVAGRRPRRRPAGHRLGRRRPARRRGTAAGGQLLPRCRAGAGAAPEAVQADLGRHRQRVRRAPRGL

SEQ ID NO: 25265 - protein, 293 aa, Pseudomonas aeruginosa
RRRRITPVALFALPPRHGCPASFALRQAERLATEMLAQRLDERPDPHRHVARRGVQGVDAALRQVPAGQQPDQPPTGDLAGHQEARQHADAGTVEHQAVHRQGVVRQQAPSGLYRGTLALAFEGPGPGRAQAGMADPFAARQVVRLEHWRQAGEVSRRRHGNLLEVAQLAGMQAGIARPADTHREVDALADQIAELVVGQHFHLDLGKLPDERRGNAADVPLDEVLRRGDAQPATGLALQVAHIGERAVQLAEHALGHAEQQFAAIGKGHATGGTGQQLDPEVGLQASQLLAE

SEQ ID NO: 25266 - protein, 367 aa, Pseudomonas aeruginosa
NRFQLLASAGEDQPDTPIRTAPRGTRSVNGSVLPSRGRVTINQVAEAAGVSKASVSRYIGGDRQLLADATARRIERAIDQLDYRPNQMARGLKRGRTRLIGMLVADILNPYSVAVMHGVETACREHGYSLVVCNTDRDDEQERHHLAALQSYNVEGLIVNTLGHHPGELRALHRELPMVLVDRQLAELDTDLVGLDNADAVEQALDHLQHRGFRDILLVTEPLDGTSSRIERVQAFNASIGRRPALKGQVLQTDDFFRDGLRAFLSASGPGPKALFTCNGVATLCATRQLRDLGCRLFDEVGLLALDELDWYPLVGSGITALAQPTDEIGRTAFERLLARLEGDREPARRVTFPAQLIVRGSTHPRG

SEQ ID NO: 25267 - protein, 770 aa, Pseudomonas aeruginosa
LRDPLLRRDHGHVRRRTARRTGPGRAVRQAHRRRRQQRRHRPRPPRLHGGLAEPGRRRLARPLRTRQPDPRGPRLPLRRGRRASAHRVPDEVPRGRWCRPAGRVLPPRLGGQPAGPRPYPRRNARRPPPARHRHSAGTLGECLRTVPRTDAAHARQGRQPVLRPQPAALAVAQRAPHDRRDQRPRRACPLGPAGPGGRPPAQRLAGTRGYRRVLPGHGRRRGGDQARPERRLLSRCPRRRAGPRRAGGDRGGHRGRRRRLRGRGGQRAAGRPAAARRGGARQLDRQPRGTGPRRHGGAAETQPTARPRAPQERLNPPPTRHLLRQEQDKLRRYPTMTMPRLASSRWWYIMPIVFVTYSLAYLDRANYGFAAASGMADDLRITPGLSSLLGALFFLGYFFFQVPGAIYAEKRSVKKLIFVSLILWGGLATLTGMVANVYLLIGIRFLLGVVEAAVMPAMLVYLCHWFTRAERSRANTFLILGNPVTILWMSVVSGYLVEHFSWRWMFIIEGLPAVIWAFIWWRLVDDRPRQAAWLSGSEKRALEDALAAEQQGIKPVKNYREAFRSPKVIVLSLQYFCWSIGVYGFVLWLPSILKHGANIDIIEAGWLSALPYLAAVIAMLGVSWASDRLQKRKRFVWPPLLIASIAFYGSYALGSEHFWLSYALLVLAGACMYAPYGPFFAIVPEVLPANVAGGAMALINSMGALGSFSGSWLVGYLNGITGGPGASYLFMSGALLLSVLLTVFLNPHADKREPDAARAHASRRAAPAHP

SEQ ID NO: 25268 - protein, 334 aa, Pseudomonas aeruginosa
PTPEHPMKKVVLYKRLSAPLMERLRERVEVLLVEEPGRDGLARLRDALPEAHGLLGASLRLDAGLLDLAPRLEAIASVSVGVDNYDIDYLDRRGILLSNTPDVLTETTADTGFALILATARRVVELAGWVRAGEWKKSVGAAQFGTDVHGKTLGIVGMGRIGEALARRGHHGFGMRVLYHSHSPKPHVEERYAASYRPLDALLEESDFVCLTLPLTAATEGLIGAAQFARMRPQAIFINISRGRVVDEAALIEALAQRRIRAAGLDVFEREPLSPDSPLLRLPNVVATPHIGSATEETREAMARCAVDNLLAALAGERPLNLVNPSAWARRRGA

SEQ ID NO: 25269 - protein, 422 aa, Pseudomonas aeruginosa
PRPGLNVVALERGENRDTYPDGAYPNTLDELTYNTRGKLFQNLSKSTVSIRHGINDTALPYRQLSAFLPGDGVGGAGLHWSGVHFRIMPEELRLRSHYEERYGKKFIPEGMTIQDYGVSYEELEPHFDFAEKVFGTSGTAHTVKGQVVGKGNPFAADRSDDFPLPALRQVYSAQLFRKAAEELGLHPYDLPAANASGPWTNPYGVQMGPCNFCGFCSGYACYMYSKASPNLNILPALRQTPLFELRANCNVLKVNLDSDGRQATGVTYVDAQGREIVQPAKLVIISAFQFHNVRLLLLSGIGKPYDPRTGEGVVGKNFAYQNMATIKAFFDKDVHTNPFVGTGGGGVAVDDFNADNFDHGPLGFVGGSPMWVNQAGSKPIGGLAVPPGTPSWGSGWKQAVKDAYTHTVSMDAHGSNMTYRDK

SEQ ID NO: 25270 - protein, 142 aa, Pseudomonas aeruginosa
SDIDPTYKDAYGQPLLRMTFDWKDNEIRMSRYVTEHMRKIAEAMNPKAISVSVKNFGDHFNTRVYQTTHLLGGAIMGSDPKTSVLNRYLQSWDVHNVFVMGASAFPQGTGYNPTGLVAALAYWSAKAIREQYLKNPGPLVQA

SEQ ID NO: 25271 - protein, 160 aa, Pseudomonas aeruginosa
  UNSURE (25): Identity of amino acid at the above locations are unknown.
NRQLSSPSPPSRAASPRPPQRRTRXWSGRVNTWPAPAIAWPATPPGTASRSPGACRWKRRSARCTRPTSPRTARPASATTASRTSTVPCATAWPGPATRFTRRCPTRPTRESAKRTCAPSTPTSCMAWSRWSSPTRPATSLGRCRCAGRWHSGAGPSLPR

SEQ ID NO: 25272 - protein, 132 aa, Pseudomonas aeruginosa
TTRRSPTWSTSSAPAGATRRQASASTRSGACARTPARRRWATFRRRDRPRRIAAERQACHSSPSPARGRGLPYQARPPLHSSPNRTCRPSSSNNATTERNARQSGRVSSHRALAQPSRSASSTRRPSPSRSR

SEQ ID NO: 25273 - protein, 237 aa, Pseudomonas aeruginosa
WTAGASAAPTPRPWPGCSTARWWTPPCVSPTPNTRRRAWPGPARPWTCCSTACSWSEKPMDYRIRTSRDEDAALLPAIERSAGESFRLLPELAWIADAGVAGVDFHRRLIERGSHWLAEDADGQPVGFLAAERCADELHIAELSIAQAHQQQGLGRRLLERAVTYAHASHCRALTLTTFCDVPWNAPFYARLGFQRLTWQEAGERLRAILGHEQEIGFGPPTAAARCAWCSRRRQRA

SEQ ID NO: 25274 - protein, 593 aa, Pseudomonas aeruginosa
RYSCQLQQDVSALPRTGFRSPSSPVCPCMSSQRRNYRFILVVTLFVLASLAVSGRLVYLQVHDHEFLADQGDLRSIRDLPIPVTRGMITDRNGEPLAVSTEVASIWCNPREMAAHLDEVPRLAGALHRPAAPLLAQLQANPNKRFLYLERGLSPIEASEVMALGITGVHQIKEYKRFYPSSELTAQLIGLVNIDGRGQEGTELGFNDWLSGKDGVREVAINPRGSLVNSIKVLKTPKASQDVALSIDLRLQFIAYKALEKAVLKFGAHSGSAVLVNPKSGQILAMANFPSYNPNNRASFAPAFMRNRTLTDTFEPGSVIKPFSMSAALASGKFDENSQVSVAPGWMTIDGHTIHDVARRDVLTMTGVLINSSNIGMSKVALQIGPKPILEQLGRVGFGAPLSLGFPGENPGYLPFHEKWSNIATASMSFGYSLAVNTAELAQAYSVFANDGKLVPLSLLRDNPQNQVRQAMDPQIARRIRAMLQTVVEDPKGVVRARVPGYHVAGKSGTARKASGRGYADKSYRSLFVGMAPASDPQLVLAVMIDSPTRIGYFGGLVSAPTFSDIMAGSLRALAIPPDNLQDSPAVADRQHHG

SEQ ID NO: 25275 - protein, 127 aa, Pseudomonas aeruginosa
PAMLIPSSYCCTDDQCPAASERSPCYAQLIDIEVEPASQLSLALEQNAHLQRLERCFRNCPGYLSASLHPSEDGQHVLNYTCWRSREDCERAWQAREDAQGPLSAGVWRLGAKSVRFETFLVDAEGC

SEQ ID NO: 25276 - protein, 359 aa, Pseudomonas aeruginosa
ARRRRRPVSEGLLQGGHVDHEAILHVAGQHPLVGLVDLLDLDHLDVAGDPVGRAEIQHFLGLGDAADGRAGDRAASHHQLRTVHRRLQRLEQADQYEGAVALEGRQIGIEVMLVRHGVQDQVEASGDGGHPLWVGGKDHLVGAEPPRFLFLARRAGEQGHLGTERPGELQAHVTEAAQADHRHPAAGTDLPVTQWRVGRDPGAQQRRRRLRIEPLGNAQDEPGRDHDALRVAAEGRQAVVAVAAVVGQGRVFRAILLQALGAGGAVPAGVDHAADADQFADRETAHRLADAGDPADDLVARHQRVQAVVPFVARLMEVRVADAAVEDVDHQVVGARRAAFEAMGGQRGAGGLGGVAADL

SEQ ID NO: 25277 - protein, 322 aa, Pseudomonas aeruginosa
AGTQRADGFGTAGRGDGRCGDAPAGLPAEPAGQPYPRPATGPRDHLPRPAQRAGQRPACGGRPAQRLRAHGQGPAAHPHRLRQCAGHRHPGSRGEHERVDLPPQLQGDDLHLAPPVPEERAPVQGLEPDGAGRAERQYRRQPGRLRKSLAVQPRVQALLRAHAERGNPGRPPLAGGSGGACNTYGYPYIQLSIYPGRPSDAQPRRSVQVPGRRDARSRHPADRRPGRTVRLRTDVRPRRQPAEDQPPPGPVAQCRAAPRPSPGPVGVLPPEPYAAGLDPRSPASDPAGQRRLAASRRSAPARHGRPPAARLRLLPIARAAPC

SEQ ID NO: 25278 - protein, 185 aa, Pseudomonas aeruginosa
PCRSCWRPFRPWPCAWPSDGRRRRRQEHPMRVLFMCTANSCRSILSEAMFNHLAPPGFEACSAGSQPSGRVHPRSLATLEQAGIATHGLYSKGSEAFEGAPPDIVITVCDAAAGEACPLYLGAALKAHWGLADPSALDGDEALRDAAFHATLARIEQRCRAFLGLPFATLDRDQLKRELERIGSL

SEQ ID NO: 25279 - protein, 88 aa, Pseudomonas aeruginosa
ARPKAPRSSATNWATSPPATPPTVPPCRSCSGRCACASNASPHPRMGVSACSASRACGPRCTSSIASSAPTCTGIAARNWPPTRSGRG

SEQ ID NO: 25280 - protein, 375 aa, Pseudomonas aeruginosa
  UNSURE (251),(294): Identity of amino acid at the above locations are unknown.
GGGAVPAGGGRPPHVPGLPAAQRQERAVPRPRPGAPARPQPVGAAGPAGGRRPAPGGRGLVLRDSPRTARQGATGTIHAPARSVRRACRQRMPGRPTGSPAVPRLAPQRSQPVATGSRGGHRPLPGHRPRPGPVPPTGRDPAQCFLFTPNSKDISMSNQEPRDLVSNLAETLGAEHEELNQAKTAEVIAHLERVIANVPPATEFTNTRKYVVLGPLLSIVPFIMTGMWFSQGKPGVGVVGLLLGLFGLFLXYQHRNSGKTPFMRLTRTQLWADSLSAPVELADVIDFSVKADMXQTTQTLHLRPETPLPTHRAVRQVFASQAMAFKGKDPRITIMSAGLQSDGKKLDCDDMAAILDAYIQAAHAQRYLQQLRSQG

SEQ ID NO: 25281 - protein, 514 aa, Pseudomonas aeruginosa
  UNSURE (254): Identity of amino acid at the above locations are unknown.
VKGTVHPRRLLLCLVLVPALLAGLGAWQSWRAEQQAERLGAAQQRVERALAEARALPPRASVRVDGRAYVRDLALARLDERLADTRSAQRLNRFAAVLADSGACLAALVAVLGAVSLAGIAGAARSALRSRRCLLLWFELGRRLLPCLLLAQIGLLALALACAGTFEILGLWRVGQVPVSEGRTQLSVALILLGLLASAWQMLAKITRLRLRPAPALDVIGRRLGEEDAPELWTLLRELAARLDTPAPQHLLVXLGQGFYVTANRVCLQPSGEHLEGRSLYLSLPLLGLLDRAELSAVIAHELAHFAGRDAHYSLHFLPIYQGAASQLAAIEEQEANVFERAALEPARLLAGYFLERFGLAVNHWSRLREFAADRRAAQLAGAPAMASAMLRSAAAGAPIRAFLEHCLLAPARAPDNLVDAIHVYLGQSGLEAPAPGAEGLQVHPQDTHPPLGLRCTALGESFERTWAGTAGRAVPTRPPSQALGVWFGAPLALSRALSADLLGKTCENPHARN

SEQ ID NO: 25282 - protein, 129 aa, Pseudomonas aeruginosa
ACQSPSGIAGAVLVMPLSRSMRPTICPGLVNWLPTAAVPARTTATPSAAVPSGAGPSASSGRRNQGSQSSRPKTNHRARRGTSCHQSRPTSHSAQTVLANSTRAYRPSAARLPSSSNSPLRARPMPASR

SEQ ID NO: 25283 - protein, 659 aa, Pseudomonas aeruginosa
PRRPPIRASASRPWRNCAGAAAAGSCRHPQLRQGDTHRLAHLGIAVAFGDPQGLGRGRVRQFAEGQGGLLAQVADGMAEQCFQRLPRRPVAQAPERPRGAQADLPVVVRQGLQQRLAGLLPAQLAKGRRRLFANLPLSVRQRRAERRQHRRLAAQAEGAGGRPAYLRVDIGAGQPGQFGQGRLVAEPAEHRHRLAAHRRLRIAEGGQGRRGALLQAQFAQRTQYAGADEGIGMPEPRQQAPPGGRFLEFAKALRGGIGHRRHRIGQGRTERIDHCVFLPGLQQARGLAAHAGVGIAAQGRNQQRQRLRQLQVGQFDQRQAAYAGVGVLQARRQFEDFGQGGVFTGHMAIRSRSGVMPGGKPSGVRRGNWRPSSWSSSSRQWRFRRTKSALVTSRVSRGRGKSSARSAMIRPGRGLITSTLSARYRASSMSWVTNSTVVRTRAHTSSSKVCIFSRVCASRAPKGSSISSRRGRLTSTRAISTRCCIPPDSWPGQRPAKSASPTSPSISMARRLRSARARPCIFRPKATLSRTRRQGNRVCCWNTMPRCGEGPSTLRPSTLTLPALGRRWPARAPSRVDLPHPEGPSRQTNSPGRASRLRSRTASKASLPCPRRMLRSRIWMRPRLLPAVVIGPCLPPRTRASATRRRASPTHCCPCRRGR

SEQ ID NO: 25284 - protein, 176 aa, Pseudomonas aeruginosa
RSSRPPTKGTSGSPGESRPPPGSAAALPAAAAARPRPRPSGRSPGRGRCPARRPADSRRRPAPDWRQGAPGARWTGPGCRPPATPHRASARWRRSPGPDSVADRRRAARTPGRPPAKRRGWPSARVGRSEANSWADSEDARLSGAPAPAGWRRQSRVPRRHGGGHSPGPARGAGRR

SEQ ID NO: 25285 - protein, 285 aa, Pseudomonas aeruginosa
SPPSARRCRRRSPRCRIPAPGCSCPLSLLPIDAQAILESVAAVVEVFEVQRRAVGGMGQALDTHDRRALLDRQGAGQVGIGEHRVDGQVGMAEGNAAIVLEDQEDVAGHQVGLLQALAERLRQVGDFQRNRLAVDQPHPLDLAHRAALFHPQALGHPRAGRHVAQAVQAVDDLVAHLRHGLAQALQGADVLERLRPGDEGALAVDLEDQPFLLQVAERLAHGDAADVEGLAQLVLRGHAAERRVDAVEDAPAQQLLELAVQRHGRKREQFAHGRIRLSEWLGHLL

SEQ ID NO: 25286 - protein, 904 aa, Pseudomonas aeruginosa
PLIFTCSSIRPRNSRQPSARQRTRSPLRYRRPLPGQPSSRKRPARLAGVAGIAARHPGAADPQFAAGATGLATTEAIDHMQIDVGQGAADGRPRMLGDPRQAGVHRGFGRTVEIEHLAAAPAGGDLPGRFVEALAPYQDAPGQRRVGIVEAGLEQQAEQRRGAVEHVDAPFFEEPQHPLRIAAHLLRHQDQAMAGEQLENLLDRGVEGERRVDRHPQALAHHVRVYRARQGLGQVERAGVLDHHAFGLAAGARGEDHVGRIAPARRRQAHAAAGQRQRRQVQAGPGEGLAGAPGALGIGKSEDDPARFAHPLHPRRRKLRIDRGVHRRRAHHPEQGDDRLAVAPGHHRHRLAGPHAGSQQRFGDRFAARAQRGEIQAAVGIQQRRRLRLQGGPQIERGHQGFHRRGLHALALPGLVALALGRADQRQPGQWQLPVGGDAFQAFDPGVEQAPGQRSVMVAADPQAGQPAFAVGQHLQLEEPAQRRLTAIQLGHPGAIQFARQPGEAQLGERPVGGKGIAQGRCLLLGEDRRLEGVEPLADAARADILQAQRRDPGERSGQLGELVEQAPRDQSRHFQRESLVALELPGDLGPGQQGGRLRQAVGGQAFEQRARQQAPRPSNRLRPGRPPAPADFPPQRPPALASNRWRFRRLRRPAPRWPTRRNAGTAAPRLPRPRSPGRPAPGRGAAAPPGWPHRRRTPAPPATAPGASLRRRPAAGRAPVPAGLPRPGAKRRDARFRARSVRPSRHLPAGARPADRPRAHPVPAPAGSCPASSGRPRAVAPRRPAPGAAAPASPRYRPGRAGARRQPYFPAARHGGARRGSARETAGILRALRSRPVAQRIAGLLTHSWLSLARVQGWWTCRSVIATSTLRSPVYGSRPWTLMKLSSIRTSPRSQANARVSSR

SEQ ID NO: 25287 - protein, 89 aa, Pseudomonas aeruginosa
PGYAARNAPCSRAVAGRRQRRLRGSALPSRPRSLSATGRQPGSGRRAGTGPARESSRPGTGREPVPRSAAAGRRAPPPGAAPAPRCCAG

SEQ ID NO: 25288 - protein, 562 aa, Pseudomonas aeruginosa
RQHVVRQTLPKVLVQRLERRGERRRQVADQPTQAGAVLGEHGAGFAHPGKTRQARGDLAQLDAEAVELDLVVEPAEVFQHAVLAHAYAVAGAIAALAAARIDAETLGGLLRLAEIATRQADAAEVQLPGHAQRQRRLEAVEHLHRGAGQRSADGRLVERFGVQVQFVRRRIGGVLGRPVEIDQAPYLGLATNLSHQVAAQRFAGQVQRAHPARQVAEGEQRGTHRGHGIEQADLVAARVVRQAEQVFHQVQRAAFGQGTEQLVDRQVEAHRGRRQYPAPFFGGIVLAGPAQEGMGAAVLDGDALGASGGTGGVDDVGEVVGADLARGQRQVVRLVAALLQRQAWPAQRGDPLAGARVDQHQQAVGVVEHVCHPLLRIGRVQRDVSTAGAEHAKQADQQAAVAPHADPDPLLRSHPGGAQAHGERGAFALQLGISEATVGGVHGDALRCAPRLGLEQMVEYAARRGGLGLAAHGLHTALFVGVHPGQPADACLGVDHAARHAREMAGDTPQFVVLGIAQSQADAAVRRQHQGQPAGAARRWPRRQHLDRAAPGQGGALLAVGG

SEQ ID NO: 25289 - protein, 402 aa, Pseudomonas aeruginosa
SGCGQDVTPLCRRASATVAEKVAVTLHPSAALALHSPALHREALDAAEHQVLHQQADQHHHGQAGEYLVGVQLVAVLENVPAEPALAAARAEHQFRGDQRAPGEGPADLQPGENRRQRRRHQDQEDEAQATQAVVAPCHTQGLRDTEETGIGVQRQRPEHRMHQHEDQAVLAQAEPEQRQRQQRDRRQRVEHRREGPEQVAAQLRGDRQAGQNEGQDDPQQVALEQHQQGDPRLGRQFAAGQALAEGPGRLQEAWQQQVVALDPRRQLPGQRQQRQDQPLAQPALLPETLAQGQAPLQGDLQQGFELDFVFFANARDSTHRSIPLLNGPAGYRRSRGSRPPSVRRPRRTASGGCVAPRLAAARRQGCAARTGGRALRPGPAPGAARAAGCGCPPPTPPRWSG

SEQ ID NO: 25290 - protein, 176 aa, Pseudomonas aeruginosa
LASASPTTCCACAASAISRWTPWRGFPVSAGRCWRRSSPGAACRRSRCCARSPRVSRCRWQPSSTIAPSPVSRCCRRNRASAWSAPTALSPAARCSLSMWRARWSSTNCACAASARKTPKPTPPAPRRTWWWRRGYWKCGSTRSASCSPPATRSCSTPTSRTATATPPIAKPWRTW

SEQ ID NO: 25291 - protein, 218 aa, Pseudomonas aeruginosa
PTRSAWTDPRPCCHGRRKARPVIPGGPFPSGDGSAGAAHHRHAVATHHHRHAALHHLRHQHAAVLEHLHVHALHRHHPAVHGVALHGALHHALHRSHAHHRHAHPHAHRRHHRHAGLGHAHHRQVAALHYHGHAAVHHHRHHLGAVAELAHVHAHRRHHLAQHAVVHRFALHGRHHHRHAHHGHHRHGGIHVHRHLHGIHHGGNSCRRSGGRCEWGRF

SEQ ID NO: 25292 - protein, 225 aa, Pseudomonas aeruginosa
QRIPLHGGGTHRHSRYFDAMDIRNGPIQITQVNKRSKTRSLFPLAGRSPVYCAAFRCSDDALRKSRGPTRKACAALPQTSTAAKPISGSRVQGSISLPQRCNTMPPNAPPPAMARFQATTIIDWARSAPSPAASAEAVCSSVAAPPNVSPQRARPANASQLQRAPRHSASAATANSARLARTIRRRCRSTSTPTSQIPATAALPNTSRARSTEAPRPTLARNGAI

SEQ ID NO: 25293 - protein, 80 aa, Pseudomonas aeruginosa
RSACSPRPGGTGCPRPLSGRICGRPGRQPVDRATAPGVPPAPPPPPGAGRRMPPRSPDRHFPPGRSLALVRNWTCGTLRR

SEQ ID NO: 25294 - protein, 182 aa, Pseudomonas aeruginosa
ERCKSGKRRIEFRSIRTVMSVIGALHGQPQRFHRLRPRRRDPQHRRRRPDPRRQRLGGGQAGRPPGRETRRAPVPPQHPQHHPDRRRQPVPRAQPAHPGRDRSHRAGAVAKPRDPARAPTGQPAAGQRAGPADARRFHAGLSGHRARPRLQRSRGGCRRRRLRRGPAHRPAGGFAAVHARTG

SEQ ID NO: 25295 - protein, 399 aa, Pseudomonas aeruginosa
SAAASPGSTPRLSWPSTASPTSSCWRPATSASAVPGATAGRSWPASATTWRRSARTSARTACGRSSRSATSAPTSSRAVSRSTPSTPTSATATATWASTHARRRPCWPGKRNSGRSARPMRSVTCTVPRCVRSSARTPTAAPCCTWAAAMCTRSTCCSAKPRRWPASAHGYSNTARRWRCNTASASACARPRARSPRTRCSWACDSFLNRLEPELHRTTINTYAFQMMTEPLPDELIQRISPIRGAYSDIRPVIDYYRVTNENRLLFGAATPFVERIPGDLKAWNRKLMLKIFPYLEHVRIDLAWGGPMACSANLFPQIGSLSGRPNAFFVQGYSGFGVTPSHIVCKVLAEGMSEGSARYDLLSSVRRIPIHGKDHFRPLLLSAGKTWHQLSGYWNGRR

SEQ ID NO: 25296 - protein, 523 aa, Pseudomonas aeruginosa
NDLPSIRTALQQSHAFHPRHSRTRHDRPAPPRFAVSQPRRHSRAVPPRRPHRAARLPGRRPTAILGRPAGAGTQPGIPRRGRRRAPGDPRQHPAARRRRRARRARRRGAGLRPRPGPVAEPAGGRAHPARRTLPGADARATRGGGQAADVGNRQEPQGLRERVRPHLRLHRRYHRSAEGTRPPLQPFRTGTGHPRPDPPGSAGRGAVHGAVQLPAERNLHHPDPGADHGQYGGVQAGQVRRAADPPVAGSLPRQLPARSDQRHLRARPGNRVGADGQRQGRRVRLHRHPFRRQRPEEAAPPPAPPARRPRPGREEPGYRPAAGRPGQRGERGGHRRAVLQRPALHRAEDPVRPRKRAATVPRQVQRAPGQPQAGHAVGTGSGADAAAGAGQGRLPRRPAERRPGQGRTSGQCGRRRASAKFLLPRSAESGEPGHAPLPRGAVRSAGAGGALSRAGRGDRLRPALRLRPAVEPVRQRPGADRPAGRRLRQPGRPDQRQRPVPARPGQLPVQRPEEFGGRHHVGP

SEQ ID NO: 25297 - protein, 133 aa, Pseudomonas aeruginosa
SRRSAPTSPACARATTGTASASAPPAAARRCSRMPRWRKRTSSTSPAASSTRPRSTSWSCSRCWPAPAAPPCATSPPRCAGGPVSTATAMPRESARIPRCSRWSGASPRASTPPRRPPCAPPKRPSAPTWRAS

SEQ ID NO: 25298 - protein, 179 aa, Pseudomonas aeruginosa
STTGPASAGAPRQRHRHPGQRAGAGRARHPGAPRLRPPHRRRRRIAVHPGRHRRRHRPWHPRRDRAAGAPPRAAMDRRQPAACLGRPLHHPAGRRPAHPRARRGSRARPGGRRHRSGARRPRRGERGRRLDRGGRGQGAHHRSRPARRQPAVRTGRHALDPGGTQSRPPLAQRPHPHPA

SEQ ID NO: 25299 - protein, 351 aa, Pseudomonas aeruginosa
PGALEIPCHRQLPVEWGEATAARLALGAVPGPGADIATGVIRRPPRSGRQRVAPGLLLPEGPQVAIAGRRMGIRQPRAVAEQLLAQGSRRIFGLVHPALLQLRHQQFDHVAEGFVGQRIGQVEAIHVGVLHPLLQQVGDGRRAADEQRSEAADTDPVGQLADRPGARRIGAGKRFHRRLDRIGVDVPQHLVRPILAEVDPGPAGDQRQGPFVADEGAVFVELGPGLGVGFAQHHRLQVEHQYLARIAAGLGDALADVGDRLLEHGLRWRGDEHALGVLGGEALATTRRAGLVEHRRALRRRFAEMDAGYLEVLADMADLVNLARVAEDPSATVAEHRAVLPTAFEEFVEHL

SEQ ID NO: 25300 - protein, 289 aa, Pseudomonas aeruginosa
VFVGIVVAAVVVELGLLTEVARAAFQVGGHYVPADPALGQVVQGRESAGEGIGMLEGQRGGQAEAQVASHRGHRRDQRQRVVHRYLGGLADRRVAIAVEHIVDAQHVGDEQSVETAAFEQPRQVGPVLQVLVLRGAVARMRPEAGRLVADTVHFEGVETDFARHGDSLACLCIRHPVHSPCRAAGPRRTRPGWQAPVAVRAQLLGKCWWINTFARPTRAPNPVGRIAPQRYPPAHWNPVRRIAASGYSPYPNLSITRRANSAPALSANAPEPRPADSRERLFALPEHPH

SEQ ID NO: 25301 - protein, 286 aa, Pseudomonas aeruginosa
PRAAIRPTRASPLTRRANSAPALSASAPVPRPADSRERLFALPERPVRPAPVESARRRVEQVAEQADQQHHRHQLGVRQAVAGVEDVVAEPGADAKHLAGHQDDPEDADGQAHAGQHMAEDARQDHPAQGFPGRGGEAAAQLQPARVELAHAGGGIQQDRPERGEGQQEIDRLVAHAHQHHRDGHPRQRRDHPQELKRRSGRRFQVARGAHQQPQRHSHQQRQEQAQQDPFQAHQHVLVEFAAFQQFTQAEQRRLRREACRKAVGGAEQGHAEPPQGEQRQQPGDA

SEQ ID NO: 25302 - protein, 767 aa, Pseudomonas aeruginosa
QDAFGEQQGLVDIVGDQDHGGAALVDRPQQQLLHVGAGHFVQRAERFVEQQHLRLPRQAAGQRGALGHAAGELRRVAGTGVLQADRGDRLVDAGLAGGRVEVRLAGEIEAEGDVLLQVQPGQQAGVLERHRDARMRSAQGLAEYPHAAGGRLLQAGQHAQQAGLADAAGTEDRDHLAGAQAQFEIAEHRLPAGTARIAEGDPASVEERLAHALASAWRCSSARSCTRLGVTIGTNADSRQRRAKPAPCSLRYALPPLACNSSCTALAAASASPMRMRNRRAGWLANSPLASPACSAATCPSRVSRCAASSPSRSERLPPRCRCTSSSARRARPMAMPHCRPRKAGRTRGRNCRASSCNSQSRPTATARRSRAAVLLHCRPSRRRSAERCKPASPSGIARTKGLPPSPCSIAAATTKSPLRRLVTHGRRPSRRQPASSACATTCSASIPERNFIALDSPVAPARRPASRSPSRRWRSSWLGLCNRYSMKARWPQKTNAAVSERAATAATRSTASASVPPAPPRRSSTATPSTPAAARRGSSAAGSASPRSRASAWRSSQSLRVGSSMVVTPCAGAACRPASAGSGLRVGPAILLQLGIERRAGEHVGEVAERRQAHPEDHFQGLGLVETGGAEGFELLVGDRTAAGDHRAGEVGQGFVAGIGQFAAGAQGLDHRLRQARLVARHRGVPGNAEVAAMGGGRHQLHHFPLGQAEAGLGVQPGHGEVGFQGGRRIGQHAEQIRDITRVVQRGLEERTRRLGGVFQGEHGNA

SEQ ID NO: 25303 - protein, 708 aa, Pseudomonas aeruginosa
QSPLHPGPTHESPTRVPLHPVVPQRTVPPSPAAPVDLPGLRRRGATGRRRRHPRGHRRCAPGAAGHHPADRHGDLAATGGKLPGCAHRDERARRRNPGEPAHLPGAGPAATGAEHQRRLRPRAPVQRVDPRPRQQPGQGTAWKAASGCTSTTSTSAAPAWPRSTFSTSSSWKVLRGPQGTLFGKNTTAGVINIGTRAPSFTPERSVEISGGEDGYFQARGTISGPLGETLAGRLSAYRTRDDGYVKNLHDGNTLNGGARQGFRGQLLFKPNDDFSLRWIGDYNEEDSDNGVLTLFSSGPTVNGVNRYEQRAAAAGATLVDGHRRKVNFDSDQQVTVFQGGTSVEANWKLANDFTLTSISAYRWWDFTPRNDDGLDVPAAYNAGVSVRDKQWSQEIRLASPSGGFFDYVLGAYYFGQDLDNKSFTDYGPRADMWNGTPAGALSDVSTRGRGHIDTDSYALFAQGTWHLTERLDLTAGVRGTYEEKSAWVERYAPLGGAAVSGAAAAARNGRVGAYDSGDIGLHSVSPSALLSLSYRFSDQVLGYASLSHGEKSGGVNLTVASAPSAGADSLLIGTERANDAELGLKTTLLDNRLILNGNLFWTVVHGYQANAYDEANRTQYLTNAGDVRSRGLEFEATALPIRGLTLNFNASYNDVRYLSYKNAPCAPEVAFQAGAPASCDLSGHQVVGASKYIANFNGEYRWKLDDGL

SEQ ID NO: 25304 - protein, 545 aa, Pseudomonas aeruginosa
PYLTASYAFRSRAVGTIDDSAYGQIPSYALVNASAGLRGDYGDRQWDLSLWLKNAFDKTYSPAPGNSADGGYPGVLGTPRTLGVNARLRIPNPSARNPPCPDSRCSCSAPRCSPPGAHAAPSVYPTGVTRYDPQKAFNQYVIFSGADRKTHLIDMNGNEVKRWDCPGFPAAVIDPALNGGKRGHVLLQLADLAAPDKLASPGNGLANQALGELDWDGKEVWRWGDQAPGGAAHQHHDQRRLANGNTLLLANKVHAVKGFAVPRVIDDVIYEVTPQGKLAWSWTASEHLDEFGFTADQLKRVRASENPDYLHINNLAPLGENRWHAAGDRRFAPDNLLLDSRNANFIAIVDKASGKVVWRLGPNLPPIDPKSARKLPRPVDQISGQHDAHLIPEGLPGAGNLLVFDNQGDAGYPSVQRGLVSGSRVLEIDPLKKQIVWQYTAEDSQQPGWAFYSAFISSARRLPNGNTLIDEGQNGRFFQVTPGGEIVWEYVSPYFGKAPRGDARSNWVYRALPVAYDWVPEGTPREEKAVNLAVPGATPQVTARR

SEQ ID NO: 25305 - protein, 172 aa, Pseudomonas aeruginosa
SAPWPTPSAHAGSTSDGSPNSAAANGRRLSTSMSPPSSGTARPAPPATDSTRTWRCSTAASARSGWTPASPVRSSPTRARARSPTPPASPSPPGKSPTRAPPGCIPGPWRFPPARAPRTWRRPSPPGPPRRRTASWWRTGKAWPTCRPAPAPRPTARPTWPPRRSRGSPWNR

SEQ ID NO: 25306 - protein, 290 aa, Pseudomonas aeruginosa
SARTLPSAAEEPAMLTLKQSRRLRNALLGLLCWGIALLLFFPIFWMLLTSFKSEIDAFATPPQFIFQPTLENYLHINERSDYFAYAWNSLLISSSATLLCMLVAVPAAYSMAFFETRHTKRTLLWMLSTKMLPPVGVLMPIYLLAKQFGLLDSRLALIIVYTLINLPIVVWMVYTYFKDIPVDILEAARLDGAGTWQEIVRVLLPIARGGLASTLLLSLILCWNEAFWSLNLTSSAAAPLTALVASYSSPEGLFWAKLSAVSTLACAPILVFGWISQKQLVRGLSFGAVK

SEQ ID NO: 25307 - protein, 383 aa, Pseudomonas aeruginosa
SASPSFRPRRYSAMADLKIRNLQKGFDGQAIIKGIDLDVRDREFVVFVGPSGCGKSTLLRLIAGLEEASGGSIALDGTDITDTPPAKRDLAMVFQTYALYPHMTVRRNLSFALDLAGVDKREVAAKVDAAARILELQALLERKPRQLSGGQRQRVAIGRAIVRNPKIFLFDEPLSNLDAALRVQMRLELARLHQELAATMIYVTHDQVEAMTLADKVVVLNGGRVEQVGSPLELYHHPANLFVAGFLGTPKMGFLRGHLSRNQGERCEVALECGARVGLPLCAGELATGSPVTLGIRPEHLNIARPGHAFQSLLRVAADVSERLGSDSFCHVRADSGEMLTLRVRGDFAPDYGAPLELGFDPEHCHLFDSNGQALDKRLQQAA

SEQ ID NO: 25308 - protein, 201 aa, Pseudomonas aeruginosa
SRQREPTDETQPAAPPPAGDRCRPPVLRPRATAPGHRPHRRRRLPPRAPGGLHRRPDEPRRSPRLGDLRRRPAQRRPRHARRPGRPGLPLHPLRAGRPTGHRGPRDRRHQRHAARRGRRRGAAGKTCRAGHPHRLADHHRRRLLHRRWQRRVPRRVAAGAPRPGQPADPARGLRLSLRGSAAAPRHRRAGVHRDVLRQPPA

SEQ ID NO: 25309 - protein, 798 aa, Pseudomonas aeruginosa
RRGGAQGAAGLRRTARPGAGALDRDARQLSQRHGRPHHPDDQPRPPPPTGPTARRGRRLAGGLRTLRAMGAGRSFQRWAPGLGKGRRAVHRRRHALRGDEDRPAQRQPPGAHLPGLPARLPLRPRDPRRPAAAPLRAGLHGPRRGPAAGTGTGDRPGTLQGQPGRALRQPRHRRPTGTGLLGRLVEVSQVHRPHRQSADRRRPAAGTGGPGGGGLGAVPGRGRRAWRTLPDSRSARRRMPGAGCRTPRPGPAPARRGDRVRPGDPGLGGLRRGLRAALRQPAPTRRQRNPAPGTRRMTPEGRMHGLFLGIDCGTQGSKALLLDAGSGRTLGLGSAAQRPPEGRDGRREQDPADWLEAMASAVRMALEEAAVDGREVRALAVSAQQHGLLLLDAEGRALRPAKLWCDTESAAENRELLEALGGPAGSLERLGLVLAPGYTLSKLLWSRRRFPELFARVAHILLPHDYLNHWLTGRVCSEAGDASGSGYFDVRRRTWASDVLELVEPGGRLAAALPELIEPGACIGNLRPEAAAALGLAPHTRVACGGGDNMLAAIGTGNIRPGLLTASLGTSGTLSAYAERPLVSPHGELATFCASSGGWLPLACTMNLTGACGLVQDLLHLDLDEFSRLAAQAPVGAEGLLMLPFFDGERVPALPHASASLHGMTAANLSRANLCRAVLEGTAFGLRYGLDLLRASGLPGEEIRLVGGAAKNPLWRRTLADLLGLPLVCPRQTEAAALGAALQAAWSLGRESGAGESLEALCRRCVALDESTRTQPQARQQAAYEQAYRRYLEHLPPR

SEQ ID NO: 25310 - protein, 223 aa, Pseudomonas aeruginosa
WSLSFLFWRFGDLHVPGVWRGPFRCLQPGKRCAQQRAGLHRDRRRLAVQRRRRPAPAGRGGGAVRRAVQRLPGHAAAPGARRRRRGLRLPGAQRRPDHPGDGRPGRQRLGAIPVPRRRLRRPPGAPGTPADAGWADTRFARRILYPGGDTGGRHPAGAGPARERPAPGQPGSQRAPRPAAGHRPLAAPGRGLRQSCAPDQGQRGRPGPCFTPAAPPARWPAAG

SEQ ID NO: 25311 - protein, 412 aa, Pseudomonas aeruginosa
TMTDETAPKDLRDQAPRLLPARLIENDAQALQAAHEVAGLARREAALRDRERRLPWQELELFTRLGLGGIGIPRAHGGAQVSHVTLAEVFRVICAADPALGQIPQNQFGLLSVIDNVASPAQKRKLFRGILDGRRLANAGPERNTRHTLELKARVRRDGDGYRVSGEKFYSTGALFAHWVAVKAIDEEERAVMLFVERGAPGLRIVDDWSGFGQRTTASGTVLLDEVPVAGDMLIHNGLLAEIPSLQGAVSQLIQAAIDAGIAQAALDDAQAFVRERSRPWIDAQVERASDELYSIAEVGRLQIELHAANALLEKAGQVLDEVAARPVDAESAARASIAVAEAKVLSTEISLAASEKLFELAGSRATLAEFNLDRHWRNARTHTLHDPVRWKVHAVGDYYLNGARPARHSWI

SEQ ID NO: 25312 - protein, 294 aa, Pseudomonas aeruginosa
GAPDEPRTRYARQSHGRCPSHRQRRRSPGNGPRAGRPVRPRKHPARPRAAPAAGRTGTVLPLRPVGHRGAPRIRRGRRLAGDPGEGGGDRQRRRQFPGADSAEPFLRPRSAAGERLAGAERSPVRRRPGRRAFRQRPGRDRHAYRQRAPYPPARRRRRLPPGRAQVLLHRRTLRAAGADPGGGRRGPPATGLRPARQRRAGNRRRLVRLRSTHHRQRFGAVRPGSGGRRGRGLVPGRLRAPDHRRPAGTDPPRGDRRRDRPRRLRGHPAFRPRARPALGRLRRRQGQRRPTDHP

SEQ ID NO: 25313 - protein, 582 aa, Pseudomonas aeruginosa
DRPPGDPPARRRSAAGACRAGARPGHRRAGRGKRGGRLDRRRRSPRADHRGRPAGRQQADRAWRQPRLSRRTRSRPPLAQRPRTHPARPGALEVPRGRRLLPQRPPAATPRHALNAEGTAMSKKQILLNAFSMNCVGHINHGLWTHPRDRSSDYRKLRHWTELARLLERGLFDGLFIADILGVYDVYQGGIEVTAREAVQLPVNDPLMLVSAMAGVTEHLGFGVTANLTYEAPYPFARRLSTLDHLSDGRIGWNIVTGYLESAAKAMGQSAQIEHDRRYDRADEYLEVLYKLWEGSWEDDAVLADRQRRVYARPEKIHKIRHHGEFYQVEGYHLAEPSPQRTPVLFQAGSSERGLAFAARHAECVFVSGQTREATRQLVQRIRAAVVGAGRRAEDIRIFMGINVIVAATAAEARDKHAEYRRYASPEAGLAHFASSSGIDLSRYGLDEPIRYEKNNAIESVVKNLTVARTDSTVRKLLDQLALGGRYVTLVGDPRQVADDLEGWIADTGLDGFNLTRTVEPESYADFIDLVVPELQARGSYKTAYAPGTLREKLFGGGRARLQAEHAGAAFRQPPAARQRQA

SEQ ID NO: 25314 - protein, 655 aa, Pseudomonas aeruginosa
PHFPFRSGAHHAEHLENPEPGRPPRQRPGPGRRRPAEDRHHRRLRPAAGSRRERSRQAGTEGRTGRVQRLERPQHHPRPGRHRRQLLPARALPGKRQPRRRLPVEAVRARDHQQRRALFEALRQPRRVAGRRQRGHRQRPDQWRPRPATATEGRPAEAQGRRRLQGDPRRYRRQPEGHPHHRAGGGTTGARPRRFRPGPGLPALPAPGRDHRPDPGTAVRRDRQPGIRDPVRHPRQLPGPRRPPGALRRHLPAFTGGPRRAGQGPWHAVPAGLGVTAMTVPPSLLPLEPFPTAPDTRASTPHIRLQGLGKRYPGGVQALREIDLEIRRGEVFGIIGRSGAGKSSLIRTLNRLERPSEGQVLIDDEDIGGYDGQRLVALRRRIGMIFQHFNLMSAKTVWQNIALPLRVAGVPRARIEERVAGLLQLVGLEEKRDAYPAQLSGGQKQRVGIARALVHQPQILLCDEATSALDPESTQAILALLRDINRRLGLTIVLITHEMAVIREICDRVVVLECGRIVEQGEVWEVFGDPRHARHPKPVRQPARRPPGRPPGAPAPGSRRRRPGAARSPVHRRQPTGAGPAGHRQGHRPARRPAPRRHRAYPGPRPGAPAATGRRAARRASRRAGQGRAGGGQGGGARPCRPCLNGSGKVSSIRC

SEQ ID NO: 25315 - protein, 99 aa, Pseudomonas aeruginosa
AASLSPNSSAWTPAPGSIAPSPSAPGPASSACASSPSTRCSTSPRAAPTSRACTWRPRYRRNSPASKTTCASCWNAAAGCNPASAPPPGMSTWPTAMAG

SEQ ID NO: 25316 - protein, 426 aa, Pseudomonas aeruginosa
LVQRPVAQLADLVVQRVVQGLGAQVAPVAVQAQGGVSGAGAGDFEHAVAQVEAVARRGDLGGGDGQGQLAALAGVQRRALGPGGVEALRGALDQRPGAFQADPEFAVARQHIGVGIGLGDLGAEPRSRFAQGVLASLLEGAFGDAEEHLGEDQLGDQRPQAGERRAQRPGIEQQLALLHPHPLEDRAAAVGLPLAHVVPILAQADTAARGGDGGNQQRPALAVQCRGDEHLRIAGAGAEALLPGELAPAVEAPGHGTVVQRVQRVAPEPAVARGQLEPRLPLLGPREQAHGGQHQVLEAIDVGDRAVDPGQFAHGLQGFAPARPQAAVFARDDQRQQAAAAQRVALGLRGTAGDVALGGVLGEIGGQAPGDLQRRLRLGAGLRIHRGFLLGGPAAQAPARAGSTSLAIISPNGPVRLVSPRPARLA

SEQ ID NO: 25317 - protein, 137 aa, Pseudomonas aeruginosa
PEKMKLSMPSSAYSPMRSATCRGSPTSAVPAPPRTRPTPAQRFGWISRRSRRPPCSAAMRRWPSESKRAKDCCAAAMVSSEMCSISLSAARQASSAVSRTITCRRMPNFTVRPWRAARWRTSAIFAATAGNGSPQVR

SEQ ID NO: 25318 - protein, 446 aa, Pseudomonas aeruginosa
RSAWPRWMPSPRFSSGSPPVTTLISRRPPDRRSRVAAIRAETVGETIPGRHRHQEAQALGQRRQRRGHHPGVLAGASGGDQHAVIAKAVGRLCHLLQVRQRDRPRALAGAEEVAIAVGREEPEHVHRRTSGDLQQFGASAEQRRGALGGEADARLQRLADDPVVVEVGLAGVNPDGQGDRLEEAEQRAQLVVEDQRVALGAASGGEQHRGVDQGVEVDQVEQVLEQARIGATVDRRGDQQQVGAFDLVEHRLQFRRRLVARQGSAQRRGDVGQLDDPAVDRQRLAKLGDQGLGEYQGAGRAIGAAGDGDDFEGAGHGISLWTVALGAVPWSKGRTNGEMCIFRAVAAGFRPRPVSHATALLSDCCPGNSSVQLVGLEQEYLECPRRMLVARRQNERRQAPLAALDVGPALAIARMELAERLVAQVEHPRPRLADARPAAQAIQQRA

SEQ ID NO: 25319 - protein, 152 aa, Pseudomonas aeruginosa
RRLGPHGCPGSIGSSSTSRDRALPERGRVMGYLPCWRRWPATASRTAIAARAPAAAGWTAGSCRPGSSTTGGGTSAPRFPGCRAHTPAVAGPAETPCSRRSAGAAGRSARASCATAPRSPGSSSRPRGRPPPGWPGAGRLPDAASRSSPSAA

SEQ ID NO: 25320 - protein, 190 aa, Pseudomonas aeruginosa
SASAAPVTPVATRPGRSAGPGRRAECRRRAAGSAHWRHAAVATVHRRRAARRARPRSSGRPRAGTGTTRRGRSRAASAGAAGGCAAPPGPGLPRQGSAVPTVGWRSCCADAARRPPAGHRRLPRPPPRCRSGRDRESAAPRPWRCPGRPVRAAPATNRGGFPGVAAGNTAHCPPGRARYRVRRSTRSGWR

SEQ ID NO: 25321 - protein, 173 aa, Pseudomonas aeruginosa
SPRKPAGSGQGAGSVPRSDGARRGRGWPPARHPATAPAECSRPPRPARACRAGAGTDATGAARRRFAGAGPRRAGTPTRAPAGSPPRRPTTSGRTRPDAPPAAGARWRTTARPRSRCRASAARAIRSGPASPARAPSAGPPRRSCGSPYHRGFATTSPAPPAAAPAAPGGEPA

SEQ ID NO: 25322 - protein, 138 aa, Pseudomonas aeruginosa
RTRGIAKDRFCAVFPVMPVIQQGTAMIRASPRCIAPPPLHRSQPPWPRVRSTSWTGCARRACRSPTTSRSATPSRRRSCPWWSASSPTSPASRIPRRRSWSNGVSSTSTATTSTRSSPPSLPAPPCRSTTPSAATTAS

SEQ ID NO: 25323 - protein, 551 aa, Pseudomonas aeruginosa
PSSTATTTSTSCCRTWWPTPKACRKSKRPARKPKRPRPATANPRPTSRPDPLPGEAAMPKSSAAEQSGESSTQTLSLLDEIIAKGRMAHDDSQQDYARDMLAEFATQVLDEGMAVDKDTVAMINDRISQIDALISDQLNQIIHHPELQKLEASWRGLHQLVSNTETSARLKLRLLNVGKNELQNDLEKAVEFDQSALFKKIYEEEYGTFGGHPFSLLIGDFTFGRHPQDIGLLEKLSNVAAAAHAPFIAAASPRLFDMNSFTELAVPRDLTKIFESLELIKWRAFRESEDSRYVSLVLPNFLLRLPYGPETRPVEGMNYVEDVNGTDHSKYLWGNAAWVLAQRITEAFAKYGWCAAIRGAEGGGAVEGLPAHTFRTSSGDLSLKCPTEVAITDRREKELNDLGFISLCHKKNSDVAVFFGGQTTNKARLYNTNEANANARLSAMLPYVLAASRFAHYLKVIMRDKVGSFMTRDNVQTYLNNWIADYVLINDNAPQEIKAQYPLREARVDVSEVAGKPGAYRATVFLRPHFQLEELSASIRLVANLPPPVAA

SEQ ID NO: 25324 - protein, 291 aa, Pseudomonas aeruginosa
ARPRRHRRRGALPVPDSPSPGVRCDGCDHSRFRQRHQRRQPARRLRKQDRNHVLQPQRGDAGHQRRQQLGTHLRQTPRRRIHPHQVHRHLDPDPQRVLLRRQADRRGDHHHRPQRRRGQRADHALHRLHPEQRGALQRQRQRRRRRQAGGNPVAELHQDQVGADRAEGRRHQGRHGCLDLGPGRQPVGQVTERRHVRSPAATVRAPQRRGRRTSSVRRPGAGRVGPRRAAAPAQYTASGECAQRHPRLWARRLDRRATPARRRPAPAGARGAGGGRAFRAAPATGRGRGRT

SEQ ID NO: 25325 - protein, 141 aa, Pseudomonas aeruginosa
PGYGTPAAPSPSAIRRSPGACNWPPANAPTRTSSVCWKASRCSPRACNGASTTTTRSSATPSSNSSTRWRCARCRPARSSSSNRTRPRATSPRATGCRATPRCSSPPAAATACISAAAPRRPCGRWRSTKRPCSAARRRKP

SEQ ID NO: 25326 - protein, 214 aa, Pseudomonas aeruginosa
ACAAWASTAGRSCRSSACASTWRLRRWAARSSTTCSPRIPCRSWRGRPARRRRRSAECRRSSASPPTRRCCRRKTADIRACACSPSTSPFPTSSTSSTCRCPARSPTDRRSTCTWSSIAHRRHACICRRKTSSSAARRRSTSFRRPRSRCARTAPAASTAWSPTVTARTAWKSIASAPCARLPGAPCSQSRRTMAAATTATSARSTGTPGASPG

SEQ ID NO: 25327 - protein, 348 aa, Pseudomonas aeruginosa
RHGNPRPARRSPSESAAAPHAAALRTVAGAAAARTRASPGVAAGHRQRAAGGGPAPARAAAAAVRLERGGKPARRPAATGAVHPGVRPRRPRRPVALCLPGMAATTRPAEGPCPRRVPRPVPAPPAQPALPGAAPSIRLALGFPGAGGDPGAGRSYVPSTACCQKPCMSAWRCRTARCWHAPRCSPAGVAPWPASPGLVRQHFGVEARLDAYQGAWKEIPTASRSPGATRRAQPAPGSRCHSRHAHLGRTRRHRLQPRSAGCPRGRPLLPRRRRPWPVGQPRRAVLRPRPGLSPEPAGERRRAAAPGARYTAQAELEHRPAAHRRRPAAAHRSRPAAAGGSLKWNSPP

SEQ ID NO: 25328 - protein, 264 aa, Pseudomonas aeruginosa
WARRPPWAPSPQGIQAYRAGLSDPAKPVGVFLLPGPTGVGKTETAYALADALYGGERNLISINLSEYQEAHTVSQLKGAPPGYVGYGSGGVLTEAVRRKPYSVVLLDEIEKAHPDVLEAFYNVFDKGVMEDGTGLVVDFRNTVILATSNVGAELLLDSPAEQVATPAFDERLRKVLLQTFRPAFLARMTVVPYRPLEEATLEGIVVAKLEKLRERYKAATGKQFDFDPAIVKAVLAKCSAAGARDIENVLMAQVTGKLAEWVLE

SEQ ID NO: 25329 - protein, 392 aa, Pseudomonas aeruginosa
RLRRRPRQHHLPLRTHRAGVLPTLNARRTAPPSRTAVMPRTIEYWRPTNGLYHATPPGIAVLTQDSDWEVLNEATGFYEESPYPSAFKGQVYRALNYINATPTGASLLWNLYTTNNFVDITPSSLGNNVQSTNQPMALNQVAREIIVGTGPGPQTQIALNQTGIAPQAQTQWLTYVINSSPHWALDGVPGNGGGLYGYLERARQYANRWMLLFDHRYFRWSDSNEGYFNEQSYSGHFGISAHNIAITNHEVAAWLAGQPLPHRLSDAQQNHARLATIVALKDVSPPSAGCSAHVRWNPTATNPLNRIRPPAIGLAHELLHAYYSCRGAQPGYDDNHYSTVLFEYRCVGLGPWDEAPLSENALRKEWWSYACQQVPGSDPENRKAIGKRISYM

SEQ ID NO: 25330 - protein, 680 aa, Pseudomonas aeruginosa
SSPLSRQKRGTQMPRPTDSTTSLSLTASALAALFPERLAGEERLNALPGWELLGYSASPLALDGAIATHLTATLHNDADQRPLDGLVAEIRQLPGDASAERYQVLLRPWLWWLTLASNNRVFQNLATSDIVTQVFDQHGFSDYQLQLSGSYQPREYCVQYGESDLAFVSRLLEEDGIFWFFTHAAGKHTLVLADSNDAFPPIPNGPQVAYLGQGIGVRELQGVRSAQYSLQAVSGTYSATDYEFTTPGTSLYSQAEAVSGAAGVYQHPGGYTAKAQGDSLTKQRIDGLRSQETRLIGESDCRWLVPGHWFTLSGHDDDSLNIDWVLISVAHDASHAHYRNRFEAIPKATAYRPARVTPKPRMHTQTALVVGKAGEEIWTDQYGRIKIQFPWDRDGKNDETSSCWVRVVLPWSGKGFGMQFVPRIGQEVIVTFIDGDPDRPLVTGCVYNGDNALPYALPDNQTQSGIKTNSSKGGGGFNELRFEDKKDAEEVFLQAQKDLNVNVLNDSTASIGHDETLTVQNARTRTVKEGDETVTLEKGKRTVTIQTGSDSLDVKDTRTVTVGADQTHSTGGNYSHKVSGNFELTVDGNLTIKVSGTLALQSGGSLTLKSDADLAAQAGTSLTSKAGTSLTNQAGTSLTNKAGTSLTNDAGVSLTNKAGAEQTVDGGGMLTLKGGLVKVN

SEQ ID NO: 25331 - protein, 437 aa, Pseudomonas aeruginosa
GEAHGGIRQARPGSRRQPSRRQPARRQPGRSVAHRRARQAAGQPRLPTGPVARRQHPAPSQRQGLRATRLRRRQAARAGQFPCRGRLVAAQGALPQRTAPRRSAQLFRQRPGGRARALPRRRARRGLPALPWQWPTGLRRTLPERPATGRRPAVRRRRPAAGQRGQAHGALALVVDQAGGALGAHRPGGAQGISICTCPGTLILITPPQVQISVPLASSAGIPPSSRVGGPPGIHGLAVAGMHGIGVSTPRAAAVAAATTGLAGLWQRPKVGMFSSGMWSMMFAAGIPLVRVRFCGNTLSTVGAAPKLHCRVAPAQTCGQPMPSSRARWRCSRIDQPIALAVGLACCFSDECPTCVSPAALEFRCDAGRSSATGIDEKGFSADRTVPAAPSPAGPRPVDAGVAVPWPPPWTGRQCLAQEASPHGSSSPMTIPCSAMA

SEQ ID NO: 25332 - protein, 437 aa, Pseudomonas aeruginosa
NLIHRLRSRELTQTTTRTKDLGLPPPLQLIADRQLADALAGGGEDRVAQRRRYRRHAGLADPAQRQVAIRLEQMHRHRLGRQRHARQLVLVEVVLLDLAILEADLAQRRQAQAHHAGAFELRADALGVDLRTAVGGDGGLVHQQRAVVLHLHLDHHRHVGDEAVVRGDSPRPAPGQLAAPAGLARRLLDHPAQAANIERVALRRLAVVPAVAEFGGVDSPRRAEQLEQVVLRVLAGLRRQFADEALDGEGEGEEGDRAEPADPGVRRGLGVLQAHVGDGERQVGQAHAQVEGALELAVRAEQCGDARRHRAMQPSLPEPRRAPTTAWQALHRILCGKLGEMQMVPPGSTGTRKWRPGNALARIAASSTKSGLDLRPKPPPSRVTLTVTLSNGSFRRSAMRSRVTCGAWVGAQTSQAPSLYQAVETGGSIGAWARCGR

SEQ ID NO: 25333 - protein, 305 aa, Pseudomonas aeruginosa
RSCSPLLRGWLDGRARRTAAGGIIVGIGGRKFRRFSRPPPEGIPCPGPPPRGRSPPARRRNAGWPARPGGCAGGNGGWAPNAAGTAPPAAPRQARRAPARVARGPRPGRWRRLPGSCPNRAGAARRRAPASPARPRGTTAARAPAASAATAGQRAWLASRAAAGRAAAPARPSVARAPPAAARRPPRHGCRRAPRHRPAAGPGRPKDSTGESPARFPDRPRRRTPGAESGSAGRRSAACAGSAAAGAGPGDDAAEPPRAGRGSARSVRGTRGRGRSAPASGRRAATGSPRASPRDRKPACWRRCR

SEQ ID NO: 25334 - protein, 488 aa, Pseudomonas aeruginosa
RLDAPTQIGDVAGLVDRVPLLQYPGVLQVGVTQRIGLAAVPVQLAGPDHQRAVDRLVDLVLDARQLAVGAAYLDRDGLLLQRQRTTVDQVAPRVLRVQRQAIQGEVAGGIHRVGPGQVAAEADVDHRQAGQRGPHHVEPAGNGQVHLVETHRAVPGEVRVGQEHALAVRRTFAANGNGVAAALQAEALAPLLGDLERLLAAQGDLLRAGRRGGHQRVGELADPAFDQQAPGQAQQVIGRDGPQPGLAKATGGLAVCLAEEAVETGGVAFEQLAYRGRLRLPEGLQRLGLVEPGVEDVGRQVVQLGRRLALAAEIARPLAARGDDLLGQQAGVVARVGVADAIAQAALILGPDVRHAIGGPADVRGQPGRPRHIGLDRHHRTQQHAGQAGQYGTHPHRCRFSAKWWPERPGHATKTPCVPGIPWRGNGQHRAWRRGADQLARACSCRARAAVPGFRCWYREPEISSARTGSTDSRVSLRPWLAWLKPCA

SEQ ID NO: 25335 - protein, 335 aa, Pseudomonas aeruginosa
LEPSMKTPSPADSDTLVQDAAHWCMRLHAEDLSEEERGEFQRWLAADPRHAAEYAEMEEIWALSELLPRTPAPELRNHAATRPLGRRRRGWKSQARAAALALLMLPTAGYLGWLQGWIPSNYQRYEAEGNVRHAVLPDGSEVELDLNTQLSFANFKDIRRVSLDRGEAYFHVTHDSAHPFVVKAGNGSITVTGTRFNVWKYQDNVVVTVTEGSVKVRSEGSGNDSSLTPGMQASYYPGLLQPLVEAVDTRQTLAWREGRLVLDDLPLSKALPLINRYLDAPLVLGDRSAAKLRIGGIYSTRDIRSLVDALPKVLPVDLEHREDGSIRISSRYAQL

SEQ ID NO: 25336 - protein, 1049 aa, Pseudomonas aeruginosa
YSSRTARRSLPQPPDRPGRLAGLSVPQQQLRYRERQPRQHREQRLGARHPATAALRRRRRPGLRADPQVARRGRGRCDGRPVAGRDRPLHPAGQGRCRPLFDRDAQGPAGRATCPIHPRPPAVPAPAAAGRRRRDAYRGRAERPGADARHPGTDRDVPGADPPGPGLVAQRRSRARLYPHLRADVRHGGGGRCARRPDPQCPAADPVDPADRQIVADDRLGPGFGSRHRPGQARHAGLLHDPQRRRPALDRQGPADPPGAAQAAGPEQPGRRQPHQRQRRAERQRPGGAVYRAGRRGQRRPPTDGGNDRPGVLRRRHRGKHPHRAGRRHSRRRQGRPGRLGGRQQWQAAEPPDQDRHQRPPAGTGACRPGGRRPPVDGRSRRQRQLMENATQPVPLIELRDIRKRYGGNGTPEVEVLKGVSLSIHAGEFVAIVGASGSGKSTLMNILGCLDRPSSGSYHFAGHDVAELDSDEQAWLRREAFGFVFQGYHLIPSASAQENVEMPAIYAGIPASERHTRARALLERLGLAERTANRPHQLSGGQQQRVSIARALMNGGHIILADEPTGALDSHSGAEVMALLDELASQGHVVILITHDRDVAARAKRIIEVRDGEIVSDSANDERPAQPSAGVERHLQADDLSQRLAEGSSEPSGAWRAELLEAVRAAWRVMWINRFRTALTLLGIIIGVASVVVMLAVGEGSKRQVMAQMGAFGSNIIYLSGYSPNPRAPMGIVSSDDVAAIATLPQVKKVMPVNGGELVVRYGNIDYHAYVGGNNTDFPEILNWPVAEGSYFTERDEDAATTVAVIGYKVRKKLFGSANPIGRYILIENVPFQVIGVLAEKGSSSGDKDADNRIAIPYSAASIRLFGTRNPEYVIIAAADAQRVHQAERAIDQLMLRLHRGQRDYELTNNAAMIQAEAKTQNTLSLMLGSIAAISLLVGGIGVMNIMLMTVRERTREIGIRMATGARQGDILRQFLTEAAMLSVVGGLAGIALALCIGGVLLLGQVAVAFSLSAIVGAFSCALVTGLVFGFMPARKAAQLDPVAALASQ

SEQ ID NO: 25337 - protein, 140 aa, Pseudomonas aeruginosa
TTVVPFSSRPAFSPPACRCFPLPSRSAPKAYRATPAINGKRCASNSISTRSICTSPTSSSPPTLGRCGRPSSACGSASTATRAKRWTGIARKSGNTRTRLAPGQVATSPCNLARWRSPAAPPTAWRRSTAACWCSRARRS

SEQ ID NO: 25338 - protein, 312 aa, Pseudomonas aeruginosa
TTRRRSTGCWKSSPRNSPDPFRHSTRTAMHALSPLALAALIVATAPAFADEAKKPGTVFKDCKDCPEMVVLPAGSFTMGTPDDEVGRQPDEGPLHDVTFAKPFAISRYQVTAGELDAYLKATGVKLADGDTRPGRECIAGKPRYQQGPRQPAVCVDYNDVKNYAAWLSKKTGKHYRMLSEAEREYGARAGSAGPFPFPFDEGKEYSIAKHANTYGASDGYNFTSPVGSFPPNAFGVYDMHGNVYEWVADCWHDHYNGAPSDGSAWMEDKCELVQIRGNDWGEPPIFSRSGNRNNAAPSDRGDWIGFRVAREL

SEQ ID NO: 25339 - protein, 69 aa, Pseudomonas aeruginosa
GVFDAPCLPTQDSSPLARHGPEPAAGGICPGAGSRVRHPSPGAGQRTPGVRPPGGYPGAVSPGRGPEQA

SEQ ID NO: 25340 - protein, 182 aa, Pseudomonas aeruginosa
SIAFRRSSRICFNSQDTSSSLLCAISLRSVANSAPISASAQSLILVQRCSSSVVAEQIDDQARSICSARSGNMTPSSSTRISPTDRFGTASGVGPISFQNASTLTGAGASIQPTKATCRPRCSSRAATSIARLPPSDHPARLKTPSGCSCSNCSAYSATISSHSGTSRPAPSRARQTTPLTG

SEQ ID NO: 25341 - protein, 269 aa, Pseudomonas aeruginosa
  UNSURE (268): Identity of amino acid at the above locations are unknown.
PGWPATSGRQARRSCRRARPVAIAGPPPRSPRPVAPDRFAAPRRPAATGSHPAAAGPCGPACRSASAASAPGTTGAMAPCIPAGARAAPSSTAPGTPPALPANPRPPAPAPPRSPPTAGPPHPAGPPPPPRAPPDARAGAPRSLPVRCGSLGSSPGGPPVRGSPPPHPHAHGSGRRCGTAGCPARQRGPARNARRSAPDAPGSRAPPLPRPGTVRPPRLPAAGSTARRGCSRYGCPAAYRSACMPRRRHRPPVLSTAAASPPSRSGRXR

SEQ ID NO: 25342 - protein, 103 aa, Pseudomonas aeruginosa
GGLRPPPARCGSRGSSPDGRHAPCTRSRRHRVGAPGRRSGRALSPVRRRGRARSARRSSRADRGRHGPARHGWQYKARLPPLRAVGRDVHPAPATYGRVAPGR

SEQ ID NO: 25343 - protein, 142 aa, Pseudomonas aeruginosa
ARRSSTPAPPAPVLAPADADGPAPGSATGPGAATHPRRRSLPRPATGNRAPRPATAATRRPAGPVRPRCRAGDSASAEPGARRSRPRTDPWHSRTMPRYRPRPRARPASGRRPRSCSATPSAPATGLAVARPGWPNESRPGD

SEQ ID NO: 25344 - protein, 118 aa, Pseudomonas aeruginosa
TWSHPCAEPAVSRQGPGVAPAPGPIALHDSCAAAAAGDRGATRSPAARRPAGRSSTPTGAPFPPPPSSCAATGRSPRTGSAGPATPRRALGYRRHRAGPVPRPSIASTNRRRRYGAGP

SEQ ID NO: 25345 - protein, 316 aa, Pseudomonas aeruginosa
IHEGHRNRCHCWKSAPRQARHRLAATRSGTTPPAAAPRRPRSASGQSPGSPATSGRQARRSCRRARPVAIAGPPPRSPRPVAPDRFAAPRRPAATGSHPAAAGPCGPACRSASAASAPGTTGAMAPCIPAGARAAPSSTAPGTPPALPANPRPPAPAPPRSPPTAGPPRPAGPPPPPRAPPDARAGAPRSLPVRCGSLGSSPGDPPVRGNPPPHPHAHGSGRRCGTAGCPAHQRDPARNARRSAPDAPGSHAPPLPRPGTVRPPRLPAAGSTARRGCSRYGCPAAYRSACSPRRRHRPPVLSTAAASPPSRSGRSR

SEQ ID NO: 25346 - protein, 252 aa, Pseudomonas aeruginosa
TGCPPHGIDSPPGSKRWNRHPGQRSCRWRPPPPASARPPRRPRYVAPFHSAAQHASAPQQLAVAATPCDPACRSDSAASAPAPATAPAPCIPAGSPPGARSGLRASRRSRSPAPRSRPTACRPPPAPPPRAPTDAPAGAPRSRPARCAGRAASPGGRSARRTRSPRRRGSAPGRRCGTSAPQPRTGWRRNARQSAPDAGGSHGPGPDRPGTARRARPPVPAPGCHRGCSRPGWRSAGRSAPRPCPPPCRSSG

SEQ ID NO: 25347 - protein, 198 aa, Pseudomonas aeruginosa
GSPSGPRPSRWNVPWPRPPGGPHRPRARSGHAPGGWPGGSARRSPGAPRRRPAPAPSVCARPAPRTTGARRVAAGTRPQWRSSLPATDSAPRHRASAASRRWPAGFPACRAAGSANAAPCARRSAPRTGRSRRSARRTGDRPSRRYPGSGRTGWYGSSSRAGRSSGRPRCPAPRCRPPAAGGCTSPGTAGCGSGCARP

SEQ ID NO: 25348 - protein, 76 aa, Pseudomonas aeruginosa
TRNGCHGSWEPPDAGGRSATPGPDAARRACRASTPAGAPAHRPPASCAATGRNRRTGSARPAGRAPRQSHRHCRND

SEQ ID NO: 25349 - protein, 184 aa, Pseudomonas aeruginosa
ILRSARSSTSRRTRCDAGSTAAHAAPRPGGSGGPAATAPRTGRTAATTRAAPPRAGGLPARPQAGRCNPRRQPPAGVAGAPAPGCRRRRAGTPYAGFHDAAPGWRRRAPAPGDPAVRSGAPRWAGCRRHSVAPGARGTTCAAGRRTGGRARPKTRRPETGTARNRFPPLAGFRGRPDASQRVVR

SEQ ID NO: 25350 - protein, 587 aa, Pseudomonas aeruginosa
PTVSLMSKKSRSRLWFLVHSWLALPIWFFVLIVCVTGTLAVVSQEIVWLANPDVRASKPYEDAEPLSFSQVLKAINEAQPDLLVESIQRPDEEHFALTAEVSYPGGSEATLYINPYTGAIQGESPSFDFRQFTRALHGWWLVPFNNGYSWGWYMVSLLGLPMLASLITGLVVYKRFWKGFLKPRLRINQGARIFWGDFHRLSGIWSIWFIALISITGTWFLIQAILADNHVTLTNDGIPPVIARADVPRAAPGQKVPYIELDEAVRLVTGRIPSLEASAVFLPGNAYSPMFVAGRGWYPLMFQSAALNLYTGQDRNHPPAQRPYPPAVRHRIHAPPAHRRFRRYLGQADLVRLRPAAEHDGAQRPADLEQAHRTGHRRAGQARQAPGAPAETGQAGAGNGQPDRGGTAMSKAAVAQPVSPLRQFWLRWRFHLNVLLILIPLGFMPRYFADMALFSGSSGLGEREIGEVQVGPWSLKLAEWRIEPPHDEGPAGFMKDFNAALCQACIPQVKATYLRIGKPRSLRAAGVIFFGSPYRMGTSVPIPPRTRPDAELWITMEGWDGSMHQASIPLAEASPATVAWLNKRGKQ

SEQ ID NO: 25351 - protein, 474 aa, Pseudomonas aeruginosa
SASPGRPPGGRPARPECRRTGHLRRPAGRRRRHPGAPGRRRSRALRRRTGRRGLPALRRRHRREQSRRAPLEPRRNRRASELPGRQRQTRGGRLVPPAARPRRSLAEARRGRCRRRTGRRPSPGRRRLAPGGQPLRRRRDPSAPPLIAHRLHRRRFSMLFSRRSSRPRGLAALLPGRALLAALLLALLAPLTQAEDGKRLRIGITLHPYYSYVSNIVGDKAEVVPLIPAGFNPHAYEPRAEDIKRIGTLDVVVLNGVGHDDFAERMIASSEKPGIPVIEANAKVPLLAATGMAARGAGKVVNPHTFLSISASITQVNTIARELGKLDPANAKAYTRNARAYAKRLRALRADALARLNKAPAADFRVATIHGAYDYLLREFGLEVTAVVEPAHGIEPSPSQLKKTIDQLKALDVKVIFSEIDFPSTYVETIQRESGVKLYSLSHISYGDYSAGKYEEEMARNLDTVVRAIQESGA

SEQ ID NO: 25352 - protein, 206 aa, Pseudomonas aeruginosa
ASAAAASSMACACASRPVACTRWSDRTAAARVRWSRPCSGRCRIAASCAWSGPARPAASATCRRRWSSTAACRSPSTISWPPCASAVRLSSACRAAGARRSTRPWNGSACWPSAVGAWAPSPAASASACCWPRAWYRRRNCWCWTNRCRPSTRAASRSSSGCCWTGARPASPCSGSSTTWRPSAASPTGSAVSTATCCSTVRRPAA

SEQ ID NO: 25353 - protein, 175 aa, Pseudomonas aeruginosa
PRNACSRCSPPSPGRTRRPADERRLRTTAPGRPGLGRRRLPSGDPGLRLRRQRAPRRPADRPGARRPRHPGGGQALRLLLRGGRPRRAHRRGHRHPPRRALHRALRQPVRLLPAVRRPAQLPAQPHRPGPGHPDRGVPLGVPGARRQPVAGAGGQDQRAYPRERAVRLGADRERP

SEQ ID NO: 25354 - protein, 450 aa, Pseudomonas aeruginosa
PRGAGGGRRAGAVPGPAAVQPHHAGQLQPATGGGARGRGEEPGLPVRGPGDPGHRRRGESDRRDPGRSPAGDPGGGGAPGQPVAERVLLAGGADRHRQHAGRYPVADHVRPADSLRRRDHPGRRPGLRSRRHRSRLPAAPERNPRMNLKPHCLALALACAGLAGPLPALAATPAAAQSAPVTVLASLPVTHALAERLLRDTEVKLQRVAPANLPASRQASFFAGRGAGGLAKAAGQADAVIDLRSIWSDDPLYPLARRSNIRIVEIDAARPVDGALPGIALRPGSDLHAYPWLNPTNLGRMADVLASDLERLAPGAAATIQANLATLKKQLLEATASNETRLAKADNLSVISLSERLGYLLAGLNLDPLDVEIQADDGWTETNIQAFAEELKSEDIALVLHHRQPPKPLADAIAASGARLVVVDTEAADPVAGLESDMKAIVEGLLAGKG

SEQ ID NO: 25355 - protein, 95 aa, Pseudomonas aeruginosa
TTTASGRLPPMALDSTTTSGTMPACSKANILPVRAKPLWISSTISATPACSVIRRKPRSQSRSAGTTPPSPWTTSTITAAGNCTPPSGSFSRFSR

SEQ ID NO: 25356 - protein, 564 aa, Pseudomonas aeruginosa
SVSPSAGVARSGWSSMTLVATCMSSTLKAWWCSTGNRRSGRQGRHSRIGCTGDAGGTHGFTAPDRSTEPGPPASARTPSSRPLVGARGAHPPDRVADVVGDQQRPVGRLRQPHRRAEQLLLVRGDEPGHHRLRRTGGLAVGERHMDHLEAADRRAVPTAVLADEGAVAIALGQLVAGVEEQAQRGHVGTQRVVGDDGLRHQVGTLRLHPRIQVLAEVAVGPAVEAALPYRGQVVRDQVVADLVALVDDGPQLAGDRFPLQAGRVAQAGGVDAAAAAGDVHLENRRTTVFDRRAVLGDVAVRTDAHVELAPVGTGEQRLGPVVVDGVRQVGELHPRVGDPGFTRHVAVAHDVPGIGDIQVIPHPLHAERRVQPFQEHVLLPLASGAGSAQQGDAVAALAGLAGLPLDHPRDELLRRGHRRGAGRVGLHHQHIAVGQDQQLARVLQAIGDLLDLQALGHRRLGLSRPAHAFRYLHRRQKEVLRFRKRRIGAGLLLRIVLRPLVAAGQDQAEGKRDGAQRVEASHAPPPPRIPPGAPLPAPAAAPSRSTAIARPASPHRRRGCARRH

SEQ ID NO: 25357 - protein, 166 aa, Pseudomonas aeruginosa
RPSRPSRRVAAPPQAHPAGDRSAPGVCRRGDSRCLIEPLYPAPCSRPGSCSCWRPAARARRLPRPRPGVGRTPAANARSPPTKPIPSCSRRCRKAGCSATRSTSSMRSRCASLHGSAPTTCARGSGPASTCAPSSAATSRSPAASRPPRRKRVPISPATSATCGRR

SEQ ID NO: 25358 - protein, 60 aa, Pseudomonas aeruginosa
PATTSRCRPTAACCRCRNPTWSPADASARCTTGTPTSPCSALRRAGSTNGCATCSTTSPT

SEQ ID NO: 25359 - protein, 165 aa, Pseudomonas aeruginosa
RPASKATEPARRSDDRPSKATSGTRRATTPTTTGNAGGPSSGSTPPASSRYSPGWPPPNAPVVPPTASPPNCCARADWPPPPVPAASNGTSRTAGHPCSGSPYRACAPTAGTPWRKTSAGDSSPRCSRSTTAKENWWRNTTSAATRAAAAVASTRCRTASAGPTA

SEQ ID NO: 25360 - protein, 298 aa, Pseudomonas aeruginosa
RIAPSTQSRSTDVKKVLGIYGNANRHWVGDGFPVRSLFSYNTLGQHISPFLLLDYAGPADFPPAQQRRGVGQHPHRGFETVTIVYQGEVEHHDSTGAGGRIGPGDVQWMTAASGILHEEYHSERFRSTGGTLEMVQLWVNLPSSDKMNPPRYQTLLDADIPRVGLPDRAGELRVIAGRYGRHQGPALTHSPLAVWDVQLKAGKHLALDLPKGHTCAVVVMRGTLAVGDEIVREAQVAMLDRDDPRLELEANNDVQLLVLSGEPLDEPIIGYGPFVMSSREEIDQAIEDFENGRFIRAH

SEQ ID NO: 25361 - protein, 1037 aa, Pseudomonas aeruginosa
FLHEARGYALPCPCHRSGLAPGRRLPGPSRQHQHRPEPAAESRNEGAAGLRRRLDAERFHPQLLFRPRQPRHPVPPRPARMGPGPDAVVPLRLYRHADRHRPGCARLLRPAPGRRWRQRRCRRAAAGLRRSPRRQLLGGRRGPQAARPGQPAEDRRPVAGEPGDRQRRQSHGAAELPWRDPEELPFPRARTGRRLRRSHPPAQPERPQSSHQRLRQRHQGRYRRRSRKPAHRLAGRQLQRPRRQPGDALQRPPGGYLEPALPRPQPAVAAFQPIDPDALAALLQDPRPGPQPARPDRQRPLQRRADPGRRRPVAEPQPAKGRWRHPVRLHRAERPDLPLRKQRHAVRRLQRPRRALVEDPVPGQPGLPRRPGLAVRRRLRPWPGRPDPGRPGQRGLRLPLQPQWQERPALGTRPVAALRLPRRPGQGPQRDPALGHPPPRRRLHRPRQHPRQLQLRRIPGGGRLPDQVALNPRNQKKEKLPHACSPATHLRRPLRRTLPGGPRRRRRAAAAGARQRQLHGRRQPSRHALRTAPAIRSGKQRQRRRRAFGSRSATGSWHHAVAALRLPQPEHPARRPLRRRSAAAAGTPGPRYRRRPGRPAHPPGRPDRQSADAAMGARYAVRPPLLAAPELRLLPAHRRLRQGRRDQHRQQHLDLQPALRLHLGTGRAPGTQRPPALRLDQPQRRPLAAPGRKRRTAGTGAARELLDLLRAGPALADRPGRLPVETDQRRPHRRPPAGRLARAGLRHRPGGDVQPGQANAVRQPLRRKRRAQPQRRQPTDPALPAGVLNRRITPWKRRHLPSSVGRITARGYPPLIRGIGGYRLWRYSPYAPRKRRTAPQLRRAMKWTPPSYGVKRQTNGAATSPGGGVSMNLSRIGLDLAKQVFQVHGVDRHEHVVCRRQLKRAQVRDFFRQLPPCLVAMEACGSAHYWARELRELGHTVRLIAPQFVKPYVKGDKHDAHDAEAICEAASRPSMRYVPVKSAEQQAVQSVHRVRSRLVRARTALCNEVRGLLGEFGLIATRRGRAATRTLLFTKPT

SEQ ID NO: 25362 - protein, 127 aa, Pseudomonas aeruginosa
TSPCCRSIQGCAPRTCAGCSTAAWKRCCWNAMAAAPAPSDDEELLALLREAHARGVLLAAVSQCAYGQVEFGVYAAGSRLRDAGLLSAGGMTREAALGKLFGLLGAGLGRDEAQRWFALDLCGENAD

SEQ ID NO: 25363 - protein, 697 aa, Pseudomonas aeruginosa
PPCGRPPAAASFSPPRDTRQRRRPARARRPSSSFSEQCFRPSPVYPPAASPQDVAFRCRPRRHPPTRRKHLHVRHRRRHPSRTRIERTVALSPPLPRASPERQRSGRDPPHRTGPVAAHRRLHRSRRAHRIRPAGVSGQVAEPRQGPRQPSGHGRAPVAVVPQPPVPAHPAVLCTGREDHRLLRWPGVRRPGEDRRCAHQRLPGCLAPDDRGDRRHPYRRVQPGGRTRLRGPARQPRAAPPVADRRLRRAAGKHPRDPAGQRRRPAAVPRHHPFPLRGRPDPRLPGLEDCPATRRQGARLRGDPAQLGLGRAAGRPVPPRDPPVHPSAAGGQSEVRHPHDADPRRLADALARRGGEHRGPLRADEAQRGAGTRRRAGADQRPAQSLPPAGQGRPARRRGLSPRSQTMNAYLSDQPVRLSPLRDEQGNQPRFGLLLEPGRPGMHVGELPAQWLKGLARSHHLLLLRGFAAFADAESLTRYCHDFGEVMLWPFGAVLELVEQEGAEDHIFANNYVPLHWDGMYLETVPEFQLFHCVDAPGDSDGGRTTFSSTPAALQLADSSELELWRRASGRYQRSAAHYSSRSAAPIVERHPRREFPILRFCEPPVEGDASFINPSEFHYDGIAPEQRGELLASLRRCLYHPQAHYAHRWRSDDLVIADNLTLLHGREAFVHRAPRHLRRVHIHAEPALRNPHLQRD

SEQ ID NO: 25364 - protein, 517 aa, Pseudomonas aeruginosa
PPRRPCAPRPASRQGTSMSHSVPNALMTGADYLDSLRDGRQVYLNGERVADVTRHRAFRNACRSIAGLYDGLHGEQRDVLTRVDAQGRRSHRFFTPAQNAEDLLGAREAIGCWSRMTYGFMGRTPDYKAAFMSGLEAGAGFYGDYRQNACAWHRAFADRGLFLNHAIINPPLDRSKAIHEMRDVFVHVERETDQGIVVSGAKMLATGSAITNATFVAPVASAQMEAGKAEDFALVFFARMDNPGLRLMCRPSYEERASSPFDYPLSSRFDENDSVLLFDKALIPWEDVLVYRDLRRATGFYAESGFANLYNFQSGIRLGVKLELMIGLLSLGVRANGTQGFRGIQAALGELIALQHLLQALTTAMARDPERNAAGSAVPRLEYANALRIQVPQIWKRVRELLEGALGGAPLVTVSGAADLRDGEARRLVDSYYRGAELEPEQRLKLFKLIWDATGSEFGARHAVYESHYSGNAEQIRLDSLAWASRRGHLAYCEAMVQRCMADYDIHGWLRGPWQHD

SEQ ID NO: 25365 - protein, 191 aa, Pseudomonas aeruginosa
TPSATIPANCAPCTANCRWCWWTASWPSWIPTWSAWTTPTPSNRPSTTCSTAASATSCWSPNRSTAPARGSSGSRPSMPPSAGDRRSRARSCKPTTSSATACAPSFRPAAPGRRRCSPATASPPSAPPANCATSAAGCSMRSACWPWTNSTGTHWWAAASPPSPNPPTKSAAPPSSAFWRDSKATASRRAG

SEQ ID NO: 25366 - protein, 582 aa, Pseudomonas aeruginosa
NRFQRIANVPSPRLHQSFQLWRGPRSQSRPGQLPALAGDGRRAARGTARGTLRRPAGYRGADRRHPVAGAGVRVLLTPRAVARRRPVEPRAGADPAPRRSLRSRMAQGLARPSAGTARSRRPRPAPGAPRLATAGGERPDAPGRPDRGAGTLLPPRRTPAAGPGDDLRHRQLALAGAGGRRSRPAPWPLCRLRALQGGDPQPRRQAGRGAAVGRRPAVLAAPAAAFPGRRGAGHRIPAAGRRPAQSQPPAHRRPRPPSASPRRNASMADFEILCFGETMAMFVAEQPGELDRVEQFGKRIAGADSNVAIGLARLGFTVAWLSRVGDDSLGRFVLDSLTREGLDCRFVEVDAQAPTGFQMKSREVDGADPRVEYFRRGSAASRLGLAHIREEMLGARHLHATGIPPALSASACELSHELMRRMRGKGASLSFDPNLRPSLWPSERRMIAEINALAAHAHWVLPGLEEGRLLSGWQEPADIAAFYLDMGVDAVAIKLGPSGAYYRDAHGEGLVPGVPVATVVDTVGAGDGFAVGVVSALLEGLPLPDAVARGNWIGSRAVQVRGDMEGLPKRSQLLDRERRKSA

SEQ ID NO: 25367 - protein, 133 aa, Pseudomonas aeruginosa
SSVPSSSTTCACCCSPASASPTTRAPARAWWGRTSPTRTWPPSRRFSTRTCIPTPLSAPAAAAWRWTTSTPTTSTTDRWASSAARRCGSTRPAPSRSAASPCRPARRAGAAAGNRRSRTPTRTPCRWTPTAAT

SEQ ID NO: 25368 - protein, 587 aa, Pseudomonas aeruginosa
IPGPRRRLRGLPHRQGRQAVRRGPADGNADRRGVLDQHHPGPQDRHRRLQLRGLRPCRAPRRGQVRRHALPGDALPVLRASQRSGHARPLRLLHAWRGAGGAAQQGQRHPLAAVDALAAGILALDLRSRGEGLPGRRRAGPGAGARRLPGRRPWPLWRLPYPAWAGHAGEGPGGERWRGLPVRQRAAGELDRQQPARRPPDRTGQLERSRPGQLPAYRPQRAQRGVRRHVRRGGAQHAVHDRRRPHRHRPLPQVAAAGGPRRPAARLRRERSPGTVPRRRQQDRRGALRRQLRGLPPHRRQGLCAGLPGPGRQPGSDRQRPDLPGAHRAQGRHPAGHPPGTVELHHAAVRLADERPGDRRRGQLHPHQLGQPGAKRQRRRGQAPAQGHRRGGGGRHSAAGTGRGGSRLSARPAIPAPLPLAGEGCHTRHGHPFTHLPIAHAAPARRTMRPPSATPGSPDGSAATGRWRSPRGRRPVPAGRRRRVAGRQGSPPGRGRRGPSRRPPARRCSGRPAAPQDSVDDARPRSGGREENRPGRSSAAWRAPSRRGPPGSVRWRRARSAPRRGCARPSVPAACGSCAGRCRRRAG

SEQ ID NO: 25369 - protein, 373 aa, Pseudomonas aeruginosa
SERQGPPTGVAKLERKRMSTPPAAPLRIALVGDHDPHITAHRAIPLALRLAGEALGLEIAFDWLASDRLPAEPALERYDGFWCVPGSPYRDADAVLRLIAHARGRRRPFLGTCAGFQHTILEFARNALGWQAATHGEEHPHSDQAVIAALPCALLEAREDVRLLRGSRLALAYAADWIEADYHCRYAIAPRFAAELTGGALRASAWSADGAIRAVELEQHPFFVATLFQPERAAVAGVLPPLPKAFVEACRTQRRDHPRRGPTPYYAVIFSSHRSAVDDGYAEAAERMLELASRQPGYLGVESVRGADGFGITVSYWDNEAAIRAWSRHAEHRDAQARGRRDWYAGFSARIARVEREYAFPAQPDTAQSPASS

SEQ ID NO: 25370 - protein, 301 aa, Pseudomonas aeruginosa
GLLMESLGWPAPAEPATTGEDEIHIRCVCQKSWRHTQRMSIILKPLRHPETSHGPQASRRDDRGNPRQADRRRAPSVRRQRLRRRLDGRTDRQRRPHPRRAVSPLRRQERPAGRGGAADRRRDESSPRRHPGCRRGPLERLPCLQPGLPGNGPGSGNPAHRPARCPGHPRQPQQRGQPTALPKLDDRATARTDGQRARPPHRRRGPGLAAQRRAGGRRPAYRQRRTPAGEPGQGLPGPGRAARRPAHGVKSQWTTASEPAATRTPRCSRPSSAQPGKASACCPSWPGSPTPGSPGWTSIAA

SEQ ID NO: 25371 - protein, 372 aa, Pseudomonas aeruginosa
PRICRVIGVSSAQDGGPRRLAGGGPFGGQLFAGWAPPQNVHSCRSLAHSCRCCVPPLPRRARGCYVCLPSWRNSQGMSTTSTDMASLIATLQDEPGFDATRIPGVRLMRAEQAYPRSPVFYEPRICILAQGQKIGFLGGETYRYDAERYLVMSVPLPFECETHASAAEPLLGVSVDVDIGTLKELLLQMEEAPGSDDDNELAPSAPMASVPLDAGMADAVMRLLGCLQSPLDSHILGPQLVREIIFRALRSEQGNALRAVAGRHSGYGRMARALRRIHTDYASALDIDTLAREANMSVSTFHHNFKAMTFTSPLQYLKSVRLYKAWSLMVQDGLNASTAANQVGYESPSQFSREFKRYFGRTPSEEIQAARR

SEQ ID NO: 25372 - protein, 142 aa, Pseudomonas aeruginosa
PAGAGALAIHTDIRIFSFPYIQEGPAMPSPAEVFKCLADETRVRATLLIVDQGELCVCELMCALADSQPKISRHLAQLRSAGLLLDRRQGQWVYYRLNPTLPAWIHEVLQVTLRANGDWLQADAARLRDMDGRPQRASACCQ

SEQ ID NO: 25373 - protein, 538 aa, Pseudomonas aeruginosa
REPPHADRLRHLPVHPGPGHLAAQGPRHRLERQHRCPARPGAGQRRAGRHPDRLEHRLECHRHLHRGDRHQPAAGRGRLLRMGRAARRALGWRRRPAPVRLLRAARRGGLGAVRQRRRGADPHAHRDVDAAGPALQPGGDPGLRHGGGLHRRQRQPAAGGLEPGEHRLGRLLRARLRRVRRGHAAGKPGERRDLPAGAVPLFPPRPAAGLCAGAIEAAAGGDPRPRDLHRRRLDAAGPARRAVRPGAAGRPRQRGGRDLCGAAAGGGRARAGDLDPAGAARSALADRGLLAGHVPGGLRPEERRSHRPPGAAPEPPGRARRMGGRAGYRTAFRRPLVGNEQHAQRAARRPVDPGQRHRRRGARSDDLRQRHRLRPGSEDHPYRQPGDAALAARAGAQRHAHHLGLLLQGRRPADPAGPAGDPFGPGPAPGHLTAAGDGGRSIPCESCSCARPTVAAAFFPKPCSTTWPRRVSRHAAPAASPAGGCIRAAWRPSNRPASPPTACTARAAKPSKAHRRTSSSPFATPPRGKPARCISAQR

SEQ ID NO: 25374 - protein, 155 aa, Pseudomonas aeruginosa
MRPFYIALPKGARMIAKWTAALLMGALAWGSCTAQAEEARPPVADKVVAYQGQQGLKVWTLRIGEAAAGEALLQVEGLDHDWDRLIHKVKVEKSARDSRYSTELNGSKYVILIVRDGWGELYLPGEQQTRQVAYSESLSSAGEPQAFLTDYLEQK

SEQ ID NO: 25375 - protein, 710 aa, Pseudomonas aeruginosa
TRMSHDTLRVRLLAFLFLIPLALYAWSAVQAFRVDSTLRDEQFMRDWSASVRNDPDAAGAIPRHLFRPAYGVEGHLHQFAEDAEAIRRDHPWLALRGWLAAIGKLCALASALVAAALLARLEYDGRRSMRSQAYLLGHLAPAWRRLGRLVPLHAGLLVAALASQLLYEALWSYSHWHSHGFVALALLAAAVAAVPRRPAHAAAPARRTAAAGGTGAPPARPRTRPGRRARPLAMAGTDRRPRRSAATGPCRHRHRALLLRHPGQGPAGAPRHSAGGAYPVHPADLCLGHERGRKRRDHRPRTGPLRRRRHRPRCLPVAPAAAGAPAHRTHRRTRGWACRPARQAGPVGRAVLPRSLRARLPALESPPGTGRRQGRGAGSRRAGLRHRAATHLRPCRTDRTPAGQPADAQPGACADRPSARELPGTGRTRQRSPPGTPLRQSPADLPADRGPFPGARRRSAATGKAHRQRRRHAVAQPPARCRPRGKPVIPPGAQTPCPAGTRGDEATQLRRFVASVPNRISIGAARGAAPLSALLGLLLLGGAWTLRDHPGPGHEAAALCLLAAAALLMCLACLQRNARSAPFLVLGQGRLRARSLSAPLDLLEVADLRLEDGVWFSAIVLELHGKALPAPSTRPLDPFAARAVSECRDGPRVRLLSPGWRLNGRNLSLLEAAEVIDLYLDIARAQARFRQLGEIPPSASSSLPTPRIFP

SEQ ID NO: 25376 - protein, 111 aa, Pseudomonas aeruginosa
  UNSURE (28): Identity of amino acid at the above locations are unknown.
PVPSSGPTACRLRSSWPTSSISASRPTXCKPPRPSTCGPKRRCRPIAPYARCSPPRPWPSKARTRASPSCRPACRAMARSWTATTWRRSSTPTSRPPTPSATCNNCAARAE

SEQ ID NO: 25377 - protein, 227 aa, Pseudomonas aeruginosa
AERSAPTCSARPVRIPMQETDETLDELPPLKARCEIREVSRGTACVALLAGLVAGATGLWLASLPNAWRLASGQWLFWLPAALLLGGGLYACLAGVFLYRRHGQVALTLTPESIAFANAPQVPMYTFQSLEIERGRWLELTFATTFDCTAPSFDNHARFDPRAFARPEARAVAGGKRVKLALCGAALNGQKMELEPLARLIYRYILAGHRQRALQHHRAPGSDGSGA

SEQ ID NO: 25378 - protein, 440 aa, Pseudomonas aeruginosa
PGIGQVGVPVLAQFALQAQFEAATQGLAGVLVAGATAEGAGDDDLVLGADLEDRRVDPRIAPQARLQPGFVLAAGGWLEAEVEDVRRVRRHRRIGHLRLGRSLEALAGAEVAVQVGGEGVHHRERRGVLPVAPRAAGIAVAQVAVVDLHLHGAVAHPGLQGPGVDGPARLQVGIEAGGGVHLVAAQLALHAELVAVEVLVAATVVAALVVVEADGQVQLARRLAYRLQPAHGATVEVAVEVDHRAVSLATRITLASYLLGYRLILHDTALAHVGVDLQGRLAEVALVVHPGLLVVDALARVVQLGVGGDGARVVLVGVPGLPQRIFSVVLFQAAVDQRQAAVGVGPEVQLGEGLVAARGAVVAVAVGVHPRGIHQETDPVALAFRVQVVAAQAIAADGGFRADPRGALAVAGEHLDHPAGVAAVDRRGRPAQYLDALGDV

SEQ ID NO: 25379 - protein, 367 aa, Pseudomonas aeruginosa
CRAGRRRSADARCYPPTTAGRRCRWGCICRSPPWVRGCVAPRPGRRRRWPGRRSPGSRATGGRRSWVGVGTACRVPRVARYRRGFAKGGNSPPLGKAPSGPRPGRPGAGCGLPVGGSLPGQGVGDDVVAHAGTEGAVSASDDQHVLATVLAGVAHRRGLAAGRQARLPELLAVLHVVGAQVLVERAAEEGHAAGGGDRAAHARYADGEADRHRGVVAAGAVLVLPDDLGGGQVDTRHVTPGRRLARQADGRHERMHDHRVGRAGVRLHAAGLALALASAGHLVARHHLRDEGHVVGAGEEDLAHRVDRHPAPVEHSDVARIDQAALAPTAGCTGPRSAASGTGCGRASGRTGCCPTCRARSAAGAAG

SEQ ID NO: 25380 - protein, 109 aa, Pseudomonas aeruginosa
TGCPPRRCRPGPPPRPAPRCPAAPDRRPAAGGGTRVARAAGRRRTTEPGAAPVATSPGRLPTAPRRCWRTAPERTGLAPHACPAAATVRSGPGRCRPAGSTASRPGSPA

SEQ ID NO: 25381 - protein, 217 aa, Pseudomonas aeruginosa
ASASAAQSAGSTVASRLRPRAPVAARRTSGSTSALASLASSARAGWWRSQPSTATASRRTAACGSPRAARAGAALSSRRSSRNARNTLARTKASACPSHGSRRRPAAGSLSSPRLCAAASATAGTGSARAAQSASTTASSSQASSRRAASPRTPGSGSPRRAAISNGSASGSSRSASSISARRRTPGSASSRRGDSSRISGRVAFLQVIWRSAVGPG

SEQ ID NO: 25382 - protein, 947 aa, Pseudomonas aeruginosa
PAPGRSPRAAAYPRTVGRASARRSPPAPPVRASPWRAGCARRGPGPASSGRRRRCRGPAARGTGCAAGIPCHAAAKVLPRSGRRPSRCRRLAAGGRPGRRAGSTCRIPKARAGRRTRPAAPPGSDRGPPRRLRSPAPGGCSGRGSGCAPGCCRPSSSDLASRRVPGRQRRADALHQPTAAHAEEADEQHADHHLVVVLDVVGSPGVVTQSPLPGDHLGGHQAEPGGAHADRQAGEDARSGAGQQHLAQQCPAPRPQAARRSQQARIERLHAMHGIEQDREQRAGEGNEDHRGLRRREHQDRQGNPGHRRDRPQHFQRRQQQGLGPGRAADRQAEGDAQRGGQQIAGEDPRQTGAKVRQEHAGLGQVAGRQQHRTGRRHVGEGHQAQIQLQTGGELPERQAGRQRSGAGGPAPGSGDRKRTHGRTPKTPASAERQRLLAGGGKVAYLAAMAAGIVLGLLAEQEGVEATLAVADEPRLVGQQLDPAVTILGVDRTNRLALRLQLGKIGQGRLRRSVMAHPGLALHPDLRYPFELLDRPAAARVAGAQRRRCVVCQRRLVVQPGLTVGLADVAVVDETLDVQPTVGLLQQLQGVDGGRQRLAVFGFPGLVAGLQAERTVEQVIDLGLDAGDLLDQLAVFLRFGGQQSIGFDARPQVGHHHLRIALGVGGVHQRAMEGRRVGLGTVVDLAGEAAIGEQLGEGYEVGMGGNLVRLQGRTGDFRRLGDDGHVALRVPALRRHRAQQHAMGSGGERYGDGLAFQFGQRLHRRAARYHDAVAAATGAAGQHADEQAALAGGGEGHAVEGAGKVGHGAEVELAGDHLVGQRCATGEVLPLHPVVRILVAAVARQVFLQQAQLADQQPAGGAVDGGVLSADGHADGFRLGTQGSQGQRQAGQDCTQSHGDSPRIMVMGIVSATRTVVGNEGCFRVASGSGRMAGSASLAGSGRQRSR

SEQ ID NO: 25383 - protein, 624 aa, Pseudomonas aeruginosa
AMARGPRGSIWPAFVAAGSVSSGTTPGRGALGGVVPQPQALVGLLFALVDGEQVGFDRFPEAGHASLLVLLQVRVAEPGSVVAPRIVHPVVVQAPAALGAEQRGARGHLRAIADNADFQGAHQLVGVVRLDPLQVLGDGLDALQAQFHLAGHLGRLQVVVDQPAQLVLHLRRRQAMLAQQRRLDPRTLALDLGAVDRAEGAPGDVFGGVAPGEPAIGEGAEHVVVRHRGHVAGSVEALHAGLGLLVDPHAGGRVAGAEADLGNVHLDHLLAVVGAAPGVELPATGAFVAMEDVLDGLDGFLRQVVELEEHRAIAAFEFLVELPHHLPAPVVAFDEALTPGVGGIATQRAGDVGTGRAVVVLDQRVDLEAFQVGQLGAGMIGHGVAVAGVGRVLVGTHQVARGRQAQAARRAAAKDHRLGADHMEVAAAAVETEYAVHRALGIGEQAGADQAVGDGDPRTLELAVEHLLDVVPFRHRQHIGAHVVDLLHRIVAGLVLFEPDAPAIQLPQGLEAVAGIGVDRRLVDDAVVGHGDFPGVLLGRGVAGDDGVVQPVHAHADGAAALDVGLVHQQHAQFAVVLLGLDRRHRPGGAAADHHDVVFLLQGVHARSPFCRSMRRRYWKASPR

SEQ ID NO: 25384 - protein, 575 aa, Pseudomonas aeruginosa
TPSRMRPRSSSLSWLYSGTGESGSSLPMVGFACRSGSDTCYNKLCCDGKRHERSSGNTENAYGYGATRAWLSPAKGPARSADRPAPSAQRPPEGEGYRRRPAAVGGVRLQAEIAQPLVGHPIVDPIGLVLPPLRELRIHRPAAGADLQAFAGQRLVALGIGGGDEIAVAGVRRQAAVGGTQRSALANHGAVAIEAVVIDRTLPAGGVPGQHQAGLAALQQTQALRRRRALVAALAVMDEAGVALAELPVVALAALVQAIVPVHRPGHQALDRVTGGFQAAKRVAHRGGIDHVAGSRRIDVARQADGQALRRDPHEVAAAGGQALGEVVEEVFFHRVVVLRDPGALAAVRLLDPQAVAALVVVLRRDEVVDAFQGLQIRHVLAVLVQIGKLRGHADDEVLALPGVVLAHQLEGRRQHPLVVGQVDGALLEVDVQAVETVGFHQTDDLGGQRLLLPGVQLDVRVGAPQRNQHRAALGVEHADLAAKLRVGQVVWLEGRDAAPFHEGHGDHVVLARHVFQRDVGERALLVAVGGAGRPVVPEAHENLLAGDARHGRRGIFAGLVQLGKVDPDHLPLLG

SEQ ID NO: 25385 - protein, 336 aa, Pseudomonas aeruginosa
ETHPEGLSDEPRRGRRERLEKTGASVYHGAFRRLSRSGRGHGCRDGGRLHLPQLAEPRRRCSAPGSTGFAEFGDHHSGKVFQQCRGQQQLGLADPGAHHHQRPFEDRRVDQQRHAFGQAERGDAAELHAGQLGGDLAGGEGQPAGPEQRLDRAVHVEPPRAQVDHRGIAFGAVALVAQDQGVGAVLQAKAVACAERRGVGMLVGDAEHHQLGGRQAARDLLRQMAVVVGRGDGVKPVALGVFAHNHGQPRMKTDGTGPCRQAGGRGRRFRLPGSPARRQAHRAPGAAAGSRKPPPPPSPPGRGRRPGSPARSGWRAAASRRWPPWRRPGPARRGSR

SEQ ID NO: 25386 - protein, 309 aa, Pseudomonas aeruginosa
SGTTLGHAPPATTNARASRCVRPGRASATGCRPARPRGPPPCAGVPPPPVRATAGSGRRPGSRARTAPRRRWPRPHAPAPRSRGSLLRALPLPARRHRREGRRRPPAARPPGFAGSSRPARYGVRRRPGRSAARPAPARRGAPAVGGSSRTGWPALPRSRHAGAGAVFPRRGHTGRAPAPRRRPQRPGGPIAGEPGHRADRSRYAGSRGGRSGSPRRAPATRRPGVHAPRAGRRCATAVDRRWPRFAGACPVAGWSSDRRRRAPPAGACVPPPTTGRTAPASAAPSSRPHPPDSPERPAGAPVRGCSGG

SEQ ID NO: 25387 - protein, 239 aa, Pseudomonas aeruginosa
RRSPGVSARSSRSPAGPPRWHWPALPGSARPPRRPAPPTARDGRACLRRSAAGVRPGRSGSAACRPAGAPRGSHAGPARSARRRGPRRGAARARASRCAQPATRHSPGAPRSSCNGRYPPAARPDGCSPRSHGGAKGRSRHRRGRRWHRRACHGPPGRSAGPWPAPHRRDRAAHPFPRAARRSSAGRYAPGPVRRSPGRGGAGGSGGLRRAGGRRGFRRCCPAAGWPRPPRPGCSGSVG

SEQ ID NO: 25388 - protein, 360 aa, Pseudomonas aeruginosa
RQSSSATPAPSSSPASQAKPNSASGQSGAKGSRRAAASSWARIAAWRASSRSPTLPARTFSRHSGATPANGPASSANSLNRRPETSRAISRGSPSSPWNCPATWVQASRAAASGKPLAARRSSSARGSRRRARPIAFAQVVRQRQRTFRRNGRLLSPVTAGAFAVFAGQRLVGPLGEMLEQQRLVSLVRARLAGRPQAAAQQRHQAGRIDDERRRRQQQPLERLSGGVQQQAERQYRLAFPAQGRSGETRAFAREASGPVAISRQALDQQIGRAPIQYLHRQAHARHRPVGHAQLRLAVQRPAQPLQRRHGIGRGVQAHADNRIFRPLGMAAPGAGLQGRQRESFERFARGRLHSGLQVF

SEQ ID NO: 25389 - protein, 672 aa, Pseudomonas aeruginosa
TRRSCGTSERQARRCRRDIGGRQAGIRRGHDGEDPSRPAERLAAVLGEHVVEDQHVAHAPVEAPRLAVYGAADGRQGLRLDRAAIAVVGLVRQVFLGDAAQQRIAQARLETGGMEEHAVVEPQALAGIRVALERRAPLPGAQVLVADPGMGDPVLSAERLDLGSAVGLERFAPGQAEAGAVVAHVEDAQAPEAFQQFVRQVAEHQPVGRHRGGAALERRDLAMEHDVQRPVGGIGLLVMQEDRLVHRMLGGGVDLAADLATRRGTLLVVEQLRGEGSGGCAEALCRVDLEASQQQAASQVQVVVQGLALLANPVGQGQAGSLCLDQQRQAVALRRRAPHQRLAAARAEIARPGEAATGETGSCSFHRCSPWEARGRQEALQPSGDMRFEIGSPAFASRRRSQAWCRRSMRCRSKIALAPVQTASQPCGWSSSHSVRSRRAPGTGMKSASTRTPASTAGAARPLCAPQAMRIGRPLAPRWRRAWVTHSRGTSWCSSSSSRSWPTWRRRHSTDCSGRRPTASGRRLTKQPTSPCISRRERPARATPTSRSSTPSSAPSTSAKACSAALNGLTEVRSASARQAAWTAAETGRARRWPARPPLSSGRAGAAPGAFASGNKRSAQRSATRSRRPEANAARSRAATCSGVLASTPRRPPSSSVFSSAAKTASDTSSKA

SEQ ID NO: 25390 - protein, 209 aa, Pseudomonas aeruginosa
AGSSGTYQPPARSTPSRPTSRPLSRRMQTPTRCSGATPAARRRTASAALSRSSSAYLRLRSAACTAMRCGVRRAWASNRWWSTPRDGAAWGSLRMACIRRSSSASIQGSRPTHAWASTMPRAMRARWPAIRRNSSYWGSRRARPTLPSAASTRASQPGLLAVGRAASTWTAQHPARAARSWPSADSCRRASSSSSASRALRSADDSIAR

SEQ ID NO: 25391 - protein, 428 aa, Pseudomonas aeruginosa
PLNSTSREIPALAGSSPLARPSPRALAVCRKPGSSRSLPWTRAASSQASASSARISPLRSQPCCQRRWLRGRRRSRETSSRGSSWTSYSSRTRVTRLIDRFLCSMGQPDIGEVEGRGRRRFAALVEQQAVDASRRGLQRLAAKAVQPERVAVHFGPDPPRVRREQQDAVAHHQRLLDGVGDEQQGETHLFPQAQQFFLHLSPGQRVQRGERLVHQQDLRLHRQRPGDRHPRLHAPGQRVRVGLGEARQADLLEAFVGASLGLVARHLAGHPQGEQHVLPYGLPWRQLVELLEHHDTVGAGRPDRLSLKADLALAGRDEAGHRLEQGRLAATGRAEQDEAIGRVDFEADPLGGPHHARAGAVFEADSVHRQQGVGGERGRLAGGGVHRRLNSPATARRPGRNSPARRPACCGSHRPGRETPPADRCSSA

SEQ ID NO: 25392 - protein, 156 aa, Pseudomonas aeruginosa
SSAARLGRSSPRSPGYRYRRRPPCRSGRRPPLPSAPRRRPGRSSGCPGGTSPWRTARSANSAPAARSCRAPRGPSGWPAPGPGTAGWRNARSARCRRPPARRWRPDAAAPRCTCRGGRTACRPTASPRRTGGSATAPKPPPPARRCDPRRRSRRCS

SEQ ID NO: 25393 - protein, 248 aa, Pseudomonas aeruginosa
RSPGVPGDDLPGAPGLTPGLAAMDEERPARSSRAGLFHPATDQQVQHIIGMPLQLIIIGMPHSIIFAISMQQFLNISMSMPCIGIILQCMASPCMEHSIMHFIGAMPIIGMPIPMPIVGIIAMQAWDMPIIARLPHCIIMGMPQFIIIAIISALLRNWPMSMPIAGIILHSMPSSIVSHCMVAIIIGMPIMGIIGMAAFMFIGICMAFIMAVTPVGEAGVGANGADSRQRRRTGKMPVQQPSRALHGG

SEQ ID NO: 25394 - protein, 369 aa, Pseudomonas aeruginosa
INVLRPAAFFPLPGAAPSIAPLSGARTMPCGSRAGRRGKRARHCPRPARRPSRSAVAGSRAASRCPSAATPCHPTLRRRRWPGSRPPRSSTGPGRRPPRRRPPRRSAAASPRHRTSAPRGPGRRTPASSSERPGTAPAPPRRTAPGWPGPSAAGAGRPARRPARFPPPRRCRIPAGPGPPRRPGRPWRGTARYRCRGCCAPAPRRRSPAIPDARPACAAPRAGAGAARPAGQGSPARCAAPSRPAAARSATTGRRPSASRAGRPARCPAERRATAPAAHRAWPPPAPAPAAPAAPGAARSRPAGPRRGRRRRRCRSAPAGSGGNPRKRRLGCCRRRRSAAPAAAPGAAASPGSGSPPAARPVANPRRRR

SEQ ID NO: 25395 - protein, 452 aa, Pseudomonas aeruginosa
EWRRSRTSPSPAAHSAAAAAPRPTQRPRRSPEMLRGVPSAQLRGTVDGVAQVVDEASRHALEQGVGKRHHRQFAGPVDEPGMPVGAAPAPGAGSLRRLRDSRVAQHGETQAEAETGIGRQFQAGYLVAAHLLRQARRQQRRAALAKDFQKAQHVAGAADHPRPAGRIGRRFEGPTRLEANADAVLERRHGLPPGHSARAWPVADVDRRQSARVGAEEAAVAHAGWNPDPLPQRFRQRPPVDPLHQRAEHVGGQRIAPGAAGFVEQGHGGQATEILGQVETRQVHAIGNPGAGIGAVCVGFEEAIAEAGAVAQQLPRRDARLAAVGQARTERRQPVGDRLMEGQPALVHQAQGRDADDRLAHRGQAEQAVLAHYPAGFAVGQAGSPSIEPLPPVCHQHHRPHQALVGECRLDHLIDIFRQAAAWLSFETGHAGLSADEGCGQDKSAAKAEKDG

SEQ ID NO: 25396 - protein, 301 aa, Pseudomonas aeruginosa
SEPCMDSLSGFTVFVRVAETRSIVGAARTLGVSASAVGKRVARLEEKLGVRLFHRSTRSITLTAEGSLFLERSRRILAEIEATELELSQSRETPRGRLRVSLPLVSGLVLPTLADFMQAYPDIELDLDFSDRVVDVVDEGFDVVLRTGQPVDSRLSMRELGEFQLKLVGSPAYFARHGTPRCPEDLLRHTCLHYRFPNTGRLEEWPLRRADGEAPPQIPVSMVCNNIETRVCFALRDQGIACLPDFSIREALREGRLVSVLDTFCERRARFFLLWPSGRQVSPKLRAFIDFVAPRVIATLG

SEQ ID NO: 25397 - protein, 205 aa, Pseudomonas aeruginosa
RCLTLEVFHASTPPSPGHHGCRRLRQVQRQPGPLPAQRRPRHRRRQLPSRRQHPQDERRHSPHRRRPRRLAGHPRRAAAPGGGRRQAAGTDLFRPQARLPRPVAPRGARPRHRLPGTDPGGRRRARRPAPRPLHAGDPDRQPVRRPRAAARRTPDPAPGRHPAGGMPGAGRPRLVAGAHRRLNSFACPTKIALPRKSASMKQQLR

SEQ ID NO: 25398 - protein, 642 aa, Pseudomonas aeruginosa
PNQCNAPTTKPRAGRATSISASAMPSSRNCLSHRRRGPAKSLPPTPEASRRHAFAPAPHEAGAKADFRQGRDGFPAETIYLRSGPRYNSPTPFIHVIRGPAMTAPLHLDSLFPSLDAIPEQYRPDAPIEQRDYLVDGQLRYWDGPLAPVRSPVFLAEADGERQVILGSTPLLDADAALAALDAAVRAYDHGQGLWPNLRVAERIQHVERFLARMREQREAVVKLLMWEIGKNLKDSEKEFDRTCDYIVDTIEALKELDRRSSRFELEQGTLGQIRRVPLGVALCMGPYNYPLNETFTTLIPALIMGNTVVFKPAKFGVLLIRPLLEAFRDSFPPGVINVIYGRGRETVSALMASGKVDVFAFIGTHSGASDLKKLHPRPHRLRAALGLDAKNPGIVLPQVDLDNAVNEAVTGALSFNGQRCTALKILFVHESVLRPFLDKFSARLASLKPGMPWEPGVALTPLPEPGKVDYLEGLLNDALAKGARVVNAGGGEHRQSFFYPALLSPVSPDMRLYHEEQFGPLVPVVPYRELDEVIDYVLRSDYGQQLSLFGNDPAQIGRLVDAFANQVGRINVNAQCQRGPDSYPFNGRKNSAEGTMSVHDALRVFSIRTLVATRDTEANKTLVSEIIRNRASNFLTTDYIF

SEQ ID NO: 25399 - protein, 233 aa, Pseudomonas aeruginosa
SACPSPAGRGTCRHLPHCPPGSSRATGCRPGNTSCSREPAQPVACAGRHRLCNGPDSRVAVDRTAPLPTRSPHERPRPSRSHRHQSLRRRRLRTARPAFPTDLRAHRRRRRRARTATRTAPRGDRLAQAGRLRRRARAARARRRRRLAAAVGSVADRTGRGRLQHHPGPARPLRLRRGPSQCRARPWPRPLAAALRRGRPGRLRLDRGRFGTAGRSAHPRLAQGRRSLGGERQ

SEQ ID NO: 25400 - protein, 679 aa, Pseudomonas aeruginosa
VLQHRQPLLRLDRSVCPARRHRRRCDRGDPHRPARRAPERRLGRLRPAHHRQRHVAVRGCRGGGREPHRLRQPLQVPDRVLPVGPARGAGRHRPRRLARRRRRGARADPYLQPRQCPASQPGSPGAAGGRAHRRARLRRRGGHPARRRSGPARLPGALRRRPAGGEGGQYRRRDRIGQGPGDRRRTGVAGHQRAVRRQRRFRRRPRQAARPPLAQCAHRRLAQSPDLQATDRRRLGDQRQRAALRLADRQRSGHGVPLNLAHPIARSCHERTGKERRRSLSATAATDPGPAHRRRRRGDPRRPRTGRAVRRGSLAARPPAPAAGGRTGSLLAERPMGHQRTARLRRRRGRLPDPGRSTEDHRRGRPVPGAVAAEPPGGARPFAPGRQRGAETLLLRPGARRRALRQRLLRTPQPYRRRIPDTSAGGWRRVPHRRPQVLFERRPARPLGTGRRPRRRAARAPGVHPARRAGADGDRRLVRLQPAHPASGTVILDNVRVPAEHVIPVHRAFDRPTAAGAVSQFIQAAIDAGIARGILAETVQQVRRHARPWIDANQQHAWEDPYTIQQVGDLRIRVRAAEAVLDLAADAIEAALAAPDEESVAAASIAVAEAKVLTTEAALLAANRLFELAGTRSTLEELNLDRHWRNARTHTLHDPVRWKYHAIGNYQLNGVKPPRHAWL

SEQ ID NO: 25401 - protein, 92 aa, Pseudomonas aeruginosa
ARLKPSTSVSSTHSCNRSATVAGLPTNSGPKPPIPTQSASSRTVQVRVGSALENASTADWIALVWMCRSTWSGRYWPKSIPVQPEISARAPS

SEQ ID NO: 25402 - protein, 135 aa, Pseudomonas aeruginosa
SPRCAGSPRRGRTPATRRPLPGPGGRSGRPPGHWPPGADRGWRGRHYCLRSGCPSAAAPVPRYSSDRDRAGSRCVAPASRRGGSRRWRDRPAAPRRPAPAPGRGPPVRAACSGWLRPWTATVRPRRGARESIAGP

SEQ ID NO: 25403 - protein, 120 aa, Pseudomonas aeruginosa
RARACSRPTAAIAWSTRAWRVAASRCGWRAKSRPKATFFSRFSQGSRLGSWNATATPGCGPRRGSPSTRTLPAAGSCRPASTRSRLDLPTPLGPRIETTSPAPRRNSKSPSTACQPAPRG

SEQ ID NO: 25404 - protein, 256 aa, Pseudomonas aeruginosa
RSGRTPTRASGGRNRRRARSGMPCRRWPATPVARHWRRLRRARCGCGTGVPAGWRTRRWPVRRAAPPRVRRGFRAVPPARHPGANGCRPGAAALRPVRGAPGRWPCRIAGRGRPGAPVAGTAGRRRATASRARPPPRADRGRRCCCIAGRAGAGPPSAASRRVLRESPGRRACRPPRVRSPPPPRNRRCAGWSPTAGDRPGASRPPPRAPPPAAPRSRRGTSSRWTAQWRRPGGRPAGRRAGVGAVPGWDSATGTR

SEQ ID NO: 25405 - protein, 169 aa, Pseudomonas aeruginosa
RRAGPRRRTPRSASAPPLRPPAPPRRRACRRRRRGVPPPPRRARRRRPGAAAARRDRRRRGRGRRPGGRASRSGSGQAWSSLLAPARHAARQAQAQACGLVQRYCSSSALSGVRANTLAKLQSVARLTPRITSRAWAWSKPAARKASNCSSVTAPRLAITARVKSARAS

SEQ ID NO: 25406 - protein, 335 aa, Pseudomonas aeruginosa
VFPLDEFVQPPCRLVIRQPRSRHQPVPCRSLLRRLACLHPRSGACQLPPGGAGTLLGARRRKRPGLATGQRRRAVLPARRRVPPVQRGHRRGSALPAAWRNAGAGVERGGRCRPGLRVLPLPFGIVRADRRRPARLADPARRRSGAGRGATPVRPDRRRVPPPAGAVAGSAGAPQPPAVPLRVAPAGARQPDPRRPGGTGTPAAVRRPAGSADRGTRTALEPGTDGRTHRTVALGLLQALQRTQRSVAGAGPAGPAHAPRLRPAARRRQRRRGRGGGRLPVHRRLHPCLPQGHRTAAGGLSQGQPLITRDRSVPGARLPARRSGTPGRAGRSPRC

SEQ ID NO: 25407 - protein, 177 aa, Pseudomonas aeruginosa
SAASARAASRTASRHGPRAPPHAPGRRRGRAIRRGRWQGRTVGRGSRRRRCTSSARCAPCTCGRHRWVGPGAPAPAPGRRSRTRRWRSGASPPAARHGRRAAANGPRCDGWRARRRRLRGCSAVRRWTAPAPPPPGRGWRPPRGADRGSATARPPPTRGGTPSRPGRGRRGNRHGHW

SEQ ID NO: 25408 - protein, 194 aa, Pseudomonas aeruginosa
PYGISSHPFIQDPHMNRRPAYRSIPSSRSAPFRRRLLPLSICLACAGGAQLAGADDTPAGTEDARQAQPATTLQTVTVTSRRRVENSQDVPTAMSVLGGETLESQRIYRVQDLQQLVPSTNVAYVHARQSSVSIRGLGNNPARGRPGRQRRAVPRQRLPRPPRHGLVRPSRHRAAGRSCAARRAPCSARTPRPG

SEQ ID NO: 25409 - protein, 136 aa, Pseudomonas aeruginosa
TATNSAPPRPARRWWMAIGARSTSTRTSRSRCSRAEPRWKPTGSWPTTSPSLPSAPTAGGISRRATTTAWTYRRPITPESRCATSSGRRKSAWLRPAAVSSTTCSAPTTSARTSTTSPSPTTGPGQTCGTEPPPAP

SEQ ID NO: 25410 - protein, 345 aa, Pseudomonas aeruginosa
SHGPLPAPAATRRHAWERGSRVVPCTAPPLRARMCLRSPGRPAPMPRASKVTDPSYELMDDHEGHSLIYRQHGFPSPLVRWHFHKEYELHLIVASSGKVFIGDYIGNFAPDTLFLTGPNLPHNWISQVEPDEVVARRDMLVNFTDEVLEDGSGVFSELNRLAPLLARARYGIEFRDPALIGESRRLLQRIADSGGMTRLGYFFILMEQLAECEDYQLLSTVTSSQLADEHNVERINRAVDYIFQHYAQDLTQEQVAAHLGMTPTYFSRFFKQAAGRGFVEFVNRLRISKSCELLARSELPVTEVCFESGFSNLSNFNRRFQQLKGMTPTGYRRLVTQRLTEQNLL

SEQ ID NO: 25411 - protein, 478 aa, Pseudomonas aeruginosa
SAASDTKTIMSSAPPAGPEEEFTDERLDQGLPGRRLPCPAPAGPGRRDPDHRHGQQQRHDPHATPVQGVRGKPPGHRAEMGGARRERPAPAPDHRHRHPGRTARPAHHRHVRSRAVGRQGLAGADERAARRLRPGRPVALGARRSLRQGHAVRPAVLRRSLDHLLPQGPVPAGRAADARATDLDPARRIRRQAQPPGPGPVRHLPARQGRLGREHGVDRHPGQRLRRTLVRRAMAARIQRRRMEEGSRLLCLHPQAVRPARRLQQRIQREPGAVQQRQVRDLGGRQRRRFVRHRQEPEQGRRRHRLRLRPPGSHRQGRLLAVFLGPGDSRQLARQGRGEGLRHLGHLAGVRQAGGGQGRRGQRAARHPRLDLQRGLPGRRAVRAGHPGIAEARRSQPSDAEAGALCRHPVGHHPRVPGHRHPGRQAVLRRPHRADEQRPGARRRAAEHRPRDEARRLSEVVRRRAQPRPARRCSSACP

SEQ ID NO: 25412 - protein, 322 aa, Pseudomonas aeruginosa
RSRRSRHEHLGPRYPAPGPSRPPPSPAPPARPWLAPGQPLGGAAAVVDDRAPGHDPVFLADPLQPAVSRRECLRRPGELHLLRHRRRLPARRAEHPAAGGQRAGDQRGVRRAHRRAAGGRRILRPRRGAGVADLAVLHHADGERAALEEPDLPPGLGHPRRRLAPVRRRAGGLAGALSAAVDHPHRLLAMAALRHPDPDDRHAVPRPGAEGGCPPRRRRSAGDLLAPDPAAPGAAHRGGADDRDDLPALGVRRDLHHHQRRPRLRIDQPRLPDLQPGAAAVRCRHGLGRGPDRGADRQYRRHRAGADDRQEPYRAQLRNPPC

SEQ ID NO: 25413 - protein, 96 aa, Pseudomonas aeruginosa
RCAGTSPSPSTWPASTSARSPPRSTPPHASSNCKRCWSASRASSPAANGSGWRSAGRSCATRRYSSSTNRCPTSTPPCACRCAWNWRGCTRNWRRP

SEQ ID NO: 25414 - protein, 581 aa, Pseudomonas aeruginosa
TSPARAMPSRACCGSPPTSASAWAATASAMSAPTRGKCSPCACAAISHRTTAPPWSWASIRSTATCSTATARPSTNDCNRRPEAASGNPPMKLNRQHLPLLATAVARPSYDPAQLRQGIVHIGVGGFHRAHQAAYTDALMNRGEALDWAICGAGLRSDDRAMHDALAAQDYLYTLYELGDQPDTEVRVIGAISGMLLAEDGAEALLEKLAEPAIRIVSLTITEGGYCIDDGSGEFLAELPLVRHDLANPRTPRGVFGFLCEALRRRRDTGVPAFTVMSCDNLPHNGEVARKALLAFAERLDPGLARWIATHVSFPNAMVDRITPMTSPAHRRQLAQRHDVEDAWPVVCEPFVQWVLEDRFSAGRPAWEKVGVQFTDDVTPYEEMKIGLLNGSHLALTYLGFLRGYRFVHETLGDPLLRRYVRAFMDRDVAPLLAPVPGIDLERYKDSLVERFANRAIADQLERVCSDGSSKFPKFIVPTANRLIAAGRPLERVALVVAAWALYLGGVDEHGERYPIPDPRAAECQALVAERRGLGRRLLGVETVFGPAIPASAAFVEAFERLYDSLRRHGVSETLRQVLGE

SEQ ID NO: 25415 - protein, 218 aa, Pseudomonas aeruginosa
RRRAACTDCSSASIAAPRVARRCCSTPAAAARWAWAAPRSARRKAVTDAASRIRRTGWKPWPARYAWPWKKPRWTAARSAPWRFPPSSMGCSCSTPRAGRCARPSSGATPRARRKTASCWKPSAARPARWNAWDWCSRRATRCPSCSGAGAAFPSCSPASRTSSCPTTTSTTGSPAASAAKRATPPAAATSTCAGAPGPATCWSWSSRADAWRRRCRS

SEQ ID NO: 25416 - protein, 480 aa, Pseudomonas aeruginosa
AAPIFAGRCSKAPPSACATASTCCAPAACRARKSAWSAARRRTRCGGGRSPTCSACRWSVRGRPRPPPLARRSRRPGAWAAKAAPVKAWKPCAGAAWRSTSRPAPSPRRDNRRPTNRPTGVTWSTCLRDNGRFPSSSGVLEICMYLVCGEALFDVFSLESAARSNELGFTAIAGGSPFNVAVGLRRLGVEAALFGGLSSDYLGTRLRRVLEEEGVDCGFLVPSDAPTTLAMVGLDASGSAQYQFRGDGCADRQVRLEHLPTLDGRIRGLHVGSYTLVVTPVADTLLALVRRESGRRLVSLDPNVRLDPQPDIDLWRRRVEAFASHAHLIKASEEDLALVLPRPRPRRGGPRLAEPALPAGLRHPRRGRRQRALHPRQLESPGGYRPATARYGRRRRYLPGGDPRLPPPPRRRQPGRASRAVAGSDRRDARLRHPRGGGHLLAGGAGPAVRPRALRPAVRRVRPRAAARSSAPAAPATPGP

SEQ ID NO: 25417 - protein, 159 aa, Pseudomonas aeruginosa
AARRSGWPRWAPAGRSAAACRHSRTPPAPPGRARRSADNRRSRRSAAAGHGRCAGREGSRPPPRSACAPPPRSSRWRCRRHRRGRRSRHGGHVAGSPGRLRTSRPRRPGRWRRQRSAAAAAAPRAAGRSPFPPDWCCRRRPSPRTRPCAPRRRPSPGWN

SEQ ID NO: 25418 - protein, 420 aa, Pseudomonas aeruginosa
TAPVRRVTHGSEERPMSLAHATRDNPTAAAHRIGSDDEALETARELAALFARESIQRDRERRLPLEELELFSRSGLWGIAVPREYGGAGVSRVTLAKVVAIVSAADSSLGQIPQNHFYALEVLRVNGSPAQKGRLFGAALAGERFGNALAEIGTRTASERRTRLRADGDGYRLDGRKFYCTGALYAQRVPTLAVDDEGRQQLAFVPRDSAGLEIVDDWSGFGQRTTGSGSALFDRVAVAAEDVVSFQDAFERPTTVGPLAQILHAAIDAGIARGAFEDTLRFVRERARPWVDSGVDKASDDPLTIHEIGRLAIRLHAAEALLERAGRVLDRATAEPDAESVAAASIAVAEARALTTEVALLAGSKLIELGGSRACLAELGLDRHWRNARVHTLHDPVRWKYHAVGDYYLNGRLPPRRGTL

SEQ ID NO: 25419 - protein, 157 aa, Pseudomonas aeruginosa
ATGGSAGTSSPATWKARPRPWASPRRSSTTAATTAPTSTWRSSTSSGRAAGKTTRCSPTASDGSTRGRRRSTRSATMASSTRSRATTSPSPLHSAPRCCSRPAPRSVAWPSPRATPNACSSPDRPARPPASWCSASARRWSAPAVAPRTSGSSWAST

SEQ ID NO: 25420 - protein, 342 aa, Pseudomonas aeruginosa
PAPWSRRATPTSSTWWCPSCRHAAATRPPMPPAPCGRSSSAAAARACRRNTPAPPSASPRPRASARPDPTFPFVQEPTMLNTLKTLSLAVLLGSGPAQAADAPLKIGTTAAFAPPLEVAVSEAGKQGLKVELVEFSDWNAPNITLAQGDIDANYFQHVPFLENANREGGFQLKPFAPGIINNVGLYSKRYASLAELPEGASVAIANDPINGGRGLQLLQKAGLLKLRDGVGYKATLDDIVDNPKDIRITELEAVQLARALDDFDLAQGYPHYLRLAGTIDPTRALLFDGIDNREYVIQFVTRGNYQDRDGRLARFVDIYQHSPVVRAALDKAHGTLYQPGWE

SEQ ID NO: 25421 - protein, 98 aa, Pseudomonas aeruginosa
CRPRPCGRTSPCRCGWPGCPGHGSRSGSPGCCNWSAWRKNATPIRRSSPAGRNSASASPARWCTSRRYCSATKPPRRWTRRAPRRSSRCCATSTAGWA

SEQ ID NO: 25422 - protein, 149 aa, Pseudomonas aeruginosa
SPTRWRSSARSATAWWSSNAAASSNRAKSGKSSAIRAMPVTRSLFGSLRAALPADLQARLRQAPGAGDPVLLDLQYTGASRRVPDLLAIARAIGQRVDLLHGGIERIQGRALGRLLLQVGAPPGELPGVLAKAALVADKVEVLGHVAHA

SEQ ID NO: 25423 - protein, 654 aa, Pseudomonas aeruginosa
TALARFPRYAADDRRVLRHRPAGGYPAGPGAGHHRAGRDLRGAPAQSHPGRSGQRAALGTLPDPDGGADSLYPDDRRHQLWSLGRGGAADHRRHAVLRADRRGQPARSRPRPGGGGPGDGLRTPPHHLQRTVAGGATGHRRRLHHHPGDHDQFLGLGRRDRCRRPRRPGLPLRLPALRHPGDAHRDHRPCAAGHVDPIRRRPPGPPAEQTPVESALPAWEGWRFAEGDRNQRRRDSASFPAPDRPVSVVLRSSGDARLVGNPVKKKEGKAPHAAKILARNIQDPGPPRPDGGARRPGRGAVRQGPQRRRRRALAGGHRPPRRLVRRPRGNRRGLPGGPRPRRRLPGSRRAAQPRRRTGRPPRRHPGAHHRRRRGLPGTRQGPGEQLHSRRTQAPGRRLLVQSRLPRARPARLRRPAHPHPRRDARHRRGRRQQAGPVPGDQGTGAIPRHRRRPAQAAGTPRLAATPRARRRRACRRGPRQWPGDPADLREEQPGTAARKHAASAEDSPAVARRRLPGSPFASDLQGIRGNRQGGLLCQAGSEVRSRVRRLAGLGQGPRRAGHRALGDPQRTRRTELRRPGETLDEPHDPRARVVHPCLLGGLGGRLQGPRRGRRRRFLHQPHLGTAEVPGPPGGARHGRAAAPARLLSLGLAGG

SEQ ID NO: 25424 - protein, 442 aa, Pseudomonas aeruginosa
ARAAIRSSRFGGAALAGAVAAEACQLHLAQPAEGATEGEGQVALGIKCLQRHPGLQVERHLAVVAFVHQGDEAPHAVVVHRQLRQFAIPRLHQLRAVLGATGYAAFALAGAQARQVVHQDRPVAVAKADEVQRRQRRLAELRIAAPEHRFAVPVHRQRAVPQFDGLRGCRFAGTQAREEFGETARLPRLHHPVALLGPAGMQAVVLAAIHRDHRHVPLDRLDRREEAFAVETVGVQLLRWLVGSDHQHHALLEHDAQQAAEQDGIADIADEQLVEAQHPHIPRQLAGQGAQRVGCTGQFELALVHPLHEVVEVLAPRGHAQALVEVIHQPGLAASYRSPQVDALDRAVAVSFMQGLETTLQRLGGAPLRLVGSETALFHGLAIDGERRHGRQIGRGIGHRAVPPGAERGARRSAKRRVYCARLGLGECRSAGTADSRGRLAE

SEQ ID NO: 25425 - protein, 298 aa, Pseudomonas aeruginosa
PLALTRRDPERLNSDRQPHRPLAIDPLATALVHHQFADGDQPRARDVAAESQQVGGMHLVAVAETVRRAQQGIFDPPMEVLALLFEQTLESLLQQVLGGAARRAPARQLLATLQAQVGQVQVIRADQPVAADQQGMVDDVLQLADVPRPGIGTQLLRRLRAQLALAVAQATAVFGDEVAGQRQDVAGSLAQRRQFETDDIEPVVQVLAEVPGIDRPLQLHVGRRQHAHVDGDALARPQAHHLALLQHAQQLDLDRHRQVADLVEEQGAAVGLLEPAGLGRQGAGEGTLLVAEQLGFHQ

SEQ ID NO: 25426 - protein, 187 aa, Pseudomonas aeruginosa
GSALASATSERNHGRASRRVYWRASSKAPSAMPRNTSVKINWAISGRRQANGVLSGPGSSSNSLSSTRTRSKIALPLSVCRWPMLSQSWPRLIPLRAVGMAAISSAPPSPSSAEAMSISESRAPEQKLFFPENSRQPSKRRATVRLSSGFSALPQNQRLRAVSSNHGCHCSGRENRRTVASIRCWKP

SEQ ID NO: 25427 - protein, 195 aa, Pseudomonas aeruginosa
SCRCRARRIPRCAPPPAADRRPARCRRRRAPGRPRPRGSAGSPGDRGGRRAARPCVAGLRSRNGRRTAARRRWSRRRCVRSACPRRARLLRRFRGRSHAGGCRTSPYAHGEPLAGARRRFSPPPPATARPRSGRRPPVRRPVRGRPPRNRRSTAADTAVAAADRAPWRSPRGCACRGSPPPRPAGRAARPEGTRR

SEQ ID NO: 25428 - protein, 402 aa, Pseudomonas aeruginosa
NSRRPGSCRFCGGIVKDCKAPRSLAHQRDHVVPWRGFQLADLLQAGAHDVAADPQQASGLQLVAVAEAIGGTEHGFLDVLVEILAVFLEQRLQRRLQRRAGGAFGSAAQAVRLLARTHVDEVQVGRLDQTVAADQQRVVDGVLQLADIARPGMPEQLALGFRAQARAGVAEAPAVLDDEVLGQRQDIAAALAQRRQLDGRHVQAVEQVLAEVSGDHRVSQVDVGRRHQPHVDGDRPARTEPHHLAFLQHAQQLDLDARRQVADLVEEQGAAVGRLEPAGLALQRTGKGALLVAEQLALHQALGESTAVDRDERAAVASAEGVDMARHQLLAGAGLADDQRVGLAGRQALDALQQLAGTGVVEHQHGGAHRFGQLAGVGMGDDGHAGFRAGECAPILPQEPID

SEQ ID NO: 25429 - protein, 1016 aa, Pseudomonas aeruginosa
SRRRRPAPSAAGACAAARHSGATASRWAAPATTGRRPGLADAPPRGSARRVPPAAPARAAIRPARRVAARPRRARRRASDPCCAAATDRWPTAPPRPSRRAWPPPARRRSAGCCHPPGATRAGGRSPGRSAGWGRTAVRGRSVRAALPGTGRCRKEAGSWGTSRAGDGGRQQRRERRLRRAHRQRLDGQRGLAAQAHQRQAEEHPRLVFRAVGRIHRQLQDQRKLRVVDVRRALPGEVRAHHAQQRPGALVAPAGLEVGHRQAGLARVVCRTLRAVLRPAQHDFQRIADIPGQALVLRAGETAFLVARVQAPGDHLVGAAFQAAVAAPVDVQGDAEQARLVALEQRAEPALRLLQAADEVLGGRQVRRANLGQPFAHLRQARLHQFQQVPHPPRLGIGRFQAVGEREASGEVLVEVVGEVLPGLRRLLLLQRLAAPERALAQVHQARRQVAAAGRQEHAVENVGATADVHLVEIVTHQLRQLRRGARRVVGLEFLQFGVERAEAHERVVVGGGQAGLLRLQPLQRRGVAFGDGRHGIELAVQALLQLGTVLGAEHLQAEIRRARPAAEIDRLAQHRLLVDVAQGLADIGHGQRVEAEQQARAGLQVLQLQQRRLQHLDLLDLHVETRGIATGQATTARPEALPHGLGRRAGGGVQDRIAIARVERWQGALVVAGEVVEEAQRLSHADIVDAQQGVVRQCLVRQGHGDEVLGLQVIDGAFQTEQVIGQLERRPLFHQQAVAGSLRRRDPFAAKLLLQLHGEVLQFLHAVSQQAALLGALEQVLVARDEILADAIAPDQVDAVDLLLQVVDQFADPQQLGRRGVSFLAELREFLGQGIAGAFQAVGEEVGVQPACHQVMEVIRRRGGDPAQVEGGEIGRTLGEQHAVVIGQARQAAGVVAAAQGIVTQLQKVVERRPAVVDGLGEQAIVALQRSGAGDQVLRRQVVLPLAGVVALLQAGLAIAADRPQVARLAFQQAAQRSHQQALGNAAIRVVDTCIQGGKPGTGKRQRSEAPARRL

SEQ ID NO: 25430 - protein, 521 aa, Pseudomonas aeruginosa
HQLPPGLDVLPDLGGAPSVVVERLVALTGAMQQLRQFTGVAQRVAPDPGHQAAPEQAQAQRGEADPALPALAQLEDARHRLGQAFLGKDPPCPQLAGEAAAPTRRVDRRQDIVGCRARRLAAAQVETAKARRLAPGVALEDRFEQRLQRTAEAFQAWRQAIQLIVHLAAQGTEFDDRLGQGGGDFLQRLLAPARLPGRFGGERRGPAEGALARLLGQRREKFLETRQVFQASDHHVNRQAQAKALGQFHVATARGEAEVGRLLAILQPRQRNVPDHPVQRAPAAQAQEQTQQAQPGAALPAQALVGQEHRLGHQQDRPLAVRPPAAEPGRTRHRQQAPGGAQLLALGLVAEHQQPGRFVAALPALLALHLPDRRVEAADLRTTAGSPPPAQRPQQQRQQHQEENQHEQGRAAHGACSASARWVTAAISCWMSRQNRCPIPLINSTSPSTARPRRKPSGSAARTGRRRGGAAAGCSRRRPRSAASASRCQAKANNACRHFSCSASPRGPRRRPRKPRIRHCR

SEQ ID NO: 25431 - protein, 243 aa, Pseudomonas aeruginosa
PARRCAAAGRHRTSRRHPARRTNGCRRQRCRPPVPGDSSAAAAARSCVAGRATAGAGRRRRWRAPASQPPPVRRRRRASAGRPPGADAAPDRAGARKIPVPPARTAGSGSPRGSTRWPAPASPAAARSHAAGRGSRALRRPARRPADRAPPRHRPGPAGCRAGPAARPYGLPAGLRPPAGGSRARQAGDGFPPRRPGCPPAAPGAGARRGTAPSPGPARKATARVCPGATPAGSVASAGRRAG

SEQ ID NO: 25432 - protein, 272 aa, Pseudomonas aeruginosa
SGHPPDALLPHHCIGVSRHGREYAAQAGPGAPAARADHLRRRDRQRHREEGAAPGGRHPRRPLRQAGYPAGEAGRTAFRRHRPRQLQRDPLLHLSPRHPAGRQHHQRRRQQAERRAALQPHRGLRPGQPGEAGGPVASPVRSAPAPARPADQARRQRRPRPVAAGRGGQHRRPAGNQSGPPGSRSGPGRRQRTPGRPAGLTLFPEKPPCPSHPPPNNPARVRPRPCPCSTRSSQRAAWPTTTASRTMPATCSRNSPPRSSTRAWPSTRTPWR

SEQ ID NO: 25433 - protein, 192 aa, Pseudomonas aeruginosa
RRELAPAGTAGGAPFPFQTAPLQESDAMDAIILDFGSDIKGDSLLVGYENKIEIMSYSHNVAMQVTNDVSNSERTSGKPHVGEFTLTKFIDTSTPTLNEYCCAGKPIAEATITIGRNAAEGNGQIMPFIVYTLNNVVLSNVSVSGGAGGKPVETLSLNFTKIKWELTAQKDDGTKEGTAASTWDLAANQLVK

SEQ ID NO: 25434 - protein, 145 aa, Pseudomonas aeruginosa
PSADMSGALPPLFERLSAEADERPAFDDRALAESVRGELLRLLNTRRPANARSGILAYGLADWTAVQRLRAEDRRQLAREVRVAVEHFEPRLQLAEVEVEPDPGNPQRLRIQLGGSLRSGSRLTPALFVIEQGNDGLEVRHERFD

SEQ ID NO: 25435 - protein, 339 aa, Pseudomonas aeruginosa
CRPARLLPARADLATARRRRLRRALSEGRPAPATGPRRMPRPARRASAGRLLAAHRAPATAPRRRLRGVQRRPPRTALPAGAAPAAVLRDRPVRTGPDPGQPRRGLPAAARHRAVRHHPRRRQRAFPQQRRGDPVAAGDRRSDPARRRGGASPDRSRRRPLGVAPEPALPGRVPLGGAVDRAPAHPPGGFADGLRDPLRPARRAYRAGHGGGARHAAGGALRNAGDRRLRRRRGAAAGGRRRTSGPAPARRVLRLSRQVPLLRLAAVRRARRRTGALPVPGLRSRTDGTPAFAGGRLPARLRAGDQPLSADLGAAAPGRHPQRVPPGRRQSPREQRGNP

SEQ ID NO: 25436 - protein, 406 aa, Pseudomonas aeruginosa
  UNSURE (173): Identity of amino acid at the above locations are unknown.
HPRRALGCREHRAASPGVLWLPPRQPPRHALLARPAHRRADPEPAGQRSAAERGGYRLRPVARDPGLQPDRRAAMHQSLSGRAPGCRHRAGLRTARAGRRRTPAQRAQRAEPAAPGRPIALETGLAADPQPPLAGGRPARPRSPAGNPRPAQPARRRQRPPADRRSAATRLPXGGGARRRGCLARLAQWPGNPPATRSAALRRRQRRAVLRRAGAVLLAVCHRQPLRAHGPGGSRQGGEDMATPGRLAALPLSQRLRRTPQRFELLQALLLLERERPQALPLGTGNAPRAEALRLRGPLLPLFASSEVESLLDDPQQPVLSTPVFGLGGPDGPLPYAYQEWLQQRARQKDHAPAEFLDLFQHRLLSLLYRVLRQASAWRSVSPVPAATPVQAAATCPQRPVAKSPA

SEQ ID NO: 25437 - protein, 173 aa, Pseudomonas aeruginosa
APGAAGQRGAGTHRAVRRRASLPGRLRRAWCASTSAWRHGWTHTRAPGRKSPRPAAARVQRGGRNLRLGRDAIAGTRTWDEHAGIAFSLGPLDAREAARFFPDGDAHGQLASLAALYFGPDLDCRLSLLVSGGAPLRLERGTPPRLSWNTGLRRIEDGQRQRIDLDLRQPEVA

SEQ ID NO: 25438 - protein, 469 aa, Pseudomonas aeruginosa
NGTRRPDRPPQPGLSPRPGARRATLPATHPSLRRDRAPAAGAAGHRRRRLRLPAAALRPGARRPGRRDQPVAGAVQGRQYPHSGAVRAHHRPARRRRGARQCARPGADPFRPAAARLARPRGAPRPVAEQRVVAAADSPRGLAGQPAGVDPGLPRTAARAEPSGGRRRQAGKRPGPAARPVHPGPHRRGPRRAHRPHRRARRGNPPVRRHPPAPAAEQPDPGRRAGRRQDRGGRGPGPAHRRRRSAAVVAGGDPAGARPRPVAGRRQHEGRVRAAPQGGDRRRAQQRAADHPVHRRGAHADRRRRRGRRQRRRQPAQAGPGARRTAHPGGHHLAGIQEILREGPGADPALPAGPGRGAGRGHRRGDAARGRRQAGTASRRADHGRGHRRCGEAVASLHLRPPVAGQGDQRARHRLRAGRPRPARRAAAAGKPAPSRAGAGRGIAAAAPGTGHRPRPQRAYHRPGKRVGR

SEQ ID NO: 25439 - protein, 174 aa, Pseudomonas aeruginosa
PPDHPRAGDPLGRGTRSGARTARHPPRTAGPQRKRRRGQARRGTGRSHRPPGRRTGAPGGRPRSHPPGRPAGSRAGGLAYRGRGDRRLDRHPGGQDARRRSPRHPFPGATNGPGGDGPGGRPGRHRPRASRPIAPDSATRPSRSAYSSCQAPPAWARPRPPTPWPTPFTAANAT

SEQ ID NO: 25440 - protein, 68 aa, Pseudomonas aeruginosa
SASTSPSTRRPTPSASSRAPRPATSATAAVACSPKRCAASPIRWCCWTRSRKPIRTCWKPSTTCSTRA

SEQ ID NO: 25441 - protein, 183 aa, Pseudomonas aeruginosa
RTADEFMNWNDLCGINTVAGKAIDIPTLVGPGVDHDRRGRTGMPNGATLTAMMNAADALRLTEAPRTRRGGVSDGISFHIAQYVPGGASLTITSQFVGQKAGSAVCYENTLFNDALVGRINAIVGNIIVRQSVAPCTRCRAGYRQLAQNGPRTIVVSSDDGYDGAPDNTIFLFAPTGLVFYRR

SEQ ID NO: 25442 - protein, 166 aa, Pseudomonas aeruginosa
RWPATTGCSRTWPPATSSPRSSTSTASATTSCSSAAATSPANTACSMARATSPSSRGCWRKTASSGSSPMPPASTPWCWPTATTPSRRFPTARKWPTWAKESACASCRACVRRSTASRRYPGPTAPPTTSSPPRAPRCTPRPRRFPAPPASTSTPAATPPRPRATA

SEQ ID NO: 25443 - protein, 185 aa, Pseudomonas aeruginosa
RSTEEKRMAASGKLDLVRGDSHLAGNLLDGSLEGPLRIDEHDRPQASLGYRQGQLHGASTLLHPNGKVSAQLAFVDGKLHGPASFHAAEGWLQRKAHYRNGLLHGEALNYFANGQVAEREHYRDGVRDGVYQRFHGNGQLAFDGRYLNGQLLDGAQPFADDGRPLDSEGKPMARWRWWWTRLAEP

SEQ ID NO: 25444 - protein, 666 aa, Pseudomonas aeruginosa
LSPVPRWPETGRPPLPPASRRKRSGQLRRGAAPGLERLAGTSRPLRPRPAASRLRRLPVHRALASRLSAQRNRHRLDARRPASGGRGAGRRRRRLPRQIPGGRGDRHGVADARQRRTGGAPARRVERRQSATRPPGRPDPTAASGTAADRRWPVEQGNRPRAVDLSVHRARARFLAAARPGSEHADGRRGAGGEGRLLGRFHAAVPGVPAQASENAETRSLPRFSAKSPRGAEARRGGPVPSMRGAPARRPHRERRRSFSAEERHMIDRVKPLMAAWVLVFASSSFASETAGKLPRKPALGPETAGATLVIPGETDRLASLYARARGEGGKVVLWAGGDAPNQMDWLKTAFESRFPGVILDVTVDLSKFHDLRIDQELAAGTLTPDVAMLQTTFDFDKWKARDVLLRYKPVGFARQKKGYADPDGAYVTAYNNAFVPTYASVRLPAERYPTRFADYLKPAFKGKLVLTYPHDDDAVLYVYDKLERRYGSGFLRALAAQKPNFLRGTAAPAASVGTDSIGSLGNLTGYATDSDTPAGYFIPTDEPFIVWNQRAAIFKAARHPATAKLLLSYLGSAEFQSSYGGWRARADVGEAPGLPPLESLKNVDVHDFTRWMADRQRVASLRRHMAQIFGPVRGESPLRDPALMSLLGLTANDIVALPEPDLPIY

SEQ ID NO: 25445 - protein, 254 aa, Pseudomonas aeruginosa
PAEHPHPAHHPRPGRATGLPGLHFPIARRRRGRLGPPAGKLRPFQPVAARPAARRQHRPALEFRRLILFAARPSSRAACALPFPSIRCSRLSRIASRQQDVPADLADVGMAAEGHGQVQLAGYDLQRPRHSGLPQRAQPVEIGTADHGPARTEGDGLEHVLPGTDAAVEPDLDALAHRLDDRRQRADGRGRAVQLASAMVADDQRIGAGVGGQPRILGIENALEHQLAAPAPLDPFDVAPVQPRVELAGGPLGQ

SEQ ID NO: 25446 - protein, 239 aa, Pseudomonas aeruginosa
AHVVDALDVPDDVAETATPGAEHAQRPARLGGDVQQVGQGRPRRRRETVLQVLVALADDLQVEGQHQRVAAGGLGTVDQAFDEIAVAHHVELEPERLADFRGDVLQGTDAHGRQGVAHAELGGGAGGEDLAVGMLHAGQPGGRDGHRHGHLLAEHAGAQRAVLDIPRDPLAQLDRGEVVLVGAVGAFAPGTGVGVVVEHPRHALARQAAQVFDIGDDAHAVHSFGGGWMVERDVPPQAE

SEQ ID NO: 25447 - protein, 487 aa, Pseudomonas aeruginosa
STATSTLRWSWATGALRNCALAGSTAPATSAAWSTPCRKSCPWTWNIARTAASASAAVTPSSEPRLNLAALASYIWQCPACRSSGGGLSTHRPDSRMRRTRSTRRALLVAVCLSPLIALAAWQAYPFRSNSFDTVSVSRGSIESSVSALGTLQPRRYVDVGAQASGQIRKLHVEAGDDVTEGQLLVEIDPSTQQAKVDAGRYSIEMLKAQLAEQRAQYTLARQQYQRQQRLAAGGATRTEDVQSAQAQMLATQARIEMYQAQIRQAQASLRSDEAELGYTRIYAPMSGTVVAVDAREGQTLNAQQQTPLILRIAKLSPMTVWAQVSEADIGRVKPGMPAYFTTLSGEGRRWTGKVRQILPVPPKPLDQSNQGGGSPTSGSGGQSGSGRVVLYTVLVDVDNGDHQLMAEMTAQVFFVAATAENILTAPVAAIHDDGKGGQVAWVVGSNGKPQSRQIRTGISDRLRVQVLAGLEEGDRLLMAAPDGSDS

SEQ ID NO: 25448 - protein, 345 aa, Pseudomonas aeruginosa
PCANAPARSASAWPLAPARAISSASSSPRRRCSRWSAAWPGSPWPCASAACCCSARSRWPFPCRPSSAPSVARWSPAWCSASCRRARPPSWTRWPPWPANDGYVHEESLPDFRLPAARRLRQHAGAPRQRPGRAQPVALPGGRAQRCQRHPPVVEGLRRAGTGQPAATRPAEQPGPRRGGGPRTPGPGLGGDRRRAVAAGAECDARRQPAETPARLGLQRYRRDLRQRCRRLLLRRPQRQLRSGLLGRSPGCLPQCPGKPQGQRVRPRNGRADPALRRRQQLPAGIGAARTAAHRQAQPGQRRARPAPGGDPPCRGLGHRPGGRPAEQPGRQPAQAAAAARAAGP

SEQ ID NO: 25449 - protein, 250 aa, Pseudomonas aeruginosa
GADYPGHPDRRAGAGATGGRAAFRQPALAGDRSGPAERTAQPPSRYRQRRSATGRGPGRRAGGARGAVPQADPERLAVVRRQPRRRHFPQPLLQPGRQPARPDLQPRPPARRARPQPGAPGRTAGNLPQGDPHRLCRHRTLAEQHRRPRPPAALAAAGAGAGAARLRSLRQPLPGRRGNPADGPRNATHAVRGAGCRRATATGPPAGLGRPVQGPRRRLAERPPGSRAERLRPALRGPPPSLLALSPFSA

SEQ ID NO: 25450 - protein, 467 aa, Pseudomonas aeruginosa
VRFGRRSSALSISNLTGTAMTRTRTRKALYLGLPIFLILVGGGLLAWKTFGPSEAGYPRKVMKHAEELHERILSFDSRITIPPDFGTEGNEFDKDGPNQLDLVKAGRGRLSGAALAIFGWPEMWNGPNAPHKPTPGFVDEARHQQEIRYKILTGMVRDFPNQVGIAYSPEDFRRLAMEGKFAIVMSMLNAYPLGDDLSQLDKWAARGVRMFGFNYVGNNDWSDSSRPLPFFNDTADALGGLSPLGKQAVERLNDLGVIIDVSQMSTKALEQVAALSRAPIVASHSAPRALVDIKRNLSDHEMQLIKDSGGVIQVVGFPAYLRPLSKPTLDKLNALRARFDLPPLEGLDYALMPGDPIITIWPEQRFGEYASALYGILEEEPKAGLKELVDAIDYTVKKVGIDHVGISSDFNDGGGVDGWKDVSEIRNVTAELITRGYSDADIAKLWGGNFLRAWGEVQKRAKPTATP

SEQ ID NO: 25451 - protein, 410 aa, Pseudomonas aeruginosa
MESAAPAIRSRPAVSALRQLPPHLPPSAGAGGHRAPAGPLRPQPGRSGGLASRGNLEIRGRGSRLGRSLLRRATWPGGAHRQHHRRPGGDLRRPAGAAGQGDPDLLPRALLHLHHPGIPAQAHGYPGPRVPAVQGPAPGFRRRDPVQHRRSDPPADPGAGHDLGAVGQRREAADPRDRQAGARTQPEARRAGPDHLRGRRRAWFRRGRRQLRRLRLRLLHRRHPQVAVRPAWHRGHHRPLGTAPGAPGAEHPDLLPRRQLRHPDDPWRLPRLRTSPGPGHGLRAAPAVGQGRGPGAYPPAQRLPQAAPGRASQGPPGHADQPRAVFGLHLLPRRRPRLRGGRQTPDGAPGNQRRRGSRCRPGGAPGAEPAERRGGDRPGAGNPRPATRLTPFATQREPPCTHYRPWPWPH

SEQ ID NO: 25452 - protein, 155 aa, Pseudomonas aeruginosa
RTTPPGCRRRPASTTACSARPSASTAPAPAAPAPSPSRSTKARNTASPSTPTPTAPAMATTSPRRWAASRPTPSASTTCTATSTSGSPTAGTTTTTARRATAARGWRTSASWCRSAATTGASRRSSRARATATMRPPATAATGSASAWRANSDSE

SEQ ID NO: 25453 - protein, 555 aa, Pseudomonas aeruginosa
YIREATMTNPKRGAIRELLALLRPFRAIVAVSIALGMAGGLAITLLLASINNALHSENGLGQGVLLSFGGLCLLALVSSIVSDIGTSYVGQHIIAKLRKELGEKVLSAPIEQIERYRTHRLIPVLTHDIDTISDFSFSFTPLAIALTITFGCLGYLAYLSVPMFLLTVVAIVIGTAAQYLARSRGFKGFYAARDLEDELQKHYTAIASGAKELRIHRPRRYRMHTGRISETANNIRDLHISSINIFILAKTFGSMLFFVVIGLALTLQAYWPSSNPAAITGFVMVLLYMKGPLEQVVTILPIVSRAQVAFQRVAELSERFSSPEPHLLLSEQEAPDKTVDSLELRDVRYSPPAVEGSEPFHLGPINLRIAQGDIVFIVGENGCGKTTLIKLLLGLYRPQSGEILLNGEPVSAETRDDYRQLFSTIFADYYLFDDLVQGKQASLQNATQYLQRLEIAHKVSVMDGNFSTTDLSTGQRKRLALINAWLEERPVLVFDEWAADQDPAFRRVFYTELLPDLKRQGKTIIVISHDDRYFEMADQLIRLSAGKVVKETETA

SEQ ID NO: 25454 - protein, 820 aa, Pseudomonas aeruginosa
EEQSPMPAPHGLSPLSKAFLMRRAFQRRILPHSLAMALSLPLAGYVQAQEVEFDIPPQALGSALQEFGRQADIQVLYRPEEVRNKRSSAIKGKLEPNQAITELLRGTGASVDFQGNAITISVAEAADSSVDLGATMITSNQLGTITEDSGSYTPGTIATATRLVLTPRETPQSITVVTRQNMDDFGLNNIDDVMRHTPGITVSAYDTDRNNYYARGFSINNFQYDGIPSTARNVGYSAGNTLSDMAIYDRVEVLKGATGLLTGAGSLGATINLIRKKPTHEFKGHVELGAGSWDNYRSELDVSGPLTESGNVRGRAVAAYQDKHSFMDHYERKTSVYYGILEFDLNPDTMLTVGADYQDNDPKGSGWSGSFPLFDSQGNRNDVSRSFNNGAKWSSWEQYTRTVFANLEHNFANGWVGKVQLDHKINGYHAPLGAIMGDWPAPDNSAKIVAQKYTGETKSNSLDIYLTGPFQFLGREHELVVGTSASFSHWEGKSYWNLRNYDNTTDDFINWDGDIGKPDWGTPSQYIDDKTRQLGSYMTARFNVTDDLNLFLGGRVVDYRVTGLNPTIRESGRFIPYVGAVYDLNDTYSVYASYTDIFMPQDSWYRDSSNKLLEPDEGQNYEIGIKGEYLDGRLNTSLAYFEIHEENRAEEDALYNSKPTNPAITYAYKGIKAKTKGYEAEISGELAPGWQVQAGYTHKIIRDDSGKKVSTWEPQDQLSLYTSYKFKGALDKLTVGGGTRWQGKSWQMVYNNPRSRWEKFSQEDYWLVDLMARYQITDKLSASVNVNNVFDKTYYTNIGFYTSASYGDPRNLMFSTRWDF

SEQ ID NO: 25455 - protein, 173 aa, Pseudomonas aeruginosa
PSAASAPAASGAPAPCSPAGAASATPAATPADARHPPPSPPPRIPPVACRRPRHGPAPRHHVPRPDRRAPLRSHPVRYGSREPSPGGRYARCTRYCHPPGTVPGRRYGTAARRHRRGTGSARSGWHSTRAASGSRAPDRRDRCTARPPRRAAPGSGHGRGCTRTGPGWSRRSD

SEQ ID NO: 25456 - protein, 167 aa, Pseudomonas aeruginosa
NYWRLHAGPRLSRPRPVPVVARNPTARHDGSAGPDAADRTATPAPAARRPAGRSSTPTGAPFPPPPSSCAATGRSPRTGSAGLATPRRALGYRRHRAGPVPRPSPASTNRRTRCGAGPAPVHGRLRPVATGSPAAAAPVPGRMAAQRWPVSVRSGLLHRTVPARWKR

SEQ ID NO: 25457 - protein, 173 aa, Pseudomonas aeruginosa
PSAASAPAASGAPAPCSPAGAASATPAATPADARHPPPSPPPRIPPVACRRPRHGPAPRHRVPRPDRRAPLRSHPVRYGSREPSPGGRYARCTRYCHPPGTVPGRRYGTAARRHRRGTGSARSGWHSTRAASGSRAPDRRDRCTARPPRRAAPGSGHGRGCTRTGPGWSRRSD

SEQ ID NO: 25458 - protein, 226 aa, Pseudomonas aeruginosa
TGHHDGFAEPGAAGRTATPAPAARRPAGRSSTPTGAPFLLPPSSCAATGRSPRTGSAKPAALPRALDYRRHRAGPVPRPSPASTNRRTRCDAGPAPAHGRPRPAATGSPAAAAHAPGRTAARSSSRPAERGRPPRAAPTRRYPTAMPWMRRSPGAPRRRRGENGCVGSRAAQPGCRSCVAGHPGPAAHVDARHSGYGRPRFPAPVARETTVAPGHRRAAGARRPGA

SEQ ID NO: 25459 - protein, 618 aa, Pseudomonas aeruginosa
  UNSURE (272): Identity of amino acid at the above locations are unknown.
AANDLGGQQRVAAKLEEVVVEPDLLQLQDLRPDPRDLLLQIASRRHVDLLQQARIRLRQALAVQLAVRRQRHPRQEQQVRWHHVFRQALAQRRLQLRPALRLRFRRIRDRRRLRHHVAHQLLAHRTRLGHHHRLAHRRMLAQARLDLSQFDAEASDLHLVVHPSEVVHHPIRTPTGQVAAAVQPAARRAKGVRHETLGGQRRTLQVAARHPFPAQVQFARHAYRQQVQLPVEDVAATVAQQRTDRHVCRAAGIARPCFPQQRRHHRLGRAVXVEQVLRLQRPPRQVIAGLRHRVAAEAIHPYRRRIAVALGMLGQLLQVHRREHPHRYPVAMHLGVGPFRQPQAVVADQHPRAVDQRVHPAFVGTVEGERHEVQLAVLRGHLVALAGGHDMGDQRTVGHRHALGHAGGAGGVDHIGQVVAVQRHLWIMSGEAGPLLLAIHGQAGQPLGDRQTLQQVAMGQQQVRATVLHHVQQALARVFDIQRHVGAAGLQHRQERHHDLRAALHGDRHPHFGADASGDQRMGQAVGPAIQLGVGEFFLVEDHRHRIRRHTRPLGHSLVYQRRCRIARIAAVPELPDDFALLAVEHVQLSQASVRHRQDRIQQVLPMPYQALCGRSIE

SEQ ID NO: 25460 - protein, 63 aa, Pseudomonas aeruginosa
VEGPGHLRFDCRPERRVIDIRQAMPGNLQLPIGIHHLNGTQAFLAEAGTQRLVTLCEALETAL

SEQ ID NO: 25461 - protein, 673 aa, Pseudomonas aeruginosa
RLADRTGIAHPGVLGGTIEDAGHHRGLGRSIGIEQPHPAHAGLPPELRPLQWHGFATDVDLPQGTVGTPWLGQGIEQEQVPVRRGQVGKGHALLDYLPIQLTGIPEVAATQDHAGTTGQRRIELFDEAVEAQGGELQYPILRGERGITTGDTRELRKRRMADGHALGFSGGAGGVDHIGQVLRPQVHHRIIRRHRCVPFQAVDGEHLQPFVQRQPGQQMLLAEQQADGAVLEHVTQTVLRIGRVQRHIGTTGLEDRQQTDHHVQRALDGDSHQHIGTDATRYQAVSQTIGAGVELGVAQRLPLQRQCLRLRTQTGLLLDLQLDQGRQPTLVGVLCPGPQQAIALLVQQQRQLGDRPARFGHDAAQEILPVPSQALDGRGLEQIRGIAERCPDTVLGLVHVQRQVEGHGAAPPLHPLQRQAWQLHALVGRTRVGLVIEHDLEQRVVAEAALRLQSLHQLLERQVLVRLCLQRALAGLGQQLVETHPAIDVGLEHLGVDEETDQPLGFNPVTVGDRHADTDIRLSAIAMQQRLEGSQQQHEHGHTLALNQLFQGKGQVWLQLQVQLRSTIAAQRLPRVIEGQLDHRLLAAQQAGPVRQLALLFPRLHPAALPQGVVRVLDRQGRQPHVEPLAIGGIELDQFLDHQLHRPTVGDDMVLDHDQHMLVGVHLQQSHPQ

SEQ ID NO: 25462 - protein, 674 aa, Pseudomonas aeruginosa
FAHEFTKVIEIGVIAGSLRRGKLGIGLQRLGLEQRRQRQLHADLALHPGSHLDRQQRVAAKLEEVVVEPDLLQLQDLRPDPRDLLLQIASRRHVDLLQQARIRLRQALAVQLAVRRQRHPRQEQQVRWHHVFRQALAQRRLQLRPALRLRFRRIRDRRLLRHHVAHQLLAHRARLGHHHRLAHRRMLAQARLDLSQFDAEASDLHLVIHPSEVIHHPIRTPTGQVAAAVQPAARRTKGIRHETLGGQRRTLQVATRHPFPAQVQFARHAYRQQVQLPVEDVAATVAQQRTDRHVARAAGIARPCFPQQRRHHRLGRAVAVEQVLRLQRPPRQVIAGLRHRVAAEAIDPYRRRIAVARGMLGQLLQVHRREHPHRYPVAMHLGVGPFRQPQAVVADQHPRAVDQRVHPAFVGTVEGERHEVQLAVLRGHLVALAGSHDMGDQRTVGHRHALGHAGGAGGVDHIGQVVAVQRHLWIMGGEAGPLLLAIHGQAGQPLGDRQTLQQVAMGQQQVRATVLHHVQQALARVFDVQRHVGAAGLQYRQERHHDLRAALHGDRHPHLGADASGDQRMGQAVGPAIQLGVGELFLVEDHRHRIRRHTRPLGHSLVYQRRCRIARIAAVPDSADSAKLRLLEHLQIDQTSLRMFGECLQQSRQVATQALDRSGREQSAIVAELQ

SEQ ID NO: 25463 - protein, 1104 aa, Pseudomonas aeruginosa
LVPVLAIGNRLFEEQPLERQQHRLAAHRPLLHLHRSPYAGDSRQPLYGLLLEQVLRSELDARRTASTHHLDRNDGIATQGKEVVGGAHLLQLQHVRPDGRDTSLHFILRRNMRLPRSSLRSRQRLAIQLAVRTQRHPLQRQPLRRHHVFRQARRQVRGQGFAPVAALALQHHVADQLPAVHRQHRRLAHPRMLQQARLDLAQLDAQAAQLHLVVDPPGVLDHPVGAVARQVAGAVHPLPSHERAGDETLGSQPRTLVVATGQAPTGQVQLAEHAHRYRLQVAIEDVAGQVGDRPADRHRVLALLHAGPVGDVDGRLGRAIEVIEAGLRQLGEHLLLGVRRQRLAAANDAFQAGAGGDVFVLQEGLQHRRHEVQRVDPLAIDQLHQLRRIAMVARRGNHQTCPAHQRPEELPDRHVEAERGLLQHRVADAQAVGLLHPAQAVAQRRMAVAGALGLAGGAGGVDDIGEVLAIEMNIRVRLTVILEPGRTAIQVDPLHALRQRQLQVRLAEQQLHAAVLQHVGLALLGILRVHRHVGAAGLEDRHQGHDHLDGTFHGHAHQAVRTDPALDQGMRQAVGPAVQLGVVQALLAEGQRRRRRCALDLLLEQPVHAALQRVLGRSGVPAFQQLIALLGIEHRQRVDAGLRVFQHAAQQVLPMPRHALDGPRLEQVGRVGQRGVQATALLVGIQAQVELGGTALPVELAEAQAGHAVQRLDVGHQRLVVVHHLEQRAVAQAALDLERLDQAFERQILMGLGAKHGVLEPGQQGRHRRAAVEYRAQHLGVDEQADQPFHLGAVAVGDGDADPQVGLPAIALQEDIEAAEQQHEQGQPLASGGAAQGLGQGRLDAELVTAATVAGNRRTRVVGRQLQDRMPLAELAAPVLQLALLLTGLQPAALPQGVIGVLDRQGRQAGLRASRIGTVETTEFFDQHVHRPAVGHDVMQGQQQHMPLLAQADQADPQQRPLAQVERLQRLALRLLAQAGFLLGLRQAAAILEGNLQRALQGRLRQAVVGAAREHRTQGFMTLHQAGEGALQRLAIQRSVQAHRAGQVVGATLWLQVPEEPHALLGVGQAVALGRRHAGRKREQREIDSLPSQGFEEDPTLLNG

SEQ ID NO: 25464 - protein, 101 aa, Pseudomonas aeruginosa
TFIRGKIETTRLLSDRTPLQFVTESMRPLHTGDFGGIWVKLIWFVFGLLLSMMVLSGLLIWSKRTAQATAALVKRGKRPARQPKPAKPAPVMANQTAEGQP

SEQ ID NO: 25465 - protein, 300 aa, Pseudomonas aeruginosa
TNEVSNEHPHPPLAPAPGRPVARPERRGPGAQPDLRMRGSAGRRDPLQGRLLRRQRRPRRNPRRDRLRRADPGSRQARRRLDPDLQASRRRVLRAVRRRPRPRGGNRPRRHRRAMSVETVRPAGAGHETLYVLLGSVLILALAATVVGLRQQSHEAQALDAHQVDARLDLNAAEQGIYADLQVAAEDIQARLDDGEAAPSVDELAAEGFPPFVADIAASSRGEHRWSHGETAGRPSYLGVSGKPEVAGSFLLLLGPAEVWLKPAAAAAGAVPGDARALADAGWRQVVSRFDAGVTRQHRH

SEQ ID NO: 25466 - protein, 510 aa, Pseudomonas aeruginosa
RARAGRTERRRQEFAGQDPARADAASRRAAPGVARRARLHRLRAAGAGVRPRPAAHRRRFHGRHVPAPSGFPRPVAQPAPGDRRGPGTGRHAGQARSAHGRPLRRRAPARAAGPGPGTAAATAGAGRTDVGPRRGRHPGLRAAAAGLAPGRRHRALDRARPGGRRPPRRPGQRSQPPPAVRRSGGQQPDPGTPAHAVLHPAPEERGGQPMNDAYEQLRQAVQAWAAAGYLPETLAYGFVVNALLAGLLIGPVLGGLGTLVVVKRFAFFSEAVGHAALTGVAIGILLGEPYTGPYGSLFGYCLLFGVLLNYLRNRTGLAPDTLIGVFLSVSLALGASLLLVLAGKINVHILENVLFGSVLTVNGHDLAVLAAVAVLVPCLALPLYNRIMLASFNPQLAAVRGVAVKSLDYLFVALVTLVTVAAVKVIGAILVGALLVIPAAAARLVSQSLKGFFWLAVLIATVSTLAGILLPIMFDLPIPSGAAIILVAGLAFGLAAIARGCLPHLKGTPG

SEQ ID NO: 25467 - protein, 180 aa, Pseudomonas aeruginosa
SAAAGSAPRCRGGRPVRGSGRASGTRAGPARPGRRRSADDRGHPPRPAGRRSRPRASAPDRGYRPVADSRAGGCAGARPGARPWPPRGPPGRVPSGSASPPNRRPWPSGCHGRCRRGRRAAICPAIRGRPPPPAAGCRRWPWTAPPRRGRCRRARRRTSCRYGRSRSGSRRRSAPPRPAR

SEQ ID NO: 25468 - protein, 121 aa, Pseudomonas aeruginosa
APRPAASSVRDCPSAPARPGSCRGSRPGTTGWCCARWRCVPVSARLPPRRCRSGRRTGSSPRRPAPAAAGRTGPGRTGPSPGWSGRGCAAAARRPEPGGSPRSPPDGCAPAPGCRRRPGNR

SEQ ID NO: 25469 - protein, 202 aa, Pseudomonas aeruginosa
SNRFTPRHARGLGPAPAGGLQPGPGAYPARVLGLAGRQRRTRDRPRRSLSRAVPGGAGKPAVQRPEALRRCAPAARACTDPRRLPAREGAARLRPARLRRPQLRGVRQRRDRPAGSGCRSRQPHQRPVAGVDPPLRAGAGPQQPAAAAETLRGPRRTLPRGVLLGLLLHHARPCGERAAPTGARHARQLRLPDRYLRAHSQR

SEQ ID NO: 25470 - protein, 326 aa, Pseudomonas aeruginosa
HTAPGVLPGGSGDRRARPAAPRGRGLSRPAGRRGKRLGLLLPLAGRRPRTGQHPHHRHRPGGPQRPALPSRTNHRQGLRQQRAEGLRARLRSPRGEATTGHRRPPLAPGGLLRRLRLATPAAHRADQRRQPLPAIHRAGLRRTRRSYRRQRRRPTAAPGRTGHHHPCQRPAMGRAERLGTLAVGRRTGPARLRPGRPGGRHRPAIPRPGAAGLRPRRKTGGEIRHQRQPGRRRRWRVPVAGRLRLVQRRDPATAPTLQPGRRSLSLSPAPGTGAARRRRSLRRESRSARGPKATARAARGTLPPPCLPPASTPAAPAPAGARPGRD

SEQ ID NO: 25471 - protein, 281 aa, Pseudomonas aeruginosa
  UNSURE (97): Identity of amino acid at the above locations are unknown.
AAARKSTRPSRTSRTGASSAPTEVRPPTTWPAQEARARPGFARNSRTTTLQEEMEMSAPANFNGQTPKIDPANAAMLLIDHQSGLFQTVKDMPMTEXRANATTLAKVATLAKIPVITTASVPQGPNGPLIPEIHEAAPHAQYVARKGEINAWDNPEFVAAVKATGKKQLIIAGTITSVCMAFPSIAAVHDGYQVFAVIDASGTYSKMAQEITLARVVQAGVVPMDTAAVCSEIQRTWNRDDAVQFAEAYSAVFPHYQLLIESYAKAQAVVNNHEQLDSQRK

SEQ ID NO: 25472 - protein, 499 aa, Pseudomonas aeruginosa
SMGRKGLHAPSFAEQEPGGQQRLRTGPMPDSSMKRGATLCLALAIGPGSLLADDSLGHRDNISTGLNQRQKAEMKVPPGFVEGSTLNGFIRNYYFARDNHDTPSRRDQREWAQGLMLSFRSGYTDTPIGIGLDAHAFYGLRLDGGGGSGGAGVLPLDSAGRPADSFSAAGAALKLRGLDSLLKIGDQLLENPVIASGVSRMVPQSYRGVTLKNYHFRALELDAGFVEATRLRNQSGHSHLTSGYGNGTKGGIAADRESPHIAWLGASYSAPGGSQATLYSGRLADIWNQHYLGLSQPWRLSSQLTLTPWLHYYKTRDQGRSQLGRIDNDLYNAGLTLAGGGQSLSLSLQKVDGDTPFDFIAQNDRTFLYESNAMQYADFNGPGERSWKIQYQASLAFLAAPDWQFGAAYGRGQADLTRVDPDSAGYGYLYNPNGKNAQHWERDLSLRYAFPAGPAKGLSVTLRWATHRPGEGYTAPGNTRGNSSSDEYRVVVDYPIRLL

SEQ ID NO: 25473 - protein, 317 aa, Pseudomonas aeruginosa
THGTRKKRNSLMRAALLPTFGALSAALCLEARADAVALPPLALGNASFMDGVSRPGMLFELPLQYVRANNASDAGGHSVPGRQRVRGTMLLPHFAYLSQNTLLGAHYGAEVLLPLVRLDLDIDGGPDGRRTRQGDLIVSPLMLQWGPATLFGRPYWQRLNFVFSLPTGDYDKDAAINTGSNTWIFNPHYAFTWELGERLELSGRLHYAWISRNDDPSPRLGANDVQPGQALHANFSISYALDPHWRIGLAGYQLKQISADRIDDHRQADSREQVFGIGPGVMYSQGRQTLFANLYAESGARNRSEGNQLTLRYLLAF

SEQ ID NO: 25474 - protein, 326 aa, Pseudomonas aeruginosa
KSMEQAPSPGSGACATMVSPLRTSGAKRPDTRITDAPSQEPLRALHRRHHRHAADPSGTGSGRWLLSAHARPPAKPRRRPGPALALRRTATAAGQRQHDPGQLAGDARRHRRRARRRPRRRAAPARHRHPGLQRRGAVLPAPRPADPGAADRLHAAGRRAGQRCLGQPGRRPARPPGGPRARRTGLFQRCPAARRAGQQAAQRRVRRLRRTAATAPRRACAGARGARLPPAAPGSEPRRAAALSRAARRAPARAARQRRGSAAAGMLWQRHRPRPTTRSCWRCCAKPTPAACCSPRSASAPTARSSSAFTPPAAACATPACSRLAE

SEQ ID NO: 25475 - protein, 436 aa, Pseudomonas aeruginosa
PARRPWASFSACSAPASDATKRNAGSPSTCAARTPTDRPAAARRRPLPSALPAIRDNAGGPPVPGAHRQASANSVSGLPRFIPRRRVHRMSPSAAGPAGIRPQGGNTCMYAIAEDTLPARVLKELLLYRRRYPEHRQSASEADEIRRIEQVQLPRIAAFIEAGEPIEFVLPAFPAKSPNPGKVLDSRPDMAERLSLSFLNHLCQRIQLFYAPGAKITVCSDGRVFGDLVRIGDAHISAYQDALRLMIEEIGATHIGVFNLEDVRAFEAQRDNHEQLRQLLIDGYAEPLESIRETLLASEEGLLLYRAITRFLYEDGLTPDYQGSKTALQRDAKERAYGVIQRSWAWGALLADQFPRAIRLSIHPQPADSLKFGIHMMPTRDDWLTPWHGVAVNTEDRFVLMKRSEVLELGGELVQINGQPSHYRLPARAARRAAVA

SEQ ID NO: 25476 - protein, 281 aa, Pseudomonas aeruginosa
SGTPPAASSARATRSMRAIIPAMPSRSASTRWPGPAVAGTWPTARRWSSAAWPTTTSTAGCGGPGSMTERKRWLAGCLSALLSLPLAAAVPGPDAPADLARGKAMAQKMCSRCHDDDGNGGPRPNRSYPKLAGLDREYLYKQIYDLKTQRRRNPATNGRGEELSAADVVNVSAWFAAQRMSAGEQTLADPRQRERGRQLFEGGLAQRGVPPCVTCHGPAAQGLAALKAPRLAGQWAEYLATQLHGFRDGKRGNSATMRAVAGGLEDSDIQALAGYLGSLGP

SEQ ID NO: 25477 - protein, 322 aa, Pseudomonas aeruginosa
NETGFRGSPMSLHPVSISLSSYGADLVRSRGQASFLPLLAMAGAQRVELREELFAGPPDTEALTAAIQLQGLECVFSSPLELWREDGQLNPELEPTLRRAEACGAGWLKVSLGLLPEQPDLAALGRRLARHGLQLLVENDQTPQGGRIEVLERFFRLAERQQLDLAMTFDIGNWRWQEQAADEAALRLGRYVGYVHCKAVIRNRDGKLVAVPPSAADLQYWQRLLQHFPEGVARAIEYPLQGDDLLSLSRRHIAALARRRPAPGGTPAWLTSRSSASARPWPCSSPNSPANWTGSSSSASASPAPTATSPSASPASASRWPG

SEQ ID NO: 25478 - protein, 347 aa, Pseudomonas aeruginosa
SPRSTPSPRMPTGSCRAWRKAACSAAGRNPRISPRSTWTWASTRWRSSSARAAPTIAMPTAKGWSPACRWRPWWTPWAPATASRSGWSARCWKACRCPTRWRAATGSAAARYRSAATWRGCRNAANCSTASAARAPEPAAHAAPVATRTRQAQEIPDHDHASPRQQPLVVHHADRFRHLQPGLPGPRQLRLRRRLRDGRRPADHPRAVLAAGRAVLPRLLLLPGAGGDLRGKAQRQEADLRQPDPLGRAGHPDRDGRQRLPADRHPLPPRRGRGGGDAGDAGLPLPLVHPRRALAGEYLPDPRQPGDHPLDVGGLRLPGGAFQLALDVHHRRPAGGDLGLHLVAPGG

SEQ ID NO: 25479 - protein, 200 aa, Pseudomonas aeruginosa
PEAPRRRTLRSELPPPRRAARGIRLRLPDPAADRRHRRPDRCRAVRPDAPAGDLHQHLPWPGGRRGGPDRGPGPAADPRRRPRRVRARAAVSRLAAAAPAERGGHPAHRLGHRGNPRSHGPLRGGQPAGRPRRRAAAEPGQSFGLGATARRLKAAPGRRPARRSASLAGIGPPESLLKRFFNVTHELIISLLIIIRKTKP

SEQ ID NO: 25480 - protein, 244 aa, Pseudomonas aeruginosa
SREDPTMPDDKAVNGRRDFLRKTLTVIPAVTLAGYGVGHAMQTPAAEQDKPRERYQPRFFTNTEWAFVNAAVARLIPSDDNGPGAIEAGVPEFIDRQMETPYGHGALWYMQGPFVTDAAPEFGHQLKLVPRDIYRVGIAALERWSKANQGKPFADLEPSAQDDILQRLEAGQIDLQDLPAKLLFGQLLQNTREGFFSDPQHGGNRGLVGWKLVGFPGARADFMDWADRGEKYPFPPVAISGERG

SEQ ID NO: 25481 - protein, 751 aa, Pseudomonas aeruginosa
  UNSURE (339): Identity of amino acid at the above locations are unknown.
RWQAGHRRDLRRRPGARDRAAGEAGDHQCLPVPQRAPAAALRHRQALRPAHRRGRGGEELRLPEHGHHQGVFRQGRAYQPLCRHRRRRRGGGRLQRRQLRPRTAGLRRRLADVGQPGRLQADRRPRRAARHAELGQRLETGGQGRLHAHRVDGRPRQQHDLPRQIVRHRPDLQGRLRPATVAHDLRLEGQRDPHEPLRHRAHAQDRRSDEPEGHLGERQELRRPLQYTGLPDHPPARRGDHGQRSEDQRAQPLPAELGRAQRLRHGRLGLPPGHRLQPHWAGGGAGLLVGQGDPRAIPEEPRSAGAGMRSATMKPTAFLAFSAFACGIAQAAAAPDPAXVRQGEYLARAGDCVACHTARDGKPFAGGLPMETPIGAVYSTNITPDRKTGIGDYSFEDFDRAVRHGVARSGDTLYPAMPYPSYARVSEADMRALYAYFMHGVEPVEQPNKASDIPWPLSMRWPLAFWRWTFAPEVKDFQAAAGLDPVLARGAYLVEGLGHCGACHTPRGLGMQEKALAASDGAAYLSGSAPLENWIANSLRGDHRTGLGSWSEADLVSFLRTGRSERSAVFGGMSDVVVHSMQYMTDADLTAIARYLKSLPPADPADQPHVYDESVAQALFHGDDSKTGAALYVDNCGACHRTDGKGYARVFPALAGNPVVTGSDPTSLVHIVLKGGTLPATHQAPSSFTMPPFGWRMNDQEIADVVNFIRTSWGNQAPSVSVDEVRRLRKDTGAAAVGDIPPPGPAAADRG

SEQ ID NO: 25482 - protein, 356 aa, Pseudomonas aeruginosa
QVGRDRRQAEAGAGHLGDRQHAVAAVGRQHPRIVSTTPDHARVVGKKIVRGDPVQHGGLRRVAALQVAFAGAEHVAHLAEVAPDQVFRRRAGHAQGDVGVAPAEVGKVVGGRQLQLQGRIARHEARQRRQQQAMQDGVGAGHAHGTAEHLALQFEADARRLQRLLRQFRLLRQTAGGLVRQVAAAALVEQCLAEVLLQPADGPEDRRHIDPEQLCGPRQAAAANQGEDQGKIGMVQAILQRCIHLLHWRRYRVRKRNYRVSARARQPAWRNWSENGCPPLPRRRCALPWSATTTRTSPPTGRFPWPCAWPARHSAWRSHSTGWPATACPPSRRWSAMTGSGACRAAPIATPTRCCA

SEQ ID NO: 25483 - protein, 154 aa, Pseudomonas aeruginosa
SSAPIAAPSTTATPKRPSACWNWPAASRAISAWSRSAAPTVSASPSPTGTTRRRSVPGAATRSTATPRRAAGATGTPVSARGSPGSNANTPSRLSRTPRSLRPRPEPAPGSRPGPAARPASRRRPRRGNRWRRRSPPPPNRPAPSPRPCRCPAR

SEQ ID NO: 25484 - protein, 117 aa, Pseudomonas aeruginosa
CSTPRPSPIRRKTPCAASASPGTARSSAPVPWPACSASPRRARRTGRARHSALDSAYTATARSSPGRWPARPGAAPGPGRSGPPGAIPAARARHCRTRRWPPRYRPASSRHAPGKAW

SEQ ID NO: 25485 - protein, 205 aa, Pseudomonas aeruginosa
SPFATRRPRMARKPRAEMIEETRAKLIDAARRAFADNGYAGASMDELTASAGLTRGALYHHFGDKKGLLAAVVQQIDDEMNLRLGAILAAGEDLWSGFRAYNRAYLEMALEAEIQRIVLRDAPAILGSPSSEASQLRCLSSMTGQLRELMDSGRVRRTDAEALAWLLNGALVDAALRIANAEHPPESLARACQALDVLLDGLLME

SEQ ID NO: 25486 - protein, 174 aa, Pseudomonas aeruginosa
KANGLPHQNQPRRGRRAAPGHRALSRGKLPPAARAGLDRRRRGRRGGLPSPPDRARQPLAGGRRRWPAGRFPRRRTLRRRVAHRRVVHRPGPPATGPGPPPAGARGDLRPRQPLPGADPDDLLRRALERAVLRTPGLPAADLAGSRRALARDPRPRAGDRLRPADSRCAMRLVL

SEQ ID NO: 25487 - protein, 609 aa, Pseudomonas aeruginosa
TAAKGLTGGWRVTVQLPTATGCFSTAPDGLPLSLFPSVPLHEQSTPKLPLHPCRHPVRPRLPGRLRTVGLSPGPRPRIPRRPGRPSLDPRPADPGHPRHDHRPQRRAAGGIHRSRVDLVQPQGNGRPPRRGAAPGRRPAPPRGAAAGPAPGQPEQALPLPRARPVADRGQRGDGPGHNGGTPDQGIQAFLPQFRADRAVDRPGQHRRPRPGRHRTGLQRLAERQGRGTRGGDQPARLAGQQHQGAEDAQGQPGRGPEHRPATTVHRLQGAGKGRAQVRRALRLGGPGEPEERADPGDGQLPLLQPEQPRQLRPGLHAQPHPHRYLRAGLGDQAVQHVGGAGLRQVRREQSSQRGTGLDDHRRAHHPRRRPARRTDHDRSADQLLEHRHEQGRPADRTQADPRTARPGRFRRAAVAGLPRREPGLPAVPREMVEHRHRQHVVRLQPGGEHRRAGPGLLGVRQRRQAGAAQPAPRQPAEPGAPGDGPADRTAHPGDAANRGGRPEGRGPRPRAGLPRGGQERHRAQGLGPGLRGQVLPFAVRRHGAGVRPATGAGGDDRFADQDRLLRRPGLGAHLQRHHGRIATRPGDPAGQPAGQPGRRRPPAPRLTAA

SEQ ID NO: 25488 - protein, 463 aa, Pseudomonas aeruginosa
PCGPTATGCKPTQRACATWTAARSAPPPAANSASRPMLIAFAIFLFTLVLVIWQPRGLGIGWSASIGALLALALGSVAPGDIPTVWNIVWNATATFIAVIVISLLLDEAGFFEWAALHVARWAGGDGRRLFAFCVLLGAAVSALFANDGAALILTPIVMSMLLALRFSPAATLAFVMAAGFIADSASLPLVVSNLVNIVSADYFGLGFGEYAAVMLPVNLVSVATSLLVLFLYFRRDLPPVYALEQLKPPRAAIRDRATFIVGGWMLLVLLAGLFALEPLGVPVSAVAATCAALLLAVAGRGRVISTRRVLREAPWQIVVFSLGMYLVVYGLKNAGLTDLLAQLLNRLAEHGVWAAALGTGLLSAALSSVMNNMPSVLLGALSIQASDTAGAVREAMIYANVIGCDLGPKITPIGSLATLLWLHVLARKGMRITWGYYFRVGALLTLPVLLATLSALALRLAI

SEQ ID NO: 25489 - protein, 242 aa, Pseudomonas aeruginosa
AGAHRLALTGGSMSEQLPNLDPALLGDPPPVSGHRPRILLLYGSTRERSFSRLLVLEAARLLERFGAETRIFDPSGLPLPDDAPVEHPKVRELRDLVQWSEGQVWCSPERHGALSAVFKAQIDWIPLALGAVRPTQGKTLAVMQVCGGSQSFNVVNQLRVLGRWMRMFTIPNQSSVPKAYLEFDEAGRMKPSPYYDRVVDVMEELFKFTLLLRERTDFLVDRYSERKESAEQLSARVDQRSL

SEQ ID NO: 25490 - protein, 469 aa, Pseudomonas aeruginosa
FPWRSTPGPPCRPSGSTRPCATNSSCATGAPRCATTRTPPVPFPVTCSVRPMASKVIFTSSPKTPRPSAATILGWLCAAGWPLSASSARWRRRWSRPPCWRDWNTTGAARCARKPTCSATSRRPGGASVDWSRCTLACWSPPWPASCSTKRCGATATGTATASSPWLFSLPLWLLFLGGLLMLRRLRGELLPLEEPVLHLLGRELDRVAAPGLWQWLGQIADRAGAPLPDHVVTGIEHCYFVTQAKVLLAPRGIPLEGRTLYIPLTYASVMSEAESAAIIGHELGHFAAGDTAHGASLSLLQRQVRLRIERIAAPEDGRVGLLGKPGLWAALYFLDRFERAYLHWNRRQELAADKVGARVAGARVFAIALLRTCALAGLIERLLASPQTRNLVHALTDHLRGNSLELDEHDSARRLEHPFDSHPPTYQRIADLSLALDDDLLRQARRIVSADDTQWLNRLLDAGHGESR

SEQ ID NO: 25491 - protein, 411 aa, Pseudomonas aeruginosa
  UNSURE (187),(229): Identity of amino acid at the above locations are unknown.
SSNCTARRYRHHPRARSIRSPRVPSANAGTAHGFACCPPAGASTVATCRYWKPRRSSTSTWTSPAPRPGSANWARSRPVLPLHSQLQGYFHEQPGTPGPRLQPRRNPRCRTRRAEPGEDRRGHRPPGAGDRQRTAGHRVHQYPQVRGAGSAAEHRALHHDRHVVLPGQAGGRRRRLAARPVRAVPRXPASQLRQDPLHAPDPYPALGRQPVGSGRAGRRHRFQRQGRHXANHPDPPPAARNAAADPSRRTPGVRLPGHGLQRQGPAHHHHVGRPAERWQEAGLRRHGGDPRRLHPGRPRPALPATTAQPGLSEGHGPSAKAAALPGAGSSAAGGARRLAVLARRAAGRATGRRAAAGRARARRSAGAAAEGQRPGGRPGLCARPGPGAARRATRRHTKRTAPESLRRRPRR

SEQ ID NO: 25492 - protein, 406 aa, Pseudomonas aeruginosa
  UNSURE (153): Identity of amino acid at the above locations are unknown.
RSLPGGAGRRIGSRLPGRHRRRRTQRTALASLPAPVVRAGPTPAALPAPRPDRPARPGPGLCRNVRDPRAVAGRPGSGQRRTHPTERGADPSRPAGVGVANAGEDHPLAPAPGAGPGCHRPPAGRRGCTGTLDATARAGGAPRHASPAAPVGXSRPGLLRDRQPRLPATFRRASGRTQPIPLATVAGPAGPRRTECSDRSRTGPLRRPRRPLQPALPADLPGRREPTGRHRGAGSQRLRTCGTGTGATVGRVLPRTFRPRREPLEPPARIRRRPPRRTTGRCAGDGLGHAAQRGGRRADTGVPRTLPARSGARAGQPGGRHPRLPGPVRPGSTGPRGGGTPGPSAGYPPSAGPALHGAGRELRTHLGRDRRPGRSDTTAEPGAGRLVRRPPGVEPSAQRRPARQDL

SEQ ID NO: 25493 - protein, 150 aa, Pseudomonas aeruginosa
STGTSSPAIASAPCNIIAHPGATAAGPEASNAQAARWRCQSTAAFRRATTLRTKSGSSATQSSALTHSGQPVPWRSRAPSRRSTSSRTARSRRSLARLRDRWRRRQACFSRSRARRRDSGSSARLWLMIGAPCRASRRFPITVHSYSNRN

SEQ ID NO: 25494 - protein, 493 aa, Pseudomonas aeruginosa
IRLPWLRRRGVLALVAQRAELDAAEHLVERAAAPHVALGQRRAQQVEVGTRLGRRGMVALHRALRRRHFADRHDRRAVAAVQHVQAALLGRRDQRRLDAIGGLQVEQGRLAADVHVPQVVVGELVVPAQLAGVQVEGHQAGAELLGARGAVAAPLVGHLVAQRQVDLAELLVDAGQRPHVRRVAGIELAGSQGLGLVRVAAVPVPHQLAVVHVEGADHPGRLVGRLVVGDVAADDHQIAGDRRRRCGVVAARGERTDAGRQVDRALDPEVLADLAVVGVDRDQAGVGGGQEQAPRTTGGDRLAGLGERGRRRADVAPGVLLFVVVGDATASHVGEALEAYRALDLRIEAPDFCAGVRVEGQHLAVRGAGVEHAVDLQRGVLVGQFERIVGGRQVAGTDAPGFLELADVGRGDLLQRRVAVAELGAPVGLPVAVRHRRGGAGHAAVAVDATDDLPRIGELAAHRGGAGQDHRHAQRRGAQRRRTVGQQRAAEPG

SEQ ID NO: 25495 - protein, 551 aa, Pseudomonas aeruginosa
RRTLAQQQQQSAQGQADAGQQVVQRAAQARQLDAAGQQRQAGQQDQQAEQARQQARSTAVTFAHRPVLPSGLMTGIAYSPITFCTPGCSARRAALGCAEEMAAGHDRIAVVRSNSLEHRLDLDPRHQRVVDLVDPARLLDVLQVRPHRQPVGHMHPVVQLGVVLGVLQRLVQRVVVVVDAVHLVHQALALLHIVVDMDARDAQADVVLRPRVERPLVDHPELLVVVHHVGRLVVDRQVGEQAQPARGIAVVRSDLLLRHHPPAMLAAARLEVVAGQPLRLAVDVVVDVIGLRRAVVVAQPVLARQLLGADLRLPDQLHRQQRALGPAAAHLEAVAGLQVRRVLLVGADLHVPVRREVVLHPQRPLADRPVVPDAPRPVAHLRAAEGQVLEIAGEAVEVLALAETAEFHVQRAVEVLLLEPQLGQPPGLPAAPDLLHRADVPGTRVADAVVGKVLAVALGDGELELGSLPAEDLLQVHVHAQGELVGVAPGLVVVIAAVEVGRRLADVLQLEVVALLQQLGALAAPVAEHPFRVRRERLGGVHRVAQQGGGQ

SEQ ID NO: 25496 - protein, 289 aa, Pseudomonas aeruginosa
PCRRISRRRTPCSAATIRPRRRCARHCAQGQAARRRAWSIRLTAPSAHSSISQPSLAELRRRSGGWVMPAPAVAPGRYAPPCAPRDRRRLRRPARPGPRPGPPVRRGPGRPPCAGCRWDGRAMLPAPPAPAGGASARAPARRAGGPASSRPPGPSAAARRPPPGPACQGSSPPLREPAIERPPAPRRAPAAPSPRGSGRGRRWPPGVPPGRHRRWPAWPVRPGPAGGGASRAPPPPRGAPPPADRRGRPGPARRSPPGAVRATHAIRWRGRRHRHARATAAGAARRPVP

SEQ ID NO: 25497 - protein, 421 aa, Pseudomonas aeruginosa
VRQGSARRHRPPPAPDRPGPHRAHRPLRLPPRPPAGARPRRARRGRDRRAGPQSATAAPPAAPGRPVRSAPGGVRRGRRPPGAATVRGFRAGWRFYRSYGDPQSVRGDARRQAERGQARQLAAVVVVEQFQAVAFQAHEVGAGHQPGVARAREVQRQVGDDPSRTGAHHQHPVRQVQGLVDVVGDEQHRGADPRPYVQQQGLHLQPGLRVEGAEGLVHQQQARPVDQHPGDLHALLHTPGQLAGPAPGEVRQPHQSEHLHGAPVALGAGQALHLQAEGDVVADPPPGEQGVLLEYHATLRRRSFHAPAVDPHAAGAWPQVAGQGAEQGRLAASRRPEQADELARPRLQAQIADRLEGFAPLPQADAQVADLDAPQAVAGRRHRTLPPAAYQGVSDAPTRFTNPLLPMPKRPMSSMPTTTSS

SEQ ID NO: 25498 - protein, 136 aa, Pseudomonas aeruginosa
PSPHCPEIISAVTRQNQEVPMPIARPVKMPGPAPGSSTSRSSARRPAPRLRAEASRRGSSASTPCTVLSRIGNSAPVKVMKIIEASDEGNIRIARGIQATAGIGRSTSSGGSSKASAQAERPIARPRAMPSAAASR

SEQ ID NO: 25499 - protein, 148 aa, Pseudomonas aeruginosa
KKQARASTTGHSGVCRDQGGGMVAETAEGFTYHNWQSRGGDAPRRVQPASLSSATTTPGRSFSSAGDSSSLVSRTPAPITTNGRSKTAASTSSGMPSGKPNAVMPPNCMPVSSVATSRAAKDSRRAPSSALTAPFTSSRREPRLTTAA

SEQ ID NO: 25500 - protein, 1403 aa, Pseudomonas aeruginosa
RRTAPAPAARRAAGAGGSGCQVRRHAARHIGRQALPQDRANLLRRRHHQAVAAGQGLQLVAAGVPPPAVDGHPGDARVLLAEDRGDRYGQRLARAVAIVGGQARIGAQGGQADLAQLRVVEHFQRQHVVLAQGSQQLGVAHRMEARVFQVRPRSAAADHEQLPGAQAVQAFQACRQFVGEHAAEAGADQGERTVEQWQERVVDGTEHGLYIGDEWLVLAFLAPRILDRQQLHVRRQARVPTTESAGVAARGRQRDQAQARLRAPAALQPQGPGALGGGRQRRRVGGMAAAHHFAGIRIALQQPQAQLPAGQPAQFGDRLHAQQRMPAGTGEALVGRQRPAEHPGQHLEHPPQLHAVLGLGRRGRLHRVSEQRQQRLAVGAGQCLGALGGETSGGILEAHLEALAGHLEVHRQRHVDVHHHLVEDAAVPYSRRRRGVVLVEVDEVEQAVQAQLAVAPANRRQRMAPMFQARALVVECATGAVEQIDGSRQPARQGVQEQAEQAVRSRLLGAPVADEAGDYFIGIAEAAQRSAMRRQQQRTQGQAAAFGQGAQARQAVGRHVHADRRHAPGSLLRQSGQRPVAGAGQVVEPEQRRGGVGLGLTLQRHVVAEAYCGRFRFPRDDTGEKVGVDRQQLVHQALQAPAVQHAMVFGDAQGEAPLVQRQRGEAHQRWAAPVERGGLLFLDPGTQAQAPCFPVEATQVVHRHLGGDRSGRVDPLQGNLATVQIEAGTQDRVAADQDRPGARQQLAVQASMHLVQDDVVQQPWIAAGLALQEHALLQAGHRIGVVEPLRQALAFRRRQQGERLQRLRRRARGRIRRTRRSGQQARQFADALVVEHVAQGKGKPRLARHDLHLDQADGVAADLEEIVADADRRAFQHALPDLQQGRLGGIGRRFQGLRGRLGGQRRQQRATVELAFGGQRQAFDPGDPARQHVGRQARLEEATQGLLAQLAAEGRGGARRERAPVDALSQRLGIARAHRVAVVTVGTLQQRVLTDAHLEAMAAQKVAQGIGAAGGGTVALVMDLQDDLPDLGQRRIVETEQHIHFRALHVDLQQVDTLQAQFADHLVEAAQAAAVGFGAQAVVEDFVDVVQQQVGPALLALVAQVASDDVAFAAGVGVLGDPGEGRVARIVGEGFFALGVGQADAEYLDLRCVASEVGLQAPADRCQRLEGDHSRARRAAGDVQREQADVGTDVEDHRVRRQDDAVAAVDLVDEDFLVDVLGFVEVQSGDPVPAGQVDFQPGLVRGLPGGGDEGDDPAIRARLGRIGLVGEYRRLAHRWVFQQRAADLAQFDAVAVDLHLFVDPPEELQATVGAPAHQVAAAVQAAAARPALVEEAPGPPRRRRRHSRAPPRRRRSTVRRWRHGSCDDRGHRPHADRRWPGRGRWSAAHARRPAPGWRSPWLR

SEQ ID NO: 25501 - protein, 242 aa, Pseudomonas aeruginosa
PGCTPPPRASPRAGRRSPRGCARSSPPPPGRAARRQPAALRRPLRCARTAWRNPGCRGHPATPAPAAAGRPADRTRPPGIPPARAPRARPARPGSARARPRRSTAARPMAVACRRRCFPGIRPRRRASARPAFRHGRGGPAGWPAGLRRGAAPATRGTRPAAADGNPARPPRRHPVRPPARRSPTRRAASRGQRDRAGPLPPPGRGSPPGGRRAARRRCPRGHSPGTAARPRRTVRPARRTR

SEQ ID NO: 25502 - protein, 502 aa, Pseudomonas aeruginosa
ATRSCASPSSARRSRSSVATVSAGACRRTPTTVFSGRSAWRRQARVCKGDSGNPSSASLAAGCTADCRSSDALMAIPRTGSGLVDMQVGHRHQHLALAGVRLAAVDADEVVEHQDIAALPGERAGFLAVGGADGVQHLRLDRAAVAVVGVARQALFADLVEQGPGQGRRHVGDMEHVRVVEPQRLAAERVAHHRLAYLAGIQALVVEPGPLGTGLPAVGLDLGATVGLEAFLPGQVDLRPVVAHVAHPMAEEALPDRLGYPSADPALVGQGRAALGGGRCLAVEVDIARPVVRVGHLVVRRNPAVRRELGGGEHPVRHFLACRRALQVVEHVRRKALYRLGEALRSVYREATKQDAAMPQQAVAQPCAGGGDPLPQVHARLARADDAQVVVGRVEQAFLHQVAGRELPGAQARRAERGAHAVPPSARREGVGGTSAGARLEYGVDMMVRIRRGPRNGSRPCWASMLSRISTSPTRQSKRRVSRSMALRMVARVCASIGLPSP

SEQ ID NO: 25503 - protein, 225 aa, Pseudomonas aeruginosa
RPAAGVPAPRGRGRRLARPHGARHPPATARRGRRRSPAGVAGAPHAPPAHAAAARRRPFRHAGAAPHAVPATGARPVRWRRPWRRLCAGGPAGCRRCPPAPVAGPPTGAVRRGSARRRRRSAPARRPRARPGAAVPAGPRGSPGHRRTPATVRVGTVAGAASRAGAPPAGNRRRRRRSPVRRAAAHQAAPARPGVAPAPADRWAAPAARRRSPGDAAGPCGRSCR

SEQ ID NO: 25504 - protein, 166 aa, Pseudomonas aeruginosa
GYGRRRARRCAAVCAAPGPRTDGGVRRATGRPGARCAWPAYGALRRRPSRAAGRRMPGRRPCRAPCARDGRRYAAIRRTGDRAEPGRRCRPPPAPGPASRGCSPLAAPPAPGPRSTRPGRRAPGRRRIAAAGRHRVLPPAARYVRRTTPSPGRRNAAARAPAAREP

SEQ ID NO: 25505 - protein, 148 aa, Pseudomonas aeruginosa
GARCCRTPGSPPAGRSAPPRPGRRIPCRCTARCGSGKCTSRARPCRCSRRTPVPRRSACARRRPSRSSARRESTAAPPAPGSGGRSAGHAGRSCALPYAGSPRHRGNRHRCSAPAPRAPNAPARRSGCSGPGRTRAAPAAAARSPAAG

SEQ ID NO: 25506 - protein, 146 aa, Pseudomonas aeruginosa
LDSSIDSSAQWASRISAKSRVAAAVGSPPSSNSKRWMRRAAACSGSPPRLCSPNGWPCTSARTRPGCGESSRMRLPTTNASSMEWVTNSRVKRTSSHRRSSSSCIFRRVSASSAANGSSISRIFGCIASARAIATRAFMPPDSVCG

SEQ ID NO: 25507 - protein, 447 aa, Pseudomonas aeruginosa
RRISPSLGVMKPATALSRVDLPQPDGPSRTKRSAGSTSKLTRWVARTTRERVRYSRLTPSTASRASAGSVEGWREAAFIGVSTPLQRRAVLEEIVLPGGRLVADRTDPVEKLRQRIGVLRRDAELHLRIGDDLQQRGSVDLRPGHPDIGIGGGRLVVLGEGRRFLQRLDEGPVGLRVVLAELLRGEQHGRRIRPQQLVAVEHHVDLRVGQRLVLERRVGEMPGQLGAAGHQRGGGVRMRQRHGVLVEAVELLVAPLLRRGVLEEARLHRNPHRRHGDAIPGAEVGDAPDPRVVAQQVVGEVAQRSHRLDVLAPAGTVPDGQQRTDAGTGDIDRPGQQRIVDRRAAGQLGPVDLDLQALGLAVLFDQALVADHVEQQVDDAELLGDADLALGLRRPAGQHRGGEAQAQAERGDQAGENGECGSWKRSWRKGGSACRRQNGASPWMVVR

SEQ ID NO: 25508 - protein, 97 aa, Pseudomonas aeruginosa
ICCSVRFGVPCKHKSELINKNLVFMALSGEGIVWLPSNPPPEECLMDRTDNVIDFARYRSRRQARRLGEMMWAVYAWRAGYVVPQPPARHDERSRRA

SEQ ID NO: 25509 - protein, 211 aa, Pseudomonas aeruginosa
PMNLPASDGVAHLELAAGVHTEPDDLIGQRVAHNLLRLRGKRNLSLDALARISGVSRAMLAQIESGRSVPSIKVLCKIAQGLKVSLAAFLDDRAFAGVAVLPAQQSKRLVSADGAFTSRALFPFDVARQVEFYELRLRGFGQEDAEAHAPGTQENLVVAQGVLEVRVNEERFLLATGDSILFYADQPHSYRNPADSEALAYLVMTYPERLD

SEQ ID NO: 25510 - protein, 137 aa, Pseudomonas aeruginosa
TSPCPCPASASSCSAWRRPAWSTPSCTSSEPCPSSACPSPCPSSASSPCRPGTCPSSPGCRTALSWACRSSSSSPSSRRCCGTGPCPCPSPASSCTACRRPSFRTAWSPSSSACPSWASSAWRHSCSSASAWHSSWR

SEQ ID NO: 25511 - protein, 273 aa, Pseudomonas aeruginosa
QGPGQHLAAPALQHHATQRSAAGDGQVPGHHDHRLGQVGALPGGVRRGGLQQRRRATERQPPEGQAGERQPAPASAQAQRQRRHGEQRQAGQDHPPQVPVDQHADQPDSRHRGAAEYQQGQVHRGAQADLGEERRDIGVEDVVRQHPGDDHQQYRTHARRAQHPEQAQAPPGRLAREVRHAAQHPADQQQRGQRQQAEGPAPAEQAAQPGAQRNAERQRQRRTEHGHRQRPPLLLRRHQAPRVAGQQAPGEAGGDAAAEARQQGQAVIRGNGG

SEQ ID NO: 25512 - protein, 605 aa, Pseudomonas aeruginosa
SPRWAEARLAGPVKPAADRNKTAAATERLIGTSTPCQAASMINIETPTYYTATKKYELSFPSLETDLDADVVVIGGGFSGINTALELAEHGITDIVVLEARHLGFGGTGRNGGQIMAGIGHDLEKIRKDVGEDGLRAIFEISDLGADIIKGRIEKYAIDADFCHGYGYMGFNARQAKTLLAWEKEFRSLGSPHEIRYLHGAEVRQIIGSDAYGSALLHMGGGHVHSLNLLLGEAKALAGLGARIFEYSPALEVQYGERIRVRTAKGSVTANKMLLGMRQLPQPARTRAAPHHHQYLRVPDDDRAAAGRTDPADQPDPRRLQRHPPGHRLLPGDQREPPAVRRRHTLRRTHPRRPQGLEPQADAEDFPLPGARPHRPRLGWADGLQRQPVPADRQPLGAAQRVLRPGLFRVRRDPQPHRLQGPRRRHERRLGALRPAQLGAPHPDPRQGPLPPAAAQRGQDLAPALRLLERPALKPTDHSTRSIPMAITAIRHGITLDELDAWGSVADLGSEILEGEVKAFGKMTAGAPTDPVSAAYFGTTAGKFRMTYPFSEQATVVSGEVRLTDESTGQSTLYKAGDSWFVSQGTPVLWEVADGGFVKHYYAVA

SEQ ID NO: 25513 - protein, 214 aa, Pseudomonas aeruginosa
GGLSATARAGFDRPQRQEGGARLARFFPGRKDSAVSRLRCSMHPPLQALVIMGVAGCGKSSVSQALCQRSGAHGIEGDSFHPAANIRKMSAGIPLTDDDRAGWLDTLAEQLRQAVAAGKLPVLTCSALKRAYRDRLRRAVPGLGIVYLELTPAVAAERVAQRPGHFMPATLIDSQFAALEPPLDEPLTLRLDATLPVECLAQAAHAWWLEHTAA

SEQ ID NO: 25514 - protein, 464 aa, Pseudomonas aeruginosa
NSNSGRTTTKGEPSMFGMSHDAYLLLDALVTIIGLIVLITRFKVHPFIALIIAAGFLGLTSGMPVEKIVKSFQDGFGGVLGFVGVILALGTMLGKLMADSGGADQIARTLIRAFGKERVHWSMMLAAFLVGIPLFFEIGFILLIPLVFIVARRSGVSLIKIGIPLLAGLSAVHGLVPPHPGPLLAIGVFGADIGKTILYGLIVALPTAAIAGPLFGALVSRYIPGTPSAELVEQIAHEPETQDLPSFGVTLATVLLPVFLMLLKTFADVAFPDGHAFRAWMDMIGHPISALLLALLVALYTFGYARGFELEKILRLLDQSLAPAAAIVMIIGAGGGFKQMLVASGVGDVIGHLAVNAQISPILLAWLVAAVIRIATGSATVATITGAGIVVPVIDLIPGVNRELLVLATGAGSLILSHVNDAGFWLVKQYFNMSVSETFKTWTAMETILSVVGLVFILLLSLVL

SEQ ID NO: 25515 - protein, 154 aa, Pseudomonas aeruginosa
ACSATTRRRSAGWSTPSPTRSAGSTSTPSASAARTATRSTAGRIRRKAPCRSMTRCGCSPSAPWWRPATPRRTRPWSARSSATARRTSSPPTTSSEAPVPLPPGEGPAATSPTVRQAAAAQQAAAPATPPARANPRNQWPARVGTGCATARTPG

SEQ ID NO: 25516 - protein, 432 aa, Pseudomonas aeruginosa
PSTGRPRCLPGVRMNARVHPEATATSLSEGADYELLAQRFRPIFARIAEGAVERERQRELPHEAIAWLKQAGFGAVRVPREHGGAGASLPQLVQLLIELAEADSNITQALRGHFAFVEDRLNAEPGPGRDRWLRRFVEGDLVGCAWTEVGSVRLGEVLTRVSRKDDGRWVVNGSKYYSTGSLFSDWIDLYAQRDDTGADVIAAIRTDQPGVRQSDDWDGFGQRTTGSGTSLFEDAEVEEENLIDFASRFKYQTAFYQLVLLAVLAGTGRAALRDVAAEVRGRTRIYSHGNAPRVSQDPQVQQVVGRIAARVYAAEAATLRAAEAAQRAYLARFVGDPQAEKEANIAAEIESAKAQAIVAELVLQATSELFDASGASAVGRGKQLDRHWRNARTAASHNPLIYKQRIVGDWEINGSEPPYVWQIGSGPATASR

SEQ ID NO: 25517 - protein, 291 aa, Pseudomonas aeruginosa
TSPIPSQGVAMSALEKNAADPYRQPLPRTPARRIADDAEAIRVARELAGLFAEEASLRDRQRRLPVAELEAFSQSGLWGISVPRAYGGAEVGYRTLAEVLKTIAAVDPSLAQLPQNHLAVLDHLRLDGSEEQKRFFYGLVLDGVRFGNAFSERHSRTVAEFQTRVLADGDGFRIDGRKFYSSGALLAHWVPAVGLDAEQRAHLAFIPRDAPGLTVIDDWSGFSRRTPPAAPSSWTTCGCRPSTSSRCTAPSTAPPPPAPYRSSSRPPSTPASPVASSPRPCSRCAATRGHG

SEQ ID NO: 25518 - protein, 156 aa, Pseudomonas aeruginosa
RQASRRAPGRSRGCRWPGARRSAHGRGCPAGSPGAGFPRAWRRGCGSVAASAGRAGARRRRYSAGSARARRRPAGNRSAGRPRPSASPRWASTTAARSSAGTETPEWSPLPGCARRPPAAPAALPPAAPGTSPAGPVSGSPARARRVRGVPAVHPG

SEQ ID NO: 25519 - protein, 581 aa, Pseudomonas aeruginosa
SGPRRCRARGSPAAAAAACRRGSLRPARRKVRRAAAPSAAAPGSGPARCAGPCRRRVAPGSGHGRAPGRPRRSPGRRGPGGWPRRGAAGGRNRGRRRRSSPGSARAAGWGPGTPPRRPDAVRAGARRVPARCRRPAPAGRPARAAGWTCRRRWDRGSRPPRRRPGAIRNRRAPPASRHRADSRGRSRERRGAPRSCLGLGLALQFGAQLHQARRNDRDERRLAPAAGETGAVLAQVCLAAAGLQLQLHGIGGGFGEPDADAEQACRLAGELAAGQSGVQRRHVSVEGFALCRQLAIQERTAAAQVPLHFVQCAARQADGHAALQAEEGRAHPWQELPGVVVQQPVAPDRHRAQIEGGGVAALQAEQAQVRRALQAGESFGNRQDEGLAALPVFDRRRHHEIAAAQVGHPRQATVQAPAGLLRVRHHLQRLDPGEELHRVGQPSGAGQAAGQQVAEQALAQFLVGTLQQVLDEGALAPEDERRGQRARRHCGHPLHRVGERAAGAAEAFLHRHAEHAGGGQARQQRGGIGVAAVEGVGLAVEPVAQGRVKHGRHSLRRRGMPPGKRRLRPAGWSSDIAPARH

SEQ ID NO: 25520 - protein, 301 aa, Pseudomonas aeruginosa
MNSSNPLVDWLLDSLEVDTSLFHVGRYCGGWHASTHGLARASFHLVVQGHCWAHVAGSARGWRLDSGDALFFLRDVEFRLSSEATAEAARCQPRGEMQALEWNAADGAGLVCGFFHFHSGLSGLIVDALPDWLILRAGDPALDAARRLFALIVDECRRQPAPSPVLLERLSHLLFLYVLRQQVLDNPTLGGLVALARQPQFAGLLEALIEAPEQPWSLEQMAVRTGLSRSAFFKRFNELSGQSPGQVLLALRMHRACALLRADASVAEVAAAVGYQSTAAFTRAFHKATGQQPGAYRKASR

SEQ ID NO: 25521 - protein, 330 aa, Pseudomonas aeruginosa
LACVRRNSGGVVDPLQFVDHRLRQRRQAVAGAADDAVAGMQFVEVVGQLAHPQRTQASLSRRRQVAEAAADADGIRGENHAEQAMAVLALDGRAEVGTPAEVHQHLADVRRADVGRQREAQQLLGGNALASGQRMPLAAAEMPAPGTQARGPVLRVGLEMPGVGDEELELLGLQAAVQRLPVFDLETHPRLRITHVEAPYRTRHQPGGGSRSGAEAQFAGLQAVEQGDLVGQVVRAADQPARMFEDDQALLGRTQVLGRAVHQAAASAVFERLDAAAEGRLRKVNRQRRGDEAAVLVKGDEVAELAEIDMHFLHGKYRANAIAGDGVGFL

SEQ ID NO: 25522 - protein, 412 aa, Pseudomonas aeruginosa
RRSLGARQAVVAGNPPGFAQRRFLRLRARRLLLRPGPRQQVLHRLRAQGRHVERNPRRRPERRQHPRSRAHRHRQLRAVRPGHLAPNRAPGPNRRRARHLRGKVRLGRTLRPARRRRGERRGGGRAQRQGRRLRQRRHRPAQRQSVRSAQPQLPLQRPGSGLRLAVPRREIRRRQPDRGQRSQRRCRLAADWHRARQRCRAGVEDHPPRQPPDPQRQPVLDRGPRLPGQCLRRGQPHPVPDQCRRCALARPGVRSDGPADPRPDPEFQCVLQRRSLPVLQERPVRPRGGLPGRRPGVLRPQRAPGGRCLEVHRQLQWRVSLEARRWPVALPHRQLRVPLQGGGHHRRLRIRTDPQLRPGQRLRRAARRLRGPPVGPVPVAEERFRQDLLASPWKFRRRGVPRRARDAAHPGR

SEQ ID NO: 25523 - protein, 450 aa, Pseudomonas aeruginosa
CLPRRPPARKRSSPMNDSIKACLAAACLALPLLAQGAETLTIATVNNNDMIRMQRLSKVFEESHPDIALKWVVLEENVLRQRLTTDIATQGGQLDLLTIGMYEAALWGAKGWLEPMSGLPADYALDDLLPSVRDGLSVKGTLYALPFYAEASITYYRKDLFQQAGLRMPEQPTWTQLGEFAARLNRPDQGQYGICLRGKAGWGENMALIGTLANAFGARWFDERWQPEFSGGEWKKALDFYVSTLKRYGPPGASSNGFNENLALFNSGKCAIWVDASVAGSFVTDKSQSKVADATGFAFAPREVTDKGASWLYSWALAIPASSRAKDVAKAFATWATSQAYGKLVADREGVANVPPGTRASTYSEAYLAAAPFARVTLESLKRVDPNHPTLKPVPYVGIQLVTIPEFQAIGTQVGKLFSAALTGQMSSDQALAAAQQSTAREMKRAGYPK

SEQ ID NO: 25524 - protein, 335 aa, Pseudomonas aeruginosa
SAAGRSRARRGAARALVLEDPDGVAMNTSALDTPLPARPARRRLQRRRRGPGWLLVSPSVALLLLWMIVPLGMTLYFSLIRYNLLYPGENAFVGLENFTFFVTDAGFLPGALNTLLLVGSVLAISVAFGVLIAALLEAGEFFGRGAVRVLLISPFFIMPTVSALLWKNLIFHPVSGILAAVWRLFGAEPVDWLAHYPLLSIILIVSWQWLPFAILILMTAMQSLDQEQKEAARLDGAGPLAIFWHLTLPHLARPIAVVLMIETIFLLSVFAEIFTTTSGGPGYESTNLAYLIYNQALLQFDVGMASAGGLIAVLIANIAAIVLVRMIGKNLTERS

SEQ ID NO: 25525 - protein, 376 aa, Pseudomonas aeruginosa
SQDPQPAERLRRPGHHQGHRPRRPRPRVRSLRRPLRLRQVDPAAPDRRPRRGQRRQHRPRRHGHHRHPAGETRPGDGLPDLRAVPAHDGAQEPLLRPRPGRRRQARGRRQGRRRRTHPRTASAAGAQAAPALRRPTAAGGDRPGDRAQPEDIPLRRTAVQPRRRPARADAPGTGAAAPGTGGDHDLRDPRPGRGDDPGGQGRGAQRRARRAGRLAAGALPPSGQPVRRRLPRHAEDGLPARPSQPQPGRALRGRPRMRRARRPAAMRRRAGHRQPGDPRHPPGTPEHRPPGPCLPEPAAGRRRRQRAPGQRQLLPCPRRLGGNAHPARARRFRTGLRRPPGAGLRSGALPPVRQQRPGPRQTTATGGLKPPAGTHR

SEQ ID NO: 25526 - protein, 411 aa, Pseudomonas aeruginosa
RTPRAGSGGLAGSHGQRGTHGPGRSRGGRPRGPRPGGFRPAAWAAPARRRGPGAAPGQALVRHRERGGKPRAAGSPRRPGRLAGTPGTGARAGLHAVQAALEQAPLSRAVRPRRAHPPAPRLPQPLAHRPRLQRSGRRLRQRLLRRAPAHLGQRRAGAGRAGRTPGGGAAGADRARRLHRQPAPRSGRRPRPGSPHAGRLRRRRQHARRHRHRQHPPRPAHRQPGHLRHPERLCRAAAGQSARRAGDLLRLVRRLAAAGLHDEPHRRLRPGTGPAAPRPRRILPAGRPGAGRRRGSADAAVLRRRAGSGATARQRQPAWHDRGQPEPRQSLPGGARRHRLRPALRPRPAARQRPAGRGNPPGRRRGEEPAVAADARRPARPAAGLSAADRGRRPWRGAPGGLEPGPRKRRR

SEQ ID NO: 25527 - protein, 125 aa, Pseudomonas aeruginosa
SRPARKTWPLFYPGRAPGEVARGWLNPRCRLVFVTHGGAGASVHCTHGSWSRPADTALPLRDTVGAGDTFQAATLAYLRRLDADSPAGLAALSREAIDAMLAFAIRAAAVTCSRVGPDLPFAHEL

SEQ ID NO: 25528 - protein, 419 aa, Pseudomonas aeruginosa
GRPCGGSGRGLPPGLAPRPRQPLPALEHGVPVHPGQYVALEQPGEAAGRGGLQREGRQQLAGIAELRQHHPAALDGQRTTAVAVVAQRQATAAAQAEKVLGHHHDLLARRRRGLRVGGAADIAEGEDLAMADMLQGRRVDFAPAGRVAQAAGGDKGRRQLRRHHVQQVEVLFRQIGVAVGVLHLEPGLARRAVDLHQVGIERQLGRILAHVLHQRRNEIGDTEQRRAGQVELDLDVLQHALPQPVVAGQVHGLLRRPGALDRHRRLGEQRLAAAQAAHQLPGVGRQVVAVVGGDAVAPQGLLQALDALPGQAQAGADDQVAVFQAVAALQQQSARLGVDPLDAGAQPLHAGRDQPGHRPRGVALCVGAATDQGPARLVVVGVRRLDQADTQPRRTFQQAGDHADAGRAAADHGDVGGEF

SEQ ID NO: 25529 - protein, 278 aa, Pseudomonas aeruginosa
PGAPATPGTPHRERRPGVAGRPRGSRTGPSRSGATRPRTTPALAGTGTLHPPRPGRHRHSPRPWRRAGFPCDPGRGVPCHLCRRPGPRTDSAEPVRPAQRDRQRRQPGAETQAVPWHPRRPPAGQRRPGAQYPPHPGAEGAGPSRRRRLPGQRREVLLHRSLVRPLGGGQGHRRGRARGDALRRARRSRPAHRRRLVRLRPAHHRQRHGTAGRGSGSRRHADPQRPAGRDPEPPGRRLATDPGRHRRRHRPGGAGRRPGFRPRTQPALDRRPGRTRQR

SEQ ID NO: 25530 - protein, 125 aa, Pseudomonas aeruginosa
ALQHRRGRPPANRAARCQRPAGEGRPGPRRSGRAAGGRRVGGTRLDRRGRGQGAEHRDQPGRQREALRTGRQPCHARRVQPRPALAQRPHPYPARPGALESPRGRRLLPERRPSGASLMDLRSAR

SEQ ID NO: 25531 - protein, 110 aa, Pseudomonas aeruginosa
TARRRRKVACSAPPWPASVSATPWPRSARVPPASAVPACAPTATATAWTGASSTAPAHSTRSGCRPWRWTTRAASNWPSSRATAPGWKSSTTGPASVNAPPAAVRRCSTG

SEQ ID NO: 25532 - protein, 535 aa, Pseudomonas aeruginosa
SSLAAAAPVSPNSVSTATGATPAYTPCTTRCAGSTTRSATTTSTAACRHAAARSERRRDRHEQEADSPKRLQHELRRPYQPRPLDPPTRPLQRLPQTAPLDRAGPAAGARPVRRPVHRRYPRRLRRLPGRHRGDRPRSRPVAGERPADAGLGHGRGHRAPGFRRHRQPHLRGALPVRPAALDPRPFERRADRLEHRHRLPGKRGQGHGPVRADRARPPLRPRRRVPGGPLQALGGQLGRRRGARRPPATGLRAAGEDPQDPPPWRVLPGRGLPPRRALSTAHPGAVPGRLLGAWPGLRRAPRRMRVRLRTDPRGHPPVGAAHPRGGGRRRPSRRGHQDLHGHQRDRRSHRGRGPRQACRVPPLRQPRGRPGALRQLQRHRPVALRTRRADPLREEQRHRVGGEEPHRGAHRLHRAQAPRPVGPGRPLRDPGRRPAPGRRRPRRLDRRYRPGRLQSDPHRGAGELRRLHRPGGARVAGTRQLQDRLCPRHPAGEALRRRPRAPAGGTRRRRLPPAPGRAPAPGLTPLSLSFRSPPC

SEQ ID NO: 25533 - protein, 369 aa, Pseudomonas aeruginosa
SSSSPAATTRTATAAWRASSTSTSIHRWSAPRWTRPMARCTSRAGSDGHDRSPEPAAPRTVPDGARHARLHAAHPSPRPGQALPRWSPGPAGDRPGNPPRRSVRHHRPQRRRKVLADPHPQSPGASQRGAGADRRRRHRRLRRPAPGRPAPTHRHDLPALQPDVGQDRVAEHRPAAAGGRGAPGTDRGAGRRAAATGRPGGKTRRLSGAALRRAETARRHRPRAGAPAADTALRRSHLGAGPGEHPGDPRAAARHQPPAGPDHRPDHPRDGGHPRDLRPRGGPRMRPHRRTGRSLGSLRRSAPCPSPEACSAACAPPSRPTSRRACARLPAPATRCCSISSTPAPADGCRTCWPSPGPSASASTCSTAA

SEQ ID NO: 25534 - protein, 257 aa, Pseudomonas aeruginosa
SVSRAAPWGACCYRSARRPASFPACWPRPRWWRTRWRCSAMSPMLERLWQGFLDTLLMIGASSAIVLLVGIPLALVLVTTGPGGIFEARLLNRILGGLVNVLRSVPFLILMVALIPFTRMIVGTSYGVWAAVVPLTIAATPFFARIAEVSLREVDHGLVEAAQAMGCERRHIICNVLLPEARPGIVGGFTITLVTMINSSALAGAIGAGGLGDLAYRYGYQRFDTQVMLTVIIVLVLLVTLIQFGGDRLARLLNKRL

SEQ ID NO: 25535 - protein, 383 aa, Pseudomonas aeruginosa
KRKKERRLMRQRFWQGTFKTLGLLGLTAGLAAQAAEPSGKALSAAAGVPWPAVIAHRGASYDAPEETAAAYLVARDLGADYLEADVQRSRDGVLVALHDDTLERTTDVAEVFPGRAKDPVSSFTLAELKRLDAGSWFNRAFPERARPGFVGLRILTLDEMLDIAEGGANKPGLYLETKVPAQFPGIEDDLRKLLERRGWLQPRERAAAGHVDVAHGNGRVILQTFEKSSLELLQESMPQVPKILLLWLGDGYLEARSPVTFKESGETDKAAFYARQEVKSEAEFGAWLDWAKAHGALGTGPSATLSERGEQSYADLVKPWMNRMTHARGLFIHAYSVDSAEDFKALGAAGVDGFFTNRTSELLKFQGRPAAQDMDALLRRHGY

SEQ ID NO: 25536 - protein, 130 aa, Pseudomonas aeruginosa
RCSARPGCRRWSWPPSTATTAMCRWIASIAGRKRSRLKPSAYNCSGGWLEVTTSTTPSSNMMRSRLPSRMASPISLTNSSSKHSTRTSRANSRARARNGSAVPVSSNWRWCTHCMKWWKCWRRAGTRRHW

SEQ ID NO: 25537 - protein, 237 aa, Pseudomonas aeruginosa
YRSSRKCPALIARSSCTLVAASTRTSMGMLLRDPRRTTSRSCNTRSNLTWIGIGRSPISSRNRVPPLASSNQPALAARAPVKAPFSWPNSSASTSDSEKAPQLTATNGPLRRALRLWICRATSSLPVPVSPITSTLASLGATWRRCSSRAWDFGSSKTWAVARIEVARFGERGSVSSRSGVRVEAFMSRRSVAAVTGSAPSRPARGSCSPAGRAGSGCAGCASSGPGAGRREWSGRR

SEQ ID NO: 25538 - protein, 477 aa, Pseudomonas aeruginosa
SATTGRCGATRRARPSGYRRRRRARRRSRRNRRPGAGRSATAFAPRGGSSHSQGVSPRGPGCSSAGASRQHVVGDHFAERPGQVGQPTAGQAGVGFGQQREDQFGEAVGLFQVRIAGEDEAVDAELGVFPDALRHLPRIADQRGAGAAAHQADPGPEVRLDLQAIAAAAVQRGHASLAFGVETGEGLLRGGDGLVGDVFDQPVRGAPGFFGGFADDHMQADAELHRTPMASRSLAHVGDFRRHRRQRLAPGQVDVHLFAGQFVGGLRGTAEVQRRIRPLQRRIERLGVLHVDVLAVEVHRLALQDAPPDPKELVGDLVALGVAEMDAVAAVLVGIAAGDHVDQQAPAGQAVEGRRHPRRDGRRNDSRTASPPGSAGARSAAPAPRPPPRSPRRSVRWGSARRDSQGCRPPVPPASGKAARPAARPGWCRGSGHRRGSGGTRTRSSAHLRRSSTVRSVRRTAARRARRRGGCAPSAAR

SEQ ID NO: 25539 - protein, 195 aa, Pseudomonas aeruginosa
NRSSRKCPATTASARSTLVAATSRTSMGIGRREPSRTTSRSCSTRSSLTWMLGGRSPISSRNRVPPLAASNQPALLCNAPVKAPFSWPNSSLSTRLSAKAPQLTATNGPPLRPLRAWIWRATSSLPVPVSPMTSALASLGARRSMRSSSSRERGSLNTSTVARTDLVSSRAWGWVMTDMLGSEPGNVRPSCPRNP

SEQ ID NO: 25540 - protein, 422 aa, Pseudomonas aeruginosa
PRSLGQYAKQRPDSARLRVRIDQLRQQLAQRLVAPLHRALDQVGNRAVRLGARQVVSDQQQLPIGVLATGRRASRPARRARRDAFLAVRVAFGGVRLRDRWLFFGQRRLRVHGDELLEQGQPLRDDLAQRLATGGEFAQAAVAPLFQALQLLLAGEQAGLLALPLHQGLRAQRFVELLLLKLRRFQRRLGALAVAAGDLLALQPLPGIEGDLGEGALPHQRQARVQQLGIAAQQPVDGRHPPRLVAVLGLRMHLLGVALAEFRQQHQRALQSAQPAALQPGLAEPGGEHQILAAPLQQIAGQLLHRGPVGALGLRLPDAGRQAAVILPAQLAQAVVVRVVAQAGAARLSGVDRFEQHFQGQGVAGKRQGHGVPPVLATVAGNSVANGDCGARTGSGWMDSGVLPPRLINDRRRNIRASFSGL

SEQ ID NO: 25541 - protein, 163 aa, Pseudomonas aeruginosa
KLRISVPPRVRHHQPSAPSSSASSTRRRTSMNRVAPLMAPAPHRPGGSPPPFRAGCRARTGVRYRSSTAPARAPPGPGGSRPAALRAPADAVAAQRRAAQGDGRGRRRPPRAARRRRTTPAATSRAAPRRAARAGDRGSRGSGIAGRRWPGRDWPGRVRRAGA

SEQ ID NO: 25542 - protein, 487 aa, Pseudomonas aeruginosa
AAAPGTPGKKALHSLRALAAPSCLGVVAAVGDEQHDLPGTAGDPADRRDDAQRLAGIEPVAGTLHDEQTGVVANAVGHLFLAIHRLPRQPAHALPGEQRQVRVGGDDGALQPVSRRLFAGAGGHPQADHQALTRRRIGQAHGKYLFLLLERQAAVARADRLDGPLQPVQQRLVATPQVEEVERFEGRHAGQRIERRPGTGQAQQAAVQGQRRGRTACQQAFDLRQAGPERGKLATDFHRVVLVARLLRQAQAPAEEQRLLPGPRAKRLHASAQGRLRQDQWRRRDVGQADVGAALLRHAQQRQAHGVGLAVVADQPQRRSPDGDRLGVLAAGQVRQRRADPRLQTALQRQQLTRPPQRTDRQVDVQQRPFGGRQRCLQIELQRRVDTSLHAHRQAVGQDRFEVQDPHLAGAQRRGVQFQGGHSPEPRVAGLSDARRQRLGTQSLQLEMLGKQLHPFVPAHRVRQNTHTTPLRRPTLSCTTVARLPLR

SEQ ID NO: 25543 - protein, 238 aa, Pseudomonas aeruginosa
TCSSVFCSSSPVTDQRDRQGQVLRRFPCHACDPARDCDDQGIPPMHCSPTIASESAAMAESTQHKLDRVRPPRVQITYDVEIGNAIEKKELPLVVGILADLSGKPDTPPAKLVERRFVDIDRDNFNEILSSISPRATLQVDNTISGDDSKLNVELRFNHIEDFDPVNLVKQVVPLRRLFEARQRLRDLLTKLDGNDDLDQLLQDVVANTEGLQEIKAARPEAEAAPAGDSEPPADQPA

SEQ ID NO: 25544 - protein, 632 aa, Pseudomonas aeruginosa
PSSRRSRHAQVIRRRTIRREFDPDPVPARRDHRKGPHGPRRQPAGLCPRHARGIRHPGPRRGHGRRQGHRGDDQRPHQPDRCADQRPAQPDHPPPRVAEAGSLLARPAPTGEQHRDQRAAQAAPAERRQERTAERPGEGGRVRPERTVQEDLRRGIRHLRRTPLQPADRRLHLRSPSAGHRPAGEAVERRRGCPRAVHRRRQPTPVRHEQLHRTGRTARPDQDLREPGADQVARLPRERGFALRVPGAAELPPAPALRPGDAPGGRHELCRGRQRHRPLQVPLGQRRLGPGAAHHRGLRQVRLVRGDPRRGRRRRGRGPASAHVPHQLRRPVAEMPDRSGDHRPPREGTQRSRLHFPVPQEEQRRGGVLRRPDHQQGQALQHQRGQRQRAPVGDAAVRAGGIALRPLPEGDHARQGRQLHDPRQRADLPEQLDRRLRADQRQRTAGNQGAVPAARGAGGCQRGGRQTGGLPRHGVPPAALPARGTQRVDPPGRQPAAAGSGVSSPPPAPPAGRPSRSRQPLSRSQMRWMRSFSISAATSKATACSSATKTRSKSCPTATTWRCRSPTTSATRNAPPANPTSANSPSPSSSTPRPRPSTSIAAPASRSPRRPSPSAATPPRATGRSCPSSSTP

SEQ ID NO: 25545 - protein, 614 aa, Pseudomonas aeruginosa
  UNSURE (535): Identity of amino acid at the above locations are unknown.
RLRCSSSNRATMASRCAMSDSIDADLLDYYQRELTWLRHAGGAFAERYPKVARRLQLAPGECPDPHVERLLEGFSLLTARLQRRLDDDYAEFSDALLEQLYPLALRPLPSCAIVQFEPDPTQGNLAEGYRLPRDTALFVTTRGGDSVHFRSSAEATLWPLAIDEATLLGGEEAQALTGVGAARSALRLSLRCLGEYRWEELSIERLRIHLAASPMGCAILYDLLAAHTVQVMAGAPGTPPAALCGMPAIVGFAADEALLPEEDGGHPGLRLLAEYFAFPDKFHFFDLPLSGALADGQALYLYLVFDRAPTARLHLQAEDFQLGCAPAINLFPQTSEPLRPDGTRSEYRLVADSHRENSVEIHSIRAVRSVAGSTVQPVPAYYGCRHDSHLGTLYWHARRIAGLTPNRLGSDLLLSVVDTGFDPLRETPAFSLTAELLCTNRYLAERLGAGTALGFERPGPVAAARLRNAPSAQSQPRLDGQSRWRLVSQLTLNHLSLVEGPRALEALREILALHNLRDDASARRQIEGLRQLDCXRVVAHVGEDAWRGWRNGLEIRLRLDPQHFVGASGVLFSAVLAQFFSLYATANRFVRTVLVEADKEVKTWQPQAGSPLSL

SEQ ID NO: 25546 - protein, 227 aa, Pseudomonas aeruginosa
VSGCAARRSASNCCRRCCCSNASVPRRCRWAPATRRGRRPCACAGRCCRCSPRARWKACSTTRSNRCCPPRCSASAAPTARCPMPTRNGCNNAPGRRTMPPPSSSTCSSTACSACSTGCCAKHPLGARFPRCRRRPRCRPQLRALNGLLPKALHERLALPDSAVLARTALFAGGRRSLAGFAGPGAPALRRGGTAGRIPGRLEGNPHGQPQPGCNAAGATCAWVAMP

SEQ ID NO: 25547 - protein, 877 aa, Pseudomonas aeruginosa
LEMELAALIGRLNPDCRRALERAAQRCLQRTHHYVEIEHLLLELLDIDGGDFACLLPRFGLERDALVAEINLSLELFKAGNTRTPALSAHTIGLLEDAVVHASVLGQAQIRSGLLLLALLDREERRALLLNSASSLLRIPHEALQANLLEWIQASREQPPAPNRPAAGGDKPESAPDPLLDQYTQDLTAEARAGRIDPIVGRDGEIRQCVDILLRRRQNNPILVGAPGVGKTAVVEGLALRIAAGEVPPSLQEVILRVLDLGLLQAGASMKGEFEQRLKGVIDAVRNSAQPIILFIDEAHTLIGAGGAEGGSDAANLLKPALARGELRTLAATTWLEYKKYFEKDPALTRRFQLVQVEEPDEATAVEMLRGVAGKLELHHGVQIMDAAIVDAVKLSHRYISGRQLPDKAISVLDTACARVALGQHDVPPPLESLRHREQALEEELQRLRREQATGLDHSARITALESESGDNRRTIRELETRWDEEREAVRELLDTRRELLALSESADAAKPDEELDGRIDHLAAELARLAAGLEAIRQDDPLVPEQVDSRTVAAVIAGWTGIPVGKMLADEAHAIRSLAQRMGQGVMGQEAALGAIAPGHPGLSRRTQRPGQAGRRIPPARPHRRGQDRDRLRPGRRPLRRRTQPDQHQPLRVPGGPHRQPAQGRPARLRRLRQRWRAHRSGAPQALFGGAAGRDRESPSGRAGSLLQRVRQGRDGRRHRPGGGLQEHRDPRHQQRRRRTAAGQPGRTGRHPGLRRAPAQSPAANLPPGVPRAHDRGALPAAGGSHPGRHRRGQAGKTAGTLQGRYRQTVRLRPGHRQGRARQVQRGGRAGYRERADGAGDGEVGGVGTRMSVPRHRGIRPFPMENVSAREQRTNS

SEQ ID NO: 25548 - protein, 293 aa, Pseudomonas aeruginosa
PSPASSSVRKPAPPCATRTHCSTMPWSVASTPSLATSSCARASHPVRAAAPATASSPRTDHVLSSSPAMTATTAPPTTPSSSSHPPGWCSTDAERPPNCPTFEDCRHAPNHRILAPHERPVSCDPTRNRRADPGQRLGGAQRSHRLLRGKPVSLRLQGTGVSRAELHKRYADGRIAALEPLHDEQFRRHHPLVAGQQCPVHQSAHGAQSGRQRNHRRNRSRPPDPDRAQSDRHRSAGADPVADLCHQQFAALGPGRRAGQRWWPLRLSRARPPVCQPLDAAVRPPLLPLERQQ

SEQ ID NO: 25549 - protein, 508 aa, Pseudomonas aeruginosa
RRFAEYRLGADLGRPRRQPRALPQPLRGDPQGHRLPPRAGHAQAAHAHPDRPGGGQGRRGDLDRPVRPDQDPVPLGPRRQERRDLLLLGARGAALERQGLRHAVRAAHRPGSDRHLHRRRPGPPAGHRLRLQRRQRPTLRAAGQPDAVRDQDQLVEGRWRLQRAALRGQEGRRGSLPPGAEGPQRQRAQRQHRQHRPRRDPDGAERPHPHGEGRRRDRHPGERQAHGDHPDRQRQPGCEGHAHGDGGRRPDPQHRRQLQPQGQRQLRADGGRQPDHQGQRHPRPAERRQPDPEERRRPRRPGRHLADQQGRDVADQPGRHLPHQQGRHQPDQRCRRQPDQQGRRRTDGGRRRHADPQGRPGKGQLRRSAWRHPASSTWFEATAISPATCSTAAWKVRCASTSTTGRRPASATDRASCTAPAPCSIPTARSPRNSPSSTASCTGRPVSMPRKAGCSARRTTATDCSTAKRSTISPTARWPSASITATACATGSTSASMAMANWPSTDAT

SEQ ID NO: 25550 - protein, 261 aa, Pseudomonas aeruginosa
CGAELRDRDRRKRIFGGSNGARSALAGRPAAGRCRGCRTLAAPMDGTTMPSTRSLPARVIVADDYPLFRDGLRRVVRRYLPQAAVSEAGSFDEVLRLASSVSPEPPALFVLDLLLPGFAASQSIERLRRAYRHSAIVIVSMLDDPRLVDEVLAAGADGYLGKSLEAGEIGTALQTLGSGEPVVRLRGGSSAGSRQRALLDALTPRQQAVLRLIADGLSNKEIGRALSISPFTVRVHVSSLLRALEVNTRTAAAALAVKAGF

SEQ ID NO: 25551 - protein, 509 aa, Pseudomonas aeruginosa
CSAPPSDAAKPAGTPSGADHGLAGAPPDTVWEIGGNADGPPGFHWHPQVATGERLGQDRRFQHEVGLGLAAETAAEQGHVDRDLVERQLQALGDALAGHLRRLGRGPDFAGAVLVPGGGDRRFHRRLGQVRQVVLGLDDIPTLGEQRRGIAAVAHHLARLARGLFQLLAVGHRVVAAVDPGVPLDRQRLAPLDRRPGVLRHHGDPAQRLELGRDRPALDLDHLDHPRHLQRRGGVVALELAAVDRRPGDHGVEHVVEARVEAEAGAAIDDIGAVDGARHVLADVAELLGLLQQQLVARRHFETRGGLGQFAEGQRTAAGRMQHLVLFGAALAQRDLPLVGRGLFEHLSRRRTAAAHGFEPMAHAARAIGVLVAVARFVAGRLDHLDPAPVGLQLVGHHHRQAGAHALAHFRAVADDADRAVPVDAHVDLRVVHPAVGHGVGAEGLLLGGQGVAPAPVGSHQQHAGGADALEETAAAEIADDQIVGVRALHALASCNLAEALWIAVLIRL

SEQ ID NO: 25552 - protein, 88 aa, Pseudomonas aeruginosa
PRKQAEAPMNHTASIPALPTAYDLLNTRIQRIIHAPAAQQACQACISRLPGEDEGDWAHLLESFDRSNQWLLDPQRDGSIVLRWSSAA

SEQ ID NO: 25553 - protein, 202 aa, Pseudomonas aeruginosa
GRPIMVPRAPRAMALSTSCPERMPLSSQTSMRSPTASTIAGSALMVEGAPSSWRPPWLLTTSASAPESAANRASSASRMPLSTSLPPQRRLIHSTSPQFSRGSNWRAVHSDSEPMSSTPLTCPTMLPKPRRRVPSMPSAQRGLVAMFSRLARVGRGGAERPFFRSLWRWPMICRSRVSTSASQPAALARSIRRSMKSRSRIT

SEQ ID NO: 25554 - protein, 382 aa, Pseudomonas aeruginosa
WWVGAERSGNSTTSRPSASQARASEGRARATPWPLAAASRVMPKSSRRGPAQGSGQSSPATRNHGCQGSSGERSNGRPASMAGVQGRGRPSSSPGAAIGSTRSSSSRSPAATPWLSPRTSTSASGRSWPSEGLDRRISSSISGQASAKDARRGIRICRAKVGGVRRVSRCWRWTWRRCSGTAASWARIGAICSRYSRPWEVSASERPSRCNRLTPSIPSRPETRLLAALPVIDRSSAARSKVPSRAAASNACNASMEGKRKSSGLSMGQTLPAARDQGYRVRAAARWPRRGARAPRNRRHRPRKPCRGCRHPVRRGSPGRFPPGARGPGGCSPGTAAYRFRRDAGAGCGSAPGPAPPRLPRAHRSLSAGPGSSSGRPPSTSV

SEQ ID NO: 25555 - protein, 151 aa, Pseudomonas aeruginosa
TARSAIAGGKTARSGRGSAASADRWTGRKPATREPWALPRGRSPAGCSWCRRPPPGGRPCGRSGSRCRPRNGHRRRESRCVPGHGCSLAGRPSARRRESRSSPPPPPRPPAPGAPGSPPAAGRGRCLAAYPGDVAHRTVPSTRRRVRRSVA

SEQ ID NO: 25556 - protein, 581 aa, Pseudomonas aeruginosa
LAATGVAQRQLDALGGGGRALHGGHATEGVARDAGDFLAVEDAVDALDQVGIHHRIVGVVVFAQQTLAFGMFAAVDEIGELRREHFVDERAIVRRLERRGTQDHVGLHRRVAVVEVDEGLRRALPAADNGDLHRLATAAGLLGHVFQVLAVVEHPAVALERTEHLRDTRGAAGTDHQGADGAHQLLAVGVARDHPQRLDLAGAQHRLDAQDLFAVAALLLEVAGDPAQVVVELHPAGIEGAQVDEVDQTIVLVQVVDEGIRAGGVAQGHQVLEEGDLQLALRHQGVAVPAVVALLVQEQHFQGALRLGPFLEGNRQGDIGRAEADTDEIVNHGGCSCLSHFQFLWIGPLSSGSDKSRAALEGHLLTRNEDREMKFKRCRARIAKSVGFPFAHAHPTVLHRVDDVLFHQAAGNIEMFGDLRMGQAVQLAQQEGTAADGRQLGQRALQVVQALPLVDHRLRRGTGQALLVVQDLQGFRPAHPATTVLVHRQVERRPVQKSLRMLDLRLTGALQNAQIRVVGDIRRCMSIPEPGTEESQQLPIMVFQDDSCSLPLRHCPSKGGIACRRHWQYEIIKFIIILIKL

SEQ ID NO: 25557 - protein, 1149 aa, Pseudomonas aeruginosa
WPLPTAATADGKRHATRPPDRTARHPQALRRQWHSGSRGTQGRIAVDPRRRVRRHRRRLRLRQVDPDEHPRLPRPAQLRQLPLRRPRRRRTGQRRAGLAAPRGIRLRVPGLSPDPLRLGPGKRRDAGDLRRHPGERAAHPSAGPARTPGPGRAHRQPSAPVVRRPAAAGVDRPRADERRPYHPRRRTHRRPRQPQRRGSHGAARRAGQPGPRGDPDHPRPRRRRPRQAHHRGARRRDRQRQRQRRAPGATERRRRAPPAGRRSQPAPRRGQQRTLGGLARRTAGGGARRLAGDVDQSVPHRADPARDHHRRRLGGGHARRRRGQQAPGDGADGRVRLEHHLSQRLLAEPARADGHRQQRRRRRHRHPAPGEEGHAGERRRAGGALREHRLPRLRRRQQHRLPGNPQLAGGRGQLLHRARRRRRHHGRGDRLQGAQEAVRQRQPDRPLHPHRERAVPGHRRARRERLQLRRQGCRQPHRHPLLRCQHPPVRHAQPRVRDHRRRRRPARAPGRTRHRPVDAAPAPRPARLRADQQRGDDPGRGEDPEHPVADARLDRRDLPAGRRDRRDEHHAHDRARTHPRDRHPHGHWRPPGRYPPPVPHRGGDALGGRRPGRDRPGPVHRRRAAARPGRGGLFPVGHRRRLQLRAGHRPGVRLHAGAQGRPAGPGGRPGQPMTDMSMKNLSLISACLLLGACGSTPAPLDSGLAAPSQWRYLAAGRSDASDIRQWWKAFGAPELDSLLQRALLNSQDLGAAVARVRQAQASAVIAGAPLLPELNATLGASRQKLLRDSGYSGTDATSDNDAVDSFSAGLSASYEVDFWGGRRAAYRSALESLKASEYDRATVELTLLSGVANSYLQVLALREQQRIARLNLDNAEHVLRLVETRHAAGSATALEVAQQSSLVASQRKQLPLLEQQAHEALITLATLIGEPVQALQVAERPFDSLRWPETGAGLPSELLSRRPDIANAEAQLAAAQADVQVARAALFPKLTLSASLSSGANRAADTFRNPYYNLGANLLAPIFNHGRLRAERDRSLARQEELLETYRKAILTAFADTERSLNSIDGLDRQLHWQQQELEQAQRAFDLSDSRYQAGAETLLTVLETQRTLYAAQDAAVQLRLARLQASVGLYKALGGGWQSDRQGLARKD

SEQ ID NO: 25558 - protein, 470 aa, Pseudomonas aeruginosa
SPAVIPMPTSPSSGEATSCAPGAKCKNAPSRQPPPDHAATDLPMNDRRTFLKQAGILAAGLPLLSAAQSLRAEGVPSDAGNKWKALRQQFDLDPQYLHFANFLLTSHPRPVREAIERLRVRFDRNPGEAVDWHREEIWKYEDEARAWAGRYFAVQPGQVALTGSTTDGLAAIYGGLLVQPGKEILTSSHEHYSTYTTLEYRHKRMGTQVREFPLFKDPHRVSADEILSSIAAQIRPQTRVLGMTWVQSGSGVKLPIREIGKLVRELNQKRDEQDRIIYVVDGVHGFGVEDVSFADFDCDYFIAGTHKWLFGPRGTGVIIARSEQLQEHLVPSIPTFSRADNFGTLMTPGGYHAFEHRLALGTAFELHLQLGKAEVQARIHQLNAYLKQRLGEHPKVRLVTPTSPELSSGFTFFRVEGRDCEAVAKHLMAHRVISDAVDRDVGPVVRLAPSLLNDEAEIDRVLEILAPQLA

SEQ ID NO: 25559 - protein, 350 aa, Pseudomonas aeruginosa
PLSPLNENRHARIIAPGPGRTDRRHRPRLRRRSEETRHGVQGLQGLPGDGRTARRQLHHGHPGRRGRPPARRGPAARRDLRQAVRHQPLPGHRRRTGRLPESHRRQAGRRRYPPRPRMHRRQAALPARPSPAGGVRRLQRREELRRLAVEEDRQALPHAQRGRARVRRPRRQRRPLPLPVRRRQGIQHRQARQHLRRQRWLQLHLAGGQLPAQRLRRLRHARQRLRVGRRLLARPLQRRAERRQRVDGGQVRAGADPRQRLGRAADLLALGQPQQCGPQRPRRLDRLPRGARTLIQNEEGRSDDTAPAFSNPSKEPGSELLGEQRQPFVQGREQAVVEVVPAQLEDGVVG

SEQ ID NO: 25560 - protein, 169 aa, Pseudomonas aeruginosa
IPTPCLPSAPTIRTTIPRDRAGRAASRSSTARATATTSPAPSTTEPSGAVGSSTPAPSSPTSSTISPTAGSARCSSITRSTATTRPSARSWATGRHRTTAPRSLRRSTPAKPRATRWISISPAPSSSSVASTSWWSAPRLPSPTGRARATGTCATTTTPPTTSSTGTAI

SEQ ID NO: 25561 - protein, 133 aa, Pseudomonas aeruginosa
TIPTPSTPAIPTSSCRRTVGIATAATSCSNPTKARTTRSASRVNISTDDSIPVSPTSRFMRKTARRKTPSTTANRPTPPSPTPTRASRPRPRATRRKSRVNWRQAGRFRLAIPTRSFATTVARRFPPGSLRTS

SEQ ID NO: 25562 - protein, 412 aa, Pseudomonas aeruginosa
VTAQFEEVVVQADPFHSQDLRPDRCDALLQLATGRSIGLLRQARIRLRQRLPVELAIDRQRHPLQQHQVRRHHVVRQVPLQRLPQRLPQTLGILRRVRHHVSHQLRAADPVMGQHHGITYPGQTGERRFDLTQFDTEAANLHLVVDTPDVLDIAIRLEPCQVAGTVQPLAGTAGERVRHEAGGTQPGPPQVAARQTGATDVQLAHRAARHRVQVTVEDVPGQVRDGPADRTDQATLQVGFAHRTVGYVYRGLGDAVHVHQLRLAIAEALEPRPQALQIQRLATEDHVAQRRLLRRHVGGTGHRHQLLERRRRLVEHRHAFAAQQTVEVFRRTAHPLRHDHQAPAIEQRAEDFPDREIEGVGMEQRPHVPLVEAEPGLGGAEQAQRVAVGEQRALGLAGRARGIDHVGQVVRR

SEQ ID NO: 25563 - protein, 497 aa, Pseudomonas aeruginosa
AQGTRNMVGRAFRLQLPEEPLTLLSEGQCQRLLPIGKRYRRDRIRRAFQSLGERFQNRPLEQRLQACVQLLLLANPRNHPGSQQRMTAQFEEVVVQANPFHSQDLRPDRCDALLQLATGRSIGLLRQARIRLRQRLPVELAIDRQRHPLQQHQVRRHHVVRQVPLQRLPQRLPQTLGILRRVRHHVSHQLRAADPVMGQHHGIAYPGQTGERRFDLTQFDTEAANLHLVVDTPDVLDIAIRLEPCQVAGTVQPLAGTAGERVRHEAGGTQPGPPQVAARQTGATDVQLAHRAARHRVQVTVEDVPGQVRDGPADRTDQATFQVGFAHRTVGYVYRGLGDAVHVHQLRLAIAKALEPRPQALQIQRLTTEDHVAQRRLLRRHVGGTGHRHQLLERRRRLVEHRHAFAAQQTVEVFRRTAHPLRHDHQAPAIEQRAEDFPDREIEGVGMEQCPHVPLVEAEPGLGGAEQAQRVAVGEQCALGLAGRARGIDHVGQVVRR

SEQ ID NO: 25564 - protein, 125 aa, Pseudomonas aeruginosa
SWTSSSTINCIDQPSETIWCWTMTSTCSSASTSSKVTRSNGPCSRSKGRAISASTRSSNRCSSSPRCTSTSSASETSAETTCTHSSPIRAIRVRRLSCRSTSAAKLRCKDAMSNLPRRRRAVGMW

SEQ ID NO: 25565 - protein, 197 aa, Pseudomonas aeruginosa
CSTRACKAASSAFAFRASRGFNSNDWFQCWRLGIGCSKNNRWNGNNTVSPLTGPCSICTAAPTRATRASPCTVCCWNRSFGVNWMPAARHRLTTWIETMESPPRAKKLSVAPTSSSFSTSAQTAAIRRSISFCGATCVCPAAACGRGNALRSSLPFGLSGIRSSASHCAGTMYSGRLAARCAVRASRQSPLSLSSTT

SEQ ID NO: 25566 - protein, 110 aa, Pseudomonas aeruginosa
AMSIHTRPWRLPLAALLLGLSGAALAHNPICECEEVQAGEIRCKGGFSDGSGAPGVTLDVIGYDEQILVPGKLGADSTLTFKRPDGEFYVLFDAGPGHVVEIDHADIAAP

SEQ ID NO: 25567 - protein, 90 aa, Pseudomonas aeruginosa
MPPNRASTPTCRSPPKTSRRAWTTAKPRPPSTNWPPRASRPSSPTSPRAVAASTAGATAKPPGVRATWASAANPRWPARSSCCSAPPKSG

SEQ ID NO: 25568 - protein, 585 aa, Pseudomonas aeruginosa
PVSTAIDRTSTPQKAFFHAVLPSLIPSARPRRPPPGPRPAGRPAAGPARPADPGRRRQTPAHRHHPASLLQLREQHRRRQGRGGAADPRRFQPACLRAARRGHQAHRHARRGGAQRRRPRRFRRAHDRLQRKARHPGDRGERQGAAAGRHRHGRARRRQGGQPAYLPVHQRLDHPGQHHRPRTGQARPGQRQGLHPQRPGLRQAPAGPARRRPGAAEQGPGRRLPRRHHPRRLRLPAARIRPGSHRRGRAGPRHRAESEPVEEDHRPAQGAGREGDLLRDRLPLHLRRDHPARVRGEALFAVAHFLWRLQRRQVRGRNGAQPRHRGPRHPGVRRMTVAERLCATPCGPAIDFAGIDLSLGGSRILDGVRLRVEAGSVHALVGPNGGGKSSLVKTLLGQMPHRGELRLEWPGAPGCIGYVPQALEFDRGLPLTVDDFMAAMCQRRPAFLGLSRSRRPAIDAALERVGMLAKRGRRMGALSGGERQRVLLAQGLVPPPQLLVLDEPMSALDEGGIQVFERLLLDWRQAGVTVLWIEHDLEAVGRLADRVSGLNRHLLFDGPAASSLTPERLLTLFSTQPRKNAEASR

SEQ ID NO: 25569 - protein, 274 aa, Pseudomonas aeruginosa
RSARRRTVPVRNRCGFPRPRPATVPRWPCPPCRQAFGSDRPAAGAAGDDSCRRAGNRRAGSAGSGSSARGCPAPLPAYLAGRAGRRSARRRSSVRRNRGHTRRVATAPRCRRRRTPAASGNPARARHTAPRRRARRRGCARASRRGPGGPRRAARAPVAAPGSPGRSATARPSAPRAPATPPDAPPARPAACAASGCRSWRWRRNTAGRTAVRAYRPLSRPPCPCAGAGSAGACRSRLPRCRPGSPSSGRSCRPPASPGESPCIPARWNTAPHG

SEQ ID NO: 25570 - protein, 639 aa, Pseudomonas aeruginosa
PLPGTGCRHGRTLKSLLAPDGIERPRAARPLRWITKSPAGKLAGQRRAEGAGETPGHLVDLFGADDQRRQEAHHAAVAAAQFEDQAAPQALALDPRGQGAVGRRMTEGIRLALRVDDLDPEHQPPTADIAQLRIVALEDAQVLGQALAHGRRVGRQVVFLQVAHHRRTGGHGHLVATEGAGVGAGLPFVQPFAVDHHRQRQAAADGLGQHHHVGDDAGVLEGEHPAGTGEAALDLVDDQRHPGLLGDPPQAAQPVEIGRDHAALALDHLDDHRRRQLHAAFRIVQQVLQVVQVRLDPRLAAETERATVIVGIRQELHARAEHRAQRLLRSEIAHQPQRALAHAVVAALERQDGAAPGGGAYQFQRGFHRVGAGRAAELDLRLGGQRRRQQAEQVLDELVLHRGGQVEGVQRQLVGQNLADRLDHHRMVVPQRQGAGAGQAIDEGTPLDVLHQQPPGLLQRQRNPPRIAARVGLLAALPFQQGRLRELVERFALRRGGAERLVFDDAGGDVHVFNPQGVVVFHWQPAIRPPGAAFADRMHRRRRRDARIYCAGPQHRARTASFGPDTVEQAASRCPRRSPARSRCRRRRRSATPRRPPAPTPPARRTTASRPRRRTRSPPAAAHRRACRRRTAHGPPGSR

SEQ ID NO: 25571 - protein, 677 aa, Pseudomonas aeruginosa
KASSGLKRSAVAIAKHSSRETQASRREGTGRRFEPPRPCARRGQRGTARRNGDWGARAPSATDLREALEFICKDLSEAIGTLAILPMELRAPRLTETGVATFPALPPGCRAAPGAPRRRPIRARRLPKRRQPMPDRTALPRAMLAAWVLLLLAACSQGPAPTPPASWGWQDASGERAIAPDEAYPELFQAVQESRLFSDQKHFVDALPLREPARIRADYLRERERPGFDLRAFVGRNFEESGSVETAPPEAGADLASHISDLWPALTRHYEQVPAHSSLLPLPKPYVVPGGRFREVYYWDSYFTMLGLAESGQHQRVRDMLDNFAYLIDTYGHIPNGNRSYYLSRSQPPFFAYMVDLQARREGDAAYRRYLPQLQKEYAYWMEGSAGLRPNEARLHVVKLADGSLLNRYWDNRDTPRQESFLEDRATAARAPQRPAGEVYRDLRAGAESGWDFSSRWLDDGRELASIRTTAIVPVDLNALLYHLERTIAKACASSALKACEQGYGARAEKRRQAIEGHLWHPAGYYADYDWQRRRPIERINAASLFPLFTGLASAERAGRTADSVAAQLLRPGGLATTTRASGQQWDEPNGWAPLQWVAVQGLRAYGRDALAEDIGRRFLAQVQQVYDREGKLVEKYDISGNQGGGGGGEYPLQDGFGWSNGVTLQLLRLYSPGAGR

SEQ ID NO: 25572 - protein, 394 aa, Pseudomonas aeruginosa
ASARLRVLALRGVGEACGEKVDQRADRRQQPAPRGEHCHHHAFHRRPLRQHPHQPALGQVATDHAERQAADPDALQHRLAQGAEVVAEQLRAQVEGRAAAIRADQPQAAVQARTLPADVGHRRQVGRQLRRAVAGQQLRAGHQHLRATCQHLHHQVAVLQRRETQRQRDVVAFGDHVDPAIEGLHIQLDVRILRHEARQHRRQFEVQQRRRAGQADHSARLRAVLFDDVLGSLRFHRHRHAMTVVGLADLGHLELPRRALHQAYAQARLELRDLAADGRLGNPQHPPGGGEATVLDHLGIDEKRVQIEHQLTTHRSTCETLRLDLRTTGSHSRELAYRSIDSIEEHRREKGPGNLRQRQPPLGGRRIPRSFALFLQHTGPAYQPVPLAGLRRAC

SEQ ID NO: 25573 - protein, 205 aa, Pseudomonas aeruginosa
HRWNAGNGPAMGQPALQRQDEPAALPDPAGCRHSPRRPARQGRRTAGDRRTLRPPPGAGADPLAAGGLGRAAEGRQAPRPRPAQGTYLRRGGHARHPRGRRRDRSRSPGRHARPRRPAAGTGSQQRRAVAGTQRRAAGRADHRLRPLRDEQPRGNRPGHRGLRERALHPRPLKSAPLRHGPRRKRGPGRALPEIHGRPPCKRKWK

SEQ ID NO: 25574 - protein, 92 aa, Pseudomonas aeruginosa
RTTISARSNWTPASSKPPACATRAATVISPAATATAPRAVSPPIAKARTSPGWAPATAPPAAARRRSTAAAWRISGTSTTSASASRGGFPAN

SEQ ID NO: 25575 - protein, 175 aa, Pseudomonas aeruginosa
PCAGPPTAPAKATPPPATPAATPAPTNTGWWSTTRSGCSEPTEPEKRETPSCVQPCYPPSAPSPPHSAWRPAPTPSRCRRWRSATPASWTASAVPACSSNCPCNTFGQTTPATPAGIRFPVGNGFVAPCCCRTSPTSARTPCSAPTTAPKCCCRWYAWTSISTAARTAGAPARAT

SEQ ID NO: 25576 - protein, 254 aa, Pseudomonas aeruginosa
GWLGEEQGPRRRSPTSRRDQPELAQQATHLIAQRRAGPHQTTAHPMHRLHGLLLCALHRDIAHARTTGGFADRLGVVCIVLVPLDVGFDELRCDQAYRVAQLPQLARPVVRTAAGLHRHQARRQLAKEIPHLCPLELATTYHMLVTINAVHLEYLFCQIQTNATKVHADSPSGTCGCTISLALDAVGGRSPFHCPTELGSCPAFPGCVGRIPPQAVSADTPDKRRITASGYSPYGAGEVSAFPGRYPPIQNASR

SEQ ID NO: 25577 - protein, 330 aa, Pseudomonas aeruginosa
  UNSURE (95): Identity of amino acid at the above locations are unknown.
PSCTAAMLGKAMHTLVMVPAMISCFLPVAFTAATNSGLSQALISPLRATYWACGAASWISGISGPLGPCGTEAVVITGIFARVATLARVVALARXSVIGMSLTVWNRPLWWSISNMAALAGSIFGVWPLKLAGALISISSCRVVVREFRAKPGRARASCAGHVVGGRTSVGADEAPVLEVLDGLVDFLAAAHHEGAVADDRLVQRLAAEYQQLHVVVGFQFQPRVVAVEHGDLGFANDLVADREGAAHDHHGAGMSLGQVEGEVLAGLQLHVPDRQRRVGQRRPLVAAVASGDHPQFAGPVGQADAGNVGIQQGLVARRVHLVAGGQVDP

SEQ ID NO: 25578 - protein, 144 aa, Pseudomonas aeruginosa
LDHFQRSTCATEAFRVVLLVEDPGGRRHPLHIPRPDASAGTGGVVVLDLALVDDGHRLEAAMRMLAYAAALLCGGEISRPGVVQQEERADMLAQCVVGKERTNGESVAHPVAVGVAVDSQDLFHVGAPRLSRWSDTLVPGSGNR

SEQ ID NO: 25579 - protein, 185 aa, Pseudomonas aeruginosa
PAGAGGQPGAAGPLPPAGAAGRPVGDALRRLGAFAPGRQPAAGRRGWQQRGPQPAPATAQRRPRHLAPGGAGGRRDRRPAALRGQSRPGRAPAGAGAAGVDAGGRHGGGNVPLAARAVAFGPRADRLSRRRLRRRRAAPVPGAGLRLSDRRPGCRVGAVAGSRRWTSRSRPATGTRHRRRRPGCR

SEQ ID NO: 25580 - protein, 173 aa, Pseudomonas aeruginosa
GPPGRWRWCGCWPVRGRRPASGRRSPSRFPRRPAGRDRPRPRGAAGRARRSPDPPGRTPGAVCHGCPSSGSAGCRRPVSPRAGAPRWGAARRSLPSSRRIPSVAAAGSAGRRRRLRVLPGGPPCRRRTAAANGSGSSCGYRWECARRYRSGRRSCRACRAPVGAARSPQGRAW

SEQ ID NO: 25581 - protein, 469 aa, Pseudomonas aeruginosa
CRPGYGCRSRRCCCWRWERRSWRYPRRRWRMASLHSLRPVALALGLVLAGCNQGSQNDPQQQTGANPALPEPKHFLLPPMKVPEGVGWSGEAKPTVAQGLKIEKIADGLQHPRQLLVLPNGDVLVVEANSPGTAPVTTPKQLIAGMVKGKSGKAGKGGNRITLLRRAGAGGQWQKYVFLEGLDSPFGVQRVGDYLYVANTGNIMRYRYVPGETRVADPGMEFTDLPDTINHHWTKALLASPDGRKLYVGVGSNSNITENGAAIEYRRAAILEVDVASRGSRIYASGLRNPTGLQWEPVSGKLWTIVNERDEIGNDLVPDYLTSVREGGFYGWPYSYFGQHLDSRVKPQRPDLVAKAIVPDYALGSHVAALGLFFYTGNELPERYRNGAFVSEHGSWNRSPVSGFQVVHVPFADGKPAGAPQPVVTGFVSADEKQLFGAPVGLAQAADGALLIADDVGNAIWRVSAAGTD

SEQ ID NO: 25582 - protein, 569 aa, Pseudomonas aeruginosa
RHARRHQRHRRPAAPRHPGGGRNALRVLSVALAGTAKPPGVQRAQLSAADSAGAEEGQGAAGGGRRGAYLHRLPGRRRHPGAGAQPSGGDRGDPPGSGRRAAAAHPRPDHPGEGPVRPGPVRPAAAGAGRRGEDPVLRPDRHRRGGSRAETGTHRHRAQHHPVVPGRLPRHEPGRAGADGQSRTEEAAGRGAQHGRAVPAVSLRLPLPVRSRRRGGGQGEPALPGEPAERSGRRRAVAGGGDRRGGPGRGRRGPGRSRLAARLAADHRAGRGGADRRRDPERLRPYRQDVRLRARRHRPRRGGAVQGHRRQPAAGGGGLPRMAGQMAARRPRRHLPWQPDGHGRRFGGDALPEGTRPGGPRGGHGRAPGRAPAHPPARLSATGRYPRSGADARGRDRRPAGRGGCPRSSADRRRPGLAGPARVPEARPDPRTGRPPRQRGALPAAADHRRRTDRRGGPAFRPRPRRGAGRLIFPPGFSLSNARAVLRAAVRSHQEQAMTSVFDRDDIQFQVVVNHEEQYSIWPEYKEIPQGWRAAGKSGLKKDCLAYIEEVWTDMRPLSLRQHMDKAAG

SEQ ID NO: 25583 - protein, 254 aa, Pseudomonas aeruginosa
VGGTPVRLFCLPYSGASAMTYSRWRRKLPAWLAVRPVELPGRGARMAEPLQTDLASLAQQLARELHDEVRQGPYAMLGHSLGALLACEVLYALRELGCPTPLGFFACGTAAPSRRAEYDRGFAEPKSDAELIADLRDLQGTPEEVLGNRELMSLTLPILRADFLLCGSYRHQRRPPLACPIRTLGGREDKASEEQLLAWAEETRSGFELELFDGGHFFIHQREAEVLAVVERQVEAWRAGQGAAALAVESAAIC

SEQ ID NO: 25584 - protein, 440 aa, Pseudomonas aeruginosa
CPRGRHRPCGGSDVDEKKAGEQRSPAFFVTRRGSAFTGQQPFDYRFHVAFQAGHRVRRLGVHHYQACAAGGDGIGEGLGWLAMVQDQGDILALQLLGESLDIGLGPAVVGLDLHVQRVQVEPGEQVAEAFGEADHAEVVGLRQASLVTGGRFQQLLLQRRQVGLDGRCGAGRQAFQVAGEDIGHAPQVGRVEPGVGMQVAAGAQGDAGQGAVHRTRGVDLDDTDIATAGQRVERVVAPDRAQVDHRVGLPGGLGQAAGAAPGEERGLAAGRQVGRGDPLQLDLGVPQQAFGEGVGDRQAGQYRDWRGLGRGRRRGEGRERAGESGASQGQGEAMGFQVHPGVPFRCGRQPRAMAARPKARPATRMIAAPEGIGRSNMIGNRIPASVLTVAISTASQKNPFSDWLTRRAAAAGITSRAPTRIAPITFTAATVTRVTRATNR

SEQ ID NO: 25585 - protein, 367 aa, Pseudomonas aeruginosa
PANSCRRRSVRPARARYRPRRAGARHRGCGCRRGSGRSRRSRWPARKAWRKAVRPRSCAGLLDGADHGVEVARHFFLVLAGAVVAIGNVRQRIELHPGLALDGLDVGGGEVDLGEDHLHVQRLELVDGLLQLARTRLDAVGRLDHGGDFQAEFAQQVVVGAVDGGDAEVGGRGLVQPRQGVGAQGPQALGVGPGVAGVGLGVGRVELAQFAGDGVDLGDRGADGQEGMRVDHLAGAARGHAGGGQQRHLGVRLDHRDAGLFAGGDHALGEIVVADAVEHHHVERADALDVLGARLVGMRVETGGDQRHHLGLVADDVAHVAVVGMQGDADAQAFAVFGLGQRGEQGQQQGGQQGAAREEGGEAARTG

SEQ ID NO: 25586 - protein, 481 aa, Pseudomonas aeruginosa
RSGSSRRRACREPGSARRSRSRRGLRRGRRCRRRSRPCSGSRRPALPRIRRSGCAPGPRRSGRATGRPGAGARGGCGCSLLTSFVQPGHGGGGCLGQGNGSLVHGAVPTFHGDPQLGVGPGARRDRHAGAHAVGAAEEDHPGGTQAARLADAQVGRLDLGNAGLAEGGIEVLHEAGGAFVVRRFDTPFGELETPGAYLDFADLAFTQSAAAREQRHVGEITWHEAERDQDQQNVQVETPAQPELAQRRNGLGDGGLAHGCPSAVWLAITGAGLAGFGWRAGRLPRLTSAAVACAVRLLQISRPLSTIMLSSRPKTNQISLTQIPPKSPVCRGRMDSVTNCRGVRSLSRRVVSILPRIKVQRGRLEHERIPAASGHEHRAVGVAGQEHRAGLQAGDAPGDEPHRLVQLDVWNLLTGCGAGHVGACDDRRDAVVGQGDVVVGKDGLDQEPGAGDGNQGDEPDRPDAAQAMEVAPEDPGALVDA

SEQ ID NO: 25587 - protein, 93 aa, Pseudomonas aeruginosa
PTRPTCSRRGPSSAWRGIGRTCCAACWKTRRPASTRCRCSMPRSAISCWKAGTPLRPSTRCNAACTGCSRSRSSAHRRRRRWPSARSAWTTPS

SEQ ID NO: 25588 - protein, 391 aa, Pseudomonas aeruginosa
PQPAVPGAVQLPERSPWQRPGIPLRRVTDGKRAVRQPDGAVRLDVGPDGRRAAFLRRFRLRHRSVRRLHRGTPGRPLAQPVARHRRQPTTAARRVAAAGCAGAPADPLRMEPGPARVRGAGHLAAAFRGAGAATATGGCADPRRTTVELRRTECAGQSPGALPDRPWRWRGRAGRAGAGAFAGHAGRLAGDPQGRRRLPAVGPGGARGAPGAYPRRQWGTASADPGASARAPAAAGGGGGAGHRRTGAGRLRRERSAPDAIGGQPGLRDLYLGLDRQAQGHIAHPPQRAAPVQRHRGLVRLRRAGRVDIVPFLRLRFLGLGNLRRAALWRVPGDRAAMGEPFAGRLLPSAVPRRRDGAQPDAVGVQATDGGGLFRRHGDAAAGAALRDLRW

SEQ ID NO: 25589 - protein, 552 aa, Pseudomonas aeruginosa
FHAVAGLVPGAVVSLQRAGGYPCRCADRQSQPRGDRAADRLLRQHPGAQGRPGRSDGLRRAAGPGPPTRAGGPGAPGPAVRATGGSLAAGAQCQPQPTVPGAVQPSERDTLGDARGSVGGPASGRPGLGRPDCAVRPDAGYSGRRKRHLGLLRLCHRSVRRLHRGTPGRPLAQPVARHRRQPTTAARRVAAAGCAGAPADPLRMEPGPARVRGAGHLAAAFRGAGAATATGGCADPRRTTVELRRTECAGQSPGALPDRSRRWRGCAGRAGAGAFAGHAGRLAGDPQGRRRLPAVGPGGARGAPGAYPRRQWGTAAADPGASARAPATAGGGGGAGHRRTGAGRLRRERPVNDVIGGQPGLRDLYLGLDRQAQGHVAHPPQRAAPVQRHRGLVRLRRAGRVDVVPFLRLRFLGLGNLRRAALWRAPGDRAAMGEPFAGRLLPSAVPRRRDGAQPDAVGVQATDGDGLFRRHGDAAAGAALRDLRWRGAGSAEPAAVVPALRRSPAATGEHVRHHRDHGTRNLPSGERSRPEGWPGQSDRRDHPGPVLVHPRP

SEQ ID NO: 25590 - protein, 162 aa, Pseudomonas aeruginosa
ARRFAAVHVPSEFRLCALLQDPRHGAAGSSSGQGCCLPCPAGRWSRGAGVGRYGCGIRRAIAAGAPRRGFQPGGMVARRQPGDGCRGPAGAAWAAGGFRRLDRCAGTGQGRSVLERDRADAGGSPEPIRGRDAGGTARCHVSGAGRAYRTGLVIDLLRHDGR

SEQ ID NO: 25591 - protein, 70 aa, Pseudomonas aeruginosa
RALRVRVLVIAVPVRFEIESADERLPKRTHLSGWDEAGAGKFSAAGGIVELPVERHVGGKFADGRNVLAG

SEQ ID NO: 25592 - protein, 284 aa, Pseudomonas aeruginosa
LAAHALGLGDEGPLQRRPGHDRPFSGRFRPALVPPGERLPRRPVFLPCESGVLVVPRLDRRPHRGLVSRPRAFPSWRSAAPRSGGHPMVRAWSMGRGRRSLAGPGDPWMRAFGCPGEQQLGGAGRGNHEAGFAHHLQRRRPVERLAQACAAAALVRAQPEAGARPAQALNGERASKDGGGPRNAGLSLSARDPGGRSASRRRGPCTGRPRPAGGPVAVARRHPAPRTACVAFRGPSAGFPRRPGSGCRRDRRRAAPAPAPAAASAAGGRGRRCCSASVRCRQRR

SEQ ID NO: 25593 - protein, 856 aa, Pseudomonas aeruginosa
GRRRRSRRHRCRRSRRYRCSPSRAGVSAGWRRASHSAPAATARRRSPPRPGPGVRGPPPRRGPGCSAGRVAAGCPVPARRRPSTTGGCRWHRCARPPGSATGWARPGRCRGAPACCRRRRAAGRRKSGRDSSWTYPSLAGQGGHRVQLGGLARRHEAEHQAGDQRATEGADDGRQGKGHRDLAEQQHAADAQGQGDPGQAADHREHRRLGEELAEDIALAGASGHADADLAGAFAHGHEHDVHHADPAYQQGDRGDRAEHQRQGVLGLRLGLDHRRVVGQLVVALAAVQAQHQLVDGAFGLVHALGVGGGDDHVLGVARAEQADAGSGVGDGDAVVGILVAGAGAFLGEHADDLERHVLDEDVAADRVGAAEQLLAHLVADHRDRGGGVFVALGEVAALGHRPVEDFREVGVVAADVGVVVDVPVAHHQLAAVHRHDLLHLGQGGDGGDVVAADDAHRRARVRRVAAEIDDVRAERAHLRHHLALAALADGEHDHHRGDADDDPEQGQRGAEPIDPHHPPGGAHRLQQFGAPGPRGFAAALGEALAEIVGLQVALDAGARLRRALVVGAVADDLAVAHLDDALGAGGDVAVVGDQDHHVALAGQLVEQRHDFRAAVAVEGAGGFVGEDDMAAVHQRAGDRHPLLLAAGQLVRTVGGALGQAQAFEQGPRSGVPLARRDAGVDRRHLDVFLGRGGGDQVIALEHEAECLAAQPGLLVAVQFGDVVAGEVVAAGAGPVEAAEDVHQGRLAGAGGADDGDELAGVDRQRYALEYLDFRSAIAAVALADVAQFDQGDGLRGVFHQLSLPSGAAINRRSPSSRPASTCTRRRSLMPVLIWRLCGLPLLPTTQATWPPLPSS

SEQ ID NO: 25594 - protein, 274 aa, Pseudomonas aeruginosa
STDGPPGLLSTYRSRLKGGQSRGTGNDSGNCNRRGSRSHRCRLRPFQYRPGDCPPGTGPGAGRPGSAVPGQAGRLPLARQHPGVAERVADLLPQGPGVPAQPHQPVFLRQLPAQARSSGRLHQPGHLLSLPDGVQRLPALGRQPLPGAEPLRRRGPAHRADAERRPGRGAAGDLAQRRRRGAGAHHPRPGGQSRRHPAYPAGVPCAQGRRPGVPPQPVPGTHGQAALQQWQADEDRHYRRRAERGGGLHRPQRQLPVGAGRHDPACLGAQAGGR

SEQ ID NO: 25595 - protein, 891 aa, Pseudomonas aeruginosa
APVAPPTARTAGGVPRRPRDRPRLPPADRRALQGGDLRAGLQPGQPWPQRHPAVGAAGACRGNLRLPVPAPEARYCGPRPARARPGQLIGATPPRPVLPVSPPGDARHAGRFRCMSRPFRPPLCRETTSMGMRTVLTGLAGMLLGSMMPVQADMPRPTGLAADIRWTAYGVPHIRAKDERGLGYGIGYAYARDNACLLAEEIVTARGERARYFGSEGKSSAELDNLPSDIFYAWLNQPEALQAFWQAQTPAVRQLLEGYAAGFNRFLREADGKTTSCLGQPWLRAIATDDLLRLTRRLLVEGGVGQFADALVAAAPPGTEKVALSGEQAFQVAEQRRQRFRLERGSNAIAVGSERSADGKGMLLANPHFPWNGAMRFYQMHLTIPGRLDVMGASLPGLPVVNIGFSRHLAWTHTVDTSSHFTLYRLALDPKDPRRYLVDGRSLPLEEKSVAIEVRGADGKLSRVEHKVYQSIYGPLVVWPGKLDWNRSEAYALRDANLENTRVLQQWYSINQASDVADLRRRVEALQGIPWVNTLAADEQGNALYMNQSVVPYLKPELIPACAIPQLVAEGLPALQGQDSRCAWSRDPAAAQAGITPAAQLPVLLRRDFVQNSNDSAWLTNPASPLQGFSPLVSQEKPIGPRARYALSRLQGKQPLEAKTLEEMVTANHVFSADQVLPDLLRLCRDNQGENSLARACAALVQWDRGANLDSGSGFVYFQRFMQRFAELDGAWKEPFDAQRPLDTPQGIALDRPQVATQVRQALADAAAEVEKSGIPDGARWGDLQVSTRGQERIAIPGGDGHFGVYNAIQSVRKGDHLEVVGGTSYIQLVTFPEEGPKARGLLAFSQSSDPRSPHYRDQTELFSRQQWQTLPFSDRQIDADPQLQRLSIRE

SEQ ID NO: 25596 - protein, 143 aa, Pseudomonas aeruginosa
RRPTAARFQGTRAGSEQGCSASAGTRYPLVHERSVTMTHSPVKQMLKEAGLKMSLARLKVIDALWEASGEQGRVPIRTLHRRLSETGTPLSLVSIRQVLGRLVESGLVTLDEQDVYSPGKASWGGAAGSAAPERRAAANEQRL

SEQ ID NO: 25597 - protein, 114 aa, Pseudomonas aeruginosa
SQGRPQGQPAGDPPAVPPGPHHRRAAGRPQRCRGPAWAVDLPRRAPARAARLTPFPLAEPLAFRRAARSGPPGMLPRPGDSRPAWVSLNSIQRYVQFCQVMRRSPLANNLPSVR

SEQ ID NO: 25598 - protein, 817 aa, Pseudomonas aeruginosa
RATPRPATSRSRRPWPATSAAAAPTTGSRRRSTTPPPSCRRPRHEALVPRRSGHRQSQPPRFPQGRRRHRRAAGGCQLGLARRPGRREEGLRRRRHAPRLGGQPEDLREHRPGRHGRHRLQPLGNGPGRAHQPGDGGGRRAGGRLEPGQGDPGARRRSALRQPGHRWLAQHAPLVRTHAPLRCGGATDARTGRGQPVEGPAGRVPRRTEQGAACAQRPFAVLRRTGRGRRGSRSAGARQAAAEEARAVPLHRQGRGARHRRRRYRQWPRRLRLRRALRRHALRRGRPAAGLRRQAQALRRRRGAEGAGGGQGDRDRGPADPVRVPAAGRGRRGGAEHLGGDQGARGAGGRVGRRGQRRLRLGGLPQATGRGRAQAGQGGARQRRCRGAVRQGWGYRRGRVLPAAPGPGADGTAGLHRLVQGRRLRSLGPDPGAASDPRAHRRAPEAAVRQGHGQRDPARRRFRPQVQARLRAGSGDPGQGVPRSPLAGASGTRGDHLHFPQFPTQYPVERLPGRGRRPTGFRQAWLHRSVAPSITALFGPDSKLQGAFDLGMGLTNLPFAIPNVRLENPEAPAHTRVGWFRSVSFFPLAFAIQSFVGELAAKAGQDPKDYLLKLLGPARRIDTAELGDSWNYGESPERYPLDVGRLRGVIEEAARQSGWGGELPRGRARGIAAHYSFVTYVAVVIEVEVKDDGALLVHKATIAADCGPQINPERIRSQLEGACVMGLGLAALGEISFKDGKVQQDNFHQYELARMPLAPKAVSVHLLKPDGDLPLGGVGEPGVPPIAPALCNAIFAATGKRIRELPIRNQLQGWRKA

SEQ ID NO: 25599 - protein, 95 aa, Pseudomonas aeruginosa
RGWPRSPCAAKAASGRQGGQRVALCAALSSQLKVNSSILFILLINKINSLLKVFHKKWESSQPLQAACLPSKRDRQFSRIDDPASSVREAVMAVQ

SEQ ID NO: 25600 - protein, 273 aa, Pseudomonas aeruginosa
PRLACGLSCSSMRNGPSRLPSSRLPARWLSPRTRSSLPDAAMRFSSVDLYQAALEGQHAAAVHRLFGAGLVGQADAGIVGQAGAGLVGEGGAGLVGQRRPGLAGQRGAGLGGEVGVALQGQAAAALQGEGAADLDGQVAVHRQLEVAADLVAVVAAGAVGLVGAHRHRARVLHIQAVAAGLDGHRALAFLQGDGLVAFLHRAGAGVLHRQGLVVADAGGAVVEHVDVEVLLRLEEDFLGVLLVLEAQLVEAATALRRVGLDPGLRLVVRQRVG

SEQ ID NO: 25601 - protein, 392 aa, Pseudomonas aeruginosa
GVVAVVDAAGDQRAVRVAVDEGDDHFLADARHELHAEALAAPGQHHAHPAGGGLVVLAVAVPGELDLDPAVLVGPDLLAGLAHHQGGLGVHARLGRDPRGAVGGGLGDRLEAVAVVRVAGVVGDRDQHPVDIQRIVVMPAEGEPVAGHQPAAVALADQARLLAAQAVDALLGQAVALGLGGVAAGVLVDAGGAGNRLGLGVQRGARGGELVVGGAVGPGYRLEAVLRRTHALQLAHADSLAQVGHLRAVGNRREGVVAVGQHQGVLAGGMGEEPEDAVFLQQPRDEGEVALAILHAVFAGLVAAAELQLVVAEAVLVEDLGDDVAGGQVLEHPVVAGQRQPPEPGAQQHLVALGAGIAGELADLRDQAVERTLVGVVVQGGGEMGGDCAVQG

SEQ ID NO: 25602 - protein, 366 aa, Pseudomonas aeruginosa
PIRSPSETGGCRDASGRSFEYPLRQLPRHLRHQHVLDIPRARRAALGEHGLDDGRVEVELFAGSGLVAFPQFFQLGHDDAFQGGFLQRPVRHHGHAREERRAEGLQQDFAQALVEGRGGDLFGRAVQQQFGADVAGGEDHGVPEVHHQAGAVFHHALVEHVVEGFQHVRMGFLDLVQQHHRIGLAAHRFGEHATAAVADVAGRGALELADGVGLLVLGEVDADQVAFAAVKGVGQGVGGLGLAHAGGAWQEEYADRLGRVAESGAIGLDALGRWRPGRPPGPSPPGPFVAPGNGWRGLRRRASCPPGCRSSRRSPRPRYASPPAREPAGRPGGWLRGRPPGAPVRRPGGRCDRPVPRRAWPRRRFR

SEQ ID NO: 25603 - protein, 142 aa, Pseudomonas aeruginosa
AARSLPADARRAGRGIRRGPVAGAGRPSDSARRRRRRRAVARSARAGSSRAGRHQSNRSWRTSRPSLPCSMTNSAGVRRDPLRRLPPSWIRRRCGLPGSGSTSTSASCRRGSKCSTATRTSRASWRRSSARRRCTAVQSASP

SEQ ID NO: 25604 - protein, 535 aa, Pseudomonas aeruginosa
PTSRLSPLMSLPKSRMIASIASDSWRGAVWNGKGAPPAVPAGASSRRYRRRQVGDQADRRAEFLELEVRPEEHRGAVGPRFAGHLADIHPRLAQRVLRLDFLRCVVVDQHVVGDPVVQVGLHVVAGHEAADLVAHDHLQVVGEARCRQHVRQHRRQARVGVGLVGVVEPGLVGGLAAEEHRHVAVLLVAQGNEAEIVEFLLAAVGDRHFGRAFQRQVAGAGAERVRWQALDRAAAFRAADRRAPAVLGEGLGDALRQDPGGVAPEVLGVVGAVDVLDIVHAFHRARLRAVGQAQEEVRQHQGHVARILALAEGAPLDQLQALEDLGQVARYGQFGEAVHVEQAWAGGGDERRVGSRGDVRQLLQQADVLRMATEGEVADQQAEGVSAEGAVFLFVDLLEQCALVELDRLLQVVLQFVLADVQQAQLEPRAGLGVAHQLVQAAPGGFQLLQLGVVDDLVELVADQRIDLADAVVDHRHGVLVDGHALVEDLGGEFREHVAGIVLLAVVVGHAALCDDLVEQGQGLGRTLAGLFGGG

SEQ ID NO: 25605 - protein, 348 aa, Pseudomonas aeruginosa
RGVLARRDATASPAFPVAGIACRGAGGAHRTGLQPLVLGSDRPGTGPLCVVRRPSAGPAPRSDPARRPAGERAGWCRRAAGVRSGDSAGGRRRAAAERPPGGQSAVAGGSVAAAEGPSAIAGRRAAAGPGQRRAPRADHRLASVAAAGRRRRQGRLRVPAVAARGEGGRRLRQPALRPADATDPAGVAPGQTRAVALRAGPGEGAVPRRAPAPGAAGGQPGRRGGNPSPACRALDPPAGGRRPAGKPYGLAAGPARQPAGPGRCLGGARSAGRRAGLRSARLPRPAAWLRAAAGLAGAGHRVDPRGLPLPAVRAGGTGIFRAPARSGAASAPGGRPADARRRRRTGGG

SEQ ID NO: 25606 - protein, 347 aa, Pseudomonas aeruginosa
LAGARHRRLRPAPAVARPATHERAAAAADESPGTGGLQRWRRHPFVRRAGCRRLVRCRPAAAHRRAGQRGRQQSLADRAVRRRRQRQHLDRKEPPMPEGSAGPFSQAYQEQPLSTAFRQAWQEWLEAWGALDRDAQDVPRMVERALELSTRITRRLWRSAFASVGDAAGVQVKAMVYAFVALVDETLVFSAWPGQGAWQDKPLESHLYGSRQAGEYLPLAIKRLLDERAPASRDLANVYLQCLILGFRGRLRGPRGEALHEKWRQALFAFAWQREADAADLGRRLEQPAAAPPRRLPVRAALPDGFRLGLAVLGLVLLMSGIGHLFWRDIQHEMAAVTHLADAEQAP

SEQ ID NO: 25607 - protein, 154 aa, Pseudomonas aeruginosa
TASSMPWRPSPNATPRRWSGCRRSNPAWPPPTTTRSCASARSTPNCRNSRPTTRRAPRRSWRSWWVTISTRWTSAVAPTFSTACSCRPAAATWRRAWWTCARARSGAASRCNSSRRRRPGRTSPTTSTSTSPDASRSPTAWKRPMPSRGGCGTC

SEQ ID NO: 25608 - protein, 268 aa, Pseudomonas aeruginosa
QQPADRRLAGGGQARRLGRGGAVGQRSVAAAQQGSDARRLARRGLAATRRAGRIAARAGAAGGTLRALPRGGASASPGRRPVVAGAAHRLAVAPLCRAAAHAPAADGAGRLRRDHPLCLAEVAAPAGRQRRQQERQGGAGSGATSAEEARRSVARGALGAMAAQAGQPARLPAATATPGTVVRPLPGRTRPQLPAAARGHRAMAGLAQGVHRHAPASAAARRTATGRGGGRRRRRRGRRGKRPGERAERAGWRADQSRGRLSATAADR

SEQ ID NO: 25609 - protein, 208 aa, Pseudomonas aeruginosa
PNRCAPPCWCSTTPVPASCWSASSAWRPARPTRWSSARPAPARSWWRAISTPSADATAARSSRSTAVLSPRAWWRASCSATRRAPLPVRCRARPAGSRRPTAAPCSSTRSATCRRASRSSCCACCRNARWCGSVRAGRSPSTCGWWRRPTSTWLTRWSPDTSARTCSTACTWRPSNCRRCASAAAISCRWPSTSSSSTAGASATPARA

SEQ ID NO: 25610 - protein, 194 aa, Pseudomonas aeruginosa
RNSPQGNPMTSPFKVVAVSGGTYRPSRTLVLTQALIAELGQSLPIDSRVIELTDIAAPLGATLARNQAPAELQAVLDEIESADLLLVASPVYRGSYPGLLKHLFDLIDLNALIDTPVLLAATGGTERHALVLDHQLRPLFSFFQAITLPIGVYASEADFDNYRIVSEPLKARIRLAAERAAPLFGGRSELLKIA

SEQ ID NO: 25611 - protein, 789 aa, Pseudomonas aeruginosa
GAPMNVFWFLPTHGDGHFLGTSQGARPVSLPYLKQVAQAADSLGYHGVLIPTGRSCEDSWVVASALAPLTERLRFLVAMPSGNRFADRLGADGGDPRPPVRRAPADQRGHRRRSRREPRRRHPSRPRRALRGHRRVPSGLAARPAGRGGGLPRQAHPRGERQGALSAAATAVSAAVLRRFLGGRPRTGRRTGGRLPDLGRAVAGGGGENRRRAPASGSPWAYGEVRHPPACDRPRNRRRSLARRGQADRTHLRRDHRRRAAVLRPFRLRRPATHGRAARRPPRSPGDPAEPLGRGRPGARRRRHRAGRRSAAGGGAHRGIRRARHRQLHLLRLSAPGRGLPLRRTGLPAAARTLRQPGRPWADQPDRAVRRNDRQRRAAGSRRRLSSRAPEEKPPVNAKTRPEAQTPLQIARRLAADFAENAAERDVAGGTPKAERDALRRSGLLSLIIPREYGGLGASWSETLQTVRELARVDSSIAHVYGFQHLMLATVRLFSRPEQWQPWFELTARNRWFWGNALNPLDNRTVARRFDGWREFSGKKSFCSGARDSEMLIASALDGEGGALLIAAIPTARSGISLGQDWDNMGQRQTDSGSAIFERVRVEESELLLDPGPLSTPFACLRPLIAQLIFTEVFLGIAEGAFEEARQYTLREARPWFRSEVAEANADPYVLARYGEFWVGLESTRALVERAAQRLDAAWSKGPALDASERGQLALAIAAAKVAATRNGLDLCNRMFEVTGARSTHAALRLDRYWRNLRTQTLHDPLDYKIRELGDWALNQSPPQPTFYS

SEQ ID NO: 25612 - protein, 154 aa, Pseudomonas aeruginosa
SARPAPARNWWRGISTTSARGATARSWRSTAGPSPSHWWKPSCSATRRVPSPAPWRPRPAGSRRPTAAPCSSTRSATCRCRSRSSCCACCRSARWCAWGRARASPSTCACWRRPTCNWSGRSMPGTSARTCTTGSMSSVSNCRRCASDPATSCR

SEQ ID NO: 25613 - protein, 138 aa, Pseudomonas aeruginosa
PVAPRTARNWWRRGIANCRSCRCTTTACGASSPWWTNATTARCRSTWRPGCRWRHFIPRATWPSPSVAPSAGCARCSWHASAATAPASAAPPKRELRMAARAHPPARPRLSSRAGAAARPCLAPPGGPGTSAVPRCGW

SEQ ID NO: 25614 - protein, 425 aa, Pseudomonas aeruginosa
PAPGPAGYPPAGRWRRTRRSSAAYRGNLARAVQAWATWPSTSTLSATSAALASTPGSSPGGAPTCSSRRPRARPWIRSMPPWSRSTRWPMALAMASRSGTRRLAPVYWRSSSTGSPAPGAWRRRAWRSAGRAARRLPNRLRVTGMARIAEDFPDFALFDDAAAFEDHHAVADLADDRHLVGDQDDGQAQPAVDVAQQREDRLGALRVQRRGGFVAEQYLRLVHQRAGDADALFLPAGELRRIGVAFFLQADQLQQPGDPLLDPCPGHPGHPQRQGDVLPHGLGRHQVEVLEDHADASAQGDQALAVVAADVFVVDQHLPLAGTLQAIEGADQRGLSGAAAADDAEHFAAADFQVDLPQGLDSTGVALAQALETDVRRGGARVGRRRERFEGQQARGNGHGRHSQPGWYSVPWALSSAARTTGECW

SEQ ID NO: 25615 - protein, 461 aa, Pseudomonas aeruginosa
TKGKVGSGLALARGRGLAEGGAGVFRLQARAAAAEELLPQGAGGIGGLVAAACLQLGHHQVDEVGVALRLHGAGQIEAVQAGIGDPAFEVVGDLARVAYQGHVAAAQGQLVEELAHGGVGARHGEVLHHRLDGVVLLVADRLVESVARQVDAAGAGEVRQAGLGAGVAAVLGMLVAGLGRGGCDDHVDAHEDPDVLGATAGADHRRADALHQLAGGLAGLSGDEHAFGVARGEGQATLRGAGLEQHRGALWRGLGEVVALDLVELAMVADLVDLLRPRVDPSLAVGEHRVVFPAALPELVEDLQVLVGAVVAAVVLDLRGLAHGLGRAFQVAGDDVPADPPVAQMVEGREPPGERVGRLVGEVGGDAETQVLGDPGHGRDQHQRVVHRQLDGFAGGHLDAALVDVVDAEDIGDEQAVEQAALQQPGQLGPVAQFAVVAGAVAWVGPEAVVDMADAIHAEGV

SEQ ID NO: 25616 - protein, 183 aa, Pseudomonas aeruginosa
SPTAWYFQRTGSCRVCTRALRQWRSRPSSARQARLPPSSISLLPASRATSVVSARASATAIEAAATLSASGSAVARSSTRPARSSSASAACRRIARRPISWMVSGSSLALSTPESTQGRARSRTKRRVSSKAPRAIPASIAAWRICASGPTVVGRSKASWNETTSSAATATRSNSAEPLPVVR

SEQ ID NO: 25617 - protein, 362 aa, Pseudomonas aeruginosa
VTRRTGAVQVVVADRVDFPAHRVVQGMGAGVAPVPVEVELGERGTAAGQFEELLAGGQADLGAQHLGLGHGDRGACRRLGVHRPRGHFVEDLAGLLQQGVGSVQLDLQAADLGDAVELIAGAFDLGVDPGPAAFADESLGVVQRRLGDAGVDGGLDQLRDGALEARDLGQQAVVDQHVAGYRNLVQQYRAAGGGALAEAGPVVDDAQAGSAALDEEHHRALFLVDGLDRHPVGEQGSGGVELLAADPVAVAVATDPRLQLQGVAGIALRAGVGQPAAVEDATEQLAFLRRAGDVVDHAEQAELVLRNLSEGRVGGTDDTEHLGQGHMGNLRAAMGAGNADAAQAEAGEEFQFLPGQASFAVA

SEQ ID NO: 25618 - protein, 64 aa, Pseudomonas aeruginosa
PGRLVTKILGCGFVGHGSALQRGGSASGIGVARLAGSVVRVERLEEGGETGGNDMLAGHLWQFG

SEQ ID NO: 25619 - protein, 437 aa, Pseudomonas aeruginosa
RFRTHHRHRRDRRRRGRHRRDRQPAETFAGVAYQPDRAGGHPLLPTGLDPGRWRRLRTGRHRAADGRAGPARRGVVAHPRRAGRPRGAPTVAGGRRQPGIPQPDRLPRPAPGLGAHRGPGGDPGAQRRHLQLPLRPGALHLGAGARPARRQGAVHPAGDADQVRRGAAEGHVPVLRPLAAGGRAAGHRGRVRPGRRGVVRCRRFRSAADGVRAQVFGRAGVQFQPGEGRRRGAQGLVRGEGRRRQHQSGGKGLRPAARGAAAAAADLCRRQRPGRRGRLVRSRPGDPATCPPWRDLRPRRCLRHRQREDRGGGAQADRGGGREPSRPAQRPWPAAALRRLRRLSADRRARPGGAGGVRLCRQAAADLPAGAHRGQPLRLAAQAPRTALGVLERHAQGPGVAGAAGALDRAAALGLTLRTAGLKARGRTAGPAPPASR

SEQ ID NO: 25620 - protein, 375 aa, Pseudomonas aeruginosa
RRNPLAVEERQHQQTLGADRRLGGQPGEFVEVEVQQVLYQAAGAGEVHRAGQRQPTAGRGAEGRQLAVRTDQRPLGIGAQGAGGAQAGGEQAGADVAGADGGEHVVAAAAGDPRVGSQAEGGGRFGAQVADAGAGLDQLRQRRRQASARLDQLQHVAGPGAPAHVEVAAAGGVARFAADAAGEPVVEVVVGQEDVRDAGEQLGKAAPAPEQLGQRVARREHQSQAFQRAGRAAEGFQQLAVFRRALGVAPELGRAQRPALGVEQEQPMLLGGNRQGADLAAVHRGFFQGHAYRAGHGFQPVRRILLAASVTAFRRALRGAAQAQRAAAAGVEQQRLATLGAAIDAEEQSVHAALRRHSPSTWRRVSLTPCRRRLS

SEQ ID NO: 25621 - protein, 154 aa, Pseudomonas aeruginosa
GVTSSVNCTPTFSQAGRPALKRSSSTHCTKGSQTTGQASSTSCRWASWRRWAGLVIGVMRSTMALGKLTCVAIQRASPGSSRSAKASSALRATSPLCGRLSQDITVNAGTPVSRRRRRASQRKPKTPRGVRGLARSWRTSGNSARNSPLPSSMQ

SEQ ID NO: 25622 - protein, 566 aa, Pseudomonas aeruginosa
RQADARAAFEGDLAALALVAAEMAAQEAHLRRAEEAGDEQVGRMVVKLQRRADLLDAPAVEHHDLVRQGHRLDLVVGHVDHGRRQFLVQPRQFQAHLHAQGGVEVGQRFVEEEYLRVAHDRPADRHPLPLAAGELARLALQQRLQFEDACGGVDLGGDLALVDAGQVEGEGEVPAHRHVRVQRVGLEDHRQVAFRRRGVGDVRAVEGDAAAAGLFEAGDQAQQGRLAAAGGADEDYELAVADVEVDALDDGLAVEAFLQVADLEISHGGIPPWTKGWGCASFHGAEGKAAYQLLLADPAEDQDRRAGEGGDGRELGPEQSFGAGIGGDQGGQRGGGRGGQVERPEGLVPTQDQRQQQGRGEPAAGDRQQYADDLLPGAGAVQARCFEDVHGDVLEVGVHHPDHDRQVDQGVDDDQRQPRIEQAELLGQQVDRHQYADRRKHLGRQHPEQRALGVAGLEEGHGVGRRHRDEHAQESRRGGDQQRVPGVGEVVAALVDVQVVLQGRLEDELRRRGEGVDLALEAGQQHPEDREEQQQGDAPAEQAEQGIAQAAGLLECQHGGFLSCAR

SEQ ID NO: 25623 - protein, 199 aa, Pseudomonas aeruginosa
PFAIGLQPQHPGARTQRWLPPGGPRGQGPASDQAGPDRPRTCAPAGQRRAQPGQRDRPVQRPGGRRTALRRRTGSRHLAGAACGRALQRALSEGAGEFPGRTLAGAEPPPAGRGVRVLRRRHPAFRGRPAIPDLAPASPALAFLLPRGASAGRSRERFRRGAVELPAGDQHQPAEHPQGAGGPQRASRLPPGHRVRERP

SEQ ID NO: 25624 - protein, 185 aa, Pseudomonas aeruginosa
PGLRRQARKRALHPLPAAPRLHRRQPLARLGQLRRQRRRGNPQRLADAPCRIADTLAGGAQRDRLYHPSRHGFHRRAGRASLVPAPVLHQAALALHRAGAVPRAVPRRPGAPGATRGARRRKRPPGVPRLPRTSREPQFLPRRRAPAGDTYLHGADPPGRRPARPALPAHARQRALGRYPDRLHQ

SEQ ID NO: 25625 - protein, 205 aa, Pseudomonas aeruginosa
MDFLLPRDFFDTSTTGVESMSRVPVLTLENAPEAARPFLQTALNNSGYIPNLLGVLANAPAALETYLTVSGLNAKASLGLPEREVVQLVAATTHGCDFCVAGHTAVARNKARLPEPVIEALRARGELPDARYEALADFTRAVIASRGAVTDEQFEAFRAAGFDQAQALEVILGVSLATLCNFANVFARTPLNAELEQYRWTNPQA

SEQ ID NO: 25626 - protein, 630 aa, Pseudomonas aeruginosa
PDPERLARPPGRRPRPRRRRSRRAAAAPGRRRRARRGGGGTPRRRRRHARRRGGAGGRSGGALADRGVRLLGPARLHRVPVAESQPGTAPTPARRPAGRPPGRRHWAVQRDEVPLRDRGAAGGGARGGGRLAPGRSPAVGDQPAQRRFRGGGGDRTRGGRQALRPGDSRRTRRLAALGGPAPARPAMQQHRRPRSARGGGRARLAVARRRPAVPATGAPGLPRPAMRHGHRPGAPRTGRSAAAPGRQPFAPGWRAGGTARNPRRTRGGAARRTGQRRVRQPAGTPVPHPHRARRSRRQCRATGVAGQRRQGIPERARRRFRPPLARVGVRPDRYAEPGATARRTATPGRGQGMSEALLDARGIALGYPRGAGWQAVLGDFELRLGAGEVVSILGPSGVGKSSLLRVLAGLQEPAAGSVRVLGEPLRGPHPGVAVAFQDPSLLPWLNLEKNVAFGLDFARQPHLDAATRQARVDQAIAAVGLEHARARYPAQLSGGMAQRTALARCLARQPKVLLLDEPFGALDEVTRADMQQLLLRAIHERGTAVVLITHDIDEALLLSERILLLGDSPARTLGEWRIDLPQPRAELVEELGALRIEILKTLRRASRTHAHPIAQPEASHVPGRPDPFPT

SEQ ID NO: 25627 - protein, 288 aa, Pseudomonas aeruginosa
PGGRPLRPPGPGRGRRVAGVRPRRGLPAQRGDQPVRQTLRQGALGVAGLLTLFALWWLGVALFGAADGLSARFSPQATLLSLGELLERRELYEHVLVSLKRVLLGLFLALLVGVPLGLLVGASRNLEAATTPAFQFLRMISPLSWMPIAVMLMGVGDQPIYFLLAFAALWPILLNTAAGVRQLDPRWLQLSRSLAATPWETLRRVILPGILGHVLTGVRLAIGILWIVLVPCEMLGVSAGLGYYILDTRDRLAYSELMAMVLLIGLLGYLLDAAARGLYRRWAHGALG

SEQ ID NO: 25628 - protein, 569 aa, Pseudomonas aeruginosa
RRGAIRPTGNGEVRVGRIAARGYPPDGVPVRWRIALGRYSPYGVRGSGGAGECVDPPTLAQQLRPHSDRGLPPRPCPARPRGPARAVHGVPDAQASQGVPMPREIRLNAFEMNCVGHQSPGLWAHPRDRSSQYKDLEYWTDLARLLERGRFDGLFIADVLGIYDVLDGNGDAAIRQAAQVPVNDPLALITPMAAVTRHLGFGLTASLSFEHPYPFARRLSTLDHLTKGRIGWNVVTSYLESGARNLGQQAQLDHDRRYDYADEYLQVLYKLFEGSWEDGAVLRDRRRRIFSDPGKIHEIRHVGEHFQVPGIHLCEPSPQRTPVLYQAGASSRGKRFAAEHAECVFVAAPSKTVLKQAVADIRQRVAEAGRDPRKVLVFNLQTVVLGETDAKARAKFDEYRAFVSYEGALALISGWTGIDFGQYRPDQVLRHIHTNAIQSAVEAFSSADPTRTWTVRELADWVGIGGFGPLFVGSPATVADLLQEWVEDTDVDGFNLAYALAHETFSDVVELLVPELQKRGVYKTEYAPGTLREKLFGDGPRLPDSHPAAGYRDLRALWEKEAGRNALPA

SEQ ID NO: 25629 - protein, 401 aa, Pseudomonas aeruginosa
PGLGGVDAWNTSSVRQRYLCDLEKIARAWLRLLVVVVCRIPRGQWRTGRLRRLPRSRDSATLVPGILFGKQATMSITKNDKNTRTTGRPTLNEVARRAGVSPITASRALRGVASVAEELAQKVRDAARELGYVANPAARALASAQSHSVAVLVPSLANLLFIETLEAIHAVLRPQGLEVLIGNFHYSRNEEEDLIRNYLAYQPRGLLLTGFERTESARRMIEASGIPCVYMMDLDSGSGLNCVGFSQLRAGEAAAEHLPGTRPQAPGLHRRPARPAHPAARRGVPPRLAKGRLLRPGAGNPYAAAVLGGPRRRTLRAVAGQPAAGRRGVLLQRRPGPGRAAGGPAPWGQGAGTDRRARFQRPAGFGLHGPAPEQHPHPARSHRPARGGAVAGADRRQGGAR

SEQ ID NO: 25630 - protein, 206 aa, Pseudomonas aeruginosa
VSAPAVPVAGELVPGLARAEQQRAEVVLAVDRDAAHRAEQVVARRAFAHAFGEDLADDVAGGHAEPGITLDEERVGPPREAADLREQVGAASHRPTPGEVDADVLQVGENLQHQLAVPGLEVAGDAFDEGCGGAEQQAVLVGHPVVVDDRADVAVGAADRADPLDQFVRQRLGHHLERVGIDGGAVQLGFEPVEEAVACPRASCSR

SEQ ID NO: 25631 - protein, 171 aa, Pseudomonas aeruginosa
ACMKSASVGRTSPLTSGRLTRRRPRGVSRLCDSSSSVASISARMRRLRSRNRLPSAVRVMLRVLRWNRRTPSFSSRRATRLPTAEALTPRVRAAPTMLRVSATRTKTVKPLRLSMQGSDYGHDSPDRTELYPSFSAFAALLSCPHPSSAESPACPVSNESQAAAWRKMSIR

SEQ ID NO: 25632 - protein, 577 aa, Pseudomonas aeruginosa
RLAWRRRWAATRYPAWNCRPIPVSASAWVSPCCATRLSRNRRRLPAPGAGAAPTGIPGSSTGPANCRWWRLPTPCSRACRDASSTTCATPSTVPRSCADGTPRSISGERRGRCVGRGAAAAAECAAGDGDVRLRRHSQRNPAGRPAAANRRGAGGQRGAGRATGQRLRLGFATGRAAGGEPDPGLAAAPGAAAGAADLLRLQQPNRRFLGLPPDPAGALRQRRRRRPRLGPAGRLRAAPGAAGAAGAGAGGGHARCAAGAVARRSAGHLAGRPARLALGLRPVVADRAAAGRLGAAQRAGLPWPAGRAAPAPARGAAHAGRASGIAGDRRLGAGAQHPLHLYRAVPRQGRPGRLGGPGPAGIRQRRGGGNLAGRRAGRPAPAADGPGQPGAVRRGGAGAVPGRSLELAGVRRPGPLGADVRWRGDAAADRLGGRRRGGRRPGPVDDRGGLEPGHRRRRSVGWHGVAALGQRDAALDPATADRLGRRAGLGQCRARFPRRPARLPQGIVRAPESGAIDGAAPGKGKKAAGLRTFIHLGYLDRSVSNIHRVEIPAVTMRSSAMQRNPLSLRRTSSLSRR

SEQ ID NO: 25633 - protein, 393 aa, Pseudomonas aeruginosa
PGERCRKNCCACGKRCVSPCCSSPTPSRRRWWWATASCCSRRTRGGSGPKCTATRSGCTALAASRCKPRRDASTACCSTRAANRRRPRPSTSPISGWPIEQRNRSMSRVTRVREEYEVQLEPLLEVSLERRLPLSQRLWQQGWLRKGLILALLALAWELAARVQGNDLLLPGFLQTARALGEGLASGELPAKAGISLLVLFKGYLLGIVLAFVLTSLAVSTQLGRDLLGTLTAMFNPLPAIALLPLALLWFGLGQNSLIFVLVHSVLWALALNTYAGFLGVSETLRMAGRNYGLRGLRFVLLILVPAALPSILAGLKIGWAFAWRTLIAAELVFGASSGKGGLGWYIFQNRNELYTDKVFAGLAVVVLIGLLVENLVFGSIERLTVKRWGVQR

SEQ ID NO: 25634 - protein, 328 aa, Pseudomonas aeruginosa
RVFRSVPSLGRGRAMQERHGLPLRSFSSGKALTAGRAVRPEVAQERRYLQGAPLGLELPGRIALRDPHCAWQWFEPEAAAEAFPAAHWLAAFLVLLGRYGNEEITLGFPEPITVRGRQAPALLRSAYRAMESSAERSARLAEELDDARRQLSADGQERAALAGCCAVQVLAARPTASSPGWLALVLAADGSVGLALRDPQYDELRRIAGHLARMARGMVDAQACVGRLPWMDADEERRMQAMRSEPQAAPSRGVLHHLFEAQARRTPQRIAVHAADRSLRYAELERESAALAVRLRAAGVAPEQRVGVCMRRDSGLLVGLLGVLRAGG

SEQ ID NO: 25635 - protein, 934 aa, Pseudomonas aeruginosa
YVPLDPAYPEERVAYMLDDADCLLVLVDASTRERVAALGRPCLTLEEGGDQANDLALPASEVGADHLAYIIYTSGSTGRPKGVAIEHGSAHAFLRWAGQHYAAEEWSGVLAATSVCFDLSVYELFGTLAEGGTLHLVENLFSLPDYPRRDEISLLNTVPSVCAALLALGDLPGGVRTLNLAGEPLRGHLVRQIRGQPQVRRLVNLYGPTEDTTYSTAHELDLHAEALDEPPIGRPLPGTTVEVLDGFEAPLPLGVAGELYLGGIGLARGYFGKPEQTAERFRVDPGSGERRYRTGDRVRMREDGVLEHLGRLDDQVKFNGFRIELGEIASCLASFPGVSEACAMLTEDSAGLRRLVGYLAAPFAPPLQALNEHLGQSLPHYMLPSAFVVLAELPKTLNGKIDRKALPRPQASGAEPQALPSDPLEQALHQAWQAQLGAPPRAGQGFYAAGGDSLRAVHLLATLRQRLSRRVPLQAFAGGPATPEALLELLRQAAPEGDEPEPSAGAAGLSLAERRLWVAQQLAPEDTSYNLLAHLRIVGATADAIEQALRQLLERHVALRRRVETGVDGPQPHALAAHAVPLQRLLASDAVHAERLLEDGVRREGARVFDLAHEAPARLLLVVTRDSARADLLLSVHHYAFDDVSLAVFAAELKTLLDGGRLGVLASTPEQVAARERAALASGRLDRVAERWAERLLPLAKAPGAAPARPEESGGRAGQRLALPVSAAVHAACRALAERTSVSPFSAALQAFAEVLGAELGVDDLLVGVALAGRSRLEMQGLVGCFVNLLPLAVGLRPEQSVEWRLRQVGHDLLELLEHQDVPLECVTQALRQRGASGLPIRIACGAHNGRAAPAVDAGVRVEADFIPVPGARLDLTLWLEDQPQGWLAVWTGASAIFDLHRIERLHQAWERRLLANAGEPISKRMSPEGCNAS

SEQ ID NO: 25636 - protein, 223 aa, Pseudomonas aeruginosa
EASRSTRQSASAQPPLPSPRNCSTTRSVPRRVARSAARSTPPPSIRWTSRSSCITSSPIPPTGRCTSCSIARSRRSRAAPPRWRPTGWCSATCRTNCWNASGAWASSTCATTAPASACPGAKRSRPTAEPRSRRSALSTGSPMPGSATSTCAPGRGARRSNATRIPASACGSTTACSSMPPVSSRACAMRCCAASPRKTCRTRPTTAMAARSRRRPWRPSAAP

SEQ ID NO: 25637 - protein, 1041 aa, Pseudomonas aeruginosa
ACRCRYWMGARPICWSSACREMATGPDASRAKARVSPLRPWAGKASRYWRSACCWTPPERRSRGCCWRRRRSSSMRPAWWRCCAAAWGRPARRARTRETRRCCSSISPSGPTRRWPAKTAKAPAVTGESRRPLRRKVRWRWRTTWAKAIGRARRLLPRALLERLAANGLPEAAALLAWTQVAGQFQGDEGLPLEMARLVSGRLFNEFAELAGPFAGVAPLCLENVRAGSVGERLDALQAAILAQEEAAALRDPFAPDWPLAELGFAWLAGELDGAGVAELDCRQPPLGGFLELQVLPHGEGRLASLRVRRDHDGTLAGRLLDAWVECLESIAADRQLPLAGLPLIGAAERERYQAWQGERVEPAPVESLVAAFDLRAALQPQAPALLDAHGSLDFATLCARSEAVAEALLAAGVRPGQAVAVMTGRNREAIVALLGVMRAAAVYTPVNPEFPAARVERMREAGGIVFALADAECAGRAREAFAGACLDLSTLPLAGSGMSLPAPGGRDAAYMIFTSGTSGQPKGVVVEHASALNLSQALARTVYANVVGEGLRVTVNAPFSFDSSIKQILQLLSGHCLVLVPQEVRSDPQRMLGFLEERRIDVLDCTPSLFRLLLQAGLDDAHPALPGRILVGGERFDEASWEVAAGWRRCQVFNLYGPTEATVNASLARVAEHARPTIGRALANVDLHVVDGLGRRKTRGASGELWIGGAGVARGYAGDAGEAGRALPRRGLAGQRPPVPQRRPGALARRRLPGVPRADRRTGEDQRLPHRTGRDPQRAAGTPSGGRGGGTHRRGRCGRAGRGSPDRRLRHRRRGDRGRVLAGSRPAQRAPGRRTEPQRNRVRLPGNLRRRGLQPRRHRPAAGRGGPRRRCQHRPVLAVHRQPRAARASGRLRAAGTDPPAPGGQPRTLRTAGRGIRHRPVRRRARRNLHLLSGLLDLLRDRRVRRRQRRTRRHPTLPEQPGRGGRGQPAAGQHRRNPRRPPARRSPPLPPAPPRPGDRRTGPGAYRPAEDRRAARGNGCAARSRRCGAGQGPADRPGGP

SEQ ID NO: 25638 - protein, 616 aa, Pseudomonas aeruginosa
SSHRLRQPRAPRGAGSGPPARPVPEHPAVPAVGFRRSARQRPSRIRLRAREPGTSAPSAGGDSQAQPRVAPGQPVQLRRLPPGRRRAGGGSKARRHPRPGGGGRRRAAGGGLRGGRRAPRGGLPVCRRTFPRRARRGTGRRLPRGVAGAARRPGAAARGGPGRGQRGAAAGAQGVVPGARPAAGGRPGLRQCRRAFAAGRAGDRRIAPADRQATEPGAVAGRSGCPRSGAPLPCRRRAAVAARHRARPGPVVAAQRERAAAPAPDRAAARGRQRRHFPWLGRAPAGGRGAAGDPVSGAPGTPGRAIRHRCRGHALCHRRRAPAIARPSVRPDRRQPRRHARLRTGGTPGKPARPARQAVVRDQQPRSGAGPGIPALPCDGRRRVAANPARVRRAAAGSARRPGAARDQPGHPARRFAPGRRLSLPPARAAGHTDHRDPRRAGPGRLQGGHRRLAAARQPLRAGDPGRRPRPGGDGGGGGLRDPAAAPGARCAWRRAGEPGNLNRRPLPPAWRQGPVPSVFIRGCPWLCANTPNATGLTPSPRPTTTAICRSRSRAACLPPSWWCSASPTSIPTPRRSAHATALAWRTAPTPWSCATSATAPKAMPRWSTWARGGST

SEQ ID NO: 25639 - protein, 134 aa, Pseudomonas aeruginosa
FRWGAPTRTSSCTPGRSRRWPPRSSVWWKPTVSTAWTSTSSRAPSTWPTTSGCCRRPSSWCASTTPGRASTSSSAWPRSFPICTRTASTCLICRPWKASTTSSRRSTTTRAATACGSRRRTAARAPGSRRTTTR

SEQ ID NO: 25640 - protein, 261 aa, Pseudomonas aeruginosa
QVSEPLRQANPTMGKLLPLSPVPLYSQLKELLRGRILDGVYPPLSRMPSENELGKAFDVSRITVRQALGDLQKEGLIFKIHGKGTFVARPKAFQNVSTLQGLGESMTQMGYEVINRLHGLRYVPAGARVAERLRVEEGSPVCEIKRVRLVNREPVSLEVTYLPQALGERLEKADLVTRDIFLILENDCGIPLGHADLAIDAVLADADLTRALAVEEGAPIMRIERLTHAADGAPLDFEYLYYRGDAFQYRLRIDRQKGERA

SEQ ID NO: 25641 - protein, 115 aa, Pseudomonas aeruginosa
GTTPPRAPRPGVVPLDTEPAATKAGQIEPRGPRAMAYRPQDIFFRSSAPVTIDEDRCIADKGCTVCVEVCPMDLLAIDPTTRKAYMAYDECWYCMPCEKDCPTGAVKVEIPYLLR

SEQ ID NO: 25642 - protein, 615 aa, Pseudomonas aeruginosa
RPGTRREARSDDDGRQQPGAHPDPRPEHPPGAGERSLRGGPRSEPGGAAGRVRLPARAFGMRQVDPARRPGRPPAAKRRQREGRRPERGRTFAAAWHGIPAAHPVPLAAGPRQRRLRPEDAGPGPRRAQPARHGDARTGGAGGLRRALARPTVRGYAAARGDRPGAGQPAAPAADGRALRRPRRADPAEDADLAAGRMGAGPHHGAVRHPRHRRGPVPGGQGAGDEPPSGTDHRRPGAGLPAPSRHPAGDQRRLRAPETPLPGTARPRRRPPVAAPDPARLAAGHHPGPTADRHMTCKNATLPEILELSPRLEDADPGVRRLALIELADLELPEALPLLIAALRGDPDPGVRGEAARLLEAWEEDAVVDALCAALADPVPAVADAAAQSLGELKEPAAGRRLLPWLGHADAFVRASVLRALRELRLEESAAPALAALGDPQAAVRREAVAVLGWLRHQPALAELARLASADVDPEVRRAATGALGLSREATVLPALCAALADAQWQVREEAATTLGKLGREEAGEPLLKALADDYWQVRLRAARALGRLRHRPAREALEALLGHPIGNLRKEAALALGELADPASAQALRVAEGDGDPEVRKAVRIALAQLRVPA

SEQ ID NO: 25643 - protein, 593 aa, Pseudomonas aeruginosa
PQSIAPAAEPARPVDPAVRPGAAGRRHQAGEPGRLAVLPAGRHRPGPERTVAAAGQACGARPVRSGAVRQHRLGAVGSRPGLVATGAAPGSVVRLRPAALATLVPPPAAGRRSGAAGHRGAGRGGGPGRHRRGGQPVHQSGADRRSHRPRQRHDQHRPGDAGRRLAGLRAHRVRRPLLAVEADHPGQRRPARGSLAHPYRRPADRRRSARTDQREHPAEGQRHALRLHRAQQGAGPRPGHRRRNLALRSADPEPGRLQGLRPHDLPWRLLLRRRAVRQERRRRAAGRALQGRQGGRRQLSAAPVPAHRRRPPDRDQRRQRQGLRGLRGQGRGRPDGRHRSVHPGRLLLHIAGGGHPQSGDHRRPRHRQRVDQRAVRGDPRLRRARRQAGVELGQRQPGRDRAPGSRQVLYPQLAEHVVAGQRRREARPGLPAAGQPDARPVGRQPHPWRREVQRRPGGPRPEHRQAALELPVHPPRPVGHGRRQPADPARPEDRRWRQAGADRADQAGQPVRAGPPRRHADRADPRSAGAAGRGGGRPYRADPGAFRPQPAAPAADRARHVGQQPVRPDALPHPVPLAALRGPVHPAVGARAA

SEQ ID NO: 25644 - protein, 171 aa, Pseudomonas aeruginosa
ASTGTPTWPIPGYPPPTIRISRPAARPSARASTCRACRKAACSANWCGSPRRASAWAGKACTAARSTSRTATAKRPRRAMRYSTGAPASSSAWEPGPSTSWCAWTTCSTASTSARSSSATATGVTTKRPPGCPGTREPGSNTSSEVPDALVRATRPALVSVVNSDYCMNVQ

SEQ ID NO: 25645 - protein, 486 aa, Pseudomonas aeruginosa
  UNSURE (317),(360): Identity of amino acid at the above locations are unknown.
RPEFRCILFAQPAADDIQGRRRAQAQAGDLRQHLPRRRQQAEKDQRHAQLGASFADRNLADPPQPEDLERSGTGQGQGEQADLGEEQAGQQASAQLEPQEQAATRAQCAACGAGDAGQGDGSQYGDQRRQAGSAIGEDGGEAIQALCASCVGESLVEPRQGQVAHIGPAVHPDAGPRRQRPRFGERALDPLLRGAQSLGLLLGAPGLPGAEPRQQRWNQHQAKQQPSRMDRALHSALAAQLLQVALGVGGLDVGVEDRRHVVAVQLLAIALQAGRHDGDARVLAFEGHGLGGEHLAYGAMGRQRRFGPQVEGLGGLXHVGLDAEIDDVGQLDRSRQAVGPELGTGQAHEGGLAGVAMLVXEEQPEQAEQQADDADPRLALGEPHAGHDEGHDAQQRTQHHVLAGIGELGGRRYVGDHPLQVGDDLGGLRLVQLFVFGTEGFGEVGDEVPGFLVAHGNILGVGSEEEALGGISPSWRNRAWARAMSR

SEQ ID NO: 25646 - protein, 202 aa, Pseudomonas aeruginosa
RSMTSAASSSDRLRPLRRQPGDSRRTRGPSRHSLTARAANGSSGRVDGAGSALPCSSRTIAENQTPSSRRRSATSSRSSGADRLRARRRPWPRTRNGALLALRCRQARHMRRAAAASRHSAAASCPGPGWSRKVQAPPSSSRPSRADSGAAPRAAPMLIRLGTLATKRRNCVASSPLVPAGQGVCAPGGITGFPRGLHRAGG

SEQ ID NO: 25647 - protein, 410 aa, Pseudomonas aeruginosa
QPRARLGSGGTQHRHEWARLRQEWTFCGGAHPANNCPPNGPPPASRRGPPSCAEDTPMTLQIRGYAAQSASTPLTAHRFERRAPRADDLVIDILYCGVCHSDLHQARNEWHNSLYPLVPGHEIIGRVASVGEAVSGFAVGELVGVGCMVDSCRHCAACSEGLEQYCAEYPTLTYNGRDRHDGLPTFGGYSERIVVSARFVLRIPQGLDPKTAAPLLCAGITSYSPLRHWKVGPGSRVAVVGLGGLGHMGLKFARALGAEVALFTRSPGKEEEARRLGADQVILSTDPQRMAAVAGRFDLILDTVPHQHDLNPYLATLKRDGTLVLVGLLEPLEPAVHGAQLVMGRRSIAGSAIGGIAETQEMLDFCAAHGIACDIEMIEIQQINQAYERMLASDVKYRFVIDMASLQKSF

SEQ ID NO: 25648 - protein, 319 aa, Pseudomonas aeruginosa
RSGHDVAEGGRRDQAAEVADPGRRIDHHRQHQLRVGRRRHADEQRTVGLVRVAPARGLARGAALARHVVARHAGADHALRVFHHGLQHRPDAPCDLRVHRLAHLVLRVVAEQAERHQLAVVGEHRVGLGQLGGVHRQAVAERHAGGGDVRPFLVERQVARVLAGEAQRQRRAETDPAELFEDRLGSDLQGDLAHADVRGVDQHSGHGQYVAPGDVVDGVPVDGHPARCHADLTVLVELAGGQRRRHAERLDHRARLEGIGEGAVAHEGRGEAGAVVRVVGGEVGHRQDLPALRVHQDRRAGVRAELEHGLFQRLVGDEL

SEQ ID NO: 25649 - protein, 420 aa, Pseudomonas aeruginosa
ISSSPVVAGSAGAGQPRLSMSNPYLELFAAPGAKGFSAAGLLARMPLSMTGLGIVTMLSQVHADYWLAGTVAATFVFCNALLAPQVSRLVDRFGQGRVLLPAALASALAMSALLLCTHYRAPNAWLYLFALLAGAMPSMPAMVRARWTELYRGSPKLHTAFSFESVMDEVCYIIGPVLAVSLSVGWFAEAGPLLATLFLVAGVSLFSLQRGTEPPLHAHPRRRAGSALAYPAVRVLALVLAAIGVIFGAVEVVSVAFAEAHGNKAAASLVLSVYAVGSCLAGLLFGLLRWRLALSRQLLCMVTLMALSLMPLLGVESILALALTVLVAGFSVAPTMILAMGLVERAVDPARLTEGLTWAITGLGIGMALGSALAGWVVEGYGAASGFLVAVGAGWLAWLLALACFRVLAQDEAGDCAVSG

SEQ ID NO: 25650 - protein, 92 aa, Pseudomonas aeruginosa
SASIQSAAYARARREPRSRRTSSRASSRAQGRAAITAWSLCGCSSPWVAACQPRALRANSRIVCWKPAQVPRNGRRRPRAWAIRRSTASASR

SEQ ID NO: 25651 - protein, 385 aa, Pseudomonas aeruginosa
RSSAGSAGRRSLASQSNAISRPSASPARRRARGIARWAVMCGSWSPTRAMRSGAAGGVDIRFRSSFATPVGGPWRSLYSCVSALDIGANAKDECTAAISPGPCRSCPGPRPGSRRQPGAGRRVAQGRCVDGLPGHPPAGEEPRQGIVRQEPQRLPGEPDRPPSGAAGGTGGAGAGGGAHRPRTGARGAQRYRAHDLLRRRPAWPAAAGAGALHAWLSGPATGAGDLQRLCQPQPARRRHRPAHDPHAAGTLGRAQPRRGALRALRQRTLPGGPRRDGARHAALDRPGRFSSRPPERGLASSTLSWGAAGLPLQRRAGGRRDGPRRPRPGGDPCLPATRRRRPAGTGRRPRGLRQRPVAADPSGLPGVALGGRIVRRAGAACAIGR

SEQ ID NO: 25652 - protein, 647 aa, Pseudomonas aeruginosa
  UNSURE (2): Identity of amino acid at the above locations are unknown.
PXPGPALRRPGRCRTRRRRRRGKLSVSSLRSSCLHQRTGVLQVLLADRLGRPVGQRRHQPSGVVAGALGEGRGAHDEDVVHVPALQVAVEHAGLRIAAHDRPAEQVGGLVDPCIEVVAEVLDAHRDGLRVHRFGDLAHVLGDVAAHADLVVLPVEGHAQQWLAVSVLVGRVDVGLFVAVGHVAAVGVHRHGVRVGVLDRLFPAAAPARRAGRHGEAADRLGAGLVDPHRRAADEAQRSVVEVVGVEVVHRHAAAAGADKGVGMHVLVEKRLDGGHVLVGEVLPHHALAGARVVGLADAGEQQQAHVVELEGTDDHQLRRLHDLAPLGVDVGHAGGLPAIAIEVDLEHVAVGAQFEQRGLAQRREDVQVRRGLGIHVAGVAAAEAAEVARPHLHPVGVGPGPRSVGRRQVVRVQAEFLGGLAEQLRGVHLAQCRQREVVRAVGGERIALADHLALDRMRGAGGAEDLLGEIEVRLQLFVADPVVLDGHAFGDEFLAVAFLVMAAQAQFLGHDPEMHAGPVQAGATDAVAGKEGGELAVGQRGVVDPVADAHGALGEILEQLAAGVVGQLVEGVGVGAVGIGIAVLAALQRHHVEPRPRSAPWPGSLRSSRKPTTTASTGLSVVAMFSPSRRKSPPAGRDTSRHGRPSP

SEQ ID NO: 25653 - protein, 901 aa, Pseudomonas aeruginosa
KNVSARIQAGQYRQVKQNGAPGVGPARPSGASPSRPGRRIDQVQRPLAGEGGQQVVHRAAGHGFAGFLGGRADVRGGHHVRQAQQRRVGRQRLALEHVEAGGADPPLGQGLDQGRLVDHPATGDVDEDRLRAHPGELRGTDQAFGGGGQRQGQADEVGFLEQRVEGAVARCVAFFDVGLRAMAVVQHAHAEAVVPAPGQGLADAAHADDTEGLAMHVGTELGGADALLPFPGAHPTGQFHYPPGCRQDQREAGVGGGLGEHVGGIAEEDAAAVEVVDVIVVDAHRDAGDGFQSRCQVEQSGVQAQAGAEQAVGLGQGVAQAGQAVAAGLLDQEHLDPFAQAFHQGRGETFVENHFLHRMLRSRSGVGRRRPPRGVRASGIGLALVGVRVEEHGEQHRQQQRSAHEQIGSPGPAGDAVQVADQPGAGERAQRAHAVDQRHGAAGDVGREDFRDDGEERSVGRVHAGPGQHQQGVGQPEVLAAEGVGTVEGDGRDEQRRPDETLAFLQPVRGPGHPEHGDHRRQVGQRRQPAGFDDVDVGAVLEDRRQPEDEAVDADAPAEILQREDDDLWRTERLAVVLHRLDALLLGGQGVFQGAFFRAAQPGGLARAVIHQAPPDEGPDHRRQAFDDEHPAPAEMLHQVAGDHRHPEDGHRVAEDQEGIRPRALGAGEPVAEVDQHRRHHRRLDHAEEEADADQQVDVGDHPGQGGQPAPEDQADEDQLLDAALFRVDRPRHLEEEVTEEEQRAQQRGQPGGDPQVVGHPGGGGEAVVGAVQVGQAVGDENDRHDVPPAAAGEARHGHGRVSPELVLFLSQQVPRGRRVQALLRRSRSSSWLRFGSPSMSPRTCTARLPIQLPRATASGSGRPSSSALTTPTAKPSPAPTVSTTVATGTPGTSPSPWASR

SEQ ID NO: 25654 - protein, 235 aa, Pseudomonas aeruginosa
NAAISAGSCQPLSRRPSSRPGRTQWACAARALISAIMRRSLGHSEGRRLGSKDRLAPLPRMRRISSWDSSQALAESAGGMPVACRWRAPSISSRIWARPSRLAAEPRRKYSTRGSAPSTSRDFIWNPVGACASTSTKRQSRPSRVRLSSTKRPSESSPTRLSQATVKPRRARPMATLLSAPAMRLPNCSTRSSSPGCSATNMAMVSPKQRISKSAMLAFLLGLADGGRGRRCAGG

SEQ ID NO: 25655 - protein, 137 aa, Pseudomonas aeruginosa
AGRRPAAGIRWPAPRLPGNAAAGAASTAGRRPTAAPRPACRRGCGSPPCSARSRHSGQGAGRLRRPPAPASASCRCRRSSPGPAAGVRRGGRSVPAPRSGRPGASGRSPPAVASRGAPGAGRGRRDRAVPAEGRARP

SEQ ID NO: 25656 - protein, 356 aa, Pseudomonas aeruginosa
NRFHFKPCESRRQRAGGGPLAAWMGRAANDQLRREGHPARRLAVAFESRQKALEGGAADFVGGLGEGGDAAAHQWVPVEFVQGQQADLIEQPAAEVAQLAGGAEGGDAVAGEQRLRPGAAGRKEGAQAVAEEVVGLQDLALERRSPADGGIEGLDPLDPRAGAVERFGDQQDVAEAAVLQVVEGLFDGVGVVQADQVGIQLGQLAVHQHHRQFAVQGAQFAGMVAEGVHDQSFDVVGLQGGQVMTLLLVVAVGIAHHQAVAVFAAGGFHAMHDGHGVGVEDVRHQHSDQPCAPALEASGHLVGAVVELVDGALDAPGGGIGEQLAVAADIARHAGLGDAGGLGHLVDGDAATAGQY

SEQ ID NO: 25657 - protein, 353 aa, Pseudomonas aeruginosa
PPGRVITLTDRCGSCRMPPFRRSRIFRQDPSGPTSRLRNDRMSAALERLNHLNLNHLYAFVAVAEHNSFTAAAEALGLSKSLLSEQLRRLEADLGIQLLTRTTRRMTLTDRGELLFGVAQRMLGELDGALSDVRDLQGEPSGRLRITAPQDFVKWHISSVSAAFIRQFPKVQVEMLADDQFSDLVGQRIDLAVRIGWPRDSGLHASKLCDFQQVAVATPGYLAGLSPVLQPHDLARCEWIGHTRLSTPWTWTFERQRERATVQTRGRLLANNTLAVYRLVLDGAGVSVLPSFLVAREIARGRLVRLLPGWHLPQGGIYALYPSARYMPVRVRAFIESLREHLGREPFRLAQGE

SEQ ID NO: 25658 - protein, 332 aa, Pseudomonas aeruginosa
FPGVGTGSPQIKSQSLARGTMSGELVFDLNALFIYAKVVEHGGFAPAGRVLGIPKSTISRKVAQLEARLGVRLVQRSTRQFQVTEIGQAYYRHCVAMTVEAEAAEDVIEQNRSEPCGMVRLTCSTPLLHFELAPMLARFMAQYPNVELYVKTFNRRVDVIAEGYDISLSLRFPPLEDSDLVMKVLARSPQVLVASPELLARYRPPELPADLSAMPYVGWERSRLDGSLRLVGADGSSAALNLRPQLLSDDLGTLRQAVLEGVGIGGLPLCVVSRDLAERRLVRVLPEWTPVEGMVVAMFPSRRGLLPSVRALIDFLAAGFADAAQRQYPEPG

SEQ ID NO: 25659 - protein, 173 aa, Pseudomonas aeruginosa
REEAGGVDPLDGPPALPVVVGVVARRVPEVAFDGLSSLLRAGSVALLAGLQRAAGAGLGDGSFEMVEQGVEVHRDDGGGADAGQFAAVVQPAGGEVPAAFRAGPQVAIDLARGALRGARGGRPILQEGLLARCVTVVPVAVQQAAVGQFHHVQARLVGAQPGGAFHPVGVFLL

SEQ ID NO: 25660 - protein, 234 aa, Pseudomonas aeruginosa
LRQVAPVGGVAFASCLEVHHVGEERRLRTAQVVAAVTVGNVPVGIDQVGEVVEHVAHPLVLPALRKAEHGEVGVPVVHLAEASAGDHVGFRQRQQAAVGRHLLVVAGQRRPQVADVAGEIGTRFRRGGLDAAGLLEVAADEGAQVEAGPLPLAQVVGADPCRLAQRERIDEVLLVAEQPAFLHRLEQLGIGFVGGDRAFAAGVLPTPGRGRGRRRALAAGRQQEQDPGREHGAG

SEQ ID NO: 25661 - protein, 184 aa, Pseudomonas aeruginosa
PRRSNSSRGWSRGSPARPARAATASPCCAEPAPEASGRSTCSWKGWTRRSACSGWGITCMSPIPGTSCATATCRVKPGSPTRGWSSPTCRTPSTTTGPRRCSPVPTGASSTWASVRTATSPRTARRSNTVVRRFSRWTSPAAAAASTPPACATRPACSGNRSPASCGPSSTSATRSATTWSRTT

SEQ ID NO: 25662 - protein, 535 aa, Pseudomonas aeruginosa
APRAPTSGLLDGVRAEAGGPGSVLRSGAVNPCVPPASPVHPIRECRPWRPDRRLPVEHHHALRVEDMHVATSVIEDQPLRATPAEGETLYEFSQSPLLERQSRQESNARSYPRRIPLALKKARGLLVEDVEGRTFIDCLAGAGTLALGHNHPVVIEAIRQVLADELPLHTLDLTTPVKDQFVQDLFGLLPPALAAEAKIQFCGPTGTDAVEAALKLVRTATGRSTILSFQGGYHGMSQGALGLMGNLGPKKPLGAVLSTGVQFLPYPYDYRCPFGLGGEAGVKANLHYLENLLNDPEGGVQLPAAVIVEVVQGEGGVVPADLDWLRGLRRITEQAGVALIVDEIQSGFARTGRMFAFEHAGIVPDVVVLSKAIGGSLPLAVVVYREWLDKWQPGAHAGTFRGNQMAMAAGSAVMRYLKEHDLAAHAAAMGERLAEHLRILQRDYPQLGDIRGRGLMLGVEIVDPQGEADALGHPPTDGALASRVQRECLRRGLILELGGRHGSVVRFLPPLIIGAEQIDEVARRFARALGAALAG

SEQ ID NO: 25663 - protein, 306 aa, Pseudomonas aeruginosa
RRSRRPGSPEGSRRRPRPGRPGAVVRRRRSSAGLRVLPGLGGEQREQAFRGQAAGRRTVEQQVAVETADPVGEAADGLQVVLDPEHGDAGLAPVQQQPLEDLDAALVEGRHRFVQHQQLRRRYQALGQQHALALAAGEGAHAPTALGQHADPFQGRVDRRAPAARQAEESRTALAHGGHEIVDGERQAAVELQRLRHVADAAGRAGPLQAQLAAMRHLPEQGLDQRTLAAAVRSDQRVHATGLDAQAHAIEDAAAAEAQVDPGEVDGRPARRGAKPFGHGHAPDSWMARTTVSRLRAISSSYLPAL

SEQ ID NO: 25664 - protein, 330 aa, Pseudomonas aeruginosa
RADRPAGRRPHRQPQPRRGGRADRPVRQHPGAALGIRRPHVGGDPAGRAQGHRAWRPGPSGSAVRTPGRGVQGRAQPEPQPAVPGDVQPPAAGGRHRGAGQRGRPELRPARLEEPYHPVRPEPGYLREGRSPVRRADLRDRPVRGADRRAHGAALAEPAARHAGKPAGQRRLAADARCRGALSVAGRLERHCGRVPAATRRAPVVRGAGRAHTDGAGAGLRRGAPGLRRAEPPGQPPGACPDRARGRCGPPGGRGHGTFHRDGRGPDGDPQGRRRLRAGGPGVSRGAPGLHAGGQRRATAAQPVAPEAAAGARRAADRPGSRCALVRGLQ

SEQ ID NO: 25665 - protein, 155 aa, Pseudomonas aeruginosa
GEPGYSSRWREPRLCHLHLRLHRQAQGRRQPPFGAEQPLVLDAAGLRPGRRRHGVAEDPVQLRRVGLGVLLAADERGTFGGCRAGRPSRSGEAGGADQSRGGRHAALRAVDAAGLPAGRRRRLLHQPETHRLQRRGAAGGRPAAGVRQAAAGRPL

SEQ ID NO: 25666 - protein, 215 aa, Pseudomonas aeruginosa
PLWPDRGGHRRHPLDLHGGGQGRGADRPADRQPGLLHPRWQPGAGTGGRARRAVPGRSGPGPWLPPASGADCRAFRRQPVRGWGADVPHRRPGALPRRRGDRVRRADRPPGEAARPAHRAGRDRGAPAGASVGARGGGAGGGRQAVGRLRGAGERERRLARSPDRAPGGEPAGIHGAGAVAGAGADAAESERQAGSQGVAATASCCGADACCAAE

SEQ ID NO: 25667 - protein, 269 aa, Pseudomonas aeruginosa
RLHPRRAVEPAAGRRGGRTVPGRGRGGAWLPGASGADRRAFRAGSLWCAGQPAVPQRRPDPWACGWGGGLPRTGGSPGEDPRLPHRTGRDRGAPARASGGARGGGGGPAGRGGPAVGGLRGGAGAGGRGFAGSAGGVPGAVEDGAARAPAGIHGAIAPVVPGADAADAERQAGPQGPAAAGCEPVAAGLRGAAKRSGATGRGDLGGGPAIATGRARRQLLRAWRPLVAGDPGDCPDAERGRRGAAAGGVVPDRVAASLCRACRGADFQQ

SEQ ID NO: 25668 - protein, 315 aa, Pseudomonas aeruginosa
NRAADRFLRQHPGAQGRHQWPDGFRRVAGPGPPARAGGTGAPGPAVRATGGGFAAGAQPRPQPVVPGHVQSPGRLSFGQPGRATARPVAGADGVAEQLRGLRPDAGRARGRGRYLGIVRLCHGSVRGLDRRAPGSALAESPARHRGRTGPAGRRVAAVAGRGARLPVAGLGRERRRGWVAAPGPVADPGAGPSASAGASTGAGGAGVELRRAQRPRQSSGSLPDSAWRRSRCAGGNRRRALAGHGGRSAGDPQGRWCLCAAGPDLSAGPFASHARGQRRRPVAQPGAFAARAAFARRAGGALHRPPGTGRIGVYG

SEQ ID NO: 25669 - protein, 263 aa, Pseudomonas aeruginosa
PCAGHGPAPYRLRRLVDAVDGRRAGPALRRLQPGARSGPAGAADTVSGLCRLAARMDGGRREGAPVGVLDRPAGWRTAGAGAAVRSSPSCGAELSRRAAGVRTRRRAGQAAEGACPTAGCEYLHVAAGVVPGAAVSLQRSAGYPCRRAGRQSQPGRNRATDRVLRQHPGAQGRHRWADGVRPIAAPGSPALAGGAGAPGLAVRATGGSLATGAQSQPQPAVPGAIQLPGGAGRARLAGSRGTEHRRAGVGKPYGAVRPGAGYL

SEQ ID NO: 25670 - protein, 256 aa, Pseudomonas aeruginosa
RLHPRRAVEPAAGRRGGRTVPGRGRGGARLPGASGADRRAFRAGPLWRAGQPAVPQRRPDPWACGWGGGLPRTGGPPGEDPRLPHRTGRDRGAPARASGGARGGGGGPAGCGGPAVGGLRGGAGAGGRGFAGSAGGVPGAVEDGAARAPAGIHGAIAPVVPGADAADAERQAGPQGPAAAGCEPVAAGLRGAAKRSGATGRGDLGGGPAIATGRARRQLLRAWRPLVAGHPGHWPPTRTTAPGGADQVDVHRGDTG

SEQ ID NO: 25671 - protein, 2457 aa, Pseudomonas aeruginosa
KTDFLRGGSVQALIEKVGSLSPQERKALAVLLKQQGVNLFEIAPVFKRQDGEPLRLSYAQERQWFLWQLEPESAAYHIPSVLRLRGRLDLDALQRSFDSLVARHETLRTRFRLDGDEARQEIAASMALPLDIVALGPLEEGALARQVETTIARPFDLERGPLLRVSLLRLAEDDHVLVLVQHHIVSDGWSMQVMVEELVQLYAAYSRGLEVALPALPIQYADYALWQRSWMEAGEKERQLAYWTGLLGGEQPVLELPFDRPRPVRQSHRGAQFILELDIDLSQALRRVAQQEGVTAFALLLASFQALLYRYSGQADIRVGVPIANRNRVETERLIGFFVNTQVLKADLDGRMGFDELLAQARQRALEAQAHQDLPFEQLVEALQPERSLSHNPLFQVLFNYQSEARGNGQAFRFDELQMESVQFDSRTAQFDLTLDLTDEEQRFCAVFDYATDLFDASTVERLAGHWRNLLRGIVANPRQRLGELPLLDAPERRQTLSEWNPAQRECAVQGTLQQRFEEQARQRPQAVALILDEQRLSYGELNARANRLAHCLIARGVGADVPVGLALERSLDMLVGLLAILKAGGAYLPLDPAAPEERLAHILDDSGVRLLLTQGHLLEHLPRQAGVEVLAIDGLVLDGYAESDPLPTLSADNLAYVIYTSGSTGKPKGTLLTHRNALRLFSATEAWFGFDERDVWTLFHSYAFDFSVWEIFGALLYGGCLVIVPQWVSRSPEDFYRLLCREGVTVLNQTPSAFKQLMAVACSADMATQQPALRYVIFGGEALDLQSLRPWFQRFGDRQPQLVNMYGITETTVHVTYRPVSEADLEGGLVSPIGGTIPDLSWYILDRDLNPVPRGAVGELYIGRAGLARGYLRRPGLSATRFVPNPFPGGAGERLYRTGDLARFQADGNIEYIGRIDHQVKVRGFRIELGEIEAALAGLAGVRDAVVLAHDGVGGTQLVGYVVADSAEDAERLRESLRESLKRHLPDYMVPAHLMLLERMPLTVNGKLDRQALPQPDASLSQQAYRAPGSELEQRIAAIWAEILGVERVGLDDNFFELGGHSLLATRVISRVRQEQQLDASLKALFERPVLEAFAQGLERTTDAVSTIPLADRQQPLALSFAQERQWFLWQLEPESAAYHIPSALRLRGRLDVDALQRSFDSLVARHETLRTRFRLEGGRSYQQVQPAVSVSIEREQFGEEGLIERIQAIVVQPFDLERGPLLRVNLLQLAEDDHVLVLVQHHIVSDGWSMQVMVEELVQLYAAYSQGLDVVLPALPIQYADYALWQRSWMEAGEKERQLAYWTGLLGGEQPVLELPFDRPRPARQSHRGAQLGFELPRELVEAVRALAQREGASSFMLLLASFQALLYRYSGQADIRVGVPIANRNRVETERLIGFFVNTQVLKADLDGRMGFDELLAQARQRALEAQAHQDLPFEQLVEALQPERNASHNPLFQVLFNHQSEIRSVTPEVQLEDLRLEGLAWDGQTAQFDLTLDIQEDENGIWASFDYATDLFDASTVERLAGHWRNLLRGIVANPRQRLGELPLLDAPERRQTLSEWNPAQRECAVQGTLQQRFEEQARQRPQAVALILDEQRLSYGELNARANRLAHCLIARGVGADVPVGLALERSLDMLVGLLAILKAGGAYLPLDPAAPEERLAHILDDSGVRLLLTQGHLLEHLPRQAGVEVLAIDGLVLDGYAESDPLTTLSADNLAYVIYTSGSTGKPKGTLLTHRNALRLFSATEAWFGFDERDVWTLFHSYAFDFSVWEIFGALLYGGRLVIVPQWVSRSPEDFYRLLCREGVTVLNQTPSAFKQLMAMACSADMATQQPALRYVIFGGEALDLQSLRPWFQRFGDRQPQLVNMYGITETTVHVTYRPVSEADLKGGLVSPIGGTIPDLSWYILDRDLNPVPRGAVGELYIGRAGLARGYLRRPGLSATRFVPNPFPGGAGERLYRTGDLARFQADGNIEYIGRIDHQVKVRGFRIELGEIEAALAGLAGVRDAVVLAHDGVGGTQLVGYVVADSAEDAERLRESLRESLKRHLPDYMVPAHLMLLERMPLTVNGKLDRQALPQPDASLSQQAYRAPGSELEQRIAAIWAEILGVERVGLDDNFFELGGHSLLLLMLKERIGDTCQATLSISQLMTHASVAEQAACIEGQARESLLVPLNGRREGSPLFMFHPSFGSVHCYKTLAMALRDRHPVKGVVCRALLGAGREVPEWDDMVAEYAEQLLQEHPEGVFNLAGWSLGGNLAMDVAARLEQRGRQVAFVGWIDAPAPVRVEAFWNEIGPTPEAVPNLSVGEMRVELLGVMFPERAEHIERAWSSICSATTDDEQRWTRMSDWAEAEIGAEFATLRSEIAQSNELEVSWELKQILDERLKAMDYPRLTAKVSLWWAARSTNAIQRSAVERSMAEAIGAERVEPVRVLDTRHDKIIDHPEFVQSFRAALERAGR

SEQ ID NO: 25672 - protein, 323 aa, Pseudomonas aeruginosa
VLPRKLQAMPFVADQEEVSRPPVAGRRALRLDMALPSSGARSTPGNDEMTKRKLAYIWSLRNAAADKAGQYVPYKGEQRYMKSVLESLVEALNQTALGDAYELVGVIYDDDAELPRDQGKIKDYGFAYRPGQQWFYPADLQVQGKTLNDLLLSVPSTYRRYPRGTPEHVAGKSDFERRLHDTLVELGADVVVLDGLLVILDELVRPGAPFARRIMNIHPGVTREDSPYERRGAYATLDALYGARGEKVVDWATMEKVAVEPLYWTGASFHYVDNGIDSGEVFHDVLKTEISPDDTILELRWNNFNNSLFPALHEGLALLAEKL

SEQ ID NO: 25673 - protein, 558 aa, Pseudomonas aeruginosa
RLMANGLAKVTSCSGPSSGWRPTSSSGVPMVKLPAGSTTISGQSLQSLNTVPGFFASSAKAGAVATISAARARGDNACMAVLVEWRKGSGELRGEDFQHPVDLRLVVQQARRQAHHRADIAIHGVADYPVRHQVFGDRLAIAAFDAEEGEARRQLGAGRRDQADLGMLAQALLEVGVELVDTRLDLGLAQLQVQLEGRAQGQAMFEGVVAARGHQGAEVVGAGEGRDARHQVLLELFRAGDDDPGATRAEQPLVGAGDEVVAVEVGEADVFHAETMHAVDHVDDPVLLVALLVEFAHQLADLADRQLHAAARLHPGHAQHPGLRADLSGDAGQDLVGGNPVRVLEQRELADLGTHALVPVFQGGVGGVVLVGGGQDLLARLHQQAAVDRRQAVGGAAGERHLARLHGEVATCPGASLVLVFPDFLAMPVHRFARVAVEADPQALDGLPHRPRVGGEEEVGEVQILRVEIELLAQRFPFIAGVARYAFGAERLGSGKQRQAGGENAGLLEKGTTVVHREVRCGVVRGWLSAWRVFALRPRRAGSCLPRAWRCRHRNNRG

SEQ ID NO: 25674 - protein, 557 aa, Pseudomonas aeruginosa
LDKASFTVDTGRTMTVSRRGFMAGLALTGAAALPVAYYTHRHLTREEEPQTPDEASLDLAATDGIRLGDRLRGLWDLRLVGGDAELPGLPREGLQLVLDVAPKGRGLIGYLDTPERLLAAEPPRFRVLGDLLGASSASIRWRLVDQASGSVAPTHDCSAVFDEVWADYANAGDGTLSGRIQRLERSPLSPNEDFRFVAVKRHFPLAHERIVLNEKLLGWLVSPQHRLFHQLWHASRDKWHRLSEKQRNALRGVGWQPGPLDRERDARGPRKDRNASGIDFFFMHRHMLHTARSMQDLPSWERLPRPVVPLEYDRPGFIRYFDNPDGFSVPPAWVAVDDDEYSEWLHGLKSAEAYHANFLVWESQYQDPTYLAKLTLGQFGSELELGMHDWLHMRWASVTRDPSNGAPVMTDRFPADFAPRWFRPENDFLGDPFSSHVNPVFWSFHGWIDDRIEDWYRAHERFHPGEVQRREVEGIQWFAPGRWVEVGDPWLGPATHGCGLSDVQASSNSVELDVETMKLALRIIFSEEDQLSGWLKRAPRRPWYARNLKLARDQLRR

SEQ ID NO: 25675 - protein, 231 aa, Pseudomonas aeruginosa
TAKERVRMEEARATRASVFPRETLAVALPAAAEGLVQADRGLQAGQSQLHGGILRRVQRALRFEDRQQGFRAGLVAAVGEIEGALRLLQLLLLPVQLAVEAVDAVQRAFGVGKGGEDRLAVGFQQFFLARQAAVALGAQAAVVEDRGEQVGAQVVIGVAESVGGAVGAGRQRGAQGQLGEQRRARHLHVGLGRGQLRFGVGDIGTAAEQFARQARSGLRPAQAVERPLGHL

SEQ ID NO: 25676 - protein, 406 aa, Pseudomonas aeruginosa
RLHRLADQGGQGNQRLMGLLLEQRQLLALAGDQAALLGDLQGGGRARGMAGLHQAQDVLGVVQVEPGDALLFAQRQYLQVAVGDAGEQGQLYRCAVVLAGLEAFQGTAVGSPATAPEVHFVAGAEAGGEGVDGIVVGGRVGTAVARVAQEFLPAGAERRIQLRQQRRAGDHRRGLGLAYAGHRRAEVLAVQQGALQQAVQFRRAEGLPPLADVAGIAAPGRQVAPLAGRGQAAVEGRRRAAAGAEQQAGGNQGEILHGHIRHWLARAATGSSWAALRAGMKPNTRPVTSAQLKAPTMADREKATATWPSSSTPPMHRARAIPARPPTTESIAASVRNWRRISPWRAPVAMRMPISRVRSRTVMSMMFITPIPPTSREIAAIEPSISDRVFWVFASAWIIAALLVSS

SEQ ID NO: 25677 - protein, 211 aa, Pseudomonas aeruginosa
MMFEPNAPICAITWRLLPSPTASMTTTEATPMMIPSRVSAVRNRLIHITRQAARTASSSSARQAPEGSLLPSARRWLRSSACRWRSTPALGCAGRSSLALSLTISPSRTSMMRLARAATSRSWVIRITTWPWLASSSSSAMTSAPLWLSRAPVGSSARMIWPPFISARAIDTRCCWPPDNWCGRLAVRSARPRRSSRARARVCRSLAGMPA

SEQ ID NO: 25678 - protein, 166 aa, Pseudomonas aeruginosa
RQRAGVVLENHYRELLRFLSARLGDRHAAADVAHDAYLRVLERSSQAQIEHPKAFLYRTALNLAVDEHRRSRVRRAEPLEVLDDEEGLASPSPQTVVDQGQRLDNLQRALAELPAICRSSFLLRKLDGLSHSQIAEHLNISRSLVEKHIVNAMKHCRVRMREWEAD

SEQ ID NO: 25679 - protein, 452 aa, Pseudomonas aeruginosa
KGANPEELEMTQATATAVVHDLIGVGFGPSNIALAIALQERAQAQGALEVLFLDKQGDYRWHGNTLVSQSELQISFLKDLVSLRNPTSPYSFVNYLHKHDRLVDFINLGTFYPCRMEFNDYLRWVASHFQEQSRYGEEVLRIEPMLSAGQVEALRVISRNADGEELVRTIRALVVSPGGTPRIPQVFRALKGDGRVFHHSQYLEHMAKQPCSSGKPMKIAIIGGGQSAAEAFIDLNDSYPSVQADMILRASALKPADDSPFVNEVFAPKFTDLIYSREHAERERLLREYHNTNYSVVDTDLIERIYGVFYRQKVSGIPRHAFRCMTTVERATATAQGIELALRDAGSGELSVETYDAVILATGYERQLHRQLLEPLAEYLGDHEIGRDYRLQTDERCKVAIYAQGFSQASHGLSDTLLSVLPVRAEEISGSLYQHLKPGTAARALHEHALAS

SEQ ID NO: 25680 - protein, 146 aa, Pseudomonas aeruginosa
CRSRPICRGRPGWPRTSAGPPMACRTSGPRMSAAWAMASATPTRATTPACWPRRSSPRAASGRAISAARASRRPSWTTCRPTSSTPGSTNPRRCKPSGRRRRPRYASCSKATPPVSTASSARQTARPPVALASPGCGPSRPMTCCA

SEQ ID NO: 25681 - protein, 860 aa, Pseudomonas aeruginosa
SLPHAQSRRFPFSFHRSVAGVRSGCPAGYLRARRRTPVDHRQRRQQAGFRSRGDARGEPVAARRPLAGADLPRPRVPRTDRADPRPARGGSAASSPGPAPAAADPAHAADLRPADPDSAPGVLRRGLSGNRAGDSPVESFGRPGPAAGRCRGARRQPWRGGRRAAAGGARATDGRAGAAARPAAALDASHARWPAVAALAAGALAAVVPRGRAGLAGALRRAAPARFGHDPGSRRQRPGRGPRATLAGARLACRGAAGGAVPAAFGAHPPLPPAQPPGLAGQPAFRRLAGGDLPRGGGPGQGIPSGGGRLKRRNFLPPMPTIIPPAAVRRALPSSHPRRSGLHERHHRYRRPAPPGAQARAADVLRLRRLRFLERRHLPRQPGRLRRDQAAPAGRAEYREPLAAHPHARPGDGHAGGHRAHRAGRHAACRRRDPRRPRRRRVRRALHPVDHEHLFPGGHRHGSRPAVLVPALRDARPRFHRTPDRPCQGRRLRRAGADPRPADHRPAPQGPEERSLGAAAADPGQPAEHRHQAALGAGHARHPASRFRQHRRARQGRRRHGLTVRVDRPPVRPAAELGRRRMDQAALGRQAGAQGHSRCRGCAVGRRLRRRCAGRQQPWRTPTGRRALDHQRAAGDRRGGGRAHRGLARQRHPFRAGRAQGHRPRCARDHDRPSLSLRAGRAGAGRSDAGAGDHSPRAGPDHGLLRPYRHPRGRPGHPVAGKLSAIAANSEWKGREERKPRGSTAARQTGSGGGTPAQDDAAVALRVEQPLVGTVEAFQQVGPVALVFAGQSGNAGLAGLLRGRGVDDALDAGVQQVIGRGQGGDRCSVVHGCLRLLSRLWVGGQRNPRFRRDTFVAELV

SEQ ID NO: 25682 - protein, 87 aa, Pseudomonas aeruginosa
PVLLDGYDCMALEPSDVLLESVFCQLDADTPRSLHDLKGDPRANLLAIRLLFRQGRITGVLLDDPSGAEDQHGPLIYHAERLRVRRG

SEQ ID NO: 25683 - protein, 718 aa, Pseudomonas aeruginosa
IPFNDTFSFARLCAAVLSPIISLQSDERLAAPMGGGAVAVRLHNQKPEKACTDDYPEPQWQGSSARCHRGYALALGYPRRRRLYRDQVRLRHGPVRLLHHPYRRPGHPFLHHAGEPGAGQEGHHHRPPAHRQGRRSRPAGLAGHRRGAVRLLPGRADHVGHGVAEEQPRAQRRADRGGHGRQHLPLRHLQPDQDGDPQRLRQVAGGQGMKRSYPDDLVIGNLSRRGFLKGVGATGVLLVAANWGWRDALAAEKKAFGADAMPHGWVDNPKIYVSIDRDGTVGIVCNRSEMGQGVRTSLAMVVADELEADWSRVKVIQAPGDEARYGNQDTDGSRSMRHWFEPMRRCGAAARQMLEQAAANQWKVPLGECRAEQNKVLHAPSGRSLSFGELAEAAAGLEVPARDKLLLKKPEQFRYIGKDVARAIDGADIVNGRAGFGFDARFDDMLYAVVARPPVYGGKLKRYDAAAALKVPGVVKVIEIEGRPIPSEFQPLGGVAVVAQNTWAAIKGREALAVEWDAGVNGGYDSVAYRKQLEEAARKPGKVVRDSGDAAALFAKGGDIVEAEYYLPHLAQAPMEPPVSTAWYKDGACEVWAPTQAPQVTRERIAERLKLPFDKVTVNVTLLGGGFGRKSKPDFVLEAAILAKAFPGRHLRVPVEPGGTICISPNFPHSIRWSACQAVVGARRGSGRLGCIARWRRASPHCSARTASSRAPSTWAWA

SEQ ID NO: 25684 - protein, 548 aa, Pseudomonas aeruginosa
PGSPPRFPALELAFVAIFPPFRWRTKKMRRPEPMPPSAASPCRSYAVPLLKTSVAAPGEAGAQARPSWMGLVRRDGLQRREETSRKIAADFSFRHSRMLARELRVRPRGTCLEAGLHRQRRGGRPRVHFQGAQQRGNVHAHGERRDRQRAADFLVRQAIGDQPQYRLLPWGQGVQEGALPTAGARPAAQAHHRFAAAERLQRRADLPGLQGFAEVAVGAGGQHLVHQTRVVEHRDDDDCAVPIGATQALDGLGGGEAGKQQVEDEEGGRFRRDARGQAQHLVEAARFAYGGLREVAADDPSQAIAEQGIVIGDDDPCGEASCARHCRPVHGGGQGTATPASTGRGPAGEGAAGTVRSAENPFSSIPVAELRPASQRNSSAAGDTHVGHSSEKQQASPTASAMGWSILLQRHRAREDGMGCPQVCAGATLQCSFGAAPTVLNVLPQNRTLTSGMPAANIMDHIPLLNIPTFGLCQSPANPVVAAATAAALGVLTPMPCIPATASPWIPGGPPTLLLGGMPALDANGTLICTWGGVIKISVPGQVQMLIP

SEQ ID NO: 25685 - protein, 688 aa, Pseudomonas aeruginosa
AWMPWGDGAQGGLLAHHPLAHSLRQGTDGVGFVGEHLAHRDAGPAGDHRGHGTRVHLLGNQRVVLADGFEAGRQARQFGGQVVDATVQFLVGLGRVGAFAEGQQFAAGVEQFAHRFAFLVPAGLQLADGPAVIARLAFQGGDTRAVVEAGGLFPAQPLQFLFQRLLAMAQAFQRRRHVVLAEGDPRAGGVEHADRLVRQLAAGDVAMRQLHRIDDGRVHDLHAVMQFQLAGDPAQHLHGGGLVRLLDLDQLEAPGQRRVLLEVFLVFQPGGGRQGAQFAARQGRLEQVGGVAAAFRAAGADQRVRLVDEQDDRLRAVAHGVDHPLEALLELALHAGAGLQQAEVEHPQDHLLQRRRHFAGGDAQGQALDHRGLADARRADQDRVVLPPAQEDVDALADFPVAPDDGVDAPGAGLGGEVLGVLVEQRVRGAFRLVAACRRTVRRGRLFAGGLDPLQQVGLQGLVGNPQQRRRAVQQQGAALLAVEQGEQQQAGTDLRLAEHTGVHHGVFEQADGVRGQRRSAGIAGLEQLQRQVDLGDQGVALQAEARQQAGEVAAVDVQQLQQQVLDLYVMMGALQAALRGALQGAATIRVEAADQGGEFHFKLPPAAAGRDRCAAAGRLRCAAGRCSSSAWAVYRAPGAAARRRSPAGSGDNPGRGRSTARRGWPTGHGRRRRGRSGRPRGHPADRG

SEQ ID NO: 25686 - protein, 290 aa, Pseudomonas aeruginosa
  UNSURE (193): Identity of amino acid at the above locations are unknown.
AGGAGTGRGTRRGHGPSAGRVVAAIPGRHRATGRRGRRGRTPGWTAPVAAGRRAGFPPRSRRTAAAAARAGAGPPPAARCRCPAATPGDARVRAAAAPATVRSAAACGAAADSEGERRAGLGLPCLHLLVGFHQDRAHEAVGGGIQREELRQHGGEQHAAGADEVLRIESQADFQAIAPAAPGILADVRHHPXAVELPQTFYLPAGAGVVAQVVQGEDFPQGFEGARAFHQREVVEGQLRDQSPARLAVQARLALRAGRVAQACGGDRPGPFEAQRGAGTQALGQIAIGA

SEQ ID NO: 25687 - protein, 399 aa, Pseudomonas aeruginosa
QLGGQAEGRGLAQRVEAGIHHAQQQIAAQPVRGQPGDAPGVPVERAEVAVVAAAIVRRDWLHGAPGNRAHGADAMDFHAVLAVTVGDQAVLAAGAVRAQRLRGLRKEVDRRRAAELEVFRLQMQACRRCAIEDQVQVERLSVGERAGQRQVEEVELVGKGEVLGEQAQARMSAVFLRQQRLVGGEADDRRHSAERRRRRAGRPRHDLHGMRGEQVVEDRAAHRRSRQVDAQALDRQLLPAVLAQAAQAQAQRRAGGADSGQGLRLLAAEQGRFVDRQRPQGRLGAAAEMHAVAAAGGDEQRGVARQPVALGEVALGRVRFELDDRAGRQRAQRQRVELFEEGVAELRVVVVEAPLQARGEQREAFQQTLDVRVGAFAGGQLQAPGDLRIALGEGAAGVP

SEQ ID NO: 25688 - protein, 497 aa, Pseudomonas aeruginosa
HTRRAPLAPRPAAARLAASGYPGNATGQRSRHALAEGQASDRRARQRRTSKGSRMSVLPDAVCWHEGMQLLPQHFQLQGLRAEALAARIGQACNPWFWGVTALELDPSALCAGQVRVLHLEAILPDGLPVSVQAGVDAPLEFDLETALAAAEGPLLNVHLAVSPLWRAGQLLPLKGRLQSRVGAPLPDLASGEHPEPITVWRASLRLVGDDGKADSVCLPLLRVAKEGGAYVSLPYVPPTPLILPESPLGRRVQSLCARAREKALFLGGRLRLAQQAGNQDDAVEIRRQLAALWTRLPEVEGLLASRTASPLALHGSLLGLAGAWAALDPLAGVPAFEALDFLDLRRGYEPLLDWLERAIESIRAGYRCLPFEQEEQVFSVRLPDPAPRQRLVVGLRMPAGAGEQAAADWLERAIVASDPHLPLLARQRMSGLPRQPMNRQEQVAYSVGDDTRLFVVQGAGDWFDAGQPLRIVAPVSGVASSPWQIVLFVADGSDNT

SEQ ID NO: 25689 - protein, 259 aa, Pseudomonas aeruginosa
PTWPMRSRRHERRDPVHAGSPPGAAGAAAGGAGLVVANPRWYGDPQLLRGGPADGARAGLAGPLRIALAADARQRDRGRAVVRHLAPAAGGASGLVRPLVVGRRGGDPAGARVGVPARRGPAPAKRRLAAPVASVPAPARQARAGRGGLEHSAGAVAGWRAGGQPRPRRAPSLRGTDPAPWPEPAGLRGDHWPGRPAGFPGTSRGAARGGARARPRLVLAVRRRSGLAVALVRAGAGGNHRHPDRVDRRTRYLARPGGQ

SEQ ID NO: 25690 - protein, 681 aa, Pseudomonas aeruginosa
RFQPDGHRQLRRHSQRRAPAVQPQRPGDAPGGPAPGRARALPVVATAAGGAGLEGPRRLLQPVPRRTLPVRLQPGSGRCRAGAGAAPAETDGDALAAGARRAGPGSLAGPAGRRGLRPPPGAGAALARPAVRARQVGPARRRPGHRLAQRPQPGTRRRPGDRLEPVLGRPGKPFPRRAGQGPDLECRRSAENHAALGEERLAASGRRPAPGQPGGGRPRGRLELPGLLGAVAHDARALLPAAPAERRLHGVSAGPATAGVCALQPGKRGADVPPPVVDEPGRQDPAVHPAAAGARAAIAVRDAVAGHRRQHGRYPMTLPLSGNALSLEVLLEPIDPGQPCGPSLRYDPDYDRLRELRREDDSSLPTGVWQAEAKRADWAAVEQLASDLLQRRSKDLMLAAWLGEAWLQRGGLGGLQRALVLLAELCERYPEEVHPQAQDGDQSWRVPPIDWLLRRYAELLHTRLPLMGQGAFAEITLYAWQRLQRQQVASGDSKSAKAALEAAQLQQKKLDEALRAEPLVQWQRKQASLLACQQQLQRLEQWCDRCLGELAPSCQPLREVIAQWLALLKEFIAMHPQAPLPEEQPPVAEADAAEGDADGEESVPASAPSGPAGAPTSREDAYRQLLLIADYLARTEPHSPVPYLIKRAVEWGNKPLSELLAELINADSEARRVWSLLGVLP

SEQ ID NO: 25691 - protein, 201 aa, Pseudomonas aeruginosa
AGLYFLFEYINTNSEFFNLWVPGARWAHIPRLGTQHVRHHPSPRPRADQIGARHRAGVQRPPFPRAAGAHRAPGAQRGQRAGHRRDRHRQGAGGAPYPRPQRTQRRPVRRGQLRCFRREPGGERAVRPREGRLYRCVAEQGRLVRGGQRRHPVPRRDRRPAAEHPGQAAARAAGTRGGAARFAPADPHRRAAGGGDQRRPG

SEQ ID NO: 25692 - protein, 315 aa, Pseudomonas aeruginosa
PSACASWWRCRPGIVSPTVSARMAATLDRLSGGRLLINVVTGGDPDENRGDGIHLGHAERYEVTDEFLRVWRRVLQGEAVDFHGKHIHVENAKALYPPLQRPYPPLYFGGSSEAAHELAGEQVDVYLTWGEPLPAVAAKIADVRQRAARHGRTVKFGIRLHVIVRETAEEAWRAADRLIEHISDETIAAAQQSFARFDSEGQRRMAALHGGRRDRLEIQPNLWAGVGLVRGGAGTALVGDPRQVAERIGEYAELGIDSFIFSGYPHLEEAYRFAELVFPLLPEPYASLAGRGLTNLTGPFGEMIANDVLPARAGA

SEQ ID NO: 25693 - protein, 149 aa, Pseudomonas aeruginosa
SSPRCSSASPKAPSRRLASTPCAKRDRGSAPRSPRPMPTPMCWRATANSGSAWKAPGRWSSAPRSASTPPGPRARRWTPASAASWPWPSPPPRSPRRATASTCATACSKSPAPAPLTPPCAWTATGATCAPRPCTTRWTTRSASWATGR

SEQ ID NO: 25694 - protein, 278 aa, Pseudomonas aeruginosa
TSHRRNRPSTHERFYPYSRPAADAATFAEPGDLDPRHRPGLRGSEVPGPARTPAPGGAERGQRAGDRRDRHRQGTGGAAYPQPQRAAQRPVRGGQLRGLLRVTGGSRAVRPREGCLHRRPGGQGRLVRGGQRRHPVPRRDRRPADADPGQVAARVAGARGGAPGVAQEHPHRRARAGGDQRATGAGDQCRALPRGPVLPAQCRQSRTVAVARATRRHPAADPPLHRRIQPSPGLRPEPVEPGGGAEVACLFLAGEHPRAGERHPPYLADLPRRADPRG

SEQ ID NO: 25695 - protein, 397 aa, Pseudomonas aeruginosa
SSPPRRDPGRLPVGTGRTRQDLADGSLLPVPARARAAPALPPLHAMGAPAPVRTDRYSRPVARPGPRVGAGCAGAVLRRAVRQRYRRCHPARQPAAHHVRGGRGAGGHFQPATGAVVRRRFQPRTLPPGDRGDPAAHGGGRGGWRPGPPPASRPGRATLLGGGGGAGERFRRTLRAPECRRSGIHAAHRTGAPPAGGAPAQRIGALVQLCAALRGAAVGAGLHRPLRPLPGDPDGRPAVPERQPARRPHSPWHRGRRATGGGGGSRIAAVVGARRRRAALHRPGGRMLRPQGAALPGGQGAVGGTLYRGLPGLRLPSHPQPAARDAAGTLRQRQRRLAPRRRSGNCGWPPALIRRPGRGSVAVPAQQRVHVLRRRAALELQQFRGAVGEETVDAGRA

SEQ ID NO: 25696 - protein, 718 aa, Pseudomonas aeruginosa
GLEVFRRVHRVGMDEQPARVGHAVHPGFHQVGVALFAAFAEGRRGPGAQRAVGLGPVQPGAELGFGLHFLPGIEGRLVGFPGFLEGHWRTGFQVTVAEPQQENLRHLRHAFLQQFQAALLEGLQDHPAIAVGHVDMPGGGALAGLQPAAAFQQLAQVVFDAGELRRYLGLQVQARLVGAALGDVEHLVEGEDAQADEAGPGALGEGAIEPGAGVQALEFGESEAAHRVLGASREDLGDVGGALQGVVVEGDQYAVAAALHVGFQVVGAEVAGHQVGRGGFLGGVVRGAAVGDDRRPGHAGGGAEGLAGRLRGLGGEPRRQAEEAQGLECSLPESLPHEAPFLLSFSRDCRPVWRRRMTAGRQIQVCPARGKMRCRGDAGSCRPRQSASPPRPGGRILQAFVQQAGQAVAAELDQRDQQHKDDDHGEHHLGVEALVAVAVGQVAEAAGTDRAGQGRGIDHGHQGDGEAADDARSRLRQQYVADDVAAFAAHRLGRLHQAVVDFAQADLGDPREERRGGDGQRHHRGPDSIAGADDHPGKGNQRHHQDQEGYRAQHVDQTAQDAIEQARLEDPARPGGDQHQGQRDTHQQDDGGGRADHQQRIEETLPEPFKHGRHGRAPPPCPPPARPWPARREARRAARRPVAAGAPGRGPGYALCRRGAGRRAGRWPWRWPAGPAPVGWRRCTGDRAAPGRRRREPGAGAPGGRPGGRRAGCRTGFG

SEQ ID NO: 25697 - protein, 99 aa, Pseudomonas aeruginosa
RAWRGSPKTSQTSPCSTMRPHSRTTTRSQISRMTAISWVIRTMVRPSRRLMSRSSARIAWVLSGSSAEVASSQSSICGWCTSARAMPTRCFCPPESCAG

SEQ ID NO: 25698 - protein, 90 aa, Pseudomonas aeruginosa
RRYSACLSRASAAVAATITLMPMKILMSSARRPAPTTAARMRCTNWRVASRVCPETNTHSAWRAAKARPRSEEPAWNSTGVRCGEGSARW

SEQ ID NO: 25699 - protein, 306 aa, Pseudomonas aeruginosa
GSSRRPRGTSSAPGRAGCVRGRCASGGRDRVRRDRRGCRQARSACCRPAGRPRWSARGLRRRRSRRPPRFPRPARRWPGRAPARHAPAALRRRAGGSPGGRSHGWSVGRRWPCRRRSRPRAGRARGRNAGCPRRRRGRSRRRSPRGGSVPAGRRWSGARRRPGTRPRPRRPPLPGRTAPNRCRWCVDRSRTSRRRFPARRCRAGRRPVAGGPRRPPPGSAPAARRVRRCSRTCARPGGSRRRRRAGGYGARWRYACRSRPGRCRNARRPGRRRTGDLSAPASRSPAALRGRRNGSAESAPGNCRRR

SEQ ID NO: 25700 - protein, 710 aa, Pseudomonas aeruginosa
PSPSRRTRAFSSRVWRVLRSGPALASRRPSRMPRNSLRFCAGLATLSITLSRPNWFCGICPRAGSAAQMTRNTSARVTWETCAPPWARGMPMPPRPRRVKSSSSCQGRRRSRSRSAASRRASPATSWAACNAWASFSMRRAGSSRGAWSRRSLGAVSSVMVQPCSVVVPPAASVWRGLRVLWCGWNAWRREGKQAVTTCSLGTSGSSDRWPARSPSLCRVCLHKPCRLLIHRKIKELEVFSNSFCWSAGAACCSAVARATVTGGLQPDAARRRRAARVIGFRARRPGARPPTRIVEGTPMQSANASELTTDIAVIGGGAAGIGVIASLLKRSPGLRISLIEPADTHYYQPGWTLVGGGAYAQGDTARPMAGLVPPGVEWLRTRVERVDPEARRLLLEGGDSLEYRNLIVCPGLRLAWERIEGLEETLGRNGVTSNYRYDLAPYTWELVRGLRGGKALFTQPAMPIKCAGAPQKAMYLSCDHWLREGVLQDIEVEFDLAGAALFGVADFVPPLMEYVRKYSAELAFNSNLVKVDGAARKAWFEVKDADGNTNLAEKDFDLLHVVPPQLPPTFVAASGLGDAAGWCEVDPATLQHVRHGEIFALGDVCGTANAKTAAAARKQIVVVAENLLGLRSGRGLPLRYDGYGGCPLTVERGRVVLAEFGYAGKLLPTFPLEPTAASRFAWLLKRHVLPWVYWNAMLKGREWLARPGR

SEQ ID NO: 25701 - protein, 150 aa, Pseudomonas aeruginosa
PGASTSPRRSSEPAGPPRASSSSRFSAALSVSHQSLAGRSARPSASSRSSPCCWAETARARTSRPSTAASSRAMRTALAMASSQSAGSCSRRPSRPSGGRCAALPRPSVRPLPASSSSALLPWVPQSMPRNNPCMRPSGVIRRVPGAGFR

SEQ ID NO: 25702 - protein, 140 aa, Pseudomonas aeruginosa
VWKTIARSRFAGGVSVMSVPSRAMLPPLASSRPAIRRSRVDLPQPEGPTKTTNSRSRTSRSMPLMMAWPSKPFCRLRILRSAMAEYLRGRKDGDALHFTAPKERPRTSCFWLIQPKTRIGAQARVETAESLAQNSPSGLE

SEQ ID NO: 25703 - protein, 836 aa, Pseudomonas aeruginosa
FSRVGWKMNCGGVAKASISLLKLVSSIQKIGKNSSRAMPQQSRPSRALRRRRDCLSVSMAGSSAALGKVLADHPHQHDGGDIGDQHRDQAPGRGHADIELQQRLVVDQVGEVGRFVAGAAAGGGEDLGEHREQEDRLDHQHHRDGPRQVRQGQVPEDRQRTGAVEAGSLLLLLVEGLHGGHQDQDGEGQPLPGDDEDDRQQRIVRQPIHRLGAEQAPDGGEDARDRVEDQVLPEQRAHRRHDEERRDQQHPHRAAAEEFAGLQQRGDEHAERHADRQHAAHQQQGVQRAGQEAGVGDEEGEVLQADEGILAGIQQVVADQREIQGHAQGHDHPQQQQRHRGADQEPARAAPAALETAAGGTGRERGIEGRGVHGDSVWIFKDKRSSSAAPGAAAPGGGLLRIAGALHLAGGALLRGGERLVAAHLPGEGGGEQLADLGADGLELGDGDQLDADIGHRLQRRMVGIDALQRFQGDPRERRGGQVGLAVGRGAGAGRHVGHAFPVRHQLAVRLRGGPGGEGLRHVLGARAGGNRQGPGIQPGGALVGDFPGGEGEAGGVGDLALALVGDERTGDAGVHPDRALAAVEQRQVLVESVAGGAGRAVPLEGGDIEVESLLPFAAAEFGLPSLVEPACAEGVGQGADQRHVLAPAGLAAQADAVLALVRAVEPGGEFAELGPGRLLGHPQPGLLEQVLAVVGDRGFGVERQGVQRALDGETVAHRGQQVVQGVVGGQPAHRLQPALGAPQRGFVHADGEQVELSALGGDVGGQALAQDVLFEHHPFQRDVRVAFLEHLGQALHADHVVVVDRGDGQGLGALGQQGQGKAGGGQAGLDRVVHR

SEQ ID NO: 25704 - protein, 304 aa, Pseudomonas aeruginosa
KMHIDLRQLRHFIALHEHRSFVAAALAVNLSQSAFSRSIQALEHSAGCRLVDRAAKDLRPTKQGLIVLEHARRLVSGAHNLANEIALFNGLEAGELRFGAGPAPATWLVPRAVGRFNVRYPKARVSFQVEHWQALNRRLQAEEFEFFVADTRHFEADPQYRTSRLRPRRWHFCCREGHPLAARESVSAEELLSFPLATNISPPNIRKVLVDLSGRPDFRPAIECENGHSLLGVVLASDAIGISSGLGDLAPPGQGGLRPLRVRELPDDLDELHTRYGIVSRAGYSLSPLAEAMIDELKRVDDAT

SEQ ID NO: 25705 - protein, 547 aa, Pseudomonas aeruginosa
SVVSFSRAVMSQPKPIRNVLYIMCDQLRRDYLSCYGHPYLHTPNIDRLAAEGVRFARAYTQGTICGPSRMSSYTGRYVSSHQVAWNAVPLPLEELTLGDYLRAAGVRTALVGKTHATANLEGMRRLGIDPASARGAALAEAGFEPYDRNDGVYPDDPAFADKRESAPYTHYLRRLGFTGDNPWHDWANSAASADGEILSGWRMRHAGLPTRLPEAHSETAYTTRRAMDFIDEQGERPWCLHLSYIKPHWPYIAPAPYHALYRADQVLPALRAAPGEESDHPVYRAFREHRESLNFSREDVRRQVIPTYMGLIRQVDDQLGRLFQHMRASGRWDDTLIVFTSDHGDFLGDHGLGEKEFLLESAVGVPLLIRDPRPEADATRGRVEEALVQSIDVLPSILEAFAVEPASHRIEGRSLLPFVHGAPPADWRRYAIAEYDYAFQAPARERLGRPIDACRMYMVRSERWKYIAYDGFRAQLFDLASDPGELRDLGADPAHAAVREAHAGMLFDWLRGLKRRTTISNAEIDLRGQAFRYGEPEGGRLVPIGLW

SEQ ID NO: 25706 - protein, 403 aa, Pseudomonas aeruginosa
AWRRSATSPTCSPARRSMPSWSNIAGPTRRPEPALAGRHAAPAQGVTTMLDPTLSDWLDRQADALDRGDADPAALLPRLAAAGVLGVAVEERLGGAGGTLADAVERVAAVAARSLTAAFVFWGQRAFIEYLLQSPNQELRQRLLGDLLAGRLAGATGLSNAMKFLSGIEALQVVAHAEEAGWRLDGRLPWVTNLRSGDFVVAAAIEHGEGGKPFVLAIPEGLAGLQRSADLRLLGLQCSNTAALDLRAVAVGRDWLLHDDARQFLPRVRPAFLGLQCGMAIGLARRALDEVQRHLGGSRSLLDGELAAQRETLDGHVAALHAGLASGEFASQPARLFRIRIGLAEAAANAVQLELQASGGKAYLSEHGAGFARRWRESAFVPIVTPSLVQLRAELQRQAEAKA

SEQ ID NO: 25707 - protein, 419 aa, Pseudomonas aeruginosa
KPYGGRAAPMPIPSLSRRPPMCLDDPTHSRRDILKLAALLSAAGALPLLSSLQARAAAEPDAPVRIGYLPITDATPLLVAHANGLFEAEGIQAERPVLLRSWAQVIEAFISGQVNVIHLLSPMTVWARYGSKVPAKVVAWNHVGGSGLTVAPEIADVRQLGGKSVAIPFWYSIHNVVLQQLLRDNGLRAVSRAVGAALAADEVNLVVLPPSDMPPALASKRIHGYIVAEPFNALAENLKVGRVQRFTGDVWRNHACCVVFMHEHDLERRPQWSQKVVNAIVKAQLWTREHRAEAAQLLSKAGANRYTPHAPEVLGRVLAPGAEEQQAYLASGAIRHADWQERRIDFQPYPYPSYTEELVRRLKDTLIEGNNAFLASLDPRQVASDLVDDRFVRQALAEVGGLQAFGLAEGFQRSEEISP

SEQ ID NO: 25708 - protein, 175 aa, Pseudomonas aeruginosa
PPTWKAARATSVSRPSSTTTAATTMPTNTYRCSTNSSKAVGRTARCSATVAEGSSATRARFTRSAMSASTSRYPASISANRRRSARRCSTRPARRVVASASPPSTPSACSSPRHRRPCSSRRSPTSASASPRPAAIRARYWCSTCRRWCWAKPTPRPGPSSTNTAPSSATKGPWR

SEQ ID NO: 25709 - protein, 220 aa, Pseudomonas aeruginosa
SPAGPGSTSASIGRTRCCGTSTPMRSNRRWKRFPAPIRRAPGRSASWPTGSVSAASDRCSSAARRPSPTCCRSGWRTPTWMASTWPMRWPTKPSATWSNCWCRSCRSAGCTRPNMRREPCARSCSATARGCRIPIRRPAIATCGPSGRRRPGATRCRPDLGGRRMTPVAISAPGPGTAPRARRAAVASPHSTGSCRWHGISSAPGHAGCGCGRCASGGRD

SEQ ID NO: 25710 - protein, 500 aa, Pseudomonas aeruginosa
AALREGFQFGHRQPALAVAQRGFLGEQPGQFAGDADRLGVVGDAPGRGPWQRLPIGIGGVLFQCAHGNSLRWDGRGSAGRRGRTAADLPDVGRLAAVDLPVADDPLLVDQGIVRGGGARIAPVAVELLAAADGGSAAGVEQLAGGLQHQFGDDRLGLGRFDLGGDIGLLLRLRVAYEARQVGALGRFGGAQGGRLGGVDARGDAPDHLLHLGILADSRGIAVAVDTGPPAHLGGDVAQGGAAGAGQHREQDQLVERGLVLEAAGEVDEVLFLHLGILEQRRAAAGGALAEAVPVVALAHAGLVGADRRDHIGAGVVALGIQIDPVGEEAAGAVVLTAVHHPATVVLARDAGEHFAQPYRTDLGPGAADQVALDEAPQPTVAARAGLGIETVLDEGEVAAQGLGDVGVGLGQFDQQLNQLRQRGAGAAVLARHAHGAEAGLLEPGDRLVGQFALPFALDGAFGDAREDRSETLGEQFVVGAFGETGGGGFGMDAGVHADSW

SEQ ID NO: 25711 - protein, 478 aa, Pseudomonas aeruginosa
RWRISKSRGQREASWSGRCIGSVMAELRSGWCSEHQRQQQDEDQADHGEDGLHRGPGLESLADAHVEVLLDQPEPGVVDMGEDQRAGAGGEHQQLAVDAGNQVDHRHHDAGPGDGGDGGRAGGDADHRGHQPGQQDRRDLRVHREMADDVADPAGHQHLLEAAAGADDHHDGGGRCQALVQQPEDLLQFKPTGVPEGIERHQQGQEQGADRMADHVHPGAERVAIGEGDVGEGLQQHQEHRQQHGRQGHAEAGQVLGLGLVGDLLDQFRRWRAGYVARDQRAEQRAGDGGGGQGDDQAVEDGLADVGAEHADRQQRAGMRRHQTVHRGKAGEQRDADLDQGHAAAPGDDEYQRDQQDEADLEEQRDAHQERGEHHRPVHPLLAEGADQGAGDLVGAAGIGHQLAEHGAQGEDHADEAEHAAEAVLKGFDDLLHRHPRGQAEEAGGDDQGDEGMHLEAGDQHDQADDGHQGVEEQVGIV

SEQ ID NO: 25712 - protein, 215 aa, Pseudomonas aeruginosa
HAEHGGLSFCRCSTGVAVSLKRFFGVALSLSDKRKNSGGGVLQPPGVGGLRQAFHRQGGVQAQGQGFVERRLEGGELAVDQGRRHEVAGALGDALGGDRRGQFQVDDAEAGHRAAQPVAVGALEGGTGQYRQLAGGHRLAQLLGEGVQPAGAVVVGEGNAGAHLADVGGGMEAVAFDAVGAAALAKGLADAGLAATGDTHDDQGLEGWMHGTPQA

SEQ ID NO: 25713 - protein, 185 aa, Pseudomonas aeruginosa
WTWTPAPGSIASASPSCAPARPPPSTCLARGRRRLAYIGAQLDQRTLLRGEGFRRALQKAGCYDPGLEILTPRPSSVALGGELFVQLLASQPQVDGVFFCNDDLAQGALLEALRRGVKVPEQIAVLGFNDLPGSDCTVPRLSSIRTPREAIGRRAAEQLLALIAGKEVRDSALDMGFELMAREST

SEQ ID NO: 25714 - protein, 266 aa, Pseudomonas aeruginosa
VLMVVRCSSGSSRLRKLSHAQEHLVRGDRALGRAHADALAVLHLQRRAVFEYPCAEAGQRLGFAEQQVERVHMAAAHVQQGAAVGVRADDLTHLGTVQVTDLMGRAERPEFLFPGQQGLRLACVEAHVAVAVAEVGVDGVLLDTALDDVGAEVADLEDRPQAVLADVLADLLQVVADAGHDLPAVAPGTAEAEVAGLQHDDVGDAVLGQLKRGVDPGEAAADHHHVGVQVGFQGGEGQFVLLGRRVVGRRLDVDHGCGLARGGCTY

SEQ ID NO: 25715 - protein, 717 aa, Pseudomonas aeruginosa
ADRRLVAGVPSAPGRRPRGAHHAAAVAEPQRRPRLSLPRSRRRRPLCPRRDFRWHGPAGFRPGRESPSPGLRALALRTRPRLGLFAGHRRARRAGGAGRRAAAGGSAAAAGRDSSRHARQRLPLRRRVPTGGGLRQRPATPAPNGRAGDRGAVRGQRRHSLRAESGLRTVCLCVRRGGDDRQRRRRAAPFGNPSPGRRAVADAWPGGGDGPRPGTRPGTAGQSRFRLRPGFLRAARPGYRAIAGGSRHLALGRRLRAFLVRRPGPRTVGGGAYQHPVRGHVGTLRQRPARRRLPFRGAALMGRREAFPENAGAAASAVAPRLPLSALLAMAMSGFVAILSETLPAGLLPQIGAGLAVSEALAGQLVSVYALGSLLAALPAASLTQGWRRRRVLLLALLIFFVCNSLTAVSSDYRLTLLARFGSGVAAGLAWGLLAGYARRLVPPEQQGRALAVAMLGAPLALSLGVPLGTWLGGLLGWRWAFGLLSLTALLLVGWVLRSVPDFPGQPAGRRLRLLGVLRTPGVRPVLLVIVAWVLAHNILYTYIAPFLAKVGLGASVDLALLVFGSAAVAGIWLVGVLVDRHLRRMVLASLALFAVAALALCLGARWSWLAFAGLALWGLTFGGAATLLQTASADAAGEGADLAQSMIVVAWNLAIAGGGALGGMVLQRWGSEMLPWTLLPLIGLAAVLVWGNAAHAFRVGPRDFRRASSEHRKAAQ

SEQ ID NO: 25716 - protein, 339 aa, Pseudomonas aeruginosa
TAFPVFTRLVAALGLGLSFATTVLASRPAQAEGEIRIAEQFGIVYLLLNVVRDQRLIEKHGQAEGLQIKVDWTQLSGGAAVNDALLSGAIDIAGAGVGPLLTIWDRTRGRQNVKAVASLGNFPYYLLSNDPRVRSIADFGAGDRIAVPAVGVSVQSRFLQYAAAKQWGDKQFDRLDKYTVALPHPDATAALVAGGTELTGHFSNPPFQDQALANPKVHVVLDSYELLGPNSPTVLFATEKFRQDNPKTYRAFVEALKEAAAFAQNDKAAAADTYIRVTGAKIDRAALLKIIANPQVEFSVTPKNTYPLAEFLYRVGAIRNKPASWQDYFFQDGAPLQGS

SEQ ID NO: 25717 - protein, 249 aa, Pseudomonas aeruginosa
SAGECNARAADGWSVTATFSATVALARRQSGVTSCPHPLQRMERMSLSVDLLLAFSLFAFVTSVTPGPNNTMLLASGVNFGFVRSIPHILGISCGFFIMVMAVGFGLGTVFEAYPVLYTILRYVGAAYLLYLAWKIATSGPAGNDPEGRGKPLSYWGAAAFQWVNPKAWVMAVGAISTYTPLQGYFTNVVVISTVFALINAPTIGIWAGFGSMLRNVLRDPRWLRVFNVGMALLLVASLYPILAESHSA

SEQ ID NO: 25718 - protein, 134 aa, Pseudomonas aeruginosa
RWRRAATRRTTWRCPRARSAPTTSPTSSTPPVPPDAPRASPSSTAAPMPSCAGPASTMPPKNGAGYWRRPRCASTCRSTSCSVPWPKAARCTWWKTCSACRTTRAATRSACSIPCPRCVPRCSPSATCRAGCAR

SEQ ID NO: 25719 - protein, 174 aa, Pseudomonas aeruginosa
RCGWKTSRRVGWPSGPGPARSSTCTASSACTRPGSGACWRMPANLFRNACRRRAATLPDDPEPPTENSDGTNSSQSHRSRLRPAAQSQPAQQRGAGAAPGGGARRPAAADRGTGSRPVPGRLDSRAGPVPARRPEPGWRPVAERLRGRLGRALPRSRRCLRPATARLQGAFLAA

SEQ ID NO: 25720 - protein, 489 aa, Pseudomonas aeruginosa
APDRPCLDRRRAPAHLAEARGVPTPPVYRRAPVVQPRHVLPCHQSRAGPARCAAAQRRRGRPAVPDLLRRWQPDRGADPGDHPQRHRPRDAALRLARGRRADPRQHARPARPRAVPRAATDPHHHVHAVFQPGARRCPADTFAPGARRYRMSASFSAPRLRPRQLSAGDLVEESLLDPANDYLRIVRARQPGMDLRQWIAAAGAGLRDSLLRHGGILFRGFAVDGAEGFSQAVQSFSPNMLDYLERAAARQEVAHRVFTSTEFSPDGWIPPHHEMSYSHNWPSYIHFYCQTPPATQGRTPLADERRVSARIPEAIRQRFLRHGVCYVRNYGPEIDLTWQEGFQTDSRAEVEAYCRQTGTQWTWLDDQRLNTRQVRQAMVRHPLSGETLWFNHAHMFHVSNMPPALARALLDEVGEQGLPRNAYYGDGSPIEAEVLDTIRAAYREETRAFAWERGDVLMLDNFISVHGREPYTGERKVLVAMTDLHVHQP

SEQ ID NO: 25721 - protein, 431 aa, Pseudomonas aeruginosa
TRARDSHECVRRPAIRCATGRERSARRIPAVSLADPRLAPPCRAAGKYGCRRAPARPGRYRGDAGAAAPGAGRRGATARGLPDDAGHEPAGAGTGWARGRSAGRAPAGRWRLGRTLRARKRASRRFAPGRGRPAGTGARPAAGRRRRDAPGAVAGGAGVRRRCGQPGGAAAPRPGAGRPGERGRGRRGAAVPAFLRVGQRGAGRRRRRKRQRLLARAGGRCGGKSAGAGGRPGRRRLDGRGACCRARCSNAWPPTACRRRPPCWPGPRSPGSSRATRDSLWKWRDWSRGACSTSSPSWPDRSPGSRRCAWRMSARAASASGSTPSRRRSSPRRRQRPCAIPLPPTGRSPSWASPGWRANWMAPGWPSWIAVSRRWAGSSSCRCCPTAKAGWPACGSAATMTERWPGACSTPGSNAWKASPPTGNCHWPGCR

SEQ ID NO: 25722 - protein, 1380 aa, Pseudomonas aeruginosa
TPAWRGSPSMRGRPSAAPWPTSICMWSMASVVARPVAPAANCGSAAPGWRAAMPATPARRAGRFLDEGWPGSGRLYRSGDLVRWRADGCLEFLGRIDEQVKINGYRIELGEIRSALLEHPAVGEAAVLTDEADAAEPGADRRIVAFVTAAGETADESWLEVDLPSGHRVAGLNLNETEYVYQEIFVDEVYSRDGIVLPPDAVVLDVGANIGLFSLYIASRAPRARVVAFEPLAPIRRRLEANLGRYAPQVEVFGIGLSDAEREETFTYYPGYSTFSGIAEYADASGERDVIRRYLSNQGEEGGANLLLDNIDEILDDRLRAEAHRCRLRRLDQVIGELGLERIDLLKIDVQRAEMDVLLGLDDAALAKVRQIVLEVHDKRDGATAGRADALSDLLRRHGFEVSIRQDALLEGTDRYNCYAVRPGYAESLAERIDWRALAPRPAAALGGELSEQALRGFLEARLPAYMLPSRIARVERLPLTAEGKLDRRALLAALAAEAAAQTLEAPANATEAALLEIWKSVLKRPAIGVSDNFFQVGGDSIRLIQMQVMAREAGLSFTLRDVFNHQSIRELARLLAAPASPADAAASSAPQTLEPFALLSAAERKRLPEGLDDAYPMTSLQQGMLLQSEASGDPRLLHNVVLHEVHGRLDGELLARAWAILIGRHAILRTGFDLHGGQVPLQWVHPAAAVAAEVPVHDLCGLDGETRRLRLRAWIEEEQATPFDWSRPPLVRLAALALDERRFALGVAEHHSVLDGWSLQSLVDELLAVYADLLAGVVAREAEAPAVGFRDYVALEREAEANAASALFWLDYLAGARYRPLPGLAEEGPRRMAAVRVDVPADSLSRLRALAERSGLPLRSLLLAAHGRALCRFSDADEVVTGFVSHGRPEEPGADRLLGLFLNTLPCRLSASVDLLDSARRAFDYERASLEHRRHPLAAIRRRNRELRLDSLFNFVDFHQDDAAPAAGVRHGGILDQVVVDVDVPLAVDFEVAGERLEVGFQYAAGRFPAERAEALAGAYREALLALLGDPVQPPAAAQAEDSVELRRVLKVLSRVLGRPLAADQGFASAGGHSLLGVQAIAELRRLTGRQLSLGLLQGDPDAREVVRRCHAADAPPLPPATERARALWLQRSGSAQPRLRLIALPPAGGNAGTFRGWDARLPADVELLAIQYPGRQERQDEPFVTDVEAMLCAIDDALLPLLDRPFALIGASLGGMLAYELAARLESLHGLRARQLFVISSRAPGPDLEYPRFHAMGDAELLRTLREYDVLPLEVLDDPELREISLATLRADSRLAADYRYRPREPLAIPITAILGEQDPGVSRVAIDGWRRHASRYELETLAGGHGLVVTAAEEVCAILRQRLAPDVPGGVPANLAT

SEQ ID NO: 25723 - protein, 575 aa, Pseudomonas aeruginosa
RRRPGRLPPPSAGAGRARPAFRRAGGVPRRRRAFRHRGVQRTLRLWPGGLRQHPGPALQARRRRRLCRGGQPGLAAARRERRGQGAARGPPAVLRRPRGRHRADRHAVRRHHRVRLARRHAAAGRRGGLRTAVGGDGRRGPRDQAAAVPGTAERPSRSGGRRTQRSRLNPARSIAAAALPIVVGEAFRRLCNHAPALIATNAGMPRGRRSRLFFLSVRGGHGAVRRTAPPDAFPTFIRGAVNDQDRLFPVAPGPRRCRGGHAEHRRQEDSHGLLAQLAGRRRRRLPAGLVRQHRAGRRAERVQRGRRGLHERARHPDLPAIQPVRRGVSPPGRRAQRPGPRGADFAGGRRRAHRVARRAGAGAGRRDRPSGGNLRFRRPGHRPRAERHRPGRQPAGAAGGPQAGARALRRAGQALHRQHGPGVSLSAQERQVRALSAGPGRRLRLHRAAVLQPGRRRPVGPGGERRQGRLDRAEQRRDERRLPLLPHREPGHRQPRLRADPGAAPGHRPAEQRRCGGYRLRDRSRRGEQRVSPPGSRRSRDQGPDDLVGELGRWPEQARRALQLGVPQALRQPHP

SEQ ID NO: 25724 - protein, 302 aa, Pseudomonas aeruginosa
PMPPTARRWTSNTSTTAATLSSIACASIGRRESGHEHPGAGIRHRGDRRRHRRADGGDQGQGARPRTARAAGGQGQRQAQRRHQHGHGRVEQRHRPRPRHGRAVHPGNHRGQRRHRQPGGGLRLCQPQLRDPAAAGSLGRQVRKGRDRRLCGEEGPPHGRLCAADAGRARHQEGALPPAQACADPHRQPPGLHPPAHRCRGRGERRTRFRLPQRRLPCDPRQGGDPLLRRGGPPGPAVLGLPDGYLREPDQRRRRLRHGLSCRRRAGQPGMLPDQPADQGLQRPGLCLRHRPAGWLYRQRQG

SEQ ID NO: 25725 - protein, 312 aa, Pseudomonas aeruginosa
ALHRMRLLERADDVGVPPGTRRRQWPGVPQARPPGGGNHPDHRGHPPWQRTPQSRAVPRRARHRLPPADGRDAHFRDRLLLRPLGLRRVGQREGRDQREGPLRCRRHGRGAAQLHARRLHLWLVRRAQRRRIRRRARLQRGRPRPGRARACADRGAAAARAWPAGGAGGVQAAPAGQRLPATAQGDPQDGIGPATHPGHRRGPGADQGGQPPRADARPGSQRYPRLRGDARARLAVPHREPLGPVPPPGGLSAARRRCLVLPRAPEEGRAGTHGQLQETGRNLPVRHRRGRTAGLPAPAAEERRRLGPHAPA

SEQ ID NO: 25726 - protein, 418 aa, Pseudomonas aeruginosa
FEGNPHATACNPGQPGAGPDFPGCPGGNHPRGHRHSGHHHQLRRRRAADPRAGPAGEIPAARRPLQGCGLPGGVEELHQWRTADQRDGRRQARLRRHGRLSRHLQRRGLRRRRQAQPVHQRAVRQHPWQRQRHRGTERLAGAVAGRTERPDHLRTVRLHCPWHAAARGGGARLGPAARRDHHRPAAGNRRFGLAGEQDCRPCRLRTLRRAVPQSRLRPQDLRRFPGQRADLPWRAGGRRLRRALSGGGGGLPAGEHRSQSTAGRRTGEIQRADREGHRHRGRGQLPVPRSARPADPRPGLETRIPPGAGDLHRHPEAAEEGRPWAGRRAFRRRPLHPRGLPSGRAGLPGGAGRLRTVAAARQRRAQRPADRGVRTGSADLGEGRGQGAPLRFAGVGPGRSCRAEGAGQGDSCDLRPGS

SEQ ID NO: 25727 - protein, 612 aa, Pseudomonas aeruginosa
QRDQAAGQPGVVRPRRRGSPQRLPAPRAGPGLCPPPWRRGTRLCRRQPAGAGAPLRRASSESAHEFASDLPTLALGHPRRFAGGLPGVLAARRRSATESGPGDLRQRADARCGVAGGLQPGPVQRAPGAPWRQSGAGLRRLSAGRRAGHRPRPGDRPLGLGRGLAAAAAGSAAADPGGGLDSPGDPDVPFVGGLDDLHYLHRRAVPDPAQYRAWRGGARSAPAGFGAQPGGGAPGTAARGAAARRRTGHLHRPGDRHGHLLVLPGDRRDDLRAMGTGLLHLGFLQHPELRRGGGRHAAHRPLRHGQQWVGEARRRVADALVRGGRQGPMTTAGNSLGRIQIRDLSIRLGQGSEAFEAVRDLSLEARPGEFVCLLGPSGCGKSTLLGALAGHLRPSAGSVRVDGRSVEGPSPQRGMVFQQHTLFPWRRVRDNVAFGLKMQGLARAERNRRAMEMLGLVGLADFAGRWPGQLSGGMQQRVEIARVLVNRPRLLLMDEPFGALDAQTRLKMQTLLLDVWARVRTTVLFVTHDIDEALYLADRVLVMSPRPGRIIADLALDFPRPRDTRLVTSADFVRLKRHCLELLDHDDGRQLPRLTPLGLPPGITPDRLRIAI

SEQ ID NO: 25728 - protein, 230 aa, Pseudomonas aeruginosa
RPWRTTTGRSACAPRGRSGACATGRRGRRWKHCSAIPSATCARRPPWPSANWRTRPRPRPCGSPKATAIPRCARRCVSPWRNCGCRHDPAAAAPAQFRQGRLADARMGGRRGQPDRPCSPARRLSLCAMPGAAPARTDRRGGAGRAPARYPPAGLRRAVAVRRWPRARYLPLVLSARRTLRRVLFRSRQQREARSWVSDCCHSLRCPRPATATTRVTRSKARRLASLSFP

SEQ ID NO: 25729 - protein, 469 aa, Pseudomonas aeruginosa
SGRCVRPVDHSQRGSVRVKSHLLRPALRPVAGGLLSASLLCNAVHAAEAFSPNSKWMLGDWGGKRTELLEKGYDFKLEYVGEAAANLDGGYDDDKTGRYTDQFALGVHMDLEKILGWKATEFQFTVTERNGKNLSNDRIGDPRAGHISSVQEVWGRGQTWRLTQLWLKQQYFDGALDVKFGRFGEGEDFNSFPCDFQNLAFCGSQVGNWAGSIWYNWPVSQWALRVKYNFAPDWYVQVGAYEQNPSNLETGNGFKMSGSGTKGALLPVELIWQPKVGAEQLPGEYRLGYYYSTAKADDVYDDVDGQPQGLTGNDFKSRGSKHGWWVVAQQQVTSHNGDASRGLSLFANLTVHDKATNVVDNYQQLGMVYKGPFDARPKDDIGLGIARIHVNDDVKKRQRLVNQVNGIDDYDNPLYQPLQDTEYNAELYYGVHVTDWLTVRPNLQYIKQPGGVDEVDNALVAGIKIQTVF

SEQ ID NO: 25730 - protein, 706 aa, Pseudomonas aeruginosa
TARRAERNRRVSNACHQPRREYRTMSEGNRSRSRLLPSLLGLLILLSGLALLAGGIKLASLGGSLYYLLAGIGLALSGLLLLLGKRAALGLYALVLFASTVWALWEVGLDWWQLVPRLALWFVFGLLLWLPWFRRPLLADGPAPLGTAALGVAVVLAGTAAVGSQFTNPGQIVGRIDRDSGMTSTAPAMPDGDWQAYGRTEFGDRYSPLKQITPANVGQLEEAWRIRTGDLPTADDPLELTNENTPLKVNGMLYACTAHSKVLALDPDTGAEIWRFDPQIQSPVGFKGFAHMTCRGVSYYDEEQYARSDVGAPPAALSKAGKAVAASCPRRLFLPTADARLIAINADNGKVCEDFGVKGAVDLTAGIGPFTPGGYYSTSPAAVTRNLVIIGGHVTDNESTNEPSGVIRAFDVHDGKLVWNWDSGNPDETEPLAPGKFYTRNSPNMWSLASVDEKLGQVYLPLGNQMPDQWGGNRTPGAEKFSAGLVALDLNTGKLRWNYQFTHHDLWDMDVGSQPTLLDLKTADGVKPALIAPTKQGSLYVLDRRDGTPIVPIREVPAPQGAVEGDHTAPTQARSDLNLLRPPLTERDMWGSSPFDQMLCRIQFRSLRYEGQYTPPSEPGQPDLSGQRRSVQLGRGVGRPGAPDPLHQPQLHGLRLADGAARQGAQRKQARGRDQRRAAEHRRALRGDHASVHVAHRPAVPGAVLG

SEQ ID NO: 25731 - protein, 417 aa, Pseudomonas aeruginosa
RGGYRPDHRQGRLAAQERHQPRQHPGADRPHRRRTEHGRLDHHRRRRGLPQRHARPVPARLRREGRQAALAGAPAGRRPGHADELHRQGRSPVRADRRWRTRLLRYPHGRLHHRLRPAQAMTRPPGAHSRLPAFRASARKGLCQGEASSRPWQSPFDTLRPAEPCMPSRPRPSFVSHLLPGSLAICGLAIACAVQGEERRSLEPMVVTGRYNPSDTFDLPLSVDSIERRQIADGQLGINLSEVLPRVPGLVVQNRQNNAQDLQISSRGYGARSAIGIRGLKLVPGRHPGQYAGWPGPGRDPQPRRRRAHRGTARAGLDDLRQQRRRGDPDVLPRRPGRPAGRRGSHRRQRWPEPQPPVHGRRGRRGRFPGGCLADGHRRLPRPQRRAPRPDLRQAELQARRRQPPGADLQQPGTERH

SEQ ID NO: 25732 - protein, 407 aa, Pseudomonas aeruginosa
SALPEKRRGDRLRPRLPRWHRALAATGKPGAGRAEPDRRPRLRPEPRRPSRLPELQRRPARREGRVAPRRGGHRHQPRSLPAGELGHRRLDPAGRGAPQHHEDGGRRPLPEQRRCQRLAALPEEHPVVLGDVRLHPRPARLPQRRQGLRDSDPGGDGLCAGGGERAGRLQLRPQASHQQPVRSRAEGAPVGQYAGQRGDLPDPHRGRDRRRQLPRRSHQLPERRQDPASRLRTGPGERTERALERQPGLYPAIRHLRFGFRGRRQDHRQGQAPAGRAGKQPVRRTGVEARGGHQHGLGRHVPQPGLRRGQQQRKGRAELCGIQLAHPLRAAPGNLGLPPAGAPGQPVRPPVRRLGHRRRRQPALLRSGPRAVLVRGSRGRIPVLKCRMRLFALPGQPLSASSIPITV

SEQ ID NO: 25733 - protein, 190 aa, Pseudomonas aeruginosa
  UNSURE (6): Identity of amino acid at the above locations are unknown.
KPWPRXTNRCCGAGVSRRAASSRSSVQSSGASSSPSRRPMTSRAGAGRRRKRVIFASICHADASRPRRISATLSWVRPSLTGTWPTRHSPRISNVPAQARARASRPIWARSRQGSRRRPSSNHRSRQRRERSALRAAPAMPARETAPNTATSAARQAPLSARTAAKRFRRCALRVSASRSSSRARARSRT

SEQ ID NO: 25734 - protein, 144 aa, Pseudomonas aeruginosa
RRSGAVGDLSQPLPEAGRGDPVEFAAEQVEHRFLQRQQFAAQAPQHEQAAEEQQPQRQREEPGRRSRGCASGCSSTALRRATGWPGRRPAGQRAAGPVDRGAARPARGGRAGRLASASSGARRIPVSPARRPRPAPTPARRACR

SEQ ID NO: 25735 - protein, 422 aa, Pseudomonas aeruginosa
APAGPGRPPPCRRLAAAPLRPAPCRIPTPVRPSAVPQSTLLSFSPPLATRCKRGASINTGASHEQPRRPPLTGKASSPTGSVRSAHGTILESRCLNRFRWLRPTDTYAMESWNPYHDTELYFDAPSPLSQSQILDAREMLGSATGHYQARTVRPSMQYFDCDLSFTEPLRTHKVLPEGLCIVQMFDGQWRHSVDGGEPYLYNLGGPSVLGTGEPMEAFDILPAGSRVRLGGLRIAASYLEEELETGDGALRPLARLKGDGASFTQLSRCGAITALFERLYQNPYRGALGRLHEESLTLGLLVELAAYLGGADLRRARTPRAQRDLAHEARRLLEANLGEPPASLELARQLGVGETTLRRIFKNEFGRSMLQYVRDRRLEIGRQMVREGRWQIAQIAYRLGYSSPENFTHAYRARFGHPPGRE

SEQ ID NO: 25736 - protein, 651 aa, Pseudomonas aeruginosa
LFGHASSGQSEPMRSSSRLSWSRSRVAKGRPRKARQRCSMRARVAWNAASRRASSPSRAEGSARPQWAFSAAPRYSGQASPAAASQTVMTMSGGAPSKASLPLLYRPWVAMPACSRVARLRGCTRPLGWLPALHASKPGGARWLNMASERMLRQLLAVHMNRTRMGCSCRRRRRPSDGQAQGQGRKGRQQDRQGQQGADPEVVAPGDAHAFARQHVQPEQRRQAADRGDLRTQVAADDVGVDHRFAHRAGGVAGLDRQGAEQHAGHVVHYRREGGGKQSGTQRGRPYAVLGQAVQELRQEVCETGVLQAVDHQVHAQREDHDLPGRFAQHPPGRDHPPAPGHRQQQRRTGRGHRADGDAQRLQGEQPGEQDQQHPAADDEGRAVADRRPRRLQLLQRINRRQVAAEIEEQHQQGGRDAHQVYRQHDRGVLAEAEPEVVGRDDVHQVRDHQRQAGAVGDEARRHDEGQGRRRAEAQGQQHRHHDGREDQRRAVVGEQRRDRRAEQHAEGEQAPAVAASPARDVQRGPFEEAGLVQQQADDDHRDEGGGGIPDDVPDGRDVARRDAAQRQGEQGTDAGAPADAEAPGLPDDQDQGEQEDGEGDQHGAARAIGSRRRRAAGGRPCRAGALRRLAASRRWPAGSLAGLRGSRPAA

SEQ ID NO: 25737 - protein, 140 aa, Pseudomonas aeruginosa
AAQLAGLAAGAAEDGRGIAQDDALDFRFQGHFQVGPVVGTEAAPEVLAGSQDGAEAKIHLVVDLLHHRGQQAFLVAEVVIQRAAGEAGAGGQFVHRGAGVAVVGERSARGVDQLGAGFLDHLGARLAGHARSPGGEGASG

SEQ ID NO: 25738 - protein, 157 aa, Pseudomonas aeruginosa
VPRRSAGRLRSGNGSPPRSSRRHTPGPGASRAAGGHPRGLRAERRAGRRSPPGRCADAPHHGSPPASRGRCGRTRGSCAGSRRRYRGTAGAGPGHGRSGAAPRRRRDRGCPARTRTRHSAPAPARRAGGRWPASRMRSPGRVPRRPGAGPGESPGGR

SEQ ID NO: 25739 - protein, 347 aa, Pseudomonas aeruginosa
CAGRGRRPGQCAAAPREGWTSVFAPVSPRRLAGPGAHSIVAFPHSISAPMQKMNAPLQYRLDHADLALVLALVRGGSLARAAELLRVDVSTVFRAIRRLEKNLGKALFDKSRSGYLANQTARRLAQQAELAEQALEAARIGLELEREVLSGTVRMTCSDAVLHGLLLPALARFMPGYPALQLELATSNDFANLSRRDADIALRMTRTPPEHLVGRNLGEVRYVLCASERYLEGRDATEPAMLHWIAPDDFLPDHPSVVWRRRHYPGVLPAYRCNGVLAVAEMARAGLGLAAIPAYLLRDGDGLRVLDADLEGCASALWLLTRPDCRALRSVVALFDELGRHVRLGDE

SEQ ID NO: 25740 - protein, 489 aa, Pseudomonas aeruginosa
  UNSURE (438): Identity of amino acid at the above locations are unknown.
RGGRAWYGNPLPRAGEGLEWQAWRSAAIRRGRSRRRNVAHRRRAGVLAQAPDLVDADAWRLVAPAGADEVDHVGDLLVVHPPAERRHGEARRCLVGGRQGAALEHDVHQGGRVAAGHYRVAGQGREDPRIALAVGAVAGPAVVDVERRAGLAVVAVEQCLGYALVVDVRLVGGVRRRQRLEVAGDGGEVGVGHVLHAVHHHVGHAAEHRAALAAAGTQEADQVGFAPAAQSGPVVAAQAVGDPVLQRRAAGQVGRAIARRQGLLLHAQPTRGMAGATVAKAFDQVGAARQHRVQPGGGLEVLHLGSEGPAPECQRPAHRQRPRDVAGLVGLLHRLHAMHEVGVEGAHVRFADSRVGRVGHRRVKRVAGPGHAVAHGTVEVLEAVVADAGLAVRGDVGRVHRADRRFHRQAPGERLAVPGGVAGHAIAGAGQVFTLPDXGRVRRCGGLGDAAREGGEGEESCRFHRCAPHACTSGPGFFRYCSRIALADQ

SEQ ID NO: 25741 - protein, 83 aa, Pseudomonas aeruginosa
ASLTACFQPLPQLGVPGGTARPPIGLEPAWLTHIGEPPTKPSGPWSKLSALKSSTATPPPPVPTKGLVCTSLSKNALMVAMFW

SEQ ID NO: 25742 - protein, 260 aa, Pseudomonas aeruginosa
VSSPCSAPLAGNRHRREGILLATVGPVHEVGAGAGETDQLPAHQAAIAAVLRIGEEAFAGVLQQLAEEQLGRQVLQVDLAGFQALQDVVLRRRLQIGERLALVGLAPAFQGGDADPVDVAWHQLQLMAELRRGVGDERPLHVPECAVPVGGFHLSVDELRHPGLDGAGAVVVAGDQSRHRGVDESPFGVGEEARLVAFAGFVLLGGGRLHGMADAIAGQGHRRDHGQGLAQEVAAAVDGLVIGHGGVLSGSSRFRLSDND

SEQ ID NO: 25743 - protein, 152 aa, Pseudomonas aeruginosa
SRTARRASARRGLQAPRRRAQAEGLTRFSGRSPARAASRLSTAQRAMASRVSSVAEPMCGVATTFGRRSSGESGDSGSRSNTSRPAARIRRWARASIRAASSTTRPREMLMKIACGRIRANCAAPIRPSVAAVSGRVRQTKSDSSSSASRGR

SEQ ID NO: 25744 - protein, 138 aa, Pseudomonas aeruginosa
PLPIAANCCSAWPSACSASWTARSPMCATCRASPVAGCASPRRRTSSSGTSAAFPRRSSGSFPRSRWKCWPTTSSAIWSASASTSRCVSAGRAIPACMPASCATSSRLPWRRRDTSPACRQCSSRTTWRAANGSAIPA

SEQ ID NO: 25745 - protein, 201 aa, Pseudomonas aeruginosa
PAGRRRGRLPATRGHASRSAAPGCAGHWRTPGAAPPTRRRCAPGRGPWRWSAPAAGAAGRSARRGPPVSRGSPGCHWRARRGKAGRSSVPASPRGGCRTGSCTGWRSPTRHRSRWRGAGRGRPGRPPRESAPCRTAARCRSRRNDWTAGSRRGCSRAPRRMAGTSGAGRGCPCGRRTPGRSPRPCRPPSAPRRPGRRRWRW

SEQ ID NO: 25746 - protein, 493 aa, Pseudomonas aeruginosa
QGCTHEGVSLFSGSVGSEQPDRVVDHHPVFVGAGVAAGVAGGGVAFAGAVGGPAQGHAEALGRAGGEGVAQRQVAFPVLGVLAIGVVEVAVARAVRVDPGQVGLATAVGGAELPVRGGEEGQAGLVLDLPRALAGAVEVGVLHGVAFVEEGPVVLRDEVERGVAIDLLQAEAQRLAAAGQGQPGVVEVVVDPAELAAALVAGLVVMQPGRQGQLAGKPPRLAEAEVVLVPDIRQAAAVERRLAAAGGAVAGAQPGDVRAFAIGGDTALGAVAVAAGEMTVAALVAQAGGFDEAGVQFERAEMVVLQGHATVALRHHATDAAGDHRVLQQLVADLQQAVQAAQLEGRAGRREAVGGATGGVQRQHAGTAAAATAVQAQAVEGVRIQADAYRRVGIAGAERQHQALGPFALVAAGRGVVVVAGEIVVADETVQRRAFDEARRHLHFGFLPLVQAGADVVAMAQGVVGQERARTYGKGKAERSPALHGGIRHGSGP

SEQ ID NO: 25747 - protein, 259 aa, Pseudomonas aeruginosa
  UNSURE (208): Identity of amino acid at the above locations are unknown.
SLLSTRLLLGKRRGVQPLPSHGSLALRIQLLVVVDHGLGLGVALDQQLVVREYRAVGFGELHGVVAVPGTLDFRADRGGVHRHHAGLDHPCQGDFLGHLGVGAGGVDHREHLVAVVYRGDAGEGHAHAGDGAGDDQLLLAGGLHRGDEFRVVPGIDLTLARDVLGVRRGLVDLRDQRAVGALRYRGGGDHRDLRQGGDLGQGGGVGAXFGHRHVLDRLEQAALVVDQQHGGVGRIDLRGLAVEVGGSAHFHFLLQGGRP

SEQ ID NO: 25748 - protein, 311 aa, Pseudomonas aeruginosa
ASSGAIARSPLASCQPQDAGGVGAGPWLQAASRSRTQAASMARGKAVRSGIGCLLFGKRRARIGRRRGAPGAARQPGGRAGKVATPVSVSRGARSSIGRIASVPIASDRSLQMNSSASRRSVAEGARAPQSPFRRAVPRCPRLAQGLGGSNLLPVPSRREACVSREECFAMATALRFRPLDAFYNVLNPVPFGFFVAALVFDATYFATAEVMWGKSAAWLISLGLLFAILPCVVDLCRVWLLRRAAVVAAARVSSLLKFAGIVLAIFNAFVHSRDAYAVMPAGLWLSIATVLLLALGEALLAVSAEEVAHG

SEQ ID NO: 25749 - protein, 280 aa, Pseudomonas aeruginosa
NPGRRPGDGVHRPAGHHQPPLDQGAARQSRRAQALRGRRFEQQHHRERRGDRIPSCGDSRGGRRQPRQPHLRLRPAQPDRPAVGTGLRQAVDHRQRARRDRQRPGPGLPDLGTGGRLLRLALQLLRPAPGFAGEAAASRPGGEGHRPRLRAGFPRGRAGPVLLHRQRVARALSQRRLRQRARQLEPLAGQRLPGGPCAVRRRQARRCAAAGGDRVRLRGREAVVRRAGGVGAGGRRGVADRRRRRQRDLAGERRGHRLAACSTVSGPKLAVRARCCGPAQ

SEQ ID NO: 25750 - protein, 172 aa, Pseudomonas aeruginosa
GAVFHLAGIQGDSPGLAGGRQERPEEGLPGLHRGSLDRHAPAEPAPAHGQGGRLSGRYARTAVLPAVFRRQRHDLQPLAAQAAGLAGGASGGVAGARGADGRAVADRPGEPGAATGARAARRGPPGPLRDARAQPRRLARLRGAVCLARAGLPDAAGVLRLRHRGAVATRRV

SEQ ID NO: 25751 - protein, 503 aa, Pseudomonas aeruginosa
LARTGPRPASRRGPGAGRRVRRKPGPGRGNGVSGSSGGSFQVRQAAASDGGETEGQAGDQDDRGAGGNRQVEHDRQQDTGQRADGGDQHRQPEEPFQRLADQARRRRRDHQQGSDQDRADHFHRGDGDQGHQGHEQVVQALHRDPAHRRQLRVEAGQHDAVVQRQGQARHQHGDRRQHREVMAVHGQHRAEQHVLEDMHVDLARQHQQQAGAERQGHREEHPDQGVRGQAGAVAQVVEQDAEQQAVAEQAAVGPGVGLAEEDADGHAGERGVADRLGEEGEALDHHQGAEAAEHRADQQAGEERVDDEAVGQGLRKVAGGGPGLDGLAQLFVGVVHRLASAFFRGWVENSVSRRSGVRLLAAGPSNSRWRLRPLTRSARRPTASRSCSIQSTVTPAWRQSSSSRSKTWMPPSSRADIGSSSTSSCGGGTRPWASSTRWRSPPERAPMRRPRLASMPTRSRAASIAGRRLRDRPRKAGRRWHMAAMKSSTVSGRPRSNSSACGT

SEQ ID NO: 25752 - protein, 265 aa, Pseudomonas aeruginosa
CRCAGVCRLRPGSAGRAGPAAGRPAGRGPGGGRRGRADGMSDGRTAWKNAFCGVDVRSMAVLTGHAGVEAADHLAPAGVGQGSGVARYGAGSGRGGLQPDFGGAEQQEERAGHLGFAADAQVARTPGGFAVAPAVLAATARGDVGDEGREALGGQFVDGGRGFAVVQARLDVFGGDLQVGVDALFGGIQVEPGVHLVGVQGLRFMGLLAQPDHRGGEGQDQHTAEQYVEGLVAGAGRADGFDAHGAAMSAWSISTTWPGPASNST

SEQ ID NO: 25753 - protein, 2636 aa, Pseudomonas aeruginosa
PSPALVAHVHGRRPMNAEDSLKLARRFIELPVEKRRVFLETLRGEGIDFSLFPFPAGVSSAERDRLSYAQQRMWFLWHLEPQSGAYNLPSAVRLNGPLDRQALERAFASLVQRHETLRTVFPRGADDSLAQAPLQRPLEVAFEDCSGLPEAEQEARLREEAQRESLQPFDLCEGPLLRVRLIRLGEERHVLLLTLHHIVSDGWSMNVLIEEFSRFYSAYATGAEPGLPALPIQYADYALWQRSWLEAGEQERQLEYWRGKLGERHPVLELPTDHPRPAVPSYRGSRYEFSIEPALAEALRGTARRQGLTLFMLLLGGFNILLQRYSGQTDLRVGVPIANRNRAEVEGLIGLFVNTQVLRSVFDGRTSVATLLAGLKDTVLGAQAHQDLPFERLVEAFKVERSLSHSPLFQVMYNHQPLVADIEALDSVAGLSFGQLDWKSRTTQFDLSLDTYEKGGRLYAALTYATDLFEARTVERMARHWQNLLRGMLENPQASVDSLPMLDAEERYQLLEGWNATAAEYPLQRGVHRLFEEQVERTPTAPALAFGEERLDYAELNRRANRLAHALIERGVGADRLVGVAMERSIEMVVALMAILKAGGAYVPVDPEYPEERQAYMLEDSGVQLLLSQSHLKLPLAQGVQRIDLDRGAPWFEDYSEANPDIHLDGENLAYVIYTSGSTGKPKGAGNRHSALSNRLCWMQQAYGLGVGDTVLQKTPFSFDVSVWEFFWPLMSGARLVVAAPGDHRDPAKLVELINREGVDTLHFVPSMLQAFLQDEDVASCTSLKRIVCSGEALPADAQQQVFAKLPQAGLYNLYGPTEAAIDVTHWTCMEEGKDAVPIGRPIANLACYILDGNLEPVPVGVLGELYLAGRGLARGYHQRPGLTAERFVASPFVAGERMYRTGDLARYRADGVIEYAGRIDHQVKLRGLRIELGEIEARLLEHPWVREAAVLAVDGRQLVGYVVLESESGDWREALTAHLAASLPEYMVPAQWLALERMPLSPNGKLDRKALPRPQAAAGQTHVAPQNEMERRIAAVWADVLKLEEVGATDNFFALGGDSIVSIQVVSRCRAAGIQFTPKDLFQQQTVQGLARVARVGAAVQMEQGPVSGETVLLPFQRLFFEQPIPNRQHWNQSLLLKPREALNAKALEAALQALVEHHDALRLRFHETDGTWHAEHAEATLGGALLWRAEAVDRQALESLCEESQRSLDLADGPLLRSLLVDMADGGQRLLLVIHHLVVDGVSWRILLEDLQRAYQQSLRGEAPRLPGKTSPFKAWAGRVSEHARGESMKAQLQFWRELLEGAPAELPCVHPQGALEQRFAISVQSRFDRSLTERLLKQAPAAYRTQVNDLLLTALARVVCRWSGASSSLVQLEGHGREELFADIDLSRTVGWFTSLFPVRLSPVADLGESLKAIKEQLRAIPDKGLGYGLLRYLAGEESARVLAGLPQARITFNYLGQFDAQFDEMALLDPAGESAGAEMDPGAPLDNWLSLNGRVFDGELSIDWSFSSQMFGEDQVRRLADDYVAELTALVDFCCDSPRHGATPSDFPLAGLDQARLDALPVALEEVEDIYPLSPMQQGMLFHSLYEQASSDYINQMRVDVSGLDIPRFRAAWQSALDRHAILRSGFAWQGELQQPLQIVYRQRQLPFAEEDLSQAANRDAALLALAAAERERGFELQRAPLLRLLLVKTAEGEHHLIYTHHHILLDGWSNAQLLSEVLESYAGRSPEQLRDGRYSDYIAWLQRQDAAATEAFWREQMAALDEPTRLVEALAQPGLTSANGVGEHLREVDATATARLRDFARRHQVTLNTLVQAGWALLLQRYTGQHTVVFGATVSGRPADLPGVENQVGLFINTLPVVVTLAPQMTLDELLQGLQRQNLALREQEHTPLFELQRWAGFGGEAVFDNLLVFENYPVDEVLERSSAGGVRFGAVAMHEQTNYPLALALGGGDSLSLQFSYDRGLFPAATIERLGRHLTTLLEAFAEHPQRRLVDLQMLEKAELSAIGAIWNRSDSGYPATPLVHQRVAERARMAPDAVAVIFDEEKLTYAELDSRANRLAHALIARGVGPEVRVAIAMQRSAEIMVAFLAVLKAGGAYVPLDIEYPRERLLYMMQDSRAHLLLTHSHLLERLPIPEGLSCLSVDREEEWAGFPAHDPEVALHGDNLAYVIYTSGSTGMPKGVAVSHGPLIAHIVATGERYEMTPEDCELHFMSFAFDGSHEGWMHPLINGARVLIRDDSLWLPERTYTEMHRHGVTVGVFPPVYLQQLAEHAARDGNPPPVRVYCFGGDAVAQASYDLAWRALKPKYLFNGYGPTETVVTPLLWKARAGDACGAGYMPIGTLLGNRSGYILDGQLNLLPVGVAGELYLGGEGVARGYLERPALTAERFVPDPFGAPGSRLYRSGDLTRGRADGVVDYLGRVDHQVKIRGFRIELGEIEARLREHPAVREAVVVAQPGAVGQQLVGYVVAQEPAVADSPEAQAECRAQLKTALRERLPEYMVPSHLLFLARMPLTPNGKLDRKGLPQPDASLLQQVYVAPRSDLEQQVAGIWAEVLQLQQVGLDDNFFELGGHSLLAIQVTARMQSEVGVELPLAALFQTESLQAYAELAAAQTSSNDTDFDDLREFMSELEAI

SEQ ID NO: 25754 - protein, 2190 aa, Pseudomonas aeruginosa
  UNSURE (1858): Identity of amino acid at the above locations are unknown.
PMLSNPNLDLVSRFVRLPLAQQKLFYQRVQAKGMSFARLPIPQTRQEMGNLPLSYAQERQWFLWQLEPESSAYHIPTALRLRGRLDIASLQRSFAALVERHESLRTRIARMGDEWVQVVSADVSLALEVEVQRGLDEQRLLERVEAEIARPFDLEQGPLLRVTLLEVDADEHVLVMVQHHIVSDGWSMQLMVEELVQLYAAYSQGLDVGLPALPIQYADYALWQRSWMEAGEKERQLAYWTGLLGGEQPVIELPLDHPRQPLRSYRGAQLDLELEPHLALALKQLVQRKGVTMFMLLLASFQALLHRYSGQADIRVGVPIANRNRVETERLIGFFVNTQVLKADINGRMGFDELLAQARQRALEAQAHQDLPFEQLVEALQPERSLGHNPLFQVMFNHQADSRSANQGVQLPGLSLERMEWRSSSVAFDLTLDVHEAEDGIWASFGYATDLFEASTVERLARHWQNLLRGIVAEPGRPVAELPLLLDEERDCLLRAWAENADEGGLPPLVQLQIQEQARLRPQAQALALEGQALSYAELNARANRLAHCLIARGVGPDVLVGIAVERSLDMVVGLLAILKAGGAYVPLDPTYPQDRLRHMLEDSAVGLLLSQEHLLPGLPLHEGLEVLSIDRLERDASVSTDDPVVNLRPENLAYVIYTSGSTGKPKGVAISHAALAQFSRIASGYSALTPEDRILQFATLSFDGFVEQLYPALTRGACVVLRGGDLWDTGELYRQIVEQGVTLADLPTAYWNLFLLDALAEPRRSYGALRQIHIGGEAMPLEGPKLWRQAGMGRVRLLNTYGPTEATVVSSVFDCSAENARVGNASPIGQALPGRTLLVLDEHLGLLPVGAVGELYIASRAGLARAYHDRPGLTAERFLPDPFGEPGSRLYRTGDLARRRGDGVIEYMGRADHQVKIRGFRIELGEVEARLMDLEGIREAAALALDGQLVAYLVAEGGEDETRQPALRERIRTALRASLPDYMVPSHLLFLERMPLSPNGKLDRRALPKPDAGLMQHDHMAPASALEKDVAAIWGELLGVERVGLTDNFFELGGHSLLATRLVSRIRQDLGIEVSLKSLFEQPVLQGFVESLGEKPAEVPPIMPVTREQPLPLSYAQERQWFLWQLEPESAAYHIPAALRLRGGLDVVALQRSFERLAQRHESLRTRFRQEGLRTVQVVDADGQLQVSRHSLANVDDASLRAAVEAEMARPFDLRADALLRISLFEVAPNDHVLVMVQHHIVSDGWSMQLMVEELVQLYAAYSQGREAALPALPIQYPDYAVWQREWMEAGERERQLAYWIGLLGGEQPVLELPFDRPRPAEQSFRGARLEFELGAERARRLKALAQRQGASTFMLLLASFQALLYRYSGQPDIRVGVPVANRNRVETERLIGFFVNTQVLKADIDGQMGFDRLLHQVRQRSLEAQAHQDLPFEQLVEALQPERSLSHSPLFQVLFNYQAERGEHGLPEVAGLSIEEQAWESHTAQFDLVLDTCESESDIWAALVYATDLFDASTAERLVRHWQNLLDAILAMPDARLGELDMLDREEREVIGQLWNRSDSGYPATPLVHQRVAERARMAPDAVAVIFDEEKLTYAELDSRANRLAHALIARGVGPEVRVAIAMQRSAEIMVAFLAVLKAGGAYVPLDIEYPRERLLYMMQDSRAHLLLTHSHLLERLPIPEGLSCLSVDREEEWAGFPAHDPEVALHGDNLAYVIYTSGSTGMPKGVAVSHGPLIAHIVATGERYEMTPEDCELHFMSFAFDGSHEGWMHPLINGARVLIRDDSLWLPERTYAEMHRHGVTVGVFPPVYLQQLAEHAERDGNPPPVRVYCFGGDAVAQASYDLAWRALKPKYLFNXYGPTETVVTPLLWKARAGDACGAAYMPIGTLLGNRSGYILDGQLNLLPVGVAGELYLGGEGVARGYLERPALTAERFVPDPFGAPGSRLYRSGDLTRGRADGVVDYLGRVDHQVKIRGFRIELGEIEARLREHPAVREAVVVAQPGAVGQQLVGYVVAQAPAVADSPEAQAECRAQLKTALRERLPEYMVPSHLLFLARMPLTPNGKLDRKGLPQPDASLLQQVYVAPRSDLEQQVAGIWAEVLQLQQVGLDDNFFELGGHSLLATQVIGRLRERLHLEVPIKSMFTAETLGEFCHGVETLKAESAPVEDALAKSLEALKRLSADELEKLIS

SEQ ID NO: 25755 - protein, 286 aa, Pseudomonas aeruginosa
PRSRTPRIAGRSFSQPGSEVPASAEHQVPWIAIGCRGVETDVGVVGLVEDVVDVDAGRQLVGDLVAGHQVHQPVVFLGELFPAAAGIVVDHLPALALPAGAAADRELVQGALELVAGVEAQLVLRLPGGNLLATVVANDLVGIASLNLPAWRQFTRDFRLVALGLGLDALVGVGDGGVGRFAVVEGVFLRAVFLMNLEVGETGIESSVEIFTLDADLVVLAFVGFEQLVAAVAIPTVLRHEDVGIAGVDGVGIVQVVDRADVGNEASGLANGRIQAGYPVVDHAST

SEQ ID NO: 25756 - protein, 547 aa, Pseudomonas aeruginosa
EQVQVIGHIEAGGHVAAQLAGLVIDVLGGGTPVGLAYIAVPVDEVVGGVVVVAQVPVALALPVGEGSRGADHQLVLATEELEGAGEIDIQRVALGFAGVLLRNDLGAVVRCRPVAHDRAEGRVVAVDLVIELHLADPAVGEIVLEVGEDGAGVLLPTAPLGSVVEGAGDVVAVALAVEEREAARPARSLGIVVLIVGADGKHGVGIQIELEDAVIDAGFALVVIHERVLILVGGYRPAADVAGLGQRAADVQFGAVIVPTARAQFDMALEFMGRFLADQVDRGAEGPRTGEQAGRPLEYFHPVVDGHVTERIARGVADVAGRRGNPVVLEVVDREAAGIVVVAVSVVGRDGDARRMAHDVVDVVEAEVVHVLAGDHGDRLGRLARSQDQAGRRGDSAWRIGAAVLGDGAQLVGGDHGGAEIDAAVRRLGDADGYRIALEVHRCAGATKQLGNRLVRLQLALDRTATLVPDLFRAIQHLDIRLAAELLECAAQRLGRDVELDFLRLDISRQRQAQGHGERVGKNPALEGTAHQKRLTQRTETVWCWHG

SEQ ID NO: 25757 - protein, 408 aa, Pseudomonas aeruginosa
RFTHGKPDEKVSRRLGFLDDLACREPYQLVRHFEIAIIVADHDDGLALAFQVRQQFGVEDPAESRVLVCGPFVEDQDRSLFEPGIDQRKALALPGGEIGGAEVAVHDADLVGDFQALQILGRVLQRSLLALDQVVEEVVVGEDGAEELAVIVAGLRADRFSVEKDLAGLRAIEAEQQLDQGRLAAAVLADDEDDVTLGDTQIDRAQMERFAAFDGGGAVANVAQLQAVDGLVRGLLFAEQKMGFGRGKTLGKFGDPLEGDLGAADDGKDGHHLFEWSLHVQQDHHEASDGGRIGRRPVGLERKRQTDHHEEQHRAEGLGQDEYIDGADVEVADVVRGFADAAGVHAIATGAVDAQFLRARSDGGVVLLQFVFEIAGGIEPFETAGARQVLGCRADDDGDDCQQEHRDR

SEQ ID NO: 25758 - protein, 155 aa, Pseudomonas aeruginosa
GLRKVSAARLAPDDSEALRVSLGNSAARATCTSAWAAASCASALAISGRRLSSSLGRPAPVSGQRRLSKGRSATCSACTGSPIRVARVISASWACCSSSGSCLRWLATRLLCWATSRAVAEPAAWRVSTRRRTCSALSRLSLAMRCCSRSANTCR

SEQ ID NO: 25759 - protein, 140 aa, Pseudomonas aeruginosa
YGRRSSARGRSTPAAAGRRTTGADGWRCARPGPGVRAGPALGCAARSPGCRRRSPASRRFPGPRRRGSGDSPGTRSRMPRGAARPARRCPVRRRRGRRSGSCRSWAGRGSRGCSSGSTCRSRRRRRWRRTRRRGSTAIRP

SEQ ID NO: 25760 - protein, 450 aa, Pseudomonas aeruginosa
VPRLPECHCRRSACGCRAVRSGGRVAWRFPSAVAAVGSGHQQAVAFLQAGKHLYPQAVADAGPDLAALRLAIAADHPGDLAALAVVVNGGDRRGEDVFRGGGDEEHLGGHFRHQLVVAVVHVDQHGIQHHPAAAALPAAAAGGAAAALVALVQRLGRHREDLPDLAGPAPAFAAEGREVGRHAGLDPADVGFRNLGPDGHRRQFGDPQDQRGLLLGIEGLAFARIDRHHRAGHRRVDAGIAELGFVAAQRGLGLADLRLVHLDPCLGGEHLRLGALHVLGTRRAAGGQPLLALVLLAGEGVLGTLLGQLGLEHLDRIAAGIDLGLLGGGVDLDQQLAFRHIVPGLDVQLADLPGGLGADVDVAPRLQGAERRDAALDAAAADAHGIEAVAAERIGLPGGQGDQGAEADCDEQCATSTTGSSHSGIRPVRGETAAAGSAGWALPDIRGQGG

SEQ ID NO: 25761 - protein, 135 aa, Pseudomonas aeruginosa
LRQLQPPWFTISSVSASALPISPWRLPSRNGPRRRAPWKCCSWTSRATTAGTATPWCRRASCRSPSSRTWCPCATPPARIPSSTTCTSTIVWSTSSTWAPSIPAGWSSTTTCAGSPATSRSRAATAKRSCASSRC

SEQ ID NO: 25762 - protein, 404 aa, Pseudomonas aeruginosa
RQPGEHPGTAAVVLDQPGQRRRRSASARRGATGHPLGQHPGRGRAGQRPVHEPVGGALPEAGTDSRLRHSATGRRRPAGPPGAGQPLCLESRPGRGPGWHHPGGATAGAVAQGLRAELQRQRLADQPGEPAAGLLAPGQPGEAHRSAGALRPEPATGQAAAGGEDARGDGHRQPCLQRRPGAAGPAPPVPRQPGREFPCPCLRGPGAVGPWRQPRQWQRLRLLPALHATLRRTRRRVEGTVRCATSPGYAARHRPRPAAGGDPGAPGAGGRGGGGGEERDSRRRALGRPASEHPWPGTHRDSRRRWPFRGLQRDPERPQGRPPGGGRRHQLHPAGDLPRGRAQGSRVAGFLPVQRSALAALPRPDRAVFPPAMADLAVQRQADRRRPATATAKHSRMISNAYQI

SEQ ID NO: 25763 - protein, 315 aa, Pseudomonas aeruginosa
SRAAGKVCPMLNPDDFRFPSIEALQAFEAAARLGTFERAAELLSITGSAASKRVSGLEGMLGVSLLQRDGRSLALTSHGREYLEQIAPILAQLAAVPLHRRQVQRQQRLTLRTPPTFARQILIPRLASFAEACPEIELEILLSSPSDGQDLPLADVEVRGDSHGVAAGERLLEERVLPMAAPGLLLGLPRPWTPAMLAGLPLLRSPLEPWQPWFRVAGLDWPEPCAGPRLLDLGMTLEAAANGQGVALARPSLARAWLAEGRLVVLFPLRSAPTHHYHLRSHQASPASQRFAAWLAAICREAVAQGREFLPAADD

SEQ ID NO: 25764 - protein, 415 aa, Pseudomonas aeruginosa
NGGISFRRCRQLFRLRRYVALYHPATPEGVDCMSVITDIEDLRRLARKRVPRMFYDYADSGSWSEGTYRANQDDFAAIKLRQRVARNIENRSLRTRMLGQEMAMPVAIAPTGLAGMQHADGEILAARAAAEFGVRYTLSTMSICSLEDIATEVGQPFWFQLYVMRDRDFIERLIDRAKAAGCDALVLTLDLQIIGQRHKDLKNGLSAPPRPTLANLLNIATKPRWALGMLGTRRRGFGNIVGHVKGVDDMGSLSEWTARQFDPRLNWGDVEWIKRRWGGKLVLKGILDAEDARLAADSGADALVVSNHGGRQLDGAPSTISALPAIVEAVGERIEVWLDSGIRSGQDVLKAIALGARGTMIGRPYLYGLGALGQAGVTRALEIIARELDLTMAFCGHTDIREVGRDILLPGSYPR

SEQ ID NO: 25765 - protein, 188 aa, Pseudomonas aeruginosa
SPFSPMRDSPRPWGAAQSPCDSITRNQKRRAPMITLNLNGKDHQLDVTEDMPLLWAIRDVVGYTGTKFGCGMGLCGSCTIHIDGQATRSCITPVSLAQGRKVTTIDHLHTDKVGEVVQQAWLDIGVAQCGYCQGGQIMSATALLKSNPAPSDEQIEAAMAGNICRCGTYNRIKTAIHNASAKLQEAKA

SEQ ID NO: 25766 - protein, 371 aa, Pseudomonas aeruginosa
PCSAAVSAASPSPTSCWKRRSWPRRSPVATCGCQWNPGGPSAFPPISHTVSGGAPARPWSAPDGVPAGLAASLGGAEHHRTVRPGQQAPGRLRPGHGPDQPAVRHPQRAPGEPRGPGAHPGRLVPLGLLLPPRLRHPELRRRTGGEGRPGPEGLPAQAARPGAANRHRRTRRQLELRRVAGALPARCWPPARGDRGGGAPVRLGRRAAQGQGAGNRRALQLRHLRGGGDRGGGEGRRRAAGAQGHHRRRLRSADQPRAHPLAARRRLRDGPGPGGAGRDQLQGWQGPAGQLPPVRAGAHAAGAQGGVGASAQAGWRPAVGRGRRARRAADSAGAVQRDLRRHRQAHPRVADPQSVAGVAEGLGPSSWSSSA

SEQ ID NO: 25767 - protein, 209 aa, Pseudomonas aeruginosa
VRRDRPGCPGAMAPRAASWPITPWPIRCARERMAWASSASILPTGMPVQPAITAATVRESTCSGTSGSSWRMASRPAARRASSAARWSMRPSSSSSGLAASALSLRASSSRRVSSSSRTASRSSSQRVSSSRMVRRLSPDSLSRAVIRALWSRPVACSRRSRCNSSSSACSRWRRLSSGGGTSCWPRATRAQAVSSTLIALSGNWRPEM

SEQ ID NO: 25768 - protein, 345 aa, Pseudomonas aeruginosa
CSSSLPATPRSISTAVASSGSSTWTSWKRRVSAGSFSKYFLYSSQVVAARVRSSPRARAGLSRLAASLPPSAPPAPISVCASSMNRMIGCALLRTASITPLRRCSNSPFMLAPACNRPRSSTRRITSCNDGGTSPAAMRRARPSTTAVLPTPGAPTRIGLFCRRRRRMSTHWRISPSRPTMGSMRPARASAVRSWVYWSSSGSGALSGLSPPAAGRFGAGGCSREAWIHSSRLACKASWGIRSSDDALFSNRARRSSRSSKASSSRPERICAWPSTLACTTASSSRPMVCADSAGVRVLPALNSSSDRLISATRASRSRPKRGSRQAKSPPSMSSSSSSRCSIST

SEQ ID NO: 25769 - protein, 532 aa, Pseudomonas aeruginosa
  UNSURE (439): Identity of amino acid at the above locations are unknown.
WVRCRQRCAARSRARRQSGLRRPIRAASSISSYLRLPQVEIDALPLAVFDAPQAGVPAQPGRCTALQAQRRAAAHQQAQATIQVGAEVQRGEAGQLAMGVAVGEEAGGLAGIQRTEAEGDAGVFVPGARAGYGIATQAQVAPAALHPGCGWPWGFPSRRPGMRPAVPPRRSAGAPGPAKPARERRPPANSAVRASTALSGSARRSCRAFGNRPLRARSCGLHRGRRRHRGNRAPSGCLAQHPVEQAEQAVLEQVEELGGGMVLLPGALLQPFLVGIGQRAVGAAEAEHRGGQHRLLRVVEQAFHLARGEQRQQRPAQAQGLRPRRVAGAQRQRLGTLAFEQQQRLQQFEALRRAAQPLTQRESGEPAWGCHVFTSLSASTRTVRTKRLAVAYSEKNCASTAENSTPLAPTKCCGSSRRRISRPLRQPRQASSPTCATTXWQSSCRRPSICRRALASSRRLCRARISRRASRARGPSTSERWLRVSCETSLQRDWPSRRGWLCALGALRRRAAATGPGRSKPSAVPAPRRSAR

SEQ ID NO: 25770 - protein, 192 aa, Pseudomonas aeruginosa
SRRAGTGSGSNSRRIVRRRMTWAWRLLREEGQAGWSAGGSLSPAGAASASGRAALISCRPSVLATTSCSNWSRSSLPSSLVSRSRRRWRASNRRRNGTTCFTRLTGSKSSMWLKRSSTFSLLSSPLMVLSTCRVARGEMEERISLKLSRSMSTKRRSTSFAGGVSGLPERSARMPTTRGSSFFSMALPISTS

SEQ ID NO: 25771 - protein, 160 aa, Pseudomonas aeruginosa
TPMKHGCFTICRKLSLALAILALAGCSYFFAPRVELQRLTLDVAARANDDSPIAVDFVAVKDAELFKELAGLPASQWFANREQYRRDYRQQFAVWSLELVPGQFIESESFPLRGDRATGLLVFAGYNTPGAHRLRLDQQQRVWLRLDTREMRLVNDPATR

SEQ ID NO: 25772 - protein, 1332 aa, Pseudomonas aeruginosa
AARRCAATASAGARSAAGRLPPGPGGARAGAVDERYRTPVLARHPARNGGGDPPGRCGAGAMSGATLFMLVLLLVLLALLLGALGWWWRTRGGTEIRSFYAAVRQMEREQGWQGRYESPWLLMLGNETEGEQLCATWRLLPVARPAWFGRWWSDGEGAILLVPESVFLPDEGLRRQSGAWLRLLRLFLRLRGRRALDGVVWNIPLARLQDGEQAANLGLAARRRYVELTQRLGLSLPVYVVITGLEDLPGFQELLAALPEEARERALGWSSPFAAEAAWQSRWCEQALEEITATLTESIVELGTLRGQVDNELYCLPPRLESLRGSLQALLEPVFQGNARGEAPRFRGLYLSGSEAAGAAADDVLPAVDAPRRRSSFASQLWARRILAEEGLAQAVPRILQLRQRWQRGIGLAALCLCLLWGGLMTWVWRDALRDAGELSQLLHGASERYQPLDDDTRRAAQVRQNVQAWWQLVSQAPRWRFTSLAFPSSWFSSLDARIDNAYRRVSECLLVRPLRSLLEGEASDLRAIRSDGQPGLKEGDDPSQWKDYLAAKDLVARATTLERHNRLFAQAIDNRRTPLDDLLQLSNDALGSSYNAGSLARLAYYNRMLFAERPADLAALDLGRVAATAADNFHDLMARWLNAYFLTDSLERTGNALTQELAQLGQERDATAAQLLGIGELINHLQQQVNRINLIWGNGVGQDLVPGYQNLLKSAQQSSLLGNRVEELQNLTVQLQQQFRSEWIAPPEAAGDGLLVKQGATLKLADDLLGLKRAIDDLKTKDFVSVALADKTLADHSLLSIDDIGVTQALSFFNDFTGYYESTLPSLNPRYRYSVLHAAASAATEAMWQSLGPRSRSLASRNASRFDVQVKQVQVLQAALLELQDLQAGARLLLSLNALAVADIGQALRDIDEQAVLREPVDFSRWSGAPNFGLQMFRAQDSAELKQSLNSQFNAMAAVAERHAPALEWLQAQQSSLATADYNAFVRFSALNAELQKFKADNPASTAAQLAKLVGNDFNQMDIGSCADILNGVLLPSSRSDLATRLVDLRQGALGRCQSLQQQQAAQAWKDLADYFNQYLAGRFPFAYSLEAADAEPGRVRHLLKLMETRLPQVREGLAQVRSPDLPAAEDFVRRLEQAQRWLGPLFERDKSGLLGVALDIDWRSDRSLERGADQVIAWSLYSGDQESRFPGAQDKGLTWNVGDPLKIMLRWAKNGSQRPADDPRQASLAVADLEAGWSYQGSWALLRMMRAHFSRQRPPNVDYTEFPLVLQLPVYAPYSPENEARMFLRLSLMSLGGKTPLSIQPLPVRAPQSPFATLLPATVASTGGTP

SEQ ID NO: 25773 - protein, 386 aa, Pseudomonas aeruginosa
IRIQNFLIYGFLGQDGRTFPGSEPSMSVITHPHARELTKSVRATVLVFNDPRSRELLERIERLAPSEANALVIGETGTGKELVARHIHALSGRNGGPFVAVNCGAFAESLVESELFGHEKGAFTGALQSKAGWFEAANGGTLFLDEIGDLPPSIQVKLLRVLQEREVVRLGSRRPIPIDVRLVAATNVDLADAVVAGHFREDLFYRLHVATIQLPPLRERRGDILPLAEYFIVEHCRRLGYTSASLSPEAERKLLGHSWAGNIRELENAIHHALLVCRNRLIQPADLHLIDMRARQEPNGLRRAPESAAGSALEAALQALFEENREDLYEHIEETVFRAAYRFCHGNQLQTGRLLGISRNIVRARLEKIGELETSPRHNVVSLVGK

SEQ ID NO: 25774 - protein, 329 aa, Pseudomonas aeruginosa
QAEAGNPPQLPGKCTFPRWYGPCSRALHLAQQSTGKSHDQPLQSRRRLRRHLSPVPHPGTHPGPDRRAWPVVADRQPGHRADRHRRAAGRYPGAQPGAGGTAGGARRDRKRRPAAGRLAGLPWLLSGPAQAPVRPDRPQRLDRHPGAARRHWRHRAPRAGPRPPVAPAVQLLPGDHPAHRGLRQRGRLRQLPDRQRAAEGAHPPRRRARRAAVRRTLRTVEDRLRCADERVLVPPDPRRWPLPRHQPGRAAGLAALPEAGGTGGRQPWLSRRADPHRTLLRGLLGGGLGAGAADRAPALPGGDAVRESFRRPSRRGWRRPSTACPAGAC

SEQ ID NO: 25775 - protein, 114 aa, Pseudomonas aeruginosa
SNTSPTRPSPPRSSPSPVSTPKASDAWPRCTAAAAIAWRSSRTSGPGSAWCAAAPAPRWSAIRGRWRSASGNTPSSASTASSSPAIRTWKRPTASPNWSSRCCPNPTPAWPAVG

SEQ ID NO: 25776 - protein, 792 aa, Pseudomonas aeruginosa
SPTTCCRLAPALEQPGPRGETPCECEDPPRGANAVADRPAPGRRFRRERRRARRRRRYPEGRARRVAPQRPVVADHPARIRRPGGELERNPANRARTGPGRQLDRPRLWLPAPDAGHRAPVLAARAMAAVVRADRAQPLVLGQRAEPAGQPYRGPALRRLARVLREEELLLRRPRFGDAHRLGTGRRGRGAADCRHPHRAQRYQPGPGLGQHGPAADRQRQRDLRAGAGGGERVAARSRAAEHAVRLPAAADRPVDLHRGVPRHRRRRLRGGSPVHPARSATVVPLRGRRGQCRPLCAGALRRILGRPGKHPGAGRARRAAPRRRLVQGPGAGRQRARPVGPGHRRRQGRRDAQRPRPVQPHVRSHRRPLHSRRPAPGPLLAQPAHPDPARPAGLQDPRAGRLGAEPVTAATDLLLMNASTRTPDRLLTLPRSPNLATSIRATAQVFEDPKSQALLEHLRQVAPSEASVLVIGETGTGKELVARHIHNLSARRNGPFVAVNCGAFSESLVEAELFGHEKGAFTGALAAKAGWFEEANGGTLFLDEIGDLPMPIQVKLLRVLQEREVVRLGSRKSIPIDVRVLAATNVQLERAINAGHFREDLYYRLNVVSLELSPLRERPGDILPLTRHFIAEYSRRLGYGQSQLSPEAAQKLRAYSWPGNIRELENVIHHTLLICRDGLIRADDLHLSNLRLERGEELARGGPASGAAEHLLQQAFQRLFEEQGENLHGRVEDALLRAAYRFCHGNQVHTANLLGLSRNVTRTRLIAIGELVVNKRGGQRIDGERAVRLSI

SEQ ID NO: 25777 - protein, 441 aa, Pseudomonas aeruginosa
VQALGIAAGKRKRLFGQPPATIRRAGAAAFAQTQPGAVDSALCGASGSALCARWNCPMPDTSPDLPAMSPLAVYRQAVEQRGFAPDEAQRRAAEALERCFQALHEAHRHGAIQGVYLWGPVGRGKTWLMDHFYQCLRVPARRQHFHHFMQWVHQRQFELTGTADPLRALARELARDVRVLCFDELFVSDIGDAILLGSLLRIMFEEGVVLVVTSNQPPEQLYADGFNRERFLPAIEAIQRHMAVVAVDGGQDHRLHPGRAEQRYWVVEAGQASGFAELFARLSAGEAASTQPIELGHRPLAVHRHSESVLWCSYAQLCEAPLSALDFIGLCDRYRAILMDDLPCLSASQREGRIARGTEDGAQLVEAGDRELPQLSVHDDGVRRFIALVDECYDRKVPLYLEARVPLEALYTEGYLAFAFRRTLSRLREMQLARFGSDSAG

SEQ ID NO: 25778 - protein, 205 aa, Pseudomonas aeruginosa
QLQAAAAIDRVVGDGHAGAFRQLCEAGVALRIEPDVVDDPWRERLQLEAAFAVGVFQEGHVLEVVGVDVALGEGDVGGVPVAELDQFDLQSLLAGFAHGDFQRRGEGGGGADLQRGVGGLGRAAAEEDGQAQGFQGVQHGGLLNERESGVRPGAGARPGAGGRRRRRVPPAGARGRRRRASPAGCRGHRRSCSCRVPATRAPPGR

SEQ ID NO: 25779 - protein, 139 aa, Pseudomonas aeruginosa
CPRRDGRRRPPPRGCAAPTGGWPRGSVRRRTRIRRGARRRPGHAPRSRPGTAPGCAVERARRGGSPRPGRTRHGGGSCGSSPAARRPVAGGRRAPRRLPSCPPRACRGPPGTRRRGRSGGRARSARTGPWPWPRFPGSR

SEQ ID NO: 25780 - protein, 467 aa, Pseudomonas aeruginosa
RRLGESASCSWRSLRRSERAAAWRQAAVEVVVADRVVLPAHRVVQGVYAGVAPVAVETEFGETGAAAAKLDQLAAGQQGDLGGQRAGFGDGDRGGRHAFRVRLGGGPVEHPPGTLQQRFGGVQADRQAADLMDGQWVVAGLVDAGVDPGPGALADETQGVLEGAAGDPGVDRRVEDLCQRADGGRALEGVLERDHVLGGHRYPVEQRRTAAGGALTEAGPVVDDFQPGAVARDEGQLLAALVVHRQGRHPLRVECAGAVELAPVQAVAVAVGAQAGTALAGGTRADLGQGVAETLAGQGGAEQATFLRRRAVHPQHFEGVEMVLRNLPQGTVGGADDRHHLRQGHPRDAGPAVFAGHRDAPQAGAGEQFQFFQRQAPLAVALDAFAGEQGGQLAGRFQGFVVAADAMGSGRGIVARSVCEAHRALLRSMSDAPDGRRSGSSRRPRGLSSAPGRAGYGCGRCASAGRG

SEQ ID NO: 25781 - protein, 400 aa, Pseudomonas aeruginosa
NKGQVFLAGLDQVRMTGEGLDPAPPEVDVRLRVEAHVGIQADQAPAALAPDQRQQGVGHRCHHQGIGSDVQTAYPPIQRRQVFQAHLAVGAAVAAELVLRRAAGVQADHRQGGRGVAGHQEAAVHAFFFEHPAQPRAQVVAGQPAEQRRLHAQPAQADGDVERRAAGDRGEAQLVAARSAFQAEDIEKGLATHQVHADLQNARRGRKATIIAEAGAPGNAGRPVRRPPVVAPGAGCGSTRRAPRSAGTGLPGFHRRRFRGPGSRPPGAPRQGRRPRSAADRPAAGRAGRRASAATAGSSPRRRPGGFPRPAGRWRAAGRGRSAGRRRCLRAPPGKDWRGSGWPRSCHAGWRWRAVAPEPARRRRTAASADPRRRPAPGRPAGRIRRGRGAAGPVPGRRRR

SEQ ID NO: 25782 - protein, 712 aa, Pseudomonas aeruginosa
GSRGAGGCARRGRTARESGACSRAAWTACSPARAPVPGVPASRPGRRGLPAARGFPPRSRCRTRAWPGAAPGPRRRAGAAHAAGRKPPGRGPRGRPPRLLPGPCVPRWPWLPASPPDPARGVRHGLPAGAARRCPGPACGRCRRRAAAPCYPGCRNRCRGTIRACGPPASFAEYLAQGFADAVSAQAVVEPLEGLDEGRRGRDRRAEHGLHAEQAPAQAAAFGNQRLAFGGARIGNRVAFAMLVDPAQVQRPGRHHQGHPFQRPAGGDQPIGGGDDELGKLRRAVRADPFQLVCDGAVGEALDQAVLVAFQVDPRYRCQQRGHVAVHEGPHVAAQQRVAEGLVDEAVAAQEAQVGERQVAAVEQADLHLLVGRDVVGELHADLFPGRAPSAETIFQHPLHEGFADHRPGVFHVVPLGQLAAVGGAGHRGDAVDHGVGKADVRRDPARQPRVEPFGEGQQRLARHLAVMREVVAGHHGERRHACVAAPPQSLAEKAEDPARGPRVGQVVAHQRQLGEELAAAIVDAVAAFGDGQRDDADGRLGKFFQQRLGAVLGEQHAADGADHADLGVRLVAQLVEGVEVVLGGQGVVHGAVVAAQAGAADRPVEGFAAVHQGVGVGRLVRAVEAADADVDDALAQLRGVVGRAGDSGRQQGEVLPVEFHRWVPAGGFRPPVAVVCRGPGRCCRTGGSAPDRSPAPGGRRSPVRNRRARAG

SEQ ID NO: 25783 - protein, 139 aa, Pseudomonas aeruginosa
APRPCPPGSSPRPGRGSRRSWSPPVPGAAAPVPGASARAGRRRGWTAVRRRGISSGCARSPGRSPPAAVGRRRAGAACAPAALAVRGCVRRRRPWRRPRACRRRPGRGRRRGSCAPSCAGTARRSGRPSPGRVSPAGCR

SEQ ID NO: 25784 - protein, 501 aa, Pseudomonas aeruginosa
SAGSPLIGSSQPLAPHSAASYMPMVSRSSCPPWVAMSVVRRWRRTFSSSTTHFSAMSGWLSSNTLDRRCMRIMSLLLTVAMVRVSAPWASRGRARQAAARQALIESFIGELLFRAGGRRGRHYCFCVARCRLHRRVTQPTKPRLHFDRYFFAPPGWGAGGSEQVLLGQPLGHQAPVAGGRHALELLEAPVEIGQVAEARLEAHLGHRQLAAGQQLAGLADAQAVDELDEAAPGGLLEEAREVGGGHAQVGGDLLLGEVLGVVLEDVVHRPVDPFDVVLVGQLRGSDGREQLVVLAFGELFHEDKKVSQAGHAAAVGDALQQSPAFADQRRVAELDAVARPRQQRGQAVQLGEYAAAVLQHLVGEVHQHVAPGHHLVGLNLADPVVRQVGTGEEQGVGGEVADVVADEYLAGAGDDQVQLVFLVEVPAHQRAGEAVLAVDQRMAFVIVHQLVGGIGDFAGSGHGRGPTGGTKAHPSPKRRGCAGDHPRASLPCVAPGGRRGG

SEQ ID NO: 25785 - protein, 208 aa, Pseudomonas aeruginosa
PWATTCAPRESAPRWSARPTPRPTWKACGGSASIRPARAARPSPKPASSPTTAMTGSTRMTRPSPTSAKARPTPTTCGASASPATTPGTTGPTPPPAPTGKSSAAGGCAMPDCRHACRRRTARPPIPPVAPWISSTSRASVPGACTCPTSSRTGPTSRRRRTTRCTAPTRCSRRYARRPAKKATTRCTAPSANIARASISPAKTCAGR

SEQ ID NO: 25786 - protein, 144 aa, Pseudomonas aeruginosa
SAIRAPRRTPPAAGWRRRWCSPSTYCRASSKPSPSSPPAIASRAVRCCPSSMARRRRTGAATPSPSTTTPSRRRRGSAWADPSMPAACTWCAASAGSTSPTTASAPNCSTLPATPANCATSAPTRRMRRCARPMPGCCSTGCAG

SEQ ID NO: 25787 - protein, 172 aa, Pseudomonas aeruginosa
PTCAAAISWWRRRSNTGRAASPSSWRFPKDSPACSARRTCACSACNAATPPPSICARWRSGATGCCTTTPGSSCHGCARPSSACNAAWPSAWRAAHWTKCSGTWAAAVRSWMASWRHSAKPSTDTWRRCTPDWPAASSPASRHACSASASGSPKPPPMPCNWSCRPAAARHT

SEQ ID NO: 25788 - protein, 252 aa, Pseudomonas aeruginosa
ASTAPVSPAAGASRRSSRSLRRAWCNCAPNCNARPRPRHERGAPRRSRDRPRLSARCRLAGGARRFRIAPGRRRGGLDPRSQRRRQVQPAARAGRPAGAGRRQRAGTRRAPARTASGRRGGVPGPQPAALAEPGEERRLRPRFRPPAAPRRGHPPGPRRPGDRRGRPGARPCPLPGATLRRHGPAHRAGPLPGAAAEGAAARRTFRRAGRSDPRRHAAAAAAGDPRARHRRGPDHPRYRRGPAALRTHPATG

SEQ ID NO: 25789 - protein, 171 aa, Pseudomonas aeruginosa
AVRWARRWPPTRSTWWCCRLRTCHRRWPASASTATSSPSRSTPWRRTSRSAGYSASPAMSGATTPAAWCSCTNTTWSGGRSGRKRWSTPSSRPSYGLASTAPRPHSCCPRPEPTATRRTHRRSSAGCWRRAPRSSRPISPAARSATPTGRSDASTSSPIPIRAIPRNWCGG

SEQ ID NO: 25790 - protein, 239 aa, Pseudomonas aeruginosa
TAGTPRTLRARAGEPETGPAGLVPGAAGGSAAGAAGGRLAQPGSGDHSGVSVPADDLAAVVDAHRGDADGRGRPADLFPAGLRRALADPAEYRRRRAPARPALAATEPQPRRHALGNPAPGDPAGHPRPCADRRAPGHRHPLDRPGALRDAWRQRRARLLHPRHPRPPGVLRADGDGAADRPARLPARRGGARTLPALGARGARVGRIAARGYPPDGVPVRWRIALGRYSPYGSMGMLG

SEQ ID NO: 25791 - protein, 521 aa, Pseudomonas aeruginosa
STNTCPAVAPAQRQGLATQALSGAAPRPGTGCARGAGCTGKPRSPHAARNPSQRLRNELCRPPVARPLGASARPLLAVQGPGVLDRPGAVARTRPFRRTVHRRRAGHLRCARRQWRRGDPPGRPGTGERPAGADHADGRGDSPPGLRPDRLAVLRASLSLRPPTLDPGPPDQGPDRLERSDLLPGKRRAQPRSAGPARPRPPLRLCRRIPTGALQTLRRQLGGRRGAPRPSPKDLQRPGQDSRDPPCRRALPGTRHPSLRTVAAAHAGALPGRRVESWQALRRRARRVRVRRRAIEDRAQAGGRRHPPARRRGRPRSAQGTGVQPADGGAGRNRRQGQGQVRRIPRLRQLRRGPGADLRLDRDRLRPVSAGPGAAAHPHQCDPIGGGSVFQRRSDAHLDGPRAGRLGRYRRLRTAVRRQPGDRRRPVAGVGGGHRRGWLQPGLCAGPRNLQRRGRIAGAGVAEARGVQDRICAGNPAREVVRRRPAAAGFPSGGRLSRPAGPLGEGGRAQRAAGLTWADGG

SEQ ID NO: 25792 - protein, 255 aa, Pseudomonas aeruginosa
RQWRYPPQGPGRLLEPGVPRWLHPIQLVVADGMVFPAHRVMQGVGAGVAPVAVEIEFLQGRARAGQFEQPVGGEQGGFGGEHLGLGHRDRGGGHALLVGGGERRFDGVGRQVEHGFRGAHADAQVADLLDGVGVFPGMLLVGVYPWPRVAAHLLHGLGEDATGDAGVDGGLDELRYGAGGGGAVEGAVHRDDVLGRHPHVVQDDGAAGGVRRLKPDQSSITVSPGASRGMNARCARCSASRPTAGTQWASRAPLE

SEQ ID NO: 25793 - protein, 692 aa, Pseudomonas aeruginosa
SAPSERLVAVASGWTRAFMRTPGRQRGRPVDGYPGVRAVAQPVPTRAGHWLRGFARAGGVAGAAACCAAAAWRTVGEVAAGPSPGGRGTGASEDVVGGEEVRRAVADDLADQGLVRLGVAGRHQGADGEHPQRVMDRHGAFRRILPAVERVAVRAALALGVDVDPADLVGEGVDQPADLRRVVAEQAQLLAVVGAQDVVDHLVQLAIGHHRHQRTELLLVVEAHVRAHRTQQSGVEETLPMLAAARIDHSCALGQGVVQQAFEVVDLARLRQRRQRHSRFPRHARLEAGQARAELVEERSQHAFVDEQDLQRGAALAVEGQRAGDRLVHRVVQVDLRQDDTRVLRVQAEGGAQAVRAGVQLLQVAGAGMGADEGEHVDLAAGHQRRHGFPAAPVDDVDHSWREAVAEGFQQRADQQHAELGRLEHHRIAHDQRRDQGGEGFVQRVVVRPHAQRHAQRNPADLAEGALFQFETAGAAVEFLQRFDGIDDVVAGAVELFLGVLEVLADFPHQQLDHRLALLAHPRQEAFDVLDALGHPQVRPQALAVVVGPHRGVERGERGVGVEQRGAAEDHLALAVGLGEEYRAAYRRQRAVPISQLAVDQVVALLDGGVGAVLLGNGVEAGKQRIEVERGGHGGSSNDVDERRGTVVARSGSKVNRFSRKTVAPLPEISLCSRFVGGGSKGMAPAGFRRRR

SEQ ID NO: 25794 - protein, 216 aa, Pseudomonas aeruginosa
ALRGAAPAVAQAVPAARHSAGGYRSRAASARLRGRGVALVRSWLNSGRAGAQSTSDSNRMKTRPTTERMVSIAVQVLKVSLTLMLKYCLTSQNPASLTWERISEPAPVASTSNSRLTPGIRSITGTTMPAPVMVATVAEPVAMRITAATSQASRIGEICAFTARWPMTSPTPLATSICLKPPPAPMIITMAAAGARLWSSSLRIFSSSNPRAYPKV

SEQ ID NO: 25795 - protein, 453 aa, Pseudomonas aeruginosa
ARLRAEQVSTGSLPAATAWRSCSARVSSQPARSSSVRGMPALILRMLAAGWKLSPSMPWAPLRWQRAWLTLDLPQPATPMMTRAWRGGCMEHLKRETALSLRPGKNRASLAPPSCRCGLSNPARAVADRPPQAIAQVARQRYLSAWNFVWQAGHDEHHQERQEHANHRTSHPQRSRAPRRGQPDHRVARVARRRQRRRRTGAEGPRRRPRTRLRGQPRGARAGLGAKPQRGGAGAVAGQPAVHRDPRGDPRGTAAAGPGSADRQLPLLAQRGRGPDPQLPGLPAARPAADRLRAHRERPADDRGQRHSLRVHDGPGLRLRAQLRRLLPVARRRGRRRAPAWHAAAGAWPTSAPSSTSAPCCAARGSAAPCKRPAATTRGWKSLRRGRPRWPSAANSSCSCWPASRRSTGCSSATTTWPRARCWRPCAVGSRCRNRSPCSVSTTCRVRTARSRA

SEQ ID NO: 25796 - protein, 417 aa, Pseudomonas aeruginosa
NGTLSVFFRFCSALILSASFICGESRMSSFEREPGCGLAENVDQVIEAAFADQRLVGAVVLVAHRGQWLYRRAAGLADRKSGRIMGEDSLFRLASVSKPIVSVAALSLVDEGRLALHEPIADWLPAFRPRLADGREARITPRQLLSHSAGLGYRFLEADADGPYARAGISDGMDLPGFDLAENLRRLASVPLLYEPGRAWGYSLATDVLGALVERVDGRPLAEALRQRVGIPAGMRDSGFLCADACRLAAVYVSDRPRPRRMAGRETVAPFEDSVGIRFEPSRAFEPSAYASGGAGMIGSAGDVLRLLEILRQGGAPLLTPGLAEEMGRDQVPGLELPANPGFGFGLGFSVLRDPAIAQSPEAPGTWRWGGAYGHSWFVDRARELSVVALTNTLFEGMSGRFVNDLRDAVYRSAELR

SEQ ID NO: 25797 - protein, 254 aa, Pseudomonas aeruginosa
VRFEYPSRRNTGCDDAFLRHAAESAVIAPNIFAVSPLATMQRPARLLHRHLAGASALPRIGPIRTYPRFAYRSYRHDECHADADEHECRHADDAHDGHADDDGDHAVRNDGRRHAVQDDAGDGHGHGPVPQQRRDDGDDDELRHAHDNAVRQPGDDGHVPGLHGDDADDGHGDGHADDGHGSDEVHDGVLHAGRRHALQDDADAGHGHGDVQELLHADGEDDGVRHADDDELQRHADDVLHLLIRRRMEKARPG

SEQ ID NO: 25798 - protein, 337 aa, Pseudomonas aeruginosa
FSYSNKLKTLAYLPTNRRAAPNPCRLARYLVPGVSGLAWESAMSVSLPAPARADVPLQIRALDAAFGAEVLGLDLGLPLAAEDFRRIHRAHLDHHVLVFREQRITPAQQIAFSRRFGELQIHVLKQFLLPGHPEILIVSNIVENGQPIGLGDAGKFWHSDLSYKELPSLGSMLHAQELPEEGGDTLFADMHKAWDSLPEALRKAIEGRTAAHSYTARYSEPRFEGNWRPTLSAAQLAEVREVVHPIVRTHPESGRKGLFVSEGFTTRIVGLPADESAQLLAELYAHSVRPEHIYRHRWQAHDLVFWDNRSLIHLAGGCPAHLRRKLYRTTIQGDAPF

SEQ ID NO: 25799 - protein, 336 aa, Pseudomonas aeruginosa
RSSPIRRWSSASRRRTPIRWRSFSTGSVRSATSRPPGRTISSRTARRCRGVETPMNAASRQPSTLPADALLAVDGVSLEYRTRSRVVRATQRVSFEVDPADRFVLLGPSGCGKSTLLKAVAGFITPSEGEIRLQGQAVRAPGPDRIVVFQEFDQLPPWKTVRQNVLFPLRVSGQVTRDEAERRADECLEKVGLAGFAEAYPHTLSGGMKARVAIARALAMQPKILLMDEPFAALDALTRRKMQEELLRLWEEVRFTLLFVTHSIEEALVVGNRILLLSPHPGRVRAEVHGHPFGLHSLGGEPLQAAARRIHRLLFDEGGEPTAAATLDFADIRLAH

SEQ ID NO: 25800 - protein, 318 aa, Pseudomonas aeruginosa
AEESIDESSHARSRRIRSPARTPAGGLPGAAPAPEPASLATGLAAQGADPGAAGAGLGAGGAGPGQRPAAARLPADGQGPRRGPGQRRTAGQGGDLPAGAVQGLPAGDRPGLRSDQPGGLHAVGPRPARDPHGDVQPAAGDRAAAAGAALVRPGPEQPDLRAGAFGALGAGAEHLCRFPRCLGDPAYGRAQLRPAWPALRPPDPGAGGAAVDSRRAEDRLGLRLAHADRRGTGVRREQRQGRARLVHFPEPQRAVHRQGIRRPGRGGADRPAGGEPGVRQHRAPHGEALGSATLGRRTGGVLRQLSRQLLRWRGGKAE

SEQ ID NO: 25801 - protein, 654 aa, Pseudomonas aeruginosa
PQICRAGARKRRARRAPARRRGGSGAAGRGLHAARQRPAGRPAWRAPRRRLIRPAGPGLSGGAGGIHARRRRLPAGAGRREHPRAGRRAGPAMPDAGGGRRPGERPGAARERGRRRPPRLHHLHLRFHRTPQGRRHRARQRPCLPALGRPALCRRRMERGTGGDLGVLRPVGLRAVRYPGRRRHAAPGGKPVQPAGLPAPRRDQPAQYRALGVCRAARPRRPAGRGAHAEPGRRTAARPPGATDSWPTPGTAPGQSLRADRGHHLFDGARTGPARRSARRAAHRPTAARHHGGGARRLRGAAAAGRGRGAVPRRHRPGAWLFRQAGADRRAFPRRSGQRRAPLSHRRPRTHARGRRAGTPRPARRPGQVQRLPHRAGRDRLVPGEFSRGERSLRHAHRGQRRPASAGRLPGGAVRPAAPGAERAPWAKSAALHVAVSVRGPGGAAQDAQRQDRPQGPAASPGERRRAAGAAQRSAGAGATPGLAGAAWCAAARRTGLLRRRRRFPAGGAPARDAAPATVPTRTVAGVRRWPGDPRGPAGTAAPGRARGRRAGAERRRRRAEPRRTAPVGGPATGAGGHLLQPAGPPAHSRRHGRRHRTGLAPVAGTACGAAPACRNGRRRAAAACAGGACGAPATPAGERRRPRRAVAGGWRAP

SEQ ID NO: 25802 - protein, 495 aa, Pseudomonas aeruginosa
SAGTARTPGRAPRMRDPGPAPARRQRPADPHRLRRAQRSGGPGGGCRGARRSRLHPGAWRAPGPDAVAGRPAAGLAGRLDRGQRDLRPAPHRAPAPGLGAAPAGECRRTYFETHVAGGLQRFLTTPSLPRRTAMERTAPSLTGRGFARPRNLSPRSSEALVRRPAAERDGLPLLIEAQAPGLSLADWIREQGQSLHDDLNLAGGLLLRGFEVDSAERFRAAAAAFAPQLLDYKERSSPRSQVSGEVYTSTEHPVDQPIFLHNEQSYTADWPLYIMFHCQVAPLEGGATPVAANRLVLRHLPDELLERFGRLGILYVRNYRAGLGLSWREAFQTDSRAEVEAFCAEHRIAHAWIGDEHLRTWQRRAAFQRHPYTGERLWFNHGMFFHATSLEPGLRDALLRSVAEEDLPYQTYYGDGSPIEAQTLATIRSAIDRETRRFDWRVGDVLILDNMLAQHGREPFRGPRRILTIMSTPYSSLAPADVPPTPSRLALGGTA

SEQ ID NO: 25803 - protein, 408 aa, Pseudomonas aeruginosa
PTCMSTNPEPVRGIAMSASEDLQSAVQPAASEALEGFPLSPLQTRAWRRHAERPENTVVGVRLHAPADTVATLERLRRALDGEAQLRVAYRTMPGMSLPVQVLDGRAADLLVERLPGDGDWAGRFARESARLAASPLGGEGQPVLALGLLLDAAGETLQGLLLAAPAFVVDAASLVALLRRGLGPAGQASADEGDEALLFQHFSEWANEALAGEDGESASGYWREQAAVAAESPLALADDLGEGDWTGAAPAAARAARTPGRQRLAGGGRPAGLDPGRRAVPGRRGTPSGNGATGLGAPVQRVRRAGRTVRRGRAAVPGECPRGQRRRAARRPPGGDPRPGGGSGPARSLCPRLAARRVGLRLAGGRTGWRRGGRAGLPSAAAGRVPRVAGAAPRRRPAGQPAGPPRP

SEQ ID NO: 25804 - protein, 451 aa, Pseudomonas aeruginosa
RNAGRALARRLGRMPGKHRRRQATAIGRAAVDRRGRARALPGLAGRARGARAGGIPGGRVRSAGRPAAAGAGVAGCPRQPGFRHAVRAQRSGRRSAAGCRRAARPGGGGDDRAQPRGDRRPARGDARGGGVHPGQSGVSGGAGGADARSGRDRLRSCRCRVRRARPRGLRRGLPGPVDAAAGRQRHEPAGAGRARCGLHDLHLGHQRPAQRRGGRARQRAQPVPGPGAHGIRERGGRGPAGDGQRAVLLRLLDQADSPVALRPLPGPGAAGGAQRSAADAGVPRRTAHRRARLHPVAVPPAAPGRPRRCPPGAARAHPGRGRALRRSVLGGRRRLAPLPGVQSLRSYRSHGERQPGAGRRACAADHRPRPGQRRSACGRWPRSSQDPWRQRRTVDRRRRGGARLCRRRRRGGPGASSTRAGRAAAACTAAATWCAGAPTVAWSSSGGSTNR

SEQ ID NO: 25805 - protein, 122 aa, Pseudomonas aeruginosa
TSTKPSTSTRKSSSTRSTAATASSCRRTRWSSTSVPTSACSRCTSPAARRAREWSPSSRWHRSAGAWRPTSDATHRRSRYSASACPTPSAKKPSPTIRATRPSPGSPSTPTPAANATSSDAT

SEQ ID NO: 25806 - protein, 111 aa, Pseudomonas aeruginosa
SAAALRGRTWNTRASMRWATPSCCEPCASTTCCRWKCSTTRSCARSAWPPCAPIRAWPPTIATARASRWPYRSPRSSASRTRASPGWPSTAGGGTPAATSWRPWPAATAWW

SEQ ID NO: 25807 - protein, 231 aa, Pseudomonas aeruginosa
RRRRRFARSCGSAWRPMCLAACRRTWQPEPPAPAARLAAGAGAVRLHSRLPMVVREYTQRHRLDAVAPADYHRHLPEQVARGLPSAELVVFRVADEHSDTAAFSARYGFGLEDCANTLVLRYKRDGAEGYAAVVNLGSRRLDVNGAVKALLGARRLSFAAREVATELTGMQFGGITAFGLPEGMPLLVDAAVFERPLVVMGAGVRETKLLLSPALLKDLPGVVVAELSEAG

SEQ ID NO: 25808 - protein, 483 aa, Pseudomonas aeruginosa
MIRIDFSQLHQAREDAAAAMPSIAGKKILMGFWHNWPAGAADGYQQGSFANIALEDVPSEYNVVAVAFMKGRGIPTFQPYNLSDAEFRRQVGVLNAQGRAVLISLGGADAHIELHAGQEQALAAEIVRLVETYGFDGLDIDLEQSAIDLADNQRVLPAALKLVREHYAGQGKHFIVSMAPEFPYLHKNGKYVPYLQALEGVYDFIAPQYYNQGGDGLWVQEANGGKGAWIAQNNDAMKEDFLYYLTESLATGSRDFVRIPAQRLAIGLPSNVDAAATGYVIDPAAVSNAFRRLEAAGHAIKGLMTWSVNWDDGLNKRGERYNWEFRKRYASLIHDGEGGDQRPAAPQGLRLLERGETSLVLAWNASSGQRPIDYYSLYRDGAMVGQSAALGSTDSGLTADTRYSYFVTATDTQGNQSLPSEGLEVSTSGGAVDPQFPQWRENQAYRVDDGVTYEGLRYLCLQAHTSNSGWTPPVAFTLWRPLR

SEQ ID NO: 25809 - protein, 838 aa, Pseudomonas aeruginosa
LVITSVRATPTSESDHGQTAPAFSRAAVQPAQGAAARAHPRRRLPAAQPHALGERAGQGLRRQPHHRAPGARRPAEGRADLQDPRQGHLRRPAEGVPERQHPARPGRVHDADGLRGHQPPARPALRAGRRAGGRAPAGGRGQPCVRDQAGAAGQPRAGFAGSHLPAAGARRAPGEGRPGDPRHLPDPRERLRHSPRPCRPGHRRGARRCRPDPRPGGRGGRADHAYRAPDPCRRRRAAGLRIPLLPRRRFPVSPAHRSAEGRAGMNTLEQEYDIVVIGGGTAGPMAAIKAKEHDRELRVLLVDKANVKRSGAISMGMDGLNNAIVPGHATAEQYTREITVANDGIVNQAAVYAYASHSFETLRQLDRWGVRFEKDETGDYAVKKVHHMGAYVLPMPEGHDIKKVLYRQLKRARIPIANRLVCTRLLTDAEGAVNGVLGFDCRSGDFHVIRAKAVILCCGAAGRLGLPSSGYLMGTYENPTNAGDGYAMAYHAGAELANLECFQINPLIKDYNGPACAYVTGPLGGYTANARGERFIECDYWSGQMMWEFHQELEGGNGPVFLKLDHLAEETIQTIEDILHGNERPSRGQFHAGRGTDYRQQMVEMHISEIGFCSGHSASGVWVNEKAETSVKGLYAAGDMAAVPHNYMLGAFTYGWFAGRNAAEYVAGRAFSAVDRAQVERERARIEAPLLREHGLPAAQVEYKLRRLVNDYLQPPKVTRKMELGLQRIQAIAEDLERIKADNPHELMRALEVSVIRDCAEMPARASLFRTESRWGLYHHRVDYPRRDDAAWFCHAHLKKDEQGRMASFRKPVETYLFAIDEGEQQAYQRLRLRNDAA

SEQ ID NO: 25810 - protein, 623 aa, Pseudomonas aeruginosa
GPTPRRSTARHRARRHESGPDRTTRTACHGLPTPGHLLPQQRPGDHRRRPLHRRQGLHRLRRGLPDGPAGHRSDDPQGLHGLRRVLVLHALRKGLPDRRGEGRDSLPAALTPAPGKRGRTRHPATPGRHSETPLVSHHRPGGGDDSHDHDSRGIPMRLRAILASLALALTSLGAQAETIRVAIGTQDTTINCAAGGLLIRELGLLEKYLPRDGRYKDADYRVEWKNFTSGAPLTNEMVAGKLDFGAMADFPGTFNGVAFAAAGKRSLFISVLSGSTRGSGNGIVVPSGSPVQSLAELKGQTISVPFASTAHGMLLRAVAAQGWDPQRDVTIIAQPPEIAGSALQANKIAAHADFVPFAELFPNRGFARKIYDGSQANAPTFHGALVDAAYAERYPEVVVAYLRASIEANRLLAAEPEKYSELIEKVTGIEAEVNYLFHGPLGLQTRDQAWKPEYRQALATSIDTLKLLKKADRGLDVERFVDDRYIREAYRQAGLDYQAALADYAPSPLRASDARSGRPIEEFERVAQIWVKGEARVRHYASPESALADLAELKAQGKAIRAIYAQDRDSGIKLLANQAWFVRDGEGRLNAFLLREQAQDYARRHGGEVRDFAAASQQALALR

SEQ ID NO: 25811 - protein, 273 aa, Pseudomonas aeruginosa
GGRLRSPPMSSLPISRPWRWATRAASLAACLAFWQLAAGLQLNLGLVTFANVPTPGAVLLAACNLAQSSVLLAHLGASLARVFAGYLLAAALGIALGLAIGRSAWAEALLLPPLEVLRPIPAVAWIPLAILMFPSSEASMIFITFTGALFPILLNTVHGVEALDPRLLASARSLGAGRRALLREVLLPGAGPGIFTGLAIGMGTSWFCLVTAEMISGQWGLGYYTWASYNIQNYDEVVVGMLLIGLFGMGSSGLVKRVGASLTPWYAAGGKVR

SEQ ID NO: 25812 - protein, 410 aa, Pseudomonas aeruginosa
KRHPARNPRTVAAPGGRRPRRTPPGADRTGRPGAAGGAAVADCGPARRSRPRRARRGRAPAGGLGGRRSGRCALCGPGRSGAGGGRCRRAEPWRTQGTGRRAAPAAVARACRCLRPRQRIACVARTAPGGERRAGPGRPRRSAGGGAPRGGGGARLAPPPAGPGRTGQAGQRRCRPGGTPGGHRRPRPEPRGDGAAGALRGAGGRSMAGSRRGGDDPWQAGPGGGRRAAAEGPGGRLLAGPPARRAGARALAPPAGAGGAGSIARPSHRQPAQGGRPGPRRTGGPGLGPGLAGRRRRRRSRGAQGGAYRPGATAGAGMTQPPLRLRNSARDGWLMLEWADGAVSRIDHARLRAACPCAQCRAQRLRGRIVAAEQGVRLRDIRLQGYGVQLLFDDGHERGIYPWSYLRDEL

SEQ ID NO: 25813 - protein, 143 aa, Pseudomonas aeruginosa
NPIFSARPCAPWPAAYCPPPCCATRCTPPRRSRRTRNGCSATGAASAPSCWRRATTSSWSTSARRRPTSTAAMTTTRPGATPTSSPWACTWTWRRSSAGRLPSSSSPSPSATARTFPTTASATRVPGTSARCRRSGAAGRPGG

SEQ ID NO: 25814 - protein, 243 aa, Pseudomonas aeruginosa
PSATCGAAARSTRCSAASSSARCATRASTPRRRSQGSLIYPGNVGVFNWGGVSVDPVRQILFTSPNYMAFVSQMVPRDKVPSGSKREGETSGVQPNTGAPYAVIMHPFMSPIGLPCQAPSWGDVAGIDLTTAKVVWQHKNGTSRDNTPVPIGLTVGVPSMGGSITTAGGVAFLSGTLDQYLRAYDVKDGKQLWQARLPAGGQATPMSYTGKDGRQYVLIVAGGHGSFGTRMGDYIIAYALPRQ

SEQ ID NO: 25815 - protein, 595 aa, Pseudomonas aeruginosa
SWSPDGIPASTPDGQGQAATLNLDVAERIEVLRGPASTIYGSNAGGVIQMFSRDGQGAPRVGAEATVGSDGLSRNHLYTEGEGDGVGFLVDASRMDTDGYRDHSAARRDQTFAKLNFRPDADSRLALIYSSLEQNDTEDPLGQTWDAYKHDPRSVTANAELYDTRKSIDHQQAGMNYERYFGEATLQVNAYVGKRSVVQYQAIPKQIGCESNPRCQRNGAVIDFDRDFHGGTVRWLQPVSQAPGELNLTVGLDYDQSRDDRRGYQNFNGDQLGVKGELRRDEVDTATSLDPYLQASWAIDAWTLQAGVRHSTMKMEVDDRYLSNGDASGSRRYRKNTPSFSVMYAFTPDLHGYLSAGKGFETPTQAEMAYAPVAANAPDVFNFGLKPATSSQYEAGLKARLWGNTRVNAAIFQIRTEDEIVVASSLGGRTSYQNAGKTLRRGFELGLESELSEHWNANLAYTRLSATYDSDFEAGGKTIGKGKHLPGVPESSLFGELVWKPAEGISMGWEGMYRSQVYVEDSNSEKAAPSYAVFNWRTRFEQRLGTWAFHQLVRLDNLFDRQYVGSVIVGDGNRRYYEAAPGLSWYAGAGVEYQF

SEQ ID NO: 25816 - protein, 135 aa, Pseudomonas aeruginosa
SAGCACSRYPASPCQRRQFRLLYECTVIGNRLLARQGAPIMSHNLAELPLSRRRALEREKQACLRLHLSRNRASERLERAVRDEVERLLGARERQGTGWPEWVSAELCVADDPLFVRKVVARLKAAVDWQRQRAA

SEQ ID NO: 25817 - protein, 220 aa, Pseudomonas aeruginosa
PEPGRPATARGSRTFRHRPGPGRAGRSGRGAGRAAGVGPARTTGAGSDASAVRCVRRRRCRPGRRLPIRRPAPPGRLRYRRGRRRSDSGAVRFVCRRVARRAAPGPGRAHRPGRPPGRWPSAAAPALRRARARPAAARRPVARPAARRARTARRRAPPAALEPAPGKAAAFADGPCPSLSPGCAVVAGSAGRGRPGCRRRGSPPCRRSPASCHRSAGRPT

SEQ ID NO: 25818 - protein, 452 aa, Pseudomonas aeruginosa
QCSMPVTTWSGSGAPARSAICPSHCQRPGAATRSSSRPSRWSTGSSSGSSSPRRRRSMSRPPRNSSHSGSEKSQGDEAVAVPVAVAPQRFVEQLAGQGGDQQASVQRDQSTEAPPGRREVAEQVGLRAHRAAPVVFQSRQQGGRDQRRRQRAELADSGQPAAQSQPRMVAADGLGVFGELVKMTFDAIGRTEQVTGNGTGGVRVVAHRGAPVAHELFVAQGRVDPEGLHGGPGVERQGNQEEECEQPYPQRIVAHPRLFLLEVVGQECLGLACGRQRLAIGDLPRLLFAGQVELAPAVAHDQDHILAAVQFGGVATVPGALFHLYLVDQAVPVVVQTFDLQQRFAGRRFADTQGPDLEPLLALVGHHLVGDWRPRLFGLRRAGSPRQCAHQQCRSPLCYHSRPLWQRDVKGAHLLIQARATNNRGGRRSQEKRRRPQVRFDQRTEPSWKAAA

SEQ ID NO: 25819 - protein, 499 aa, Pseudomonas aeruginosa
SAETMFTRFETTSGRLALSAMKPAAMTKARVAAGLKRRASSIDITMGVRISAAPSLANSAETAAPSSTQKANRRRPSPPAQRATCSAAHSKKPASSSSRLMTITAMKVAVAFQTMFQTVGMSPGATLPSARASRAPMLALQPMPRPLGCQMTRTRVNRKMAKAISMGRLALLAAGGGALRAAVHVAQARCVGLQPVAVGPQGHLQDFVDPGRQRRVQAVIHPLALATVEEQPGTAQLGQVAADLRLAVGEGAHQFADAQFALVDDQQGGANARLVGQALEHFGGAGHRWAFLDIWKAEYTDIRMYCKRPRSRRLAAGGLDFLARRAPEVALELAAELRGTFVADLVGGGTGVQPVLHHQAPGLVQAHALQVLEGRGEGHRLEVVVEGRHAHVRLASQGVDVQRTGVVGVDAPQGPGHAPVAAVPAGHRTQGVALLAAQGAEDDLADQLRAEDMAVQRALQAAQQAHHRIGHPRVQRYRSHRRAGCQLIVVVAAGSLFHL

SEQ ID NO: 25820 - protein, 430 aa, Pseudomonas aeruginosa
QQFLQGADIHVDAHSQQGFGGGGVGFAFERQGHRHHQVAFGVVAVGFAAEETDLLALGEDADARLIEHRAARIGLFGAHQANPGDAGGVETRFVLQGGDQRRHVGGSSAHALAVSPGGEANVATPCAPGQWRHATSARMGKASTGMDILRRRPSGEQLPPERTAASKPSRPAILRRGHTDDPTDPRLRRPVRQHPADRPSLRTPRAARRRPGDRHPLLRRLPLGPPSGAQRMAQQPVPAGAGPRDHRPGRQRRRGGERFRGRRTGRRRLHGRLLPALRRLLRGPGAVLRGIPDPDLQRPRPPRRPADLRRLLGAHRGLGQVRPAHSPGARSEDGGAAAVRRDHVLLATASLEGRSRQPGGGGRPGRPRSHGPEVRQGARCRGGPVHPLAGQGRGSAAARRRPGDPFHRPTADGRRRRTLRPDPGHRAAPA

SEQ ID NO: 25821 - protein, 183 aa, Pseudomonas aeruginosa
AWRVTPGDLCRGPAQGKTSSKLEVKPIMKNSCASRELSVGELARRAGVAVSALHFYETKGLISSQRNAGNQRRFSRETLRRVVVIKVAQRVGIPLAEIARALQTLPAGRSPSAADWARLSAQWKEDLTERIDKLLLLRDQLDGCIGCGCLSLQACPLRNPGDQLSAEGPGAHWLDAEGREHDG

SEQ ID NO: 25822 - protein, 166 aa, Pseudomonas aeruginosa
STRRIAQRLSAGRSRSPARGRGSRASARRLPARSAAGSPGVRRTARSRARRRRSSGSAPGSGWRGRRSPRAPAGGGPGPVAGGPGRWTTRRCATRRRSVRRRGNRPAGHRRLPPASGCRARSGGDGSPPRRPRRRRSRPARAAGGSFPRLSARWPGAARRPRRGWF

SEQ ID NO: 25823 - protein, 792 aa, Pseudomonas aeruginosa
FLTYAAYVNFVFSRRRRFRWSRPAEAFHEQPLSRTVRRARRQGLFSRRPAGADAPVDDRPGHRHHAFPGACRLLAGRYRGGHLRVLQCLARAAGIAPGGPLRPGPGAAPGRAGQRPGDERAVAVYALSSAECLALPVRLARRGDAEHAGHGTGALDRAVPGLAEAAHGVFLRIGDGRGVLHHRAGAGGEPQRRLVRRGGAAAGDAVPGRRGEPVQPATRHRTAAACPSAAPRRQRAGLSGGTRAGAGAGRHRGDLRRGGSGQRGLRRGARQQGCGKPGVVGLCRRLMSRGIAVRAAALAPGAFPATALHGYADGPEPDAAARGGEHPCACPDRAGGRLQRGADDDPGHGPGRARGGPGAPHRRPDLGHHRAGHRHGLGLGAGRLGGGGLRRRQRFPRRGRRRLAGLAAGPGLLPGAGSGRGRRLRGVRLSREGVFAFDPGDPRAETGVPVAPAARLGVAVLRVAAPGTDRRLVVPVGDGDAETVGAADRLHAEIARLAAGQFQHALGRFGVAVVDGAAMGAEDHCVIRCRAAPGVVAALRPARLDECLRQWRQDAGHGCPLGLEQGGDEERMLFQLHRADRSVGAPGAGPQCAAGKFRGEARGDCVAAMVVRLDPVGGIRQGQARAAQQADILAGFEQSAGQGGDHRLVAVRMLLTMGRRLPAEGVAGELEDRVLEAGAGTEERPAPAPGMGDQAQHRVGVAIGAARHAPEPVIALQRRLGGQAVAGQPVECDLQAECLAGQAQGQGNRPVGGDVRVVVADQGNAQRRRGRGGHPFSLQFRHAGWRALALTL

SEQ ID NO: 25824 - protein, 406 aa, Pseudomonas aeruginosa
ACLVLVATGAAWAAGSGALAALAVEQLAAFRQPLHVAADLYRAAADPVAARHRVGQRQAFQQRADHPDREAVAGAHGVHHGRHRHAGDQPFAVGIAIVGAARAELDRHRVDAHVQVERGDIRGFLPAAEQAAFLQARQDPVGMRGEGVDLGDHAALAGPQRGPQVGVEGQAGALAAHAPHQFVGQFAGTRRECRRNAGGVQVAGAEHFFADMGEAQPAGRRAAAEVLDPRVGTIDLAGLHLEPGGRLRVDLDEAAVEALAGQAVEYEAAERVVADPAQPGHREAEAGEADGDVAVGAGDALAELLDPVQFAGLFGDEHGHGLAEAEDLEVSHAGVPPGAGRRRARAAMCRRLRLSRSSPCSGYSMARATPSGKCCSRRCQYCRSAADGGTATSLPSRLRITALQCT

SEQ ID NO: 25825 - protein, 888 aa, Pseudomonas aeruginosa
LRFGRGPPLPSSSWQREHIFCAIALPRARSAGASGPGTAAASGRESRAERQPASQRLRSVMLPGPPQPAVDVVVGHAALDHRLAVGQVPATAGPGQRVEADLLGIAGIMALIDRVARAELAAGGVPDQLEQLQALLRLQLGTAVVAVHQPPCLAVAQVGGARDGDQRGAAEGAFQQLADTLPDLRHLDAQGIGVLQARHRRPGGVALRVAGHGGGQRLQQVLQGDQLAEGRLYPAEALGAIGAHAEGKQADHQFQLHPEADAGLEVVQVGEARLGIEAGGAAQVAVDQDVLPGNQRLVEQQHAVVLVETTGQRVVEGAARALLVGWPAHQAQAGVVHAGEEHQGEVLGLAGLHLRRGDRGDEGGVGDGAAGGEHLRPADDDTLVGLAFDVDEHVAHLVDRLAAVQRRIDDRVVEEQPAVGEGAVPGAGVLPVVAVEAGAGLQPGHERRLVVRGTPHEAVGHARPAADRLARAEQVLGVLRGGEEAVAAAALGIDPGEDVALLAVEAVVEPGDAAAGVAERPVPGDVGDPFAVEVDLATVAQAVEIVGAGHQRVGDGMAHAGSLSGRRPWRARPAGRSVALQVRVAQRRLGVDMHPPQVARRAVDEGLATVQQGQVVGDHQVVAAPAVGVVRLWVVQAAAQAGEQFAALFRGDAVVVELGGVDEAGVALDRRFAETQDGEFSARVALDYRCRRAAAVVRRAALVPAAGATPEFQLATVGQLQRRRGRAEGGAAAVAVAGRVDTVEQLEFRDRLQVHAVPVQRHVVVGEDVVLGAFLFHQLEHRAERPQHDFAEVVAVAGQALGVGEGGEAAQEQQVVAASQALEPLRRQLADVHAGAAGLQQQAEARLVALFVAQRRETYRLIAEIGVHRLAPRAQATAARRAALAGRR

SEQ ID NO: 25826 - protein, 84 aa, Pseudomonas aeruginosa
WLPELRGTYVLFLRLPATVGSSKCATVPTVNITRYVLDVNLCAYLDHWTRLIGTQIVWASTRIAWSYNCDTNFPMWGVDRFLEK

SEQ ID NO: 25827 - protein, 255 aa, Pseudomonas aeruginosa
SIPSRILENPPMPLPALPLPALPLDALLTGRAQPFTRPGSRSGIAKSPRDGALRVTPVGLEGDEQGDLRVHGGVKKAIHHYPREHYAAWIAELGEHPLLMQAGAFGENFSTSGWSEADVCLGDRVRAGTALLEVSQGRMPCWKLNDRFEVAGMSLRVQESGRTGWYYRVLEEGVVAAGDILQLVERRHPDWSLLRLSEVLFDRRADAELLRQCLALPLTPSWRRTLERRLEKGQVEDWGPRLEGAPGQAETPRPT

SEQ ID NO: 25828 - protein, 209 aa, Pseudomonas aeruginosa
ATQTSAKGPLFMLRLSMPALLLALAGCATKPPANPDNLCEIFREKPKWHEAALKMQQRWGAPVQVPMAMMYQESSFKHDALPPRYYFLGFIPWGRVSSAYGYAQAKDETWADYKREAGGWGASRDDFADALDFMGWYIQKSQRVNGVSKWDAYGQYLNYHEGWGGYRNRSYDAKPWLKNVSQKVQSRASLFGAQYRSCQQELSRGGWFW

SEQ ID NO: 25829 - protein, 141 aa, Pseudomonas aeruginosa
SGSSSSARCTRKGPTPTPNARPPATTTASPGSAASSARPASTSCRSCSTCSPAACRWSARAPTPPRPRPPAFPSRRRSANTARATGSSPASPAGRRSTATGVRPTPCTRSRNAWNTTSNTSPSGRCGSTSTSCSVRCQPYS

SEQ ID NO: 25830 - protein, 404 aa, Pseudomonas aeruginosa
PEPVAEDLPAYRRAAGRRPPAHGDQPRPAVPYPGRLPRGQPQRPGPGPAAGADGTQYRAGHRRRRAACAGALRRPGAVADPSRRPPDPRRAGLRRGGGRGSRTRGPRVPGDLRHHPGARRDRLRLYRTGRPAGQRLPGRTLRRETRPGHRPVLPGQRQVPVERRHVLLPGRHRVAGTGAPRAGGADRRPRRPGRRQQPGERPVPPARAGRRGLRRGAGHLRRLRADGALGQGRRGALLHRLERHRLLAGAARTQRGGRERQPGTRRERAARRQQLLHRFAEAPGRRRRRARPDHRRHPRRPAGGRRGAQPGRQVRRPGTQASRPRRLPPAPHGQPALGHLHRARGRPPLQDQAHRGAPQGFAVVADAPPSQRALDRAQRHGAGGKRRARVSPQHQRIHVHPRRA

SEQ ID NO: 25831 - protein, 349 aa, Pseudomonas aeruginosa
PPPEQSGDHRPGDDRGTERRVPRRGRHRPLQRHLRSRPRQRREESLMRCALVIPTRNAGAHLDRLLPALVAQRRQPDSILVVDSRSSDDTVERFRAFGARVEVIEPASFNHGGTRRWASQQVEADALIYLTQDAIPASPDSFANLLDELYAEADIGVAYGRQLPHPGAGLLGAQARRFNYPPESRSKRLADASELGIKTCFSSDSFSAYRSDALAAVGGFPEDVIGSEDAYVAARLLQAGYAVRYAASAEVYHSHDYRLLEEFRRYFDIGVFYGRERWIRAAFGGAGGEGKRYVLAEIQALRAAGALYRVPEIALRSAFKLLGYRLGQLERHLPVALKRRISMFPGYWK

SEQ ID NO: 25832 - protein, 375 aa, Pseudomonas aeruginosa
LDPADRDQQPPGAGDAEHPARPYRRRRTPAHRPTDRPPGGRALPRGAGQPAAAGGPVEAHQVLCEEGHRRGVRRDSRDPGNLRRDRGNHRGRAPGQGPREEIRGHPCGRLDGDGDQLHLERAGSRPGSGQGLDRDLHGRAHPGARPQEPVRLLRGADCRQRGADQELQGADPQAPQRDRRIQHRGPPAGPVRADQRAARRAFQLDPPDRLLRQRPGIHPPATQGAAQGDRHGAADRAEPGAAGPAPAAQPEAPGTRRHDAHLHRRCAAGEGPGRLDPCPGEGSPGRRRHRAEFRGPRAEHPDHSPGTGPAGRDQQQRGPAHPARGAGKAARRTRGATARSAGHRADPGAPAARAERHRAQLRAVRRQPGEIADRP

SEQ ID NO: 25833 - protein, 464 aa, Pseudomonas aeruginosa
PSSPRRSARSTGSSSTGAASRCRARSCRPSPATGARSDADRPPRAPAAGKEWHRRLRQSFPQRPAGSRHRSSHAARRRGGRQREYRQPAGQRRLERLRPGPCRTRRRPPGRVHRPARAAQALPAPAAERHGARSGAHGLAPRAPALAAEPAGTPALSPAPGRRGARRPADPARRACRGPGPDAPGDPHRPGRRVPGPADAPAARAGRGDQPRQPGDRHGAAAVAGHPAPAVLRIHLSRQRHRGPARGPRRPVRQRAGDAPARAPDPGRRHRRGNGLRRRRQLPRPVEGTDRRAWPGRRHRLEPEPGRRGHPAYHPGPPRDGPAVPRVEETRSARPAARHQRRPVLGGSLRARRDHLGRSRLRRGSRQRQRRHLPSGRRGSPLRTVVEPRSRTPPGTGLGRARRSDRPCADLAAHRAALPGTVQRHGGNRSWHVRDSIWAAARCCSPWYCCWCSGGVPPTPRSRY

SEQ ID NO: 25834 - protein, 138 aa, Pseudomonas aeruginosa
SASGGPRPIRKATPSCSRPAPSPCAWSTRRSRWFPPAWPSSARCPTAAPCSMPSATWAWRASAPSPPTTPIPSCRKATTRGTWTSSPTPTRSTAPCATPACRRSGAPSGAGRPTRGRRSCRTSLASKARPTTCCVAWR

SEQ ID NO: 25835 - protein, 464 aa, Pseudomonas aeruginosa
LPALRATAARRRPAVRAHRAQRRVVPRCRHLRPPAGLGAALRALRPVALPPLGTPGDEPGGSGRRRDRERCAAAQRDARAPGASGGQRGRLRALRRRPADARSAARAVPRQLRIRTERRCRGMDARRDPAAGLGTLPRGAHERLRLCAAGGVGATLERSAHRMARLRSRPAATAIEQFGVPRRAAPWRRFEAEGARGPGRRAAAGEYRAGRFRPGTAGRRGLPRRRIRRAARQRRGAPVARPGACPRAGRERPRLRTSRARLERRRQPTGTGLRRPRRRERRHAHRTRLPHRRQLAALGHQPPGLCHGAGPGKPARHAGDPLHRGPSRRPAAPAGGLPAVGLPAHRDAPAAPAPALRSRVPPTRLARTGHRPVHQHLQHGPAATAASAGRALCAADPRSVPDHPEELPRQPPQGTGLSDQRVPVDRLCAACRRPCLDPFAVQRRRGCAAVSRGRRESPGAAQPG

SEQ ID NO: 25836 - protein, 664 aa, Pseudomonas aeruginosa
RLLRRTRRPFGTRPAATILAAGGYPRTAQERALVRQCLGPGARPGARRAAAGAGRQPRPPARGTTRLARPARARRARRRRTARAVPPGRAALATVLRGRLRPAGGRGAERRHAGGGGQRHLAGRSHPAVGAALLAQRRRRPGTPDAAPGRCAARSLGGRTHRLGRALQPRSLPATAGRTDRGTELRMSLGNLVAVVFGLAFGGALLMLSPAKAGAAMVGLAAAVTILRFPFWGLLLFALVATFMPYSTVNVGIRSTVSEAILALTWGAVLWHIFLSRLPPAPAVRYRSTERMLLWLMLFTVLPFVVGQVSIKAEASGLSNWLRWLLNLSIVFLAGRLLVERKNRETLVIALLLGTLAMLLMSIAVFIRYRSASGMAPILAMFNYANLDTLKFGLEALSSRMGSPWMHPNATGGIMALLLPLAFCYGVANQGWRRGLGLAVAVLGAAAILLASSRGAMLSLAVVLFWMSLRKVPYTGRLLLLGVGLVVVLVLSYPPLQERLATIFSPQNASTEVRFDEYRMFPKAVARYPLGIGFKVDPPVPGTDLLGISNLWLNFMYKVGLGGMLLFIAVTWRWWREARPEKGPIRLTRDNAIWLGSTGGILAALVSGLFDHYFSFAVVMIGLFWLLVGINLLEARRLFPERQPQPRAVGYRKLKRQLERGAEA

SEQ ID NO: 25837 - protein, 475 aa, Pseudomonas aeruginosa
DARLRLLADPCHPARPVPGLRPRMAAGGLLGRRRAQRRLPHRPVPARGPAHVAGRRRAQRGGPATVPRTPGRTSPRLAGGNPPGAARYRRGAQPPAAGGGALAGALARPGPGRDGQRPGRGQLAGPRLVRAGADAPCAIQHPPAGRRALRPGRARLAAVQSTAGALPGLARPGQPARTTGPGLPARQPADAAGAAAFAMDRGLAALALAPVRHRTGRAWRAHRSAVAEQRRQPGPGAGRAAGGLAARRRRGDLGQPGAQADEPAADRPDEPQPGVARHDEPTPGWRAPGPASPRPGDRQPADPAGRGRAGRCRTRPGGPVAAAADRRLAVAGAAGLVRRATGVRRLECLAGALRLRRRRYSPATALRAARQRAERRAAGGPAVDFRTAGDSPRGPWRGALHRAAADASPGPARRPALGPAVAAERPGHGTGRRPAVPHRRHLAATGPGHRRRLPGAARHGALAAALAHRLTHGSG

SEQ ID NO: 25838 - protein, 255 aa, Pseudomonas aeruginosa
  UNSURE (227),(237),(244),(248): Identity of amino acid at the above locations are unknown.
NMEHRSEILKKGEAMTSAAVETTPLTCDVLVVGSGAAGLAAAVTAAWHGRRVVLVEKDPVFGGASAWSGGWAWLPRNPLARRAGIEEDIEQPRTYLRHELGERYDAARIDAFLEACPHMVAFFERHTHLRFVDGNGIPDMHGDTPGAAEGGHQLVAAPYDARQLGPLLPRLRKTLRETSFMGMPIMAGADLAAFLDLTRSLPAFLHVARRFSSHLWHLLRYGRAMHXVNGVALVARXVKSGAAXGACXCGLPKGS

SEQ ID NO: 25839 - protein, 459 aa, Pseudomonas aeruginosa
RTLRVNHQSGAKRIFRTGDSPLGRAAPNVTSAHYANPWCYGQIAMASRVSLLHHRRHAMTAATCGWVTMSMRELDRLKVIEAIIEGRLKPAAAAQRLRLTTRQVHRLVLRYREDGPAGLTSRRRGQPSNRQLSPGLENPAISLIRRNYSDFGPTLAQEKLVECHGLKLAKETVRRIMVDAGMWVPRKQRPPKVYQPRNRRACCGELIQIDDGKPLAFYSDKASVFRSNHKAPQGGDGYTQFGQAMYELNIESCANSSQAKGRVERANLTLQDRLVKELRLRGISNMADANAFAAHFMASYNARFAKPPRSEHDCHRPLHSDEDLELIFAWREARRVSQRLTVQYDKVLYLLADTPQSRRLAGDHVDDLPLPEWPHRAQGGRHRPPLYHLRQTLRDRPGCHRREQALGSCAASRPARPSAARQSALAIGTGKSAAVNARQDAVEEGAARTDAGRYRRCPG

SEQ ID NO: 25840 - protein, 425 aa, Pseudomonas aeruginosa
PVADTGWIHRVLPGRDQTGTRAHRHRPGAVPAVLPRPGSRGAAQQHARATAVLRRAHGDHVPGTGRLLRRYLQQPPALPHHVLRLGLGVLPAVVHVPGPGPVSLPQQQAGDLLVHRQPAAVRRAAPAGAAPVPGLDETRHVPATDGDPRLHRERHAPGRIPGTQPRHPLRHHRLHRRPLRAGPGELQLAAAAGQHQGPGEADPPGTGRPGAGRPALVRRGAHRRHRPSPAAIAGERPAGAGHGCLPACPQPHRRCLRDPHVQRVRAAAARLVAADQALRGSGPGEHRAGPLRPADGPGGPGDQARLQGAGAVPAETLRLQQPVDLGLQVPLDVHGKDRRQRRTPDHPRRRPHHPGRPLHPQDQHRRAAAAVQRARRQHVDGRPAPPRHRDQGRRHSLRGGGQRIQLAPPGQARHHRLGADQRLPG

SEQ ID NO: 25841 - protein, 533 aa, Pseudomonas aeruginosa
DRHPAQDQETRGIRPRIHRQVVGVVRPLHPVPYGASRTPDQGSLLMNAVAPLIPCIVSGGSGTRLWPVSRESMPKPFMRLADDQSLLQKTFLRIAGLPDVARLLTVTNRDLLFRTLDDYRAVNRSGLAQDLLLEPMGRNTAPAIAAAALHVQEHFGDQAQLLILPADHLIRDEQAFAAAVAEARGLAAQGYLVTFGITPERAETGFGYIEQGAPLGNGFRVARFVEKPDQATAQSYLDSGKYLWNAGMFCFQAATVLQELERHAPEVLIAARAALADGSSLENGQCRQRELAAGAFAEAPDISVDYALMERSDKVAVVPCSIGWSDIGSWQALRELSAADENGNQVRGESVLHDVSNCYIDSPKRLVGAVGVHDLIIVDTPDALLVADAARSQDVKFVAQELKRRGHDAFRLHRTVSRPWGTYTVLEEGRRFKIKRIVVRPKASLSLQMHHHRSEHWIVLSGMALVENGEREFLLNTNESTFIPAGHSHRLSNPGIIDLVMIEVQSGEYLGEDDIVRFNDIYGRAPASDEKKA

SEQ ID NO: 25842 - protein, 182 aa, Pseudomonas aeruginosa
PRTPFPPRPTVSPTCSTNSMPRPTSAWPTAASCRTPAPACSVPRRGASTTRRKAAASAWPTPRNWGSRPASVPTRSPPTAATPWRPSAASPKTSSAARTPTSPRACCRPATRCATRPAPRSTIPTITACWKSSAAISTSACSTAASVGYVPPSAARVARASAMSSPRYRPCVPPVPCIAYLK

SEQ ID NO: 25843 - protein, 1242 aa, Pseudomonas aeruginosa
TDAVHRAQRRQHLLSVHRSHPGRAPHAAGNRQRADHQARADLPRAAGHGEHQPGAGQYGVRRRRGAQPVGRADPRRQQHGAGDPRRRRHPAGGRRPPRGAHARGLGRPLSRLLPRLQPVDEDRAGRPQAPGHAAWRHRLRAQVDGRRPYRGRRRLPEPVAALRQVHRRRRQLHRQQRSLRSDIAMIEIRSLRDLLRLLFIYQREFKLAALSAVVIIVLGAFLLPAKYESNARLLVKPGRDSTLPIEISNRQALVMPSTQRDPIVDEERLLTGRPIVRQVAERYLEVLANRPPPEGLWKRTKFYVKKAIGAVFDGIRVTLETFGVIEETTAVERLAKDLEKKFEVTHAAGSTVMEISFTWSEPEVAQEVVKAWIEIYMEERTQALGRKSLYAFYEAQTADSAAQIKSYKAQILKHLNEIGASSIEDRLQDLSERINVLRGERFNSIRLIASSDSALESTRQQLKGLPREIVTVRQIALNPAQQDLRRLLNQKRLERADMMRTYTDDAPPVKALDASIRALEKEVQDEGATVQSSEDRAPNTLTTHLERVLLDETSNNAALRTQLAEQEKQLAELEAQRREALDIEPTLARLQRELNATERNYALYVDSLEKSRIDRELDKSQISNISVIEEATYNPGRIFPKTLLMLFLAVPFGLAVGLLVVYLCYLLDQRIHDGGLVEEKFGLPLWTTLPELSNSTAESSNAFTASIYRLYGLLPYARIEEKGLTLGLTSARHGEGVTFIIEQLPRLLEENGVRVRIGGEPAQPGRSGIARRAGPAGQPRGLHRPAPRRPDRPGGRGAEEHRAGGRACADHPHHGVRQGRRDHHQPAPLRGAEQGPADHRPLPERVLMRIALLAPLPPEKNGIADYASHFRNALQGLGIEVATPLAGVAADSANIASRLDSVDWNAFDLVHAELGGGRLGEFIALRELRKRFPRLPLSATVHDPERMVWRRERLPWPLNLLERLPSPLPQAAVVLADPLTLREERAVAQGLTRLVTLTGLGGECLARRMRLPPGRVEVINHGNLEIATVPLPSLDTLRLLYFGFIYRGKGIEDLLEALADLFASAPEMRQRVRLTLAGGTAAEMAFGAGGNYLDQLKAQIAELGLADAIDWNLNLAAADIPRTIQAHHVMVLPYRESKKLGLLGQQRGTSGALSWAAACGRGAITSDARAFAEEVASGNGAIYPQGDVAALSEQLLNLAREPRLAQAWAERAGAIGHARTWPRTALRFQALFNDMVGTVHGT

SEQ ID NO: 25844 - protein, 1209 aa, Pseudomonas aeruginosa
GTLSGRQRAAARRGTAAGVLGASRRRRDPGTEGASRGGLERLPRGQRAVPLVQPGALQQADRPPAGPGAGVGAPGPALGPPGNRRGPVPAGLPRPVGQGSRGAPAEVGVLPGRLGPLHHHRAVLLALPGPVSAARPGSLRPAHGDALAALPERGRLAGMERAQPDRLLAAQGRSGRLRQAAPGQHHRPAHGRPGEAGGFRRHGLLQRDARRPHHVRCPRPPGRGEPRHHRHLPPLYPVAGRQLPVEPGLRLPRQPDQPRPAQRRRAGDLEHRVGLVGLQGAEGVAGHHWRRRPGRLRAASPGADECAGLRPDLPLHPQRSRPARQRARPRLRPARPGRQPQAGLPGPATLPQGHRAEAAPGRPAGHRGPARRFLQHRLDPRGRSQRLAVLVGPRRQRAPTEAQGGHPARSTQRQGHALERQRRPGSPGEVQPADAGLGVKPPMRILWILPYSPWPTTSGGKTRQYHLLRSLAARGHRITVLLHSKQPVSAEDRQALEPFLERLVVLPRRPLRSLSTLLAALFAPYPLLASVNGLSAELQRTATELLREPWDVVQVEHSYSFQPYERPLRDAGQPFVLTEHNVESSLGAATYDRLPGWALPFVRYDQWRYRRWERRVMSQAAAVVAVTEKDARQLSAMLGRPVPVVVNGVDCEHFAAARPTPEAQRVLFLGNYEYAPNVDAVEWMLDEILPRVWAHCPEARMSVCGYALPAEWAQRWSDPRIEWQGFVPDLLQLQSSSSVFLAALRHGGGSKLKVLEALAAGLPLASTAQGVSGLELRDGEDYLGGESAEQLANAVVRLLHDPAHARALGENGRAYVRRAHDWSVAASQLEQVYAGLAEGSAGMRIGLDYRTVGSSPHSGISRQVYAMEQALESLPGTQVTRFTVAPLDDPLRQRAVCPPWGCPRTAMHQPHQRLRFEAGFLPRALREQDIDLYISTFNMGLPLPPRPPGVRYALLIHDLFQITLKNYHANRLKALVYRISEYLSIAYALRVADRVWTPSQYSADEAVRLFPGVAGKVRVLPNQVDGFSGEPADLSARGLPPRYWLLVGTRELRKNVPWFVSAWARARAQAPGVPPLVLVGSLDHLPEEQRGLPGLHALGGLDDAELHALYRQAERLWQPSYAEGFGLPVVEALSVGTPVAVASGTSLDEVTPPSAPRFSPSDGAALERLMLRLADAPREASAEELIAWAARFNREAYRQRLAALIEELS

SEQ ID NO: 25845 - protein, 514 aa, Pseudomonas aeruginosa
SACSGCWSGSTCWKPAGCSRNASRNRGRWVIASSSDSSSAGPKPEMLGSAFWLTLATLLGLCLGFAREWLLVASWGAGERSDAFLIALFLPEALRMSLAGGVLSAAALPLFLERQGERRLDWLAAILPALLGIAVALSLLLLAAAPWLVRLLGPGLAETASAQAAANLRVLAWCVPGLMLHALFSIPLQAAERFVLAGLGSLLFNLPPVLYLALHGQASQPEQLALACLLGSLLMPLVLLPSLWIEGWRPWHWRLSGTELGELGGRIGPLLLSNAASQGLALVERLVASLLGEGAVTWVNLARKLMNLPLIALMSLNQVLLGMMSRRQGGERLALLRRGLETASLLTLPAGVGLVAAAPGLVALLLPQQTAGSPLPALLAWFAVPLVFGAWNALLARYAYAAGDTRLPLRCELLGSALNAALLAVLPLIFGLPGIPLAALGGVLCTALLLMRRQALLGALPWARLWLLSALAMALAAGLLFRIDGIWLQLGLGTVAGCLALLGMALWLRPWRTD

SEQ ID NO: 25846 - protein, 420 aa, Pseudomonas aeruginosa
RVKRELQSEKTLDSDGCDPRRGHPDHRLRAQLVRRQFADRALSVALSVHPATVLLHFRGFFRTEQPFGEMALRKADALLKPFFVTMLGYVILRDLLRGQPLLPDIGGMLYASVDTLPWQALWYLPHFWVATLFAWFMLRVIHRLGLSLAASCVLLAVQLGLGILFLKTFWQIPVEFGGEQYLLPGLPFSLDITLISSAHFMFGYVLRDVLRRHQSSLLTLCIALAVTTASFLYYPTVVDMAQRRYDHWFWATVQAVSGVYLCWALSGLMMKIYWLGQGDDLHRPVDPDPADLPRGDPAQDLQPAGPPGPVGTGRCQRRPGDLGDRLAADRRSDQARRAAARPLLPLPGCARRPPRSRAAAKRADALGPVRLRRAFPLPSPFSLTGGRPRFDLADDRPLLSPSGLVRGHCLPRIWNIVPKS

SEQ ID NO: 25847 - protein, 144 aa, Pseudomonas aeruginosa
SWWRRTRCSAAPAPGPAAGPGCRATRWRVAPVSRRTSSNRVPTCATNWASVTTPRGSTPSSKPARTWWPSSSATPTCGSSTATASRTCMATRRAPPRAATSWSPRPMTHGNWARCCRACARPCGRPRSWACRSWPAPTSPPSWT

SEQ ID NO: 25848 - protein, 67 aa, Pseudomonas aeruginosa
ELEAELASRVTKKEEAEAKTWAIQERKGKARWQTISKGLTRKAGERQFDKLLSGLTDPRYTYRMIEE

SEQ ID NO: 25849 - protein, 119 aa, Pseudomonas aeruginosa
RTLRSPVAWRVITSMIYHYPNGRIEPRVDGTALPFTTYDKLCEIDQGAIVENKRLGHVLQVAQLVQAQRDNRRSQSVPGNPRQSTQGKMLSKKAQRELMPEDIAAALDNTPPSRRSRHA

SEQ ID NO: 25850 - protein, 124 aa, Pseudomonas aeruginosa
YLLALVVFGRQGEMCRMKNTREITKTFKHIPTLCYQFSRNPVGLLCLVILQCFLHLLVVEFYRGGLADWGRLPIRTSKTCCRPAEALTVPACGSFLYGNSVIIQFENDIARHIADATDVDLHMT

SEQ ID NO: 25851 - protein, 546 aa, Pseudomonas aeruginosa
VLGTNPRPPRLSTHPDGSGGLTAGEGLADSILYLVDTISHLREPSHAPACPTPACPTPGCPSHRPRPALHPPRLAQRHRQVSARRCAQGHPRRPGGRRTGRPARPWRRQESDPPLPTRTLRRLDRRTGRTPPADAGGRLRRELQHQRLERSRRLPRRPRAGRHRAAGGVPGAHALLEAQRPLRGRRDVPEGAGVRAHRLVLPGAGGRRGGGWRYPATGRTAPSGLVVVAPVRGAVRQAGRRRAAAPVPGAAADAILAAHPGAAPGKRPGRGLGAAPGGSPRPGRDAQADLRKRRPPPRRQGIGLGMHGVPESGYKAPALSDPDVCQRTPFHAAALDAGPAPGSCRLRHQAPRQSRQPLRDLPRKTEMARGGAEDAAALGRAGPGADGDDVPGIVLQARRPAAALLLPRFHPLGPGQLRLRLRPGQGRDLGRLQARGRRLGRQPRRLRRRPGLHGLVHPEEPTGQWRLQVGRLRPVPELPRGLGRLPQPQLRRQAMAEERLAEGPVPRLAVRRPVPQLPAGTVARRLVLVARSAHAAGSNLFRLRRG

SEQ ID NO: 25852 - protein, 506 aa, Pseudomonas aeruginosa
KIVTKLTLHRLALPYPLNGLPVIGRANNMHSKSVDSLSLTRAGFIEYFLVATKLVHALTAIAPALFLLYYPGLVPVELRSNMLGLLLFFGALTVIMFQALDVYSDDIFSNRLRFRIMFFAWASAFCLLLFMYQGLGLFPYLSSKLVIFWFTGSLLLFGVQRLLVLRLYRAWMKRGMYLQRTVILGFTESGMHLAEYLVRNHDIRSGIIGFIDDRSERVPENYNSLPLLGNTKDLEKLIRQEQVDQVLVALPWFAEGRIGAIVHRLRQLPVNVLLVPDMAAFRHAHNRIVDVSGIPMFNASELPLRGWSPLIKRCEDLVLGSIALVLFAPLMALVALAIRLDSKGPVLFRQKRYGYNNRLIWVFKFRSMYTERTDANAERQTTRDDDRITRVGRFIRKTSIDELPQLFNVLAGSMSMVGPRPHATATKAAGIPFEEAVSEYSSRHRVKPGITGWAQINGYRGETDTLHKIKKRVEYDLEYIAKWSVWFDLYILFRTVPAVLLTKEVY

SEQ ID NO: 25853 - protein, 299 aa, Pseudomonas aeruginosa
RVQAARLPPWPAGTPPAGRPQAPHQHVSRLLEVNIMTYRKCSLMKRTLLMLAMLALAACNTPARIPAPDSDTVDSGKRALEELARLPPAMERVRVGDTLRIVRDAGEMPTLSAFNVATIYELTLYTVLNDGSIYYPFIGRIQAAHRTPQEIANELTTKLAPIYREPRVTVNINQAPGNTVFVGGAVRNPSAVPIPAANNMEQAILGAGGILPVGDARRVALMREDSEGRYHAYFLDFSQLMKIGPEGRKPLAMQRGDIVFVPKSMVGDRIEGVDVYLNQLLPFAKSIGVGVSYTVNNDR

SEQ ID NO: 25854 - protein, 109 aa, Pseudomonas aeruginosa
PSSSSNCPACWRKTACACGSAANRPSRGEVVLLDAPALLDSREAFIALRRADLIALVVEAQKSTVPVVEHALTILTTAFGKVDGIIINRRRFEVPSKVLQTIARYRSAF

SEQ ID NO: 25855 - protein, 485 aa, Pseudomonas aeruginosa
TSLANPAWHRPGPSAPERSAMRGPGRAPRCASRHCSTTWWEPFMARKGLYLGGSALLLAVVLLLVFWGRPADAEIQVLKAPRAVVWKDFLGVNAQFLWFSPERYNKQIDRLQDLGLEWVRLDLHWDRLETAEDQYQLASLDQLVKDLEARQLKSVFYLVGSARFITTAPFYSPFQDQYPPRDPEVFARRMAMLSQRYPSVAAWQVWNEPNLIGFWRPKADPEGYAKLLQASTIALRMVDPEKPVVSAGMAFFSEMPDGRTMFDALGHLGVESLGTIATYHPYTQLPEGNYPWNLDFVSHANQINRALRNAGVPAIWSTEWGWSAYKGPKELQDIIGVEGQADYVLRRLALMSALDYDRIFLFTLSDLDQRASVRDRDYGLLDLDANPKPVYLALQRFLKVTGPKLRPADPPVTEDLPDGSFSIGWTREDGRNVWLFWSARGGNVRLPKLKEATLHDPLSGKVTPLSGSDGLEVPVKSSLQMLVWE

SEQ ID NO: 25856 - protein, 127 aa, Pseudomonas aeruginosa
APRTARPWSPSSNAWSCCRADRCAASPRCSPRCSRPTRCWPASTACRRSCNAPPRSCCASPGTWSRSSTAIASSPTSDRCATPASRSCSPSTTSSRPSVPPPTTACRAGRCPSCATTSGVTAAGNAG

SEQ ID NO: 25857 - protein, 489 aa, Pseudomonas aeruginosa
VENVVGKPRRCRLRPGLRRSAADAQPGQGRRRHGRPGGRGHHPALPVLGAAAVRPGGDLHALLHGQRGDPFDGQRSDPRPDLGRGALAHLPLAPAAGAGGALPLHRAHAAVADAVHRAAVRGRPGQHQGRGQRPVELAALVAQPVHRVPRRTPAGGAQEPRDTGHRPAAGHPGDAADVHRGVHPLPLGVGDGADPGDVQLRQPGHPQVRPGGAFLADGLAMDAPQRHRRDHGPAAAPGVLLRGRQPGLAARPGPRRGGPRRRRDPPRQFPRGDAQPGGGAVLDVPAQGALHRPPAVARGRPGGGPGAQLPAVAGTPGDHLLAAERQYRGALRRVSDVPQGRRPLSAGNRLQGRPAGAGYRPPGHLQPVAELHVQGRPRRHAAVHRGDLALVARSPSGERPDPPDPRQRDLAGQYGRHPGGAGQRPVRPLLQLRRGDDRPVLAAGRDQPAGSPPAVPGTPAATAGGGLSQAQATARARGRSLRCSAPPSG

SEQ ID NO: 25858 - protein, 85 aa, Pseudomonas aeruginosa
VSASSGSCKVKKRWIQMDVTRGVGILIIVFGHSWFVASSPTVLYPLLSPFILPLFFFISGGSSGPSNPSARWPCARPTPCSSRSS

SEQ ID NO: 25859 - protein, 112 aa, Pseudomonas aeruginosa
RSTGWGKAMTYIGQSTLILLIFHGEIQHKTFNLLAHLGLSEPAAASVALVISVIVSLLIGEVIKRVALLRALYFPFPGAQEDRRGPGRRRSALTPSARCACAGPFPSRLPFP

SEQ ID NO: 25860 - protein, 222 aa, Pseudomonas aeruginosa
  UNSURE (4),(11),(21): Identity of amino acid at the above locations are unknown.
ARTXGCPGLDXARYQGHAIDXVHGATVAQQVPEVAGKAPGDMQEGRQRAGQVQEGGEVGAGHDRHAHERGLPQGLAQARQQRAQLPCVIGRGDQLVAALGGARRVAMHVRDAVAVDEPQVGVALEEGHHVRAGFEEGVDPRGVVTLAQFVAQVGTRLLDVLLDTGATRQRVARQPGPAAGPGAGAAEHRVLLHQDYPAPVPGRGHRRRQPGGAGADDQHVTG

SEQ ID NO: 25861 - protein, 658 aa, Pseudomonas aeruginosa
STGGRLNSSEPSPARTKRSAACRGMLNSAWSISPGTHQARTRKLAAAWALAVSARPGPSKRTSQGAAASSRRLSATAIPSSAGRIAASQSRRRSPWRSRNSGRAAALSTPPASDMRRASGRNRAMRKASLRSPAPQEATSSHSRAKPRHRPSRVARVSQKAEPSISGFGPALELSLELAITHRPRLRLAFREQPAGFQQVDPDQQPEQADHHHGEAEVVVEQAADQRRQDAARTAQPDRVVAGQADRAFLRTGFAPPAPGHRDEQQHAAEADLVHEVQPQVGDAQEVGTRHRRVDLEADSQRIAGDGLGEHPILVEAHLGTGVLRREDGRQAFLQRRVAEHQDHHQADPEQQQAAGVGHLAQGHPEQHHRQAEHRPAGTGEEDRGGAEDRHGEAQAAPPALVGDPVAERQGQQQGHDPAGGVGVHPWRAHPRGKRLQAELEGVQVGVVEHRQDRRHPRRRAVADEHRDGHQQHRQGAQQQGDDQCLAVLALHQQASGEEHDGQVEQPAQPVRQAAGLGLDADLADHERQHGEQHQPQQHALGGAVAHRRRRRQAREEDVPEHRAPGQGEDRFADRRTDPHVDRGVGHEGRHQGEQQQPPEREAQDGDRGRQADHGGAGLGRAEHQQRSAEGQAEDDSDEVSQRHSQLSSSISAASRCR

SEQ ID NO: 25862 - protein, 542 aa, Pseudomonas aeruginosa
GQVARPGGQPTVRRPACSLALRAAWAGCACGSMTQDGRSSVPIRLGAVLADATLVEGGRGSSPRRARTGLPEPAAARQFLLATAVLGAEQRGAGLDLLRDVLQPWLGVVAAVAVAAPALVVVQVLAVGVPLGDAIDPLALLDVPAHEVQGVGEVVAAGAPAAGLALVVGPGLVLGLGVAVGGADPAPGDETEEVVARRQGVVLEGRFLVHHRHRHLDRRAPALLHLQRRLVPFRFFAEDLAEVVGIGGGLGGAAGKSQEQGRHREPQHEKGSFGRRLGRLTLALYTRFPALHASPGRFPACGGAVGASSGRPGRLGLAGGSLQARPPVLDLAFFQAPLQGAPPGWRQRQRQALAQQLGVGPPVEQHLGQAQQRPVRMAPFDQLQDIASRHHAFLQHPVVPAGAPGLLHPQGHPGDLEAVVELPAGHAPLGHLQQRGAGPHAVAEADVGFAPAAGAEVLAEGARLHQQGVFAQFGDPGGVVFAWVMVDRFLDAAMDAQVALFVALQADGGDPERTVARRLGDAAARAGAGEGLGAAGEKGIQG

SEQ ID NO: 25863 - protein, 344 aa, Pseudomonas aeruginosa
GTCSVQGYIKNSRGEVNIDMVTEHIFDFEWRPLQNYLRDRDIAIPPFAAEQESRSDALYNWIVSKGYSGKEGLNLGTYYHISDYGVIGLALLCAENVGDILKVIRAYVKLFNRDIANVGVKPRENYEVEIHISVNFKPEWNDASRQFHVNVIASATYKLIMDLLGNDFPISALTVPVHGADKTIYEGFFSLPVKHEGNDIIFSFPAHQLNRTLATANPAVFQSALTMAGESFNALLEVEMGGLRQRIELFLDSIPDQYPSLVTTAKYLRMNERTVRRRLADEGCTYRQIVDKARKERAIALLLNSSIPVDRISDILGCSETASFRHAFRRWTGQSTTEFRNSFH

SEQ ID NO: 25864 - protein, 344 aa, Pseudomonas aeruginosa
AEETKVDRELDQTLQRNLERLYNYLENPEREEAQRVLLAAEPEPIRITHGIPDLYTDWLSSPSYSAQGGLTGQLTQVISQTAGRPVLVFDDYFKVHEVTIRTVAETGGANSISVSDLQVQLNQQINTFIQDRIDGDKADKVSRLQSNISYLIEMGINIDFTARHELPPGGRGNRATIPTSDPNGESGVTIGYGFDVGQHDESGIQALNIAESTRKKIRPALGLKGANTATFQALAQLIPVLTDEDGLSLFTAKMIKVTDRMKVKFQQWSTLPPAVKTIVTDLYYHYGEYSSFPNFETAISQNDWPAAIRELSNWNGTPNSTDPSDGIARRLNNRADYLQRSLGL

SEQ ID NO: 25865 - protein, 220 aa, Pseudomonas aeruginosa
RANSQWLFEGPQGQAPYPEPWVNRCARAAARAPCRAAPGSRRRCPGPVAARCRRCGTAGRRPVPWPGRSAATAGPRAGRRAGPGDASAAARCRAPRQGPRGESPAVRKSTAGPPAARRSARCRAARSAVAGEYRRRRRRNAPARHSRRRTPVARRTRPAAPATASRRSAAAATGPPGRVRQRPARPRPAGSAGWRSPGRGEAGPGARHPGVGSSCRATPG

SEQ ID NO: 25866 - protein, 213 aa, Pseudomonas aeruginosa
CPSAASCRRCGSRVLCACRRSLRRGRRRPVPVGWRRRSSRARDVRRRGRSRPARGHAPGRATGAPRRWRAARRIRRRGSPRRPAVPGRKRPARYSPAAARRPGPRAPSASNRRHGAARRGTPNCSIAVAAGRERSLAIRCADRSSVAPTPPAAHSRRRSCAPRGSVPRPAAGSRRASIPRHRRSVRIRSCRGTARAALRASAGRRRSARSRPR

SEQ ID NO: 25867 - protein, 409 aa, Pseudomonas aeruginosa
AHVAAAGRPEQPDVATVLAGPADAEGTVGQVLGDRRVGRAQLRPGDLEEALQGQVDRLGVGVQVEQAVVAVAHAGALVEIAEGEEEDPVVVQRTHQRQATQHVVGLAFDANDVLQLLRPLVGRPAPLGAPDRRHAGVAQGAVDLVGVGDEVQVPRVVAFRQLGIGVVGGDGAEALHAQVAEGIEHGAAVGHLAEEGHAGGNHRLLRVDHAQGDGAGLEQLGVAFRIGLGPPEADQVGLVPYLPGGHARVALREHRHAPGEDFRVARRILVLEGRVERRGGDEAGRADQVEHRLQLARLEILDQLVEGGQLVLVLGGFQAVPVQVQAHPLQPQVLQAVDLLVVTLRAEPEELRVDPEEVFPDHRARRLQYLDLGVGGTPPEHQQQYHGEQQRAAAQIESLTCHERFPPCR

SEQ ID NO: 25868 - protein, 138 aa, Pseudomonas aeruginosa
VRAAPARSRCRSSRWSRAPRRPCPSAPSARSRRRCPAPRRRPRRPARAGGTGRSPGCCRRPGRRGRRSAPPARGAPVPATRWRPGSRTCRRSTGTCRCPGRTGRWPGRVSRRSVRPGSRCPAGRPVRYSRSRSRRAPG

SEQ ID NO: 25869 - protein, 453 aa, Pseudomonas aeruginosa
RVSACSPGKPATGGSRNRRKRCRGSAGRRRSSVDFLGQEYGWHRTEQDVEVEPHRPLGDVFEVVFHAFLDLVQGVGLTPVAVDLRPAGDAGLDPVARAVFADRLLEGNAGGLGRGGVGARADHRHAAGEHVEQLRQLVDAGLADEAADPGDAVVVAGGLAFGVGVGPFRVHRAELEDPDQPVVVAVAFLPEQHRPLGVEPDRQGHQGHQRGEEDQRDAPQDQILAALDQRRPAAQRQLGRVEHGDPGDIDDAVVGMPEGSHVRHQQDVHRQLPQAMDDGADAPLGEPGQGDQHLVDLFLADQLLQVLGVAQQRQRVVVLRDPLGAVVDEADDAGADVVVAYQVFGQVHAALGEAEDHRPLQVHAAFHPGPVQAQHQQALHAEQQQAAGEPEDHQLAAEVGKQAQALVHEQQQAERRGPGEEHDAEAQAVAEDIVGVDVQCLEHDHRERAEEQQ

SEQ ID NO: 25870 - protein, 417 aa, Pseudomonas aeruginosa
LGRDELAQTERSTRMINKRNAIFLSMILIFFSIACIGSAGVRVWNFYTLFDSGKIAENFRAMPRLFNSVPVKKSGAAHFFEKNLRDMPGSFSFQGHEVGFKDWLASSNTTGLIVLSDDRIAFEEYYLGNSAKSLAIGWSLSKSLMSLLIGMAVDEGSIHSLLDPVNLYAPQLSAGGYAGVSLRDVLEMSSGIVFSEDYGNSDSDINQLGRTIALGGSVNEKVSSLRREDAPGRVHHYVSVDTQVLGMVLLGATGMGPSQFMNQRLWPQLGAECEGAWLTDDRGTELAFGGVNLCLRDFARIGLLFLHGGRSLTGSQIVSAEWVKASTKPRSAHLRPGRYIEDGEPNLGYGYQWWIPEGKEGEFLAIGVYGQFIYVNPLRRVVIAKTSAYVDYNVDGIRMEHEALAAFRAISRTVGVR

SEQ ID NO: 25871 - protein, 270 aa, Pseudomonas aeruginosa
ISRSDQQKNHPIWDHPAPHLAAFMQGINMKLKSISIFAILTLYYNITLCVAEEPKSYFPPGDYYRTGNSGLLTISPLFEGLQKFRIRSTGHNAHACGLNGTIESGHVQVDVRGIGDMSCDVVFKLNDDRITIEKGAASRDCQGFCGAAAGFTGTYWKPSPICEPASIKFNDKQVKKALKNNETEKAYWISRKLITECRDMFEGFGYLSRVFHTAHLSLSAKNHQCKKILEKGSFFRDLKREYLPEKMQNEYDKYSTEFNRLESECEQSMK

SEQ ID NO: 25872 - protein, 162 aa, Pseudomonas aeruginosa; identical to SEQ ID NO: 24887

SEQ ID NO: 25873 - protein, 208 aa, Pseudomonas aeruginosa
TRSPAGSCAGAAAAGPVAVRHRARRPTGGRPRRRPACRHACPGCRCRRRTAGGCGARRRPPCAGRLRGRRRSARRRNARPVRGAGRYAVARCPPRYRRDAPAGCAATRPSRRTRRWRRRTPGPSPPGLPGARARPRSPPPPARRRRSRRPARHRLAGWSRRPQRSWLLPFSRFRNDVPYSREAMPAYQPARRKERAIIGQVEARSAAR

SEQ ID NO: 25874 - protein, 305 aa, Pseudomonas aeruginosa
IQRFFTLQLPLDALTHSGCSKAPRARLPTRSHGSIGAPGPQPERHAEQRQAAGDGAQAQLQPDAVDAEQQAGGQCHGQGAQQPQPGPGQGAEQGLATHQQQRGAEHPAKGREGNPRQSENQRQDRQQRGVQRAAEQLAAQWQASIAGGVGVTRQQGIPGAEHQWHGEPGQQRRQRRAGGLLRQQQGHQAGCGSDQPDPGRQGQQAGGLQAAAKQGQALATLASAHHAEQHLVEAHQGDQRQVHQLARQVDPGHRAFAEQRGHQPLDQRQALAGGVAQQQRTDAPAKLAQFGAGQAPVPGPPALDP

SEQ ID NO: 25875 - protein, 598 aa, Pseudomonas aeruginosa
RQAHVEGADVQVDVLFAQGAWEEPGFEAQALVRLVHRGARAAPRRADRPLAQRVVERGHGEAGHLRAGQAFQGLLHGIDLAADARVRRAADGAVVESYAHAGAPFGEAGVDLFQLAGGDAPVVRATYVGAAVLAQRAGMRRVVQQAHHGVGELLGGFAAEVVLAVPQFQAGNALRGTRQRQPGGQGLEHLQLRTAAMAQRGEEHRTARLQLQQVGNEALPFDARIAPALRPLRRQRIAADAHARLGAVCPDPRQDLVEHPFHGIDVRCVFVVAEEQHALRFGRRPGGGEVLAVDPVDHHWHRAPEHRAELPRIFLGHGDDRCRLAHHPAFPAAVTPLVVAHEGQRPARQAVVGGGTEGRLDVVLGEHERLAGVAQRSLVGLEAIAVLDLDHVPGLAQQLRGGALQLRRQAVDAGQQRVGREQRGEQRGEAAQRSARQHDQAFEEGLQGLAVLGAHRLLAVQQHGDPVAACREAAQQVVLAGLAAAGGGPGRVGQDPENTHGWLHSQTSICRLDFTGTSRPSLPLKGVTLPLSGSCRVASLSFGRRTLPPRADQNSQTLRPSSRVQPMLKEPSGRSSVTGGSAGRSFGPVTLRKRCRAR

SEQ ID NO: 25876 - protein, 403 aa, Pseudomonas aeruginosa
SPLRAMNGSHHVVEQCLEAQRGARPGPRMADRSGALGPGLCQAGFASEVQQLFGEGCHVSLRVDGAVAAGDFLGEGASVRGDRAAPAGCRPGQGAAGAALLAEQTEFLRLAVRQDHHVVGLDGTRDVRGGQVQVPVDGVGQAKLGDLCLQLVEVVAAGAEGHFRGGAAGQGQAHALAHLRRAGEQVGEGLEQVLDAFAAIDESEVQQAQGVQRRQRHRGDLQVAVVDHLDPPGRQAHPPGQALAAQAGEGHQARQALGHGTLFAQGQRVGEHHGGLGQGRGQAFQQVQRPGQALAAPDHALRIVHRGAQRQAREALAQLAQGDELAQAAAAEFGMDQVEGVPVDAVQPAGDIRAVGRHAGERRGYFDAETLQGVAEMTGVVGDAILFRRQGREEGDPHQNALR

SEQ ID NO: 25877 - protein, 669 aa, Pseudomonas aeruginosa
RAMVCRTLLGTSKRRRLMMIPSTLPNAVVRMVSACSTTGTVLFCASTTRAIRSARRRAMKASRLSSRAGASSNTTSPRLGRFAADPHAHAVFLQQAGQLLDDEGHAFTVARRGQAQGQALFLDARVGQQPVQPVDAGGEGVAALRGAVAQLRQGGPQRQAEFLLDQAAVVDALVEQVAEIDHQQADGEAEGHGEEQHQQGFREDPPGVVGGFLDHRDVADLALVQFTVDPRFLQAVDVQRVVALGGVQLALQARQGRLDVQRFAPLRLEFGELLFLLRELGAQGRVVAGLVQQDPFQVSGQGVRRAVLGTLHGGAFVLDFLLQGTDRGVQGLHRRRIVGVGAHHVGAFQALLVEQPAQVLLRRVQRDLPHRDDLPGQPLELLAGGFQGAVGGGDQADRVETLAAQHVDPLGQVLQAVLDAGCADLVEVLEDLRLVALDLRRAVGSLRLVEGVQALAAERLGALFHVDLDPGLDHFLGDFRLAPGEADLHHRRAGRMGDLEFLLEVLGQALDRGGFLDHAEGFQGHANPVEHRADGLLHIELGALPQALRRRPVGQHLEVALGHLADDRSAGEQAFFVDDRVALGARHHQRLAVADLDRQGRVTARLDQQACVGLVLGRQQEGAEDDDHHRAEGRQLELALVDEQQAQQITQGTNFYHGDVAPQRSLLTV

SEQ ID NO: 25878 - protein, 495 aa, Pseudomonas aeruginosa
PGRSASGFLLVAGGGATVDVVEADDVVLAEVLAALYLDHHQVDDPRIAQAVAMPGGDERGFVGVEEKLALAVFHQRHAAEHDPVLAAMVVHLQRQRSLGAHHDALDLEAAAFLEHGVGAPGPADRAVQAEGVVAATLEFLGDELDVLAARRVGHQQGVGGVDDDQVVHADGADQALRRIDVAVADVVQHALAAYLVAVLVRRAEFAQRLPGADVAPADGAGHHGDLVRALHQRVVDGDVRRLGEGPGGQLALAALAVLQAAAVGQGGAGGDQHLRRVALQFLQHGGGLEAEHAGVPQVLAAVQVGLGGGLVGFLDEACDPEAVAQRGALFDIAEAGLGALRGDAEGHQVPLGRESASLGHRRGEGLLVADQVVGGKDQQLRLVAEVLLHMQRGGGDGRRGIASHRLQQQVLGQAAAVDRAVVVQGTEQQVAVGHREQAGDVRQPGDTQEGLLQQALVIGQAHEGFRHALPGNRPQAGPGTAGNDAGDQRGDGVHQ

SEQ ID NO: 25879 - protein, 151 aa, Pseudomonas aeruginosa
KGVLWQTSGSLNAGALYPLSGTPCIPRPIPCLRGGGRRFLRSAWASRPGRGLPPGAAPSPRPGLFPGAAPGCAARMASAAAPGTGAAARRRPACRTAPRTGATTTSPDGAVRPVAGYRQPPPRLPPAPGSTSRCARTPAPSGTSRRPRSGR

SEQ ID NO: 25880 - protein, 150 aa, Pseudomonas aeruginosa
NKRLPLFQGGRALRIVCLLVLLSLIGGCSHSVTLQERAEQEAIFIQEFRQEFAKRLRYPLFAPGDEIPEADVMVFFRFASSSGRISSCRVQYGAGNDKSRSTLDEVFAKRVIATCREPDLPVAPPALLDGGGGFSFKQRVMFRKVVERLR

SEQ ID NO: 25881 - protein, 251 aa, Pseudomonas aeruginosa
LEWYSQQYRSERWHSQAIEQSRGLSPTIPGTLEVATMAEINIYQNPGQSLANIYKGFARQCNPGFVFPEAQTIEAWDIPLRLHPEFIPGGDISKADQQYSTLLAQEIANGVTIGFRMVNEKERVCNVEILPLLTSMAQNLDRIKARFGSGYLDRFKGSPNVYPTDVGFSTDASGGISQESGLLVSYGVNLRTLTPGTWQAMTLPEDIKALVGPGVGLRLDAPNFSDVFNTIKSGLRYTTAVALLLAYFAAI

SEQ ID NO: 25882 - protein, 231 aa, Pseudomonas aeruginosa
QIQHLVVLHGQPLRNPPRFSPGEDQLQIFITVQRAMAVMLRARRLGKTRVVAGHKVGCKGIGVGHVADSAKPQLLDQAILQSEVRTLHTTFGLAAVGAALDVQLVHRLAELGIAVAALRRLVVTAEHAGFVAVEGQRLSIIDLDQFAATGAPVAWLIDLGRPLLARYPHAGINHDPSYRFFGQLKAVALDQFFLGQSWTKVAIVPSNQANGGILQTWRQLPVTRLTTSTRC

SEQ ID NO: 25883 - protein, 114 aa, Pseudomonas aeruginosa
WTSQSGCGQWRINCQSLLPSSRRRSRLCLRVLLRTFTLKSFAGGTLQGQLLELERQYWLQLTDSKGFADGQVSAVKGWRYRVEGLSPDTAPAPQLPKASPVNKSKPAKPSSPKC

SEQ ID NO: 25884 - protein, 146 aa, Pseudomonas aeruginosa
SGGPDGGTRDDRGNPMGKLNPKQVENLTEPGTYEDGDGLRLVVKPTGRKSWLLRYQLAGRRREMGLGSFPEVSLKKARLEASAKRSLLSNGIDPLAARDIERAAQREAQKASEAKQLKFEAIAKEYCDAHSASWSDKWRKGWLTQA

SEQ ID NO: 25885 - protein, 97 aa, Pseudomonas aeruginosa
SSASFTSPRLVDAEFLRQARLIRSKPTPPQKSRPQAGFLIVRNNPIPSEHPADSLAIMRVSDATVSDGVQRHLTSSDDEVGGPMGGRGTTGEIQWVS

SEQ ID NO: 25886 - protein, 118 aa, Pseudomonas aeruginosa
RQPLTAETCPSAKPLLSVSCNQYWRSSSRSWPCSVPPAKLLSVKVLKSTRKHNLLRRLLLGNSDWQLIRHCPQPLWLVHHDAWRGQRLCAALDPLHASDKPAALDHRLIAADAVPPRE

SEQ ID NO: 25887 - protein, 817 aa, Pseudomonas aeruginosa
TCADPLFSPRPSPDGEGRCSCQADGGQQQVDRLDPEERRHQAADAIDQQVALQQLRSVRRLHPHAAQGQWDQRDDDQRVEHDGRQDRALRALQAHHVEHVELRVDADEQRRQDGEVLGHVVGDGEGGQRAAGDQQLLAHLDHVEQLGRVAVQVDQVGRLAGGLGAVVHGHADVGLGQRRGVVGTVAAHRHQATFALLLANPRQFLLRGSLGDHVVDPSLGGDGSGGQRVVAGHHYGADAQPAQFGEALANARLDHVLQVNGTEQPAVGYHQQRGAAALGDLVHLPRKHLGHLLPRQVDEAQRRIHRPLAVHLAVPVDPGQAGFRAESDRRQFLAARLLDRMQDAQVFDDRLAFRGVVGQRAQQRALGQFLAAHPRRGVQRAATAVAEGDGAGLVERQHVEGPPAAFHRRDPELAITFRRTRRSMPGDADAREQPADGGRDQRHQQRHQEHQRQVAAGEQGERLEGHHYQQEDQGQADQQDVQRHFVGGLLPLGAFHQGDHPVQGRLARVGADPYQQPVGHHLGVAGHRRAIAAGLADHRRRFAGDGGLVDRRHPFDDFAVAGNHLAGLDPYHVALAQAAGSDALETAVGAPLIGGEALAAGLETVRAGLATPLGERFGEIREEHGEPQPEGDLQRHRGRHRLVGDEAQQGGEHGGQFDHQHHRRAQQLARVELDEGLQQRRPPQGGEAGGRVVATFERFVQGVLGRLSLSVHVRFLQKPRLSCSAIGPRARVGRKVRPPTSRMVTVSRLTNSGPWVGKLFGPTGLAFFAARLPAMARIGRMYPKRPMSMARPIIRLWNGVLAPKPANAEPLLALPEV

SEQ ID NO: 25888 - protein, 76 aa, Pseudomonas aeruginosa
SSWLNPCGPGLVTAEAGPGRLAAMAPSTNTPTGITSRVNTSRRTSFASSFLPRYSGVLPTIRPARNTAIRTNSSMP

SEQ ID NO: 25889 - protein, 170 aa, Pseudomonas aeruginosa
QRHQQIDEQSRGQGQGQPIQNGHVCDLSFERPLPLEGKSPQRGRKEAIQGRVGRHKESVKSGADSAWESNRPGTAPRPVTRRRIDASPGRRGSCCGRSAVAGSAWCPRRCGTAARRDRSARSRSRRYSRRRRISAPRGRRRGRTFPRRTAWRRTPRYRHRGLRRAAARRR

SEQ ID NO: 25890 - protein, 731 aa, Pseudomonas aeruginosa
ADASATWRRSVMRLAARPTLFPRATLSGLAAAEVSCAQIHPMIGCFFRDHSPQALPGGHRPGADPPAHRRRPLAARPAPAAGAGTRRAARHEPQHRARSGAGADLLRRAGSPPGRRHLRARLRRSAGNHAGAGAQRGAALPGGTRDDRDRGGAPGSRSPRRQRPERIARTSRRFAPALRQRRPAGLHRARRPLPPTDGRCRPQSGAQRTLPLFLAGHPDLAGTHHGRPTKGPALLRAAPATARRHRTRRPGRCRRGQPRTADLNPGQTHDSRLECPAGSAPRPSSGRTADRCRSRRRTSSAGAATTPLAAPAGPGAGGAEPAPGAVQPRPPAQPGARRYRPLGRCRRPADHRAGTLPGVVRAARAAPGPAYRRRAQRAADPLLPGRRHRPAQPVPGVRPVRRQRPGRRQHRHHRRAPAGHRQTRLPAPGRGDDRGLHHGPVPGRSARRRRYRAAGEALRQLGTGAGVLVAAGDPRRRLLAAADPPGPARPSPGLPCHRPVARPAGLAGHAVHGPAIVPGLHRLRLAAVDPDRPRHDCGGSRPGAVRLGDAATDHRPARALARRSRQGPAPGGGAGDGDHPRRPARLPLCAAADHLGLGGPARPRPGRYLQHRPGADRPALARRPRRLASVGHGPGRRLHPGGHGAVHGRRGPRPDRRLERGRLYLHRRRHRRHPVRPRRRAQPVRGGPQRTPVAPQTQKAPHRGAFSPSSLRHPGRALRRAASAACWRSSR

SEQ ID NO: 25891 - protein, 148 aa, Pseudomonas aeruginosa
KRPGDSNRNPRIPALNGSASTGRYGWRRRPPSPAAAPAVRAAPRDAPRWRRSSAAGCPARRRRHRTSRGCAPRDRWRYRQCCSRRRGTRPRPGDRRELRRGAGSHAGSGRWRPATSPGNNGRTRWPAPASGRPRPSGTSATGSPASGP

SEQ ID NO: 25892 - protein, 135 aa, Pseudomonas aeruginosa
PGRCAGHAGGWRSLPGRRSSTGWYRRTGSWPSSPGFPRGPPRRRHAAGRTAGGYASRPACWRSATRRRRLRSGCQAGRRCCSSARRSVAPGRAFVARGSWEFLAQGGSQGLPVGGSHSCQSTASRRSTHSWKREP

SEQ ID NO: 25893 - protein, 156 aa, Pseudomonas aeruginosa
STRRASAASATGTPARASPWKTATSACRCPARKTTASTATTTVTPCATAAGSAASTSTPATAWRRTRAWSGNWRPRKARTSTPTPTARRFPRFPTTSTTPIRSPTTMPVRCAGMSTSTRATASIYKATHSTGSAGRNGTPARRPLPSARNWRSSGN

SEQ ID NO: 25894 - protein, 140 aa, Pseudomonas aeruginosa
SCRASSASACSTARTANSSSTSFAARPAARGSSCSSPAAAATTTRARCSSCSAIVTCCSASTTNSCTTRRASRACCSAATPRTARCSAPPQPSSRPAAWRAATATRRIGWTPSTNCSARRPGTGPSASIQGISRCSAIGR

SEQ ID NO: 25895 - protein, 355 aa, Pseudomonas aeruginosa
PVPWVSTWPATPTSAGASPKEKNHEPAPRLGHPYPHAGDQPGPGAAADPVAHRLLHLLAPAGPAPGTDPYRPVDRRPAGAGRRIRRDRRQHARAAEAAAGHPRHPACALHRGTRPQRQYPGVRRTVARRVAERRADRHLPLHHPAPAYRPGQRPAAGWRQRRRRPVRRGLPRPGGGRHVQRRLQPAATGNPPEGRPAGRLRPDPHLPRRAPPGAAPVGADQHHGPGGRGDPERRLQDQPADPRRRRDRRPGPSHQQSRQRAGPREPGTGTGDQPIDQRPRGSGAGEPGEVRLPGDDEPRASHPDEWRAGHAATAGNHRADPRTGRVHGAGHRVHRTPAEGHQRHSRFLKDRTRRA

SEQ ID NO: 25896 - protein, 270 aa, Pseudomonas aeruginosa
CAEVHRGRRHPSQPGVAGSRSRRTVADLRGARQRHRHLAGTPGTYVRRLPAGGFVDFPTLRRHRARPGDRQDPGGTDGRHPAGREQGRLGIDLHPGDSAALPAVAGAPAAGRRRRRPGRRRSGNPPGRGQSGEPDSHRSHVAQPRLSRHPGRRRYPGGTQRRAPALRRDPDGLPPAGARRLLGDTGNQGPGERPAGTDHRPDRQRPAGRSGELPAGGNERLPGQAIQTGGIATHTATLDRLAAGTPRDVERNRTRGAGMIYDKGGKRTRE

SEQ ID NO: 25897 - protein, 174 aa, Pseudomonas aeruginosa
GARMTKQHAFTREDLLRCSRGELFGPGNAQLPAPNMLMIDRIVHISDVGGKYGKGELVAELDINPDLWFFACHFEGDPVMPGCLGLDAMWQLVGFYLGWQGNPGRGRALGSGEVKFFGQVLPTAKKVTYNIHIKRTINRSLVLAIADGTVSVDGREIYSAEGLRVGLFTSTDSF

SEQ ID NO: 25898 - protein, 160 aa, Pseudomonas aeruginosa
PAPWAAPYRPAWPHRSRSRASTTRSPPPAPPAPIASARPWNRSSWASRTWSSPAAAKRNTGARAACSTPWAPSPPSTTTRRKRPPAPTTPSVTASSSPAAAAWWWSRSWSMRSSAAPRSTPRSSATAPPPTATTWSPRAAKARSAACSRRWPPSTRRSTT

SEQ ID NO: 25899 - protein, 613 aa, Pseudomonas aeruginosa
ATASASAAPTPPWSSSAGRVDSLHRRMKRPPGRFFVPSVSLPGLHERAKPPALPADSTGQPRPSSCPLESAIMSLRSMPIATRAALSFALITALLVITGIFSLNRMGSLNEASSDISDNWLPSVRESAELNVLLAELRQVQLAHVLAADDSSKRFLESRMTEIGKELTDREGAYQRLISGADERSIYERYLATRQTLLQSQQTLVQMSRSKPLEETRQYTESTLLDQYRATQQQLQALIDFNVKGASQASHTADEVYDSAFAAVIGVLLVAGLATVVLAWLFTRSITQPIGEALRVAEVIASGDLTSRIDTSGRDEPAKLLVALQGMQAQLRQTIQQIGSSATQLASAAEELSAVTEQGNRSLTQQNDEIQMAATAVNEMTAAVEEVARNASSTSDASSASEQSAQNGRQRVLETVQAIRLMSEEVDNTSALVGGLAEKAQDISKVLDVIRGIAEQTNLLALNAAIEAARAGEQGRGFAVVADEVRALAHRTQESTREIEQMIANIQEGTGAAVGAMDSSSVRARNMLEIAEAAGLALNEIAERVGQINERTLVIASASEQQAQVAREVDRNLVNIRDISLQTSAGSNQTAAASQELSQLAIDLNNMVTRFVV

SEQ ID NO: 25900 - protein, 157 aa, Pseudomonas aeruginosa
NPILSPSGAAQMVKRTSHKQASCPVARPLDVIGDGWSMLIVRDAFEGLTRFGEFQKSLGLAKNILAARLRNLVEHGVMVAVPAESGSHQEYRLTDKGRALFPLLVAIRQWGEDYFFAPDESHVRLVERDSGQPVPRLQVRAGDGSPLAAEDTRVSRD

SEQ ID NO: 25901 - protein, 327 aa, Pseudomonas aeruginosa
SLAWVKDVTRDRANNVENRARVRGPAMAFLLIGLSEHRPLPLGQGSPLRWLALLFGLLAWHAGAGERVIYPRHSEGRNPEPYVVELLQLALARSGGDYRLEPSAQPMPQSRAQLRLEQDDPGLQVMWAQSRDDLEETLLPIRIPIYRGLIGWRIPLVSAANKDLLASARTLDDLRRLRFGQRQDWADTPILRANGLEVKTSQNYESLFRMLDAGRFEVFPREVVVIDGELEDASRAGLHLAIDQHVALHYPAAFYFFVSRQRPELAEAIRQGLEKAIADGSFERLFERHFKTRLGKLALRQRRIIELKNPYLPGKTPFQREALWYRP

SEQ ID NO: 25902 - protein, 928 aa, Pseudomonas aeruginosa
RDIRLMNSHAAGMGRNRHERCPCPDRQRSVPAPRCRPRYPPALCPAQRPATERSQVRLRPRRVRRLHRADGWRRHPLLHHPGGGRRRPPGGYPRRTRRCHPSPSAATGLHRRTGRPMRLLHQRHGDDRQGVAGSQPEPQRRRDPPGTGLQPVSLRHPCGDSQGRAACRREPEGASGGAPGMSLANPSRRGFLKAGGLLLVTVNLPAPLLALAEQGATDLPLDQVDSFIAIAADGKVTAFCGHVDLGTGIRTALAQIVAEELDVAFEQVEMILGDTRRTPDQGPTIASASIQVSAVPLRQAAAEARRFLLRQAGSHFPVHPDSLRSENGQVFAAANPQRRIGYGELLRGQRFNLNIDGKAPLKPRSEYRLVGKPVRRVDIPAKLTGQLTYVHDMRLPGMLHGRVVRPPYTGADVSAPLGSGLLAVDESSVAGLPGLVKVVVIGDFVGVVCEREEQAIRAARQLKVRWKDWQGLPPLEPDRLEDTLRRHPKKPRTLHDSPGLEQHLAGIARPLSATYVWPYQLHASIGPSCALAEVDAQRARVWSGTQNPHDLRNDLARLLQRETGDIEVIRMEAAGCYGRNGADDVSADAVLLAQAVGRPVRVQLMREQEHGWEPKGTAQLIEVRGGLDEQGRVAAYDFATCYPSNGAPTLALLLTGRIPATPQVADMGDRTAIPQYRYPRMRVVANDAAPIVRASWMRGVSALPNVFAHESYVDELAHLAGIDPIAFRRRYLDDQRALALIDALVARAGWQPRTSPNPEARRDGLLKGRGFAYARYFHSKFPGFGAAWAAWIVDVEVNPENGAVRVAKVWVAHDCGQMVNPDGVRHQVHGNVIQSTSRVLKEFATFDRRGVTSLEWGGYPILGFPELPEIDVLLFDRPEQPPMGAGESASVPSAAAIANAIFDATGARLRQVPFTPERVLAALRSAQA

SEQ ID NO: 25903 - protein, 343 aa, Pseudomonas aeruginosa
LTDEEGNTHRPLGLRQPRRARRHRPRLRLATGHRATGRHTRSLQRRADRPRRTPRRPRRLRGLPHSRRRPAQRRRTGLADAVRDDLQQQPHAGSRERHRWLVLPRLRAGHAAWRGPRRQLPVSGVPLHRLHQDSRRRPEGPVRLPDEPAGGAQRNACQPAAVPLRPTPADGRLEPAVPGARRLPRRADAQPAMEPRRLSRRRPRPLQRLPLAAQCARRGKVRQRALRRRRGGGLDRASLERQFAGAHRLERGGPLRLPPPRLFGLPRGRQRADGASGRRRPGQAVGRGPAGPGPLPCVLRRCPGRGNRSATGATPRPAGLRPRATAQRQRRAPVRRGLPGLPP

SEQ ID NO: 25904 - protein, 140 aa, Pseudomonas aeruginosa
PRSLATRVTLAPSSSAATALSRRRRWRHSRNDNWVCSRNNRARVRRDAPTSPAQSEMPRGSAGSACSASVIRRKRGSPGNGRFSGASRRRPTSSATTCMRRSASPPGGYSRGNSAARSNSSRSRPDTSSTRQPPGSERSR

SEQ ID NO: 25905 - protein, 183 aa, Pseudomonas aeruginosa
CSWHAPGPAYPGCHGRTRRPSARRRREPAPARSNRRSRNRRQPGGSYRQPRAPVRARPPALPACACAAGPGRSSAASSPRPPRRRSADARPCRRGPPPAPRAHGRRPAGRCPARRRSRPSSSAPSAGPGAAPRGWRRTPVDLRTAAHRCRRRPALHESHSWVLLLRELEKTKPAEAGFVGATA

SEQ ID NO: 25906 - protein, 85 aa, Pseudomonas aeruginosa
TAMANATPARRPIGWVRRPIPPPTRARATTVSNGRPTPVRRKPKAALHTCSPAAMPALGGKMMLPAPRKSANVMKPRASRSNPFK

SEQ ID NO: 25907 - protein, 454 aa, Pseudomonas aeruginosa
NDEGHRCEAVAFVLELRKPGKSGLLHFPTGQLGQGLADVGQGTHGLHTGVLQGGELLVRGALAAGDDGAGVAHALARRGSHTSDVGHHRLGHVGLDEGRGFFFGGTADLADHDDGFGLRIFLEQLQDVDEVGARDRVAADAHAGGLAEAGVGGLLHGFVGQGAGTRHDAYLARQVDVTRHDADLALAGSDHARAVRADQAYAQLVALDLGVQHVEGRDAFGDADDQLDAAECRFQDRVLAERSRNVDDRGFGAGGFHGFLDGVEHRQAEVGGAALAGGHAADHLGAIGDGLFGVEGALATGEALADDFGVFVDQDAHYLPSAALTTCWAASVRLVAAMMFRPLSARTLAPSSALLPSRRTTTGTFTPTSLTAPMMPSAIMSQRTMPPKMFTRTAFTLLSDRMILNASVTRSLVAPPPTSRKLAGLPPCRLTMSMVPMARPAPLTMQPMLPSSAT

SEQ ID NO: 25908 - protein, 305 aa, Pseudomonas aeruginosa
TGASDHSALLAVGDVDGMAIHCQGSFVQGFGQRRVREDHHAQVFGAGAEFHADRALLYQLGGARADHVDAQDAVGLRIGDDLDQAGGVVGSHRATAGGEREGADVDFDALGLEGLLGLADPGDFRVGVDDRRNQVVVHLRLVAGDALGDHHALFRGLVREHRAANHVTDGEDARNAGLAVVVDVDEATLVQGHAAVGGQQVGGHRATADRDDQLVEGFLLLAVGVGEGHGDLLLLHFRSGHAGTQANVQALLGQDLQGFLGNLLVGSREELVQGFQHGHLGTQAGPYRTQLQADDAGADHTQLLR

SEQ ID NO: 25909 - protein, 280 aa, Pseudomonas aeruginosa
TMSLPSMEALTPGKRFSASVAALTKKDMKPRRTPLCFFSNRSLYFERRSMIGFMLTSLKVVSMAMADCASTRRSATLARRRVIGTRFSTRSPAAKIGASAAGAAGLAGAAGAFFFASTAATTSSLVTRPPLPVPAMLFGSMPASSASLRAAGDRMASSPPAAAGAAACAAGAAAGAAAAGAAGAAAPPSFSLPSSSLLRTVSPSFLMISASTPSASARTSMTTLSVSMSTISSSRLTASPGFLCQVATVPSATDSGKVGALISIAIVCVSLNSVSSARRR

SEQ ID NO: 25910 - protein, 406 aa, Pseudomonas aeruginosa
IIFATSVAYSVERASSWRLVVKPTWLLITRWMVPPRLVCAGLRHLEGFHDHALPREGGIAVDGNRYHLVAGAVLAAVLASTNGTLDHRGNDFQVGRVERQRQVDFATAGHHVRGEALVVLHVTGAQLDDLLAFELVEQVARVLAQGVDQDVQATAVGHADDDFLGAVGTAALDDLVDHRDQAFAAFQAETLGARVLGAQVLLQAFGRGQALEQVRTRLGGEAGTTTHAFQTLEEPLALLGIDDVHELGAEGTAVGALQAVDDFTQGRLFLADVKLTGAESGVQVGTRQTVVVDRQVGRRGTLPQAERVEGGSLVAAETVSVNETKDFDLLLLVLAAHATGGNRLGTALVLGQQDEMIAHCGVRDVGGGIAIGGKLLEIRAPLFWHSVRVVQVELVELFDVGSVTTG

SEQ ID NO: 25911 - protein, 860 aa, Pseudomonas aeruginosa
SAPARRGPSRPCRWCRPGNPACTAQHLCRGCNDKHSLATWRAPLVSPNLGFECRNGLRREVDGTLGYALLTREVQGVAQPVLVVALLEVFTGVGATGLLAVLGRDRGGLGHLEEVLQFQRFDARGVECLALVVDLDVGDTLAQVGQLGDALLHVLAGAEHTEVVLHAALQLALERSDFFAAGALVHAVQALEGGFQVALGSAAGVDALFQRFFQVQTGGTAEYHQVEQRVAAQAVGAVYRYAGHFAHGEQAFDDLVVAVGVLGDGLAMDVGGNAAHHVVAGRDHRDRRNDRVDVGEGLGQLADAGQTAVQDFLAEVVEFQQHVVLVRTHAVAGQNFLDHGTGDHVATGQVLRVRRITLHEALAVGVDQVTAFAAATFGDQYTGAGDAGRVELPHLDVLHRHAGTQGHAHAVTGVDQRVGGGGVDTAGTTSGQDHGLGTDVDGLAGLDADGDDADHRAVLVLHQVDRVPLVEERGAILQVGLVQGVQQRVAGTVGGGAGTGGLATLAEVLGLAAERTLVDAAGFGTGERQAHVLELEHGLGTDGTHVFDRVLVTDVVGTLDGVVHVPTPIVVRVGRSDRAGDATLCGYGVGTGREDLGHHGGLVAALGQLQRGTHAGATATDDDGVKGKCTNASHGSHTPKNLHTPDEECEHRHAANRLEEETHDCRRLAESHRSQVVGGDGPHTDPRMDAQGNQGQQAEDAHPTLREQAVPVRVGNVGVSNEVAQQENDISRENDRGNALGHPVVEAGAREVCDVSYHTHTPARTISTTAMAMTILEPRLPPSSVSPTPASMTRWRTPATRWYSSADSRPQITILARGLVRHAFTCSKPSSELSDLSSANSSTAIPRNRMTPEIRWRMDV

SEQ ID NO: 25912 - protein, 152 aa, Pseudomonas aeruginosa
AGHRRSAGAPSGTSVDRPVRSSPGSAPGSATAGDRRFPARPRENRPRSPTTAAERYPPLTGRGSCRPSSSGVRPGRNRAGWQTPAAPAARSTEPAPATPGSPTRRPPARRPARSRRAPRPASVCATAYLSSFSEHQPLPVDACPLGFIAAAN

SEQ ID NO: 25913 - protein, 114 aa, Pseudomonas aeruginosa
KASSPPTITVRAPLTAPAWPPETGASRKPSSRSAASSDSSRATSAEAVVWSTNRLPGAIPAKAPCSPSATARRSSSLPTQQNTSSAPAQASRGVSARRPAYSSTQRSALADERL

SEQ ID NO: 25914 - protein, 230 aa, Pseudomonas aeruginosa
PIVPRPRNATAVIPSSPRNPIPQPSTAVCRGPEAPPYSARTLVWIAPMPHWLVIDLEATTAEGGWPLEEMEIIEIGATLVAAADARELDHFQRFVRPVRRPLLTHFCRDLTHISQANVDGAAHLNTVWEAFERWLAQHRPRLAGWASWGDYDRRQLEQEWRQHGLTSQLSEVPHVNLKQRFGEVRQLPRPVGLNAALQLAGMSFQGQQHRALEDARNTARLLPLVLPVEH

SEQ ID NO: 25915 - protein, 154 aa, Pseudomonas aeruginosa
MPTNSAGRMAKYLATSLAMEKVVSAPRVTSNSLPTWTTSSSLVGSLSRSTRLAASRAAWVPSFMAMPTSAWASAGASLAPSPHIATRRPSPCSWRIRASFFSGVASAITSSTPASAAMAAAVSGLSPVTITVRMPSRRSSAKRSRMPGLTTSFR

SEQ ID NO: 25916 - protein, 447 aa, Pseudomonas aeruginosa
MAPSSRPLATTSSGVPPLWAILSTSRESTSGIFSRGRSMKRSAASTAPLRYTWPFQSTPDRRVSALKAIGVSSSRRGSSIGCRMRRYSTIDLPSGVSSASEPSNAPSASSLPLTPGAAYSALQRRLPKVMVPVLSSASTWKVPRPPSTGGTRNWRSRSGAPGGPCPAMPMPESSPPMVVGISVTSSATRNTSGRLPPANRANGLRVTTTSRKIRVRPISRMSSATSLGVFCRLAPSTRAIIRSRVDSPGLAPIRTSSQSDTTWVLPVTAERSPPDSRITGADSPVMAASLTAATPSMTSPSPGIISPAWTRTTSPLRRLLAATLSKLPSARRLLAERPWLPALRLSARALPRPSASASAKFAKSTVNHSQRAICSATEVGTAWSGTKHSKVVSTAVSSTTSITGERSNWRGSSLTKACSSAGRHKAARLVDALWRRSSDLCKAFLDA

SEQ ID NO: 25917 - protein, 402 aa, Pseudomonas aeruginosa
QGEGSTLALGGADHVAGDQQLLDLRGALVDAEQPHVAIEALDPVVADIAGAAEYLHRAVGDAAAHFRGEQLGAGRLGTDIAAFVALPRGVDDHAARRVGFGLAVGKHRLDQLELGDRLAELLAFQGIAQRILKHPLGDPHTDCGDVQAALVEHLHRGLEADALDPADQLTGRHPAVVEDHVTGMRALLSHLAIRLAQGQPGRTALDDESGDSAGATDRRVGARHHGVDAGLRGVGDEALGTVEHVVLAVTHRRGLQRGGVGTGVRFGEAERTEQFARRQARQVAPLLFFGAVDDDALGADAVVGAQQRTERRRGPPQLEGDAHLFLHGHPEAAVGLRDRQAEQAHLAHAGDDRLGDAVGFRHFLLMRHQAFADELADAVQQQVQGFRITNHAHSNRPLGRLP

SEQ ID NO: 25918 - protein, 757 aa, Pseudomonas aeruginosa
NYISHSEISIHRSFHVRRSFARGPARISRSRYSPASPQSSASQERAERRSAPAPRQPLPDARRGSGDPRHRAHRRLALLCSWRRSPRSLDEHGDRPVRPPRRALLGSHRALPEAGDRRGQRLRPGRRLRTGDALRPDRRRRVGTVRPAGDQGRGDAGCRRHPAPGTGGGQVPGAAHAVHRLPGEGSASAGHGPGQRSGGGRVDAGARPGTGHGDRPPAPSGAGADQGGGPGRCRPAAGQCPGPGTQGVPVAVRLAGPEGRHAGLPGETPAELPGEIDDARYSLYRRGRYRCDGHRDRPDRRPGRPDRMAVRQPRRGRRRGTPAPAADLREPVRQRQAERRRRRGRAKPAAGGGTPGTTGRLRTGGGGHRRAPGGQAGIAAPAGSHSRAGDHPRQQYLVAVDHRHRRRLRAAAAGRRLSLLQPGAADARGRGGRRPGQRSGSRRRPARPRRAPGPPRRTDQGQPRLHRQPCRPRLWHRGPAHPRRRRRRMRRDRPCAARVRRLPHGAVRTARSYRPRRVAPGNGIDLPAVLPGTALPPAPADPPVARRRPSRAQERPGLLSLRRRPAAGQARSATGAAGRHPAPGVAGLRKRGRPPHARRTAASPRRRAGNRRTPFRRSALPAGRLGRGPEQRRAALRLSRRAQRRHRPALRPRAPALPDALATDYPGHARRRPRATGWRRRRGHGAARQSRLRRPAGTGDDRQPRLRHRPAGHCQRRGYRPGGAPRPRLSPRPAGMGRPPRPAAPAEHSPALADAYR

SEQ ID NO: 25919 - protein, 220 aa, Pseudomonas aeruginosa
LDVSSVTIPLKRSLVDIALEQIRQRIDAGHWPLGQRLPPEPELAELLGMSRNTVREAVRVLTFSGVLEVRQGDGTYVRACADPLETMLVLARSAVQHSLEARGMIEIEAARLAAVRRDDSDLSALREHLDASRQRYGSADLQDYIEHDVRFHQRMVDAAHNPVLSELYRYFSQVIRTSLERTMADPQRAQPCFELHQQLLDAIERGDPDAAAAANRALLI

SEQ ID NO: 25920 - protein, 429 aa, Pseudomonas aeruginosa
TRDRPMTHALNARPGAHPGHPPEELLIDAEVDDEPVPPAPPLRPWLLLLGLVLVALNLRPALSSLAPLLNQVRDDTGLSAAAAGLLTTAPVLCLGLFAPLAPRLARRIGAERSVLLILFCLAGGIVLRSLFPVFGLFAGSVLAGASIGIIGVLLPGIVKRDFPRQAGVMTGVYTMALCLGAALAAGATAPLEKLFGNWELALAFWSLPAILAAAFWLPQTRQGQHAHRQAFRVIGLWRDPLAWQVTLYMGLQSSLAYIVFGWLPSILIDRGMTAVEAGLVLSGSVMLQLITALLAPWLAARARDQRLAVVLVMATTLAGLLGFLYAPLQTIWGWAVLLGLGQGGTFSIALALIVLRSRDAHVASHLSGMAQGVGYTLAAMGPFMVGVVHDLTGGWNAVGYIFIGVAIAATLFGLGAGRSQYVGARSEHL

SEQ ID NO: 25921 - protein, 517 aa, Pseudomonas aeruginosa
AAGEGQQAEQHGSRYAGDHEADPGQQGLRRGGTDHPVDHPLYGAGDKVAIVLRAVADQALQGTVDDGLQARPVAVEEEDQDQAEDQFQDPSADLRAARQQPVADLADIGLEHVEERHALLVDGVPPADQAVADQRYAGHPRRRRRQALDLEILQQLHQRANVVRQAEAEPDQRQCHQDDPAQGQQARRQRLAATEQAREHAHQRPTGESQHRGPEQRRPEWRQHPETGTEQTEQQHAKQQPIVIEHQGRPSSKGDTPIDSARRAPFPAGAWGAGERQSTLAGGLAEGIFAIARARRPGRTRSTQPVEVQALDLRLAQLHAAVQHALPAQGVAPLLGVLAGQLDPHPGIQAQGPHQQLQPVAGRLRRHMAEGQFAVGLEQAQQGRRARQQFRQRRIGLEFLGLQVGAAIATGDRVDRHQAVLLRRRQTHQQVGLLLVRAVQLGIAEHGVGQQAAGAAVASLAPEQRRGVGLEQRGARRGERLLAAVLGRQAVGQCGQLAFGAHLALHAQATADATDRP

SEQ ID NO: 25922 - protein, 218 aa, Pseudomonas aeruginosa
PGIPRCARSSARGPGSGAAATVGSGARRCARYSHRAPVPGRAGRAVRRPPGRSRQPRASALPRLFPARHRPACACGVAPVAPSALRRASAAPCRLRQCRESGHRSTPAARCARARPRRAAPRRWRPSSAPTGKNAPSPVARPPSARPARSPRAGSWRPRHDARNARGRRSRGRRYAARRASAPGARSSWRCPASHAGRSPACRPADRTDARPVRCAAG

SEQ ID NO: 25923 - protein, 549 aa, Pseudomonas aeruginosa
CVLPRPAGSCRTLLGRPRPAIEHAFQQFGGFPRALQREHVAAGQRHELAARHRPDQPGVVRQHHLAVPPAHHRQRHLQLSWTPRTAVRHATVDADLGGRIEAQAQAGTAAAVGQPVAYVGLQAIGVEAAEQRLAGEVRPRLFQVGERLATPQGAPGRSDPVDEAEALGGTDHQAVGEGQHRRIEHHHAAVEFRPAQRRVVVQHAAEGMADAPDRLFQAGEVVQQFVHQVVPVVVHRETRVVPVHFQVIHPVLRRQRLEQLGVGSRREAVGVGEENRLRHARRLDRADARDSPAASPRRQWLCRLPCTAKRPKPQAERTRCSRIAAATSRNTTPQAASSQGTARNRRACRAGRVRVRLSRPNQQAPMPNSSAATASLPPSDICAGIRLPSKAMNNTSALGLNRLVATPRSQGPRGDGGSAPSSRPGWPSPRRSQARSAPTPSQARYSAPSACRMANSTGVRLSSSDTPVSTRVVCRRIPQASPSALARPARRPWCRDVRTTRATSGPGLTRAMANTAARVSKTDNSCMATPRKRDRKGKRESALAQARRR

SEQ ID NO: 25924 - protein, 474 aa, Pseudomonas aeruginosa
PIGAPEQTAEVRLVVETELLGHLAQWLLAAQNQRQGALQAQLGQPLVGRQAAVTAEAPQHLPGAQAAEGGQFLQVRRVLQARLQPVAQPRPVALAEAFPVALLQAQAAAQAEQAGQRLPEVLFQGQTVLQRRRSAEHAQVQLTQALLQTLVADQATGQTRRPPTAVAEVTAGALQPVGIERQDADTVALLAGAAAVVDAFRRHQQRVAGPGQAPFAAGGIAMPALQQQADVVLQVEVPGKGKAVVLGVYQAYAGNPAAEMGDLFHPATLPPAGRNDLGQNCGPRSARPARQWHHRHGQAGDAARLAVVATEADVPDMGGAPQVDRPGHRGDPAAAQATQVVGVHFQADAVVLAGIDAQVAGHRAQAFREDHRGAAMQQAERLVGTRVDRHAGGQRLVVEGFEADAKQVADAVLLRGVQLLQVGHLSPEAHGNSLRKGEAKGFPSVGVIRARARPRGVPPIRGSASHRHLPPYCA

SEQ ID NO: 25925 - protein, 179 aa, Pseudomonas aeruginosa
CVPRRRGCSGRSSRSSAGRAGRRGSNRCSRSSRRPRAHPGPGGDTRAAAPRVPAPRRRARSAPRPGLARRAPCDRRCGRGSAASAGGRASAPASSNTPPSGTWSRCAARRTAGSAAHASCPRRRCPGFRRRTPWFPRRATPSRRTSVPPRGTAAGRRASGRLRGCRTVPRRGWRRRRNC

SEQ ID NO: 25926 - protein, 224 aa, Pseudomonas aeruginosa
PAGDCARCARRGNRAPRADRRRGSTRARCRPARPGPVPRAPARRSAGRARRGWRESRPAATRPAARRSAAPPCVHGRSGAARNPGWRAVRPRRGATARVSQLRLFVARRVRGGRHAVGGLALGGAGARPVGERPGFLVAVEGTETADLRQVLAEAVAESHQAAVRRAVDQSVDQLDHHHRPEEQFGDLPDQDEQQHPEDADGDRFACLRVCGHGGLLVRSRWWE

SEQ ID NO: 25927 - protein, 950 aa, Pseudomonas aeruginosa
FIHFWPPRGNHAIIRSASRPTSLDAGAGKSPRLVYHARARQYLSRTRSFRAHRFTCSRLPDPAGPAVRRQARGRRPVQRSQRRSRSIDRDTPETIPGGSSRQHQRARPRADRRQRRPRHSRTDAPGPGHDGRLPVRQPAHGQLPRHQHVGGAAPAGADRRPLGVPPGPCQRRLERPAAGPRGCRADRSVPWAEYRQLRRQRIDGGDQHHHPRPRRVARHAPEVHGGPARHPRLVRQPEHRPGRQRLPPVAVRPGRRRLRPRPRRSRPARRPPAQPLQPQRQPQPGAEPEPGVATGGQGRLEPAPLRLPLAVSPGSRRHRQLRYARPRLCRFAALECRPRPAPQLLYTRLRTALGAPAGMERLRGGHCLQPATGAALGTEPGLPAQVRRRSDPAAARQRPGVATGDPGPRPATQRRTAPGLRTGRPQHPGKPLRPGDAGHPQPGRQPAPAERPELPLRPGKLRDLLRRQGQQPDLAAVQPIGVACRRTLAAAGRGDARRRRGLRQFVQPAAGGELPVQPPAQPARGLFGGSAVTGHVRKRRRLALPGPPPDTGALWAERSLLLRQRPRPRRPGQGTHPFARDRLQRFFPRDRAGRGCTPVLRGNHRTDQRSAQRRRLQSGQRRSHPLLRRGRPARLAPGPTRPPARHLRLSRLRRHQSLRPAPDRPPRRLGRLDARLGPRLVQRPLLLWRRLAQWTSFRTRRPAPGQAHSPGQGRPGTGRRAPAASRRRTADVSRQPLRQPPPALLQRRGDVLDASLAPRPPGFPGAARARLLLSPACRRGRATGLGQRQPGGRGERLSRCPGAATAAGPGGTAHARGPGGGDGLRRRHPPAPARPRGPGLAPAPAPGAADPGAAAQPGRWPAPAARRQRTWRTRRRRSLRTLERPAGVPPAPPGAPDPAGHPAHRRALRQGQRIPPRRASPRGPQPGAPAVRRQQQRQRRPAPAAVPARQ

SEQ ID NO: 25928 - protein, 760 aa, Pseudomonas aeruginosa
PAARHRRQTAVQLAEHQEPAARQLRQEPRAARPHRSLRQGRQPGEQLQRPGGLAGHPRRIARPGAQALAPQPLSRAFQGARQSAGSPFPGYRPGQRRRPRPAPRRRRRTMSQRHGWDIRTRMLAISLGPALLLTLLLTAYFTYSRLQDLRQELTHTGQLIADQLAPAAEYGVIAGNTPVLQKLLQATLDTPHVRFIEVRDRNDNILVYVEQLPGALQNAAPIDIFHSTIQRQRIALASDPLLDGASEGDGQSGEDYLGRVVVGMSNDAFSQRQQEILLKAALLAAFALILTFLVARRLAQRLSAPISTMGQAVEAIQSGDYKTSLPILDDGEIGDLARHINNLASGLDRASREQEQAISQLISAREEAEQANRAKSDFLAMMSHELRTPMNGVLGMLQLLETTEQTREQAEYTALATESTEHLLKVINDILDFSRIERGALELECIPFNLLELVQGSALVFQHSAQQRGLALELQIQAGLENIEVCGDPTRIRQILVNLLGNALKFTEEGAIHLSLEWQALDHDVLWLTCAVHDSGIGISPERLEHMFDAFQQADSSISRRYGGTGLGLAIARTLAERMGGTLQAESKEGSGSTFTLEIPLPFQQSPAHRQQAAGDAAPVAAGQEILLVEDNPVNQTVIEAMLRSLGYRVTLVADGIQAVRSAERQRYDAILMDCRLPVLDGYSATREIRAQENGRQVPIIALTANALQGDRENCLQAGMNDYLAKPFKRAELQRILQRWIGSQPELPVTSNETGRGEPE

SEQ ID NO: 25929 - protein, 174 aa, Pseudomonas aeruginosa
TAMPPAWGETAMSDALALTVNGQSLRLDVAPDTPLLYVLRNDLQLNGPKFGCGLGECGACTVLMDGVATRSCITPVEAAVGRRVVTLEGLGDATHPHPLQQAFIDEQAAQCGYCINGMVMTAKALLDRNPNPSDDEIRQELAYNLCRCGTHVEILKAVRRAAESLKEHQEEHPA

SEQ ID NO: 25930 - protein, 146 aa, Pseudomonas aeruginosa
TRRTARCASPRSGSPMTAGRWSIPMGSGTRSTATSSSPPAGYSRSSPPSTAVASPAWNGADTRSSASPNCRRSTYCCSTAPSSHRWALASQPRCPAPRPSPMRSSTLPGRACDRCRSLRNAYSRRCAARRPDPFPRGAAAPRAVDD

SEQ ID NO: 25931 - protein, 434 aa, Pseudomonas aeruginosa
QMKKATRIGLWASGSLVALAAIALGYAWQPAIGPLEGTPGPFSAEQIARGERLAALGDCAVCHTREGGPRNAGGRALPTPFGTIYSSNLTPDRASGIGGWSYPAFERAMRHGVARDGSYLYPAFPYTAFTRTRDEDLKALYAYLMSQPAVHSETPANQLPFPFDQRQLMAGWNLLFLEPGAYRDEPTRNQQWNRGAYLAEGLGHCSACHSPRNALGAEKSGSAHFAGGEAEGWTAPALNASSPAPIAWSEEALYAYLRHGYSAYHGVASGPMAPVVGEGLAKQSDEDLRALAHYLASYAAAPAGETDQQQAQRLDRQGYGRVQPPSGSGARLFAGACLACHHDGDGPRFFGVRPSLALNSNVHADSPDNLLRIILDGIHSPATGDLGYMPGFRHSLHDRQVAALANYLRERFAGKPAWPDLAAKAASLRRQAAP

SEQ ID NO: 25932 - protein, 150 aa, Pseudomonas aeruginosa
DARPRHPADIHGETPPPAATVRAAGRTPPVPGNRRAANDPGRDCGTAQGCKPPRRAGRPAESTAPAAPAPDSCAARCWRARCRWRRTSVGPRGARASPPGARRASRRRAGTPRRAGCGIAAGRVLVPFAASVVPIRRVSGARPMVSCGSP

SEQ ID NO: 25933 - protein, 128 aa, Pseudomonas aeruginosa
TNRSHAMSSHRPQHRLSVPDIQRRKGAGSLVALTAYSTPMARLLDPHADLLLVGDSLGMVLYGMPSTLGSEPGDDGRPHPGGDARQSARLRGGRLAVRQLPGIAPTGVPQRRTPAGRQRRPGGEAGRR

SEQ ID NO: 25934 - protein, 331 aa, Pseudomonas aeruginosa
AGRESPRRCFAPLGRRSPRPGHDFRRLMKKAARRRPSWGSPDVSGDRFARLAQQPIANDCQDQRNGYRQQPAKALIGERKLGEDVRHPPVQLGRPQPVDDAEEQRDDHHRHEHPRGRHPEPVEQAQGDQHDGERIESHQNRYRKADQLGQSLVGDQQAEQREHDHHRLVRNRQQVAEELAARRDQPYRRGQAGQGDDHRQQQAAGNAKGLLHIGGEDLYAILGVAGDALAGGAQIEQRQVDQGQAGGGDDPGDHGIARDQPAVADAAVANGGGDDDTEDQRTEGIHGQVAPAGSPAPGARSGTRRNCCRSLPPARRSPRRQGPAGPTAAPA

SEQ ID NO: 25935 - protein, 236 aa, Pseudomonas aeruginosa
MKPRSSRVTPLSAASRSVVTGRRPTATISLSKVSFCSPLASVKVTVTCFFFTSEAVTRAPRRMFRPCLVRTFRASLAICSSAAGRNLSRASSTVTSAPRRAHTEPSSRPMTPAPITPSFFGRAWNSRAPVESTMMSSVSGAGGISTGREPEAMITFSASRTWVLPSRPVTSTCLLASSLPWPSKEVTPLALNRVAMPPVRFLTMLALRATIAGTSMVTPLASIPWTLKASLASWYL

SEQ ID NO: 25936 - protein, 147 aa, Pseudomonas aeruginosa
RWSAWPWRTAPRPGARRPWPAGGSSARASRHGRRRRRSAPRQPGRQAWPGRPGRSSSLRPQRPRLPWSRDRPCRCRRCCSDRCRLPRPACARPGTGWRRRRQRRPERRPVQPERRRAQRQPERPERRRRLRSACRAARCSERCRLRS

SEQ ID NO: 25937 - protein, 164 aa, Pseudomonas aeruginosa
GSCTEPELPPGRLPGTDTAARYGRSRYLRGLPRDASPAGRSTPCRCTARRGRPSSDPGCRFPGSRSGRNRWPDLPGSRWRACDAAGTSASSPPAACAAGGSPDGGACGRPEPGWSARRPGCSARHRAAGSAPGARRSAPGPAPHSRAAAAWSGRRVGPICFRHW

SEQ ID NO: 25938 - protein, 104 aa, Pseudomonas aeruginosa
PPGRRWRSRRTGLPRSPASSAWWWRNRIRTPARPLPKGRNRRYPGAAGRRTDWPAVRRPSRPSGCAAPRDGARRCHGRRPGRSSVPDGLRTAGSRRPGSRRSPS

SEQ ID NO: 25939 - protein, 139 aa, Pseudomonas aeruginosa
SPGGWCHRVLYARVCDIWKVSMTTPCPAKAASPWMEIGTTLSPELSLRRSWRARTEPSTTGETISRWDGLNASARWTSPPLVITFEEKPWWYFTSPEPSSTIFLPSNSSNRSRGFLPRVLTRTFRRPRWAMPMTISLAP

SEQ ID NO: 25940 - protein, 310 aa, Pseudomonas aeruginosa
RLRSPQAATSVWPLQIPQIVRVPARMPLLVIFFKSGPWLCELGPLSCCDAGRTPAPQVLLGTTHITTARGSGSALQQHITHVADRLGRVQTLRANVHAVHDSAAAEHTEWVVQRSQALFGLGVTAVGQETIGLQQCGRTEELVGVPPEGRAGGRAAGAQDALVQTVQLLALFRGLQTLDGRGRRIVLQERLHLLVLLVEDAHVHDQVTNDRQARQRTDHQLAALQAGGRQRGDAGQAVLAVDVHAIGAADAFTAGTTVGEALVLFLDQRQHVEDHHVLAVGVDLEILHVRRSIFVGVVTINTHLQHGGHP

SEQ ID NO: 25941 - protein, 114 aa, Pseudomonas aeruginosa
FCMQLCSSRLSGATSSPLVRSFTPFRRLKEASRSLSEAPRASMPSFSAFSRCRPAARPNTTRSSSELPPRRLAPCTDTQATSPTANRPSTIWSLPLASWVMAWPWMLVATPPIM

SEQ ID NO: 25942 - protein, 288 aa, Pseudomonas aeruginosa
RPELRGKLPAHDVQHPLRDQADQPRAGQGHGPHLHSPRRPRAERLHLHGASGRLLRRQSVRLHRLRHRRPVGTGPWRRERSGAAHARRDRRRVQHRQVRREGQGQERSVQADGLRPSCLQELRPARQGHEADLRRGPPGAGHQRPATGTGDEARRNRPPRPLLRGTQPVPERRLLLGDHPQGDRHSDQHVHRDLRPGAYRRLDLALAGNALRPLQDRPPAPALYRPHPARLHRPQGSRLKPVTSGEKGCFGSLFCARPFPPDTKKPPRRRSFCREGALSASRQRYAGP

SEQ ID NO: 25943 - protein, 256 aa, Pseudomonas aeruginosa
FSSRCRQRTPAGLPAGMPGSGEEIDGAMQQAPQPALHCMGRISPESWQRSGQDSRPKRAQRIRTGQAAAKPGGSAARFRLETRAAKLPLLAVAGSEQPGPGRLRRCPPLHAARLAQVEGLRRRRVAEEGVASGTPVAGDPGRQDPGATFHLVIDDTGQALPRSTPPGQGDPVQLAVRQRDAHLHAALARLERQLVGAEPAIGAAQVPLQGQASTDQFEALQALLLAAQLQATGAFPPGPEKTALALPQRRPSATRH

SEQ ID NO: 25944 - protein, 161 aa, Pseudomonas aeruginosa
PRLPGRRRPARRESPAHARQPAATARGRLPPKRWCGRRTGCPAPFRRRRPARPAPRHAGRRRYRRNRTPARRQHRPRAAYRRAVRRTPRPSAAPWPTSDCRHRRRSPLVAGARPSGSPSCPGREMRPQSFRHLLEIRSRSLAQRFAEVRKPRHTQRGPWYG

SEQ ID NO: 25945 - protein, 153 aa, Pseudomonas aeruginosa
VSRASSTAPWRMPAIPHGCCRWYCRWSIERGPRRLVTPFRGLGILAGLFKPACSPLQEKPMFKVNEYFDGTVKSIAFDMTAGPATIGVMAAGEYEFGTSQLEIMHVVAGALTVKLPGSDEWQEYASGSQFTVPANSKFQLKVAQDTAYLCEYR

SEQ ID NO: 25946 - protein, 405 aa, Pseudomonas aeruginosa
RRLAAAPAATRRRGWWTRCGDVRAICARRSWTPESERSCAIPSEAEAQLFSDRAEGQGRQESQAADQQDGHGEQADEQRTMGRETVRPHRAGLLRRQAAGDGEDRQDVSEAADEHGQADHQVVEWRVGTETGKRRAVVGAPRGVGVEQLAESVRAGIGHRRGRPRQAGGDGAEHQHADRHHQQGEYQQADLLRLELLAQVLRRPPDHQAGEEHRDQDEQQHAVEAGADAAEDHLAEHHVQQRQHAAQGAQAVVHGVHRAVRGGGGGDRPEHAGGGAEATLLALHRRALLDRQLRQRRIRLVFGPQRQAQAEAEQQQHAAEDRAALAQVLHVMAEGEYQRRRDQDDRGHFEQVAPGARVLERMGRVDAEEAAAIGAQLLDGDLAGRRAERDGLLGALQGGGMDIVE

SEQ ID NO: 25947 - protein, 246 aa, Pseudomonas aeruginosa
GLRHALPDQQQRQQQAQRQQHVEGAAGQVDPEVAQLPRGAAADAARQGHQHAEADRRADEVLHREADHLAEVAQRGLAAVGLPVGVGDETDRGVERQCPFQARQVLRVQRQAALQHEDRKQQDQAGQVECQQRQGVGLPVLLARRIDAEQAIADALQWRQRRAEEIALAFHHLEAVAPEERCRHQDQGEKGQDQENLVAVHVPSPRHGRRVAAPPANRRTVPWPGPGTTNPERSCVRSLLRAASAA

SEQ ID NO: 25948 - protein, 282 aa, Pseudomonas aeruginosa
LFSINHETIFRIAKYQFIGASMSADPSPVVLLEFPAADIALLRLNRPQARNALNDEVRQRLASHFQTLGADPAIRVIVLTGDSRCFAAGADLRDLSTSTAIGLYGRHGERYWEAIARCPKPVIAAVNGFALGGGCELAMHCDLIVAGESAQFAQPEIKVGVMPGAGGTQRLVRAVGKFQALRMLFTGCLVKAPQALAMGLVSEVVADESTLARALELAMEIARLPPLALAQIKEVVLAGADLPLDSALALERKAFQLLFDSQDQKEGMQAFLEKRPPNYQGK

SEQ ID NO: 25949 - protein, 510 aa, Pseudomonas aeruginosa
TMPDIRCIAVVGTGAMGTGIAQIAAQAGLTVWLFDSRAEAAAEARQRLRQTFESLCGKGKLSAADAEAAQNRLRVAERLEQLGDCELVVEAIVERLEAKQELLRRLEAIVAPETILASNTSSLSITAIAAACERPQRVAGFHFFNPVPLMRVVEVVDGLASAPEVGDALLALAARLGHRGVRTKDSPGFIVNHAGRAYGTEALRILGEGVAECAEIDRVLRECAGFRMGPFELLDLTGLDVSHPVMESIYQQYYQEPRYRPHPLTRQLLAAGRLGRKSGQGFYRYVDGQPQDKPGPQPVPQAAIRPPVWLGCENEDDRRTLAELLHRLGVEPETGERPSAAALCLLAAWGEDLSSAVQRFACPAERSVGIDLLCDLERRRCLMLSPLTTPAMRDAAHALLAGDGVGVTVLRDSPGFVVQRVLAMIVNLACDIAQQGIASVEDIDQAVHLGLGYPHGPLEWGDRLGPRRLLSILQRLQTLTGDPRYRPSPWLRRRAQLGMSLRAGETAAVG

SEQ ID NO: 25950 - protein, 144 aa, Pseudomonas aeruginosa
KNATPCWSMESHQPIRRSPISGTPAIHEGGGGRPSTWRFFSSSISERTLSARPKPSQISGNATRTIQPRVSRPAASDSRPPSRRVSMRISGQLAKASTAAQNSADQNGASTQRLAPSRPNSSTRSNSRSLSNIKAGLPQRGIHR

SEQ ID NO: 25951 - protein, 564 aa, Pseudomonas aeruginosa
PGEHLATDDAAEDRQLQQAVELLRRHLRIHPHLELGPDARHAEQQGRPRTLHVLDEGVQAFGEEHRGSPVERPHLDEHPFRHVAQRQVGEHPVVFAGAEQFHAAAGGEGETAEVVHHPLGHAGGSGGVDQGGELLGGGRRVAFERRAGMQVDPLAVETPFRVQRHGHGRYALGDSGRHRRPVVELADEDHRRLGMLQHLARRLGGEIGIEGDGNVPGHPDRQVSDDPVRTVLRDDRDTAAGGEIQAAQPGGCTPRLVAHLAPAQLLDPAATDGLHQVTPLRMTLFALEEDFERQTICSDHVPPPLLLFWEIDQALAWSNIPSQPTAGKPGNVSVCSRCARRFLAVPRVMQRDQGHQPGGGEVAFQLGQRGSAHRQRIAPVAMHQQTAQRPDQGLVADQQEIALAALVEETEHLARIVVGGQPGRGADRLDQAQCLAHQLGGLLGAHVGAGENPVQRQPGQPRGALQHLLASMGGQAPLGIPAGVRFGLAVAQQPEFHNFGSSSRAGCAAGGTLWAASPSAARALGQSANGQGFSSLWKVPKRPICARYWLRLSPKAIRLPFGAP

SEQ ID NO: 25952 - protein, 1138 aa, Pseudomonas aeruginosa
TSWITTTAPRSSSATCQTRTNSSIQRMRMAIDSRACGSADMAVSSSEAGGGNEIDVGLRLAAHQQLDDLRQGAAFEEDRMETGDQRHVHLHLVGLFLEYLESVHTLRGLAHARYRLLQAEPLAEGVADLVVAALRRGTGDDQVADAGEAEKGHRVGTELDGEPGHFRQRAGNQHAAGVLAHVHRRGQAGHDRVDVLQRTAEFHSEAVAAGVDAEGAAVQGRLDAGAQLVVLAGDHRGGQLVLCDLARQVRAGNHPDAGLRGDFLEDLTHQLEGVRLDALGQAHQQLVRQCRLVWLQHLAQGAGGQGDEDQLAIGQGALQVGDRLDPGMHLDPFQVARVLASAADRLGLLRVAHPLADRLAVLGQQVGDGGAETAAAEHGNRLLLCHDSSISGRHAAITPLYGRPAGRPVLTPALAKARASFTMPGPDNTYREQGRSVPIASRAPASLTLLALLFGGKLAAADLFNDPSGVPEVLTATRLKQSPAEVPGSISVLDRELIVASGARDIPELMRLVPGMMVGYLSGNQPTVNYHGTSMSGARRLQVLIDGRSVYRPGLASVDWSDLPLALEDVERIEVFRGPNTVSYGANALMGVINIITRAPGESPGTRLKYTAGQRGIRDWYASQSIALEDSDFRLSLSGQEDDGFDRDHDGHALRDGRRLSRFNLNASHSLAPNQSLEWQLAAKEGSNQHPYAYRSPFPQVPDDIDNSDTLAHDYAGSLRWNVDLDPRHSFYIQGYAQHWERRQEWNACEAAIAFSPQLAQLWELNPDYLRRFADDPTRLPPGSAQELQLATQVLDQLRNGGLRPVCGRVDRNIRESRYDLEMQDTLSLGDNLRLLNGLSYRYDQANSETFYGGRVSSQIWRLFSQLEWHAGEHWLLQGGGMLEDVEGSGSSFSPRLAVNYLFNPQHSLRAVYSEAVRSPGMYENDVDWRYRVRHLTPAPYGQSEAYYFASAHGPGDLGKEHTRSREIGYNGFFRETGLAVDVRLFYEEITGLISDPLSVVDFSPDNGDRIRFSGAEGQLDWRLGLRDRLRATYAYLDYDATSRYDRRLTARHGGSAGWMHDWGQGWSSALFYYGDDSLNGHRFERVDLRLAKRIPLGKAALELAGVLQQRLDDEPLTFPDNRYDSRHLLYFSAEVTF

SEQ ID NO: 25953 - protein, 309 aa, Pseudomonas aeruginosa
MRRLRPARRAFQALLALVFCCLPHVGEAAQLVLVSANQGAAVNAFRDALAQRRPQDQVELRTPAALAEGMVFADDTRLLLLGPEALAWRLRQHRAPPTLALLLNRVDGQRLLPGANGHGGHGVGGLCVLWSDPPASRQLRLARLILPGIQRIGVLYGKDSEFLLDELRREARSQGLQLFVASSSGNDDPRPLQFLLGNSDLLLGIDDKQLYNSQSIKSLLLGSYAKNRALLGPTAAFVKAGSLASSYSDQEDWLDTLDELLGQAPRHWPLSLYPGHFKVLGNRQVARSLGIDLASDADLGRRLAEGEEP

SEQ ID NO: 25954 - protein, 412 aa, Pseudomonas aeruginosa
QLLRVIRMRRVVITGLGIVSCLGNDKDTVSANLRAGRPGIRFNPSYAEMGLRSHVSGSVDLNLEELIDRKVFRFMGDAAAYAYLAMEQAIKDSGLTPEQISNPRTGLIAGSGGASTLNQMEAIDTLREKGVKRIGPYRVTRTMGSTVSACLATPFQIKGVNYSISSACATSAHCIGQAMEQIQLGKQDVVFAGGGEEEHWSQSCLFDAMGALSTQYNDTPEKASRAYDAKRDGFVIAGGGGMVVVEELEHALKRGAKIYAEIVGYGATSDGYDMVAPSGEGAIRCMQQALATVDAPIDYLNTHGTSTPVGDVAEIRGVREVFGDKAPAISSTKSLSGHSLGAAGVHEAIYCLLMMEGGFIAGSANIDELDPEVADLPILRETRENAKLDTVMSNSFGFGGTNATLVLKRWQG

SEQ ID NO: 25955 - protein, 428 aa, Pseudomonas aeruginosa
PHQPHRHLWPRRTGQAAGRPPGHAGTTAPDHPADRQLGDPTGLRRGGTQRRHRAGQPLADPAERRNPDGRHRGQRDDRRRRGSGAQRQLHLGRLVRLRAIGAERTPAGTGDGPGDPPDERRSGQYLGAGRRPGGKGPGHFQGPRRDPRYRRTDQSPGAQRGHRGGSRRRAGPRFRRGRRRGSRPRPSHPGIHPRDRADDRQHPGRHRRRGRRHGQQQRTRPQHAGDRRSRRPGAQRDRGAGRPDQRAYPGDRQRLRAAGPGGPRGRPQPGEHPRHLAADVRRLQPDRRRQPGTVATGHRPEQHGHPLRRLTMPCAVSRRRTSSGCPAWSPGFTMKPDPLPLRSRPDGQAHQPQASQLSSRPPAGRDRRRLVDAHRARCLRRTDALRRIPEEPRPGQEHPGGAPAQPGGARRDGGGPGRKRQSPGIPSD

SEQ ID NO: 25956 - protein, 242 aa, Pseudomonas aeruginosa
TAAARPGFAAPLAGPAVRPAGLACRGWRTGDLSAPLRRAQPRTLRRRAAATGAGQERRRLPPGAQRAAHAAVPCATAPGAGRSGPAGDVGAVPRRPGRDPAADPHSDLSRPDRLAHPPGQRRQQGSPGLGADPRRSPPPALRPAPGLGRHTDPARQRPGGEDQPELREPVPHARCRPLRGLPPRGRSDRRRTGGRLPRRAAPGDRPARGPALPRGLLFLRFASTPGTGRGHSPGPGEGDCRR

SEQ ID NO: 25957 - protein, 151 aa, Pseudomonas aeruginosa
NEALTPPPMSSMSRNAPYRLDDQIGFILRQANQRYAALFANGIGNGLTPTQWAALVRLGETGPCPQNQLGRLTAMDAATIKGVVERLDKRGLIQRSADPDDGRRLLVSLSPAGRAELEAGLAAAREINRQALAPLSPQEQETLRGLLARLT

SEQ ID NO: 25958 - protein, 537 aa, Pseudomonas aeruginosa
RSIRRSTRHEPGQSLATRLPQGRRPAAGHRQPARPAARPCRAGRHRPAAGPGRLVHRHCRGRQGHRLLRPRRPWYRHPHGTGADRRRRVGRRVRAGRDDPRRHPSHTGPGADHRQRQHPGQRRAAAPGRRRSPALPPAPGRKPFPGASGQPAQRKRPGLRRRQSAATDRLRRVAARPALQPEHRRQGAAQAAQRVPSGRQAGASGGHPGEADRSTDLCPRHALARHAAWTSGTPALYRRGCQRPARQRPAGGGRKLGRRAAGAGQGGRDRRLRRRGLRTRGAGDPRRAPAQGALEGLAGPAAAGTRPARGHASPASEEATHAARLTRSRAAPRGHRPAAVGHLCLALPVARLHRPFLRPRRGRCAARSRLVRHAEPARPAQRPGQAAAARDRGHRGDSHGSRRLLRTQRRRRRQRRRRAPGAGSGPAGAGTTDARTGTWLGTERHRATDRGPRRSRRARPGGGLRLRHLLPLQRRADPGPAPHRADPGHPAGGRHGRPHRDPAIPLPADAGGGQRRRPYRPRVLDARRLGAAERVRP

SEQ ID NO: 25959 - protein, 134 aa, Pseudomonas aeruginosa
RRQHASASGPPAASSRSPPSPSATPGNRPSGHWKAHPVPSAPSRSPAANASPPSATARSATLAKAARATPADGPCRRRSGRSTAATSRRIARAASVAGPTPPSSGPCGMAWPATAATCIRRSLTPPSPGLATKT

SEQ ID NO: 25960 - protein, 177 aa, Pseudomonas aeruginosa
TAMCMRTARTTCCGSSSTASTARPPATSAICPASAIASTTGKSPPWPTTCASVSPASPPGRTSRPRRQACADRRRPEACGSVGQAQGAGEATGGLAEMTLEQADERRGGVVAKVAGHPRHAGALLQRGDRVEQTQALAPLAKRQLGLLAEQPRQGPSGRPHQSRPIRDAARIGGIRL

SEQ ID NO: 25961 - protein, 227 aa, Pseudomonas aeruginosa
SAIRWAWCSMACPAPWGVSLEMMVAHTLAVMRGSRRACVVADLPFASYQESPRQAFRNAARLLADSGAQAVKLEGGEEMEETVDFLVRRGIPVLAHIGLMPQQVNAMGGFKAQGRDPESAERVRRDGLAMQRGGAFAVVIEGVGEPLARRLSEELAIPCIGIGASPACDGQVLVSEDLLGLSGEQVPRFVERYARLDREIDEAARRFAEDVRERRFPEARHCFAMRE

SEQ ID NO: 25962 - protein, 673 aa, Pseudomonas aeruginosa
ATGSTRISLMGTAPARVGKDKARRSGLCRGYCLSGQLHQQLVQSAYVGARILEAVPRGQGGLVEENMRQLAEAVLIRLRIQLLDQRMLRVDLEDRLRVRHFLPAGLEDLAHLQAKVLFADGEDRRRIGQAVGNADFADLLVEHLLQALDQAFLALGDFFLGLLVLFRVQAAQVQVAAGDIDELLAVELRQVAHQPLVDAIGEQQHLDALLAEDFQVRAVLHLRVALAGEVVDLVLAFLHPTDVVGQRYALLARIVAGGGEAQQAGDLLLVAEVFRRAFLEDLAEVLPEGLVLLRLVLRQLLQHVQHALGQRRLHRVDHRILLQDFPGDVQRQVVGVDHTLDEAQVQRQELVGLVHDEHALYVQLQAPRRFAMVQVERRAARHVEQRGVFQLAFDLVVAPAQRVLEVMGDVLVELLVFLVLHLGARTGPQRAGAVDRFPFRLGRLVRLFAVEFLGQLDRQSDVIGVFLDHVAQAPAIGELLLALFQVEDDAGTALGLVDGSDVELALALRRPVHPFAGRLAGATGVDIDLVGDDEGAVETDAELADQVRILLLVARQVLQEVGGPGLGDGAQVSHHILAAHADAVVFQGDGVGFLVEADADLQLGAALEQLGIGQGFETQLVGGVRGVGNQFAEEDFLVRIERMNHQVKQLLHFSLKAQCLFLGFHAHRSKLHQ

SEQ ID NO: 25963 - protein, 629 aa, Pseudomonas aeruginosa
VGPSSGFSSAYAKKPRTIVRRLAFEQFETGDLRRAQQVARLPRTGHFPADHQAPLAVEAGETALGDTPAYRSGLDQALAVALRFDLDQLQVEGGVTRRRQRLRLGRRRRRGHGRRLRRQGGERVAAHRPLPPGVLLQRQLQHLSLAGHQGLDTQRPRMAGRAPGRRPHEADVAAGETSLQIVAQDQGQGIVGVVAQVDLAVPIAQPVGIQLDVAAEGGPVVARQAQVELALQAVRRLGPQVQVQGIATQETTRLGQVLIRLQPAQLDFWQRAAVLGQHVQAQRPERLCRKADLQLALGVEIVPLAQAQHAANQLAALRRERLAVELPAERDGQFRRRPGLRFQPAQAEDRLQPRSVVTGQQRQADHQRDATQRGQPDALARRTPVHADIGQRHRREKAAVTPQQTGTEGQDDDPDIAGDHQQQAAQNQQGIHRDILSPLSAAYGSRLVHLEMRPRGGDGLALGGLPGVDRDVRHPSPLAPDLALRVGIAEVPGTQVVDGEIDDLRQVRNAHEGQQVQHRRMLHEAGDHAAMDGRQGRVADVVLVRRQAEDHVVAQAQAFDAEQLGVRDQLHQRAVVVVPTRVADQLLEAGRAHAAPPCAAGLAAPARAEPPMRMKAPTTWAMGWPGSSW

SEQ ID NO: 25964 - protein, 79 aa, Pseudomonas aeruginosa
TMKKTVTLALLLAASLGLAACDKKEEDKAAAPAAPATETQPSAPDTPPAEPSAPAPSSDTPATPQTPAPTPEQPQQNQQ

SEQ ID NO: 25965 - protein, 211 aa, Pseudomonas aeruginosa
PLQEALHQGRALVLAGTAADLSRRREDRRAAKDQQGRQQHRRDDLSDPVDKATRVQHQEQNHGEVSDGIDEQRHAAVPGEGCDAHLEGHHGCTRGGEQRADGKIDGDGERHSRAPPDRLGQAANTASDPGQGDHRQQRQADTGKEEAESRAPYVFARRHAGTGRKDDVTRAEKKRERHEAKGEQVEPFQMSHRRMYHWQKSRLFGVSLWGC

SEQ ID NO: 25966 - protein, 400 aa, Pseudomonas aeruginosa
SGRSLLTLRGLDDLLGSVGQAGCRDDVQAAFGQDLGTQFSVVAFQADDNRNLHADFFDGADDAFGDHVATHDAAEDVHQDSLHVAVGQDDLERFGHALLGRTAANVEEVGRLAAVQVDDVHGTHGQAGAVDHAADVAFQRDVVQLPLLRMGFTGVVLGRVVHGAQLRLTVQGVAVDVDLGIQAVQVAVFLDHQRVHFQQGQVVVLEQLRQADEDMGELLDLVALQAQLEGQLAALVRLRADQRVDGSLEDLLGSVVGDLLDVHATFGGSHEHDAAAGTIDDGAEVQLLVDVGAGLHQDLADRLAVGVGLVGHQVLAQPLLGERLGVLFALHQLHTARFTAAAGVHLSFDDPLAAADLVAGFCGLFGGVYGKALGYRQAVFSEQLLTLIFVEIHACLPLFV

SEQ ID NO: 25967 - protein, 518 aa, Pseudomonas aeruginosa
RPLWPHGTCRSCPAAPWTGCSQRSGRYRRAPPCLPCRCTSRCRRSSGPAGQRGWRQRNRRGRHQSLPRRISGSYLNPYSGETGRPHEGAAVKRNAKSDVQQQASRIFQQVLDRHQEAHRFLAVDQTVVVGQRQIHHRQDHHLAVHGHRALLDLVHAEDSGLRRVDDRGRQQGTEHATVGDGEGAAGHVFDGQLAFLRLLAEVGDAALDLGQAHELGVTQYRNHQAAVAGNGNTDVLVAVVDDVVAVDGSVDPREALQRLGGGLDEEGHEAQAHAVVLLLEQVLVLRTQVHDRLHVDLVEGGQHGHGGLRLDQALGDLGPQAGHRHALLDTVAGGEDRRLGSRGGRLGRGGRGVLLRFDRSDHVFLGHATALAGAGDAVRIDAGFLGQLARGRGQDGVVAASGGRSGGLCSRSGGGRSGSRSGRSGGAAFVQLAEQLVAQNGVAFVLDDLGQHAVSLGENLDDHLVGLDVDDQFVALDCFARLLVPGGDGAVGDRFREGWGFDFDSHCVRFLKFGFFSA

SEQ ID NO: 25968 - protein, 573 aa, Pseudomonas aeruginosa
ALNSKGVLQQFFLLLGVHRGVAASRSSGAFAAGVLEVEALLVRGDDTTHVMLAAEPGALVHRLFLAPDDVLEVLVRSQNFRQVVFRERIQLLDTDDRGIFAAFRATLLQQVVVHLAAAQHDAVDLLRIQAVDFRDHGLEGTVGQIFQGRDGELVTQQGLRRHHHQRLAQRADHLTAEHVVDLSRGGRHADLDVLLGTELQVALQARGGVLRALPLIAVRQQHGQAAESAPFAFATGDELVDDHLGAVGEVAELGFPDHQRVRRGGGETVFERQHGLFRKEGIVDIQARLAVEQIGQRYVDRVVLLVVQHRVTVREGATADVLAGHPYRMAFEQQGRVGQGLGEAPVDRQATGRHLLAIFVDLRNLALNHEAFRHFQHLAGQFLQGLQVEAGVVTRGPGMTQVRTPVDEQFLVGFLDQALHHVQAVVQGVAVVVDLRLNLLGAEHAGIHQGIGVQLAGSTLLGDLLVHQRLGAARLVRLVVAAATVADQVDDHVTLELHAVVDGQLGDEQHGFGIVAVDVEDRRLNHLRHVGGVLGGTRIVLAAGGETDLVVDHQVDGATASCMRGSATSGRFP

SEQ ID NO: 25969 - protein, 431 aa, Pseudomonas aeruginosa
EAIMADKKAQLIIEGSAPVELPVLSGTMGPDVVDVRGLTATGHFTFDPGFMSTASCESKITYIDGDKGVLLHRGYPIEQLAEKSDYLETCYLLLNGELPTAAQKEQFVGTIKNHTMVHEQLKTFFNGFRRDAHPMAVMCGVIGALSAFYHDSLDINNPKHREVSAHRLIAKMPTIAAMVYKYSKGEPMMYPRNDLNYAENFLHMMFNTPCETKPISPVLAKAMDRIFILHADHEQNASTSTVRLAGSSGANPFACIASGIAALWGPAHGGANEAVLRMLDEIGDVSNIDKFVEKAKDKNDPFKLMGFGHRVYKNFDPRAKVMKQTCDEVLQELGINDPQLELAMKLEEIARHDPYFVERNLYPNVDFYSGIILKAIGIPTSMFTVIFALARTVGWISHWQEMLSGPYKIGRPRQLYTGHTQRDFTALKDRG

SEQ ID NO: 25970 - protein, 281 aa, Pseudomonas aeruginosa
ALSRPSAQRRCPFRDKRRPTSSKLSRLCSWQRNCRRPALSRPAPRKPPSLSHNGGRALPATDRARLLPPQLKRCSPRSKSRGMANAGGTRSSLHRAGSRDAWLAHQAAASTTASPLKASPQTSERLCNRIPFILFRAPAPTGRCLPTWIYRRSQLGCGAVPIPRSPPIMPVWLQTALLLACSNLFMTFAWYGHLKTLNSKPWIIAALISWGIALFEYLLQVPANRIGYTELSVGQLKIMQEVITLAIFVPFSVYFMQQPLKLDYLWAGLCLLGAVYFIFRA

SEQ ID NO: 25971 - protein, 302 aa, Pseudomonas aeruginosa
AASRTQPGDQAGGIPTTAAHRLHFGVELVDQRRDRQLRAVAPRLGEQDRQVLAHPVHGEAEVELSGQHALVAVFQLPGLGRALADHLHRRLAIETGAPGEVQRLGQALEQPRDADLVDHLGQLPATHVAHSPDHPRIAAQQRFGASIEGLLATDHHRQGAVDRACLAAGDRRVEKAQLTLGSQQRQLAGDFRRSGGVVDEQAARRHSGEGALLAQRHGTQVVVVTDATEHQLGASTGLARRIGAPSGVLLDPAQRLGRRAIVDTDVVALSLQVPGHRVAHRAQAEKCDRSHSVISSKSDPAA

SEQ ID NO: 25972 - protein, 212 aa, Pseudomonas aeruginosa
HSGLPRSGSPAILSADPGMDSSDASLAGNRSGGHHRGRRLAPGGNGNHRDRRHPGRRRGRPRTGPLPAFRTAGQAAAADPLLPRPHAYQPGQRRWRSPSQYGLGSLRALARPASSATGRLGQLGRLRPPPVGAGMAPARADQPAQRSAARQSQATLRRSPPVAPPSRPERGPATGRDEFPGPAAPRPGGCPQYRTAAAAGIAGGALNEARAA

SEQ ID NO: 25973 - protein, 62 aa, Pseudomonas aeruginosa
VSAGIREGPGRARGRLGGKGWTRTYPARCAACCCSPCSDCRWWRPLRSNRSDWWMRRVPRWA

SEQ ID NO: 25974 - protein, 90 aa, Pseudomonas aeruginosa
AVSWATLSWNLLFAGTVNWLPLAYSCHSSLPGSLTVSAPATTCMISSWLVPNSYSPAAITPMVAGPAVMSKAMDLTVPSKYSLTLNMGFS

SEQ ID NO: 25975 - protein, 217 aa, Pseudomonas aeruginosa
TGSPCPGGVERGSACPVSSMTRWKVAPGSCRPGSPATGVPLATPSSATRRRRNPSTCASRAACNGGQRRSRPGPGCSLPATASSGSFAARVSRRKRAADPPGLAAAWPVRILCARFGRLSWPLLCQLSGEILPMQCRAGCGACCIAPSISSPLPGMPAGKPAGVRCLHLDENHLCGLFGRPERPAVCGQFGADPEICGDSREQALALIAEWEVITAA

SEQ ID NO: 25976 - protein, 143 aa, Pseudomonas aeruginosa
AWLQNRHRHRGGADRSGGGMGMVTNVTNFSRSGLYDWMAQRVSAVVLAAYVIFLLGYLIAHPNISYADWHGLFSQGWMRIFSLLTLVALSVHAWVGMWTISTDYLTSMALGKAATVVRFLFQAVCGMAMFAFFVWGVQILWGM

SEQ ID NO: 25977 - protein, 591 aa, Pseudomonas aeruginosa
SMASIRTLSFDAIIVGGGGAGMRAALQLAQGGHKTAVVTKVFPTRSHTVSAQGGITCAIASADPNDDWRWHMYDTVKGSDYIGDQDAIEYMCSVGPEAVFELEHMGLPFSRTETGRIYQRPFGGQSKDFGKGGQAARTCAAADRTGHALLHTLYQANLKNGTSFLNEWYAVDLVKNQDGAVVGIIAICIETGETVYIRSKAVVLATGGAGRIYASTTNALINTGDGVGMALRAGVPVQDIEMWQFHPTGIAGAGVLVTEGCRGEGGYLINAHGERFMERYAPNAKDLAGRDVVARSMVKEVLAGNGVGPNKDHVLLKLDHLGEEVLHSRLPGICELSKTFAHVDPVVAPIPVIPTCHYMMGGVATNIHGQAITQDANGNDQIVEGLFAVGEVACVSVHGANRLGGNSLLDLVVFGRAAGLHLEKALKEGIDARGASESDLEASFKRLNGVNERTSGEEVAPLKRELQSCMQNYFGVFRTGEYMQKGIAQLADLRERIANVKINDKSQAFNTARIEALELQNLLEVAEATAIAAEHRKESRGAHAREDFEERDDENWLCHTLYFPGEKRVSKRSVNFAPKTVPAFEPKVRTY

SEQ ID NO: 25978 - protein, 454 aa, Pseudomonas aeruginosa
PSMHESVMQRMWNSAHLSGGNAAYVEELYELYLHDPNAVPEEWRTYFQKLPADGNPAPDVSHSTVRDHFVLLAKNQRRAQPVSAGSVSSEHEKKQVEVLRLIHAYRLRGHQASTLDPLGLWQRPAPADLSIDHYGLTGADLDTTFRTGELYIGKEEATLREIVDSLKSTYCGTFGAEFMHIVDSEQRKWFLQRLESVRGRPGFSAEARAHLLERLTAAEGLEKYLGTKYPGTKRFGLEGGESLIPMVDEIIQRCGSYGAKEIVIGMAHRGRLNVLVNTLGKNPRDLFDEFEGKKIVELGSGDVKYHQGFSSNVMTSGGEVHLALAFNPSHLEIVSPVVEGSVRARQDRRKDSSGDKVVPISIHGDAAFAGQGVVMETFQMSQTRAYKTRWHHPPGDQQPGRFHHQPPGRCAFHRVRHRRGEDDSGADLPRQRRRSRSRAVRHPTGRRLPHAVQA

SEQ ID NO: 25979 - protein, 217 aa, Pseudomonas aeruginosa
GAGPGALLRAPGALPAALCRAEHPGLRADHPGSGLPHAPPSGDPPAAQAAGGDDAEVPAASQARHLDPGRSGQRFLPDRDPGNRQPGSEEGRPRRAVQRQGVLRPAGEASRGRPRRYRDRPYRAAVSVPGRRPGGSSGSVQEPQAHRLVPGRADEPGRLVLQPASHASCHRRAQEGPQPRVRRPRRLRCSGLRLRLDARRAAGKTAARRLYCLTPTR

SEQ ID NO: 25980 - protein, 236 aa, Pseudomonas aeruginosa
RRAGRDHQERRRHRSEQRAARQAERRRRRRSGRSGCRCARRRSGCTGRRSGRRWRRRRHPVPGRAQAGRGSRHRSEQHRRHRQGRSRDQGRRGRCGRSEEERPGRPGQACRPGCRGADLRRRRPCREARADDPPAGQGRRAPGRGAVRHGHADHLQRGQHEADHGPAFEVQGPVREEAQRRAPGLHVLLRQGRHRGAEALPGGQRFHRRQRHRLPRLPGHRCCRFQRPRPGGSGTA

SEQ ID NO: 25981 - protein, 121 aa, Pseudomonas aeruginosa
RRVHEPGRDRGRHRQLRQEGEGRQADHRRHDRRHLHHLQRWRVRFPAVDPDRQPAADRYPRHAQDPGAPDGRERPGGDPADDVSGAVLRPPSDRRQGSGELPGGDQGPAGRSGSPAAGRLI

SEQ ID NO: 25982 - protein, 479 aa, Pseudomonas aeruginosa
DMSQKFDVVVIGAGPGGYVAAIRAAQLGLKTACIEKYIGKEGKVALGGTCLNVGCIPSKALLDSSYKYHEAKEAFKVHGIEAKGVTIDVPAMVARKANIVKNLTGGIATLFKANGVTSFEGHGKLLANKQVEVTGLDGKTQVLEAENVIIASGSRPVEIPPAPLTDDIIVDSTGALEFQALPKKLGVIGAGVIGLELGSVWARLGAEVTVLEALDKFLPAADEQIAKEALKVLTKQGLNIRLGARVTASEVKKKQVTVTFTDANGEQKETFDKLIVAVGRRPVTTDLLAADSGVTLDERGFIYVDDHCKTSVPGVFAIGDVVRGAMLAHKASEEGVMVAERIAGHKAQMNYDLIPSVIYTHPEIAWVGKTEQTLKAEGVEVNVGTFPFAASGRAMAANDTTGLVKVIADAKTDRVLGVHVIGPSAAELVQQGAIGMEFGTSAEDLGMMVFSHPTLSEALHEAALAVNGHAIHIANRKKR

SEQ ID NO: 25983 - protein, 296 aa, Pseudomonas aeruginosa
VMSVLINKDTKVICQGFTGSQGTFHSEQAIAYGTKMVGGVTPGKGGTTHLGLPVFNTVKEAVEATGAEASVIYVPAPFCKDSILEAAFGGIKLIVCITEGIPTLDMLDAKVKCDELGVRLIGPNCPGVITPGECKIGIMPGHIHLPGKVGIVSRSGTLTYEAVKQTTDAGFGQSTCVGIGGDPIPGSNFIDILKLFQEDPQTEAIVMIGEIGGSAEEEAAAFIKANVTKPVVSYIAGVTAPPGKRMGHAGAIISGGKGTADEKFAALQDAGVKTVRSLADIGKALAELTGWEVKKA

SEQ ID NO: 25984 - protein, 349 aa, Pseudomonas aeruginosa
TGGCRTSSPSFRSPIRALAGCCRYPLRWSWQSFAIGCWASRAKRSPETSGEPQEGRLRAAFFMSRRKSCPGRGERRPNGAKQRRGDSRPAQEGVFMTAELGIFNGHLLQHLLAALWFLFCWVGYTRYATWKGRDTACLASVMHLYREDWMRRLLLRDNRIADASVIGNLERNASFFASSTLIILAGILTLLGSTDRAVSVLADLPFVEEASRGLSELKLLCLAVVFVYAFFTFSWCMRQYNFAAILVGSAPMIGERNVGELERKSFAERAARVISLAANQFNFGLRSYYFGLAMLAWFINSWFFMLVTAGVVLVLYRREFHSDVLEVMVYTETAIAESPREGEGEVPRG

SEQ ID NO: 25985 - protein, 340 aa, Pseudomonas aeruginosa
GYRDGCLADSGRPAADGRRLYLGHRPGLRYRSAVGLRQPFPAGGAGLYRRALAYGAQGRRAGRAGLHPAGGRPGAAGQSRRCAAGGDPQPALAETGGQAAGGTVHRAQRGVQRQAFRAAERRVDWRRAEPAPGARFLRPARAADPPSGTAARGAAPGRAARGRRRVARSRAELAATGSGPARGASSPAWLYLAPGPAAQGAEPPGGRVPPEPAERLPDHPQRPRRAVYRPAALSARQGRPGLRLRRYPGPGLARLSAATFRQPRRQPRAGAVLARGQPCAAAAYRGPGGRPGSGAGADAGEERPAGVDGARRRVPRLAGGACDRGRGGGAARAAGAAGAG

SEQ ID NO: 25986 - protein, 330 aa, Pseudomonas aeruginosa
LREPAELEPQQGRRQAGIHLAALRAGPRAVRPVPSRSAAGPEAVRTARVHHGPGRRVPAAVPALHQGCGRLQRPVAERLPGNPAEGSGDRLDEVGVDQARAGHAGEAGEERAGAVQDLLEELRPGPQGRPGGRLRQQGEDRRPAALRLHRRRFGRAERSAGRLHRSDEGRPGQDLLPHRRELLAGEEQPAPGSLPQEGHRGAAAHRSHRRVADELPAGVRRQAVRRCRPRRPGPGQPGLGRGQEGPGRSRQEQGRPDRAPEEGARRAGQRSPRFPPPDRFAGDPRHRRTGPWPADAPDPRGQRAESAGLEADLRDQPAASADREAGCGAG

SEQ ID NO: 25987 - protein, 175 aa, Pseudomonas aeruginosa
GGVRTDADGSLFVLRSVPADPGIFRGERTAVAGAYLQARHRLAAVALDQADMGFVRGEEIVLAPLPNRHQQGEERASLVSQTVFLVTAAFGRDRHHHAVLHQVAQARRQDVLGQAEALLEFAEARQSFEGIAHDEHRPAVADHVQRAGDWTTGLLVAGALDHLGGSGGGEDRVSW

SEQ ID NO: 25988 - protein, 594 aa, Pseudomonas aeruginosa
NPGSTLGNRRKCAAVRRRTAWSDDEAGDHVVQVDGQLRQFLAGGGGLVGAGGRLQRDVADVHQVAVDLAGHLGLLLGGAGDHQGTLVDLADPLRDLVERQAGGFGDLQHVAGAYAAAVHGADRGAGAFLDVGDHLLDLAGGFLGAMGEGANLVGDHGETAALLAGASRLDGRVERQEIGLFGDTADHVEDLGNVLGLFRQAADQRRGIVHFFAHQADRLDRLQYPLASVLRRLLGGGRGVRGGAGVARHFLDGGGHLVDRGGGHLDFVVLLGQRAVALLGDGAEFLRGGGQLGRRAADLLDGLAQLCLHALEGDQQLGRFVAARGVDAAGEVTGSDHLGHSQRLADRLGDAAGEQPGQYHGSEAGDQQYADHCGEGAVIDLIGRVAGLAGALDVEVDQRLQLLLGGAVLVEQGAFGVLAGLFQRLAARHLHQGLLALQERLPGSQVALVDRALVGTTDQPLVGALAIGQFLADFRHAAFQEALAAIVRRQHMGQLHLPQFGEQNVQLGAFADARQPVVADVRRGFVERTHPVQGKDAGDDQQSGDQGETQGGTGRDGHTAQRHDGGFQGAGRGTGLTSTIGRQGGRFSPFMQSG

SEQ ID NO: 25989 - protein, 183 aa, Pseudomonas aeruginosa
SRACHSRLRWMAPSSVNFSALPSRFTRICRIRVGSPQTSIFSRPAWICNSSASPRCWALCWNTRAEPCTSSSRLKGMHSSSSAPRSILEKSRMSLMTFSRCSVDSVASAVYSACSRVCSVVSSSCSMPSTPFIGVRSSWLIIARKSDFARFACSASSRALINWLIACSCSRLARSSPLARLLM

SEQ ID NO: 25990 - protein, 262 aa, Pseudomonas aeruginosa
DPRGNRPASPHRGDFRPEPGARDRRARADRHGGRQRGRRAVRPRPGGPARPHLPRLRQPRPLRSGTRRCAEERLRDHGRPGRGDGHGREHPQHADYPRAGGNDPVRRQARCQPDDLSRPRRRRRPDRHLFLAEEPQLPGRPRPRRGAQPGGGGIAHGRDRGGCEHSQGTQGKVRRDAGVHAAGRRSPCDPLRRPHPGAGHPAADARRAEDRRRFHSHHRLLTRRPPCPQTRKHANRSPSASSGCCCSSWSGRSPNCSSGRWW

SEQ ID NO: 25991 - protein, 333 aa, Pseudomonas aeruginosa
WLSATASASTWRRSAVSVPSTATRNPGRSPTGRAPAPPRARPPTACRPPRTRRATKSRSCETLAVAPRRGRTARQPGFRAAPDRPWTQGGAAERRAAGRVAAGRDSRQPLRARPADRRAGARGTGPGRAGRHRALVDPRRRSARGARFPRRAQRAQSPAGQPPAPGRGAGRSAGAWQPARSVADEHCLAGRAGRRLRRRRADDPGLAASPAARLGSAWHNDYKPKHFPACLRLAVMEYSTKQVLGRSPRTTTTEAVRGHCKSSAARSLLRARKASSATALPGAAHRWRPGRGAELGRGGRPGAACSRLVAQPGSPRRQPYRDHLEELCALDRH

SEQ ID NO: 25992 - protein, 260 aa, Pseudomonas aeruginosa
ARWPSSSVSTTRRTSAVCSGAPMGYRRRACASADSRFPFRSLFRGVAMQELSVLLTLAAVFAIALVSPGPDVALVVRTSLHQGRRAGLASALGLACGILLHTTLVLTGVSLLLSRTPVLFAILQALGALYLAWLGVGALRAWLRRGDGQPGRLDGALPPSPLGPWLRGVATNLFNPKALVLFIALLGSLIPAQMSLGGKLAVAALLFGMGACWFGLLSLTLTRPALQARLLRAVPWLDAACGVVFLLVAAAILEHLVRSA

SEQ ID NO: 25993 - protein, 284 aa, Pseudomonas aeruginosa
KACSIAGRGRPRSVRHEPAGRGSTHQPAAHRTGRASVRSAGRQAGDRPAWLAGQRHELLAPGAEARRAAYRRPRLRRPRAFRASCRGRQLPALGLRAGRADGGRATGLGAFFPVGALDGRHRLGAARRGLARAHRAAGVDRWPDSLHWRSRQGAAEARRSAEGATGATPQAQAGLCRAGKSRGSADARGWRDLPGGRRTARPARPGTGARWLYLAHRRAPDPTVAAAPDPGPRAELRAQRGMPGQPGTGRTGHAGGGAAHAGAAGDPAVRAAPPAGRASPASGR

SEQ ID NO: 25994 - protein, 164 aa, Pseudomonas aeruginosa
TPVITPAWRGKSRLTMPGRSTPMMPMLAPARTLPANRPNTGNRLRRTMPPARQKRISSTLRSAPIRRARRGASGANNPRQSTGAVVSRPAAAAERPVSSRTWLSRGARLDSAGRRFSATSTRPSRSSQGRSGGAGGTGSSSTSASISSSSGGWPGCAPGRAFKA

SEQ ID NO: 25995 - protein, 151 aa, Pseudomonas aeruginosa
SVARASGSAGARGRRAGRCRRCARRDRRSAARRCSGPRPRRPAGRALRRKGVRRFPARRRGDAAVRRACGGRPRFRSPATPGAGWRPAAPVADRACPAAGRRRSDRSPGRSCARDGRRRATGGSAGAGGSAVPGSTAGRSIPLPGATRRGR

SEQ ID NO: 25996 - protein, 130 aa, Pseudomonas aeruginosa
PCVARSAATSRCTAARSAGPAWRRCRRTSGNSSSGTSASATRKTGRKCARGWSGPSATMPTTASACRSASGNATSTRWAWPCTMRAMGCWRSIAAGRVSISSARNWRTTSARACCTWSTTSRPPPADRGR

SEQ ID NO: 25997 - protein, 91 aa, Pseudomonas aeruginosa
SRRCLPTARPKPTRRAAWSSTPRGSATKAAMSVPRRPAPSCSPRKCAAASPTARCRYSAAPAISATTGSSASIATCGCSASTRAPRRSSNC

SEQ ID NO: 25998 - protein, 98 aa, Pseudomonas aeruginosa
SAPPRASVDPSPCHRPWRSPRPVALPGAVRATLYAFFMPSDAALNRFFTPPLRRLSLKRQRPLEGEIAHMTVLDWLSLALATGLFVYLLVALLRADRA

SEQ ID NO: 25999 - protein, 560 aa, Pseudomonas aeruginosa
GRAHEQPRDSLDPGLFRPGPGACTVPRALLLQGDGRPTQSPQRAAGATGARLLSPVRRRSGERAGLEDLHPGAAGIQPGRPGPAVFDPHAAGQPAAEPAAPAGPGMDTGVQHRGQFRHQHQLAGLQRRGLAELLQPDGRPHGAELRQRGGRPLRAGGPGARHQPPLHAAAGQLLGRPDPRHPLRAAAAVPAAGVAAGLAGRAADLIRLCPCHHLARRRADHPARPGGQPDRHQAAGHQWRRLLRRQLDPSVREPERLEQPVRSGLDHPDPGGAGIHLRPLREGPAPEPRDPRLHAAAVLPRPGLVAVGRIPAESGAGAVADRAGRADGGQGESLRHRRQHALGDHHHRRLERLGERHARQPEPPGRHAAAAEHDARRGDLRRRRRRPLRHAAVRPDRGVPRRPDGREDAGVPGQEARGEGGPPAGIHPAGDACRRVGARRHRRQPAGAGLGGDQSRPARIQPTALRLHLGERQQRLGVCRFRCQHAIPQPDDRPGHAHRPLRIHPADPRHRRQPGGEEGQPGGAEQFPDPWSAVRQPAHRDHPAGRRPDFPADPGPRPDR

SEQ ID NO: 26000 - protein, 703 aa, Pseudomonas aeruginosa
TTEPRLLKESHMNAQTQASKNALHKSLERRHNASTSLAALWRPALLQAFVKLDPRQLLRSPVMLVVELTAVLTTLLCFVPDQAVPTSVALQIALWLWFTVLFANFAEALAEGRGKARADSLKAGSQGLSANKRRADGSFESVAASSLRKGDVVRVQAGEMIPGDGEVIEGVAAVNEAAITGESAPVIRESGGDRSAVTGNTQVVSDWLLVRIGANPGESTLDRMIALVEGAKRQKTPNEVALDILLIGLTLIFLLVVVTLKPFALFAGGNLPLVFLVALLVTLIPTTIGGLLSGIGIAGHGPPGAPERDRQFRVPPVEGGRGTFHVLALDKTGTITFGNRRCSALYAAPGVSGKELAEGALLGSLADDTPEGKSIVEYLRILHPIEEPRREELTPIAFSAETRLSGVDWNGQVYRKGAVDAALRFIDLPREKMPEVLSREVDKIAQSGGTPLLVVANGRLLGAIHLKDVVKPGIRERFAELRRLGIRTVMVTGDNPLTAAAIAAEAGVDDVIAEATPEKKLARIRQEQGEGRLVAMCGDGANDAPALAQADVGMAMNDGTQAAREAANLVDLDSDPTKLLDVVQVGKELLVTRGALTTFSIANDVAKYFAILPALFVGIYPQLDVLNVMRLQSPQSAILSAIVFNALIIVALIPLALRGVRVQAADASQLLQRNLLIYGVGGLVAPFLGIKAIDLLLTAVGLA

SEQ ID NO: 26001 - protein, 324 aa, Pseudomonas aeruginosa
GIGAIHTRVRAEYGGASGPRQTAVLGCGIGFRGDDGMTAVAFLGLGTMGYPMAGHLQREGYDVCVYNRSSAKALRWVEEYAGRRADTPREACAGAELVFCCVGNDDDLRAVALGEQGAFAGMAPGSLFVDHTTASAEVARELSLLAAERELGFLDAPVSGGQAGAVNGALTVMVGGEEAFYRRAEPLLRSYARMVRRMGDVGSGQLTKMVNQICVAGLLQGLAEALHFARCAGLDGEAAMQVIGKGAAQSWQLENRHQSMLAGEFDFGFAVDWMRKDLSILLAEARRNGAQLPVTALVDQFYAEVQAMGGGRWDTSSLIARLRS

SEQ ID NO: 26002 - protein, 257 aa, Pseudomonas aeruginosa
SRSGKSSLPLERVGSLAVSRHTAAHPAPKAQDRGLQGVDRPAGEPKITIKRGTGTMRGILRMTVLAAAVFGVAGNALAEDWKLAKDEDGVKVYLSSVQGSKYKAYRGVTDIKADVATIEALQEDVKGSCKWIHACAEMKLLKQEGADAWTYSKIDMPWPVTGRDVVIHVTTEKTADGTVIRHLKADPTYIPEEKGQIRVPKLVGEWKLQPKGQGVTEVTYQVETEPGGSIPSWLANSFVVDAPLNTLKGLRSAAEKR

SEQ ID NO: 26003 - protein, 321 aa, Pseudomonas aeruginosa
LHRQFQLRVVDAQLLEDLVAGLLHDLGARVEVLVDTMAEAHQLERIVLVLGLLDELVDVGHVADLVEHAQHRFVRAAMGRSPQGGDAGGDAGERIGAGGAGQTHRGGGGVLLVVGVENEDAVHGLGQHGADRLGLAGGVEHHVQEVFRVVQVVTRIHHRLALGVLVHHGGDGRHLGDQAMRGDFAMLRVIDVQGVVVEGREGADHAAHHGHRVGVAAEAVEEGLQLLVNHGVVLDGADELFLLRGGGQLAVQQQVAGFQVVGFLCQLLDGVAAMEEDAFVAVDIGDLRLAGGGRHEARIEGEVARGGEAPYIHYIGTHGTG

SEQ ID NO: 26004 - protein, 68 aa, Pseudomonas aeruginosa
RDKFESQFARIHAVEPSVAGFSQKKGAIYAFYKRPAINHLAMGVFVVISSLTVYTRRPTARGIPGPLS

SEQ ID NO: 26005 - protein, 147 aa, Pseudomonas aeruginosa
WVPDKCTSRQLALFVRALSVKKAVNSKRPVNLDLRTIKLPVTAYTSILHRISGVILFLGIAVLLFALDKSLSSEEGFEQVKACLTSPLAKMVIWGLLSALLYHLVAGVRHLVMDAGVGETLEGGKRGSKIVIAIAVVLIVLAGVWVW

SEQ ID NO: 26006 - protein, 199 aa, Pseudomonas aeruginosa
TSAPAAKKSLRSSASCKAACRTTSVCSAPASTCRRASPSWPTCASVSPTSRSTTRARHSTPRASKRWNCKTSSRWPRPPRSRPSTARSPVAPTPVKTSRSATTRTGCATPCTSRVRSAYPSVPSTSRRRPFRHSNPRFGLTKGARHVASECLSLQPRQRCCAVHAGFPGRHQRQGRDGPRRAGADQGTGRGLLLPSFLP

SEQ ID NO: 26007 - protein, 631 aa, Pseudomonas aeruginosa
PAVAKSTWRWRSTRPTWKSFPRWSRVPFVLARTAARTAPATRWYRFPSTAMPPSRGRAWSWKPSRCRRPAHTRRGGTIHLVINNQVGFTTSRQDDARSTEYATDVAKMIQAPIFHVNGDDPEAVLFVTQLAVDYRMQFKRDVVIDLVCYRRRGHNEADEPSGTQPLMYQQIAKQRTTRELYADALVNAGVLSAEQVQSKIDDYRDALDNGLHVVKSLVKEPNKELFVDWRPYLGHAWTARHDTRFDLKTLQELSSKMLEVPEGFVVQRQVSKIYEDRQKMAAGGLPINWGFAETLAYATLLFEGHPVRMTGQDVGRGTFSHRHAVLHNQKDDSVYVPLANLFDGQPRLDIYDSFLSEEAVLAFEYGFATTTPNSLVIWEAQFGDFANGAQVVIDQFITSGESKWGRLCGLTMLLPHGYEGQGPEHSSARLERYLQLCAEQNIQVCVPTTPAQVYHMLRRQVIRPLRKPLVVMTPKSLLRHKLAISTLEDLANGSFQTVIPEIDSLDPKKVDRVVLCSGKVYYDLLEKRRAEGREDTAIVRIEQLYPFPEDDLAEVLAPYKNLKHIVWCQEEPMNQGAWFCSQHHMRRVIAAHKKGLNLEYAGREGSAAPACGYASMHAEQQEKLLQDAFTV

SEQ ID NO: 26008 - protein, 423 aa, Pseudomonas aeruginosa
RLRAEETEFKETHTMAIEIKAPTFPESVADGTVATWHKKPGEAVKRDELIVDIETDKVVIEVLAEADGVLAEIIKNEGDTVLSNELLGKLNEGGAAAPAAPAAAAPAAAPAAQAAAPAAAGGDDAILSPAARKLAEEAGIDPNSIAGTGKGGRVTKEDVVAAVEAKKNAPAAPAKPAAPAAEAPIFAAGDRVEKRVPMTRLRAKVAERLVEAQSAMAMLTTFNEVNMKPIMDLRSKYKDLFEKKHNGVRLGFMSFFVKAATEALKRFPGVNASIDGNDIVYHGYQDIGVAVSSDRGLVVPVLRNAEFMSLAEIEGGIANFGKKAKEGKLTIEDMTGGTFTISNGGVFGSLLSTPIVNPPQTAILGMHKIQERPMAVNGQVVILPMMYLALSYDHRLIDGKEAVSFLVAIKDLLEDPARLLLDV

SEQ ID NO: 26009 - protein, 390 aa, Pseudomonas aeruginosa
TSMNLHEYQGKQLFAEYGLPVSKGFAVDTPEEAAEACDKIGGSEWVVKAQVHAGGRGKAGGVKLVKSKEDAKAFAQQWLGKNLVTYQTDANGQPVSKILVESCTDIDKELYLGAVVDRSSRRIVFMASTEGGVDIEKVAHDTPEKILKATIDPLVGAQPYQGRELAFQLGLKGDQIKQFTHIFVGLAKLFQDYDLALLEVNPLVIKKDGNLHCLDAKINIDSNALYRQPKLRAMHDPSQDDAREAHAQKWELNYVALEGNIGCMVNGAGLAMGTMDIVNLHGGKPANFLDVGGGATKERVTEAFKIILSDSNVKAVLVNIFGGIVRCDMIAEGIIGAVKEVGVKVPVVVRLEGNNAELGAKVLAESGLNIIAATSLTDAAQQVVKAAEGK

SEQ ID NO: 26010 - protein, 561 aa, Pseudomonas aeruginosa
RRPDFPGFLSSRTKATASQRWPSSFYRIRQTNVAAMRYHCQRFVSDKTPGAPRIIPQASAPAAITPHGPQKGSGGLTGPPHPEGRCFLTPPKGNPEQPRLLPVVHPPMTHLKGFDLLALGFMTFALFLGAGNIIFPPSAGMAAGEHVWSAAFGFLLTGVGLPLLTVVALARVGGGIGRLTQPIGRRAGVAFAIAVYLAIGPLFATPRTAVVSFEMGVAPFTGDGGVPLLVYTVAYFSVVLFLVLNPGRLVDRVGKVITPVLLSALLVLGGAAIFAPAGEIGSSSGEYQSAPLVQGFLQGLPDHGYPRCAGLRYRHRHRHSRPRHQRQPAGHALFHDRRGHRRHRPVPGLPGAVLSGRHQPGHRRRRPEWRTDPHRLCAADLWRFRQPVAGGGHHPGLPDHGGRADHGVRRVLQRPAAGFVQDGGDRVLAVQPAGRQPGTDPVDQPFGTGSGGTLSARHRADRPEPVRPALGVGPAGVRAGDDRRAALRHRRRAGGGQAERVGAGRLRQASARRSEPWLAAAGIHCAGPGSRLRSAAGQAARSGRLRRQANPRKAASGRPFS

SEQ ID NO: 26011 - protein, 456 aa, Pseudomonas aeruginosa
KSPLARALSGYVNENLLLVLLRLLRSRCRSLRGCRSVARRRRGAGLGRGSIRSARLGLGSRSCRGRCLVFLFLVASGQAKAGSEQQGKSYGLFHRLASMCGFPRCSPLNICAGVKFHTLRLFRSLCPKPRLPGLWRQGMIRPPENSQQGRRHVGKSSPRARPALSLGLASLPGAGVDGRGRRRERTDPAPALQPGDHRQPGKRGRPRRRDHHPDGHHLWYFHGLRAAGLRDLPDARPAHRLHASRRTAQGCLWLRRVLPGHAERDLHPRLRLPGRSGPAHRPCRRRFHAHGRFGPRRGGQAGRAGRCGMSPTSLEQLVRDARRNNDYSPLVELIPYAKLLGIECLRLGDDMVFRLPANKDNIGNPTLPAIHGGVIAGFMEHAAMLHLLTFMSIPHLPKIIDFSIDYLRAGHFRDTYAQCQVWRQGRRVANVAINAWQTTQGEPIATARAHFKVDEP

SEQ ID NO: 26012 - protein, 422 aa, Pseudomonas aeruginosa
AVRCGKWAEDIAMDALLILGGLLLMVAGYIWVIVLAFGTGLLWGYGSLFPPVALAYIGVHWRTARKGVGLAALGCIPLVVGLALLASHDAARLEAILSLRWLKPEARPPAELSIALSGEFNGKPFAPQSGELIGGVLSLRQGHDFYAQRELQIRLPAQPLGALRLDVLPEDGGALPEVELSWLQPDQDLPEARRLLRGYTLHLDLRPKAPNRLEGEFHLSLPSDYRTTLSGHVELYTDRLRYRHGKVDLGYDSDDTLALVLRDYLQRRFASRDVSLVRAPSWRAASHARPLRIEALVAGQAQVLELTLEKNARREWTVRGDAFPALPAEPATVAAAAAPPEPQALPAPGNATLDLELVQVEPQRYSQRLVKATTVRGRIAEGRFTGLDSEGRLVIRREMPGAGEASYLLRPAEIARLELLER

SEQ ID NO: 26013 - protein, 659 aa, Pseudomonas aeruginosa
KAGRRPHLGDIRRGTRLMSLMELGAMSVETQKETLGFQTEVKQLLHLMIHSLYSNKEIFLRELISNASDAADKLRFEALANPELLEGGAELKIRVSFDKEANTVTLEDNGIGMSREDVVTHLGTIAKSGTADFLKNLSGDQKKDSHLIGQFGVGFYSAFIVADKVDVYSRRAGQPASEGVHWSSKGEGEFDVATIDKPERGTRIVLHLKKGEEEFADGWRLRNVIKKYSDHIALPIELPKEFHGEEADKPAEPEWETVNRASALWTRPRAEVKDEEYQEFYKHVAHDFENPLSWSHNKVEGKLEYTSLLYVPGRAPFDLYHREAPRGLKLYVQRVFIMDQADEFLPLYLRFIKGVVDSNDLSLNVSREILQKDPVIDSMKSALTKRVLDMLEKLAKNEPEQYKTFWKNFGQVLKEGPAEDFGNKEKIAGLLRFASTGDDSGEQSVALADYIGRMKEGQDKIYYLTGESYSQVKNSPHLEVFRKKGIEVLLLTDRIDEWLMSYLPEFDGKQFVDVARGDLDLGSLDSEEDKKAQEEVAKSKEGLIERLKKVLDEQVSEVRVSHRLTDSPAILAIGEQDLGLQMRQILEASGQKVPDSKPIFEINPQHPLIEKLDAEPDEDRFGELSHILFDQAALAAGDSLKDPGAYVRRLNKLLVELSA

SEQ ID NO: 26014 - protein, 513 aa, Pseudomonas aeruginosa
PEQVLADQYLAVAGRRGADTDAGDRQFFAKATGQRLAYAFDDHREGAAALHGEAVAAYPFCAFRVTPLGLEAAHGVDLLRHQADMGEHRYATAYQEVHGFFHFLTAFQLHRLGAAVGQQACGVAERLSGRFLVAGERQVGHHAGAPTAAHHRQGVGDHHLQAHSPGCWACHRAPCPANRRLAAGRHADRGGGPWACCRRSAPPGCRHPCGAGYRERTGDVAGDDCSWRGSGLSMGSHTIPSAAHRSLDGWGQPMPQTGQERDLPRFRSLPCAVYLRAFEMPAGHRVEMHEHPWGQLMYAASGTLRASTERHSYLVPAQRALWIPPGVRHAAEACNPVLFRSLYLDRSLPGGCRVLEVSGLLRELLLRAAEFPREYPPGGEAERLMQVVADEVGRLREAPLNLPLPGDPRLRRITDALQADPADPRGISDWAGLVGASRRTLARLFREQTQLSFREWRQRLRLLNAVAALEEGASVTRVASDLGYDSTSAFISLFQRHFGQTPGCFARSLRLPN

SEQ ID NO: 26015 - protein, 243 aa, Pseudomonas aeruginosa
SAAGCPGCPHAHCCSAPGMDARRRSAVRRRHGGRPGRPRRTGARRCRWAVARGRSPAGRGVAPVADRFPRPGQRRRTQGNGPGPAGPRPTAWPGLRRPLAPSARWRPRGRPNSRGGGRRRGPPRSRRWAPANWRSRLARSSPPPRRRRSARCRTFPRRAHCAASGRRCNGRGLRRDRRRGSIAGCASARRGRRRAPGTAGSSRPSAGVGRRGTAAGWQAFRCAPPAGSSGRRTGPSGLRRESW

SEQ ID NO: 26016 - protein, 399 aa, Pseudomonas aeruginosa
ITRSPAPACQASRPNSRASQRSGEPWPSGSGLCSLRPIRRNAMAGPRTRALFSTLFALSLVTSLTHARDYRYSDAHVHYVDFFQESEGMPRLLEAMDKGRVDHVMLSGVAVAKKWHEDEPKRPRYYAGDDAGAYWYSATDVIVAAAVKSLPAEQRRRVHPFLTGFNPTDKNADAHIRRMLELDPGLWQGIGEIFTRHDDLTALTYGDVPRANNEALARVYHLAAEFDLPVLLHANVTSKRERNPLYLAEIEEPLRNHPHVRFIWAHAGTSMEIHRHQKKLDFLLPTLRASATALPEPLHRPVLVGVAPVPAGRAGQARSAVAGTGRAVSATLHARFRCGRPVRQPARVDGELRSVPRRLARAGRSPGGAGQLSGGAAAPARRSARRITRIRHQSVMPAS

SEQ ID NO: 26017 - protein, 159 aa, Pseudomonas aeruginosa
VMSFIRSCISRSVFLLGAGVAVAAQAEVRIDGPIEYGVFESRYQDFQPGERVLTRSEQNIQQTTEVPAKLGTKFGMRYQLSGKQEGDTPLTLLYLTPGVVTPDGQRHDKFEVVQKLVPGAPTDVMAYEFTEPHEVVKGEWRLMVFQGDRLLAEKSFDVR

SEQ ID NO: 26018 - protein, 363 aa, Pseudomonas aeruginosa
DGARHGQTTKRVTMLFRSMASCDSSWLAAAVWLEPADVCSEMSRMFTRLRSTSRATWACCSEALAITRVRSLIWPTRSAISLSARPAASAISSMLRARTLLLSMAPTAAPVPSWMLAIICSISRVDSWVRWARARTSSATTAKPRPCSPARAASMAALSARRLVCSAIPRITSRTLEMSWAFSARPPTSAEVLSTSSLIRRIAWTVSSTRWRPFCADCSEADEASEVELALRATSSTAAVISLTAVAAIWISSFCWVSERLPCSVTALSSSAAEASWVAELPICWMVWRSCACMPWRATSSLAGSSRPEVSMRLVRSPEAITSATRSASPIGWVMLRVNSQASTTVARPATSSTPITAAKALS

SEQ ID NO: 26019 - protein, 372 aa, Pseudomonas aeruginosa
VGHFRVEFVDVGGAGDEAALHHQQAIDRLVHAGGAQRVAGQALRRADGRRLVTEHFAHASDLGDVADRGGGAVGVQVVDRRVDGGQRLLHAADRAFAARGDHVVAVGGGAVADDLGVDLGAALERMLQLLDHHHAAAAGDDEAVTLGVVGAGGLFRRVVVLGGEGAHGVEQAALAPVFLFAAAGEDHVLLAQLDLFHGLADAMGAGGAGGGDRVVDALDLERCGQAGRYGAAHGAGHAVWADALDAFLAQGVDGFHLVQGGSAAGAGDQAGAGVGNLFRSQAGVLDRLLHRQVGVGGGIAHEAEDLAIDQLFEVQVDRTGNVAAQAHLGVGRIEANAGPTRTEVGGNGVFVIAEAGNDAQTGDNDATHADNP

SEQ ID NO: 26020 - protein, 437 aa, Pseudomonas aeruginosa
SPACGYGCPSRGAGSWFFSFGEAPAEVGVAGQVDTQGTGYLPIAEHLEMPWIEAEGPVPGRLAEQFVEGVQPILLVAVAARQAAGLDEGCGGAEQRAVLGVAAEQQALDALRVVQLFVVDAEQQVTIAEQELQRARVVVAAAAGDEQLEPLAAGLAAKLVEEEFAVLAVEHADALDARQDQARQAELAGRRRVAPEYAETSDAVSAMSVGAWQQALAIDPVEQQRQGRRRPVLAQAPGQGLGAEQEQAGVVGEDHPLRQGRGRAQFHLVLRPSLRQGIAKGVHRGPLVGADQDQLRGLADMRETAEDEREQRLESPAGGAQATHLERHLGAEVEQVAAVVAVVGKRQRFVVETLLEHAGQFQGGLAQGNALGQAQVDAFETMSIERVVAIIEEGAGPALAPVVHPAGRAAVAGGQAPVVATGGVVVEIGVGGAQAVA

SEQ ID NO: 26021 - protein, 341 aa, Pseudomonas aeruginosa
IMTEQQPIAVLGGGSFGTAIANLLAENGQAVRQWMRDPEQAEAIRSRRENPRYLKGVKVHPGVEPVTDLERTLADCQLIFVALPSSALRKVLQPHQAALTDKLLVSLTKGIEAHTFKLMSEILEEIAPQARIGVISGPNLAREIAEHELTATVVASEDDELCARVQAALHGRTFRVYASRDRFGVELGGALKNVYAIMAGLAAAMDMGENTRSMLITRALAEMTRFAVKLGANPMTFLGLAGVGDLIVTCSSPKSRNYQVGHALGEGLSLEEAVSRMGETAEGVNTLKVLKEKSDEMQVYMPLVAGLHAILFEGRTLAQVIQLLMRGEPKTDVDFIPTTGF

SEQ ID NO: 26022 - protein, 271 aa, Pseudomonas aeruginosa
RGDRHVRRPASTRIDRHPHPLDAAVRPGLAGRRTAPRGGGGDPTGLPTDLRRAERQPDGFRRQPQPVPGADRPFRYLPQRRETLAVRRLAERPRRRGRGRPQRAARRAPGARRRAEVVKLWLLRHGEAEPHASRDSERRLTAHGRKEVLQSAARLAGLPLDGILASPYVRAQQTAELVREALGLVEPVGTAPWLTPDDDPREVLGFLDERSERNLLLVSHQPLVGALGGLLVHGNRRDPLPMSTASLAELEGDFAAAGLMTLVSLHHPRHG

SEQ ID NO: 26023 - protein, 576 aa, Pseudomonas aeruginosa
WNIRPSKCLVDLPEQQQRRRYVVTANRLPLEVFFEREKRHPQRRYLVQPIGGGRVEELSWGEVGDQARRAAAWLRSLDLPAGSRIAIISKNCAHWIVTDLAIWMAGHVSVPLYPNLTAESARQVLEHSESAVVFVGKLDDWPAMAPGVPEGIPTVAMPLHPEGRFDRQWIDLHACAPLEGDTPTAAEQLATLIYTSGTTGVPKGVMHNFSSFAFAASRGVELFGTREDDRMLSYLPLCHVAERMFVEMGSLYGGTTVFFAESLDTFVEDMKRARPTLLFGVPRIWTKFQMGVYSKMPAQKLDRLLKLPILGRIVGRKVLAGLGLDAVRYALCGAAPVPEALLLWYRRLGLDVLEVYGMTENSGYSHVCRPGRQKTGWIGQNSPGVEVRISDEGEVQVRSGATMVGYYKEPEKTAEVLTADGFLRTGDKGEQDAEGNLRLTGRMKEIFKTSKGKYVAPAPIENRLAVHDRIEQVCVVGEGLSAPLGLCVLSEVGRREALNGTRGALESSLRAHLEQVNGALDKHERLVGLVLVQETWAVDNGFLTPTLKIKRNMVEGAYGSRFHEWVERREAVLWHE

SEQ ID NO: 26024 - protein, 179 aa, Pseudomonas aeruginosa
LPPTGSPWLPPCARNSHEPLATNARPGATERLAEEQHRRPAWHPLRSLRRRVADRQHAGRLAYPPAVRPAAWRRLGGPRGKPGLDGQLPVRRYQPVLLRRPGSERQPPAWPAQRPGHRGGQGDPPGAHHPCLGHPPQWRRRQAELHRPPDHGGGAIGGQGGLSAVRNFVQDRSVPRAVE

SEQ ID NO: 26025 - protein, 176 aa, Pseudomonas aeruginosa
PGPRRASAAAPASVAPGHARRSGGAGEPSGPGRAPLAGAGLPAQPGQQPAPGGGRPGRLRPARLDAAARLAGVAPGVPAEPGGTGRLLRPEPLAGAAALPPSLRPAAPPVADPTAPGARLAAGSARRAAIEPGGPAVRFLRPGALQPSVPAHLWVTAGAPAPALIRVFLSDPFFVE

SEQ ID NO: 26026 - protein, 366 aa, Pseudomonas aeruginosa
RAAQQSGASTTVAGAAGDGARAAQQGGVAAPHPADPGDAARRVHVAARRPHVPAGAPAGNRRTAERRVRSLVAGDRGAFGMSLQVEEVRISLPHIELAAHLFGPPDGKPVIALHGWLDNAMSFSRLAPKLAGLRIVALDFAGHGHSAHRAEGASYLLWDYALDVLMVAEQLGWERFSLLGHSMGAIVSVLLAGALPERIERLALIDGLIPYTGEADKAPQKLGEALKAQLALRHKRKPVYAELEKAVEARMRGVGEISREAAELLAQRGLEPVPGGYTWRTDARLTLPSPLRLTQAHALNFVRSVECPVSLVLAEQGMLAVEPRMRALLETLPFERHHLPGGHHLHLDDEAGAQAVARVFAAFFAR

SEQ ID NO: 26027 - protein, 245 aa, Pseudomonas aeruginosa
GTDLPARGDQSHQRSPAHGGRGARRRRADRTDLPLAARAQQPGGVRRGAHRAAQGRRHAVVLVRATRLRLQQPAGQRRVRQCQAVRPGRAAGLPAGASGGAAGEQPGGGLLDHPWQSPRLPAGRGTQGRCAAGGTAAEPGDPAAPAQGQRRTDPQPCAGGAGRLLVGAAGADPAPGYRGAGRAVRQARPGVARRPARAGRAEQPHGAGPVGGRGPAPQLAALNAFARACGPGRWRKCLRQGRPPE

SEQ ID NO: 26028 - protein, 153 aa, Pseudomonas aeruginosa
APDCGRHRPSVGGSGRRALCSPAGRRCRSAGAKRRDVRAMRSGRCRRGERLPGAPPRSRSSRVPPGSAAPRCAPAPAWFPADRRRRARRCRRPGGLPARRRRSAPAPLRARCCGSCRAARRVPAPAAGAGRAANGRRRCAGGSAPGRCPPGSA

SEQ ID NO: 26029 - protein, 149 aa, Pseudomonas aeruginosa
ICAQDTSAAASPESVARGKSVGLAARRMTLRRQVADASAYGGGFAGAQGHAQLRSSAQPGTGPVARVTGKRLQALENAQQAPRAEAVAPFQRAVGIAEAEVHRLVDILDAGNALLGDVAGEVDDHRQYPLDDEAGTVAQHRDPDAVASQ

SEQ ID NO: 26030 - protein, 680 aa, Pseudomonas aeruginosa
RVGGVAHGRGSQWREHQAAPALEVAEQVDADAALGGTGEALHGAAQVLAPGGQQAERCGGRAFAGFRLDAEAMQQFGERAAVVLVFAAQPHRGPDGGLRHRLRTGLVLRLAVDVAIEALAALAPETAGGEQLAGQRVRAVARFLVVLLVDRFHYRVRHVEAGKIEQFERPHAEAGALAQHTVDLGAFGDAFAEDAQGLGAIGAAGMVDDEAGAVLGPYAAVAQARGEGEQGVADFRSAGQAVDHLDHAHQRHRVEEVKAGDPLRPLAGGGDGGDRQRRGIAGEDGLRRDYGFQPAQQFLLGLQALDDGLHHQFAVAQLFQAFRHPQPVLRGLGVGGAQLAFAAQALEGLPQALACLGGGLGAAVEQPYGQAGLGGDLGDPGAHRTGTDHGDTTNIGHRLFPLVVRRAFLQEGLHAFLLVLRVEQQLERLAFQGQGTVQRQVGTGQDHLLDLRQRQRGQAGDLHGQFQGARQRRLVRHHFADQAHGQRLRSLHQAAGEQHAQRLELAHRPYQALGAAGTRHHPDLDLRLGELCRLAGDDQVAVHRQFAAAAQGEAVDRGDHRLRAARDGFPVALAVAAVQADRRARREIAEIGASCKAARVAGEHDDADRRIRAERLEVAGEALAHFVVQRVPGLRTIEAKQGYIGCGKFEQDHGRRIGGHGSSDELIFRYAKYSFMIYRK

SEQ ID NO: 26031 - protein, 596 aa, Pseudomonas aeruginosa
PFWIGCPWPWPRDCSSICWWRCYAPTVPRGGHMNSHEILLILAFFALVLVPAPFLGRYCFKVMEGQRNLLSAPLAPLERVCYRLFGVDPASEQDWKTYTLALLAFNLAGLVLLFSILMLQGSLPLNPQHLPGLEWTLAFNTAVSFVTNTNWQAYSGEASLSYFSQMVGLTVQNFVSAAVGLCVLVALARGISRRSTRQLGNFWVDLTRGTLYVLLPLCLLLALLLVWQGVPQTLFDYVHATTLQGAEQTIPLGPAASQIAIKQLGTNGGGFFGVNSTHPFENPSAWSNLFEVASIILIPAALVFTFGHYVKDLRQSRAILGCMLLLFCLGLGLSLWAEYQPNPALAQLPIEQGAPMEGKESRFGTAASMLWAITTTAASNGSVNAMHDSLSPLGGMLPLLNMMLGEVIFGGVGAGLYGMLLFVLIAVFLAGLMVGRTPEYLGKKLEAKEVRLLVFTLLVMPVGVLVLGAIAASLPGPASAVTNPGPHGFSQLLYAYTSGSANNGSAFAGFGANTPFHNLMIGLAMLIGRFGYILPILAIAGSLAAKKASPVGPNSFPTHGPLFVSLLTVTILLVGGLTFLPTLALGPIAEQLSLGF

SEQ ID NO: 26032 - protein, 218 aa, Pseudomonas aeruginosa
CIRWDTRRTRTRPRALRRKRMDKDVSGALRRLLLLAMLGLPLVAAAAVEPQRLVDAARAQVGVTLGYDPAYRQLDYPGGDVPLQTGVCTDVVVRALRGQGLDLQKAVHEDMRRHFAAYPQQWGMKGTDRNIDHRRVPNLMTWFSRQGLALAPSRDASAYRAGDIVAWRLDNGLLHIGVLSDRRLEGRPLVLHNIGAGVREEDLLFRYQVIGHYRFPQG

SEQ ID NO: 26033 - protein, 270 aa, Pseudomonas aeruginosa
IQVGRHRPVGAGARKRMKGMRLHKRSLVWGLALSGLAVVLAAAWWASQASREPALWSELRVPPAFAIPRDFDLGEHRLSWGGKSLALSVAGSARPPLWESEGGFLGAGRESAGRLQLRCQEQSLESFELVGRRLSLKGHLRCADGRLSAYELSFEPRQGGMEVRVALADSELNRVALSWRRGAGERLSGIVDDEVEGRSWVLPAGVAGYWSSAGNAFLGHSTAAQSLDLREPGRVQWRAATESARAWLFAAGNREQWQLRSARLEAETRR

SEQ ID NO: 26034 - protein, 265 aa, Pseudomonas aeruginosa
EARIQAFRQLRAEDRSGIRTQGSDLLRVPAMLQVSVYRYNPDKDAAPYMQDFQVDTNGKDVMVLDVLALIKEQDEGFSYRRSCREGVCGSDGMNINGKNGLACITPLSAAGLKGGKLVIRPLPGLPVIRDLVVDMSIFYKQYEKVKPFLQNDTPAPAIERLQTPEEREKLDGLYECILCACCSTSCPSFWWNPDKFLGPAALLQAYRFLADSRDTKTEERLASLDDPFSVFRCRGIMNCVNVCPKGLNPTKAIGHVRNMLLQSGT

SEQ ID NO: 26035 - protein, 249 aa, Pseudomonas aeruginosa
GQRGLQSPWYRSQGRHHRRSGDGCAQGQHRQEPDRRHRYPVQGQRRDLLRRPRQAAGQQAGGSDRSGRQDPGPGSRERDHRFRLPPGGDPAGPADRRHHRRLHRRPGIPGPTEEAGCDRRRRHRPGAGFGMGPPGCRGDRAGSPGQVPPGCRRADCQGSPEGPDQARPEHSPGCPRDRFGSEEEAGHRDLHRRQRRAEGNLRQADRRGRPSPGDHRPAGRRQRRDPGRAWLHLRRRPLQDQRSGRLRHR

SEQ ID NO: 26036 - protein, 262 aa, Pseudomonas aeruginosa
RGSRRDARAQGLGRGRDGRRAHRRPQGADELRPDSVGHLHPPGNRLGRQDRADPQGRGRRSQRRHLPVRRQRSRDGCQRHHRPGQGHRRCEDRPRPGRPRDRPERRRAGTARRDRHGIRHQRRRPGHDGLLSPDAVRSPARSCPGSEWPCHPHRQPQEALSDPTPRFTPGASQRRGTRRPSGQDRFLALSGPGSVESTVCRLRRDAAGGRLSEEPRRVSAGDRCEVAAGVCRRTVFSRAGWFAKRRSQVVGRHERSAEMRNT

SEQ ID NO: 26037 - protein, 282 aa, Pseudomonas aeruginosa
PGHLPLRTGHRLWHQDGRRRDPRQGRHHPPRPAGVQHRQGSRGSHRRRSLGHLRSGSVLQGLDPGSGIRRHQADRLHHRRHPDPRHAGRQGQVRRAGRTPDRPELPGRDHSRRVQDRHHAGSHPPAGQGRHRVAFRHPDLRSREADHRRRLRPVHLRGHRRRPDPGLQLHRHPEAVPGRSADRSHRHDRRDRRFRRRRSRGLHQGQRDQAGGVLHRWCDCPSGQAHGPRRRHHLRRQGHRGREVRRPAGRRCEDRAFPGRHRQGPGRADRLGSEEGLISRVF

SEQ ID NO: 26038 - protein, 300 aa, Pseudomonas aeruginosa
TRVALSTGSERSSRRCCCRPCWSLAARRSSRRRERSAAVPASTRARPWCRASCRGYLTMDTLGALVFGIVIATAIRDRGISDSRLVTRYSMIAGVIAATGLSLVYLALFYLGATSQGIAGDAQNGVQILTAYVQQTFGVSGSLLLAVVITLACLTTAVGLITACGEFFSDLLPVSYKTVVIVFSLFSLLVANQGLTQLISLSVPVLVGLYPLAIVLIALSLFDRLWVSAPRVFVPVMIVALLFGIVDGLGAAKLNGWVPDVFAKLPLADQSLGWLLPVSIALVLAVVCDRLLGKPREAVA

SEQ ID NO: 26039 - protein, 278 aa, Pseudomonas aeruginosa
RVVLRLQHADHPRRHPHPAGLHRSRRLGTGRPAVRGGGQPGTVGTEAAVPGSGLRLCLLHLQLVHAPIQLRGDPGRLGTDDRRAQRRRAGAQILCRACRPGHLAGGQPVQLRLALVLFRPGHARLVHQFLVLHAGDGRRGAGPVSPRIPFGRAGGDGLHRDRNRRKPAGRRGRGAQGLNPGHEKARLRGLFQGTSTRTYCWFCCGCSGVGAGVCGVAGVSLDGAGALGSAGGVSGALGWVSVAGAAGAAALSSSFLSQAARPRLAASSRARVTVFFIV

SEQ ID NO: 26040 - protein, 169 aa, Pseudomonas aeruginosa
FALQKTPSKVAVMSENPLLERARRFLSALRHCQVLGLTVEAADEKGLTLRLPYSQAIIGNPESGVVHGGAITTLMDTTCGISTVCVLPDFEICPTLDLRIDYMHPAEPHKDVYGFAECYRVTPNVIFTRGFAYQDDPGQPIAHVVGAFMRMGGSARAGAARPAAQGGAA

SEQ ID NO: 26041 - protein, 240 aa, Pseudomonas aeruginosa
PRQSPLRRALSFPTLAGAVPMSEIRVEPVAYDIDGQPYEGQLVYDASHAGPRPGLLMAPNWMGVSAAALDIARQVAGRGHVVLVADLYGRDVRPQNGDEAGAAMMPLKNDRALLRKRMQAALAALRGQALAAVDTTRQAAFGFCFGGCCALELARDGAELKAFVSFHGTLDTPDPAHARNIKGAVLVLDGASDPLVPREQLPAFAREMTDAGVDWQLTIYGRRGAFLHRSERQAAGQDAL

SEQ ID NO: 26042 - protein, 144 aa, Pseudomonas aeruginosa
RSTKRGTCSPLSPSRSSLTSTWPSQAGEAPIPMQGIASSSLRRRASGSPTPSMTTAKAPPRCMARPSRRTRSALSGSRPWALKPPMALTCCGIRPIWASTGMPRRTRKSTVSSISSPPSSFTAWAPLSASRRAALRNACRGDSW

SEQ ID NO: 26043 - protein, 507 aa, Pseudomonas aeruginosa
RGWPATLATTPPRRSSACSSVISARPPVASPAPCACPTEPHASGRRLSAQACRLGREVRPGGLAGETLAQVVGQGGDLPVVEAMAEAGHIAEVAGGRAVDAVEDDPQQVVRAVRMHIAVQRQGWTHAEEARSVAVMVAGQAGPGEQARAAAAGRLHAAVALPVEALRLLLIGFPGRGSGVGRKVMGQGPQVLVRLLGQAFADHWRHRPAGDPVVGRIAVAEVGVEGLLAPGDGRRRTGVQGWRGPALRLAAGEVRAAGLFRAERIARRVAGAAMAEAFGEIGAAVPLLVARRLVAVGAGLQEQQVPAGHQLALVEGERQLVGRRFAVHRRLAHQVGVQGLQVFVASPGEGGVRERRIQVAAVAGHAMPHGPLEGGVGPATDAARAIRREVAAVDRPERRRQGPSAGVARAAFASVADRAVAEGGEAFAAGDLLGAEGTGCAFQWPDGRLPGVAEGDGGERDEAAGGPEADACCLLHLSVIHCAGRRGAPGKRIRPARCAAPRVRVPE

SEQ ID NO: 26044 - protein, 183 aa, Pseudomonas aeruginosa
PTATCRGPTTRRWRGSITWPPNSTCRCCCTPTSLPSANATRCTWRKSRSPCAITRMCGSSGPMPGPAWRSIATRRNWTSSCRPFGRLLQRYPNLYIDLSWSVLRPYLLDEQGKPDPQWLALVERFPQRFMLGSDVVGQFDSLPELMASFDPFLDALPEQVARQVARDNFLAVLPRQPADPRGE

SEQ ID NO: 26045 - protein, 360 aa, Pseudomonas aeruginosa
EIENVVDDLQQVFGGLGGQRRVLGLFAGLLGGFQQLQHAQHAIHRGAKLVAHHRQEVGLRPVRLLRFLAGADQLADRLFLFPARAVQPAGEIVDVTGQVADLAVVEDRQAGLVVAALDRLDRLAHGADRRRQALRQAARDEEGEDQGEGGQQGGLQEDFLLPLAEGVVGHADHHPAEVVLAGLAVAFAGAIQQRVAGQGDTLALDGGVEDVDRRGVLQRAGQLFDVHQDIVVAVAYLDEAHMRGVEGGLQQLLQHGRVAGDHAVFGGRRQLVGDQLAGMGQFLAQVLQARVGEVGGEQQGQQQRRAQADRQHAGTDVPAVALAHGSSPSARRRPRSASLARSIPRERATCRLPSTLKCPG

SEQ ID NO: 26046 - protein, 135 aa, Pseudomonas aeruginosa
CAASRRPTSISFPPPASDEETAMSADPQARESIAIRILWMLLFVLVWQVAELLLGAVVVIQLVYRLIYGAPNGSLMAFGDSLSQYLAQIGRFGTFHSDEKPWPFADWPSARAAEGEAAHSVPPAAHPARDEEPKL

SEQ ID NO: 26047 - protein, 191 aa, Pseudomonas aeruginosa
RSSAIWWKVPMARASTNGWNAARPCSGTNDSHRREALGFPLAQGIPMSLWRQMPDLEQLNASQKNSIGDLLGIRFEAFDDESLTASMPVDSRTHQPFGLLHGGASVVLAESLGSMASYLCVDTSQYYCVGLEVNANHLRGLRSGRVTAVARAIHLGRTTHVWDIRLSGDDGKPSCIARLTMAVVPLAGRAG

SEQ ID NO: 26048 - protein, 277 aa, Pseudomonas aeruginosa
SSGMEQITHLSSGIPGVRLIDAEHNRFSFPRHFHLEYHIGLLLQGRHRYAAGGERRLAGAGDALLMAPESIHDGSSAGEEGYRIRVLALDADWLERASRDFSDGRRGAPRLTSSLVRDERLQQRLRQLHLGMLGGAAALENRLALEEHLWQALACLLSLGSSLRLEEGDREGFGQRDWTRLRDWLESRLEYPPNLEELAAFCGLSPWQVLRRFRRHCGLPPHQWLTQLRLERALPLVLRGEQPLSQVAQQFGFYDQAHFSRLFRRTYGLPPARLRQR

SEQ ID NO: 26049 - protein, 531 aa, Pseudomonas aeruginosa
FAFSFPIPFSWSSHAGIVCLADPGGGVRHSPGQPRSRCRPGGAHVPAPGAAGRPGQRAGAGLRDSPAYHPGADRRVAAAQPYACAVRHPAGARRAVPGLARRRRAARLAAARRRPAGPARRGTAAVAPGALAARSGDQSVQSQGAGVIHRLARQPDSRADVARRQTGGGGAAVRHGRLLVRPAQPDPYPPGPAGPPVARGALAGRGLRGGVPAGGGGDPRASRPLCLRFWPLRRARQPAKPLPPRRGCRRIPGISPVETSRMSQSVFFAHANGFPSATYAKLFEALAPEYRVDHLEMHGHDPRFPVNDNWDNLVDELLHHLASLEQPVWGVGHSLGGVLHYHAALRRPELYRGVVMLDSPVLTLADRLVIRAAKRFGFIDRITPAGRTLGRREAFPDLEEARAYFSGKALFRRFDPDCLEAYVRHGLADSGGGSGLRLRFDPATEISIYRSVPHSSPGRPRQLQVPLAMVRGRHSKVVLPHHTRLIRAMPRGEFMSLPGGHMFPLERPRETAELLKGVFDRWSRATEERSA

SEQ ID NO: 26050 - protein, 314 aa, Pseudomonas aeruginosa
TSCAAWNARSAWYWPNRACWRWSRACGRCWRPCRSSGTTCRAGITCIWTMRPGRRRWPGSSRPSSRAETPACRCFLDYSGSSRKAGRIVTESHRMIDLYTAATPNGHKVSIALEEMGLPYRVHALSFDKKEQKAPEFLRINPNGRIPAIVDRDNDDFAVFESGAILIYLAEKTGQLMPTDVKGRSRVIQWLMFQMGGVGPMQGQANVFFRYFPEKLQGAIDRYQHETRRLYEVLDGRLGEAEYLAGDYSIADIATYPWVRIHDWSGVAVDGLDNLQRWIAAIEARPAVQRGLLVPRREKEGDDAIRTAQSMLTR

SEQ ID NO: 26051 - protein, 271 aa, Pseudomonas aeruginosa
GPVCEGSCCYPLGVFSFSALAADLPGSHDLDILPRFPRAEIVDFRQAPSEERIYPLGAISRISGRLRMEGEVRAEGELTALTYRLPPEHSSQEAFAAARTALLKADATPLFWCERRDCGSSSLLANAVFGNAKLYGPDEQQAYLLVRLAAPQENSLVAVYSITRGNRRAYLQAEELKADAPLAELLPSPATLLRLLKANGELTLSHVPAEPAGYWLELLVRTLRLDTGVRVELSGKHAQEWRDALRGQGVLNSRMELGQSEVEGLHLNWLR

SEQ ID NO: 26052 - protein, 360 aa, Pseudomonas aeruginosa
GRPALMFDNDRLLLRVLLFGLLGASLWVLAPFWSALFWAAVLAFASWPLMRMLTRLLGGRESLAAGLLTLGWIVLVALPLIWLGFGLADNVRSLMELLKNLQVEGLPPPPSWMAGVPLIGDRLIGWWDSIDQQGVAFFYVLKPYVGEVGNWLLARSAKIGGGILELVLSLILIFFFYRDGPRLESIVHRALERLIGNRAEHYRDLVAGTVQRVVNGVIGTAAAQALLAWIGFMIAGVPGAMLLGLLTFACSLMMVPPLVWGPATAWLFFKGDYGHGVFLGLWGFFIISGVDNILKPYLISRGGNLPLVVVLLGVFGGLLAFGFMGLFLGPILLAVAYNLLSDWIASTPRTPPAEGRGPDA

SEQ ID NO: 26053 - protein, 405 aa, Pseudomonas aeruginosa
VTKEKKPRDAGLFASAGLQVFAAGPHVLAAPGAEAEQGGGDGDADEDIADRVPAAGQVVDHADHERPHGRQGVADALGHARQMRGDVGVARAQDDQRQGDAEGTALAEAEQDRPAPDGLQRRIEEAEQAGEGGRHHQHHRQALVPGASGEPGREQGGDQLQHHRAGQHQAGFHRSHAAVDQDRRQPTEDDVGQGRLQAHVQRDLPGQRVAPQADDTEGLAMGVLALAGLRQPEGGGEDRRQRPERQRQFPVAEELLQRRGSAGGERCAQAQGHGVDPGHHPGLAREVAFDDARQEHADDADAGAGQDAAGEQAEHREQAAQDDAAGQAEEDQQHAALGADTPGQARRERREQPQAEYRRGGQQAGGSGREAGIVAHLVEQGGEAGQRRAQVQRHQHQAQQEQPGA

SEQ ID NO: 26054 - protein, 167 aa, Pseudomonas aeruginosa
PRPRCTAWSISSTLAMPCWAMSQARLTIIASTRWTTKPGLSRSTVTPTPSPASSAWAASRMAGVVSGESIRQRRRSRSQSRSMPTLRSAGQAKRCTALLRSSPQAASRQSAAAEGRSPVSGSTPRRCSSSASVRRSSSFSQPSHTGGRMAACGTGCGPGLSCGWPST

SEQ ID NO: 26055 - protein, 145 aa, Pseudomonas aeruginosa
KPATRCGRSQAAAMAVIDSDEVLLARMVSGATMASSRRSNSCLASRRSTMASTTSSQSPSCSRRSATRSRFCAASASAALSLPLPHRLSKVCRRRWRASAAASARLSNSHTVRPAWAAIWAIPVPIAPVPTTAIQRISGIVYFPW

SEQ ID NO: 26056 - protein, 167 aa, Pseudomonas aeruginosa
FGGRFSRKACMPSFWSCESNSNWNALRSRARALSSGRSAPARTTSLICASARGGRRAISMASSRARASVDSSATTSLTRPMASACGAFTRQPVNSMRSAWNLPTARTRRWVPPAPGITPTLISGWANCADSPATIRSQCIASSQPPPRAKPLTAAITGFGQRAMASQ

SEQ ID NO: 26057 - protein, 296 aa, Pseudomonas aeruginosa
FFEKEVPTMRGNDERRSPAEGASTEAEVSAFEAVLIDPMQEKDEELKDRQFVTALARGLELLRCFTPRESLLGNQELAKKTGLPKPTVSRLTHTLTRLGYLRHLPHSGKYQLEVGVMSFGYAMLSNLSIRALARPLMEEMAGYAKAAVAMAARDRLSMVYLDVVHGEANLTMRRQVGSHLSLHRSAIGRACLAAMPEDEREFIVGHIRKRHPEDWPEVRKGLERAFRDYADYGFCLSLGEWQRDVNAVGVALHHESHGLLAFNCGGPSFHLKREKLEDDIGPRLLHMVHNIEAATR

SEQ ID NO: 26058 - protein, 390 aa, Pseudomonas aeruginosa
WPIGVSMIRDPETLNLLLDSIRQFVRESLVPHEQEVAETDRIPEAIIARMREMGLFGLSIPEAYGGLGVTMEEEVSIAFELGRTSPAFRSLLGTNNGIGSQGIVIDGTEEQKRRYLPRLASGELLSSFCLTEPDSGSDAASLKTTAVRDGEHYVLNGTKRFITNAPQAGIYTVMARTDPAIRGAGGISAFVVERGTPGLSLGKPDRKMGQKGAHTCDVIFDDCRVPASQLIGGVEGVGFKTAMKVLDKGRLHIAAVCVGVAERMLEDALRYALERKQFGQPIAEFQLIQAMLADSKAEAYAARCMVIDAARQRDEGRDVGTEASCAKLFASEMCGRVADRAVQIFGGAGYIGDYGIERFYRDVRLFRIYEGTTQIQQLLIARNMIRAAQG

SEQ ID NO: 26059 - protein, 174 aa, Pseudomonas aeruginosa
AARRRQFRERRCQQPAQGRRGTGPGRRDDSRRRRSHRRGGGGQRGRHHRRIGAGDPRVRRRSLGGDRQHPGGVRLAAGTDRRQPGRVDPGPDDRPGGRRQAAEDPQRSGAGHPADRPDPDLPAGSGDPQAVRPVRRRQPAAGVPGGAAGDADPDHHRRAALGHRHRRAWTAWCA

SEQ ID NO: 26060 - protein, 407 aa, Pseudomonas aeruginosa
SPIPGPAGGRRPGDLPRAGARQDRHHHLRQPPLQRAVRRAGGERQGTGRGRVAGLAGRRHPGRQVDRRIPAHPASDRGAAPRGTDADRFQRGNPPVRGRLERPGVPQGGGGCGAALHRPAAGEDARGAFAGGGQDRPERRHPAAGGSQRPAARCHSPEGRGQAGHSRALRRTAPAGHPHRNGDRRQPADRRCHRRRGWGRRRDRRGYPGEETGADSPGAGRRSPGGDVRRRCQRRPGAGPGRRRHGHERRHPGRPRGGQPGRPGQRPDQAARRGPGGQGVAGHPRRADHLLHRQRRGQVLRHPAGAVRRHLPAARRAQRDALAKPAERDPVGHRVQRADHRRVDPTGLARRAGAGGGRFATAAAQPADLWRRRPGGAVPRDQGDRPAADRRRPGMNNGLRRRARAWD

SEQ ID NO: 26061 - protein, 188 aa, Pseudomonas aeruginosa
REDLHMFKQLRPALASLLVLSMVTGVAYPLLVTGIAQLAFPEQANGSLLRDAEGKVLGSRLIAQKFDGEEWFHSRPSAGDYATVSSAASNLAPSNPALAERIARDAAQERIADQGPVPLALVTTSGSGLDPQLPPQAARYQALRVATARGLPLRLVEDLVESHTERPLVGPAVVNVLALNMALAGLKR

SEQ ID NO: 26062 - protein, 162 aa, Pseudomonas aeruginosa
LLILRCQESPAHLALRPVNWCSRLLKMTIAIGRAQQTETWLARHMDGLIVPAPPEDGLEALTAEWRVQVAGTCGEGVSKPLGIAGFLDLADNPAAPLERIRGGIRSGIDGLAAFLRRAADAGVAHVALNPKISRRPYADVMEELAEALVRPASKASLESAVQ

SEQ ID NO: 26063 - protein, 252 aa, Pseudomonas aeruginosa
SPPADLTSRAQNRHCNAACSISLASGPRSSPIPISSSGLPTTGRWPRSIVRPCTACTVSMATPTIPRTQAMPPERASRPLRWRKPSMIDLDIQRMADLEAIRSLRIRYSHYLDGNHMDELAALFAPDALCDAGRGLWQGREQIRAGLSAAFEAYDHDVEGSYPFLHAVTNHWIEFLDADTAQGRCYLIDLETMSKRERDPWLLLGSYADEYRRVDGRWFITRTRLDIFWPERQAGGGLPGRDLILPEAYPAS

SEQ ID NO: 26064 - protein, 272 aa, Pseudomonas aeruginosa
HQDIRLRKFLQRSPKVSPLLITALIIGGIALLIAIGYINHVVENSKLEKARLKAELNDRVRRCAQISESLPGQFVSPSLKLLMSQIELSLSEQQLALEKKADAGLKARIEELRALVAKGESIPVRNPPQAILTEDKAKEVRFLFEALHAQLTRFTQDGHLPRSEAQIWVKEIRHLLVRLHIEFFGNLGQQALQQNEPRQARLAFERGAQYLRKQPELARYQAELQQMEAQLARANAMVLNNSQPASEEPSELNEGLKALDADDLWKKKNVYD

SEQ ID NO: 26065 - protein, 836 aa, Pseudomonas aeruginosa
RHGSIIGCAQEPRQTVGMGYARRQNLAKADPRPHGYSADSSPVVQTGQPHRAGGLYPGNPAQPDSGWRRLCQPGRIHQSRSARAAGRQPQPRRANRLQHRCGAGPGAGPRPAALARRGPRGNHRHLRPAAGQRLARTRRKPPAAAQRLPLRPQAGLRGPVACRPCAGRGPRRTAPGNRHLRVRQRLPPSRRHHPALRLRAQPAAVADPAGALLYPADQAPGQPDPGPQRTRSTLAGTHAPALPQGPRTRRDRRAGGSHQPPARAHLGRDRTAPGGGEPPDPVPGGAGKHRRRPYRRAEGRQRAPDAIQPGTRRSPPDRSRYGPGPRQLPGQHEPRDPHAAERPARHALAEPRRPAHPGTAPATVDRPRLRQGAGGIAQRRARPLQVRGRATGPGTDPVRPGRPGGRHRQPPLAERRGRRGADLPGRPRPARPGFRRPDADSPGRQQPAVQRAEVHPPGAGRRSRGSHRRGCAHQCARHRHRHRPGGAGSHLPTVHPGRRGYHPPIRRHRPRPGPHAQAVRGHAGRADGGVDGRPGQPVQRRPAAGAGQPSAASAAAARPGDRAMLGQQRAGAAAANLAAALGPGVQASGDRRQPARPLARRTDIGLPGLSDGTASEHRYADPAGHRLRQFPRTGAGPPPVAAAPTGQAAESQPVVPGPETRARTHCHSPVERLGHHGRTAQHPGPAGGGQPGQPVGRQGPAAQARLPGMDRRTRAECPEDAGGASHRPGPDGLQHAGDGRLRSDPADPRQRTLGRPADHRADRQRPAGRARTLSCRRHGRLPGQAFPPRRTESHPRPLVPAHRERLAGLATTASLLPPDGSATAIRPGAGAGRTSR

SEQ ID NO: 26066 - protein, 321 aa, Pseudomonas aeruginosa
PRMIIRSPFARPGGLRTALRAFSREEKLYTMMRILLFLATNLAVLVIASITLKLLGVDRFTGQNYGSLLVFCAVFGFAGSLVSLFISKWMAKMSTGTEVISQPRTRHKQWLLQTVEELSREAGIKMPEVGIFPAYEANAFATGWNKNDALVAVSQGLLERFSPDEVKAVLAHEIGHVANGDMVTLALIQGVVNTFVMFFARIFGNFVDKAILKNEDGPGIGYFVATIFAELVLGILASIIVMWFSRRREFRADAAGAHLAGTGAMIAALQRLRSEQGVPVQMPDTLNAFGINGGLKHGLAGLLMSHPPLEDRIEALRASAR

SEQ ID NO: 26067 - protein, 164 aa, Pseudomonas aeruginosa
FRPMRFPCRSAPISTAATSRSSMPAIPAGSAWRSVPTWPASISSGSTSRSRAWLPPPSTASPWSTPASRPTAMPGAATRQSPRTMANAGSACRRNTTPTACISSWNRRKAKSASPTSSPTAANGMPAWSNVRSASRASNGSPSAPACKAATSNCCGSGAIPTAT

SEQ ID NO: 26068 - protein, 350 aa, Pseudomonas aeruginosa
RHRERNPAMQRTHAWENERLHPAHASVLILPLHASSRSESPGRPQRSSRRGQRGRSRAPHAPQPTGDEPYPVTDPRGGRRPDHGPRRPQAGAHAPCPGTAGAGPATGGPGPRPVQHSRDHPTGQAGALLHPAFQQHPGRRSVDTPAGDLRRGGAALHPALRAGVGHRRRGTAAEPHRPLHRRLVLDGTRGQDPAVAHHPLRRPGPPGAPDLRRRDHSAALRRFSAYRRLASWPQPWTAGPGPGRTRPEARRQADQPDLPLGDLRPARLRPAAADRRAFPVAGQPTGPGPAPVRHPGAVEDRDGGPGLASTLRQRSRAPLVPANDQADLRGSAERSPSAAWLQLKQMHKMH

SEQ ID NO: 26069 - protein, 535 aa, Pseudomonas aeruginosa
TAAEIRRVSAHALFPHPRRSEVAMTSLATPLGQPTPTAAPAAQPFGARIVVGLLGVLLASLTAGLNGHVTEIAMTDVRGALAIGHDEGTWLTVLYEATQVAAMAFAPWCSVTFSLRRFTLFAIGGFALLALLCPFAPNLESLLVLRTLQGLMAGCLPPMLMTVALRFLPPGIKLYGLGAYALTATFGPNLGLPLAAFWFEYVGWQWVFWQVIPLCLVAMAAVSHGIPQDPVRLERFRQFDGIGLLTGFPAICALVIGLLQGERLDWFESPLICLLLGSGSLLLGLFLVNEWSHPLPFFRLQLLKRRNLTFALITLAGVLVVLGASMGVPTEFLAEIRGYRPLQSVPMVLLVALPQLVALPLVAALCNIPRVDCRWVLACGLCLCAGACLSFSQLTADWVREDFYLPMLLLVVGQPMAVIPLLMLSTSVIAPIEGPFASAWFNTVRGFFRGSPHRGDRRHRHRPRALPFQPPGGSPGQCAPGRRTALATDRRPATGRRLRRALAAFGRTGPPTGPGAGQRRRAAGNGRPGLRPADH

SEQ ID NO: 26070 - protein, 134 aa, Pseudomonas aeruginosa
RSFSSRARPWRASCVWACRWKHGSTPRPAPAPPRLPSNERHSAPAYCQPCARRLQPRPRLHPPGPPCARRMVAPGRCRQPQPPRRRAARSPMVDAVRRRAIERPAATGPACQPRPAQRRGAPAAEPRDPSQPRR

SEQ ID NO: 26071 - protein, 693 aa, Pseudomonas aeruginosa
RPALGGRQRHLPAPADHQRRPVRSLRQGRQRQLQPRPGRLRRLLGAGLLGPRATRAGSRRRDGGSQRERTARRAGLGAGGSRARLYPVARRTEPCGDHPRQPRDRTAQPGTHPHAPGQRRRHRPRGSPGAGPGGQHGGTPARGGKEPGAPGQRPRLPGRRQPRQPARRTRPGAGDSASAGQRAGRPAVRTGPAPPRHPSCRSAPARRYRQHRRGQGGLLSAHHAQRQLRFRIPATVQPGRLGPSPVRHRPGVQPADLRRRTPARTPGATRGTAAGSRHRLPAHRAACLAGSRRRDARLRRQPAPPGAPRRSRGAEPPRPAERPRAIPRRRGGLPQRARQPAATAGQPGTAGRQRRSGVADPGQPLQGAGRRLEPNVRPGVGLRRRRARTGEGVGNGPAARYPDLRPRGGARQLHPGRPGAGDLSGDRFAPGRRARTGALGAPAATQYAQRRGDGKRSALLRALQADPTHGRRRRGGRRRQPVPRQRSPAPPRGDRTGPRAPDAATGGLPGRPSGRLRRPHAGPGHPGPARGRPGRADHPQPNLAGLDPGRPRSRPGVQRGLCRAGIPGTAWRATHAGGPAAASLPERGRAVLPAGLGLRRRTRRNAARSRRGAQGQPSRGRLRRRRGRARRLPAARLRRRPRAAGRQPVAATAGPSTACPRGVRAVLLAALPGRQDPHLGGLPQGTPAPGVRA

SEQ ID NO: 26072 - protein, 241 aa, Pseudomonas aeruginosa
PGDPRRSALLGGKPNRRSARDRDLTPGSIGILKNIYWFSIDRGRNMAHPSHEVNHATDSLYFPRLTDARPRTGRQRRTTAPPGYRAAAAEGDPGGFRALGKRRPASNRRRGAGYLARLLRLSAAPLRRALPGQRRAGAGAADDRTAPGRRPAGPGRPTATIRPRHLGAAEPDVPAGGHPGAPAVPAEPPRSGPAEPRRPGPAPTARGRRAADRFRQHHPQPGRTGLARRAGSHRALGAGVP

SEQ ID NO: 26073 - protein, 223 aa, Pseudomonas aeruginosa
RRRRRALPATRVSLSLVSRRSRLASGSSIRLKVSRIWMRPMSSRDRPPSLRIAPSRFFAATPSRAPRAVRQRARPSLGGAIGRRSPLRSGRSPRSPRSARSRGADGVSGCSRRTDSRSSALPAVRRASNAAARVSASQPRRRHSSSRTAPRCSTALSSKGVRLAARRARRASSTVSASGRRTSPTFCPVTRSITCSMRRSRGVTSNSARPSRPARPVRPMRCT

SEQ ID NO: 26074 - protein, 150 aa, Pseudomonas aeruginosa
SRVACLVRTKAISASNCSTSSRRWIEPAFWSAWTIRWTCSMRATVWVLAAILTCLGCFRWRSAMPRMDAGRVAEKSTVWRDSGSASKITSRSSMKPSLSISSASSSTRRWTVASSFSSRRRWSHRRPGVATRICAPWRRAFSCGPMGAPP

SEQ ID NO: 26075 - protein, 334 aa, Pseudomonas aeruginosa
RKSAERIHSQSTALRKMQVLNGVSFDRRASYRNFDVCVRFFRHASSERLTMDIPIPDVYTDVARPPPGNRRMNDTLPGRISRERRGHLLLLGLDRVAKRNAFDLPMLDDLVAALGEYEADDQLRCALLFAHGEHFTAGLDLANVGETFRQGWKLPEGAVDPWGTFGGRRPSKPLVVAVQGYCYTIGIELMLAADINLCASNARFAQLEVQRGILPFGGATLRMHQVAGWGNAMRWLLTGDEFDAHEAYRLGLVQEVTAPEDLLDHAIALAERVAAQAPLGVRATLGSARQALLEGEAVAAAALPEAARRLLDSEDAKEGLRALQERRPGRFEGR

SEQ ID NO: 26076 - protein, 82 aa, Pseudomonas aeruginosa
SPDSMTRMTPYSSRSSTSRRSSLTTHLPPPLRRLSPGAPAKAPQHSKAGPTMDFRYCNDRWRRCGELLYHAAIRFPEHCQES

SEQ ID NO: 26077 - protein, 448 aa, Pseudomonas aeruginosa
MSQSWSPESWRAKPIQQQPEYPDAAHLARVEQTLAGYPPLVFAGEARELRRQFAEVTAGRAFLLQGGDCAESFAEFSAAKIRDTFKVLLQMAVVMTFAAGCPVVKVGRMAGQFAKPRSSGDETQNGVTLPAYRGDIVNGIGFDEKSRVPDPERLLQAYHQSTASLNLLRAFAQGGFADLHQVHRWNLDFIANSALAERYQQLADRIDETLAFMRACGLDSAPQLRETSFFTAHEALLLNYEEALTRRDSLTGEWYDCSAHMLWIGDRTRQIDGAHVEMLRGVGNPIGVKVGPSMDSEELIRLIDILNPDNDPGRLNLIVRMGADKVGDHLPRLIQAIQREGRQVLWSSDPMHGNTIKASSGYKTRDFARVLAEVRQFFEVHQAEGSYAGGIHIEMTGQNVTECIGGSRPITEDGLSDRYHTHCDPRLNADQSLELAFLIAETLKQVRR

SEQ ID NO: 26078 - protein, 511 aa, Pseudomonas aeruginosa
ARRGRSRRPAGALARAAPRASVPPTPRAPRSPPSPGPARRPCCAVARPARAGRHRPCRSPRHATHVPPGARAPARRGGRRGRPDGRCTGMAARSSRTRVFPSACRSPGDSGNRTGARPAPAPRPTSRRARARHWRLAAAAPAVRRGSRPAGSSPRPGPAAARQPPPVRRGARGSAPGSADSSRAGPFRWPRPGRSPPSATARAGPVPPKARGAPAIPRETPAPAGHRAARSRAVRPPSARRRRTAIPAHAFPRSSPTRDRPAPAACSGCRHLAHLARAPPATPGGSVAAVPGRNVPVAGRCPGRRRPGASASASTGSVPAAAARPRAPSIRTTGGDGRHSRPPRRAASWSRDRDGKTAAGSASAPAHSPNRSATGQGARAFRADAAAARCGASAGRRSPARPGPGGGLRRGKAKDSWSAPVDEGDCESIAPPPPCQPGAPLRFAQCRRSGSSQKCRSPSWKISARLRPRSFSASSLILSSSRRSRANCNQRRQRRHNDGAAVEAGWDAAWK

SEQ ID NO: 26079 - protein, 121 aa, Pseudomonas aeruginosa
CASSRRSCRASPKPIRWCRSRCIATPRSTCWRATTSTCPSSPASRAPRSASCCARSPSSGWPPRASAPTTSGRSRWPCSTPPAFAGPGPATPWRRRNWTTASPTAAPACRRCSRWSAPASP

SEQ ID NO: 26080 - protein, 536 aa, Pseudomonas aeruginosa
CATRTASHRSPRSSPNTSARASVSDSTAHQQEHRAQCEEGAEGHAQAALGQGVGQPHAPGNAQQAAQRQGDPHPPVDMAVHGVGPQRHRRARRGQGQREALGDDLGEAEHRSQHRCRQHPATDPEKPAERARAKAQHAHPGQTVARRRAALRRAPEQAPEHVAGQRQEEDHERFAHPRRIDPRGHAGRQERAKQAGQGKDSGLARIDAVALVVAPQRQHHVRYHHHQRGTLRQLLVETEDHPQRRDRQQAAAYPEQTAQATEHHPQQEIEKYIQHVSPSFDASMLGKRGWMGNAQESTMAMPITQRHEHVARYPQRTVRSLPRCPRWRQLLRRCAQAPAHPVRRGAPDGRPGTRRRQHSAGAHHPCGARYSGRPGLRRPRPADRHRTAPGPCRSGVPEHRAAGPDPYRCAGALRPPPPGPGGRRLPQGQPRPRRAIAPDRQLHRPAGRTSRRGRSGVARRPATRQPPGGHLAGADGAGGLRQPGIPARTRRSRIPRRTAGACRHRLGQPVATLCLALPARRQAPAPAAETGAAGHQ

SEQ ID NO: 26081 - protein, 285 aa, Pseudomonas aeruginosa
PSSARRFCNRATQPWLVSSPKAALILSPTTNSVCAAACWVSRTRARQPLNSNARIGTSMSASILNAQNLSKVVGSAEGKLTILHDLSLDLARGDSLAIVGSSGSGKSTLLGLLAGLDQPSGGEVRLAGHALGDLDEDQRARVRAAHVGFVFQSFQLLDSLDALENVMLPLELEGRADARQRARELLERVGLGQRLGHYPRQLSGGEQQRVAIARAFAAQPDVLFADEPTGNLDSATGERISDLLFELNRERGTTLVLVTHDERLAHRCRRLIRLESGRLIDRVEP

SEQ ID NO: 26082 - protein, 147 aa, Pseudomonas aeruginosa
TWPAWPRCCSPASPWPCPPPVSLHGATTPARCCAASVCRAAKPCSSTRCNCCCWACSPAPSAPCSAGWHSSACSACSPRCCRRTYQPAACSPPSPGSPPAWYRWPASPSRRWQPWAGYRRCGSCAATCCRCRCAPGWPTPAPCSPWA

SEQ ID NO: 26083 - protein, 112 aa, Pseudomonas aeruginosa
ASCGASSTRSPWPWSTCWCSFSRRASWCSSPVSRRPSTSACARVPCCARWVPSASCCNVPGGSSSPCSAQSAACSRRSAARRSACCSTDWSSTCRGKRIPGCSRCLWWAPCW

SEQ ID NO: 26084 - protein, 217 aa, Pseudomonas aeruginosa
PATARTPGGDGEPAPDPGLPRAGPVRSARGPAGHGRGHRGRALRPVSRPPAALEKRHPAAGPQPTARRPPAPAPRPALRPCRTGAARGNPLIQRPSDPGSRCRAAGGRPATPNLRMAGRPFQPVLLAKRRRGRALPHTRSLGVVRGRFKRAFRAVTTRLFRSATQVMTGRQEAADFLAWRKKAEAGTVPAQGTAKRFSRKDSGDGWQDAPLGPINLR

SEQ ID NO: 26085 - protein, 265 aa, Pseudomonas aeruginosa
RCPGLRHRSQPVGHLGSPRRAVAATGGGNRRPQRPAQGQPDRPQPRRADHPLRRRRTSRPDRFRHQRRRPAQGFGHRRLPAPDPTGFGRRGNPLRAGQQPRRADQLPFQRQHRYAEFTGLAGVAEQRGGRALQRQVPAGRPHLGLRRGRLQGQRRELLLLERFLAADQLPRSERRLPRRLVADLQERHRQRRPGRHLQFAPGHGDPRQLPDEPPGRGEPGLRPHQPVRDQPGQRLPPARQPPEERQPVGPRPGPRPRPFPGSPLA

SEQ ID NO: 26086 - protein, 245 aa, Pseudomonas aeruginosa
AKPTAARRSNAWPRSASANRNACAWARWNRCARPSSADRHGNAENAAKGASADNATLRGAALAWPARRKPVLRAATKKGGHPKVSALFRRQPGSAGQLAVQRELAGAIDQQRHADHQKGQGIFIAVVGDEEAIADVHAEDRHDHGEAHHHRRRTHQQADHQRQAAEELGAAGQGRQQVARGQADGFEPLRHAVQAGAAEHAEELLRTVGHQGKTGDDTQDGQAGTGVGRQDGLDQWIHGASSGVG

SEQ ID NO: 26087 - protein, 184 aa, Pseudomonas aeruginosa
PTPASPRNVKHCSPARAPPGWYKWSSPAPAWPTANRRCSSAANSTRAAGCLPPPASTPTRPATGTPTPLAACAPCSTTRGYARWANAASTSIATSLPVRPRKRPSRNNWHWPSSYSVRCSSTNATPASACWRSCATSAIACRPPSYIVSPASAGRCMATSTSTCTSASPAGSTTSAAAPTCMIW

SEQ ID NO: 26088 - protein, 136 aa, Pseudomonas aeruginosa
NTSSGPSTRWPSSPPCCWCCSPCSRKPPGATLPPSAPPPPRASWFRAGQPAAPCPPAATCCRWNRPRAWAAQLPRRWARGRVGSSCPARARAIPRCSAPGSARPAPASASPCSPRPATCGRSSPTVPAPTPSPCWC

SEQ ID NO: 26089 - protein, 178 aa, Pseudomonas aeruginosa
RDAADIIDGILSWTDNMPSTRQLIVFLCCLGLPLAQAAEPVPLGGRPIVTLQRSGDAPVRLTLSDLEALPSETLEAQLPGEANARWQGVRLSLLLRHLDLAPPTRLRVLALNDYSAIIPYSDLDSYQPILAYRRNGAYMAIRERGPLFIIYPMARYPELRNQVYYNRTVWQVSSITLE

SEQ ID NO: 26090 - protein, 528 aa, Pseudomonas aeruginosa
VTDMTVPLLDPTKLRRQRQIMGLLLGLVLLMALIAGAALWLAVRQAQQLAQPNLHNELWQTYSLRAELDRTLDAARHTESGEGQADDLAIRLEVLASLIAPLRRQSLFRHLAEPRPEVQATLQRLIELSDRWSNQAPWGDPVAARRLAAEIVQQVPPLLEPTHQIVVASNIALTNQLDVDRKRLHRAFYALFWALLGIGAGGALLVLRLVTDFKRAQQLAGHLIELNATLEKRVGERTRQLSEGKALLHFILEASPSDVVLLSACGASIHYVSPRLLKRLGCQAQDDFNLPRLFASTSEYSRLQNALEARGQVDGWEAQLCGETPCWAVICARHLEIDGEPATLIWCYDISRRKAMEQELRLLASTDTLTGLHNRHSFLHQAELMLKAAERFRHPCVALMLDIDHFKNINDSHGHLTGDRALQRVAETLRQGLREVDLLGRLGGEEFAALLPEVSLDQALDVAERLRAGVEALRVNNPDGEPLRMTVSIGVALRRDAGDDLESLLVRADSALYQAKSGGRNRTEYAPA

SEQ ID NO: 26091 - protein, 632 aa, Pseudomonas aeruginosa
PFAGGTAQAMHLQQAFEAAQLAAAQIATALPGLEQEQREQTDRQYRRGTEQQAQSGRIEPAEPALQEGALLLTLVGQDPALPAIVQAVPGQTHVVEPGQATVAQRRQRCVGEVLAVPGQGLLQPLFDPFGRHLVGRVDAQPALLRLPVFDPGVGVELMHQQVVARRIQLAALVAGHHSRRNARGAQDESHRPGVMRAEAAARVEQEIVHPVGTGRWRFQGVGEGLAVEALQQGRDQCLRLRMGLAQLLGQGARARIAVHRQLQVAPAHARIDAGLAQRLWPGTGSVEQTLLDRLPPLQVEIAHQARVGLVGLRHVEGEQPGLRTGLHDHVVAQLGATLLPVHSILARPLRRLSPTSSVETLHGQGAPVELLARRRCALEADPERQFGGAPKLGDIPWRHALRESGDPLVAGHRQRPQRPQAGEEQEQQEHQRQRLQQQPAGQPQGRPGPAGESALLQSDQRRQQRGHRQQAVQRGEETVVEQVAHHHCEETEEHQYQRIAAGLHFHQLEDERGDQQHRPRVQAHQAAARQPDPGPGEQRQGQLDPGARIAGTHAEDLHPPGRATEPHGRDPQRQVGQVRQDHQYLRHQQPDQRDPRNRVHRAAPNNASARRQASRWASPLAGCRRVPGSARP

SEQ ID NO: 26092 - protein, 219 aa, Pseudomonas aeruginosa
LIAASSITSSARPKAPPWRVGRMNTRRWFSSTLLAGGIRRFSQRCQRGQLRRRIRAPGLRATAIAPARRHRARWGPPGRAGDARRPPATPPGRLPESHSRVPPAAPRHAPRRATPGYRAATGRGRRPAACGSLRPGAARSPPAHRWRGPSALRPGKRPAPRGRARVPGAAADRAGLRRATASVPPRARGNPATGASGSDPAAIPAGRRCRPGWPGSAWR

SEQ ID NO: 26093 - protein, 384 aa, Pseudomonas aeruginosa
GWSCPSPAGLRSTGAHGPAGRPGPGAPGGPCPGESHRPPSGRLPGCSASRPRVSGENSDPTGLGPAGKALAIFPHETVKPLPPVLAGVPATSLDAGGGTGAPLGAGADDACASPARHGARRSPTAGVGEAASAQFGDDRRQRLGRVGGLADRPADHQVIGAGVQGLARGEDAPLVVLGAAGRADARRDQLQARMGGLQRRRFLGRADQAVHAGLLRQGGEAQHLLLGLDVEADARQVLALHAGQHGHADEQRPGPAEGLQRLAAGGHHAQAAGAVHVDHPHAHLGGGLHRHRRGVRDVVEFQVEEHLEALATQGLDYTRGTTGEEFLADLHPAQFRVQLIGQRQGGLTGGEIQGDDDGGLAGGHGLSRGESKTARIVAESGRLP

SEQ ID NO: 26094 - protein, 537 aa, Pseudomonas aeruginosa
  UNSURE (84): Identity of amino acid at the above locations are unknown.
PGTRRGDERRGLKAGAEQLLQPVDECPDPPRQMPPVRIQGVRRHRFGPPLRQHLAQLAALEVLAHVVGRDLDQAQSGQAAGDVXFRIVHRDPAAQRAGQGAPILAILPGQHPAAAGRGILDRPVPVEVGWRPWLAMLFQVGGTGAIDQLHLAEASRHQAAVAQLADPQDAVDALLHQVHRTVAGTQFQFDVRMLAEEFRQRRGDQQSRHPARHVDLEPAAGAAAVVEQALQLLHVFQQVAATLQHHAAVVGQLDLPGGAMQQPAAELRFELLDRRRDRRPRHVQQVRGLGEAAGFGNAQEHAHAVQTIHGQAPSLYSGWLDSLSMPPTFIQRTRTNSLESLLYFLDPQMPHAALLLPPSASPLPEVVGFWRDAGPTLWFARNADFDRRFRERFAHLYELACANALRPAADEAEDHLGLLLLLDQYPRNAFRGTPRMYASDAQARRWAERALGQGLDRQVGDALRLFFYLPFAHAENLADQDRSVALNHGLGQPFLAHAREHREIIRRFGRFPHRNPILGRPSSAEELAFLAAGGFAG

SEQ ID NO: 26095 - protein, 138 aa, Pseudomonas aeruginosa
LIDRPSPVPCPTGLVVKNGSKIRPRTSAGMPLPLSCTERNTWRSSAQLFSRMRPKRSMACAALVSRFSSTWLICDGAQAISGSSPSWLLISALSLMAVRAISTALRTQSLRSTSSLKARSRRAKSLSPETSSPIWPRP

SEQ ID NO: 26096 - protein, 544 aa, Pseudomonas aeruginosa
RTRRTDMPAIQSELDVNGEDFARNREAMLAAVAGFRELEQKVLDKAAEARPKFEKRGQLLPRERLALLLDPGAPFLELSSLAGYKLHDDKDGTQAGGGIIAGIGYIAGVRCLVSASNSAIKGGTISPTGLKKTLRLQQIAMENKLPVVTLTESGGANLNYAAEIFVEGARGFANQARISAMGIPQVTVVHGSSTAGGAYQPGLSDYVVVVRGKAKMFLAGPPLLKAATGEIASDEELGGAELHAQVAGTAEYLAENDADGVRLAREIVGMLPWNAQLPARPARSWREPLYPVEELLGVVPADPKKPYDVREIVARIADGSEFLDFKNEFDGQTVCGHLRIEGHACGLIGNNGPITPQGAAKAAQFIQLCEQSNTPLLFLHNTTGFMVGTESERQGVIKHGSKMIQAVANARVPKLTLVVGGSYGAGNYAMCGRGLDPRFIFAWPNSRTAVMGGAQAGKVLRIVTEEKHAKEGKEADPKMLEMLETVTAQKLDSQSTALYGTASLWDDGLVDPRDSRRLLGYLLDICAEAEARPLKGNSFGVARF

SEQ ID NO: 26097 - protein, 135 aa, Pseudomonas aeruginosa
SSPRNTRNSAAPFAASSSGKSTPTSTSGKRTAASRSTRSSARPANSACWASPSRRSSAAWAWTTATRSSPPRNSAASPAAASRWPSACRPTCAPRPWPASVPTSCARSSSARPSPARWSAASASPRSAPAPTSPA

SEQ ID NO: 26098 - protein, 197 aa, Pseudomonas aeruginosa
RAGAGAARRRRALLRRRRHQGHGRCPRRRGGSLPHAEPRLRQPAGGSPGRPATAGGAGGRRGARRRFRPGLRVGRSDRRRRCAVRPAGNQPRHSPGADRAFRGPPHRPDPGPPPGPHRRPLRRPRGAAPGPGAFLRGRRRCPRTAPGGNPRATAPLRAERQRRHQGPAAGQRKRRTRRPAGRCGATVRRSGGRRRRQ

SEQ ID NO: 26099 - protein, 863 aa, Pseudomonas aeruginosa
TGLPQRCRVQRGGRRRPPCATGRRGRVHRPGSGGAVLPESRGDPRRRPSQRRRGDPPRLRLPLRERRIRPCLRSRRDCFHRPGCGSHPPDGQQAPVEDRHARRRGAVHPRLRRRRTGRRDPAARGRTHRLPTDDQGQRRRRRPRHAPGGGTRPTAGPVAHRTLGSAGRLRQRRTDPGEGRAAPAPCGDPGVRRPPRQPALPRRTRLLGAAPPPEGHRGSSLPGARCRPASRHGRGGGEGRGFGQLRGRRHRRVSSRRGWPLLLPGDEYPPAGRTPGHRTGHRPGPGGLADPRRRGPSAAAAAGTGGTARACHRGPPLRRGRRSRLPAADRHGAALGPGTAARRTHRPWPGRGAGGDALLRPDAGQADRLRGDPRRSPAQADPRAGALRAAGGRRQPAVPRQPPGASGLRRRRGDHRLHRRTLRRRPQPATAPAGRRGTGPGRRPALPGRRRGQCAPARPGRLAQRRRGTVEDRPEARRTARGDRPGRPRKRSPAATAGAPGATRDRRAPARLRRTLGQRRTRRHSPPPRVPRGRRAPLGIRPRRQPRTGRGHPRRRQRPGRRQFRHAQGADGRRHRRGAGRRGRTGRQGPTAAGAGGNEDGTPAEGRSRRRGPPRPGRPWRAGAQPAGAGRGGSRRLRHPAAHPQRQRQENGDAHVTARQDPVHHRRQPRHRPGDSPARRARWRQPGDRGEERRAASEAGRHHLQRRRRGRGRRRPGPAAATRRARRAGRGGGHGPRRRTLRRDRRAGQQRRGDPPGRGGEAGAQALRPDVPDQHPRGAGLQPGRPALPAQERQRPHPQPVAADQPGRQVVRPARPLHGHQVRHEHAYPGDARGVREIRHQRQRAVAEDHDRHRRHRVRAGQP

SEQ ID NO: 26100 - protein, 727 aa, Pseudomonas aeruginosa
RLPPRAHPGDHGRRRARHSHQRGAQPQRAPAGRRGIAARARPERFRAVPLRPGGWRAGARPVPRLRSPTKGARRSGAGFRAICRSAPGRPRNGHSRGGGCGLESRERPTPRTTTTSARAMTHADLITFNRFVARLPATFGRVPRMLRGLYYTAIRNREKSLSLGWALERAARLYPDNPAVLDGHRRISYALFNGWANRLARAFKAEGVGHGSVVAVMLENRVELLAILAALAKLGAIGALVNTTQRGKVLVHSLNLVKPGHFVVGEELREVFEEVRQEVLGNAGHCYWVDDGDTLGDPGSPPMGWRNLMRLAQGQTSENLEDTGRVRLKDSCFYIYTSGTTGLPKASIMSHGKWIKAYGGFGHSGLGLGRDDVLYLTLPCYHNNAVTVCWSAALAGGAAMALRRKFSASGFWKDVQHYRATCFGYIGELCRYLLNQPPCAEERGNSLTCMIGNGLRPSIWAEFKQRFEIQRITEFYASSEGNIGFTNVFNFDNTVGFSPATYAIVRYDLENDHPVRDAKGFMEKVGKGEVGLLISEISAKWPFDGYTDPAKSEAVILRDVFKKGDAWFNTGDLMRDIGFKHTQFVDRLGDTFRWKGENVSTTEVENALGAFDGVEDAVVYGVEIPGTNGRCGMAALRLADGVELDRDALAAHLDRELPAYATPVFLRLLREVETTGTFKYKKTDLKRDAYDPARVSDKLFVRLPGSAGYQPLDAELYQALQEQRYRF

SEQ ID NO: 26101 - protein, 167 aa, Pseudomonas aeruginosa
GGSRCRPFPRTSAATAAWAYGSLPCRAAPSSAPVPSAGAGPAWRSAAACVPRGRDERWKRASPAPACPWRPACWPASAAQPQASAWPAAWVRQPAPRLARPSSKLFSARQARQALAPLVQASLAWQGRAAPAAVLPGLSFPVPWSRHRRPPGSNRKEQRRKFGKDVS

SEQ ID NO: 26102 - protein, 202 aa, Pseudomonas aeruginosa
RQTATKARGHYRHPGTLSVVRPMSNLSCADNRLMSARDAAAASRAMVVTAVSWRSRLSSRGVPVVPPGSLRGNVSAARPTGSRPAPSCPAHAGQGPPRAPRRAPPASPQPPCPWPGRRSRRPAPPGPSPAARPGPAVGRPGQPEPAARPRPSVAAPPRTMRSWPARPGAPTSRRTAEPAPPARAWPASPQRPRRLRRAGAHR

SEQ ID NO: 26103 - protein, 353 aa, Pseudomonas aeruginosa
PAPAPAPRPAGWRKPPANAACGRLPASAATRTGRVRHAPPGVARRRGSPGPAPAPAAAARGRGNAPASALRRRSRNASVGSYRHLLGQQPAQLLHRVAETALHRLQRRLGERGDLGQFQFAVGAHQEYLALFLGQGLQRALQALAVAAQAELLLGAGALVGLRVQLFVVAVLQRLALAMLAPMIDQAVAGDLVEPGAEARPALRLALAADQAEPGFLVDLVGQFGLSGQAAEKTVETLPMALVEHLEGRAVALAVTRQQRFVAAGGRRGAGGGMHAAGRLLSCVKGDREQAHRPHPSRHASASPRNARAVARSAAGAAIGRHFPASDSSAKVPVRMEAGKNIETTSSCSGDTR

SEQ ID NO: 26104 - protein, 1217 aa, Pseudomonas aeruginosa
LDRRSARASDSPARITSLGAARSTSESSLTWSNSLCALASDCSLSLWSAQPASAAQASRVAKRVALPGISRSPPVACADVSGSCPARRAGPCSSASAPWTRRGVRPARPARPTGAPSCRTPRSSRSAPRRTCPGPVSARPRRRWHPPPWPAPAPVRSGASAPAEPGRCSHNRSGSARRGLRPSSIECSQVTFLRSRTGAGSRQLLGFPAFEIVLQERYGNAGSRQFCHLFRQLSAQPRIVAGGVVRQRQVQPLAAQHRFQRLQVVGHAQRLDLGLPGQRLVEEELAALEHQVLQALGQARHRLQVETGLGEAVELLAQAAAGQHAALVPDQVVAADERERGVLVHPDHPAGHQERRMHIVHAAEPCQGQVSPGEQVGATAGHLFLGLLPGAAVEHVDAHAELLAQALQQVGIGSDQALRILRVAPQVGGVLRVAGGHQALAGAGRRGQPRNEQRRQQDAGQAARGTAKGHGFRLRGTGMRAAVCHISARAPAPLFRWVPARRVDPGFAVGAREAAGSGRADDHQGAHVHLLRTQLAQGGAQQALTGPPDVATEHHQGLRRTMAGDDLQRPSQLPGPRPRDRIVESHRQVGGAGQVQAPLDHLPGLEVVGQRQHAEIVAQRRPRPGRGGQGRRDAREDPQLDRVPGRLASAMQGFQHRGGHGEHAGVAGRYQHHRPARRRQFEGMPGALQFLAVVAAMQHLSGAEGSGHVDVGLVTEDVLGLVQCPPRRRHHQLGAAGPQADHCESAATLADAVHRQGRGGHRQPVADLLGGGQGLAQARSGIGLRQEAQRYAERIGGGLQARIGHPRAVGQQAAERRRGQAGIDQRLAHRVRRRVGRFERRQHAARMDQQFLGPRRTRRGRHVNRQRCLRVARQTGRVEPVGGTLDAHRLATEQIGNEALALLQVGQDITGGRVEHAGAEAQLAAGGDRRRHGQHLADFPRQPVDPGQPAEQRHHRATVLGQGQHRRLRSLALQQRRQAANDDAGGAQGDDWAVGAIQFAQGVAEVRIGTVGLHPPGEPVDQRPGIARLDPPRGIQRALAEDDDGRNLLGVTHRRPLPATCRRGRRSARSTARPSAPPVPTARSAGWPWSPARRTARGARGQARPARGGPCRNCGRASSPPPRRHPPGAGATPPRAALRRAPRGSGCGTPAAHRAPPRRRASSRRQAPLRFRSASPGGRAGTCRNRRRTGRPRRSPPRRGRRPGARPAVRRRCRRNR

SEQ ID NO: 26105 - protein, 218 aa, Pseudomonas aeruginosa
SVRDRRARRPGPAGGPSRHSSFALRGQGVHRRGGHGAAATATADDHVRHPAAIGGEHLLGFRGADEADREAQDQRRFRRAGVEHFQQVEQRGRRVADHHHAALQVLAPVLQGPTAERVLPSSVASAGTSASLRVQITRLAAGSRERVTPSATIRASQRIAAPAASAARPAAPAPGEKRRSSTTSTMPQAWITLTASFSRSAGMPARFASARMVANDWR

SEQ ID NO: 26106 - protein, 293 aa, Pseudomonas aeruginosa
AARGGQRRRTVRSRTGAVAAGRCAGRGVRPGARRRPWCRPGLWRRRWNRCRRSAAPTAHRARSAGRVRAGRAAPGRPRRAPGSAGARLARGSGAGCRRHGVRPARPGLPGKRCRAGRAAPPRRPSPGPAGVAAGRRDDSTDAPANAARPPPARHAAEGNPGAPARPPARFSGQLLQQVAHSPSVAAGRARGTGRAAPAPGTRPAPPATPPGGGRGPGSRRVRRPASRSAPRASARARCHGDVRASPGLRRRPAGWRTWPTARGSGCPPGAAATAERPAGARPATGADRARRPG

SEQ ID NO: 26107 - protein, 560 aa, Pseudomonas aeruginosa
CGRCRRPAPGRYAAGRDRATDVVRAGAPGSGRRSKTLLESASRRPHRCPPGTDHGIGTPRPMLALATGFGGRSPGSQPGVPPGGGTSASRRLPGNPVANGANTGCIQLRGQPRLGPGFEKTAAPCSLFGPRWPRANAKGPGTDERAIMPPSPGPGKPIPSGSRRGPFTDAFQEYRNRVIGRLDAALADPGGHRRGRLSRPRQAGPACPAASQPDRRRGAPAGTAAAVHRRRPRNLADAVLPGTIAGPARPADLRAGQRRPDAVRRRRQSRPATAGDRTAGPAGALLPLAGRRPPRLGPAGGRLPVAGGAPAGGAAGTGPRRPAPAGPQQRRRQPGRHRPPVERPWLRRQSPERAGTPRRAARAPSRRPRRRLVAAARRRSQPGGGGMPRRRRRRAPAADPGPGRRSLSPRRPVDQARRPRRDPGAPGALPRRAALGRRRRLRLHRHRMDARAPQLPGDRHRSQRRAPGTYPPQPRRPRRTDPAPGRRQRPGGAAGTARAGRHFHRRRSHRRGRAGNLLGAPAARRPPVRQRGHPAERTGAARLAATPGWRPPPALHQTGI

SEQ ID NO: 26108 - protein, 245 aa, Pseudomonas aeruginosa
ASRLGLRAFWTWRTTPPRPWSASAVAFAAASMGWRPFCGARPMPVWLMSHSIQRSADGPMRTSWKNWPRRLCGRPARRPSSLQCSDPFLMLRTFMEMLFSTYDLAGLPLSNRMVMAPMTRARGQRRTGCGDGDLLPPARIGRPDRQRRGSGLARGHGLLVHAWLVYGAAGRGLAAGDQRGARGRRPHLRPALACWTHLARLAAGGRRVSRVFRRPASREFAGLRLDRARPGRPGAGKRPARLGRG

SEQ ID NO: 26109 - protein, 495 aa, Pseudomonas aeruginosa
HLRLWRMRRGRWYLRQSLECDSPVVWRHDDGFGHHRRNGCRRSSSDDGVGLVLLCHGRHALDMDREVRAGRFHLALFEQIETIRPVLHHPAARLNILGVVVGRTHLVRVRVRKLRVHPNLGIADLVERRRDGSADAVTGQLILVAHSFQGRVEGVLADALLEFAAVREQMDLSRPHHTQQVAHDLDGLHGQRHDVGRNVLRALAGLAHLVLELLDDLRRDDPQATVEIELVRGRQPQLAGTHAGQEQQPDAELGLPTTRVVEPELVQEIGKLRKMQVGVVVHRGLGLGHHVQVGGRIGFQPLHDDEGIAEQLPQPGADLLGSGERLALLDPRQDAQELGPANVVDRHLLEARQHVLVEDPQDLRQRAVPALLDLLAAMLDPRIEDGLEGVVGRKLDRVSLLFPIGMGVDALCQKRPGFVAQGARFAQTDLGVVPQGDALLLAEPVIAQMPRLAAGAGDHQAEAIGVGDAVGFLGGLGLPHGQIRECHHQAPKSWT

SEQ ID NO: 26110 - protein, 230 aa, Pseudomonas aeruginosa
PRLISTEEIVMSLTLYGAPLSPFVRKVRLLLAEKGLDYQLEAIAPFGQPAWYREISPLGRIPALRDGDLALADSSVICQYLEERYPEPPNLQGDAPASRAAVRWLEKYADYEIAPLATLTIFRNRILKPAMGQACEENEVRRALEEKLPAHFDYLENHLDGRAFFVGERLTLADLAIASQLVNLRHAGENLDEQRWPALAAHFARMLERPAMQALLPGERRTLDKLAAKA

SEQ ID NO: 26111 - protein, 175 aa, Pseudomonas aeruginosa
TRRSAVRQAQEYLHQAFDPGLVLGAEASHARAVQIEHSDQAAVLEQGHHQFAAGSAVAGDVAGKRVDVVDPLGQPGTRRGAADALGEGDADAGDLALERSQDQFLVAVQIEAGPVQVAQLMEEKGGELRGVGDEIALVGEQRLGLRRQQGVAGQPGARLLQIDHAWRSSSCLPTQ

SEQ ID NO: 26112 - protein, 860 aa, Pseudomonas aeruginosa
PLRPSRCQRAARLRSQSTASRTAGSSGSRRASTLSARARKSLNRESTLFSSDRTDVTDRSSVAPRNPDRRSGWAMLGGRTSPRLIPAPMDIALTHRLSFKQASLTVLVAFILGTLLSLIQVGVDYASQDASINREVRALLDVSHNPAARIAYNIDAELAQELVLGLLRSPAVVRAEIIDTSGLPLASASREPAESRLRPLSDFLFGHKRVYEDPLHVDHAPGEALGVLHLEIDTFVFGNDFLRRAGITLLSGFVRSLLLSLILLVLFYTLLTKPLVSLIQALSGHDPRSPARMRLPCPKGHERDEIGVLVEVINRQLGRISVEIEQRREAENRLTQYLEELESIVAARTAELKAANARLTLSNQELEEARQTALDMAQARASFLANMSHEIRTPLNGLLGMLSLSLDGPLTPEQRQQLSIAHDSGKVLVELLNDVLDLSKFEAGQLVLEQIPFDLGVLVEDTASLLSQNAAAGVELTCLVDPALPAQVSGDPTRIRQVVSNLLSNALKFTRLGRVDVRVEATAEGVRISVRDTGIGIAQEALDRIFQPFTQADAGITRQYGGTGLGLALTRKLCEAMQGELTVESTVGLGSLFSVGLPLAPVSPPLQALPLRGRVIAQCSANSGLAQLLQTWLPRWGLEYKRLETDDSLLGHSLDVLISDCPDCLMGLRPSIGTPILLVTAYGSFLEPELARRLSPLRQLARPLSRNQLYQALKHVLEHTAIAPSSASDTTGEQRNTRVLLVEDNPVNQLVAKGLLHKLGCQVWIAEHGLNALKMLEEHPIDLVLMDCNMPVMDGYEATRQIRDSGRWGGLPIIALTANALPDERERCRAAGMDDYLAKPFHRDELKAILDRWCPLTASD

SEQ ID NO: 26113 - protein, 155 aa, Pseudomonas aeruginosa
RFTTGPSRPIRNLVKFPLDALAAEQARRALLQADEQRVGAGAVDLDLPEQREAHPVVQFAELRNLALVARFLLAELVAGEPEHHQSALTVFFPQGLQPLVLRGEAALAGGVHHQQRLAAEVGQGLLFALDGGAGNAQQRIAHGLSSLLRVGLETK

SEQ ID NO: 26114 - protein, 153 aa, Pseudomonas aeruginosa
LNEKRPEPKTGRRSLALPRHQLQRGRVDAVTQPGGPGAIREDVPQVGIAAAAADFDAMHAVAEVVQFADRLGVHRLEIARPTAAGVVLGVGVEQRRAAAGAMIDPGGLGGVVFATEGAFGTAQATDVELLFGQLLAPGVQGFVDLAHRLYLAI

SEQ ID NO: 26115 - protein, 558 aa, Pseudomonas aeruginosa
HSRAGAQARQTPRGRGSPHPQAEYRQPGAVRFRSSRGNSPGRHPQPADRPGLQRLQGPVQRAQGSDAVLPAEAGGRRWHRGHLPRQRRVGTDRDVHAGAAEQRRRGADPRSRLPAVDRRGQPRRRQGGALPVRRAGQLVAGPGRHQGEDHAEHQGDGDHQPEQPHRRGVFQGSAGRHGRTGPPAQPGAVLRRDLRQDPLRRRRPRLHRLAGAGRALPDLQRPVQILPGGRLPLRLGGDLRAQAAGTELYRRSRHPRQHAPVRQRPGAARDPDRPGRLPEHQRSGPAAGAPAGAAQPRLGTAQRHPRRQLREADGRAVRLPADRPEGLPDPQRRKVRPRPTALGKTADRPGHRLQLAVARPLPGGHPAPRRRPGAGDPAHRQLPQGLPAVTPPLPRRRWRRPARRPIHGPADRRLPQGRRWRPPASLPGVSAQDRALRRRPDRPRGAGRVRPAEQTSPKLSGRVALARRGRLPALRQHHSLRGSRPGGAQRKGLPKTYPYRPPGRGGAGRGAGQRAPRTGQPGQPVAPGAGAGRRRTPGRADPPAVRGQPGRARRHSLK

SEQ ID NO: 26116 - protein, 395 aa, Pseudomonas aeruginosa
GSHADPRRFRQRQHPGHRCQRSPPDPPGDPSRPGQPAFPVVPLQGRGHGSRHRAPLHPGQRRPVGLQPCLERLPGSRLVRWRTLVPRAVAIRRRRPAFPAGTGGKRSPLRLLRALQPRTACPPGRTCARHRGRRTARRRHQRARPRHRIAAGQAPSRQPPEAVGHRPAASRRTHGRMVHGRPDRAPAAAGRYGNAAPAGKGRPVPGAEHEPGRRVPRQPAHQRRRPGSQPGLAGAERRAQPGSLVRPAGDEAPWRRPVPRHPRRRGNPPRIRRRLRGQPGLYAPPGTARATLPRGTDGARRIPDPPWVPTHCAGPGQPGAGLQLRRADLRLPGVHHRDAVQGPRRQPGARDRLVRRPLQAARPGRPEHPCGAGRRTPLKMDGAPRGAPFQPLSSR

SEQ ID NO: 26117 - protein, 356 aa, Pseudomonas aeruginosa
SVHRHSSAATGARKGTANAIQQCSERTPGRTKDCTLRMPACLYFHSMHLPDLNLLVALNVLLEEGSVVGAARRMHLSPPAMSRTLSRIREAVGDPIMVRAGRKLVPTPRALELQEQVRQLVDQARDLFNTRETIQLDKLERCFTLRSNNTLVGGLSIRLLEIFAEEAPRCTLRFVQESDIDDEALRQNRIDLYIGASSWMEPEVKTQQLLTTRFVGLARQGHPIFDGEITPQRFVAFPHIAVSRRGLNHGPLDQALGELGLKRDVKLISPTFHSAIFALPGSDLLLPIAEHSLWRANRLGLGLRQFDIPVPLKTVMVVQAWHPRFDNDPAHRWFRQTIKRICEEVQSDPHPLLGSN

SEQ ID NO: 26118 - protein, 969 aa, Pseudomonas aeruginosa
CSPPASSRPSRDPSPRPGSTPSAASSGVVPTAVIGAIGTAREHYHSNRLVDHLGNAPQAVELRLQQIAGLQPGADSGAHWQHLAEQARQQAQVLGNADVLLAMAGLACALLITDSDPAATGSTRPARSLPHTERSLYVVHHFAQGHPAARRPAGPDPTGLPAVPPARPTGRAEHRRRLCARRFHPGRAESRRLRPGRSGRGQPAGQGRPVARPPRRPRLPHRPGRRRSRRARCRGQPGQCRGQPATPAGADRTGAGQGPRRAGRAGLRPSRAKPLPDPRQQGRRQPAERPAGAIADRYRQRPAGRGPGRSGCHAQAGERPRSPRRPGPWRPATHAGATRPGPPGPLLLRTPRALRRPGRPPPTARRRLCHAGQRAAGGGAPAAGLRGRQFPGNPTDPRLSRTGRGNPRRYLPRRGSARPCRQHRTGHRPELRADRPGQRHRQLHQGGPADPGEDRSRAAPGHGGQVACGHVGGSTDRHRDRHPLRRGCPAMKGTPLLLIASLALGACSLGPDFTRPDRPAPGEWSLQAAAGNPSHLAAAPLAAQWWTLFDDAQLNALLQRVQRANLDLRSAAARLQQSRAIRRSLGGDALPSVDASGTYQRQRTTSAGLFDPSGKAGKGNYNHALAGFDASWELDFWGRVRRELEAADATVEASENELRDVQVSVLAEAARDYIQLRGEQNRAAIIRDNLETARRSLELTRTRLANGVATDLEVAQALAQVASMEARLPEVEKNQAHLVNALGYLVGASPGSLLAELGPARAIPRPPGSVPVGLPSELAQRRPDIRRAEARLHAATASIGVAKADFYPRITLNGNFGFESLQLSSLGDWDHRQFAIGPAFSLPIFEGGRLRGRLELREAQQQEAAIDYQRTVLRAWQEVDDAMHDYAANQRRQERLGEAVAQNRRALQSAREQYRAGAVDFLSVLDSQRQLLDNQEQQVASDEAVSLTLVNLYKALGGGWSPTSDPASG

SEQ ID NO: 26119 - protein, 335 aa, Pseudomonas aeruginosa
DGAGRGPAKELEMDLLQGIRTFVRVVEHGSFTQAAQALGTSPATVSRQVAGLEQALSARLLQRNTRSVVVTESGLRYYEHCKQILRTVAAAAADVEDSQSHASGRLRLHAVTELGLEHLMPLLVDYLDGHPDVSVDLTLAQGTPALLEEGLDVLITLSRTLPDSTLVARDLGQVFSVVCAAPEYLARHGVPRTPEDLLRHRCLNVAAPSCPQGWAFVGERGETLLDLDEALKVNLPEAACAAAAAGLGVCLLPGFVAARALQEGSLLRLLPGHRLHVREVFVLYSSRRYLDAKIRTWVDFLRERLPLAFERDRAILDDRRYWAESPTGVARETAT

SEQ ID NO: 26120 - protein, 257 aa, Pseudomonas aeruginosa
IMLPTLYISHGSPMLALEPGASGVQLRRLATELPRPKAILVVSAHWESDDLRVTGAAAPDIWHDFYGFPPPLYAVRYPAKGEPALAQRTIELLQAAGLPAQADPQRPFDHGTWVPLSLMYPQADIPVLQLSLPSRLGPALQSRVGQALRQLRGEGVLLIGSGSITHNLGELDWRAGPEAIAPWAREFRDWMVEKLQADDEAALHDYRRQAPWAARNHPSDEHLLPLFFARGAGGGGMRVEHSGFTLGSLGMDIYRFD

SEQ ID NO: 26121 - protein, 232 aa, Pseudomonas aeruginosa
CWRPTSTSAPATRASPSSKCSAESSRSVARHCACTRSPAGATPCAGCSPATNSTPTKPIVSAWCRKSPPRRTSSTTPSPSPNGSRPRRRWACAPPSARRARPCWKAKRSPPLRCRKPPGACSTARTPRKACALSRNAARDASKDARPGPCPRALATGPGAGCRYSPATNSRVAAPAPRHASAGLPGRVRGPGSPAPASPRCPRPPDTPSNDGDSARAAAARPAACHRCRSTG

SEQ ID NO: 26122 - protein, 141 aa, Pseudomonas aeruginosa
SRCAAERAAAAPAARRERSLEQHPAQAYRQLPAPLDRHRRQAQPGGHAAQLLGQLVQGGIVHAVRLGMQRMYRQALARPLGAEVDAADQTAVVQEWQHVVAVHAFFLRRVDLQAIAEIEQALGPRPLPDQRVEGREQGTGA

SEQ ID NO: 26123 - protein, 135 aa, Pseudomonas aeruginosa
PPRHLRFAGAVGRLAPALDPDRQQLASLHQFGEARAALRRAQPIVVAQVLFGGHAQGARRHPQQLALGLCLRKLGARQQFRGKHPLRQVIEPLEAAPSGHRQLAGGEQPFQRMLFRAPVPPGTGPLLPRAQAAGT

SEQ ID NO: 26124 - protein, 359 aa, Pseudomonas aeruginosa
DQSNESFLCNASWRLMNELPARHRYGIAPHLRRHRRARWFHPRRGGGESHPVGGQHADEAARRGRPAALAVRARRKADPPHRRRPGAARLCPADPQAARRGVQHPAPPAHGRLGAHRHPGRLRDALPPGDPVALRRSLSAGAGRGALRHLAQPAGAQRPRPVHRHPRAGHRDRPVAAPGALRLDGRRGLLPPRPAADPAGHVQHHLLLPGLGLQRPGGGGTGLPHRLQQPQPVGAVRGGQRRPRRDRATAQPAHRQPAHPRRERGPARPALGQHHADAQPAQPVTGHREARRIHRRGLPSLTQPRTSRSTAHNARKAQKAMRRLRSGKAWASLTPQEMLSRPPSARGIPIRQSTWPCMA

SEQ ID NO: 26125 - protein, 341 aa, Pseudomonas aeruginosa
ASVAGWETHKKAQWLCQLRKGMSMLPDTLSEQFVLYLDVLDGGSFSAAARKHPLTPSAVARRMDALERAVGSTLLVRTTHAVRATPAGLAFADRARRIVTELRLARAEAVSLSTAPQGLIRIDAPVPFGRRHLAPAVADFLKANPGLDVQLRLIGSFIDLQGEHLGEVDLVLRAGPLPDSRLVATSLAPMVRVVCASPEYLREHGVPASPGELPEHAGIDWDNLSPPYAWRFQHDGKLQHLRPKRARLATNNAEAMVDAALAGLGIAHLPTWLCSEYLLRGELQALFCDDGLPAAEPTCIYALRLEREASSRTRLLLAFLRERFGFPPPWDQALQQRLGER

SEQ ID NO: 26126 - protein, 154 aa, Pseudomonas aeruginosa
CWQPGRRGTLERFSYEYPMDERQKIRPRIIANLRKIAPALPQDPDACPVRRPSAALPDATRAVASPAPPRPRQVHRRRSTPARRCAGFPPGRRAGRRNRVRGMPRASPGAPPLPVYRCARAAAVPPTARERRNPRRAPRSGRSTTTGDRSRPAP

SEQ ID NO: 26127 - protein, 252 aa, Pseudomonas aeruginosa
PPAANRRHPPAPAPPAPAAGSAGGRRAVVPANQAAPGFRRQTAKSVARQPSAARRGRRETHPAPRRRPGNGADVPAGRPRATGRHWARGTRERRSTWKARTPAATAMRGNCRSIPRHSGTPGSATGTAACARAWPAGAPPAVRRAKASITTSAAATGAHGRAPGTHFDPIQALHVRHRVRPRTDPGEGLRLVHPQAHGLTVLGGQLASQAPGDADVAIVVDHATENVPARHPPLLFVPGSLPRHPADFPPTT

SEQ ID NO: 26128 - protein, 257 aa, Pseudomonas aeruginosa
HPARFHREGSDQPGQALPALFRLQLFPAIGTQQPVAQTRPFQRLPARLGRQQLATKRAVRRGIQLQLTRHHMHPDLATGEQVQLIVGLDQLIGVEGPGGTRHGGLLRVRNLSRKRYPGEVSKQRFQRRPDIFQEPSGGRRAPDGCHPPASSPGPRRPLRGKTAPGRSFPAPRPRRRPWKRPRCSAGRSSAATGYPAAAPSPLPPGPFAPCWQDSVAIAPAPFRAARRCLPARSPPAPASPRQAAPAGAPGHPRRCRR

SEQ ID NO: 26129 - protein, 885 aa, Pseudomonas aeruginosa
STGSNPDEAGAPLPPAEPRRSPIVPRVAQRRAARAVLRPADRGRLEHRHRLFQRPPERRHARPRRRVPRRRPGAQRYPAGKRRTDRTRHPSGPAPRRQRRVFQRDRHRPGHPAQQHQGGRRPLPPARPAQERCRAVRRRAGRRSSAGGRGMGRIALAGQPRPEGRRQHRDRPQAAAHRAHPYLRAGPRRRLVQPDAPRHDEPGRPRCHRGGPAGQPGALPRSVGRPAGSPPGLSPAGQGQPRRQPAPAGCPRRQPPGGRCPRPCRALPEPGQPGRGAARRRRRGPVRRPFRCTALRRQRAAALPRSVAQRNPAPLRAATVAAGPARQRHRRPARLVGTARPVPPARHAAAAGRTSRRPVPRLRRGRHRPGIAGRLRPPAAGSPGPGTAVAGPAQRPAAGADAHLDGLRLRPARPGPDHVAVESRPEADPRPARRRPGRHAGARRPPAARPERPAPGTGACQPAMAAGTRPVVAAPAGRRRTEPGLRPDPAGYGPDRPASRRTAGYLAGPVAAGRPQPFRPEHPADGKGRLRTSRAKALPRRRAAVPHGSRAPGSGERQAGPGARRRRAQRACPAARPRPDLVRATALRQPAHRRTLVERAAAGGPAGRVGGREAGRQPAYPGRRPAHLQRRRAESRGPGPEPAQGEVGQFPAELLHGLPARHPDRPAGDLPDQLLPAGQPGTRPDRTGPRLPHRHPAAGRRPAEPAAEHPRPGHPGRGVRAGVRSRGGLRGALRRSPGDPRRARAPGCPAARAGCRARVAATYPAGRVRPARRSQRPARGARLRGGQPAALPTGLRPAVASASLVARAASGGRRAGRRRRPAGHPSRPQQQPAAGPARGLIGYTGRLSSVHLWNHPNHESLSSTAHRRHPADHSGGRRAVTRRAA

SEQ ID NO: 26130 - protein, 196 aa, Pseudomonas aeruginosa
KSRMETVKKHAEAPMPDRFLRLFFALPCPPPLAERIGRWRDDRPLPGRQVATANLHLTLAFLGQVPSARLEALLDMAAAIEAAPFDLYLDRLLRWRNGILLLAPSQPPGALLRLRRALRSGLAELELPVETRSFSAHLTLARDAAPLEDAPPPPTFVWQVDHFSLFCSQNDAAGVRYRTLGRWALCGEDSNERFAP

SEQ ID NO: 26131 - protein, 315 aa, Pseudomonas aeruginosa
DENNMKKKSLLPLGLAIGLAFLAASPLIQASTYTQTKYPIVLAHGMLGFDNILGVDYWFGIPSALRRDGAQVYVTEVSQLDTSEVRGEQLLQQVEEIVALSGQPKVNLIGHSHGGPTIRYVAAVRPDLIASATSVGAPHKGSDTADFLRQIPPGSAGEAILSGLVNSLGALISFLSSGSTGTQNSLGSLESLNSEGAARFNAKYPQGVPTSACGEGAYKVNGVSYYSWSGSSPLTNFLDPSDAFLGASSLTFKNGTANDGLVGTCSSHLGMVIRDNYRMNHLDEVNQVFGLTSLFETSPVSVYRQHANRLKNASL

SEQ ID NO: 26132 - protein, 443 aa, Pseudomonas aeruginosa
DPGRGLGPGPFPEAPSREENPPADSTGVRRQPGLVRLAGTFPRPRDGAPGQPAGGRRPRPASSLRGRSGAGPPGHAGQGRAAANLLQGHQRRWQFQCRRQRQPADHPRHPQPVRLLPQRRRRRAPAAKPGPPARLHRRRTPGAGARPGVGADAAIHRLQEGTGAARTRPAAPGRPRRPAPAGSRGESPARADLQQRSARGVLRRRGNLQPVHPGAPGDPPGRQAQRRGKGRRHRPPARQPAGRPAGKRAAATAKRTAAADRRPPGRWRRPGSHPPDASATGGRRSHHPPGATRSATLGLEGPAGRLFRREEPDRRQYRAERSRPPRGGRTPGRGALQRTGTLAPGRAGTDAPGRAALTGTETPRTRRRALRRITLPSGVQPWRGRRGGNLCCAPQRKRAATRRCPPFFVASPVQRDSLPSSENLPAPSISSATLIIRRVRAYS

SEQ ID NO: 26133 - protein, 172 aa, Pseudomonas aeruginosa
STARPRARRRGGTNGHHRHQPGRQRTGAAALRRTRRGRPAVYHRRRPPPRGQPLERRHRSRPARPVRRPAGTRGGRMRPRLQSRLLSPSGPGKGPRGTTGTGRRATASGVPPRTRRQRAPAGDPARLPRSPAGRRRTLFHRRAPGAVWLPRPRPAHRHHRLDQRRAPRHPPA

SEQ ID NO: 26134 - protein, 150 aa, Pseudomonas aeruginosa
AGIIRRAAAPRLDSTTCKDPPRGSPSRSTENMGKRHPNLLAWQWRGYAANHRNPTNLVLHLIAVPLFIVAAILLLGGLFGLDLLQVVLGVIGIGAGLAIQAKGHALEEQAPEPFSDRRDAVSRLLVEQFVTFPRFVLSGAWWRAWRERHK

SEQ ID NO: 26135 - protein, 254 aa, Pseudomonas aeruginosa
ARCGRITSTCATSSQTSATRGIAFIAPLRTTPAHAGRPRAGPRRWPVAGVCRAAPGHRAAAARRVPGLHGTSGPGDFRDPRRGARIPATGLPHRARRSPSPAAPGHGKTPSNAGAAASRPAGRRAVPGSRRRPCLPARAPGPRHPPRPARGMARRPAAEGRPAPAGAGRPSSRPPAGRGESDSPPAGAPAAASRVARSGGTAAPRQPRRLPGRRIPAAAPASRRRWPGAPAAGFPGAPGNRRARRRTPGPLPTR

SEQ ID NO: 26136 - protein, 343 aa, Pseudomonas aeruginosa
AGLAQLISCISPRRRATRLLLPNWPTRRTQSTPSCTRSTERSLEPSSSSMSGCWRKNSGSAGAISSRATRLGTSTLSRPLARLPSWNRLSSSSMSSSRWRQRSSTTLPSWVSWTCRVVRCSSRLPSCASSCWTAAETVARGMSSRSAALVKLPVSATRRNTRMLSRRSMGRPLLSIRDGWTVYPCHLRLSKEPGPIAWSPYSTSWIRRCPMQRFCFLPARPRCRKWSGSGAMPALPSGSPGTPISTGASASASPTSTSLPAPTRCARLPMKPRTISACCCCSTSTRATPSVEPRACTPATPKRGAGRSGLWDKASTARSGTRCGCSSTCRSPMPRTLPTRIAR

SEQ ID NO: 26137 - protein, 607 aa, Pseudomonas aeruginosa
RQGHPWLRAAGEQRGDPAQAVGCAEDLLDPSQQGASGLGQLRLAATAIEEFQAEVDLQPGNGLADGRLALAQLARGGAEGAEGNGLDEGLEGFGRQMHIGFSDCIQLNPIPKTDDNTARLQRRTGSVRHDPHPHRPRQDSQGADLPRPGLRGPGRPPHRAGAVAGDEQAPGAHGCADADVLHRGDALEHAFQQPLRPRPAAHGLPAHPAGPGAACDALRAGADRGAGTAGRLVAVDRTGRGVPPRHGPDPVLPALHHGLQLELRRPPRTPGGKPPGQGRRLRRRLGRRSGRQPLAQAAEHAEQAADPFLLALVARHLGQPVNLRQASPAPQQGLLGGRLQAFLEQSPADRLGQVAEYLRLVDQFEQGLGVAERRNHQAEQARMGLGQGFQQRRGMLPGQLQVADQHLHRFGVQPHQRLGQVARAQQAMPAGMAEGPDAVQGFRVVVEQQHAQRRRQRGRGRRRQALAAGDLRRLAQGEGHFLGIPGLGQVAEDATVVERVDGGIEVGIAGEENPQGLRIALASLRQQFGAAHLRHALVADQHLYPFRLQALQGAPRVALGEHLVMAAELHGQAAQDALLVIDEENADGRWAHVRRSVSVRGPALAAG

SEQ ID NO: 26138 - protein, 64 aa, Pseudomonas aeruginosa
TFISMRENNMPWYAWLIIVLALGSIVGGLLLLRDSAKKLPLSEEQLKRIHERNAELDAQEAKDR

SEQ ID NO: 26139 - protein, 258 aa, Pseudomonas aeruginosa
TGGCMLGRLIPLLPILFLLGGFFTGHIALLTAVIVLLYIIWVTYAERWLPTLLWWPVSLAASALIAIHYLPGFIPLRLFPWDLASASPPIQMIWLPWDKALVALTLLAWWLRRPKQPLVSLDITALAFCLTFFVVPLLSIMTNAASWQPKWPDAFWWWLVLNVGVVSLAEEAFFRGLLQSQLIRWFGAWPGIIVATLAYAALHLLVNPVYALLAGIAGLGYGMVLHFSGRLSLAVLLHASINTLHFLLLSYPFRLISE

SEQ ID NO: 26140 - protein, 1053 aa, Pseudomonas aeruginosa
CRPTLPPSRVKNNAKDRTHRLRLGLLGRHLHRGRPVGARRAAGLPGVRLPGRDHHVDHGRRPPETAGRRLRHRLRRGPRTTAGRDRREEDPRHQQRWRDQSAGLCRRPRRGLREGRGAAEDRRAPWRQPASAPGRTGQGRHPRDVQRRAFPADVRLAQRLPRRAGHRRGPAPGRGYRDHRPGGRQRGGQRRPGARVRLGLGRLRPTGPGRPRRAHRRMRRAMHRRQFHRLGAGAGLRAHRFPHRRGRGRRALRGDQGARHRWPGQRTERRRTDALRDRRPTRLPAARRGLRLHRGAPAPGRTRPGRGGRRARPAAHRPVQGQRHLSGRFPLHRQLPDRRHRCAEEGRAGQPGDHRQDRGNLRRARLGALPRGQCRTARQRSHLWSPWATAGQPRSGGQAGRPASAQGSPGAVLPRDRPGRHRDGARPDRHRRRPADGVSGDPPVLFPDRQGAMRVERRDRRPAPSAGTAGPRSLRPGTIGRGAPAATPGAARQRQRAAGEASGGALRRQRQPQQHRGHGAAPGVPAVDRRGAGGRRGGGLDAACARPADRPGRPLVPARQPQPELPAGERPRRRRRRQPAHRPAGQGLCPAVAGVPGGGAAGARRRAGNARQITTTRNGECGVPLPLYGIHRSHQNNELRLDLPTWPVRRPDHHRHRRRQRHRPLHRPRAGGPRRPRGAGRTQGGKAGEDRRRDRRGRRQRQLARLRHPRGGSGEDAGGEYPGRTRDHPSPRQQRRRPVSLAPRLDQPEGLRDRAPHQPGRRLPGRPRSVQPVDEQDRRQHRQHARRHVGRHARHGSLRRRTLGHGEFHQDRRRRVGPCRRAGQRGGAGLDRVQRHGYLRRRVQGGDPDPARARAAQAHRQRVGSRRRHRLPALPRRRLRQRQHDPHRRRRQPGQPRLPAIQGQAGTEPRVQRLPPRLPARRTEGPGGLTCPRSSRNSTSTARTSPATARPCSPPWPASASWSRRSWTRPPRPGRSSRNAASCCRANAWRCCSTRARRSSNCPRWPATSCTTTRTAPRPAAGSSPGSATSPGCAAWSVPATARSRAAPSPRPG

SEQ ID NO: 26141 - protein, 222 aa, Pseudomonas aeruginosa
CPGGKTTHDLHPGTRGTPPHRSQLRRAGNQPQRRPVGKGRPLPDPRDLPQGRRTRPAGHLQAGEVRRHGPGLQLLDRRRRGIRQHHLRRHPDGHRRADRHVHPGPGPLRFRRVARGVPPPGHRRRDGRLHRRLRGRRRLRRRRPEDHRAQGRRRLCDQRQQDVDHQLAVGRLHVPARQYLRRQAARQQVADRGPDEDPGHYPQSAPGQARHAQFGDRPGVLR

SEQ ID NO: 26142 - protein, 442 aa, Pseudomonas aeruginosa
RPRTAAQPHRRGRRRLHDADAAVPGRTAVRRGQHDQGPGALHRRHHRVLQGAQDLRPAADRQPGHPLSHGRDDDRGRGAARPGLPGHRAVRERQGRDAPGFHGQAQGRPPRPRGQRRLPAVLGRHGLHVGQPGLPRLPRHPPGIHRRRCRRDHARHHLQADGHPAGQEERLTFQEETGMSLPHCETLLLEPVEGVLRITLNRPQSRNAMSLAMVGELRAVLAAVRDDRSVRALVLRGAGGHFCAGGDIKDMAGARAAGAEAYRTLNRAFGSLLEEAQAAPQLLVALVEGAVLGGGFGLACVSDVAIAAADAQFGLPETSLGILPAQIAPFVVRRIGLTQARRLALTAARFDGREALRLGLVHFCEADADALEQRLEETLEQLRRCAPNANAATKALLLASESGELGALLDDAARQFAEAVGGAEGSEGTLAFVQKRKPVWAQ

SEQ ID NO: 26143 - protein, 676 aa, Pseudomonas aeruginosa
ATTAKQGNSLQEPNDMPSFNKILVANRGEIACRVLRTAHELGYRSVAVYSEADADARHVQLADEAVCIGPAAVAQSYLNLEAILDAARRSGAEAIHPGYGFLSENAEFARACEAAGIVFIGPDAEAIHLMGSKRLSKIAMLAAGVPCIPGYEGAEQDDATLRREAERIGYPLMIKASAGGGGRGMRLVEEPDQLLDQLRTARSEALGAFGSAELILEKAVLRPRHVEIQVFGDRHGNLLYLGERDCSVQRRHQKVIEEAPCPVLDADLRRAMGEAAVKAAASVNYVGAGTVEFLLGEDGRFYFLEMNTRLQVEHPVTELVTGQDLVAWQIRVAEGHPLPLRQEQVELRGHAIEVRLYAEDAGRGFLPQTGTVLRWDPELLPGVRIDHGLVEGQAVTPFYDPMLAKLIAYGATRDEARRKLIRALERCVLLGVDGNQRFLANLLAHPDFAAGEATTAFIGERFAEDPSLQPRQPGAEELALAAALLYQAGAEASAHQPGLAGWRSAAGAPWKIVLKHAEQRVEIGLDVLESGRRPRLLARLERREIAVRLLDCDGRWASAELDGIRRRHAYHVDGGRLWVYGHGGNLELVEVTHAGASAQVGASSGTLKAPMDGAIVEVLVGEGERVGKGQLLLVLEAMKMEHPLKAGVDGVVRRVQVGRGEQVRNRQVLVEVEADA

SEQ ID NO: 26144 - protein, 291 aa, Pseudomonas aeruginosa
DTPPLIRNDNDKKTETPMSLHGKTLFITGASRGIGREIALRAARDGANLVIAAKSAEPHPKLEGTIFSVAAEVEAAGGQALPLQLDVRDEQAVAAAMARAAERFGGIDALVNNAGAIRLVGVEKLEPKRFDLMYQINTRAVLVCSQAALPYLRRSANGHILSLSPPINLAGRWFAQHGPYTVTKYGMSMLTLGMHEEFGKYAISVNALWPKTMIATAAIEFELGSRDAFRRARTPAIMADAAHAILTSEGRSLSGRLLVDEELLRERGQSDFEQYRYDPEGGALVPDLFLD

SEQ ID NO: 26145 - protein, 400 aa, Pseudomonas aeruginosa
CATSVSSTPSSSTVSATPSAGRARTFPPPRWKTPSAPSTGSRMRWSTAWRFPAPTAAAGWPRCAWPMASNWTATLSPRTSTASCRPMPHRCSCACCAKSRPPAPSSTRRPTSSATPTIPRGSATNSSSGCPAAPATSRWTRSCTRRCRSSATASEHRGGLLAELELQLGPFQGPRHAQFAVAIEQLAVEAEVAVVLFLEHRRQQRLGLMGLFRAGRRHLLHQFLRQAQVQLGARQRLAYLGVETSGGSALRRRRLVLGDRPAGRLRRRSRRLRLGRRLGFGNLLRGWRDLLRSCFRRGRHGRRWLRSCRLHWLGRGALLLRRCFRGFLFRCLGAVIAGRQEATEKNNDANSAKTFHSHAGMANCGNADGRLQPRQGVTIVILALSLLFAPCLTCHARITA

SEQ ID NO: 26146 - protein, 512 aa, Pseudomonas aeruginosa
SPGKFFADCRGAPLSQGSASRSGGDKAFLAKLPGKHAEGHDRPLRLAVPGNPAGQPQAVVELLGVAEDQPRGDADALLQGPHVEFLGVDLGRQADPEDEAALGPGHLRTFREVLLHRQLVGGHVLPVLLADVAQVAVVAAVLQVGGDAHLGHGAGRMGGEGLQATDLLLVALGDDPADAYAGRDGLGETRAVDHPAVAVVGLERARLALVEHQFAVDVVLDHPDVVFGGQFQQLLLAILGNRPAEGIAQPRGQHQGLDRPLVGRQLQRFKADPGARVAGDLDDLQAQHVGELQQAVVARRLGGDQVAGTGQHPQGHVDRIHAAVGDGHLRRVDHHAGVAHADRHLPPQRLETGAEHVAERPGALEAGDLGQLLVQGAHRQVVHVRHRRAEREYPFAAGLGEHLVDDAAAGDQAGTLDPRDIRGRRGQRRGAVDVEAGLRTGADQSLVLEGGVRLQHGGVADVQLGTELAHRRYPLARLVDATANVLGQLLGDALVKQQIGHGGFSSAIEPKQ

SEQ ID NO: 26147 - protein, 148 aa, Pseudomonas aeruginosa
PRMSSASSSARRAAGTISSAQPGPRPITVSRPRRWPMRSIAKGAAATASRSPTCSAAGKAWRRRAAGSACGRKRSGTPSASAAACRRGSAIRALSASKPPSAAAARPASTSAWRTASAAASAGSSAASTQRGWISSSSARGARAEGVT

SEQ ID NO: 26148 - protein, 571 aa, Pseudomonas aeruginosa
PRAFPGRPGCRRGSLRRGWWRTTGDRSPGHRGCSQSCGFSGSGLGRQGRQVVGGRGESQAAGQQLAESGVAWVVPVQVVEPAAARQQGERRAVGSGAGPFAAAQVQLRQVAARAEAFGQAQGVALGVGQASGAGAGTAAGDQPRQRRIGLGQQAESAQAEQRLVGLGVRQVRQEHALPGGQAQAAVAMAFDQLGQAFQASAVEPAERRRRADHHQARLALRLDAEMTPRTPRRTPPGRHPLVTPQREIQARLQGLQQGSPASSCNRWRIRRLLRLGALEEQVEQRQHQGLAPLRRQRRQGAVAGRAAGESEDQRRGRRRGHRREPDVMGMFEHRQVFAAVQLDGELGRQRVVAAVRLEPQQQPSGQRAHVQRQVRIEPGGRAEHKVAHVVGAGQGPMPGTEAGVQQAADKPLFLAATDAAQLQVGTVGRLDHAAGAIPRRGRHGACLGGVQAAGVELDAADAAVQRLDDTQQAGTGRRTWYGQGRRGLVVVQKRYSNRRRGDRTAVPQGQTTASVHPARCWHSRLVSAAGLLARSPAFHPGEEPPLRAAFPVIQWRMARIQAAYSCGGSHG

SEQ ID NO: 26149 - protein, 445 aa, Pseudomonas aeruginosa
ARASKRPRLRVPSSALVGPALTRKGRAPTNALLCRPARGRENPFRPEAVAGPSQTHFRSIGTVSSADSTPPWLTLVGIGEDGYPGLGKQARRALLQASRIVGAARQLELLPPCIGAARETWPTPFSLEPLLARRGQPTCVLASGDPMLFGVGASLARQLPATELRVLPAPSSLSLAAARLGWALQEVACLSLVARPLAALQAQVHDGRRLLVLSNDGDSPAAIARLLNARGFGASRLSVLEHLGGPLERRLDGLAGDWSLPRAADLNLVAVECRAGAGAVRLPLTPGLADEAYRHDGQLTKRDVRAVTLARLAPCPGELLWDVGAGCGSIGIEWMRAHPSCRAIAIEANDERQEHIRHNRDALGVPTLHLVAGSAPEALLELPEPDAIFIGGGVTAEGVLETCWERLRPGGRLFANAVTLQSERVLLDWQQRLGGDLHPLFTKRE

SEQ ID NO: 26150 - protein, 342 aa, Pseudomonas aeruginosa
RARAVNDVPDAATVTYYRQRASAGLIVSEGVPVSREGMGYLFTPGLYTEQQVAGWRLVTNAVHEAGGRIFAQLWHVGRISHVSLQEAGASPVSSVARRAENSQAYAWIVQGLAGQVPASAPRALAEDEVPRVTRDIVAAARGAITAGFDGIELHAANGYLFEQFINGELNTRLDRYGGSIANRLRFLLDTVDALAEAIGAQRVGVRISPFGRLNDMRAFDDEAQTWLTAANELSKRNLAYVHLSDQCTIGGSPVGDFLQAFRDAYRGTLIAAGGFDKPRAEQALQRGVLDLIGFGAPFIANPDLVERLANDWPLAAVDRSTLYGLHGEHGYTDYPPYAGDAA

SEQ ID NO: 26151 - protein, 289 aa, Pseudomonas aeruginosa
TEKILTAESQGVATPHYRPHHRRDRPPHRHWLYQPRGGKQQAGESAPEGRTQRPGPALRADFREPSRPVRQPVAEAVDEPDRAQPQRAATGAGEESRCRAQGSYRRVARAGRQGRVDPGAQSAPGDPDRGQGQGSPLPLRSPACPAHPFHPGRPPAAQRGADLGQGDSPPPGAPAYRVLRQSRPAGPAAERTAPGAPGLRTRRPVPAQAARAGALPGGAAADGSAAGPRQRDGAEQQPAGERGAQRTQRGIEGPRCRRPVEEEERLRLIPACLRQPCYNPGSYRPRKSL

SEQ ID NO: 26152 - protein, 170 aa, Pseudomonas aeruginosa
PSPTWRSPASWSTCVTPAKTWTSNAGRPSPRISRGCSNARRCKRCCRGNDGPSTSSQRKPERVAQQSVRRRNISTRPSIPAWSSALKRPTLGLSRSSTATRRPSLSRGTTSSLLEALSQAMWPGNAWTSSTRWVSRVRAAAPQTPLEKGMRTQATLPWNGPRTSSSLRFR

SEQ ID NO: 26153 - protein, 142 aa, Pseudomonas aeruginosa
FRLASIMPARTHPSIAKCARCWTSATTPPRESPTTSMRSWPRSWSSACCARPPWSARKSSTPPACRWPAPRANPPKAACGRSATSSSATSGSTRTRCMSTMRRARPSAYCTWKSTPSCSATTSSVAPASPCSPASCAACCCR

SEQ ID NO: 26154 - protein, 508 aa, Pseudomonas aeruginosa
IPGVLVAWYSPLKARSVPPRRQMWNCSSVNSSRQESRGLSILLIGSTSRSEKCPALPFPGDGPHVSCVLLIDASLSSALQPAKPRSSGLFAACSTVFAHFGTRHIMQVSKSNKLANVCYDIRGPVLKHAKRLEEEGHRILKLNIGNPAPFGFEAPEEILQDVIRNLPTAQGYSDSKGLFSARKAVMQYYQQKQVEGVGIEDIYLGNGVSELIVMSMQALLNNGDEVLIPAPDYPLWTAAVSLAGGKAVHYLCDEQANWWPDLEDIKAKITPNTRAMVIINPNNPTGAVYSREVLEGMVELARQHNLVLFSDEIYDKILYDGAVHVSTASLAPDVLCLTFNGLSKSYRVAGFRSGWVAISGPKQRAQSYIEGLDILANMRLCANVPAQHAIQTALGGYQSINDLVLPPGRLLEQRNRAWELLNDIPGVSCVKPMGALYAFPRIDPKVCPIHNDEKFVLDLLLSEKLLIVQGTAFNWPWPDHFRVVTLPRVDDLEQAILRIGSFLKGYQQ

SEQ ID NO: 26155 - protein, 167 aa, Pseudomonas aeruginosa
PPRSRGAAGAALPGDPSMDLQIDDFHKDAAGGLLLLYQAFPRKTALYVEDLIGREAPDEFGLPSKRHQSCLGALLWLAEEGYLRFANTIHYEALDQAVLSEKAFLRLTRIVPRAAAALAEAPASVRREQASLANQLRQALAQGDGERLAGLTRLLFEGNLGAQGDTV

SEQ ID NO: 26156 - protein, 394 aa, Pseudomonas aeruginosa
QPRASPGTCGSVISPDEVPMQIRADFDSGNIQVIDASDPRRIRLAIRPDLASQHFQWFHFKVEGMAPATEHRFTLVNAGQSAYSHAWSGYQAVASYDGERWFRVPSQYDADGLHFQLEPEESEVRFAYFEPYSRERHARLVERALGIEGVERLAVGTSVQGRDIELLRVRRHPDSHLKLWVIAQQHPGEHMAEWFMEGLIERLQRPDDTEMQRLLEKADLYLVPNMNPDGAFHGNLRTNAAGQDLNRAWLEPSAERSPEVWFVQQEMKRHGVDLFLDIHGDEEIPHVFAAGCEGNPGYTPRLERLEQRFREELMARGEFQIRHGYPRTAPGQANLALACNFVGQTYDCLAFTIEMPFKDHDDNPEPGTGWSGARSKRLGQDVLSTLAVLVDELR

SEQ ID NO: 26157 - protein, 136 aa, Pseudomonas aeruginosa
SRPGGSRSGCSPSGRAKNPPASCPPHSWEKPQGGDNRPAGQLPCASPSRTSTSTGHGASRITRSPTEGSSRRSSRPRCRWPMMISSQPRRRASPRITCTGSPARSSARTSSSHPASSAQASSSTCRASSHSCAAGG

SEQ ID NO: 26158 - protein, 168 aa, Pseudomonas aeruginosa
ATRSWSAPAASWCPRPVPWNCRSRSGNWWTRPATCSTLARPSNWTSWSAASPCVPTTPWSAVCRYACWRSSPRRRRAAPCASCRSRTSTTRHCGRTASTSTSAPRPGWNPRSRPSSCSPPASSAWPARGTRSSTARSLRSASSLFRISPSRVVASTMDRWTRPWENSA

SEQ ID NO: 26159 - protein, 261 aa, Pseudomonas aeruginosa
PGPATGGVLVRIRRLAVGVLAGHSTVPGGDGRGVPWHPPGPGAPGTLPPVRRHRPAHRLPGDLRPGDRSAARRTPGLVRVAADLPAAGQRQPPAGAVPGQRMEPPAAVLPPAVAEAPQPDLRPDHPGRRAGGARREHGRADRIPRRDPRLPPPAERTHGVAGGPSAARRAAAGGGPLQHPAGRLPLGAGLRPVPVRRCLPELQPTDGGLGARGLLPADAVTGGRPADGGDSAADALHQRHRAHRGTLRLGLVQHRPRLLPG

SEQ ID NO: 26160 - protein, 379 aa, Pseudomonas aeruginosa
SLIPILPQRDLPAPPGRSHTLKGRCMSFITSRKGILLLAALLVLTLLVYLLFHLLAPRVVQSTDDAYVHADFTLVAPKVAGFVQDVLVEDNQPVKAGQLLARLDDRDFRTALAAAEADVLGAEANLANAEANLQRQQALIEQARAKVRAEQAELVFARHEQSRYQTLASKGAGSLQNAQQAQSRIDTASARLAEGQAAVDATRKQVSVLEARVGQARGDLQRMQARRDQARLDLSYCELRAPFDGQVGRRQLRVGAYVTPGSALLAVVPLQQAYVVGNFQETQLTHVSPGQAVEIRVDTFPGEVLRGHVDSIAPATGLSFAPIAPDNATGNFTKVVQRIPVKIVLEPRQAMAGKLRVGMSVEARIDTATGTRSAEVAQQ

SEQ ID NO: 26161 - protein, 159 aa, Pseudomonas aeruginosa
TPCCNGSSVPTSTCAAPRRACSRAARSVAASAVTPCPRWTPAAPTSASGPPAPACSIPPARPAKATTTTPWPASTPPGSWTSGAACDASWKPPTRRWKPARTNCATCRSRCWRKPRATISSCAANRTVRRSSATTSRPHGAAWNSPARAWPTASPPTSR

SEQ ID NO: 26162 - protein, 232 aa, Pseudomonas aeruginosa
PRRWPRWPAWRHACPRWKRTRRTWSTPSATWSAPAPAACSPNSARRGRFRVRRAACRSACRPNWPSAAPTSVVPKRACTPLPPASAWPRRTSIRASRSTATSVSNPCNCPAWATGTIASSPSARRSACRSSKADACADAWSYARHSSRKPPSTTSAPCCVPGRKSTTRCTTTPPTSAARSASAKPWRRTAAPCRAPASNTAPARWTSSACSTASGNCWTTRNSRSPATKRCR

SEQ ID NO: 26163 - protein, 125 aa, Pseudomonas aeruginosa
TWPRRPARRAGPSSANAAKRCSISTRRSRSTFPRPPAPPPRPGSASACCPASSPPARCRKAACCGYCRAIDCMSARCSCCTPRGATWTPRSAPGWTSSGNACPWRSSVTGRSSTIGATGRKAQPA

SEQ ID NO: 26164 - protein, 368 aa, Pseudomonas aeruginosa
AADQGLGMCRSDMHDVVPALAAGRVLCFLQDACQRDSPGVTKREAGAGAKNSLASKHQAHEKAPPKRGFCSSRWTSVLAIAAQAQGLAGDAGVLELGQQALEIGLGQLDQAEGIANLDATDVLAGQAALVEDRAQQVLRRNPVARAEGSAAAGTAFARRRHRTTLAAALRTLAAFATVGTLARCRWGQRLFAAHRLQVQRLAGGQACQQCGGQGLGIAAEATAQLVAHRAALLDGAVEQGRQARGQARQAGLQYGLGIRQADFADLLPGDPLDHLQHAPLARSHQQQRAPFPAGTAGTADAVHVGLGVVGHVDVQHVGDARYVQAPGGNVGGDDDVQRTVLQRLDDPLALGLRHVAVERGGAVALALE

SEQ ID NO: 26165 - protein, 331 aa, Pseudomonas aeruginosa
FGVVEGGLLGADEGDQRVELLDFQQALDRTGLLVGMDHQVDLLDARHGLGLGGDLDVLGLLQVALGDATDGRRQGRREEHGLARFGKRLEDHFQVVHEAELEHLVGFVEHQALDGGQQLLVAAQVVAQAAGGSDEDLCALAQGLQLRPHGRAAVDGDHADARQLLGIGFAGGGDLQGQLAGRHQHQHLRLAAARVDARQQRQGERGGLAGTGLRLADHVVAFEDQRNRLSLDRRRLFVAYGDDCREHIGVNTERGEADGFLSHGFASYTSAKTHDPWLLMPCTAETATQAAGAGICEIAFELEDYVKEIRRADTQPEHSAPKNAGPERGQF

SEQ ID NO: 26166 - protein, 579 aa, Pseudomonas aeruginosa
RLCAFFPTCVIGETDNGHPDSRRLYRRCPPPARKPPHERHPPRTHQPRTARPPAAARPRPRGQAQRLRPADARRPGRRARRIRGRRPVALCPALRPRRAFHRRAGPGQCRRDLPPGLETPRRRRRSLGHLRRPASKQAAGGGRARLLLHHRHRTDAGGRHQPLRQQRALRPARSAARNPPVRWRDTAHAPGRRLGQRHALAAHRRRIRRPRSLSSRPGAGSHRPGGPPRPRHRPRRTGRGPGAAGRARHPRLGAPGPAGRRSGRRRCVAGSRQAPARQRGRQGRPARSPGTPPGTLRRTLGRALVRAPWLLGRAQAVDIALQRIAELRLQRRGTRPQGFLVEFEGQVRRHQHHHVALGHRTLPVMMVIAPAQQRRAQRLAIGAAPLVDHQPAILGEALLAGTEEIPGQVRGRRAGIGIEVEEDQVGLRAFAQALQCVADAQSQARVVAQPQMLAGQARNRRAQLDGLGLLQRQVAQAGLGQAAGAETEEQRATRLRMAEPAEQHGAGVVVFQPGWIGHEHAALLDTVAELKEAIVAGLDDPDDPVFVALLDQQTFFAHHSPPPAASPAIARRSGKSTAA

SEQ ID NO: 26167 - protein, 500 aa, Pseudomonas aeruginosa
QSRPDDGFPLLQRSLAALRRAALPCRNPLSRALPRVVDEPVLEPRELEGQADPATTRVPRCRAPGQGRADPRRIPAAGLRRRGSRAAPAVRRSHRRTRLLAPGRGLRGKLRRIFRGEDPRYLQGTVADGGGNDLRRRLPGSEGRAHGRPVRQAALLRRRNAERRDPARLSRRHRQRHRLRREEPRAGPGAPVAGLPPVHRQPQPVARLRPGRLRRPAPGAPLEPRFHRQLGAGRALPATRRPHRRDPRLHARLRPGQRAAAPRNKLLHRPRSAPAELRGSPDPPRQPDRRVVRLLGAHALDRRPHPPDRRRSCRDAARRGQSDRGQGRAEHGQRGADPPDRYSQPGQRSGPPQPDRADGCRQGRRPPAAPDPGHPARGPPGAVEFRSYARQYHQGLQRLQDPRLRPRARRSPPVLRGAPGRRQLRRRHPHRDDRAERHRVHRRFATDHRRRPQRPLPHPLRPAAERRPVAGAGLPDRRNPEAGAPLSAPRPLPPPGGSAR

SEQ ID NO: 26168 - protein, 284 aa, Pseudomonas aeruginosa
MSYQPGIDTELLRTFVAIAEHGGFTRAAEAVNRTQSAVSMQMKRLEEDVLQRSLFERDGRQTRLTAEGQVLLGYARRILKLHGEVFNTLRRPHMVGSVRIGTPDDYVMRFLPAILSRFAEAYPLVQVEVHCDTSLNLLARNDLDLSIVTREPGTEIGQLLRQEPFVWMAAEGFCPHDQRPIPLAMFNTTCFCRAWACNALEAAELDYRIAYSSPSLSALFAVVSAGLAVTVQLRSLLTGNLRILDESEGLPALPSASIMLMRNPHSQSPVTEKLAEYIGEGFRL

SEQ ID NO: 26169 - protein, 282 aa, Pseudomonas aeruginosa
LNRAPAGAPRTMRGRRRRPCAGCARARRGPASRPRKCSAGRPAPGGSPSASRHGRAWRRSPAPPPCSARPGPARGPGRRPGRGRTPKSAPVSPAPRHRPRKARRASPRQGPARPSRANRSAASRRPAAGAGTGARTCSRPAPGGRSRTLRASAPHRSARPRWTPGTRKAGRSGQGLRPGADRCGCAGGSATTPAPRSVPPSPARYPAPVAGRDRRSPPAPGSPASRRLSRTDRPGNRAPSPAGNREIHPACQPLFRRLHARQAWLDGKRTRKHNGYANYAKA

SEQ ID NO: 26170 - protein, 368 aa, Pseudomonas aeruginosa
SAASSTCRANISARSIWCCAPARYPTAAWWPPRWRRWCGWSAPARNTCANTAFPHPQANCRSMPASIGTTCRHPMPGASSTTASSSTCGRNGRGWPPITPKRWSTRRWPASASPTCRPGCAASTCCAANCRRCSATTACPPPSPPAFMPCAWNAKPVREPVCCWLSSASASAFRRPGTRPCSSVSASAEDTTRRETWKANSHYAKFMHSALLTWKTAMSRLPTTPCEQLKLDNQLCFALYSTSLQMTKVYKPLLQALGLTYPQYIAMLVLWERDGLTVGEISARMLTDPGSLTPLLKRLEGEGLITRTRSSEDERVVLLRLTDKGRALQRQAESIPACILESTGLDLPQLVALKDELLALRGNLQAPD

SEQ ID NO: 26171 - protein, 167 aa, Pseudomonas aeruginosa
HDDKFHFTHLLSAQELNVQIRQVTLMQTIKALYTATATATGGRDGRAVSSDGVLDVKLSTPRELGGQGGAATNPEQLFAAGYSACFIGALKFVAGQRKQTLPADASITGKVGIGQIPGGFGLEVELHINLPGLEREAAEALVAAAHQVCPYSNATRGNIDVRLNVSV

SEQ ID NO: 26172 - protein, 104 aa, Pseudomonas aeruginosa
PANFPGWGDCCYGNVHLKGNTMNNVLKFSALALAAVLATGCSSHSKETEARLTATEDAAARAQARADEAYRKADEALGAAQKAQQTADEANERALRMLEKASRK

SEQ ID NO: 26173 - protein, 332 aa, Pseudomonas aeruginosa
KNPRPLRVRGPLPRRSPSGRKLGRIAIHRRGHRRRRFLGDFHRHAILRGHHFADHVPVQLDTLGQVVALEHGVDHRSVLVHHRRVAMVVQRRMRLQVDLAVAHAELVGLVDDTHAGADADHREQVGHVGVVHAEAAMAGAGADAELLVRTMDQVARHTQGQLVRSQRIVRARRHHGRQRIAIGGVLGADRGRRIPGRVLGLGGDAGVRDRRTPALAADAQRIGVHHVLPFRVVVQAVLGQVDHHAFARARRQHEAGRDDHLGADARQPGIDAGVGGDHFAVAQVVLLAEVGESVLVLGLDHLDLADDVLARRRELQFQGRCGAGRKQRGERQ

SEQ ID NO: 26174 - protein, 230 aa, Pseudomonas aeruginosa
GCATLAESGIPGKSQSSGFSVGQTFSRSLRVGGERRMDAIRLHHPLDPADPFEEKRHQGGLFLRRDRAVDLGKGLDVARAVVRRQLDTQQQHLRPFRPGLLRHAGKILLQLRRRHSAQPVVASQLDHHQRRLLLGKQRRQARQATRGGVAADRGVHHPVVVTFVGEALLQQGDPALAGIQSQSGADTIAHDQQRLRRGLLGQQDQGQAAAQQQCTHRNLHERQHSQRAEP

SEQ ID NO: 26175 - protein, 932 aa, Pseudomonas aeruginosa
ASRPRPTPGPLSAPALRRRAATGRHCPCLRGAAGRAVRRRTHRQPRQRHRRADQRPALRTQPRTRYHPGPGYPRRASGASLPAPDPSGKRSPDRPGRTLMKPVPLSRLLSLAGRQLFRESRSGELRVLFFALLIAVASSTAIGYFSARLNGAMLARAAEFLGADLVLNGTQPASAEQIERGTRLGLRHADSVEFSSVIATDQGIQLSSIKAVGDRYPLRGQLKSAAAPFAAEQAGGRPQAGEVWVESRLLVSLDLKVGDSIEIGRKPLRIARILTYEPDRAGDLYSLTPRAMMSLADLDATGVVQPGSRVRYRDLWEGPPEALQAYRQQVKGSLAANQRLQDARDGNRQVGDALGRAERYLNLASLAAVLLAGVAVALSAARFAARRYDASALLRCLGLSRSETLLLYALQLLLLGLLASAIGALLGWLAQLGLFRLLATLLPPDVPAGGLFPAFAGVATGLVSLAGFALPPLAALGRVPPLRVLRSDLLPVPMRTWMAYACALLALGLIMWRLSLDLKLTLALLGGGLVATLVLGALLLLGLNGLRRALARASLPWRLGLGQLLRHPLAAAGQSLAFGLILLAMALIALLRGELLDTWQAQLPPDAPNHFALNILPTEKDAFERRVQKLSPGAEPLFPMVPGRLVAVNGKPVQALDEDVRSERALQRDLGLTWSERLPSGNQLTAGRWWSAPQPGALPGVSVEEKLAANLRIQVGDRLTFSVAGQNREVQVQSLRKVKWDNFQPNFFMVFQPGTLTDLPVTYLTSFYLPASQERDLIELARAFPTVTLLPVDALLSQLRSILDQVTLAVEYVLVFVLAAGFVVLFAGLQATLDERVRQGALLRALGAERELLQRTRRVEFALLGAVSGLLAALGCEAVSLLLYRLVFDLPWQAHPWLLALPLVGAVLVGGAGLLGTRRALNSSPLRVLREG

SEQ ID NO: 26176 - protein, 185 aa, Pseudomonas aeruginosa
SDTLAGFHPFICGTTRTMSRYRPPRTAGTPLITPEGAARLRAELHELWHVRRPQVTQAVSEAAALGDRSENAEYIYGKKMLREIDSRVRFLRKRLENLKVVGERPADPNRVYFGAWVTLEDEDGEQARYRIVGPDELDLRNNQISIDSPLARALVGKELDAEVLVRTPAGEKLWFVVEIEYPPAP

SEQ ID NO: 26177 - protein, 362 aa, Pseudomonas aeruginosa
RTPACRTPAGASAPALSRKPPRVKKILLLIPLAFAASLAWFVWLEPSPAPETAPPASPQAGADRAPPAASAGEAVPAPQVMPAKVAPLPTSFRGTSVDGSFSVDASGNLLITRDIRNLFDYFLSAVGEEPLQQSLDRLRAYIAAELQEPARGQALALMQQYIDYKKELVLLERDLPRLADLDALRQREAAVKALRARIFSNEAHVAFFADEETYNQFTLERLAIRQDGKLSAEEKAAAIDRLRASLPEDQQESVLPQLQSELQQQTAALQAAGAGPEAIRQMRQQLVGAEATTRLEQLDRQRSAWKGRLDDYFAEKSRIEGNTGLSEADRRAAVERLAEERFSEQERLRLGALEQMRQAEQR

SEQ ID NO: 26178 - protein, 537 aa, Pseudomonas aeruginosa
KTRYQYRIYRLFLSRRRLRTHPGLQANPFAFICKVVLVDAADITHHTHAYLFRSHPLDLEEPAIRIEPPATRLGAQVLYPLRPHVVGRQGERQALAFVEVLAGEELLADLGQVATGGQHVAVLVVHIADPDAARRRRGDLHQPAGAAGTARLRVQMRLLVGHRRQRQPVHAALPRVALQQWTDRFQALAVRRAEGVADLVGAPVDALESHVLVGRRAGIGEEAVDGRAQGAGIAAHVPGHVGAIVQHQVAVDAQLRQHLGPAFGDGLLDHGEAEDACLDHFHHILDGQGSVQLFDPDRCHAALRQALVDQFDGALGGAAGRQRDGPPGQLLQARVAPVALARHQHQRHIGAHRRARADLQAVVRRQQFAGGDQVAFATLQGGKQLVLGLGYELEGEVPRGRRTAVEVLLEGAQATVLDADRLALHLARAVAALVDQHLEHASAADARQVAGLRLFPVPVVRLAGDARSRRQGCEHQQAKRKQQQTRHPGLQRPGSMSLSGGPDQSEHGSLGKFLSDSGCKRRHWVDNPGAEEPDLRL

SEQ ID NO: 26179 - protein, 298 aa, Pseudomonas aeruginosa
RIVLQAVCHPSPGGSGAIEGAPPRCEFQEGTMQLIDIGVNLTHASFAPEREALLARARAAGVVQMVITGTSLADSEQALQLCGELDEGGRLFTTAGVHPHEASHWNADTARGLRALFDDPRVRAVGECGLDFNRDFSPRPAQEKALEEQLALAVELQRPVFLHERDASERLLAILRDFRDRLPAAVVHCFTGERRALYGYLDLDLHIGITGWINDERRGTHLHDLVGEIPVGRLMLESDAPYLLPRSLRPKPKNGRNEPAYLVEVLDCVARHRGESAERLAAHTSAAARAFFGLPTID

SEQ ID NO: 26180 - protein, 504 aa, Pseudomonas aeruginosa
WRLAISLPIRRNPPMGTWISDIPLKYKFWAVNAVAFFTTLLLVLFAMQQEAAGRNASAQRAAAAEGELVQSWPAGSALPARSNLLPLEQAASLGGTAAQALGKGQGWIELSGARQGDTPLLGAWVGQTGSGQRFAVLAPASDLWQVFADRAGAYAVAVLVLMLALLAASQLLIRFILTHLHTLKDVMLHVEKSGDLSARVPLQGRDEVGQMASAFNAMQAGYQRIVGTVAAAATKLDEGAQALARSMGQVRQGMLGQQSETDQTATAINEMSTTVFHIAQHAADTRDQSQEADRLAGAGQQAVSRVSASIAGLSQGVQDTAEMIQKLAEDSQKISGVVNVIHGIAEQTNLLALNAAIEAARAGEMGRGFAVVADEVRNLARRVQDSTDEITQMILALQSGTRDAVEFMQESSLKADGCVSQAGDAGEALAAIANAVAQMRESNTQIAVAAEQQSQVAEEMTRSVVGIRDVTELTVQQTVESAATSQQLVDLAGDLTRAIGQLRL

SEQ ID NO: 26181 - protein, 227 aa, Pseudomonas aeruginosa
VSNGHDCAAARSDKAAPATPDHGAVARPGAADGADRRGCAVAGGAPGPATGPAEPAQRAVADLLAARRTGSHAGRRAAHRERRRPSRRPGDPSRSPRQPDRAAAPPVVVQASRRTASGGTGHPATPDRAQRSLVEPGPLGRSRRRAPPGRGDRPAGSALARTDPPDRRRQQHRPDQPVGRRPQAPAPGVLRVVLGAARDRCRRCPAGAAPGHRLQTRTATGRASDRA

SEQ ID NO: 26182 - protein, 582 aa, Pseudomonas aeruginosa
RHPGETRRRAHPPAQRRQGAAAFHPRGQPERRGPAQRLRRQHPLRQPTPAQAPGLPGPGRLQPAPAVRQHQRIQPPAERPGGARPGGWLGSPAMRGNALLGGDLRAPPGNRRRAGDPDLVLRHQPAQGHGAGTAPAGQHRYPDRPAQPPLVPAPGGTHAQGRRTLPPPLRGADAGHRPLQEHQRQPRPPDRRPRPATCRRDPAPGPARGGPARSPGRRGIRRAASRGQPGPGAGRRRTAARRRRGATGEQSRRRTAADDREHRRRPAQGRRGRPGKPAGARRQRALPGQERRAQPHRVRARLTCASAEHRDHLPADRQQLAVGAPHPRRHVTVAVARLLDLRQVTAPVAAALLRQRLEELGGPGQRAGHRRGAQVRQQRRRPGVEQRQQVGNLHGLSLGFVAETHPAAHLARLVRRERQAAHCPAHGDVASELRGHVTDIGQLLALFGALHPGRRQRFHRHRRRAGDAETGLDQRHHLLALTDLDLYLAHRLALAQQPGAEARRLLGGQRSDEADADGAQRTPRLDHRKHGLVGQRHHQATEGGAALAPTGRYYHRGRVAADRLDQFGKIHVCLARGFEGPS

SEQ ID NO: 26183 - protein, 204 aa, Pseudomonas aeruginosa
PDSSTGRRTASASRSPSAASAGSSTSRSRIGPLSHPTSAAACSSSSTPGTPRIGRSRLRRRRRAMRRSCSASPSVRASRRATADINATCWPITSASSSSMNPVMPAPLPGHPAWARAPGARAAPGAMRADATLDHRHRHVHSVALRTRRRRPRWLAPAPAGRGRRARRRSVALRRGNGAGHASPAGVRSGAVGGCADRHGLARA

SEQ ID NO: 26184 - protein, 417 aa, Pseudomonas aeruginosa
PRRADSRHACGRPAPARPRNRATWPRSTAAGRPGAAGSPVPAPPAARPARPAESRSSRRSEQRQRTQAGLALGLAAGRLQACAGQRQAIGLLPRGEFQDCMAQAAQATFEIPAEALEFQPQVFPTERGEVLHQQPLATGKRLPMQAPPRVARLVGAQSLVVVDARACQRAPLVLGILRARREEWLAGQRPRVDQRLLAQVDPAPGHQQAEGKATLHPQAPRPQPAASLGRVEQQHLGSRVACQVGVFQRPLRPADGDGLARPPRAFQAHPETGALAGEHRVRSQRGEAQAGKVAIGMEDGHHAQGQQQEGQPVGQAVLVVDRRQQHHQQRQAESAALAGRQDEYATLVQLDAARRRYPPVQPALPARPVAQAHQSAGTSRNSHCTSAPPPCPVGSAWSRRRCPATAGNTAWTSSGIT

SEQ ID NO: 26185 - protein, 288 aa, Pseudomonas aeruginosa
VSDSARVTRGSEPPASSAATRRRRSDAPRTSSTRPSRVRPASVSCGWRPLRSKSSRPRSISSRAMASLTVDWLLPSLRAAALKEPRETAWTKASRDSGDKCISVFPIVSNLTLSQRPMTIQPDFNDEPGAFAMTHTHTALDKTLKERIFHALAFEGLAVLLTAPVLSLVMNKPLAHMGALTLMFSTVAMLWNMLFNSLFDRAQRRMGFQRTLQVRVLHAMLFELGLIVVLVPLAAWWLSIGLVEAFLLDMGLILFFLPYTMAFNWSYDVLRARLVESRQAKAAGCDAG

SEQ ID NO: 26186 - protein, 480 aa, Pseudomonas aeruginosa
WRRNCMARLRRMRSSSSTKRMRTGDGLMSGAPFQFAGLLSRQADEEAGSAARFGGHADGPAMLLDDLVADRQAEPGALPHRLGGEERVEDPAEDLGGHALAVVLHGEEHLALVGPALQQDAAETLHGLRGVGQQVQQHLVDLRRRAGDKRQLAELAADLGLVLDGGAGDQHGVAHAVVEVDLLAEGAVQAGEVLEPGNQLADLAEAVAGIDEQLPQVLAQLFDGGFAAHRVGRLQRLRQARFVALRVAQAVDQRRLGIGQAQQGIAQLLQQRQVVADVAERRVQLVCDPGHHLPERSHLFRLHQLRLGLLEVHQRLAQHPVALGDARLHGLQQVEHGAQATVAALFVDQGEVLGDRILQATGDLLRRLFQAGAEGDAEGRPVHDVAHRMAAPEVAAETLHEDVLEGVAADQAEDPALVVDHRQREEGTVLRHQQAVGDVADAHRRSQGFHRAQQTGQRARRHRQPLAGRPGRGNEGIPAS

SEQ ID NO: 26187 - protein, 687 aa, Pseudomonas aeruginosa
SSNAEYPFSGSSAARCRSSARPAAPYLPTGLGIAPQVLVGIHEMYACEDDRASAWVTAENGFVSAPFSTKRLLGNVAPHFRRHGSRTMQKTVRIGCASAFWGDTCTAAAQLVRGAPLDYLVFDYLAEITMSIMAGARLKQPDAGYATDFVEVLAPLLGEIAEKKIRVISNAGGINPQACAAALAAACEKAGVQLKIAVLHGDNLQARQAELAKAGIREMFSDAPFPPMCVSLNAYLGAPGIVEALRLGADIVITGRVVDSAVVSAALVHEFGWAWDDYDRLAQAALAGHIVECGAQCTGGNFTDWEQVPDYEHIGFPIVEVEADGRFVVTKAPGTGGLVSELSVGEQMLYEIGDPRAYLLPDVVCDFTEVRLRQVGPDRVAVEGARGLPPTDRYKVSATYPDGFRCTASCLIAGIDALKKAERVSQAIIARTEEIFAERGWEPYREVNVELLGSEATYGPHGRRQDSREVVVKLAVRHPRKEALVLFSREIAQAATGMAPGLTGIVGGRPTVYPVIRLFSFLIDKAQCALSVEIDGQRHPLELPVLEAFDPARLAEARQPPRPVQPASASVPLVKLAVARSGDKGNHSNIGVMARRPEYLPWIAEALEEGAVVDWMQHVLDPQTGRVGRWYLPGSHSLNFLLENALGGGGVASLRIDPQGKAFAQQLLEFPVAVPQALADALETQGR

SEQ ID NO: 26188 - protein, 315 aa, Pseudomonas aeruginosa
PQPGTANAAFRCPSTGFIGVTRTMSYDSIFRPGLFDGQTIIVTGGGSGIGRCTAHELAALGAHVVLVGRKAEKLEKTAGEIVEDGGSVSWHACDIREEEAVKTLVANILAERGTIHHLVNNAGGQYPSPLASISQKGFETVLRTNLVGGFLVAREVFNQSMSKTGGSIVNMLADMWGGMPGMGHSGAARSGMENFTRTAAVEWGHAGVRVNAVAPGWIASSGMDTYEGAFKAVIPTLREHVPLKRIGSESEVAAAIVFLLSPGAAFVSGNTIRIDGAASQGSRAFPLFKGKPGQSRAYNGFHRAYLPDVLKDQED

SEQ ID NO: 26189 - protein, 683 aa, Pseudomonas aeruginosa
TAVPGGGAARGGSGRPEEALRRPRDRRAHRRRLRVPRLQERVRRPDRLRPPAHRGPRLRPDRQQRTDHPAGRGQGGAVHPALRTEQHAAAVPAQHHRLHGRHRVGAPGRDQARLEDDPGGGQRPRAQADPGGRRLLRRRQLRDVRTRPRPALHLRLAEQSHRGDGRCPGRQGAAHRHRGETRQGRQGSRSEDARDAGNRHRAEARQPVHRALRHRQPVGRRPGRPARQPQAARLPAGYLRGSRGAAAEGQQLRGREVLTATGEPATAPLPALPEGRGLGESKRILPENNDAQEERQPMIFTQEHEELRRTVRSFVEREINPNVDQWEKDGRFPIHEIFRKAGELGLLGISKPEKFGGMGLDYSYSIVAAEEFGSITCGGIPMAIGVQTDMCTPALARFGSDELREEFLRPAIAGEMVGCIGVSEVGAGSDVAGLKTTARKDGDDYVINGSKMWITNSPSADFMCLLANTSDDKPHVNKSLIVVPMKTPGITLSPHLDKLGMRSSETAQVFFDNVRVPQRNRIGAEGAGFMMQMLQFQEERLFGAANMIKGLEHCIDVTIEYCKERRTFGQPLIDNQVIHFRMAEMMTEVEALRALVYQATELYVKGRDVTRLASMAKLKAGRLGREVSDACLQYWGGMGFMWDNPVSRAYRDTRLVSIGGGADEIMLGIICKLMGILPGKKKG

SEQ ID NO: 26190 - protein, 183 aa, Pseudomonas aeruginosa
PRPAAWPSPPPASTAARRCAWAWCISARPTPMPSNSAWRKPSSNCAAARRTPTPPPRPCCWPAKAANSAPCWTMRRDSSPKRWAAPKAVKAPWPSYRNASRSGPSEPRPRNRATASRSRTTCPASTRSSSPTAVKSPAGCCAPPMNWATAALPCTARRTPTPAMCNWPTRPCASARQRWRSPT

SEQ ID NO: 26191 - protein, 289 aa, Pseudomonas aeruginosa
PREEPVPGLGAGARGTPVPGQPGGARRPSADQLRPVQRLGQSPGARLQGRGRRPRQRGRGDAGKPRRAAGDPRRPGQARRHRRTGQHHPARQGPGAQPEPGEARPLRGRRRVARGVRGSPPGGARQRRPLLLGRRRRHPRRSRLAADGLAQPDAPGPGTDLGEPRGHRQGAAQGLLLLHLHLRHHRPAESLDHEPRQVDQGLRRLRPFRPGPGPRRRALPDPALLPQQRRDRLLERGARRRRGHGPAPQVLRQRFLEGRATLPGDLLRLHRRALPLPAEPATVRRGTRQ

SEQ ID NO: 26192 - protein, 208 aa, Pseudomonas aeruginosa
SNWPLRRKSLSSFSSNIGGNSGLGLWVSSVPGGAIFCTSSFGRRRSSLALGSGLRTSGSRRAVEARFAGAGLSLATGLLAGFGGAAAGFGLAGGLGSATCSAAGATFFEAVFGAAGTAGAGSARAGFTGLAGARCSCGGASGAFFSGALEPSSQAARKQPKRTTTQIRQRRFIVTQVWPIAAMLTADCNQGKGSLSSSWHSLCCSPHV

SEQ ID NO: 26193 - protein, 169 aa, Pseudomonas aeruginosa
LASKAGGSDISPDSGAGAAGARMARFAAAAPATPSRRGTSLNATSGRAWRSASSSTFWLTSPSTSATPSRLAKAACQRGLREASSQRRHQDRAGSTCAAWRRAAARIAWSSAGAGCCGAWARKCASICSSATLAECFCGFIPPPPRPAAGAASAPRSGNGSSPSPAATG

SEQ ID NO: 26194 - protein, 348 aa, Pseudomonas aeruginosa
QRNPAPPGSPGEKSPGPFGVPGLPAAARDSARRAELALVVGEDDLHPAVLRPPPVGGVVGDREGFAVADHLHARGIHAEIGEHVGHRLGALARQVEVGLPVADAVGIAFDADHPPRIELEELHQLQRGAVGRRLEFGAVEVEQHVAKGEHQATLGFLGAETGDLLAQALALLLHAEQLGFAQGQLQALALQLQAGQALLVEVEQGVLASDLAVALAQVGILDHVAAAAPVAGQAFGAGQRFAGADHILGRRAEHVGIFLDLVELALRLGQRLFAELVVGAASQRGAGQQGGEESRFARHQSVSPSCLRRRFRLLSSSPSWSLLFCVSTLDSARRASSSACSANRRAFL

SEQ ID NO: 26195 - protein, 179 aa, Pseudomonas aeruginosa
TGTRRPCSPRPPRWSSGTADAHSPCCRAVPGSGKPRRAGRRDRWSPLPGPSPRSRCRARRCARRAPCPGAATGRHWLRSGASDPAGRATGRGGTPGCRWPPGARRSRPPRPAPERTAPPAGCRPGGTGNSERTWIQAPRYRDARSSLPHFRARSRPAIPMGTSAACRPRLRRRRAGSCG

SEQ ID NO: 26196 - protein, 137 aa, Pseudomonas aeruginosa
GCRTATARRNRGPEAPPPWPRWPGPPRRQGRSAARPRPRPARQRHAGLPAPRRPWRTRRGRRTIPAPPPCPSPPVRRHAGRAAIPRGCRCHAAPVRRGRVRPCRRRSGNRGCPRPRPVPAAPQAPSARRSRAPGRSL

SEQ ID NO: 26197 - protein, 170 aa, Pseudomonas aeruginosa
VGRDAGRCGPSPRARRPPPAGRRPARRRARPGAGAQRDRPAAGSAAVRRAHRRRPAGADRPSARCRPASRRAPPRPGRHRPAPGAPRPPPRRQVRAPPARSADGSAVPRPAAHAPRASRESPALPPGRAANGPRRASRRHPRRAPAGHRANRQRSACPAPGRPGHNRRAG

SEQ ID NO: 26198 - protein, 199 aa, Pseudomonas aeruginosa
RLSAWSRSNSRAASGRTSSDRCGSSPAAGLSIRLRTSSAPARDPCRGPRPASSRRRTSRSSSPRRTPRNCRLERLVASITPLAQSRAAAATARAWAASRRPASSLMRQMPPSSAWTIRSRPGQGDGRGTGRGAGVWSSFKNATRIGVAATAPLSPRDRPRHRYTPPDVGTRDWFRRQVSWLAARRSTRGRNLRFAPPSR

SEQ ID NO: 26199 - protein, 153 aa, Pseudomonas aeruginosa
PWWASARTVIPASASRPGVPCCKPAGSSARRASWNCCRRASAPPAKPGRRRSPWNHCWPGAASRPACWPAATRCCSASAPVSPGNCRRPNCGSCRRPPPSRWPPPASAGPCRRSPACRWWRARWRRCRHRSTTAGACWSSATTATARPPSPAC

SEQ ID NO: 26200 - protein, 153 aa, Pseudomonas aeruginosa
DSRLVKSGWRSPPRRCCQSSSTRSLCRVTALANRRPPGRRRSQQVSSTPSAVTPPPMKMASGSGSSSSASGALPATRCRVGTPRASRLWRICSWRSSLASMAIARQLGCARIHSMPMEPQPAPTSQSSSPGQGARRARVTARTSRLVNWPSWR

SEQ ID NO: 26201 - protein, 209 aa, Pseudomonas aeruginosa
ASSARPGVSGRRTAPAPARHSTATRLRSAARGSDQSPARPSRRRSSGPPRCSSTLRRLAPKPRAFNRRAMAAGLSPSLLRTSRRRPSWTCACSAASGRATSDRQATSCRAQPRRAAASEREEGAGRTRSSVAGSCRARLAPTPNSIGSPLASTQVGWPRRASNGSRENGVGQVSRAAPMHGGSSSSWRAAPTIRLACSRARRACLPRPG

SEQ ID NO: 26202 - protein, 206 aa, Pseudomonas aeruginosa
LHPRWPGDLSPVVRHHPRRSEPRRHPGRPGKARGQGDPRLRHGRRGRRPALLARRRRRRPRRAGRRRGDPLRRADGRRRRDPLAAARRQPGDLHPQRSGRAGARHGTRQYPLGGGPLEHWREHLEGSVVVIGNAPTALFYLLEMLDAGAPKPALILGFPVGFVGAAESKEMLAADSRGVPYVIVRGRRGGSAMAAAAVNALATERE

SEQ ID NO: 26203 - protein, 572 aa, Pseudomonas aeruginosa
SSSPATSGREGPAVSDAQQVPAIVILGQGALDTARRVQARYPGALVHGLAGRVEADRSYTDFGDTLRELYCADRPIVALCAAGIVIRSLAPLLQRKGAEPPVLALAEDGSAVVPLLGGLAGVNRLAREIGEVLAVAPAITTSGELRFGTCVLNPPAGYVLADLEQGKRFVADLLGGQPVRVEGAADWLDAARLPRDPEAALAIHVTPSARAPRAEELLIHPRCVLAALEPADAAADAVRQALVDAGLAAAALGGLLADSARMADPRLQAAADALGVPLRFLPQADPAARLRQALPAAEQVGDRLAVAAAPLAMDRIGQRRGRLTVIGLGPGCAELMVPAARRALDEAEDILGYQTYVDMAGPFRAGQVLHGSDNREELQRARHAFELAATGRAVVLVSSGDPGVFAMAAAVLEALHGAGEPAWDAVELRIFPGVSAALATAARAGAPLGHDFCVLSLSDNLKPWEVIERRLDLAGAADLAMAFYNPISRARPWQLGRALEIVARHRSPQTLVVLGRDIGRPGERLLRTTLGELRAEQVDMRTLVIIGSSTTRSFPRADGEAWVYTPRWYPSE

SEQ ID NO: 26204 - protein, 305 aa, Pseudomonas aeruginosa
RGGSARGNVADCCAHPCTAEPESMSFRCSPCRLAGILLAALFVPGLAAAAGSCERLVATGNPEYPPYLWRDPQDPKRLIGANADLLQRLGKELGVRIDVLYSGSWEKAQEEVTSGRADLLAGAYLTLARLGSMDYVHPPFLMTSGVVWVNKDAAFPFIGRDDLIGHKGSVLAGSSLGEEFDRFAKASLDLKPVPSLTQGLQDLMLKRSEFLLYQALPGQAQVEALGMADDLEALEPVLSSEGLYLTLSHNSACNDPWLRGQLAKKMTELSAAGVPVTLLQDNLERWKAQQLPASGASSTTQESDL

SEQ ID NO: 26205 - protein, 158 aa, Pseudomonas aeruginosa
TGSTNSPDRVRNISTASCGTILASPREPSRRSRGIRMIRQPRFARFVLPLLLSLCQPSFAAELRAVAEARRQELLLEDSPVACGEAGCTARESLSLVALQVQARVLVTRLGRDDFSPAARQPAAVPDYRLFGDLGLAPSPFAWQALTGESAAADALRF

SEQ ID NO: 26206 - protein, 281 aa, Pseudomonas aeruginosa
PESTDSFVSAGISAARRGRLDVFPGFHPDRHFRRTVRRWKMSTDSRSGRASGDGPGVSWRRRCVPRRMWPMSLLSVAFDTGQESTSGMHASTSATTAAGSDETLLARYRKGDSAAFEVLYQRHRQGLYRFLCGLAGQTELADEIYQETWLSLIRSESQPQGRASFRTWLYQIARNRLIDHWRKHGQRQPLQDSYDEQLHAQPDQGAGPEQQLSLSRDGERLQSALETLPEEQREVFLMRAHGELELAEIATLTQSPLETVKSRFRYAVQKLRRLLAEEVAV

SEQ ID NO: 26207 - protein, 781 aa, Pseudomonas aeruginosa
SLHERSQRLPCLPRRKQLRRRSRQPRSRLPNPSRRPSRSLRLRRRSRPAGRSPRTSRRRRSALPPLVSTPRYASRCRAPSWTCACRRNWCRRWRRPARKRPISPSRCCRRCSRKRTTATSASTASCSIATANWACRGPWKGPSCSSSSASRPPRCSEAVALLLQRLVQLRVQRLVAGAAGQPDEEFVADPRGIVGVALEVGLLVLEGAGGLDFAQQAQEHRCGIGRQLAVEVRGESVAVQFDAIGQAQRGHPAAAVGAGNLHAVDHRILDPVEGAEGVFHLGGGNVLALPAEGVAETVDELGVLETDVAHQVAGVEPGVALLEHVAEDHRFALGRIGVAVERPLRTDLADQQADLALADLLHEALGVAHRMVVLQVVADDGVGGWGEAHRIVEIEYIGEADVAFAGSVELGDPLDLEALLELGPDRRAQAVADHAGQAIAAFLGARWLVQQVAAELADVAEAGRPVVLHVLPETAGGELAAQGHGRAAGERRAPADGHGVVVVTGQGQVEHVVAAQAQAGMAEAAVGLDPLAVAHDRGFRQAGGAGGVDVEAGVLEPHPAGVLEVLRGLSLGQAHQVAPAHRRRAGIAEGVAVVDPVAMAGVAEHLLADFLEHLAQLFADHEVAGLHQVQAVHQDLAALGGVDQCADGAELGQGGEDRQQLDAVFQHHRDHAAVAYALGLEGARQAIGPAVEQGVADPPMAVEHRRVVRVQACRALQRPAQGQALLAVTDRGVVQAAQHARHAAEGGRQAGNETVESDQVGVGHGSRASRCCAGRRTLPRL

SEQ ID NO: 26208 - protein, 341 aa, Pseudomonas aeruginosa
GRAAWLQTSTARVLIWYIRSKRLGSSFSTPTRRIAPALLTSASIPPKRSAARAMAAATACSSRTSSCSGRAWPPAASTSAATLKMVPSSFGCGSALFAAITRLAPSRAARRAISRPMPRLAPVMNRVLPCSDMGVSVFLSLSLRMSGGVSQASASTSTSTCRLRTCSPRPTWTRRTTPSTPAFSGCSIFIASSTSSSWPLPTRSPSPTSTSTMAPSIGALSVPELAPTWALAPAWVTSTSSRLPPWPYTQRRPPSTWYAWRRRMPSSSALAQRPSQSSRRTAISRRSRRASSRGRRPLSRTSRPISTRCSACFRTIFHGAPAALRQPARPGWCALASAPAW

SEQ ID NO: 26209 - protein, 223 aa, Pseudomonas aeruginosa
PSSWAVRSTRQAISPRLATRILLKLGMSFGSWRLLPCFAVVAHWAQTGLRFCTKARVPSLPSAPPTASANCRAASSSRAPSSPLSLASSRALVAALAFGAQRRSCSRVSSRRCSRASASASQKCTRPRRSASRPSKRAAVRARRRAWVRPMRRTTKGAICAGRMPRLVSGRPNCASAAAIATSDTQARPKPPPSTAPSTSATSSCGAAWASSSRLPKARFSVR

SEQ ID NO: 26210 - protein, 608 aa, Pseudomonas aeruginosa
RSWVVFPPGHHCFPAGSACSLPTLFLQGERGEGLSPARLLQSEPRDPEAVALQRPRLGFRADIQQVAEQPAAVARVDQAVVPQAGGAVERGGLAVELLRGDGFQHLEHLRIGFLAFLGVFLLGDDAQHLAGLGTAHHRGATVRPGEDEARVEAASAHRVVAGAVGAADHQGQLGHAGVGHRLDHLRAVLDHALALRLGADHEAGGVVQEQQRRVALFAELDELRRLGRALRGDRSVVADQAAGVALDAQVAADGLAVELVLEVEELGAVGDARDDLADVVGLLRVGRNHPEQLLHRVQRFTPGTRRARRQLCVPRQHADDLAGQAHAVGVVFRQVFRGAGDLRVQFGSAELLVAGDLAGGGLEQRRPGEEHLGLAAHHHHVVRQPRLVGTAGGAGTMHHGDLGNAHGGDPRLVGEAARTFDEDLRRVVEVGATAFGEGHHRQLVLHGDLLQAQGLLQPGRGDGAALDRAVAGTDQAAHPGDVADPGDDPAAGLGAVLVVVQLVAGQRGQFEERRARVEQQRQAFARQQLAAFLELRPGLGGLVQDLLLQLAEAGHGGEHGLAVAGEVLAVDVEFRLDRGHVSPPGPSVRRAGRRGGSRCTRGSVPACP

SEQ ID NO: 26211 - protein, 133 aa, Pseudomonas aeruginosa
SRPGSRTPGSPAARRAPTGRPRCRCRPRRPRRSRCVRSFALFLTRDGGSVGRHYQASAWLRRGQKQIRSRLLPKRLLGRLRRHTFHECRQALAGQSRGRSANTERPGARMSGTEPPTIRKRGTQRWTIRKPGK

SEQ ID NO: 26212 - protein, 464 aa, Pseudomonas aeruginosa
CLSHVGNLTLLNWRVSLHCPVRACQREVADVSERVVPSVAPGGTPDSGDEHQRRRRPPADAGAPCLPLAAGGRRRAPGPRPGQPLHPPGHLHAAFRPRPLGPPSGARRHEPGAPQRLPRRQPGRGGAAGHRSPAVSDHRGLRPGRRRGPLPWPGHRARPAEGHGGAHRPAQPGAAQGAGGPQGVPGATGAVGKDGFARADGGRGRTRAEHAARLRRQQPGAAGGAERSLVAPGRCPGGAGRLPGRPAVRRSAPGAGAAGGRRGAPRSRRRTVARGPAAIVRRYPLRPRPDRRAGFRAQGLRPPGPRLQRGGRPQRLRAQRRADRPHRHQGQGRDQQPARRAAAYRLRAVADQPGAAEPADQRRAGHGAFRPHPAEELGRRAPGVPLRAGQRQGHARRGPRPDLRPVLHHQAGGAGHRARPVDQLQDHPATWRDHPRGLRTGPRNPLPHQPAARAGPRTETERLT

SEQ ID NO: 26213 - protein, 310 aa, Pseudomonas aeruginosa
  UNSURE (239): Identity of amino acid at the above locations are unknown.
TVQPSRIERRGLPMDRLDSMRVFLRVAETGSFTKAADLLDMPRATVSAAVQQLEAQLGSRLLHRTTRQVQLTHDGSVVLERCRHLLEDMEELESLFHDGSRASGRLKVDVPSRVARLLIAPALPEFFRQHPDIELELGSSDRSVDLVQEGVDCVLRVGQLGNSSLVARRLGEMQLINCASPAYLEEHGEPRTPADLDRHWAVKYASPSSGRVLPWEYREDGRTLTRALRSRVTVNNAEXYIACCLSGLGLIQIPAYDVREHLQRGELREVLPQWRAEAMPAYALYPHRRHLSRRVRAFVDWLEQLLRARL

SEQ ID NO: 26214 - protein, 264 aa, Pseudomonas aeruginosa
STTFISPARSGLRQTAGFCDNARRFRFAAREPMSACQSPIIVALDFPTREAALALADQLDPKLCRVKVGKELFTSCAAGIVETLRGKGFEVFLDLKFHDIPNTTAMAVKAAAEMGVWMVNVHCSGGLRMMAACRETLEAFSGPRPLLIGVTVLTSMEREDLAGIGLDIEPQEQVLRLAALAQKAGMDGLVCSAQEAPALKAAHPGLQLVTPGIRPAGSAQDDQRRILTPRQALDAGSDYLVIGRPISQAADPAKALAAIVAELG

SEQ ID NO: 26215 - protein, 98 aa, Pseudomonas aeruginosa
CACRWVTPGARRNARCCSAKPGAICCRAWNPCSTTRRWPLSRPKCRRSAPAMRWWTTCCAWSKRPARSRPSPSACRRAVAWRCSPRRVPGRCWRDATM

SEQ ID NO: 26216 - protein, 1027 aa, Pseudomonas aeruginosa
FRKTSRRCCRRSPGIACATRRTPPGTVAARWCNGCCAKSRRSDAPAQLAALAALAEPADTAGEQRRAEPASRIHPADPPGRRFRPGAAGDAAGGDQLPEQPGLRVDLPAAVPGRGDHPPYLSQPCRPAPHRVGSGPGVRRRARRFPGAPGKPAAGAPGHRRRLAGAAAGIRRPGRRRGCRGAAVPPDRATRLAAAGAPAGGESLSPRPAGGLELGRPAPAGAGLPSAAGRRAIPRAGRGGCRGPGARAGKHGRRRLPGTARLPAGRLAAAPALEGVFPWPGAAGEGLRRARWGRPVAGIRAPRRGSRKSPGPLVPCSPGTLRAAAALWPGAARHTPATGQRRGPARGLPACAGVVRSGAMNAIPRVALVWLLVAQVLVILPHLAYLPLWIAAMWLGCAAWRVQVFRMRAGYPRAWVKLALALLAGAGVWLSRGSLVGLDAGAVLLIAAFILKLVEMKTRRDALVLVFLGFFAVVVGYLFDDGFLAALYSLLPVTALLAALIGLQQSAFASRPWPTLRLAGGLLLQALPLMLLLFLFFPRLGPLWSLPMPGNKGVTGLSESMAPGDIAELGRSAELAFRVRFEGAPPPREQLYWRALTMERFDGRRWAQAPQWSGEDAMHWQKRGPELRYDVIMQPSSQPWLFALDVAQTDQTDTRLMSDFHLQRRQPVEQRLFYRASSWPQALRESSIDPRMRWRNLQLPMHGNPRARALAEQLRQAHAQPQALVAALLQRFNREPFAYTLKPPATGADGVDDFLFDTRSGFCAHYAGAMAFVLRAAGIPARVVAGYQGGELNPAGNYLLVHQFDAHAWVEYWQPEQGWLSVDPTYQVAPERIEQGLEQALAGDSEYLADAPLSPLRYRGLPWLNDMRLAWDSLNYGWQRWVLAYQGEQQGAFLQRWFGGLDPTRLGLLLGAAAILSVGLLALFLLKPWQGRGDLRSRQLRRFERLLEMHGLRRSPGEGLRSYGERAARVLPAQAPAIAAFVGAFEAQRYGHGGADDPGLRLRALRRALPWRLVRAPTRDGRGEEQA

SEQ ID NO: 26217 - protein, 398 aa, Pseudomonas aeruginosa
CRRSPAWRRARMARHCTTCASPCAVCAACCGRSAESPASRSWSMPPPRSGGSAGRSATWRCCCRRSPPKGCGMRWRCAGRCWSPATWRFSPASRCTACSFAWTSGRPCCVRPSGMPCWMACTAGCASACAGNGRPCAPSWRTPPTSTGTRYGCGSSACATGWRPIRTIAAFPARCWRRSRRPSRRWAIGTTSNSGCCDASASRTWRPCARSGRHASNWPGSVPDGPCRHCSRHLPGTEAAGIPIGFFPRIASPKMGPRIPSRGTHEFFRIDPGGPPRPFLGGSTGQLGPGPRHLRWPGGGVGLRGHACGGRGGASVALHRRQLRRTAGPRAAGELQRPVVARGQGGEPGTGRGPSGRAGGDAGPGQFRRRPRVGGGGGSVAGGRDEGPRREPGAALYP

SEQ ID NO: 26218 - protein, 152 aa, Pseudomonas aeruginosa
RLDAGAQPFGDVQRLVQADLWKQRGEFLAAQATEQVHLAQALAQGLGDTLQGAVAGQVAVAVVDVLEVVDVQHQRHAGVAEAFGGLEHEFRLVQERVAVVQAGQGIGAGQQAQFLLHGLAPADVVAPDQGRRLAVDFQVARADHRPARRFPA

SEQ ID NO: 26219 - protein, 475 aa, Pseudomonas aeruginosa
LGFPAIHLAARLQGVLQAAVFAGAGEQPGQVEVVLGLATQALEQAWADVMDAGAAGAEQDHVARAGLEDEMQQRLAFAELAGALADAFLQGGVKLDQMPGQLLCAFEVGDQAQHQQGTAGTDPEQRPEQRVERPVQALAVDVQLVGQGDVAGDDDLVGRFEQGRNLLDDLRGQAARGDGIAPGGLVRPAIAELDQALQGGLYLRTRFGEMPEQRLAAQRRDQAGEDFETDRQVVGLAFAALGVPRGVQRAIQFGAQRVGLPQLVVQVRLGQLLGLAHRQPQRSPGDQRHQQHQAEQQPHDLALPAQLCRIEQRHSHVRYLLKSDGADLPDGTVVVDLVSQLRIAGHRVDDEKRSAFADRHVGAVAAIGEDGLVAVEVAVRDDRRVVVQRQHAQARGRRQVQVAQQQAEAHALPAGVGLAGELGFQGLAGQGFEVGQGQPYGSVAGPLQGDDRTSAQRHGLRGLGKRQPQATEKDD

SEQ ID NO: 26220 - protein, 137 aa, Pseudomonas aeruginosa
SGSAVARPPAAPASAPARRRRRRRHGRRRPATGRWPGRARRSAGRSRSGRPRRRAAGYRPGARRTTRSNPAPCPAPGQLCRPGSRPVPAAAGCCGRAGRCRLASSEPARPRRRRRAGRKRCARRLPAAWRTTPAAGW

SEQ ID NO: 26221 - protein, 540 aa, Pseudomonas aeruginosa
VAWCLPGIRSEAAPPRSRRTRREMGGKPLVEQSVIIADRVLRRPDYLPNASVCSRCRRGTCQDCHALIDPVPRRGTSSLASGDLDDASVAAFALPAGARTLAGGCAHHRPAGQLAQGTAGDPRPGEHPPRWRAQGAGQPEPQQLGRGEGRADRRRVPSPARLRAIPQQPFAVRAEPHPQAHTQAQGPVACRPAAWRRRPGRPRRTAAGARRPAGQPERAGARRCAAGAGGAQGQPALHAPGAVVRADHPAAGRQRRRGRHRTGQPAPGATPHGTDPDRKAGRFPGRRGCDGNGPGRHPRLHRGRAAHRRTLGQGAAEAARRPPPGAGQSRRHGLVRAPRCQHPARDHRPLPRRYPRAGRPGRGFPARLPARLQGPQPPRRGGPQAPGSGPSTAAALRAAEQHGLAGAGGGGLQGVASEPEGARFRRRQRADADHPGGGAQRRGRQCARQGQQRAGRQSLPDQDPQAVLLQQAPRRTRAPGVHPGGLQHGAGAGTEPAHPGASPGARSESLVLPGRAGGCGRDRHGCGELCQQRQQVLPCI

SEQ ID NO: 26222 - protein, 147 aa, Pseudomonas aeruginosa
GRTMNPLIKTILSTNAGAGLAILRIVTGLTLMSHGSQKLFGMFGGAGLNGMAQWFESIGLTPGYLLATLAGSAEFFGGLALVIGLLVRPASVVVGFTMIVAIFSVHIGNGFFITDNGYEYALTLLMISVALLIDGAGKFSLDGKLSR

SEQ ID NO: 26223 - protein, 179 aa, Pseudomonas aeruginosa
SGPGRAGRRRRPSRCASAPAAGRCAGPATAVPGPGLPAAGGRSRPAIPGRWRPRRRRGTGRRLVRPAAAAWRAGGTGRAVPTSRAGRRWRWRAGPAATVAARRGAGFRCATDRGSAAARWRRSAVQRNGRRTGPRRRRRAAPRPGWPGSGSARHGRGHRPPGGCRRGHPAGAGWRRGCP

SEQ ID NO: 26224 - protein, 305 aa, Pseudomonas aeruginosa
NSRWRCSRRPRSAGRRTARAARRCATRGTIGDRRGSAGGRGAPASSGFDPVDQATAFQTDQAPAAMRQTLVVGNQDQGGTAFAVEFEEQVADPLAGGAVEVAGGFVGEQHVRLRREGTGNGDPLLLAAGELARIVAQALAEADSLKQFSGALASVGAAFQFQGQHHVLQRIEAVEQLERLEHEAYMGRADARPLVLVEVAEGVPGETDLAAAGLVEPGEQAEQGRLAGAGAADDRQAVAAGEVEGEVVEDGQLAFRATDNLAKVLRVENAGAHGGSDACIAVERLPGPGPADPAGRGADAVGRGR

SEQ ID NO: 26225 - protein, 167 aa, Pseudomonas aeruginosa
YQRRFGTGYQPGLGRPVAEAPRRRRLRLPGGERLDQRRHLRGWPGAPAGAACRGEAGAGGDRAGRQRRAARNGAGAIATESCQHGAKGPGGRGEGAAAGYPVAAELRPALHRGLFQGLRRGRGAGKDRPGAVFPRRGRRGPGDDAGGWHPSGARRPPEGSWKMSGRR

SEQ ID NO: 26226 - protein, 336 aa, Pseudomonas aeruginosa
NLAGCYTVFPTPSSHSPRILRNVVARTRCLTVFRRAAFGRLRIGPGTAAPASGRGRRRPGPGDQGQVRGHFRRPRRAVQPGLQRNGRRQPRRRSLVAGRRHRGDHPDPLRAAAWPARRRGDQPGRVPPVLLPERAERGAHLSAGHRPRGLGFADREHPHHRQDQGPGLVSAGLDPRRARRRWRSAADRGAAGPGQSAGTVQADPGCAGLPDPWFEQEVRHRHPHQPWLLPHVQRRRDPPVLYDQRRHQRAYHQRALQVRREQRQGLPGGAYAAERPWRPVGGGQAHCGDQHHAQARRPGQAYPVELGRGPRSGGLGGWRAGGNRPGIGAGDDRDGG

SEQ ID NO: 26227 - protein, 199 aa, Pseudomonas aeruginosa
RCRRQDEAEEPADRRRYRDRVQGRRQAGADHPRSQGSDLLLLRRPAVRLHGQRVQPVRDRERRSGRRADLHRRRHDRHLRSRVLQRQGDLGRAADHHRSPDRLHRAGRPRRHLGQGDEDRAPEQRRRAAGFRVLRNRRLDRDRYPHRRVQVPRQGLILSCDEKKPGIRRAFSFPLSAAAARRVGSFRPTRSGVRRYCRG

SEQ ID NO: 26228 - protein, 258 aa, Pseudomonas aeruginosa
HGGVERGADMLDVFLDFLLGMVLGCLGGLFGIGGGLLAIPALGVIFGLDQQLAQGTALVMVVPNVVLALWRYHQRNRIDPRQAGVLALTGLLCAFLASSVAARIDAARMREAFVIFLLALAGYMFWRLFRRPPQGGATPRYGLPWMGVLGLGAGSLGGLFGVGGGVLATPVLTSVFGLAQVVAQGLALALAAPSTAVALGTYAMHGHVDWRMGIPLALGGLLSISWGVRLAHALPERSLRMAFCAFLALCAVLLLVRG

SEQ ID NO: 26229 - protein, 633 aa, Pseudomonas aeruginosa
APVPCSRPSTRWSGSGRGPSACSISAIAWRSTRRRKNACTATTCCHSCTTAVWSAASTSAPSGRASAWRYMRCMPRRTAWTMPPCTSWPSNCAAWPPGWAWRRWRSRGAGSWRYACAGCCSSERSRRAAGAAAARSAAHLLQGFGDQEGQLQRLVGVQPRVAVGVVAVAEAVFGDRSRTADALGDVLPGHLDVDAAGVAAFGLVHLEELADFGEHAGEVAGLVAAGGLDGIAVHRIGTPQHLAALALDGLDQARQVVADLVGTHPHDQVEAARIVVRVENIDQADQLLAVHARPDLDPDRIAHAAQHLDMSAVDLAGAVADPEHVRRAVVPLAGQAVAAGQGFLVVQQERFVGGEEACFAELRRAVQAAGAHEGEGLVDAVGELLVALGQRRVGDEIEVPAVHLVQVGEAALGEGAQQVEAGGGLVVGLQQALRVRHAALLVEADAVDDVAAIGGQGHAVLRFVAGGARLGELAGHAPDLHYRAAGGEGHYHRHLQQYLEGIADLRRGKFGEAFRAIPALEQEGASGGDFGELPAQLASLAGEDQRRVSGEGLLDPGQVRGIGVLGLLLDRLGPPALGAPGLAHLRLLAMLGKADCGMVEQLAAAPPAIVAIAEIHRRAGFAMLRCFCRSAWR

SEQ ID NO: 26230 - protein, 519 aa, Pseudomonas aeruginosa
VRRRCRAELRVHARSSLAGIRLHPRHAARRALPFATASRVVPRFRRRQPDPGLPAPPAAGGGRGHRAAPGDSAPGPRASGAARRPAPAIAHRRRTGEPGRMRGGRPDLPRPLYRYRPVGRAPGLEFPRCLPGAPRRGWLAGDQPVERHRWQAAGRAAAARALSPSLLGVSGGRGQRGDAGAGEPGPRTRPGSPADACRGAGAATRLFVAGLYRQPAPGPVARARGQGPGLASFEASRAAFLESAQAFLGVLAVEQAPGGFRQRSGGDRFAFQQGLARRAEGGAHAQRRLGRDPFGEGDGVVEEVLRGGDFLHQAETIGFVGVEFVAGEQPAHGVAPAGDLVHAQCRATEREDSALHFELGEARVAGAEVDVGRQHQFDADGVAVALHGHHQRLAWTPAAEGAPGIDGAFGEFPALAEGLADIGQVQPGGEMLAVGEEQGTAQLVVGLVFAERGDQVVEHRQVEGVALGHAVEAEQQQVAAPFAADASWEGVVHAAVSWRGAGNVGIDVWNRDVHCQSLR

SEQ ID NO: 26231 - protein, 699 aa, Pseudomonas aeruginosa
AAMGHGSLRMYTRQTHDSGNRRLRRARYSPQCARGNRRRRLRRAFAYPGSIDSADPRRPRHDRPGADRYRQDRRVRPAAAVAHRPEPPRAADAGAGADPRAGPAGRHRLRNLFQAIAGRRRGRRLRRRAHGAAAEGPAPGRTDPRRYPRPPVRPPAPRREAAGHRPAPGARRSRRDAQARLHGRPGSDLRGASRIAPDRALLGDPAGVHPWHRRAPPEAAQARQDRRQDPDRGAHRAGPPDGPCRPEGRFDPAPAGSRAVRRADRLRPHQAGHPRLRRITRAPGLPRRRAQRRHAAGPARAGHRVAEGRFAGHRHRHRRCRPGPGRTAHHPRAEHRHALRPRVLRAPHRPYRPCRPGRARAVAGDSARAAHAAGDRAGHRAEGRRSPPAGCRDRTGGPPGAPGREPDALARQRRRAARRGARRAVPSPRLRCRDPGRRIAGTPDRRQGAGPGVGAPRTAADPIGTARACRPWRTRRASGAQRRASSDGAAERRPCPLPHCPRRARRGCGEEPAGRDPQRGRPVPRGHRSHPDSRYLQPDRAARGQSRAPADQAQGHPRRRQGPAPAPLSRGLRSSAMNKSPASAGLFHGLDVCWPDCFSRLPRLLVSSPRASPFGKRPEGNKGLAQPPGQAPRRACQTCTYRGPDPPPIHDIADNAYGVIRATGLCRSRFPGCQPSPPSLRREADALRQSPEKPCQSKR

SEQ ID NO: 26232 - protein, 162 aa, Pseudomonas aeruginosa
RREEYSTNTSRTCSRWPGSSRNRLPSCSARAATKPGSRQTPSPAAAAAQAASGRLTLSASSRSSSVSPRSPTKAQPCGQDGAATFRQRCRSRSSGVRGTPCRARYSGAAQTTLNTWPRSRATRVESGKVRLRVISTSRPSSSRAGVPWASVRSTETSGWPSR

SEQ ID NO: 26233 - protein, 243 aa, Pseudomonas aeruginosa
QHRQVEVLAHPVRRQLAEAQAGTGAQAQAAGQHPAAVDPRDVAEGRHQRQRDELRKGHQQHHGYALQGAVAADLGEEFGRHAHARAEHHQHAGQGDQGEGQVAALQQLQAEERQRVAPFVDQEQPQQEAAAAQQQADQRRLEPVQAFALQQTDHQGADRREAGEQADAVELAEAFQAHRVLGDAMGHRGHRHQAQWNDLPEHPLPADVFEPERRQWQAQVRPEGRGEGIGAQAIELYPGWQEA

SEQ ID NO: 26234 - protein, 169 aa, Pseudomonas aeruginosa
RHGHQHWRQAAGHQPLQGAQDQQALEVRRERTEQGQQGEAADGEEREAAQGKGHRTPGRECHGGDLGGFVEHGQPGAFVMANGECAAHIGHGDLGDMTIETGGERGEQHAEQADHDARAERLGGGGCGWRRLAERGGERSHRDLATARVGKQGMGGNSSDFRRSLGASR

SEQ ID NO: 26235 - protein, 271 aa, Pseudomonas aeruginosa
RSMRFCRSASSSMSDSCTKRRVQRGASSAKISSRRIDRPPTRVLLERRVKQRSSLSSWMVSRVLNRSRAWSTSCRTCSCSSRARGVGTSLRPARTMIGSPTASRIRDRVRLIAGGLRCMRRAAPTTLPSSRRTLRATRRFRSGRCMEWKYKHAGMRRVQSFVLPGVRSLHCWIAFAVPLRAPVAAEECRCTLYPRICRCSIRSWSPSTAARRPVALPSWRGRPPRRARGSTCCARWTPAMRCRAGRRCSTIRPPRTSAKRPGRCSTRLVRC

SEQ ID NO: 26236 - protein, 257 aa, Pseudomonas aeruginosa
SARRRVRCWWKCAREMRRGVDLPADCRHLAVFPTNAEDRMQADFWHARWANNQIGFHLDEINPYLMRHLSRLRLQAGEQILVPLCGKTLDLAWLAAQGLEVLGVELSEKAVSDFFEEHDLRPEIDQLDGFRRYRVAGITLLQGDFFALQAEHLAQCRAFYDRAALIALPPEMRERYAGHLQAVLPTRSLGLLVTIDYPQAEMAGPPFAVPDEEVRGYYAGGWRIEELERGDVLGVNWKFLERGVSWLDEAVYLLERG

SEQ ID NO: 26237 - protein, 412 aa, Pseudomonas aeruginosa
KKGDRWSPCPKCESGSACAGAQRFDTIFQRRVAHQQAGQAVLEAAIDAEGVQGVGHLHRHALFRTQALQRGDHRAGAGQVGAGGVGAELAAAREPHDDDAGEDAEHQFGEDGRDEVADARAVLVLQDGLVDEVAEDPREEHHEGVHHALDQCQGDHVAVGDVTDLVGEDGFHLIGRETFEQALADRDQRVVLVPAGGEGVGLVGGEDADLRHLDAGFAGQLFDGLQQPLFVTGARLADDFGTGAHLRHPLGDEQRDQRTGETEHGAEDQQAAVILAGEAVHPEQFQGDAGNHQDCQVGGQEQQDAHHGVKLLLTAEGTERGSQAAGAGERAPDNHAGLYKGRSMAIQSRDYFKLCRLARPGCPRTAGGSARPGVRRRPAPAPGATGWPGWPVRGARWPAPRPAPPRPGGRYG

SEQ ID NO: 26238 - protein, 109 aa, Pseudomonas aeruginosa
PKSSSTSVAWAVPNAPSVANTTPPRPPGSIIAPAAARRCSTPTPSTTPAAVGRAISSRWTPRRSANWTTSATACIASKSAAAAAMPTWGTSSRMAPGPPGCVTASTRPR

SEQ ID NO: 26239 - protein, 413 aa, Pseudomonas aeruginosa
AVTSRIGVPMLGRSPIRQSGQSDISTSSEWPSRLSSVSRRLYSRPQRGSQVCSSCASPLLAEHCAITRPRSGSACSGGLTGASGRPTLNRLPRPTVDSTVSSPCMASHSLRVRARPRPVPPYWRVIPASAWVNGWKMRSSASWAMPMPVSRTLMRTPSAVASTRTSTRPRRVNFSALDSRLLTTWRIRVGSPETWAGRAGSTRQVSSTPAAAFCERRLAVSSTRTPRSNGICSRTSCPASNLERSSTSLSNSTSTLPESWAIDSCWRCSGVSGPSRLSESMPSRPFSGVRISWLMLARKLARAWAISRAVWRASSSSWLDSVRRALAAFSSAVRAATMLSSSSRYWVRRFSASRRCSISTEMRPSWRLMTSTSTPISSRSWPLGQGRRMRAGERGSCPLRAWIRLTRGLVSRV

SEQ ID NO: 26240 - protein, 343 aa, Pseudomonas aeruginosa
VSAISMGAGISLGEVLPPSIAHPDRLSGFLGATDDRSVTSVRSEENRVDSRLSDFLARAESVLARLEPLLPAVREAVDWERSLAARWHRDGRSGYLQPLEVSLDLRLADLLGVERQREQLERNTRQFVAGQPANHALLWGARGTGKSSLVRALLAELAGAGLRLIEIERDHLADLPRVVEQLQGLPQRFVLFCDDLSFDAGEGDYRVLKSVLDGSLEQAPDNVLLYATSNRRHLVSEKQSDNENWKMVDGELHPNEAVEDKIALSDRFGLWLSFYPFTQEHFLSVVHHWVDVLAEKAGLAWSWSEELEKEAIRWALGRGNRNGRCAYQFSRYWVGKQLLERQA

SEQ ID NO: 26241 - protein, 155 aa, Pseudomonas aeruginosa
GPAGAGRRGPVPAAPPAGAPPATGRRPPAGPSRGGRRPARGRRAPAGPAVRSPAVAGRDWRRRRTASGRRWPARRSAGRAGPAMVPGRTASARFRGRRRCTAAAVPAGAPRRRSGWLAAGHAGPACRGRDNRPRRCPPGSARAASSLPMTRFRYS

SEQ ID NO: 26242 - protein, 301 aa, Pseudomonas aeruginosa
NASVKGPRRLPDGMGFPGPGLGGIIARSSVPGPFALARGQRGPKREHGAAVFSKPGPSRGCPRNCMQPVFAPFATGLPGRRREAEVPPPGGTPGCEPGDLPPKPVASANIGRGVPMPWSVPGGQRCGRRDADSSSVFERRPDPGAPARTTSVALSRPAAYRPGAGRRHLPHQARRRPPGRRPGTRRGGRGAGLRQRRDRGDQPFQPAIARRPSRRGRAACPPPAGRRPRSPAWVPGRRRRRAQPYAQPGRRARSAPVAGRAPAGRSAVAAAPGGQPLPRAVGQVRHPAGRRRRPGDARTSP

SEQ ID NO: 26243 - protein, 337 aa, Pseudomonas aeruginosa
RAGGGLAAFAGASVESSRRPAATPAGPGDGRRGGAARPARQRLPGRPGRAGRTPWRRQPAPDPLARRAPAEPGARRGRPGAARPARTRPADRARCAVGAADRLQRFQRLRQRPGRHQGRRLAPGRTPRPAQRPAATAPVRLRTVLRRCPPRAAHPAGAQRRVLRPVPARPMPPRIRPVAGQPPDFRHGRRLPGGPAFPAHFRKTRMIDYIRDGQAIYRQSFATIRAEANLAGIPADLEKLAVRVIHACGMVDVVDDLRFSPGAGAAGRAALAAGAAILCDARMVAEGVTRSRLPAANRVICTLNEADVPALATELGNTRSAVGPWSTGASTWRAAWW

SEQ ID NO: 26244 - protein, 256 aa, Pseudomonas aeruginosa
TPWPRSANDECREGPPAGPGRRARRSRTDHPQGPAPAARGAGGRLFRGQGQEGQRLRHHRGAPGPGPGAPAAGLSGDHREAGTAAVLRDHHQRFLRHRRRTAGRAPGRRPRRGGDLRGRPVLLRFLHVPARPPGDALRKRSGAWRLLDARRRGGARCAAGVPQPEPLGALRSAARGGVAPAPGGCRRGGGDEARPQFRQGPPRAGRAWPRAPRAVRRAGDHGQPADRAVGTGGADGLAVLLADRRPRRQVAGRGRR

SEQ ID NO: 26245 - protein, 417 aa, Pseudomonas aeruginosa
RSCRTISNAGKPSNCRLPAPVRLRRKVTCEHSMDDGRRPRRADPERLCEQRPGSAGADAPDRTGAGAGQGGGCHRRRGRAETGPGQVRRGADRDDRGVLQEGAPVGRAGRAGRTPRRVQGADAEEQGPARRAGQEPETSAQATGGDRLMPGKATLFATLLACAALAGCADHKLSEQSLAKAQSEFDQVKEDSDVLRAAPKDVIRAGESLARAERLSSYWGSSSDVIQYAYLSQRYSEIARQHALLNLNQERLTRLQLERERLQLALREAKLLSVQEQGQRLSEEIASLSTEETERGLVLTLGDVLFDFNRAELKPAANRTALKLVQFLQLNPRRVIRIEGYTDSVGDRQANLDLSRERAQAVADVLADLGVDPARMQVVGYGEAFPVTDNASNRGRAQNRRVEIVFSNDKGQLSAPR

SEQ ID NO: 26246 - protein, 244 aa, Pseudomonas aeruginosa
ATVSVQSPRKTRHDQSAALPTHRPAVGRGHSPWRLPAGRAGTVGAQAQYPVERQPRHRAAGVRHPRGPGTDPRPSAIRLLRPPHPGADRADPGYRAGRASRPGHPQQHHQPGARRVPPRRGIPARRGGAARGLPAGARLAPATGQGHPLPEPPGVQLHVQPRFRAAAAAGGDPHARRRRGGRPVAGDHHPRLRGCDPHGPAGADPSRRPDRHRVAELLRPAATRRRAGPEGHRDPQRPAHRDQP

SEQ ID NO: 26247 - protein, 232 aa, Pseudomonas aeruginosa
RAVSATRCRSCAGCWPRRWRYEPTEAFRERRRRADAGAFPRPRAAAAGAGAGPGDPRRRATPGGACRTRPVLVAALAGSLPQAALAGGFRQPAGRGAGAGAGQPKRAGRRRAPGPPRSGVQRCAPARRSRRGRCGEAGHARAGGAGSAVRRDVGAPGLAGQLRIVRGGAATDGRGRAAGSGCPGRPTAGPGRAAGEGPGGAGRRLRRPGQGQGGCGEAGGARRGARGGPCPA

SEQ ID NO: 26248 - protein, 136 aa, Pseudomonas aeruginosa
RRWSPRRRRSPDAPGGWRGTAGCRRPPAARSAPARGSACAGLRRGSPRRRSAWPASGRRRASPPAPRPGHGRCVRRAAVPGPSAAPCRSAAGSRDRRPRRRGGPRWHARAVPPVPAAAAADGPRRRGSARPPGPGR

SEQ ID NO: 26249 - protein, 476 aa, Pseudomonas aeruginosa
SAGRPRRVPAAGSRNAAGSCRFPPGTSAFLLARQDAHQLADDAEHDLVGTAADGYQAGVAVGAGDRVVPHEAHAAPVLQAGVADLAAEAAGLELGHGSQARHVPAFHVQLGGLVDQGAQRLDLGHHLGHAKVDDLVVDQRLAEGPALLAILDGDVDAVLQALDHVGRAEQPFFLELQHLHHEAGAFRADAVALRYADVIEEHLGGLRTAHAELVQVRTEGNARGLHRDHDQRLVDVRLVVGGIGEQAHEVGRRRVGDPHLAAVDHIVVAVLARGGLQAGDVGAGADLGDADAADHLAGDGRAEELLAQLVGTEAGQGRGAHVGLHADGHRDAAAGDAAEFLGGDDRVAVVQAHAAELLRLGDAQQAEFAGLAEDLVDREAAVLFPLVDVGVDFPLDEAANGAAEFLVFLGEDHGLSFLLGIIVFRQDPLALSQPSSFRESGERGCRRLACCSQNLATPKLLPFSGRASASAQISSR

SEQ ID NO: 26250 - protein, 490 aa, Pseudomonas aeruginosa
LHQRHAGAGGLHRAWRLARLGQSCRVEGFEDRQFQRMALAVDLYAQRALRLVDQEREQADHRIHRRPAADDAGQAGRHPGGGLGDLAGEQHQGFLARMPDGQLDHHFAAVLPSPMGTIGGFAAEQFDIDLAVGLPAALGEDFLGPGDDRLADPLGLLQRIDAGDQATGGAAETVRIGGADLVPVGGRQAARAFHRDPVGSDLAQAHLGEVADHVGQQVGAWVADLVEHLFADAQFADQATGAGRLGHHEAPVGLDLDDGETDVLVVRHLLPVGEIAAGALRAAFDDVPGEGGLGQSVVVVPGPAELVHQGGADHRAVDHPAGDHDIRAQAQGLDDARRAEVGVERDAHRRERRVAEHLADAGLGQFGLARLQVVAMEHGDLQLHPGLLAGRGEGGGTGLRIDPASVADDADLLLGDLAQQWCEDLDEVGGVAGVRLFQAGAGHDRHGDLGQVVEHQVVQRRAAHQLGGRGAGVAPEGRGAADAYGLLHCS

SEQ ID NO: 26251 - protein, 454 aa, Pseudomonas aeruginosa
HCLTGGYPFIAPSGPASERLPMSPSALSRLLRPVEPLTPAMSISDVADRLLMPEHRAFLSLPVVDDERRVLGLVSRYTLQDIFMQRFGRDLWGRHPVRDVMNRAPLSVSLGASLEEAAQQVTGRLQYPITEDFALVDEEGRYRGLGTVLDLLKAMEARIAQRNRVLRKALVDLKESQAQLVQSEKMASLGQMVAGVAHELNTPLGYVGNNLALLEELSDPLLRLADAQAALVDCLGDPQCDEARLAQALQAADAVRREAAVEQLREDLRQLFVDTRYGLGQIGELVSGLKDFARLDRAFSEEVDLNDCVRNAVLIARTAIKDKAEISSQLGELPLIACAPSQINQVLLNLLTNAAQAMERFGRILLKSWADERQVFLSVQDNGKGMPAEVLGRIFDPFFTTKPVGQGTGLGLSISYKIIQQHGGTIRVASEPGRGTRFLISLPREQARELKRSA

SEQ ID NO: 26252 - protein, 258 aa, Pseudomonas aeruginosa
RGAHPAQPGHAVPPPLRGAHRERPAARPGAPEDGTDTGAGQRPAHAADERRRTAGAGSRALSGDPADSPHRLFRPRCRRRRAQRRWHLPLPDQALESPGNGLHPAPGGGDRQPPGPAGAARGHAGGAAERAAARRRPGNPGLRRGLLPCRRASPAARAQPGRGAGVAEHRTGGGAGQRPEAGRGAYRAAAEIPGPGPSAPAQPGGYAVPRHPGPARTDQPGADIPLPAQADPQGIVRERPEGGRRAGLAVARAKPAGG

SEQ ID NO: 26253 - protein, 211 aa, Pseudomonas aeruginosa
PAGRGAARRAREGTGRQPARHARPPARAADGLNAGLAGVATGGLGLAAFHQACAEDVVAPVEGHGVGQEEQDQAHVEEERLDQSDRQPPGGQRYQHHDQPQLEEHRMQHPDLQGALEAHAPLGAVEEAVEKHVPEHRHGGEHQRQRTHVRQGLVHHQRQHRRGEEDGQALEGQGVEDPLLESLVEGGVGVGHGERSRFVVEVGLYCHRSLG

SEQ ID NO: 26254 - protein, 229 aa, Pseudomonas aeruginosa
DSPGQGPPGAPGPGLPAGPWAPVDRRPAGDGQDHPQPCPGAGARAQFPAHPVHLGPAAGRYPRYLGVRQGQRAIRLPSRADLRRTGACRRDQPRHAEKPERLARGDGRRPGDHRGRHPALAGTVLRHRHAEPGQPGRHLLPAGIAAGSLPDAPVAGLPRARGGTLAVARRSPARSAAAPGTLARPRGAGRFPGRSAEGPRQRCAGGLRAAPGRSDPHAAGLRPRPVAAR

SEQ ID NO: 26255 - protein, 379 aa, Pseudomonas aeruginosa
PGVARRGACLGAAGGTRLCDSGRRPGGVAGGRRASPARPGGPHRARWRRAGAMAVARSPGALMRLRNWPRWQRWLNRRIPPASSVELNQRRVFILPTRQGGAFGLALLVMLLAAINYQNSLAYGLTFLLLSLGVVTILHTYRNLAGLRLTALGADPVFAGERAGFRVRLESPRRARQAIAVGWPERPLEYADLAGDAAAEVLLFHPTERRGWLRPGRLRVESRFPLGLLVAWSWVDLRQQALVYPRPLAGEPFLAPGAEDAEDQGRALASTGVDDYQGLRAYQPGDSRRRLHWKAFSRGQGLLVKDFAALGGEDLWLEFERLGGDLESRLGRLCHAVLELSARQQPYGLALPGTRLQPASGEAQREACLRALALFGAAR

SEQ ID NO: 26256 - protein, 542 aa, Pseudomonas aeruginosa
TAGRGDRPAGGVDVGGRPPGGAHGWRGTARPAHRPAPSAQPAAADPRSPRRRGAGACRRRGRVAQRADPRPGGAAAGARRRRAAGCAGGAPAGAGVRLRGGSRQPAAAPPAALPGRLAGPVAYGPAACRVGWHARPGAQAPAPAMEDPARRAGGHHLRALAPATAADQARALRAGGLSARLQHSRLAAGAAQGGPVGAGRLARPRTVAVAMPARAGPGARARGLDGTLRTGPGACRTGPVDIAAGTCRALRPPVFRSAFSQGSPRLRWALESPREAHMNFSELIQAVRRDPSSVVVPASWGQGRATFGGLVVALAYEAMLAVVEAGRPLRSIGVSFVGPLAPEQPASFSARLLREGKAVSQVQVEVRQGEQVVTLVQASFGVARASAVAVEALPAAGMKGPEESQELPYIRNVTPEFTRYIAMRWAVGGLPFSSNKSRQMGGWMRFRDEPEGEPMEVSHLLALLDSWPPALLPHLGTPAMASSLTWTAEFLQPLPQQGSGDWCRYLAEIEEARDGYGHVAARMWSADGQLLAISRQMVTVFG

SEQ ID NO: 26257 - protein, 164 aa, Pseudomonas aeruginosa
SALSARTSRLSRSSPASLRRATPMLTVIRSGSPSGLFTRSASTPARSRSATSSAWSRLTSGSSAANSSPPRRPSRSTSRRPWRRVSATRCRARSPVRWPWLSLMFLKWSMSSISATQGWRKRSAALSMSSAWCRNEWRLCRPVRVSVLASRRSSCSMALRRLMS

SEQ ID NO: 26258 - protein, 503 aa, Pseudomonas aeruginosa
LADGAGQIARQVDQLLTGGRRLDGLLHGEFGDVADAHHRTGHLFRDLALLFRGDGDLRVAFTHLRHRVGDRRQRLAGVAGLADATVGLERAFLHELHGVAGTRLQGEDHLGDLVGGVLHATGEVAHLIGHHREAAAHFPGPRGLDGGVEGKQVGLFGDAVDHVDHAADLLAVLGQLLDHLGGVLDALGQPGNRRADPAHRLLAGAGQAVGFLRLVTGVGGVLGDMEDRGGHLVDRGGGLVGLALLAEHALAYLAHAAGQRLGAFVELGSGRGDGADDALVAGLHGVEGAGHLADFVASLQRYASGQVAALLDVQHHVLEGMQVGEDEADQQLRGRQQRQHQHQHGDGVGAGTVGEDLPQVAGRGEHGEALAGAGLADPGAEQRGIALARAGQLDPTLPLAQRLGSCAAQARGLFQRQQVAAGGQGAAGWPALNQLALGGGGALGGSVAPGGFLLHGEQHQQQGGEEGHRVDGPELVFQWNVADPGAHRGISSYRQANGKAPLS

SEQ ID NO: 26259 - protein, 172 aa, Pseudomonas aeruginosa
KLSKGQSLMRVNETVRQLSGRSAGSLRAISVDRRQAEERPRRGAGVSGQALCALAAMAGHAVEHLDQVGRLVAPVLRLRSQAARQQVGRVAFQHETADRDLAYQIMQVGAAALVVDPAGDADVQVEVEVAIQRPALAGETMYDGGRQAIAEVAQDRQQALAGVAFVEEHRTL

SEQ ID NO: 26260 - protein, 493 aa, Pseudomonas aeruginosa
LIRSPGEGHRAWPLETWMTRLLLLSLCLLVLAPLPAAARITGQPDNWHREQPETRDLASIRRAGVLKVLVNQSRNSSGEVKGEPIGVEYRRLRAFEQYLNSRSPSARNLTLKLIPKPKDQLLAALQRGEGDLVAPGELLPAHDGLQVSPSAPVRADVPLVLVARKGNRRYTRLEQLSGRTIPLPAGSAAEGAIELVNQRLAQRRMAPIRIEKLDASLAVEDVMEMVQAGILGFTVVEQPIAERWAKVLPKLRVDRHLVLDNRADMAWYVRRDASTLRATIDRFLADTRAPADQDVAFQRVYRRAYKVRNPLGAADRKRLEAVRPLLQRYARQSSMDWLALAAVAYKESHLNPKARGSGGASGLMQITPAAARSVGVGNVHDKDSNVLAASRYLTKIRKQFFSSKHLDERERLAFTLAAYNMGPERVQNLRTQARRRGLDPNRWFFQVERVAAEEIGMGVVSYVSSVNKYYLAYERERVRLEPGVRAKTATAQK

SEQ ID NO: 26261 - protein, 444 aa, Pseudomonas aeruginosa
SMAPASSRWTASCPAEPGWRRKRADTFGWPPFFVAARSTGFRLAGHARAAPLRVALSAEAPFAAFSAFPCRSALLGLAHLFQRAQAQAFLFAEALLGQAFDRRAAVGFAQPGIAFDPALLGEIVVQPALPGRALPIELLQAGGGFGAHQLLTHLADGFRAGASGLEGGGLLLQFALQLRQHAFLLVFRQAGAQAVDGGGLFLGAELAVLADRQALQGELVVGFLVGEERHVRFVAEDPRAQGFHRGFPLAQGVEVGQARQVAFEQHQFLLVVDVLLHQRQRLAARRLLEFGGDVGAQAVQALLQGLFADGAEEVVEQVADVAGDQQVAAGVDTETAIDAGAPEGGWQRRDLGRHDLGGRHRFSRGGCWRGAVCARLRAGRGRRLGGGGRFQPDEPGQAGGERQWNQQEDFLHARGLPGKGRGRGPGRGPTGWRSSGGWRAGGRR

SEQ ID NO: 26262 - protein, 156 aa, Pseudomonas aeruginosa
QSPCGFSRMRVRRFKQQLAGRPAAAEIPLKRWLGVASHRCPAGPKRRRHDVMTCPSTQLRLAPITTGLVRRNPRILLSGPHQPTLVRYLEGWPKRWNGSRTFLIQFAQDGKDLARFPSDAFDFAVVQAPEAEDLDLVVRQLIRVARQGLITRRILR

SEQ ID NO: 26263 - protein, 297 aa, Pseudomonas aeruginosa
PRGALRSDQRGAGGARWTIATHGSGGSTNERMKACQCIRSALAQDPQRAAVEGATGAQQAGAAYQHGAHQRQREQPGMRLPRQVEDQSVEQQADRLAAERREQAADCAEQGELDPPGTLQQLALGTQRAQQGTLAHALVEGRLETGEEHHEARRENEHQHVLHGQGDLVEDAPQLAQQGVYRQQGDGGEGAGQFDQVAFLAGRQVEAGQVGHRQVGQGAGLEDHEEVRLEIVPLHLAQALDLDLAILPGDAEGEPVADLDTQVGGQLLFHRHARQGPRLRRAPPASGGELVAGGQSL

SEQ ID NO: 26264 - protein, 663 aa, Pseudomonas aeruginosa
PGQAEVALQGTLAAHVFVERLDRLAVHRYQAPGNHGEQRLGAGGELLHATFEGVLFRRQDVQGEMVGGVRRQLGLPGIQQFAAKQGDQGHSQQDQAEGQALSGGGQRVPQQLAESQPPWQAGTRQCPAQAVQAEQQEGAEHQRGDQAAAEQGEGQLQVETQPPHDQAQGEQGAGVGHPGAHRHRQQVAAQDPQRRYPAQGCQRREGEAGQRYQAGGDPGEGGEQAAGWYVRRQQRGEQAEQAELCQPAEQGADGAGEQAQQQQLQRVEEQGFAARQTEAAQQRAGVVAPCSETGGGQGHGDAGEQHRGQAGQVQVALGTAEGIAHLAVAVAGILQALVGGEAALDLLAIGLEGFRRAFPQIAVAHPAARLDHPGGIEVGQAHHGAGRQAVQVAGAVRLVGKDARDAQRLAADLDAVADLQVEADQQARFDPYLARLRTTAGLLGGERRGSALELAAQGVAVADRLDAAELDALVGGDHAGKLDAVGVAQAQTGAAFDLFGACRLGTVEHQVGAEELGGAGEHGAVQAGAEIADGGARGDRDQQGEEQHAQLAAARLAEQLATGEAQQAGEGHRLHQGSTRSIRRPLSRRIRRRQRCARRSSWVTRTRVVPRSRLSSKSRSLIRSPVALSRLPVGSSANSTSGCAAKARAMATRCCSPPESWRG

SEQ ID NO: 26265 - protein, 353 aa, Pseudomonas aeruginosa
WPRRWPRPTRSSSSLARWRASARPSSSRGSITFSSASRLSSNWNDWNTKPTWAARTRARWSSSRSPRACPARRTSPPLGWSSPASRPSRVDLPEPELPTIARLSPRARSRERSWRMVNLPSALPTTLLRFCALRMLALMEVPMRALLLSGCLALVLLTQQAAAQTLLVVGDSISAALGLDTSQGWVALLQKRLADEGYDYRVVNASISGDTSAGGLARLPALLAEEKPALVVIELGGNDGLRGMAPAQLQQNLASMAQKARAEGAKVLLLGIQLPPNYGPRYIEAFSKVYGAVAAQEKTALVPFFLEGVGGVQGMMQADGIHPALAAHPKAPGKCLADAETAALRLPRDTAFG

SEQ ID NO: 26266 - protein, 450 aa, Pseudomonas aeruginosa
GCAPSGAPHAASRLDPLRLSTDRARRSAGPVRLSRGPGACGGASAGAGYPGGPHALWQAAAGPAALAAAGTGASARPAAVSRLPETTGGGKARGAPVLVGLSPPGETWRGVTLSFLLLHRTRQGFSGMLSRVPVVSLSFAALLSAGSASALELQLPPPGEDVVGQVQVIKAKYEDTFADLGEQYNLGYSEMVAANPGVDPWLPGVGTEVIIPTRFVLPPGPREGVVINLAEYRLYYYPKGQNVVHTYPLGIGREGWGSPIANTRITAKTKDPAWYPPASIRAEHAADGDPLPTVVPPGPDNPLGPYKLTLGVPGYLIHGSNKKFGIGTRTSHGCFRMYNADVTHLFSMISVGTSVRIINEPYKFGVSNGKVYLEAHTPLNDHGDPSVVDKHTAVINTMLKRDDLAKRIQLNWDVVREVVASEDGVPVEIAQESAPAMTATVDSDPTQLTP

SEQ ID NO: 26267 - protein, 293 aa, Pseudomonas aeruginosa
RPSPCELPEAHRQAMRERKRPSLWLNLEYLSAEEWIGSCHALPSLQACGLSKYFFFPGFREPSGGLLREAGLLERRRRFQASVSAQDEFLASLGVRRKVGERLISLFAYENPALPGWLEQLRDARQPSLLLVPEGRVLADVADWLRVATLAVGDVHVRDALRVQVLPFMAQDDYDRLLWCCDLNAVRGEDSFVRAQWAGRPLLWHIYRQEEEAHLAKLEAFLELYCAGLPADLAENLRTFWLAWNAGGGLAGAWEGLERQLPEWRREAQRWADEQGMRPDLAARLVQFYADWL

SEQ ID NO: 26268 - protein, 198 aa, Pseudomonas aeruginosa
FFVFHPSDIRMKTAQEFRAGQVANINGAPWVIQKAEFNKSGRNAAVVKMKLKNLLTGAGTETVFKADDKLEPIILDRKEVTYSYFADPLYVFMDSEFNQYEIEKDDLEGVLTFIEDGMTDICEAVFYNDKVISVELPTTIVRQIAYTEPAVRGDTSGKVMKTARLNNGAELQVSAFCEIGDSIEIDTRTGEYKSRVKA

SEQ ID NO: 26269 - protein, 187 aa, Pseudomonas aeruginosa
SFRATRKSPAFAGLFRFRCPPPRRGESEASDRHVQAYVDIAAGSVGVGADLVGGGYQRFGGFALQARQVDVQFDLQAEAAGNLADADLAGYRGVGGKGLLALAGNELQGSDEAGGVAGGEQLFRVGGRAALAAQFARSAEFHVEHAVRRYRTAVTASGGGCGCGVESLDGLHEGHLSDLYVKFLRAK

SEQ ID NO: 26270 - protein, 376 aa, Pseudomonas aeruginosa
LAVRVAHQHDAGRGQGGQALALVEDAQVAGEQAAQLHGHGEAGADHREQRRQAGAAVGDAVVQFRRLQGVAGPGPAKAGGVEHGQRDRPLVVGAEALGGHPDEGLLAQQLADLGARLAGDDGQVEVVARQQVERGVAMHLDLHQRIGFGEARQDRREEAHHVVVRGADAHRADHVRAAQGVEHLAVQLEDPPGIAEQHLAFGGEAGLPSVALEQRALQDVLFEPLHLHADRRLGAIHRLRGAGETTVLGDGDEGAEQFRIDAGLVAHSSISKMHCIRMIRWIDPMPGGTLCLSRTEGKTMKGQQDYFGSHFHAASHPASTAAPSLWRRWRRWLQLARERRELLRMSDEALKDLGLSRADIFQEGERHFWDDPLRRH

SEQ ID NO: 26271 - protein, 249 aa, Pseudomonas aeruginosa
VVSEERLLVEERDEYGVIRVIESGDYRFLEFGDGVEQSCVFMPDPAWLEYDYTRAMLLGGLCHSQPRRALFLGFGAGSLTQACLRHLPLEEAEAIELRPAIPRLAREHLGLRDDPRLRLRIGDALESLGECAEADLIFLDLYTDTGPSAAHLAWNFLGACQERLAEDGWLVINQWSGTDGKPLGAPLLRGRYHHHYWECPVAEGNVVMLVPANLALELDQEALRTRAAALEPQLGYSLQGYIDSLRPAQ

SEQ ID NO: 26272 - protein, 594 aa, Pseudomonas aeruginosa
FKSNLANPRPSCLGGRFGRTGHEQPWVMGLCGCIRGKPMTQETVGFAALGIHPNVLAAIVAVGYEEPSPIQAQSIPLILEGHDMIGQAQTGTGKTAAFALPLLSRIDPSRREPQMLVLVPTRELALQVATACETYSKQLPGVGVVAVYGGAPMGPQLKALRQGAQILVATPGRLCDHLRRDEKLLATVQRLVLDEADEMLKLGFMDDLEVIFEALPESRQTVLFSATLPASIRGIAERHLKQPKHVKIAAKTQTVARIEQVHLMVHADQKAGSIQRLLEVEQFDALIAFVRTKQATLDYAELLERQGYRAAALNGDMPQAQRERVIESLKDGSLDIVIATDVAARGLDVPRITHVLNIDMPYDPESYVHRIGRTGRAGREGRALLLVTPRERRMLQVIERVTGQKVGEVRLPDAETVLEARLARLAASLTPLLDSAVEQRGAVRDELCRRLGCDAETLAAALLARLTAGKALDLESVRREQPLTPSAPRERADRGERGERPERSGERRPMAPPSEGRARCRTALGARDGVAAKNLLGAILNEGGLSREDIGRIQIRDTFSLIELPEANLERLLTKLKDTRVAGKALRLRRYRED

SEQ ID NO: 26273 - protein, 133 aa, Pseudomonas aeruginosa
CCRNRSAARLPRAVGAGPGRRGSAGPDRGGSAGTAGAPGCPPAGTSGSAAPRCRGRMVAVGRPGPAGRRPGAVRSSAAPAPARLWPGSARRRGAAESRRSRARYPAPRRRLLAGRRFPSARKPPGSPSAAAAL

SEQ ID NO: 26274 - protein, 340 aa, Pseudomonas aeruginosa
AGAECLSLLGNLGGAGAGRGVDPCFHRHAHTQLARHGLARLENDLHRDPLDHLGEVAGGVVRGDRREAQAGGRCDAVDMAAQNLAGEGIDADFHGLSGRDVGQLGFLEIADHVGLLQGHHRQQRAARRDIGADAQLAAADLAVEGRAEFAVGEVQAGLVASRLHALQVATGLADAGFEDAHLLARGIHCGLALGQPGAGGIDPRLRLLGVLQAAGALAGEGLVAALLVTGEDQLGLLGADLGPRLFDQRLLALQVGLGIGQVGLGTEHVGFGGGQGGAEVAVVEAGEQLAGLDRLVVLDQNVLDEAGDFRRDQGEIGVHIGVVGALHDPWGEQVEQQVDQ

SEQ ID NO: 26275 - protein, 256 aa, Pseudomonas aeruginosa
GRPGDSDREDAWSGSISTLACAGCSLSFSQACVRCIAGLRSRCLYAHRWLPKNAGARSIRGFADVPYAPGRHRRRPADPSHCRAGAAGRRAGRAGPPAVRGGRRLCVAGPADAARLSARRARVRRGPAGARRGLCAASRVRAGGTGRAACRRPGAGDPGRGAAPGLRADHHRPSAPGTAGAPARSFGRRPGDPRGAVSGAGGSARGRCAGELTCRPIVATLRFFPRMRRTGCRRIFGTPAGRTTRSASTWTRSIPT

SEQ ID NO: 26276 - protein, 626 aa, Pseudomonas aeruginosa
SPCRRRCASAMPGISRRSCRRAASACWSPSTTRRRRWPVRRSPCPTRRCVATTLAVGGSRNWSAATCSASTGNSSSAGCPGWTRPSTCWREAETGRRAAPRPFSAEFVDQHRKGAQDVLAEPLGAGAGPAGPGLRVVVVVLERHLDGERQAVVGLPDEVAGQRQVGLARRSAWVPMADLEFAARHQFLAEALLEPFQAGRIARVALAAGGEYVGDFLVAVDVEEQVDAMALHLLLDEPDFRAALGARLQPGPVEILAGGVGAQVAVERAVRVHVRHQVQVGLFQQALHFRIVRPLQALDQAFHEPFGHVFAGMLLGDDPQLQVAVGMAPDPQQFDVAALHAGADGEPFDALDAERTFDQAGMPFAAVGLEVGEADFAFLRFQLEMQAVGVVLRRHAEPAFAIVRGDCLVAAPGMAVGRLAGVDQGEAVLGGGSHALDLEVEPLEMLAGQVGTDRQADPAGIAGIDDLDVAAVEIGADLHGNLIGRNHGPACSGAGSRLSKRPWIGGFPGHKKRATDGRPVPSVKADQRALARSASIRSSSGGWLISRPARPCLRPPLMPKAFRVSGICTGTPCSERRRCSAAIIAPVPARWAPAASARNSRRRENHMTMMLARMPSTSSAKMVATK

SEQ ID NO: 26277 - protein, 154 aa, Pseudomonas aeruginosa
EGLFAEHRLVESLVMNGVGEAQVAFLGEPEQRAQTTLVTFARQAELVRRLAADQVFDVERGLARKRLVEKQEAASGVLVEVVDLQVHGWVAGQGGASGAAGAGGLLLVALEEAADAQDRLLQVVDAGQGDHPEVVGPRPVEGGALDDQQFFREQ

SEQ ID NO: 26278 - protein, 326 aa, Pseudomonas aeruginosa
VEDELFVVVDRADLRVDPREGVQRAHRLHAADAGDVVEQFPGAVALLQQAPRRQDQIVDALVAAQGGLDRVLRRDVGAQAHVGEDVETFDIALCPLLGPGDRHPAGAEAGHPVGFGQAVEGQAEHVRRQRGGGDVDGAVVEDLVVDLVGEQHQVVLAGQFDHAFQHFPGIHRAGGVVRVDDHHRPGVRRDLRLDVFQVRPPVGLLVAQVVHRLAAGEADRGGPQRVVGSGDQHLVAVVQQRLHGHHDQFRHAVAEVDVLDANAFHLLLLVILHHCLARAEQALGVAVALGGRQVADDVLENFLGSFETERRRVADIQLEDAVTLFL

SEQ ID NO: 26279 - protein, 111 aa, Pseudomonas aeruginosa
KMKLFRHYIIALAIIAPAPAFADGSTDRLYGETLQANEASTRAYALNAGKNPPPVVHYRYGMTLDIAKVIGLTPTYGKCGIMPAQMSYVDSKGEINILEYRTSGSSCRNEN

SEQ ID NO: 26280 - protein, 236 aa, Pseudomonas aeruginosa
LVCRSQPCLRFIVEGPHVVQAAERRNPDADPLRANRLGQGVHRIEQKAQPVGDRATVAIQARVQLAIDELLEQVAVGCVQLNAVEARRDRAPGGSHDVARDPRHLILGQGARGACRHLAGQALHDPGVSLRILCSPGDGRHGRRACLLQRDVRDASNMPELGEDAAAGLVHRVGHQPPARDLLLRIQARREQVAHALARDRNPFADDQAGRCALAVIGHRRRIRYVVDRARASSVP

SEQ ID NO: 26281 - protein, 381 aa, Pseudomonas aeruginosa
FPFGEERVEVATQALLPVEQHPFALQGDRVGEQAAAGPQALPAGFQHALGGDSAADENGVRLGQFQQRLRGAAGDQVQGRYAEGVAVVADMFLALVVGFDGDRPATGVRAHPFDADGAATGADVPEQLAGAGRQARQGHGADVALGQLAVVAIGFVGQARGQRQAHGAGAGAAFHRHQVEIGGARQRPVAGEAVETALERPAEVFQHAQATGAEATGVQQAGDGGRAVAVVAEDQQAPAVVDLCLQRRQRARHQRQAGDLLQGPAEAGGGQREGGGRRQDPQFGRRQLPGETGADAEQHRVAAGQHAGRLAAPGQQWFQGERRRPGFAGGADARRQQFQLARRADDPAGLQQGTPGLLAEAGITVLADAHQGQPGRRRVCR

SEQ ID NO: 26282 - protein, 556 aa, Pseudomonas aeruginosa
RGANEGRRGNTEPRSFRSPGLAVAAPATVCSLYSRHSPLDYREGGAKRRFLPRVERRAASQETCRRNQSRVPTSGGVYRCRGLSLGDSGAVAATPIRVAFLNDDQTPAPLPVPRPSPCPGLLRIVQALDGGICRIKLDAGRLDAAQARAVAAAARDCASGVIEATNRSNLQLRGVRRGEEERLVRRLLDAGLGPRHGSLAGADDVRNLMLSPAAGLDPHLSLDVRPLAARLLLRLQADSRYHALSAKFAIQLDGGEDLAMLEHPHDIWLSPMPAAPTATLVFGLAGCPARDRPLAALPAERGESLVLALLDLFLERAQPQQTANAPPVAGAGRRTLLEALQARLDFPLRRDERVAAWRRSPGRPWSHLGVQPQRQPGLVMVGAAAPLGRLDSACLEGLAELVERHGDGSLRLTPWQGVLLPNLAHAEADQALLGLRGLGLLTEPDAPLARLIACSGSSACARGLADTKGDALRLAERLGPRSDLPQLHLCGCERSCAAAHRAPLTLLARSGGFYDLYRHDPCHPGFGQLLASRLTFATAADYLAALPSQPTSGKPA

SEQ ID NO: 26283 - protein, 280 aa, Pseudomonas aeruginosa
PRGALRDRPRSPWRQRHGRRGGERPGHGARMMSVVKGRLLGLGVGPGDPELITLKALRLLRAAPVVGYFVAKGKKGNAFGIIEAHLDQAQVRLPLVYPVTTEKLEPPLCYETIISDFYDTAAEQLAAHLDAGRDVAVICEGDPFFYGSYMYLHDRLATRYESEVVPGVCSMLGGAAVLGAPLVYRNQSLSVLSGVLPEEELRRRLADADAAVVMKLGRNFDKVRRVLVELGLERRALYVERATMANQRIVPLERVEPMASPYFSLIVVPGDKWQGGAGGE

SEQ ID NO: 26284 - protein, 412 aa, Pseudomonas aeruginosa
RGGAAARRAGRGQPAGAGNRRGAGRGAGDHHQRRAALRHLRAQPARRLCPGRPGAGQALRCRFARWPAGARRGCRRLARRGPFAARPGGSAGDSRDALGACAAGRGTADPSALRAGGARTCRRGGGRGAPGAGRCRPGRGGARRLAGRQRADGRSAPAGRRRCARRTAALPAAGRSRCAPAPGLARRRAGRRPAGGGRRALGDGPHRPASRPTHSDRPGARLRRADGACGAAGTGRGRGHPRLPDLRRHGRTLPRRTGAAWQRQPRGIAARPACLRTGGDGQGGGAGIVRRPRRVRHGRRGAGSPAWRWRAGLGRGRAADLPWRLGGPGHRGQGGGASGPRFLRAVAVRQPQALGGDRAAPGPGRRRRPGDGFLQSDLAGAALATGTGAGDRRPPSFAADPGGARSRHRAAR

SEQ ID NO: 26285 - protein, 120 aa, Pseudomonas aeruginosa
LVSIRWMMAAGLAALTLSGCASNDPAPLEQMRLTEQALEQAKAVGATDDVAELKLAQDKYAAAQIAMTAESYKKARLLAEQAELDARLAESKVLTQKSKDQLGELDKSLKRLRKQLGETD

SEQ ID NO: 26286 - protein, 215 aa, Pseudomonas aeruginosa
RGAMSSNETLPGLVIADSFPVMQWALQRYLSEECGRQVLAVIGDSDSLVERLADLPPESILITELGLPGQRSRDGIHLVEWLTRHCPQMKVMVYSVFSAPLLAKAVLRSGASAYISKRSPLETLKAALECMALGQTFLDPGLHPQRHTGKPLSPTEVDILRRLARGDTVSEIAQRTMRSVSTISTHKKNAMVKIGLNSDAELIALGVMNWLHELA

SEQ ID NO: 26287 - protein, 598 aa, Pseudomonas aeruginosa
FFPGRPPARRRPGLPPVRRSRPGAKPLRLASVDRRERGGGRVAFLTFPMAAPQAALGGLFPARTRPVATDRVFFSSRTRRLCDRPVQFCDCMPGCRPNCSGAVSRIELLFRFNRRGKPAMTNLLLYQRIAQQLAEDIRRGVYQPGERVPSVRKLSTQLNVSHATVLQAYATLEDQGLIRARPQSGFYVHRTPALTAPTPDIARVERPGLVTRSSIINQVLAESRREGVFPLGAAVPHVDYLPVRALHQQLAKVTRFQSPRAFSYMFSPGFEPLRRQVAIRMRDAGVVVDPSQVTITHGCVDAIHMALRVLTRPGDLIATESPSYYGLLQLADVLGLKVIEIPSDPRTGISLEALQLAANQWSIKALVLTARLSNPFGGTIPEDRQKQLLKLTAEHNIGVVEDDIYGELMFDQGQARSLKSHDRDGRVIYCSSFSKTISPGVRIGWIIAERYQEEIRRLQTFTTHSACTVTQMGVAAYLENGGYDRHLRYIRQEYRKNMTAYQLAVQQYFPEGTQMTRPKGGFILWVSLPAKVNTKELHVRALEQGISIAPGLIFSNTEQFNNCLRLTCGIPWNREAERAIMTLGMLAGQLCQEGLIAA

SEQ ID NO: 26288 - protein, 456 aa, Pseudomonas aeruginosa
HRTGVDQRHACLHQRHDGRRQRRNAAGALPQGRQRGLRGALPAPSARSLPFSLRPGRTDRTGRRDLPGNLAQPDPQREPAAGPGELPHLALPDRPQPLDRSLAQAWPAPAVAGQLRRTVARATRPGRRPRAAAQPEPRRRALAERAGDPARGTARGIPDARPRRTGTGRDRHAHPVAAGDGEEPFPLRGAEAAPAAGRGGGGMNPQKHSASVAEEQMLAHFRAHAPQQPAPALDQAILAAARRQAAHVEPARSWWRRWLEASRRPRWQAAFASLLGVALVLGLVSQNVLDDAERQARPEVAFSDVPLRDGVAGAAAAKRAMRAPAAPAPLSGEMSEPPALLASYASSGEAPQLMAEAAPPAPAALADRPPAQAAQQAKVQAALAGDFVAQARGKAVAVKPEVLDEALGAVLALREQGKTEQAATQLAELQKRFPGENLVERLERLATIAASAKKRP

SEQ ID NO: 26289 - protein, 231 aa, Pseudomonas aeruginosa
TWGEQQRECQDDDSDPLPWLQSAVSIAAIGHTCVTMKRLCRICVVVLFGCFLAACDDGSKAPEKKAPEAPPQEQRAPAKPVKPARAEPAPAVPAAPKTASKKVAPAAEQVAEPKPPAKPKPAAAPPKPASRPVAKDKPAPAKRASTARLDPEVRKPLPSAKLDLRLPKELVQKMAPPGTEETHKPKPLLPPMFEEKDDSDFRLNGQLLYRDRELGVSRPLEGAELQFEFRQ

SEQ ID NO: 26290 - protein, 288 aa, Pseudomonas aeruginosa
PGSPPQSAARLSSETSVEEQVGHQRATLRVVAVLLEIALAALAQQFLVDQQAPAEAAPLAGENGVRGVGHDRRGARAAEGVTAAQLELDGGGGDHGLRPQRVDADGVFPELLVHPQGKHAHAVLGDRVGAVLGEPPAGQVDRRRQAEDVAVGAPAQVGQGGLAADQHRAGVDLVHQVEALGLQLLHPDQADRPGVVDQRVDPAEAFGGAGHGRRHGLLVAHVELQRQGLAAGGLDLGGDAEDGAFQLRMRLGALRRDHQVGAIARGAQGYLPADAAAGAGDEQGLAVQ

SEQ ID NO: 26291 - protein, 1001 aa, Pseudomonas aeruginosa
HGRLRFLVVVVADERRGVSGVGFHLDQHLPVAHLLATADLDAADHAVDSGLQRVFHLHCLQHQQQLALADPFALADQHLDDGAVHRRLERAGTGADLGAGAGVGDLYQFEVAAVAVYPEAPAVHVVRVAAANAVEFGAGPASVAVEQAHGDLASLQARQQSRPATAFEDVQADLHALFGVLQDDLPRCPGGAAPAGQAGLVRTGLGAGLVEQGGGQGQFLGARLARLQAGVFGEAFADEGGGRLAGGEVRMRQEVGEEPLVAVDPQQHAALQRADQLAPGFVAGRPVGDQLGQHRVVEGRHRLPLDQAMVDAYAGQQFRVPAQHRAGLRQEAATGVLGVEADLDGMPAQFHLFLPQRQRMALGDADLPGHQVLAGDQFGDRVFDLQAGIHLQEVEAAILAEKKLDGAGAHVVDRSRGLHRRLAHGATQVGIEHRAGSFLDDLLVAALHRAVAFAEVEQVAVAVAEHLDLHMARAQHGLLQDQFGAAEGAQRFRACGAQLVQQLVGFLHQAHAAAAAAGAGLDHQWVADAFGLAPQGRVVLFGAFVAGDARHPGGEHGDLRQALAAHQVDGFRIRADENNPGGFAGTGEFGVLGEEAVAGVDRLGAAATGGVEDRLEIQVGLRHRCRADAHGLVGQLHMAGVGVRLAVHGNAAVAQFMGGAQHPAGDFTAVGDEDLVEAGHVVRLLEAVALFRGRGSLGPDRLAFLYEGQGAFTAFGAAHRFGELSRRIVQQGAEFAAFAGQQQGLGGGVGVRRAAAQLLEGFLQALFEGIGVGLAEMHQAQAQRLAAVEAGGGEGQAAGLGQADAADHERRDLRRENAEAGFRQAELRIGGGDRYVRHAGQAETAAEHRAFHQRHQQLRGGLGFLQQAAEGAVQRAVGFRPGGAGTGHVLDVAAGAEVPAGAAQHQRPHATVVAHGGEHRAQFADHRQAHGVAALRAVQGDPQDALDGFQQQGLAMRQAHAGFLLERQPFFLPGRMPISLQMMPSMISSAPPPMDTRRVSR

SEQ ID NO: 26292 - protein, 245 aa, Pseudomonas aeruginosa
MPTSTCGAIPRPVGKYGAAGRADERHRAADDPEKGYSALDDQKAREVMLELVATGQLTDPESARGKLLQTAAHLFRSKGYERTTVRDLASAVGIQSGSIFHHFKSKDEILRSVMEETILYNTALMRAALADAEDLRERVLGLIRCELQSIMGGTGEAMAVLVYEWRSLSAEGQAYILGLRDIYEQMWLDVLGEARLAGYCQGDPFILRRFLTGALSWTTTWFRPEGPMSLDQLAEEALALVIKDA

SEQ ID NO: 26293 - protein, 308 aa, Pseudomonas aeruginosa
NGAPDMSPSPVRILFVDDEERILRSLAMQFRRHYEVLTESDPRRALERLKTERIQVLVSDQRMPQMSGAELLAQARERYPETLRILLTGYSDLDAAVDALNDGGIFRYLTKPWNPQEMAFTLRQAAEIASRQGLPAPPAATLAAPLSVLLLDDDPETLDCVGAFCHAGGHRLLRARNLAEALVWLNTEPVEVLVSDLKLAGEHTAPLLKSLAQAHPRLLSLVVTPFRDTQALLELINQAQIFRYLPKPIRRGLFEKGLKAAAEQALLWRGRSLPEVDRLAEVPRDEREKERVGSLLGMLGRLRERLTA

SEQ ID NO: 26294 - protein, 452 aa, Pseudomonas aeruginosa
GRKNRIRPMSRRNASTSPIDSHQAASGTSTTISPSSKSIACSTRTCRVRWKPMRRWARSKRLLKSMFQSIATVENISVSAPMCARGLFITSDSTGAVRRTARPSKARAWKIRSLRVLSRAVWVWVMANAPGSSLKSGCIVIGLWDRVKLDTIGKTDMHLSPESLEAFVQAVSLGSFSAAARKLGKSQSTVSEAIARLEIDLGLELFDRSGRQPQLTEAGRTLLGRVEEVLGASDRLRRVAALLAGGSEPRVTLALSDTYHSARYEARLAELDERYPELEFECLIAEDQDVIAQVSRGRATLGLLAAQPHYPPELGVAAVAERAEFGLFAAVDHPLAGLERVSERDLSEWRLLRLNTYSETGAAINDGLPSSGGRCWSAPNYLLLLEMATHGFGWAELPRWLVSGYANGRLKELPVSGWPRSQAVDVVWSRQRPLGPAANWLLDRLLDRDLPI

SEQ ID NO: 26295 - protein, 364 aa, Pseudomonas aeruginosa
  UNSURE (244): Identity of amino acid at the above locations are unknown.
VAWIDCPAIPNREKGPAHGSSGQHARVPARCRNRQLHQGRGPAGHAAGDGLGGGPAARSATRQPAAASHHPAGPADPRRQRGAGALPPPAGRHGGAGEPVPRRQPRQRPAQGRRAEPGGATADRPGAAGILPPASGHRTGTGFQRPFGGPGAGGRRLRPAGRPVGQQQPGGATPRRDATDQLRQSRLPGRAWRATDASRPRPALGGQVCLAQQRPGVALGVSRGWAHPDPRVAQPGHGEQCGKXHRLLPVRTGPDPDPCLRRARAPPTRRAARGAAAVAGRSDAGVRPVSAPAASVAAGQGIRRLAGATAPRPPLVHDVHLPGAFRATANGRILRQCAPFSIRRERAHVRLPVPHHRRPGFPHP

SEQ ID NO: 26296 - protein, 256 aa, Pseudomonas aeruginosa
GRPGAGRSAGPETVPGEGRQGTLHQLCRGYSRDLAWQGLRGVPRPEIPRHPEHHGDGGEGRRRDGRVDGQRALLRRPAHDGRLPRDAGGLQRAQAVAHRRDRADQHGARGPGGHRPRHRAPGAGVAPRRPGAEGRHGRPGLLGPGSAGAEGRPSGPATGHAGHPPGRQRPGRPAAHPHPAPGPGRRLRLPGDRPADQPGRRPGQGAGGDRRRTGLRRLPPRLPSATVARRVEPDWRRHHPRRRPGGRLSLPQRLGL

SEQ ID NO: 26297 - protein, 316 aa, Pseudomonas aeruginosa
DRCFPRKREVGMLNTLEACLKAVDEILLGKDRQVRLALACLLARGHLLIEDLPGMGKTTLSHALARVLGLSFQRIQFTSDLLPGDILGTSVFDKDSGQFVFHPGPIFAELVLADEINRATPKSQSALLEAMEEGQVTIEGATRPLPEPFFVIATQNPASQGGTFSLPESQLDRFLMRLSLGYPGRAAERSLLLGEARRDLLPRLEPLLDHAALAAFQAEVPKVRASDALVDYVLRLVEATRTQPAFALGLSPRGSLALLAAARAWALLAGRDYVIPEDVQAVLPAVAGHRLRDQADPTGHGGGALVQWLLREVPAL

SEQ ID NO: 26298 - protein, 602 aa, Pseudomonas aeruginosa
RTSPRSVGKTCGWNSSASAGISKVAWAACAMQSWNSPRGSSPMAWRCPAHACNRPAARPSARPACVRWRCSERRDERDSAGRAGLAAGGAGTGDPAAPGLPAAVDRGHVARLRGLAGAGLPHACRLSARLGQAGPGAARRGRGLVVARQPGGPGRGGGAADRRVHPQAGGNEDPPRCAGTGVPRFLRSGGGLPVRRRFPRRAVQPAAGDRVAGGADRIAAERFRQPALADPAAGRRAVAAGAAADAPAVPVLPPPGAAVVVADARQQGGHRTLGEHGARGYRRAWALRRTGVPGPLRGRTAAARAALLARLDHGAFRRTTLGSGAAMVGRGCYALAEAWPRAALRRDHAAQFAALAVRPRRGADRPDRHAPDERFPPAAAAAGRATSVLPSQFLATGAARVQHRSAHALAQPAVADARQSARARPGRATAPGPCATAGTGRGPVAALQPRALRLHPETASDRCRRGGRFPVRHAQRLLRALRRGDGFRPARRGHSCASGGRLPGRRAESGGQLPAGASVRRPRLGRILAAGAGLAERRPDLPGGARTDRTGAGAGPGRGQRVPRRRTAVAVALPWPALAQRHASGLGQPELWLATLGPGLPG

SEQ ID NO: 26299 - protein, 286 aa, Pseudomonas aeruginosa
SRVASARIAPGAALAPGARAHAGWPGRGAGMTGFIDELLAEVIGQQVALMSAVARLEARTDGEALHDLRIALRRLRSLLRPIRGVPGVEELEHAAAEVGWLSGPIRDLEVLLPALAAEGLRDALAVRRPVLESGYVAVLASQPLHRLQLCLDVWPALLRTAQRHAVLDGMHGRVRKRLRRQWKTLRAELADTTYEHWHPLRLRIKRVRYGLEAYPHDCSIPGSLLAPLKAAQSALGDWHDLEQWLLRCQREPDLAPVREVWTARFELARERAGRALSTLQQALAGH

SEQ ID NO: 26300 - protein, 263 aa, Pseudomonas aeruginosa
LVAADSTVCCTVSSVTSRMPTTERVISSATWLCCSAATAICVLLSRICATALAIAASASPASPAWLTQPSALSELSCMNSTASRVPDCRARIIWVISSVESCTRRARLRTSSATTAKPRPISPARAASMAALRASRLVCSAMPWITLTTPLIFWLSSASFWIISAVSWTPWDNPAIDALTRLTACWPAPARRSASCDWSRVSAACWAIWKTVVDISLIAVAVWSVSLCWPSMPWRTWPMLRASAWAPSSSLVAAAATVPTMRW

SEQ ID NO: 26301 - protein, 233 aa, Pseudomonas aeruginosa
PYSARRSPVKQCTTAAGRRSRKSRRIASRRSLASRSWRNTGRCSSTASASCSSRAFSWAGRGEKSRLKSRPHSPTARTRGSSNRARRPRAVSAFQWLASWGWTPAVVNSRPPSSSSPQSCSACSLSARLVPVMTICTTPAARARASSASRSGAKLAWVRLTPISMSCMVPSWNSQRGGAPSIAPDPPGDGWQTACRTIRYNRRSGSSAPGLSTQCLRLQPLSERNLPRLPCSD

SEQ ID NO: 26302 - protein, 141 aa, Pseudomonas aeruginosa
RASRSASSTVACAPSSNTSTAVRRPRGTSPSSSYPSPRTSCLPPCSVAKATWSPPANCCRRTTACRSARARRCAPMCRWCWWRARATGATRAWSSCPGGPSRCRPAAPPRAPSNWSTSAWRNAAWHRSGSKSWTLPWPSRM

SEQ ID NO: 26303 - protein, 127 aa, Pseudomonas aeruginosa
WKWSRQASSASPWSSSPSPNAGPRCCRSCASTATWCWTIAPTWPGTCAAMPAPCARPSTASSPIPARRPTRTWLSSASTGAPTRSATPSARRTASAWKRSVHCCSATRGRAAWTGWRWRRWPTRSRI

SEQ ID NO: 26304 - protein, 245 aa, Pseudomonas aeruginosa
SNRLRMSRVISRLPLASTLKLPSTLVPLKEVGSGATLAGMTWGAGTASPAEAAGGARSAPACGLAGGAVSGAGEGSSQTNQARLAANASGISRRIFFTRGGFRERAGAEAPAGVLQAGVLQAVGVLAVDADRAGLEQAGEAEDLVHLVQVVHPVVVADHHAQVRTAGADQAVVGGAVLEGQRRGAEEGVARIEEVGQRRGTAPGVIAHAVDLVGALAAGRGGDALRVLGVEARGPLAVQRLQRAQ

SEQ ID NO: 26305 - protein, 262 aa, Pseudomonas aeruginosa
VTGRSVRVPGWKTMKKFGWKLSHFTLRRLWTWTSRFCPATLKVSRSPTWIRRLAASFSSTDTPGRAPGCGALHQRPAVSWLPEGSRSDQVRPRSRCRARSLRTSSSSAWTGLPFTATRRPGTMGNSGSAPGESFCTRRSKASFSVGRMFRAKWLGASGGNWACQVSSSSPRSRAIRAIASRIRPKARLCPAAASGCRNNWPSPSRHGRLARASARRRPFRPSSRRAPSTSVATRPPPSRARVSFRSRLNRHMIRPRASRAQA

SEQ ID NO: 26306 - protein, 170 aa, Pseudomonas aeruginosa
SARRWRCRGCRWVRRRTARPAAPRRHGQWRPVAARRRRAGADSGPGVGRGRLAQAVLWRAGERRRGLPVPGAASRSPAHRGCRATGTTGTRSLHGPRGRAPAGPRRGRRGRARRDGPRRRWAGRARRAGRAGSTCRSRSCRRSPGCRRGRGRGRGRGGWSTCLPRYRQPC

SEQ ID NO: 26307 - protein, 110 aa, Pseudomonas aeruginosa
DFPGIPLSAKVAHPQEPPMPRPAWTLYAYQLIEPDDQLDLFACREVRVHVVARQLELDTPADRTLCGKLLPAQPRWQPLERARLRDRLLCPDCRKQLEAEKRGERLSWLV

SEQ ID NO: 26308 - protein, 117 aa, Pseudomonas aeruginosa
TAGHEEERRMASWDIFCSVVDNYGDIGVTWRLARQLAAEHGQAVRLWVDEPQAFARICPRADPVAHVQCLDGVEVRAWGPAVGTGGGRRCGDRGLRPANCRRRTGRPCASASGRPCG

SEQ ID NO: 26309 - protein, 413 aa, Pseudomonas aeruginosa
TRSLLHRLGRSMSLSLSLAEARRLALAAQGFDGRRTRRSVQRRHLREMLARLGLLQIDSVNALVRSHYLPLFSRLGPYSMTLLDEAAWSVGRHRQLFEYWGHEASLLPLEHYPLMRWRMRQAADGQGIYQQLARFGREQQPLIRQVLQAVREQGALGAGSLSTRQERAGPWWDWSAEKHALEWLFAAGELTVAGRRGFERLYDLPERVFPAELLARPELSEAQAQRELLRMAASALGVATEKDLRDYYRLSPAQSRARLAELVEAGELLPVRVEGWSQPAYCPGEPQVPRRLGASALLSPFDSLVWERARAERLFDFRYRLEIYTPKEKRVYGYYVLPFLYNGRLVGRVDLRAERARERLAVHALHAEANGMDDAALHELAEQLRSMAAWLGLATVAIEGRGELAVRLRGVLL

SEQ ID NO: 26310 - protein, 286 aa, Pseudomonas aeruginosa
RLWRYSRYRTMSLAISWLPAESTQLAAGSRCSPPVPRETLSIEAIDIHPQRAQGKAAVLDAHPAAARAAGEEQWQQVLVAGVVARRPGRLPAVVVKRGLVVGLELFHHPVTELPRPGRDGFRPGAPVQFAQVVGDAAGTDQQHAFPAQLAQGLADAALQGRTEAARQGQLEHRDVRLRVHQAQRHPGAVVEWSLWVGLGRQAGGLEQFDRPLRQRRLAFGRVAHGVEGRRKAVEVVPDIRRRGAGYSQVVAFPVRGNHQDRLRPRQLCSQAAQLYAAGARFEGEHR

SEQ ID NO: 26311 - protein, 198 aa, Pseudomonas aeruginosa
DLLAMLVIAQTAFRHHDAARIALQQARRERLFEPGDLARNGRRRGPQRLGGLGEAAVLHHADEGPDTLQQVHFQLLRRSAPGAVSARRRVGRWAPAAAQRLVEVDQGQRHRFVAGDLLFLVVQQLPLAVEHAEEVHRAGAVLLAGALQGAAVLRHGFAEALLAALVGGVVVHRVVDFLPGTQHGALVVDGGFLLLCLA

SEQ ID NO: 26312 - protein, 470 aa, Pseudomonas aeruginosa
LQASAQASAFEDRQAERRADGELAMVPVAQAGQLQGFETEVAVERDARIEVRLGHADAGGSGVQARFGTTDVGAALGQFGRQADRHAARRTRNRPRRAEFGEQAAGAGADQVAEGVDQVRLVLFHLGQACLHAGHLGQRLGYLEVGGDAVGQARAGEFQAAPCGLEVVADDRRTVLFAAQLDIVARGFRQHRDLHVAQFVLAGFHRRVGGFQLASHAAPEVQLPGGVEAGQGVVVVAFAGLAGGIEQAGAGGPLALVGAAGVHRGQGVTAEAATDRAALLQARRGAAQVEVGTLDPLQQGVQLRVVEQRPPLGCERRGGEVAGVAGSGLERPFAGRRAVRAGEVGAEAAGAERKAGNKQERSAFHCWATSAERVPVAVSIRASTDMPTRNLPAMAWRGSRTIFTGIRWTTLVKLPVALSGAIGAKLRPVAGAMLSTWPRRTSPGKVSTRISTACPGETWVSWVSWKLPTT

SEQ ID NO: 26313 - protein, 195 aa, Pseudomonas aeruginosa
ARWHAQGAVFRSPRRAFAALLDCVRGAFTRTGGCRRMPVHALSEDLPMFHTLLVAIDGGPQTRRIAELARQAAAPGARVHLLCAVDAGYALPGRPTLLDYPPAAHECEEARQVLDEACALLAGCELEVRAELRAGDPVQVILGEARRLGCELIIIGHRHLGRLERLLDPSVGDRVIREAPCPVLVEVREGDAQGS

SEQ ID NO: 26314 - protein, 186 aa, Pseudomonas aeruginosa
ANTVEQAAKSPLDRGLAGCNADDRLASIRSTHDTCGPSPGKGSAGHFSDREVEPMSKIDKPLDSWREELTEEQFHICRLGGTERAFSGEYHATKTPGIYHCTCCGTALFDSDAKYDSGSGWPSYFQPVDAEAVRELDDFSHGMHRIEVRCGRCDAHLGHVFPDGPRPTGLRYCINSASLKLVPRES

SEQ ID NO: 26315 - protein, 197 aa, Pseudomonas aeruginosa
RATTRLWFGSFFIQSICVQLNCELLCFETHPQQGRQAMSDSLLSIPCTTIKGEQKTLADFGGKALLVVNTASKCGFTPQYQGLEALWEKYRERGLVVLGFPCNQFGKQEPGDEGEISQFCELNYGVSFPLFRKIEVNGAGAHPLFVSLKKRAPGLLGSQGIKWELHQVPDRARWASGEALCADHQAGRAELGDPGAA

SEQ ID NO: 26316 - protein, 163 aa, Pseudomonas aeruginosa
MSTRGKVARPDGVEESLLLDNQLCFKLYAASRAVIRGYRPLLEQIGLTYPQYLVMLVLWEWHASPPEQPTVKALGDRLLLDSGTLTPLLKRLEQLGLVDRRRASHDEREVHLTLTVPGITLRERVIPLRQQLICSTGFDLNEMFDLHQRLGGLLSRFRLVVGG

SEQ ID NO: 26317 - protein, 506 aa, Pseudomonas aeruginosa
PSSRGRLVARGERAPTVEDGFQFVAVERLGQVVVHAGGTTTFALVRQGVGGQRDDRQAAPASAVADLPGRFVAVHHRHVAVHQDQVDGMLLQHLQGIQPVFGDPYLAAELVQQALGDQLVDRVVLHQQDPGVALFSRGVRGARRGYGSVFEHVFQGLVQLVATQRPGQLAQRRQAAGQLRFEETAVGGDQQDRRTDARTQSHQTVRAIRYQYVERVAEQAVVGLQTLVLQAPARQPGLQQLRQPAVGRALRDHPAAQRQRLQRRADRRQRQADAEQAAQADRRLHRQLALHGLAQLAREGQAEACAAVLAGDTRVGLGERLEDAIQRLLGDADAGVAHTDAHTLGGGFHANVDPPQAGELQRVGQQVADDLANPRRVAGNLGGQGGVDQAGQLHAGRGVLREEAGGVFHQDAQVERDLFQDQLPGLELGEVEHVVEQFHQHLAGVVGDRQLLALFRGERAVEAQREHAEQAVQRRADLVAHVGQEAGAGLGHIESGLAGFFEFLVG

SEQ ID NO: 26318 - protein, 410 aa, Pseudomonas aeruginosa
RLPAAAGGQPRPAPGRPAGRRAAARATGTQHPPVRRRPAGQPRLALGGPRDRQVLPGSCAAGRAGRRRAAPDRDRARPPGRPAARGRATARPAAALRTVLRRPLVRCRGRRLPGTQERARRLAGTGAGQCAALRHLQPPAPGFGEAERQRELEDGGRRAASQRSGGGQDRLVRPFRPVAVVLSLHPGAFPQRGSPLGGRARGEGRAGLELERGTGEGSDPLGAWPRQPQRPLRLSVLPLLGGQATAGAPGMIDLQQSGAGLAGYALLAAQAEALFADERDFIANAAQFSAFLFHELGDLNWAGFYLNRNEELVLGPFQGKVACVRIPFSKGVCGAAARTRLTQRVDDVHAFPGHIACDSASSSELVVPLLKDGRLVAVLDLDSPSVGRFSAEDQAGIEGLVEIFLRLTDC

SEQ ID NO: 26319 - protein, 658 aa, Pseudomonas aeruginosa
QAASGLSPRLRSLMMTLSDLTVRQAKAAEKTYSIPDTDGLGLVVARTGGKSWHLRYYWLGKQKRISLGNYPEIGLREARTLRDEARALLAKGVNPHTDRKQKRHAVKLAADYTFKAVFDAWVEHRRKEIKEGRNSTLSQILRIFNKDVLPSLKQMSIYDIRRPQLLGVLARIEERKAFTTAEKVRTWLGQLFRYALVIVEGLEANPASDLDVVAEPKPPVNHNPYLHLPELPDFLHKLRLYNPRGWQTQLGIRLLFLTGVRTGELRLATPDQFDLDRGLWIIPPQIVKQLQDEMRKAGKRPQDVPPYIVPLSVQAIEIVRYLLGVMRPAQVHLLTHRSELKKRISENTLNAALKRMGYEDQLTGHGIRGTISTALNEIGYPKIWVDAQLSHSDPNKVSSAYNHAKYVEPRRRMMQDWADRLDLLEQGQVEAASAHLTIHIEGVPAMAEEDKPNTIVAAASAASVPPVVAEPIVVTPNDGGITFQRLSQVPPPPTHAPEPEVSVIQREREEMLAIYESPSSLPVPLFGKLAGKSKDQINRELKAGKLLSISLGNRGQRVPDWQLVPLKHKLAQVLMNQCPHADPWDLYRMLTRPHPDLGDRAAIDIVTPGNLGMVVRVIAGTQQQPNRPGPDSSVQGIPEETRQRIQRLLNDAAMLESA

SEQ ID NO: 26320 - protein, 157 aa, Pseudomonas aeruginosa
RGVTPDVQATPDNAISEVICTNLDYAQYSCAPKRGVSMASDTSLIAEQGVATLPDAAWAQARQRAEIIGPLAALDVVGHEAADAAAHALGLSRRQVYVLIRRARQGAGLVTDLARSRSGGGKGKGRLPESVERIIRELLQKRFLTKQKRSLAAFHRE

SEQ ID NO: 26321 - protein, 215 aa, Pseudomonas aeruginosa
GEDSADFGGVGDVAQFQALGIAGADGDGAQAVAIDLHRDTVGGVGEHQDPRGIGHHLDHLAHQAAGIEHRLADENAVVLALVDHDALGEGVRIDADQLADQYLVVDQRGGIEQLAQAHVLLGERGEFLHPALHQQGLGLEAFVLGDQLATAAELVAHAFPGAHRHFRQAVKRREHHPQLATDGLQIVEPGVHHHQADRQHGQHQQANAQRRAFGE

SEQ ID NO: 26322 - protein, 125 aa, Pseudomonas aeruginosa
TADRGIRSLPYITHGAPPPFQGRFCWRLPMALERSDVEKIAHLARLGLSEADLPRTTETLNNILGLIDQMQAVDTSGVEPLAHPLEATQRLRPDAVTETDHRDAYQTIAPAVEEGMYLVPKVIES

SEQ ID NO: 26323 - protein, 488 aa, Pseudomonas aeruginosa
GRGHMLHQLTLAEIARALADKQFSAEELTRTLLGRIRQLDPQLNSFISITDDLAIAQAKAADERRANGENGALLGAPIAHKDLFCTQGVRTSCGSKMLDNFVSPYDATVVEKLTAAGAVTLGKLNMDEFAMGSSNQSSHYGAVKNPWSLDRVPGGSSGGSAAAVAARLLPAATGTDTGGSIRQPAALTNLTGIKPTYGRVSRWGMIAYASSLDQGGPLARTAEDCALMLGVMAGFDPKDSTSVEQPVDDYLAALQKPLSGLRIGLPREYFGAGLDSRIADAVLAVVEELKTLGATVKDISLPNMQHAIPAYYVIAPAEASSNLSRFDGVRYGYRCDAPQNLEDLYKRSRAEGFGSEVKNRIMVGTYALSAGYYDAYYLQAQKIRRLIKNDFVSAFAEVDVILGPTTPNPAWKIGEKNDDPVSQYLEDIYTITANLAGLPGLSMPAGFVDGLPVGVQLLAPYFQEGRLLNVAHQYQQVSDWHTRTPAGF

SEQ ID NO: 26324 - protein, 630 aa, Pseudomonas aeruginosa
GTPHAMGNRDRAGNPRTARHPIEDLLRQLDRLRRRAEYPSQPGRPGHAGHPAGAQRGGRTHGLPVRPGDRRTDRPAERVRPQELLLPRPAEGLPDQPDGPSHRRQGPSRHHPGRRHHQAHRHHPRAPGGGRRQEPARRLPGHERHRPEPRRHAVAGDRFRAGHPQRQGSRGLRQGDPRPGALPGHLRRQHGRGLAALRLQRLGTTEGPGRIRHPRRDQERQLLPLHREGDQPRDPAPDRADRGRRQGSPGNPPVRPEQGRDPLHARQGRSQRLPLLPLSRPAAGGHRARVPGEAARATAGTAGAEARTLREPVRPVRLRCQRAVRQPRDGRLLREGPGHLRRRQAGGQLGDGRAGQPAQQGRPGDRAVPGVRRATGRHDPAHQGQHHLRQDRQDGLRSHGQRRGFRRPDHRGQGPEAGHRQWRHREDARRGAGGQRRAGRAVPRCRRGQARQDVRLLRRPGDEGLERQGQPAAGERVAEEKARSVSQSQTPGSPGVFLSARSLLSMPTPSAAARLALAVLPLFLAGCSSLAGSGSADTGEASYYGSRHAGLRTASGERYNPNAMTAAHRTLPFGTRVRVTNLDNRRSVVVRINDRGPFRRGRIIDVSRKAAEGLGMIRSGVAPVRIESLD

SEQ ID NO: 26325 - protein, 304 aa, Pseudomonas aeruginosa
YKELPNVCDFPPGRRRHPLRRQPLGRRRGSAALQPGLAARRSQPAGGPRPDAGHPLQRKPGQRSGQARRRDHQRPQRRRRRRAQGQGRDHQPGQSQQLSGLRRQGPEDHRLARARRAAPGKLRLRRPRPAFRRPAGQAEDGRHGLQHRRCDPQEERGPIDERRRGRVQGARPVAHRGARRQGLQAGQPEREQRRRTAPVPGDADGGDEGRRQLRWRPGTGDRGRDQPGHGQRRRCDRGADALIRSARTTRGSLRAASCVSTVSRAANAACVAFAQIRKCDIPFQTDNNIYTEPTSTLAAGTCPA

SEQ ID NO: 26326 - protein, 425 aa, Pseudomonas aeruginosa
KRRHPLRDHSLAARRSAGRRRSPGLRQQPDLLLGRQPGRLRSRPVHHRYRFRRRGGNRLQPPDPVRARRHQGPSRPRGKLGRQRRRQDLYLPPAQGREVPQYRLLQADPRIQCRRRAVHLRTHARQGSSVPQGLPHRVSLLHRHGPGQEHRQGREARRAYGEVHPQRGRRGLHPEPGDALPIDPVRRIRRATAQAGQGQRHQPEADRHRPVRVQPLPKGCADPLQGQQGLLEAGRGEGRQPDLRHQHRRLGARAEAQGRRVPDHPQPAPRRPRRAEEGPEPEPAVAGRLQPRLHRLQRHPQAVRQAGSTPGAGHGGEQEGHHRRRLPGRRPVGEQRHATDPVVLRRDHQGRALRSGQGQGAAEEGRRRRGHRDHPVGHAGTTPLQPQRQADGGNAAERLGEDRYQGEDRHLRMGRIHQARQGRRA

SEQ ID NO: 26327 - protein, 549 aa, Pseudomonas aeruginosa
GRSSDDALRKRKNEVCMRKILPLRAWLAAGLILGSPFSHAASNLVFCSEGSPAGFDPAQYTTGTDYDATSVTLFNRLVQFERGGTRAIPALAESWDIGDDGKTYTFHLRKGVKFHSTDYFKPTREFNADDVLFTFQRMLDKNHPFRKAYPTEFPYFTDMGLDKNIARVEKLDEHRVKFTLNEVDAAFIQNLAMDVASIQSAEYAGQLLEAGKPQQINQKPIGTGPFILSRYQKDAQIRFKGNKDYWKPEDVKIDNLIFSINTDAAVRAQKLKAGECQITLNPRPADLKALQEAANLKVPSQPGFNLGYIAYNVTHKPFDQLEVRQALDMAVNKQAIIDAVYQGAGQLAVNGMPPTQWSYDETIKDAPFDPAKARELLKKAGIAEGTEITLWAMPVQRPYNPNAKLMAEMIQADWAKIGIKARIVSYEWGEYIKRAHAGEHDAMLFGWTGDNGDPDNWLATLYGCDSINGNNVSKWCDAAYDKLVKAAKRVSDQDKRSELYKQAQHILKEQVPITPIAHSTVYQPMNKSVHDFKISPFSRNAFYGVANQP

SEQ ID NO: 26328 - protein, 575 aa, Pseudomonas aeruginosa
CTRPARTRSTAASTNCAWSAPSPSTCCKPATTGGPGDGAHEEDPMLHPLLRHLPLALALCAAGAAQAKNLVVCTEASPERFDIVQYTGAVTADASAETVFNRLLAFRPGTTEVIPGLAERWDVSADGLSYTFHLRPGVKFHTTDYFKPTRSLNADDVLWTFQRALDPKHPWHASALRGYAYFDAMGMGELIKSVEKVDELTVRFVLNRPEAPFLRDMAMPFASIYSAEYGDQLLAAGKQGQLNNQPIGTGPFVFKRYAKDAQVRYTANPDYYAGKPPIDNLVFAITLDPNVRMQKVRAGECQVSLYPKPEDVPRLKQDPNLAVDEIDALLTTYIAINTQHKPLDDPRVRQAINLALDKKAMLDAVFGPGAASPAVGPYPPTLLGYNHSIQDWPHDPERARALLKEAGAENLRITLFIRNGTSPTIPNPALAAQMLQADLAKAGIQLTIRSLEWGELLKRSKAGEHDLSLLGWAGDNGDPDNFLSPNLSCAAAESGENQARWCDKDFEALMRKAREVSDPAERAKLYEQAQVVFHEQAPWIPLAYPKLFNVRRNTVQGYVINPLSNNNFATTSVKP

SEQ ID NO: 26329 - protein, 641 aa, Pseudomonas aeruginosa
FHCTTIGVADPHLLRRDAAHLRADPPDSRRPGGGDDGRTSRRSADACRGPAPPGPGQAVVPAVPGLRGQPGTGQSRRIADHPRRRLARIPHPVPGDPGTVPGRHALRRHLRSAGRGDRRPETRFAVRPRGDDGVPRRLFDADLLVGPDPDHAVLRVAGLDAGVRPSRPALRHRAEDRLHADRHPAFRRTGLVPRCRAPPDPAGHRAGHHPAGGDCPHDPLGDARGVARRLCAHRPRQGPVAGPGGLRARPAQRADSGADGIRPAGRHAARRRGADRNHLLLAGHRQVADRRHQPSRLPGGAERHPAGRHPGHLGQFRRGHPLRPGQPAHSPPTLMSQPMNAMHNAPASDPSLVYPSPLKEFWQAFAHNKGALGGLLFMLLIVFCALFAPWVAPYDPSEQFRDFLLTPPSWLEGGQARFLLGTDELGRDLLSRLIHGARLSLLIGLSSVVISLIPGILLGLLAGFSPNRAGPLIMRLMDIMLALPSLLLAVAIVAILGPGLINTVIAIAIVSLPAYVRLTRAAVMTELNRDYVTASRLAGAGTLRLMFVCVLPNCMAPLIVQATLSFSSAILDAAALGFLGLGVQPPTPEWGTMLASARDYIERAWWVVSLPGLTILLSVLAINLMGDGLRDALDPKLKNAA

SEQ ID NO: 26330 - protein, 345 aa, Pseudomonas aeruginosa
TAHPYPRHRRPPHEPPRYQEPQRALRRHHRRARGRRPRPERRQGRGAGHRRRVRLRQVGDHDGPDGPDRRPRLGIRRSPALRRPRHAHPQGPPAPAHRRQGHGDGIPGPDDRPQPQLHRRLPDRGSPPPASRPARQGPAPARPGTARTGRDPGRRQPSRRLPAPALRRHEPARGDRHGYRRRAQAADRRRADHRPRRDHPGADHGAAAEPAARPGHGADPDHPRSRRGRRDRPARLRDVRRRSGGNRRRAGAVRPPDPSLHRGADQGDPRALCRRSPPGHPARHRSGALRPPARLPAVATLPLCPGALPPGAAGPGGTRARRGALLLSVEPAERGGLMETGSDRP

SEQ ID NO: 26331 - protein, 570 aa, Pseudomonas aeruginosa
SDPSLRSLPRPVQGPRPGARAERRIVRTGSRQDPRRGRRVRLRQVDPGARPDPDRGTHLRLAENRRAGGQGRQQGPAPAVAPRRADGLPEPLRLAQSATEDRRPVGRAAADQHRAVARGTPRKGPADDAPGRPAAGALPALPAHVLRRPAPAHRPGPGDDAATQGAGGGRADLGPRRVDPGPGTEPFHGPAAAVPHRLRVHLAQPGGGPPRRRRRPGDVPRPTGGDGAGGQALREPAASLYPCAALGDPGDPPGPDEAEDPHPGRTAEPAEPAGGLRLPQALPLRHRALPQRGARAAPARPAPGGLPPRRAIPRLSATGRSPPRSPSELAQQRQPYPEPYQQPTEAPLLQALCPRPGRQPAAQAATGQRIGAVEGQANQNQDRTERGELDGQRTGPGADELRQQHRTEQQGLGVQQVGQESAQQGPAVGVRDHRRGARVAGRQGQSATAQHLQAKPGEVGGAEQAHQVEGPGSGTEQQRQSSRGHQHMAGPSQRQAEGGDQRRATALAGAGLEQQEHVWSGHQVNHRQGNQESARVHRIGSRKVTRITILCPQGRAGACVFHQPIHSIWQ

SEQ ID NO: 26332 - protein, 170 aa, Pseudomonas aeruginosa
IPLSGDYPSGYAKMKLDAYDHRILAALQRDGRLSNVQLAEEIGLSPSPCLRRVRLLEEAGVIRGYQASIDRDEVGLGLTVFVGIKVERHRQEQAEAFHRAVVDLPEVISVHLVSGESDFLLQVVVPDLRAYERLLSETLLRLPGVSDIRSNFAIKTVKAPSPLPLGHLAG

SEQ ID NO: 26333 - protein, 202 aa, Pseudomonas aeruginosa
FARRWRRRLAGWLRRRPPHRRRAARARAAAAGSPAGNARARWHPTDTPLPLRHTAGNRPPPGSGHRPVNRRARREPGRRRCPVPASPGNRRRRPGRHAARPRRSPVRCVARGGPGSDSRAGIRDRPPSAPDALRSTPARSPPPCTPAPSRRKRFPAMASPRDYRADDWPRLPPGGPEGRQRIRRGAASRAGRRPAAGFAVPP

SEQ ID NO: 26334 - protein, 266 aa, Pseudomonas aeruginosa
RPANHSFAPAQVEEVLAPDGDEAHPVAQRQWARRSGGRIERTPRTASQQVPAAGRGLRIDRRLRLGNGQAAGRYTRPRGGPPRQDQARIEAAEVGESRSETDRADPVFGRAVQFDHSFASQSAGNRYRREVLAGVPDGNLVQAPGILGGAPGVPLRQQRTQAFFQYLRGDAVGVVMQHQGGPARHQIPDAFAEPLAQTSGQLGQAHRQVHFGLFGERQQQGFGTSGFDADHRLSRAARRRRRTASDCGLSPCTQRLSAVRRSGLPS

SEQ ID NO: 26335 - protein, 196 aa, Pseudomonas aeruginosa
RSRNLLQIRIVINYYGFAFDRNLHSLQFSHYIFSHLARLEHLAVLHDQCKSISLAIISPSWTAPCCCIFPPSSPPRKSPGSAQPWSRRNGPTARRPPATNRPRPSTTCNCRRTTRWPGRSAKPCCSACGTIPCSCPPPCRSRSSRRYSTAIPAGARSTSTSTTPCATSMAAASGSVPTCPRPSSSATRRTMTAANW

SEQ ID NO: 26336 - protein, 625 aa, Pseudomonas aeruginosa
QAFPYPRRFIEASDDRASGPSYEAIVSPTPPSVTRNRIDWAGLGWLFLFFWFFSGITQLLLLTSGNSGFSGFRNAMVLSTIWLAPVLLFPRWTKPLAAVIGLVLWAASLVGLSYFGIYHQEFSQSVIFVMFESNTAEASEYFSQYFNPWMTLGLVLYSLVAILLWRRLRPVYLPRFSALPVAVLLIVATIGYPFYKQLVSQGRPFDEALDKVQARMEPAVPWQLLIGYQQYRQQLGSMQALLQKNAALPPLKNLVDANGDTPRTLVLVIGESTSRKHMSLYGYPRETTPQLDALKAANRNLTVFNNVVASRPYTIEVLQQVLTFADQEHPDRFLTDPSLMNLMKQAGYKTFWITNQQTMTKRNTMLTTFAQQTDAQFYLNNQRSQNASQLDGAVLAPFAKVLDDPAPKKFIVVHLLGTHMNYKYRYPADYARFVDRQGAPAALSDDQVEVYNSYDNAVLYNDYVVSSLIKGFANSDPNGFLVYLSDHGEEVFDEAPHDRLGRNEGDPTRGMYTVPFLVWTSPSWQQTHPRDLQALVDRRYSSEDLIHTWSDLAGLNYDLFDPTKSLVSNDFQHEVRWIGNPYAHNGLRDFDKLPLDKADAGQQVAQAGRPAPTTPRAPSRQPNEG

SEQ ID NO: 26337 - protein, 361 aa, Pseudomonas aeruginosa
QWDVPVRPAFNRMDEKRPAQALRLHPERADQAFQLGHLGAQFAAGPFGLAGAFRGALAGLVDLDDVLVDIVGHGGLLLGGGGDLLVLVDDHAHRAEDILQCLLHLRRLVDRAIGGMVAAAHRLHRRIDAALQAQDHLFDLGGGLLGALGQRAHLVGHHRETAPLLPGTSGLDRRIERQQVGLFGDALDHIQHLADRGAVTGQAIDRRHRLVDLAGQALDATHLRLDQAAPAEGFLVHAVRAAHRHRRAACHFLGGSGHLVHRRGHLLDLAALPGYRLVAFGRHRLDAQGLPLDLADGLADPLDQVVDLRHRFVERLSQLAQFVTAAGLEADRHVAAGDALHHSPEILQGGAGGNVETAVEV

SEQ ID NO: 26338 - protein, 305 aa, Pseudomonas aeruginosa
LKVNGESQADSPSLRSEEQRAEGEHGVPEHGRAHQQLPERIQAGDAGGTQFDRFDIAGDPSGLAQQRGRRDVPGQQPVQQHADNREEVADQGEAQHQRTHRQPVEDMPDARRLFAQRRLAGVLQRQCQQAIGQGRHRAEQGIPEDHCEEALVALPEQMAVHPADQFALAAAQDPQIAFGDMEGSLGLLAPPGVAERPEVGHDVAAAETVDHHQKMQRKAQPAIGQRLQQCQQQGQRQQRQDYREQQPQPGAAGHRGQILDQAQPGEPGAIALDTPAPAGELLQRKGQQQHQERHVSSLESVNPAR

SEQ ID NO: 26339 - protein, 438 aa, Pseudomonas aeruginosa
  UNSURE (174): Identity of amino acid at the above locations are unknown.
RPVGRITAASLQRSLCSASSWISTQLPTRSASTRSSASSLSGRRTSLSTGAGAASGEVRTISSTTRSMTGARGFSAAVPGLASSSRGLSATAASPRLSRCRPWTCRVSSWLKNSPVENGSKGALANPSRSALSRPGTRSSNCWRDSGSSCGPTLQISWSMVSRASRHSAEALPXLRQISSITLLQASRSRRTTTSGRTLPSSRWFSTCSTSCRASSALARPSSASRVPLLEELAAAALVAGEGNEVLQQLGEDRRVVDEVVQQPHHDLFDLLVQAVAPGIIVFGPAQRRGCDLVEQATRRMATAAEEGLVEQGHLEHRDLHPTDQGLQRIRQGAVIENEFEQHRHQVDDVIVHLADHPRTAALVADPLEQLVDPVADVELRGAGARQVLLQVGKQAHQVVAGNRRGILRRFATVEGRIVADLRQQFLQRAEDFLLAAL

SEQ ID NO: 26340 - protein, 291 aa, Pseudomonas aeruginosa
SPDLVQEPAMPNLTLADLQGEIQANVRTALAEDVGGGDLTAQLIDPQREAEARVITREHATIAGRAWVDEVFRQVDPRVLVTWQVEDGQRVEPNQMLFQLKGPARALLTGERSALNFLQLLSGTATRSQHYADLVAGTAVKLLDTRKTLPGLRLAQKYAVTCGGCHNHRIGLYDAFLIKENHIAACGGIDRAIAEARRIAPGKPVEVEVENLDELRQALEAGADIVMLDELSLDDMRTAVALTAGRAKLEASGGINESTLRNIAETGVDYISIGTLTKDVRAVDLSMRLTL

SEQ ID NO: 26341 - protein, 342 aa, Pseudomonas aeruginosa
RGKVHPGGYQRRSGRRSCSTFRQQDAAGCHKGWLFRPALRALREDLPGALPYRRHAPRSGQAADPVGQPYFRATQGDGRPGHFRTAQTAGRTDQDARVEEQVHRLPRQHPADPVGREDRDADPRLLQRTNGHRRPRLRGGPEGTLPGRTQAATGHDPGHRPHRLGQDGIAIHRPEHPQYHRHQHFHRRRPGGDQPGRHQPGQRQPAPGHGLLPGAARLPAPGPGRDHGRRDPRPGDRRDRHQGGADRTYGDVHPTHQQRRRDPDSPAEHGRAGVQPGDLGEPDHRPAPCAKTLFALQERTRGAEGNPASRGLSGRQDRYLQALFAGGLRPLQERLQGPCRYL

SEQ ID NO: 26342 - protein, 336 aa, Pseudomonas aeruginosa
GGSRQCRRQSDNSHGTYDHGRARRTGRRPDHRYVSTDLPTGFRCVKMELLDYLASHPLAFVLCAILLGLLVGSFLNVVVHRLPKMMERNWKAEAREALGLEPEPKQATYNLVLPNSACPRCGHEIRPWENIPLVSYLALGGKCSSCKAAIGKRYPLVELATALLSGYVAWHFGFTWQAGAMLLLTWGLLAMSLIDADHQLLPDVLVLPLLWLGLIANHFGLFASLDDALFGAVFGYLSLWSVFWLFKLVTGKEGMGYGDFKLLAMLGAWGGWQILPLTILLSSLVGAILGVIMLRLRNAESGTPIPFGPYLAIAGWIALLWGDQITRTYLQFAGFK

SEQ ID NO: 26343 - protein, 164 aa, Pseudomonas aeruginosa
ACERRAGEVDRRALRQPRADPGTGGGGGTARPGTDRRPPAPAAPGHPGAVGTHRGPRYPAGQAAVAQRDAPQHRRRRHQPAQPEGPSLPPRRRAAGNHWLVPTLRTPGKAHRPPHTEERARTGRHHRAGDRQRSDPPRRSAGDRAPCLSRMTDIENGGLPCPAD

SEQ ID NO: 26344 - protein, 269 aa, Pseudomonas aeruginosa
AGQLPPAGPGRRRPEPGDRPQRQRYPGADRCQRQGLPGQSQRRGLRQVRPGQCRRPGGFHPGPGRQGLPRRQLPVLRRLRRNRKQCRQPASQRRRQHRPAGRPGQQRRRDPGATRRRGPGRRPGHQPQFRRRRPAQPAGGQGLGRRSRTQRRPHPRRWRPGADERPQRRQPAQDRRQQPGHSRGQDATQRGRTHRPRRRRTGDRAGGRQAGRQRHRRRQWRPGAEPGRERRDTANRAAGHPCRPGRNRHLEDSLARGQRSRCRPGKRCR

SEQ ID NO: 26345 - protein, 328 aa, Pseudomonas aeruginosa
PGRRQPRSHRQCERQRHPYRRGLAAEQPRRAGRAEPGQHRQRQRQRHAGRQPPNLCSGRTRSRKHQHSQGRGQHLQQPGRFCHLRPVEGPCQPLRRGGPGRQEPRRPHPQQRQSGNAVAERSRDEPGRTGRIQLRRRTGGRFRLRRRLRQRTARPVRWAHRPQRKQWYRPRHGQRQGPGHRRGSTGRADRPEPERGHQQRQRPWRCQPASRSLPGRPDRPQPGRQPGQRQCQRQPEWWVAAPGRRPDRSQRQCLAGQCLRQGQCRYPRSRSGWRSARRKPVRLRHQRFRQWRSHRRQRQNPGWPDRVQPRRQSFQPEGLRVGKRRGEQ

SEQ ID NO: 26346 - protein, 258 aa, Pseudomonas aeruginosa
PGRPATGRRGKCSAWHERGGAGMKPMDKQKVLAKVEKLMALANAKGATPNEAETALRQAAILKRQFDLSEAEISAHTVETACVPTRTRRSPAQWLHELAGICASSFGCDYLAAYAMPAGWTFKFMGRGIGPELAAHAYSTLHHQLVAARSAHVAQQKRCKLSTKRRRSKLFVEGWLLAVRSLVRDFAGRPDESTQAAIKAYLELHHPELKLLEPAAPTKPLAYDQASLHAGWEHGKNTRLHRGVSRRVQGALEQGGSR

SEQ ID NO: 26347 - protein, 92 aa, Pseudomonas aeruginosa
RAQSASSASSSAPFRRSSMKNKIEDLRNHLFATIEGLLDEDKPLDIERAKAVAHVGSVIIESAKVEVKALEIIGAPGSSGSTFLQIGQEDSK

SEQ ID NO: 26348 - protein, 89 aa, Pseudomonas aeruginosa
GGRIMKASQTYQCIVKFDGAGFWTNTIQKQRATCTWSDKVAASRLAERLFGEDNAYITRMPAQAGDHEKRIESRWELSCKDPKEVARDA

SEQ ID NO: 26349 - protein, 371 aa, Pseudomonas aeruginosa
QGLRPVAGNPGGQAHPQPVPPLHRPRRRPVDQLRGAPAGLQDRVRRGARHTPDQQPPHSASRPAQAPQGGAGEHVMKGVRRPILRYHGGKWKLAPWIIQHLAPHHTYVEPFGGAASVLLRKARSYAEIYNDLDGDVVNLFRVARDHGEQLRQALALTPFAREEFEASYAETSDPLERARRMVTRSLQGFGTAAASGERTGFRSTSTRSGTGPALDWRNYPDTLTAITERLQGVVIENRDALALMEYHDRPNTLHYVDPPYVHSTRSTKVRHNATGKSYRYELDDNQHKELAAFLKRLRGMVVLSGYPCPLYDELYSTWHRVDRHAYADGSRERIECLWLNSAALEGLAQLDFFQASNASPSPSFQTTVAQY

SEQ ID NO: 26350 - protein, 106 aa, Pseudomonas aeruginosa
RTDRTPDLVPLGAPDAGKPGPPRGQHGVAGHRDDPHRGSQRRSRTRQSRVHQPRHRLVSHPELVERQPLPTKQERAGQARHPLPGQRQRSPPLAYGSPATEPPLGD

SEQ ID NO: 26351 - protein, 461 aa, Pseudomonas aeruginosa
VCAAATPQPGSVRRRYDTMTMRLSRFPISTLLDSASGHLEAHLFKKRLDAESGEPLAQQYSGIIFSGNPHETVPRRLLLDKRLTPLERNCWQVFRLLINDDGLTAFPTYEQLRPYLGMQPGKIASRETIAKALKVLRLTRWLSLGRRLRNDLNGQVQGNVYILHDEPVSPAEALELDPDYMQLLSQSTGDSNRAIREIGQVTWREFRDDPDVGRRLPTHLEKLEGRLNHQQWAIDSQLEADPAAEFGIRTLPDLPHSTLSSDAELSEISGKQCALPLSSDAEPRQNPPSTPLVRMPNSYSTYTYKQGSVCKKPVQPRTREEAHPNWQGLLHTLEAEQRIQAVSALRRVSEDLRQPIIEQWQHRCAGGTVGNPFGYLMTLIQRAVQGKFNASWAPEEPAERTIPAAERPSRALAPPSPTTPTQPQLQPKGDTRTGNEVLSRLKDLIRPRHGSSVPSERGDEP

SEQ ID NO: 26352 - protein, 619 aa, Pseudomonas aeruginosa
ESLGRASCFLVMRPRITLPGPDLGTGGELGVATGNTLPRIELGAVDELGGATGTTSPGSSLGAVEELGDSTGITPPGTDPSAGGELGVATGNTLPRIDLGAVDELGDSTGITPPGTDPSAGGELGVATGNTLPRIDLGAVDELGGATGTTSPGTDFGAGGELGGSTGTTPLGTDFGAGGELGGSTGITPPGTDPSAGGELGVATGNTLPRIDLGAVDELGDSTGITPPGTDPSAGGELGVATGNTLPRIDLGAVDELGGATGTTSPGTDFGAGGELGGSTGTTPLGTDFGAGGELGGSTGTTPPGTDFGAGGELGVATGNTLPRIDLGAVDELGVATGNTPPGPGLGAVDELGGATGTTSPGTDLRAGGELGGSTGTTPLGTDFGAGGELGGSTGTTPPGTDFGAGGELGGSTGITPPGTDPSAGGELGVATGNTPPGPGLGAVDELGGATGTTSPGTDLRAGGELGGSTGTTPLGTDFGAGGELGGSTGTTPPGTDFGAGGELGGSTGITPPGTDPSAGGELGVATGNTPPGPGLGAVDELGGATGTTSPGTDLRAGGELGGSTGTTSPGTDFGAGGGYQLLPPNRNRKDVRLNRVCPYGRTRIRAAARAGNPIQRQR

SEQ ID NO: 26353 - protein, 186 aa, Pseudomonas aeruginosa
GLIGMRQLDKDQQGALQQSAFRPLQQTAFQALQHSASLKGLLKPFKGKGELAQLAEQCEVLEQGLLELAQGLLAQVRRPPFTLLPTRLIEQRTSARTTFLRWQHIATRRMGVGVWAEMLRQDKTPEYLLQDLYEMELQRITLNMQISLIHSIGKQAAECAEKMGQAEAEFMGRLQQSQTRPGSVGM

SEQ ID NO: 26354 - protein, 652 aa, Pseudomonas aeruginosa
PRQFDRLFREIPPMHLVIIEAPGKLKKLRSLLPSIRPDVTWQVEATAGHIRDLPVHGQDPQMLTVGVGQDFKPHYQILSGKEKTVARLKELRQKAVEVYVASDPDREGESIGWHILQAAGIKNYKRVAFKEITKSCISAELSSPRRLDLPKVASQECRRVIDRLVGYLVTPELRRVMGRPTTAGRVQSVAVYLVVLREREIRAFTAIKHFGVELAFVSPSDGRTWKAEWDPVPTFASKEFPYVQDRQLAELVGAIRNVIVETCIDGEETDTPPAPFISSSLQMAAGNALKWSPDKTMKIAQRLYEQGLITYHRTDNPNISKDSMSDIRAVAKALGLKCVEQQRMFKADQDAQEGHPAITPTDWTAATAGETADEQALYQLIRVRALASQIEAAVYAVRTITLLGVGPDKKPLRFGAKGKLLNVPGWRKLLQGDDAEEQKNETPSNPIPELEPGQILKVYSGEVLEKKTSPPKRFTDASLVGEMKRRGIGRPSSYASIVKNIIDKGQVQMKGRSLIPGELGEATIALLEHNFSFLSLDFTRNLEVALDRIANSEDTYMNVVQQFYQLLQSELQTLRAHPSAQGDPRASSTASAPTAPASDFLCGKCGLPLVHRKKAGKGGFDFWGCSGYRTTGCKVGYPTRNGQPDFDNPRGL

SEQ ID NO: 26355 - protein, 84 aa, Pseudomonas aeruginosa
PGFEPAHSQILEIYIMATRQTGTVKWFNEVKGFGFITPESGADVFVHFRQIEASGYKSLDEGQRVSFFVTAGAKGPQAEQVQAL

SEQ ID NO: 26356 - protein, 430 aa, Pseudomonas aeruginosa
HRQPNPGLKIVQKITSPLDCPAFIAAHRQNPQDFTRRRQLTFKNLVLFLLNQPRTALQTELDQFYRVLNQASTETQMVTAQAFCKARKKLNPEVFESLNRLLQQQIDCFGLRQKWRGLRVLAVDGSTVHLPLESTMATFFGSHSGFPMARLSTLYEVADGQTLHSLIVPLTVGERDCAHLHLEHLPADSLTLFDRGYPGHWLFALFAQQQRHFLMRLPCGYNAQVKAFLHSGQVEDTQLFVANHPEARLFCSEAGVDPASQIELRLIRVELANGESEVLLTSLLDREAFPAEVFAELYHRRWGIETDFRRLKQTLTLDNFSGRSVTAVKQDFHAAQLLKNLALLMQHLLQPVIEQRHKGRKLRWKVNFTQGVSRLKNTLVELLVRHCAQGLSNVLALMAKSLSAVRSGRSFARQRKRAASRGCEGYKPTR

SEQ ID NO: 26357 - protein, 379 aa, Pseudomonas aeruginosa
MAAGAAGTIPSSNIHASVYRNGPTLVPPGALRATVGVTQMIEIKREKKFFALGEMRLENGERLRNARLCYQVVGTPNRARDNLVLIPSYYGGTHWGSLPLLGADGPLAGGDYCVVLTNLFGAGWSTSPSNAAPGQGAADFPRVGLLDNVRAQKALLDRLYGDDWQLALVSGWSMGGMQTLFWAMAYPERMRAILPFCCTARCWPHNRVFLEGVKAALCADAAWLGGRYSMPPERGLRAFGRAYAGWAYSQAFYRHELWREMGFESLEALLDYWEQDHLEQDANDLLCVLHTWQSADPARSFAAGSLAEALGRIRARSILMPGSSDLYFTVEDARHEAALIPGAELRVLESDWGHCAGGPGRSAAAMRQVFAAMAELLGR

SEQ ID NO: 26358 - protein, 298 aa, Pseudomonas aeruginosa
PSAGHGAEFGQLLEVGLHAGGFADPGEDLALELGEFRRELHVLVALGRQRHLVDGIDAPGAWRHQHDAAAQIDGFFDIVGDEQDGALLQPVHVTDQVVHDFAGLRIQRAERLVHQQCRGFGQQGAGNGNALLHAAGELAGVGIGEARQTHQVEQGIGAAGGGLHVSIVAHGIADHLELAAELDVLHHRQPGVEAVVLEDHGAVDAGAVDGPAVEQDLAATQRLQAGDDAQQGGLAAARGADEGDELVGLDVQVDRLQRLHLTALADEGLADLVYTNLGIGHGHFLIQGKARRCNQRKA

SEQ ID NO: 26359 - protein, 130 aa, Pseudomonas aeruginosa
SARAWRRCGGGRRTARRPAAAATTRARRRPAVHADAPSWPAAESAARRRTGSSRPLPAGRPGGLAAPTRAARSPSFAPAIPAGAARFRDSCRPVRLPAAVPGSRSASGRYPQARPAAGSRSGDATGRYRR

SEQ ID NO: 26360 - protein, 330 aa, Pseudomonas aeruginosa
PGLSITGSPARGCSSSIRSWPNSPRTSRRPRGPGLPMAAPVAWARRRLGSGRSERSGRWPSRVCTTSMPTPRAQSSSAWIAAIGARRRLTSIPAWSAYPPSAQKSRCMSITSSAVCSRSSGCVVRLTAQTPCTPRRRCLRRCRGPAAGLSPRWSLWPRTAPRRAAPIRYGWGTCRRAESRPGRRRESSPARPVADGNAASARSRSPRHAPARNRGSLPGRCRSGSARGRNPNAPGALPPARRPARGRAAPAGCPRRRTTGSRNGRAPAPGGAHRGDGTHAPRRAPGRSRSRHPGWWCRRSAGRRRISVATCSRMTAPVPPVRRLVPPRPR

SEQ ID NO: 26361 - protein, 255 aa, Pseudomonas aeruginosa
IGRCQQLRNGLVGEYRRELGAVAAAVGVRHHLQRAHGRIGADPAGAHRVHPNASRAQLPGQRAGQADHRVLAGDIGGKARHAFQSPDGGLVDHAGAGAQAWQQCAGQALHGTDVVLQQGRPALIGLEAALAQRRGVLDAGVVDQHIGVEAAAGEVIGVLLHRLPITQVQCGAVQQRLASEFVGEPGEGVGVTVQQLQGGAGSGEALRQAPADAPGGASDDHATASVIQCLVHVTPPSGTRRPRRRRSCRPCSALR

SEQ ID NO: 26362 - protein, 837 aa, Pseudomonas aeruginosa
RHRSGPTATTGQAAHGGGQPVTAWQGSDRHRRILAQQAVLLEGLPELPGHLGVEVFHVLPGTLGIGRARDDRGDHRVGQAEMQGGGPQIDAAVLGSGLELLPALGDLWWDLVVLIVIATGQDAGVERPANDDANVACLAGREQGVQRLVVLQQRVAAGQQEHVRVALLQSQAAWLHQVDPQAPAANHAFIAQLGQRLRRAVHGLLEVLAPLRAPLVFGNVVDEHHIEAIDAHALQAVLDGAACAVGRIIRHTLVGQLVDEGLGVFRLAGRLQQAPDLGAQDVLVTRLATQQAPEALLGEARAVVRRHVVIAKAGVPGGIEGGVGGFFAERMEHVAQRCAAETDAWQGDTHGVLLRMQMVPTGVGVALHRRSARRWMFRQCDGMAAVQPRRSSSASAATLQIGAPAAKFGDVLGAVQAVGLADEACFPAAVGELHLAQAERCRNAGEKGAELLVRQLPDFNLDGRSAFGDANHARAQRWPAGQGVELVVRRAAGGFQQPSATLPELPVQRQAVQVRSADHQAGAVVAGRIPGRRGNERVTADQLQPCLMLQRIGQAQQVLVGEHPAEQRHAPGQAVVHGGGRHRDSGVVEHVHEVGVVAQVRIALDRLGVKFGERHWARVGGRQHTIDLGHGAVADGLELLQAVLRLEQLHGGCTGGFLQNGFYYRQHGVGLLLDQRARHAVAFGHPGAFVKQACSFEEGGEVHFHRLAAEGFQLFDGGGEQRRAFRAAEKFQVLGYAEAEGLDLAEGRAVITQRVAAAVLVARIEPGGERQQLTGFGRCGREEGHAVQRTAGRDNAGGGDQPFARFQAHQVVQRRRHPAGTGGIGAQREGTEPERNG

SEQ ID NO: 26363 - protein, 1238 aa, Pseudomonas aeruginosa
KRRNLFHRDVRCRPAGPVGGSIKRDPPYGCFGCRGASRLLDHHHPLASAHRRPWLGADFLDHAGDRRGERDFHLHALEDHQHVAGIDPRALGHRHLPEVAGDVALDAELAGAERGVLAEVCGDFLALEVRLARFDPALALGVEGAALLAAEGVDAVGLGGKKVLVVGQAQLGVLDLQRVAAERKIAADSRQLLGRDRVEADLVEEAQQPRLAAERLDRAVAVPHLQGAADELVAARAFHAVDAHVGAADAHRVLRGPGARRVVLGGDQAVARVQRSGHRRTEIHVAEAHHQVAGVEHRAVHRVEVGQVVDAADELQVARAPGRVLAHRGHVLLDGQLAGRVVPGQRQVDDARGHLQILRGAHGIPQAGDDLQEILQRQGLGLVVHLQGADAGGQVDHPIELLGFEGLHQCMTTEAQHQVQLRRADFQQQVGVAGEGGDQAAVRFTDIQHDGRLQSYRRGDHCRRREAGALGIGGLGQLACGQHIHRDEAHLVAGLELAELPQICLDDGHRADEAAQARAVRAEDHRHIAGEIDRADGVGVVVDVRRVQAGLAAALAHPLGFRADQAHPGAAGVEVHFPVGGEEARDVALGEVFRRAVRAVDHPQLAHRRQGAAQLGGEPGAGRRVAQRCQVQHVAGTQGAATVAAELAEGKGALAAQILRHLHAAAHGQVGAGTGAGDGADGQGAAGRDENGGAHRLRDVIELHGDLGASQRHHRIGIEAQDRSAHGDFQPGGVLGVVQQGVAQAQRAAVHRAGRRHAHRPVAEATGEVLHGGLGAGADDLEGVGLVAEALQTTGPGVAAGEWGEGKNLAQIIAVGFHAVDQGVAEGGVQRGAGRFAARRPADDLGDHRVEIRRDLAAGFDPGVDAQALAVGGREGHGGQQARARLEVPARVLGVDARLDRVAAGLETLHQLDQRRQVAGGQLDHPAHQIHAPDLLGDAVLHLQAGVHLEEVEALGFGVVDELDGAGAAVTDRLGQGDCRLAQGLGHAGRQVRRRGFLQHLLVAPLHRAVAHAQGDDVAGAVAEHLYLQVAGTLDVLLDEHARIAEVVLPQALDRVEGISELRRRAAHAHADTTTTGGAFQHHRVADLLGCAEGIGEAVEQLGALQHRYAALFGQGAGGVLEAKHPQLFRRRADEGDPGGLAGFGKRRVLGEESVAGVDGFRAGFTGDAENLLHVQIGLRGRAFAQAVGLVGLLQMQAGGVGLGVDGHAVHIQVAQRTQDAAGNGAAVGDQQFVEHGQ

SEQ ID NO: 26364 - protein, 302 aa, Pseudomonas aeruginosa
RSRGFFALKNSVSTAWLPSRSSRRRVCPALTSNRYGSPAGITWRNAAVSGCRLLSVRLITATSSDVQAFGVVKGTTVFRARGAAEHADAVAGHLMPGQLDRPGRVHRVRVQRMLQGGEDHQGVHRCVQFQVVAGLGVAAMEGEGTVGGDVHPTEQIEHHEQVLQVQVPLAHFHQQVVGAIAEEAIAQFLIAALAVLLHDFIGVQHAAEAVVPAAGVGRDGGEYAPHVRVQAMPGGELGGVLALEGIRQVQPLALLLGVEQHQADVGAAFEIGQTQQLAPLEDEGGVAAARNGFLVQRGADRE

SEQ ID NO: 26365 - protein, 188 aa, Pseudomonas aeruginosa
TPSAGFPATAPAAAHACPCECRGRGRRRARPATARGASSPAPGRWPVAVACRRRAVPGTCPAHGRGRPCAASAQPAHGHRACGVRADDPAAGRAGVPGRGRRCPAPSGAEIPSSAERPRRDWRPVRLPMAGHPAGSRHGWALPGRAAAAGRSTCRNRRHRPGCRTHLRQSSGSGAPAPPGRHTAARHS

SEQ ID NO: 26366 - protein, 306 aa, Pseudomonas aeruginosa
LRQHQAQDQRPGVGAEGLRLDQQFAGYLASTLLEVAGEDRGDADDDQHHLGQLAQPEHDKQDRQDRQRWHHRQHGQQRRQRRTEQRQGASGDAQAEAGHGGDGQPATEALETRGGVLPEQVVARAFVRGEGEAFDSRAHLVEAGQELVVGIDFQALGRAGQVQRQHQGEGQYGQSKPAAAARRSIDQAHGQVPRFATAARTGRVVNGRADTSGHMANPPVFGDGAGAACGSRCSPGLLSRRVTSLEVANSRTSHSRASRNPSRLFRIVAAASPAGSTKQERCQGAIDRCQRLLRWTKAGETPLHGA

SEQ ID NO: 26367 - protein, 430 aa, Pseudomonas aeruginosa
HRQPNPGLKIVQKITSPLDCPAFIAAHRQNPQDFTRRRQLTFKNLVLFLLNQPRTALQTELDQFYRVLNQASTETQMVTAQAFCKARKKLNPEVFESLNRLLQQQIDCCGLRQKWRGLRVLAVDGSTVHLPLESTMATFFGSHSGFPMARLSTLYEVADGQTLHSLIVPLTVGERDCAHLHLEHLPADSLTLFDRGYPGHWLFALFAQQQRHFLMRLPCGYNAQVKAFLHSGQVEDTQLFVANHPEARLFCSEAGVDPASQIELRLIRVELANGESEVLLTSLLDREAFPAEVFAELYHRRWGIETDFRRLKQTLTLDNFSGRSVTAVKQDFHAAQLLKNLALLMQHLLQPVIEQRHKGRKLRWKVNFTQGVSRLKNTLVELLVRHCAQGLSNVLALMAKSLSAVRSGRSFARQRKRAASRGCEGYKPTR

SEQ ID NO: 26368 - protein, 196 aa, Pseudomonas aeruginosa
AAAASRRRAAGAHQPSVPSGCRAQAVDQPGDNSAPSWRGSSDGAASGVAFLEEIHLQRPDQAPGRPDLPGAARRRGPHHQPRNHAQGQPVGLDCHRRNLCELSRSAWPWPCSSSSRPARPAPAPLANWRRSRPRPSSPRPRCVWPRRSGNWRAKAKPARSSAPRGRRSPCRCRRRRRRSRSRFRRWCGPSTAPAAR

SEQ ID NO: 26369 - protein, 176 aa, Pseudomonas aeruginosa
LPHSCSRAGTRLTPPAARSCRATTASSRSPWTRSYSPTRTATACPWASPALPPPKPPPRPKAPPFRRRCPGRYRSRSSSRYRHDEPSNCRACTALHGDPTAHRRRWRVGGLETPARDHGPGRRRHALSIGEPPERHSRSVVHRPSRSPWLPIPAQPHRPADHSPALPRRRHGRPGR

SEQ ID NO: 26370 - protein, 373 aa, Pseudomonas aeruginosa
ASARRQLLLAGGVLMGGFWEQLQFAFYSKQFGRKERLQFYESMSTLLENGVPLKDAVAEVHKIFAHEGQHPFHPVAIASREALMGLSNGKRLATAMALYLPAQERALIEAGEMSGNLVQAMGDAVSLVEAQARIRATIWQALLYPSALSAMMVFLLCIVAYRMVPSLARLSDPVTWTGPLATLNAIASFVTGPGIYVLVAVITLTVVVIVTLPTYRWKGRVWLDRMLPPWSIYRMLQGTTFLLNMAVMLNAGIRPYDSLASMIKISPPWLKQRLEAARYGVGLGQNLGVALRSAGHDFPDRQAIQYLCILANRGGFSEALVKFSRRWQETSLKQIELAAGLVKNFALIFIGALMILVLLGAYQAQQLIQSMNH

SEQ ID NO: 26371 - protein, 183 aa, Pseudomonas aeruginosa
NLTKERSMSTTQRTSRPTQGGFVSIEMIIVLIIIAIGVGLGLAAAAGMFSSSNANEEQRNISVIAANARALKTSSGYGSSGTNLIPSLIAINGVPKNMSVSSGVVYNVYGGSVTVSSTGMGFSITTSKLPKDACITLGTKIAKNTFEQTKINSGTAITGEVTTAAATQACSSDSNSITWTYSS

SEQ ID NO: 26372 - protein, 471 aa, Pseudomonas aeruginosa
IARLAKACGSLSMNNLKLSRGFISIELMIALIVIAIATTGGISVLMSYLDGLNEQHAAQQQQQVAKAAEKYLKDNFSTVLASAGATAPAVITVPMLRNTRYLPAGFRDTNIYGQQYQVLARKPAANQLETLIVTTGGQVASELSIRRIAQLMGATGGYISKTNTSVAQGAAWQVALSNFGSAPGAGHLATALFFQDGAIANEYLYRNAVPGHPELNRMNTALNMGGNNIAAAGAVTASGNITTSADISARNVTATGTVKAGTADVAGETYTGGWFRTRGNSGWYNERWDGGWYMSDSTWVRSWMNKNVYTGGELRGGKLSSEGRTTVGEYLQINGLAAENAGCAPNGLVGRDNSGPLFCTDGLWKRPSGVNIATPVVLAQYPADNRPRTHCQAVSRDALINGSGPGVLRLEVDGVIVGQARSTAGRNADVVEDASISAMVKAGHRFCLYSTVVLAGFGNSAGMRVTATYLN

SEQ ID NO: 26373 - protein, 105 aa, Pseudomonas aeruginosa
ARLQTTSVDPQGGRMKSIYNTPGFSEELLLVCASLREVGLDNLADQFRDAVFDRSVVDQAIIALRERVKTPSPEHAADNEPWLYCDWQARQTAYRLLQRLERATR

SEQ ID NO: 26374 - protein, 143 aa, Pseudomonas aeruginosa
SITLPTPAGFSRQGDLANHRSTPMGWLFSHQTKEDLLRELLAPTSTFAGSTKVLAHAVSGNELWTVVKRTFHLAGFYFGKPAGHSITMIELHLLDCSAGQWGYKTIPESAGPFYYGCPLEFLDLAHDEVNQEWRERLTHEHQA

SEQ ID NO: 26375 - protein, 247 aa, Pseudomonas aeruginosa
SRWAQLRPSHQERSVTTTLPCTSWTTPPRGFTAPRGRRGSSFKEVPMPSPTPLYQIEECPDLYVDACVCDEQRNLVFLSAWGRDTVTQEFLARLTLDREENGIDHFHIIVDGRRLPVFPNQDLLEKRTTRQFRGTLFGSLLNLWLFDRRASAPDRGNHLAFALLQRDEDPHQRLWPLVMETCPLPLLQHWREPVMEVLTQHQMLTALPGTIGNVCAWRLALRVDVLEPTLGELIRESILTTDAQAQA

SEQ ID NO: 26376 - protein, 277 aa, Pseudomonas aeruginosa
PTLTIVPRTSTSPAPRAASASNHRTPHMNRTVSLLSGLVLLSYPAVGQEAAASRETSSQLSGSQLGTLKQQTSQSDLAQEWGLNQQEWTRYQTLMQGPRGVYSPGIDPLTALGIEARSAEERRRYADLQVQAERRRVEKELAYQRAYDEAFARAYPGEGVIRLTESSTANPSGTPNMSPALQSSGRLALFVQDNCTACIQRVRDLQQQNKEFDLYFVGSQNDAERVRHWAILAGVDPKKVRSKQITLNHDEGRWMALGLGGALPALVQEVNGRWQRL

SEQ ID NO: 26377 - protein, 522 aa, Pseudomonas aeruginosa
PMAGQYPLEALLRPAVELYTTTVCFTAAALCIVAPWTFALTPLFGIVAALGFAWLGIVRLKQAGVVLRYRRNIRRLPKYTMTSAEMPVSNEHLFIGKGFRWTQKHTQRLVDTYLPQFASYVEPSPLYERARRLEKQLEFAPFPLKLVAKATAWDVAWNPARPLPPVGGLPRLHGIEPREQDVGLQLGERVGHTLVLGTTRVGKTRLAELFITQDIRRTHCRGRRRRAKMGRRTQTVHHGHRRRRAEEQPDYEVVIVFDPKGDADLLKRMYVECERAGRLDEFYVFHLGHPDLSARYNAVGRFGRISEVATRVAGQLSGEGNSAAFREFAWRFVNIIARALHALGIRPDYQQILRHVVNIDALFVEYAQKYISEHDPRAWDTIIHIEGKLNDKNVPFNMKGRPFRVVAIDQYLTQKRIADPVMEGLKSAVRYDKTYFDKIVASLLPLLEKLTTGRISELLSPNYADLNDPRPIFDWMQVIRKRAVVYVGLDALSDTEVRRRGGQLHVQRPGLGGGSHLQAWSR

SEQ ID NO: 26378 - protein, 222 aa, Pseudomonas aeruginosa
RPCPAHSPGGKVRINLHADEFNELIGDEFIPMVNKAGGAGVQVTAYTQTMSDIEAKIGSRAKAGQIIGNFNNLFMLRVRETATAELLTNQLPKVQIYTSTPASGANDAINNKKAAFTSSSHDQVQMTSVPMLEPAHIVGLPKGQAFALLEGGNLWKIRMPLPAVDPDEVMPKSLQELAAGMRKGQAANSEWWEAPGYSALQDGLPQDLVDDFRHLGAGEDAA

SEQ ID NO: 26379 - protein, 228 aa, Pseudomonas aeruginosa
PPAAPNRVTLQTYLGITPCAEGRCREHERSPDISVPGRRWLSSIGRRGAVHWSSDDLPSAVVRLGDVQHLARLGHQQPRQRHCRRFRDTDLGPPRHHLLHPPQLTHTETLMMKFTLQKLSTLCRRLAAISLAFPGVTLGALPKPEAPTRGEGSGIMQTIQNFGYDGAMLLALLICVAVFLGVSWHTYGTYHAIHDGKKKWSDLGAGVAVGIGLLILIIYLVTKATTIM

SEQ ID NO: 26380 - protein, 257 aa, Pseudomonas aeruginosa
HLVLSPGGAGPLAALSRLRQPSPGDALRRLDQSTHGVPMSFRKHTAQQQAHINTFRFITGFLCMVIVVLAYCVWEARKDLWIHIPPDLRSGSTRLWWDIPPESVYAFGLYIFQQVQRWPKDGEVDYKGNLFRYAAYLTPSCKVFLEKDFEFRRNAGELRGRERTTSEIPGRGIGESDGRVIQHSINDWTVNLDMDSTEYYAGEKIKRALARYPLHVIRADVDPETNPFGLQWDCYSDTPQRIELEEPAAPTKREGGL

SEQ ID NO: 26381 - protein, 355 aa, Pseudomonas aeruginosa
HPGLDPHPRGRGHRSPPDRPGAQALSRFDRSVRARPRPYPAGGALHHPEQRAARRRPCAGRTAERSRTAEQLPALAALQFRSEREASPGVVHPDDVRAAHRQPVAHLGAHHRYRAPWLHAVQPWRCAVDLRPVQQAGPADECPRLHLRANRVRQVSVPDQPHQPDARHVPATDVRRGSGQQFRPAGRLRQAVWPLGPPGPPRPGLRGQPGAVRGRHQAGRESRPGEGPGCRRHRGLGLGPGQQGRPRGRPARHPGRDGDRRPPDDHRRRGKGRRAPDPCRSQRHPPGDSGGGQDLRRREPHGADPGCARCALPGLQERWLRARTPRAPGRNGGSHADVLHGCRRRDVQSRRHALA

SEQ ID NO: 26382 - protein, 122 aa, Pseudomonas aeruginosa
CIASRRIARLAWRGVRGSRRHQSILQRLYAIFAQSAGNGGGLPSGTLDFPELDQSRLEKCAKDMDLEDQLIKTDIDTARSKSITATPTLVIRDNQTGRSVKLEGIADETTLLSAIDWLAKDH

SEQ ID NO: 26383 - protein, 157 aa, Pseudomonas aeruginosa
SCLLSVPSSNRYRPMPLHHSPPGWRPQKLVVGLLLVLLSGASQAETWVITDKAHPVTATGSSRVLLLDAQQHLEEQLTDALPKDPQQAQAAFQQLLQSPAGRRLQAELVKAQQDVADAWSLGVEKIPAVVVDRQYVVYGEPDVSRALELIAKARRSR

SEQ ID NO: 26384 - protein, 236 aa, Pseudomonas aeruginosa
PGRPGAPPGVRCLPDGRAQQGPVVAAPDVRRRQGAQRRRQRPGHPSRRSADQPPAAGDLQSQDRTGTPSRVGQQFAHAGHRARATARLRVQWRVRVGARCRSPRSPAGPLCRRRQDGRETVMADTLTTRKLLGQLLVGVLIVVGLAVVGTLLSLFALNHFGGIQGLEAWRQSNYWSLFAWRALLYCALAIAWFRLKQRKELSAHERQRIRRIEILVLLLVLLIEFSKAYFRTGGAA

SEQ ID NO: 26385 - protein, 180 aa, Pseudomonas aeruginosa
EPEHLDHQGFWSSQDERAQGIPAPGSQTAVPCAASGQPKPHGHHRCRRGCGMTPLQLTEEYLFAHDLREASQKTYRAATRALMKHFGSTVTVQEITHRSVLEWRRKVLEQGLSKRSWNTYSSHLRTVWGYAIEYELLTHSQINPFKKTGVTPPKRPSKTVALDAIQSARSWLKVLDVKLQ

SEQ ID NO: 26386 - protein, 332 aa, Pseudomonas aeruginosa; identical to SEQ ID NO: 21096

SEQ ID NO: 26387 - protein, 401 aa, Pseudomonas aeruginosa
RPSADLPGPRPSASVAGFCTPRRDSPDGPQENPRFRTVPHRAANPGGTPGKRRAVAGRVAGRLRAGHPPDPRMPDVAEPGRTEGTDTPRTRRRAQRSAVRCGRRRGMIAAYQARCQARVDAALDALFVAPREELQRLYEAMRYSVMNGGKRVRPLLAYAACEALGGAPQRADAAACAVELIHAYSLVHDDLPAMDDDDLRRGQPTTHRAFDEATAILAADGLQALAFEVLADTRRNPQEHAVCLEMLTRLARAAGSAGMVGGQAIDLGSVGVALDQAALEVMHRHKTGALIEASVRLGALASGRAEPASLAALERYAEAIGLAFQVQDDILDVESDTATLGKTQGKDQAHNKPTYPALLGLEAAKGYALELRDLALAALDGFPPSADPLRQLARYIVERRN

SEQ ID NO: 26388 - protein, 639 aa, Pseudomonas aeruginosa
TAGLSGLHNDSLMPKTLHEIPRERPATPLLDRASSPAELRRLGEADLETLADELRQYLLYTVGQTGGHFGAGLGVVELTIALHYVFDTPDDRLVWDVGHQAYPHKILTERRELMGTLRQKNGLAAFPRRAESEYDTFGVGHSSTSISAALGMAIAARLQGKERKSVAVIGDGALTAGMAFEALNHASEVDADMLVILNDNDMSISHNVGGLSNYLAKILSSRTYSSMREGSKKVLSRLPGAWEIARRTEEYAKGMLVPGTLFEELGWNYIGPIDGHDLPTLVATLRNMRDMKGPQFLHVVTKKGKGFAPAELDPIGYHAITKLEAPGSAPKKTGGPKYSSVFGQWLCDMAAQDARLLGITPAMKEGSDLVAFSERYPERYFDVAIAEQHAVTLAAGMACEGMKPVVAIYSTFLQRAYDQLIHDVAVQHLDVLFAIDRAGLVGEDGPTHAGSFDISYLRCIPGMLVMTPSDEDELRKLLTTGYLFDGPAAVRYPRGSGPNHPIDPDLQPVEIGKGVVRRRGGRVALLVFGVQLAEAMKVAESLDATVVDMRFVKPLDEALVRELAGSHELLVTIEENAVMGGAGSAVGEFLASEGLEVPLLQLGLPDYYVEHAKPSEMLAECGLDAAGIEKAVRQRLDRQ

SEQ ID NO: 26389 - protein, 119 aa, Pseudomonas aeruginosa
RSTPRPSSAMAASAPSSWKPQSQRRLNSASPVRHSECRRPSTGAPSAMSPMLRATCSLPLSSSRKPCMVNSPKGVGSLEAATNTTDTGELLGKRKSAIVPAASGARSARNAANTYRDGR

SEQ ID NO: 26390 - protein, 239 aa, Pseudomonas aeruginosa
RASSGSATSAGADLRSSTSSSAAPASPSGPPTQSRSPGRAPARVSAWPAGTLPNTVRVMLSGPRVVSPPTRARPHCRAMASRPRAKPCNHSASACGKVRARVKARGAAPIAARSLAETARARWARRKGAQPAGKCTPSTRVSVETASCSPAGGASRAQSSPMPRATSAAGAAQAAAAKKRRISSNSPMTPPARDQRLPPRSSAARRRGASLSSTPLTNLWPSVAPKVLASSMPSLITTL

SEQ ID NO: 26391 - protein, 185 aa, Pseudomonas aeruginosa
ERYGHRDGRVAFYHSCAACASSAASPRSEVQASRGWGRAVTSQSSPTARMSSIRNCAASAIRASGQSSKGRALEPRNFGATNSRYSSTSPSRAKAPARRGPASTSTSLAPRAASSRSSLCKSTWPSAEGSASSSWPASWKRSRAEAAAQVATSAGPGVVERRLQRHPQGARRPAPATAGEPRRAR

SEQ ID NO: 26392 - protein, 253 aa, Pseudomonas aeruginosa
PARSRRADSDGWSTAPGAPVPGRGPCTAGRRRSFLGRLAGEAFDLLAEFVEVLEAPVDRGETDVGDFVELLQLGHHQFAQHPRLDLALAGGAQLVLDVADGRFQALDADRTLLQGALHAGAQLVLVERLAAAVLLDQARHDQLGGLEGGEAFAAGQALAAPAHLIALGDQSRVNHFGVMGTAEGTMHGADTGVAEGSRMVAHPRPTEHPQNRPAPARWERREESDVAAYAKRDKNHTLRYTSAARIPPLWSSP

SEQ ID NO: 26393 - protein, 211 aa, Pseudomonas aeruginosa
SSPASWPGACIRCGSPSRPPSPSANCAWYARRDGTASPDPGAGRAARRRPAQRHRAARHRPAPVADRRAEHGPPVQPGGNPPHPRRAAVLVLLLGQRAGPGALAGGAPAVGPRQARAGLRQRLRGGGDRRGPRRRRRGGGLRPGSPGAGSEPGERRTERSGAELFGGLLRRGRSLRPDPGGRRALRPRQPAAARPVPQPRPPGAGRRLAGP

SEQ ID NO: 26394 - protein, 353 aa, Pseudomonas aeruginosa
LPSSAVPAPGRARRLYLAGPRRARRIPPGQPVSRRTRASLRHGLVCARRAPTYSGHHLAFPRIDMSDTPYIFDVTGANFEQQVIENSFHKPVLVDFWADWCAPCKALMPLLAQIAESYQGELLLAKVNCDVEQDIVMRFGIRSLPTVVLFKDGQPVDGFAGAQPESQIRALLEPHVKAPALPDEDPLEVAQALFAEGRIGDAEATLKALLAENNENAAALILYARCLAERGELEEAQAILDAVKSDEHKQALAGARAQLTFLRQAADLPDSAELKSRLAADAGDDEAAYQLAVQQLARQQYEAALDGLLKLFLRNRGYQDDLPRKTLVQVFDLLGNDHPLVTAYRRKLYQALY

SEQ ID NO: 26395 - protein, 203 aa, Pseudomonas aeruginosa
RNKLFSFLAGVPFMRPLLLALVLLPFAAQAHDDHDHDHAHGSLGKHEHGVAQLNVALDGKTLELELDSPAMNLVGFEHAASTDADKAAVAKARAQLEKPLELFALPVTAGCSVASQELRSPLFGDKAPAHAHKEKAGHEHEHGHADIHAHYQLSCEKPELLKLLTLAEFFKRFPATQKIQVQLIGPDGQKGADLAPASAELKL

SEQ ID NO: 26396 - protein, 511 aa, Pseudomonas aeruginosa
PGAGRQPSARPARPRRRTARTPRRQPVHRPAAAGRRRPRADRPAGAGDRRRADLGARRRQPRGVSPVALRRMPRGRRQPAVRQPRPEPGRAVRPQPVPFRSQPRRPAGRTLSMYLFRLALASLANRRFTALLTIFAIALSACLLLAVERVRTEAKASFASTISGTDLIVGARSGSVNLLLYSVFRIGNATNNIRWDSYRHFAGNPRVKWAIPISLGDSHRGYRVMGTDAGYFEHYRYGRGQELQLAEGRAFGQDLFDVVLGAEVAEALHYRLGEKIVLAHGVSTVSLVKHDDKPFTVVGILQRTGTPVDRTLHISLAGMEALHVDWRNGVPAMGAGRVSAEQARHMDLQPQAITAFLVGLKSKVATFALQREVNDYPGEPLMAILPRCRPAGTVGPDGHRRKGTVRGLAVRRPHRPDRHAHGDPHQPQRIAAGRWPSCARWARAPGTSSACCWPRPSAWRWPASPSASACSTSASPPARATSRPTTASTCRWPGRATMSGACSGLSWRPPC

SEQ ID NO: 26397 - protein, 234 aa, Pseudomonas aeruginosa
SAACRPGAPTASPWPMACRSAYDPEIFPDAALPDRPPAGFRPAPGQCRGARRAARTDLVATDPGRRPARPGAAADPRPRQRPQRSRSGGQPAEPQRPGGEGTGRHRGQAAGLHRAAGNQRGRAGHRVPPGPLLRRLHPRTAAAVEPDRLREDRQGRADGRVVSAILGRGHLQGGERQQRAGGGRLPHAGEQGDALRIRRWLNDMRQSAAPFTLRRSHLLLGLIELCQGRQLLAG

SEQ ID NO: 26398 - protein, 65 aa, Pseudomonas aeruginosa
RIRGRPAIRVLMVAAPANSRPTPSQMRPNGPITCSANRGIAIGVSSRCRPPPKSKFSTCRRIAAP

SEQ ID NO: 26399 - protein, 262 aa, Pseudomonas aeruginosa
RTGRWQYSCVLLGLATALRHACAYYPGILWTRRSPARLLQPAGFLAAACQARQRETRRRAGAWTFCPAGRTVDVPPPRPTGVPRHAFDPVARPRPALHAGLHPGGTGQPVRVLSHRRGLPRTRFPAPADAGRHAPRLPAPLPRLRSAAAAPLPGQRFAGGAAAPGHRPPARGGQRAVPGLPATPRDLRRGRGAGACASASGGGPVVTARRPPRGLLRPGAATIARPAWPDGAGGAGMRHASGQRRAPARPDAEGTGDRPAAA

SEQ ID NO: 26400 - protein, 133 aa, Pseudomonas aeruginosa
STLYTDDSTMTHKRFFLELLLALVGYAAAVLISGQSLAGTEPGAGRVFLALLPVPPMVALALVVIRYLRRLDEMARRIHLEALALAFVGTALLTFTYGFLETTGFPKLSMFFVWPLMGAFWVIGCVLGLRRYA

SEQ ID NO: 26401 - protein, 70 aa, Pseudomonas aeruginosa
KRSSTTGKASWTESGPASENVRGAPGDPGGKPPLPCTKWQLPHFPSGLALDQAYRQPSPWSPLDTLKNHG

SEQ ID NO: 26402 - protein, 711 aa, Pseudomonas aeruginosa
PAIERLRGPPPAGRRCQGRARRHQDRTAPGTARLHAAQPLPVAGQPADHGQRQDRPPGPASTPGRTMPGTTRRATLRHPRRTASGPVLAGSAGAYRLRPGRQLLRGRRPFPAGRRPGTRIEPTLRQPCLHPRHLPHPERAPTGGQPGAARRRSAAGAGQRTGPGAATGRAPARRRGFQPPHGHRPIAGATAHPAHRRQRADGRPPARRAAGQPRGRPALSGPCAKRRPCPRTPAPGRPAAPHRTRRDGLATGQGLRRRPRRTRFRTTGGNLSRAGRQRRPGLPFRQRGELHPAIQLHEARQRRGARPGPALLRQRPLQAADAAVEHLGVQLGPPAYRQAPDARGRRHRPEPAGGGHRHGLRAQQMGDGKDRRPRRRTRPAADDLPPRLRHLPQPYRRLRRLPVVEPAGADLPGVPGRAAPARAARGPDHGGLHGRGDQRHRPPAFGAGQEIQPGAEHSALPDPGRVLRPSRATRRASPSADAVRRLGKSLGRQSRRPALSPAEHVPRQHVRRPQHRRVVPGHLSLGLHQRRGTPARERRARAGVRRPPARPVPRRPGRQRHAVTRSPRRLRSGTRLGILSALSPGEPHAQRSDRRRLARHRPGTGGCLPATRRTGIRRRPATARLSRATGTGGAGRGALASGDRRPQPTRLRRTHWRDAGRAADRSPDRQRRHLRPAATGCGGNRRRADRPAIPDQRHRAAAPGQGTVRPG

SEQ ID NO: 26403 - protein, 251 aa, Pseudomonas aeruginosa
PGWRGGVHEFADGQPGAGPVGHDAALRRQQGGAEQPGTQLGGRVRGVAVQPVAPASRLGAYRNGRRQRAAERRGKRRRTGRGGGGCRGRECLSLRRLSEPAAALVKRADPSGHPAIALGRIPDEVGIALDAELLHGTDLLRTDGLHAAMRALGDFGDGQSGAEQTDDFRLPGRQPFVVRGKHLVDEDVPDRRREILVSRIGRAHRRQQVTGRVGLAEDAIDTLLENGPDKARIVQHGKDDQLQMRITSPQQ

SEQ ID NO: 26404 - protein, 221 aa, Pseudomonas aeruginosa
SPLTVPSDMDETMRPWIWFSPTRPPMRLRPLPLTVLLLRADRIEPALLPTRPPTDALAAALTLPLASTLTSSPPLWPTSPPTRLLNPPLTSPREIAWATEPPRLCPISPPTRLLLPPLTLPVASAVSMALWLLLPTSPPRSAPPWSVTLPLAFRFPSMPLPSALPISPPVARPPLLYTDPLACERNISPPELRPTSPPVFPAPPASTWPLALLSETWPNML

SEQ ID NO: 26405 - protein, 214 aa, Pseudomonas aeruginosa
MKRVPITDSEAEASATSATSRTQAVPHRPRPTPVTACAPGRRPTPGDMPVAGREASSRAGPAHSRPGTAAAARCPSAPEPSRDPARPAAPGGCPGRRRPPTARCGHQALPRRTAGARRWASGYPPARALPPASDSRGAPPLRRWAPRCANWTSVRSRRPCRWGRGRRCSTGRAAGWESPHSRGGRSGFPSSRQPRPWRLARGPGRSSRPGFVPR

SEQ ID NO: 26406 - protein, 60 aa, Pseudomonas aeruginosa
VIFLVPGGRGRLNQAQSVILIVWALPDSARLLRGGKSRKSGLRPSSLPSRHRCPAWSTRV

SEQ ID NO: 26407 - protein, 373 aa, Pseudomonas aeruginosa
ATMLATLLGGEQVHGVAVHHLQRTATAASHAGQRLLGDDHRQAGFLCQQLVQVAQQRATAGQHQAALGDIRGQLRRRLLEGALDRLDDGRQGLLQGLEDLVGVQGEAARYAFGQVTAADVDFANVAAREGGADLLLDALGGGFADQAAVVAAHVGDDGFVEAVAADADGFGVDNTVEGNQGDLGSAAADVYDHRAAGLLDRQAGADGGSHRLFDQEHLAGAGAQGGFADGPALNLGGLARHADQHAWAGLQEAVLVDLVDEVLQHLLADAEIRDHAVFHRTDGGDVARGTAEHALGLGAHGDDALLAAMAANGDHGRFVQDDAALAHINKGIGSTQVDRQIAGKHATQFFEHGKETLGEAWVKNTRVKKCGKL

SEQ ID NO: 26408 - protein, 605 aa, Pseudomonas aeruginosa
SSARPRRTRPGRSARRTTTRFPSTWKTSTPSPPTSPACRGCPCPPASSTACRWVSSCSRPTSRKAACSTSRTSTSRSATGTPAPRPASKPWQRHAVPSPLPARRGRPAGSAAGLRRHRRIEEHHMQWETVIGLEIHAQLATQSKIFSGSSTAFGAAPNTQASLVDLAMPGTLPVLNEEAVRMACLFGLAIDARIDRQNVFARKNYFYPDLPKGYQTSQMDHPIVGKGHLDITLEDGTTKRIGITRAHLEEDAGKSLHEDFQGMSGIDLNRAGTPLLEIVSEPDIRSAKEAVAYVKAIHALVRYLGICDGNMAEGSLRCDCNVSVRPKGQAEFGTRAEIKNVNSFRFIEKAINHEIQRQIELIEDGGKVVQETRLYDPNKDETRSMRGKEEANDYRYFPCPDLLPVVIEPEYLAKLREQLPELPVQKRERFESQYGLSAYDASVLSASREMADYFEKVQGICGDAKLAANWVMVELGSLLNKDGLEIEQSPVSAEQLGGMILRIKDNTISGKIAKMVFEAMANGEGSADQIIEAKGLKQVTDSGAIEKMLDEVLAANAEQVEQYRAADEAKRGKMFGFFVGQAMKASKGKANPQQVNELLKKKLEA

SEQ ID NO: 26409 - protein, 143 aa, Pseudomonas aeruginosa
SRWIEPPSTHDRNLPMSEQGKTGLEIRREVMGDAFVERAMGNATAFTQPLQDFVNEHAWGSVWAREALPRKTRSLITLAALTALKCPQELKGHVRGALNNGCTVEEIREALLHCAVYAGVPAAIDAFRAAQEAIDTWQGEQPA

SEQ ID NO: 26410 - protein, 540 aa, Pseudomonas aeruginosa
TASRPHAGAASPSRPGRPAARAPRPAVAVQGPPPALAPRPGRRPSPGRPAPGRRRPPAGSARALPFAGVGQIVEQAAEQGVHRQLHVAGESQDQRTLQQRGLRRLLGVGLEDALPVFGRQLDLQCAAGVPVGVVGVGGEESVAIDVATPPGEPGVRAGHLHQAQATVLHDQAQAVANPRLAAGQRRIGDAQRQQLAGGLLDAAVGILQQIIEIAQVGRGRAIGQAQAYVARVRRQLQRVARRRQAEVLHLLHLPAVGQQVEAHRQAVADLPVLAQLGAPVAIAERLLRQRNVVDSLGQLQGLAALAARRPAEQLGLDRLFALVEDEQAEVGLVTLAEASRPAPLQVQRLLRAKELLLLADLAVVVDGPRGDPPAGQRVGHAEAEAGLALGVGDQLRLPGGGVDILAARPLQYLDAALAAVRPSGCAGAAGQRHVVADEGQAGAGAHVVAPRMVEELVDAGGDLRLQGIDHLIHHADGQVAGNRFAGEARGQGHGHRLARFVALLVGGDVDLYLGHADLDPGVLEAVVAALGVEHREGQVR

SEQ ID NO: 26411 - protein, 726 aa, Pseudomonas aeruginosa
ELLAHRDPHAVLGRIEFFQAQPVGALGQQGGGLDLVALQGQQRILHRLGEGDQCGGFLAGAVLGLVEHHLDGARHRLHALAAHRVAGGAKELALVVAQLHGIGTGALEGQREAAVGDRTAVGGAVLQADPLVAARLERGRLFAGIAELDLLAGGAEALRRAQAVARGAALDEDLLAGLDPVGGAVAGEDGQHVATGFLGRRQFDGGAALAVCGQFGAAQFHRELAEILQFVVHHRQLLGAQAQLQARVGHRLAVRIEQDDLALHRLGGLEVRLGQVEGDFEVRLDVFGDAEGAAVGLPAVVEAQLVAAGDGVLRQLEAAIGAALRVEAEVQALQYRAAGVDHAQAHRRAGGGLGLPGVLELAADHLQRDPVARPVQRAVGEGVDLGVVDLAVVIEVLGDEDPALAVLADHVGALRTGVLEPQQAVGVGIAAAHHAQAVGPQHLGVGHRGAFVLACGPDQQLVAGDLAHRHAVGDEHHGGGAVLADKRLDQVQARLQLAQRDVDIARHDVDELAGGTGQLDVLRRLDGLGVPQRIAELADQRQAGNRRVLRLRVVGRRRGHGVAHLQLGHRLGDLLPRLVGEGALHHPARLAIPVVPEIGQGVRQAFALELSLGQDPVQVLLPLEELQRLFDPVQAHVDPAIGLHAVAPVVAAGRFETDPRFLVGGEAAVGEQEEGFAGHRRVAARFHRVFRLDGGERQQDQGGDRQATAETAQVAHCCGLHWDAIH

SEQ ID NO: 26412 - protein, 509 aa, Pseudomonas aeruginosa
SGVSCWASARPSSAEPAVLTRRPRRLMARARTRVKVGSSSTSRRWGCSSPSKSSSSDIGRASQTDHSSHSVAARQAQFGQSAAIFVVIQLHRSTSAGHAGLTEKQAEAEALALGGEERFADLFGDRQGHPDAVVADTQADTAAVPVQADVEVVGTGVRRIVQQVQQSLAEVGRRGQARRGAEAQALVAVGSLRTHQVPAAQHRFQPFRGALLLDRLTTVGLGRPYQLLEGVLALLDLFLEQCQVFLQGRVLRALLAQLVEQHAHGRQRRTQFVRGTGRLGGHREQLLVAHAFLAPLGLHVRLPAQRLGHLHHEEGDEGRRQGEVQPHAEQVQVDQHRLVLNRLQVQRVVPDQQQGVAGQGQAGEHHGVDPGQGRSGDGQRYQVIGDEGVGRAARVIQQGAVDDQVAGQLYRVLLVGHRPRRAQAQRGEQNQAGGQAKGQAERQPRQRQQVGEPGETHRAGLRGQHENTDEEQTAKVLATGGEQENRCAHVFFRNKREYSQDAVGNSAAK

SEQ ID NO: 26413 - protein, 307 aa, Pseudomonas aeruginosa
LRNLAGRHPALFRRALSGLRSVNFTFFPKSPNPFREKPSSHGPRLAYRRVCHACRNDALQCEFSLSTRSCPMSAISRLAAAVTLCAASLSAVAEEAPRYNQVSLHAEVSQQVAHDLMQVTLYSENQGSDPAKLAAETTSVLNAAVADARKVKGVTISLGSRNSYPVYDDKGQKITGWRERAELRLESSDFAALGQLSADLLGKLKMGGMDFSIADATRKKNEDQLMKGAVDAFKERAQLLTEALGGKGYKLVSLSVNSAGAPRPYPVMRMAAMKADASFGGAQAPEIEAGTSQVTVNADGVIEVQMP

SEQ ID NO: 26414 - protein, 621 aa, Pseudomonas aeruginosa
SGRRAPQEAASGLPLAFPLSLAQQTRPASRLRKFENATFPFKRITTSTLNRPRRLRPAHALHSFAQDSSRGCPSQTIKITRGHSMRRNAVIRSAIIPSLLGAALVAAVPQAFASNLIFCSEGSPAGFDPAQYTTGTDFDAAAETVFNRLTQFERGGTKVLPGLAESWDVSDDGKTYTFHLRKGVKFHSTDYFKPTREFNADDVLFTFERMLDKDHPFRKAYPTEFPYFTDMGLDKNIARVEKLDEHTVKFTLNEVDAAFIQNLAMPFPSIQSAEYAAQLLKQGKASDINQKPIGTGPFVFSRYQKDAQIRFKGNKDYWKPDEVKVDNLIFAINTDASVRAQKLKAGECQITLNPRPADLDALKKDPNLNLPSQAGFNLGYIAYNVTHKPFDKLEVRQALDMAVNKKAIIDAVYQGAGQLASNGMPPTQWSYDETIKDAPYDPAKARELLKKAGVAEGTEITLWAMPVQRPYNPNAKLMAEMLQNDWAKIGIKAKIVTYEWGEYIKRAKGGEHDAMLIGWSGDNGDPDNWLGTLYGCDAVDGNNFSKWCDAGYDKLVKDAKRTTDQGKRTELYKQAQHILKEQVPITPIAHSTVYQPMRKTVHDFRISPFGLNSFYEVSVGK

SEQ ID NO: 26415 - protein, 563 aa, Pseudomonas aeruginosa
LRLPAAPPRHERGGASPRGGRPGRPAPEESSMRPRSALRYSLLLLALAASAAIQAQPKTLAVCTEAAPEGFDPARYTSGYTFDASAHPLYNALAAFAPGSATVIPALAESWDVSADGLVYTFRLRQGVKFHSTDYFKPTREFDADDVLFSFQRMLDPQHPAHDLSPSGYPYADAMQLRDIIERIEKIDEHQVRFVLKHPEAPFLADLAMPFGSILSAEYAGQLIARGKGDELNSKPIGTGPFVFTRYHKDAQVRYAANPDYWKGKPAIDHLVLAITLDPNVRVQRLRRNECQIALTPKPEDVAALRQDPQLTVLEEAAMITSHAAINTRHEPFDDPRVRRAIAMGFNKSSYLKIVFGDQARPAIGPYPPMLLGYDDSIRDWPYDPERAKALLKEAGVIPDTPLNLYISTGSGPGGNPARVAQLIQSDLAAIGIRVNIRQFEWGEMVKRTKAGEHDMMLYSWIGDNGDPDNFLTHNLGCASVESGENRARWCDKGFDEAIRKARMSNDESQRVALYKEAQRIFHEQMPWLPLAHPLMFDAQRKNVSGYRMSPMSARDFSRVKLD

SEQ ID NO: 26416 - protein, 551 aa, Pseudomonas aeruginosa
REQSGDEIPTSDRRDAGIGLDGIGRARLGSGRAGNPADPGQSQLRRPGAEHPQRGETDQGPGRRQRAVRGAEPDPDHPQLLLAGKHEGQLHLPHSQGRRRLPAHPPAQRLGPGHGAQVQLGLHPGQHRLRLRRRSLQRDRPGARQGPHRRRRQPDPGEQRWRGDRRVVQAGRRQHPPARLEYRIQGRSLPGQHSSVQLYRQPCPALQLHRLRRDQRGAGQPQPAGRQLPQGQPADRFRRRGHDHRVRHPPGQGRPPELPGRQLQAARRAGNLPLWLAFPGRLEPVLPGRDPRHRRPRERHRPAHRLQRLPHRRHRRARGRLHRQRHLEPGLHSRPSRPRPDPGLPAGRRQRILRLRARDLGDLPGQLDAGRLQQPQREVRADPLRDRLELLRGPRPEHRRVVREGLGHRRHPLRRRSQRCLRQLRRGARPGRREAPRAGPDGGLQGAERADQGQHLQAHLHDAQGQPEPGRRQRQRTAPGQHLPLQPAVNLRQPAAPATGPTRRTPCSIRCSDTCPWPWRYAPPARPRRRTWWSAPRPARNASTSSSTPAR

SEQ ID NO: 26417 - protein, 361 aa, Pseudomonas aeruginosa
SRRRTRTTAPPPAGRTVRDEELPANMLSFIARRLGLLIPTFFGVTLLTFALIRLIPGDPVEVMMGERRVDPQMHAEALHRLGLDKPLYQQYLDYVGNLAQGNLGESLTTREGVWHEFLTLFPATLELSLAAMLFAGTFGLLAGVIAALKRGSLFDHGVMTVSLAGYSMPIFWWGLILIMLFSVSLGWTPVSGRLDLLYDIEPKTGFMLIDTLLSDEQGSFLDAVRHLILPAIVLGTIPLAVIARMTRSAMLEVLREDYVRTARAKGLSPARVVFVHALRNALIPVLTVFGLQVGTLLAGAVLTETIFSWPGIGKWLIDAISRRDYPVVQNGILLVATLVILVNFVVDILYGLANPRIRHQR

SEQ ID NO: 26418 - protein, 346 aa, Pseudomonas aeruginosa
RTRHEEHNHEQRIRIRATGDRRMSLLDIKNLSVRFGDTTAVPVVDGLDLSVDKGEVLAIVGESGSGKSVTMMALMGLIDAPGWVSADHLRFDGHDMLTLKGRQRRRIVGKDMAMVFQDPMTALNPSYTVGYQIEEVLRLHLGLRGKALRQRALELLERVEIPAAASRLDAYPHQLSGGMSQRVAIAMAIAAEPKLLIADEPTTALDVTIQAQIMELLLNLQRDQDMALILITHDLAVVAETAQRVCVMYAGEAVEIGGVPALFDRPTHPYTEALIKAIPEHCAGEARLATLPGIVPGRYDRPRGCLLSPRCPYAQEHCRQERPALEAHERGAVRCFYPLNLLNEVA

SEQ ID NO: 26419 - protein, 323 aa, Pseudomonas aeruginosa
WKPVLTARDLTRHYEVSRGLFKGHAQVRALNGVSFELEAGKTLAVVGESGCGKSTLARALTLIEEPTSGSLKIAGQEVKGASKDQRRQLRRDVQMVFQNPYASLNPRQKIGDQLAEPLLINTALSREERREKVQQMMRQVGLRPEHYQRYPHMFSGGQRQRIALARAMMLQPKVLVADEPTSALDVSIQAQVLNLFMDLQQQFRTAYVFISHNLAVVRHVADDVLVMYLGRPAEMGPADKLYENPLHPYTRALLSATPAIHPDPTKPKIRIQGELPNPLNPPEGCAFHKRCPYATERCRSEVPELRLLDQRQVACHHAEQFLG

SEQ ID NO: 26420 - protein, 193 aa, Pseudomonas aeruginosa
TAEPVANLAGDAAQYRPRPETAGAGQVGTLPGLGEAQFDALPAADPEATPGQAFATVHRQRQTRSGQRQPGRLHPALQHQAAESDFQQWRPPGITEQTIGPGCRLAVQRAASGYAEVLPAAPAVVLQQALRSRLDDPQTIHSRPPRSRKSSRPMATKRTRSPSASGHGGVAAGSNGRHGLRPSRCQPPGEACG

SEQ ID NO: 26421 - protein, 64 aa, Pseudomonas aeruginosa
HRPPGHRGNGRKRPAHRSGTAPWHAPLRQSRPASAGRSRSGRDRPGARRCSRHGVPPAPPRAAW

SEQ ID NO: 26422 - protein, 164 aa, Pseudomonas aeruginosa
PLCGYSPYTPQSPAVPVAGNEKAPLGAFFIHPFSTRRVGNVLRRPGVARPPHRALRAVPGRHHRPCPAGCRRRTRPRPRRSSAAVHPPLHAGGPGHRSSPPGRGRRPGPGVAARPWPGLAPAPHDSSSRGRNCVRRTAASCACARRQCWRATGCAGRRARYRCR

SEQ ID NO: 26423 - protein, 244 aa, Pseudomonas aeruginosa
ASRSRCPGCRRHAAPGVRSVAGRHRSAATRWSTGARKAESAHPAAPAGASRPGVRKNPAAGARPGPAPGSARRPRPPPAPGRPGDAAAAIRGCARAPGAERSPADRRRAIGWRCRPAHAGPAARSTRPGCQDSGTPAAPATRPRRPALPRPPGRHRRSPRPGFPAIGAGPRRRHHRPPPGRTGSARPAPATSPACAGRSRRTARTGDLPRPAGRSSGHRGWRPGQAPCVRSRGRCPAPHRRRRC

SEQ ID NO: 26424 - protein, 399 aa, Pseudomonas aeruginosa
APGEAGVGEVVLLGGLADQVQAATGGAGAGVGRARALADLDLLDVEHLAGLRGDVAHTVEERIALGVEATDEWPVACGVAALARAEGDTRGGAQCVGQGQGASVLDHLLRDHGDGLRRIQQRRGVLLRRRAVDVVGGFVLLLADDGGRIQRQYSVLVGLFLPGLVGVGCLRCGDGGDGHTDGRSQQTLRRNGGIRGLTRHSKPLPGSCEGRGIYCRSELLSIITDSHSTGIYILYNFLITFFPISLVWNIWRFYMTNANQYHWQSFRLHGQRHVAAYSRHLHRRGSLPDPRSPGAGGMGRRQGDRRLPIGQGQAQPATAAGPPAGPGDRRSHAAAPVEPSPVHVRRPAAQGLPAAIQLLYRRGLVRLPHRQRRARRPWRPRAGPYRPVLDPLLQRPGGL

SEQ ID NO: 26425 - protein, 371 aa, Pseudomonas aeruginosa
RRRTGDPGHLRPATGEAARRRSGALPRHQPAQGQSGHPRRALRLVLLDPEPGPRRQPAHPAIRNGPVDPATHPRRPRPSLADPPHRYLPQSPAALVGTLNMRHLLLRHDALDAEGFAAQLAGTPGEVAQAILGAAREGLTEAQALLGQILLDGQGIQRDPTLARTWFTIAAERGHAMARNMLARCLEHGWGGPADPAAAAVHYRIAAQAGLDWARYNLANLHATGRGVSQDQPRAYALYRQAAEQGHAKSMNLVGRYHEEGLVVARDLAQAAHWYRRSAEGGDFRGQFSHAAMLSASGRHAEAETWLRRALEGGNLNFLRSARHGLEQSAHPPFRSLALAYYRRAAQLGDDTDREALEQALERHGYARLPV

SEQ ID NO: 26426 - protein, 364 aa, Pseudomonas aeruginosa
PAQPLPHVHDSGMSPSAQRSIGWTKNVPRRPCAYTRNAPIRRFSWVTWAPSSRLARSVWLAPSAVRSPAWLISTMFWSISWATAVCCSAAAAICWFWSTIMPTAPRIFSSACCTCADSLTVPSAVWWLLPIAFTAASTPPCRRRIICSISAVDCWVRLASVRTSSATTAKPRPCSPARAASIAALSASRLVCSAMPLITSSTWLIEALSLARRLIAATDWSISPARRWMLPTCDSTRLRPLRVSWFTLFALLTAIAALRATSWAVAAIWFIAVATCSIWLRCPATAWLLSADTDSTRRVCRSTSPTVWLTRSIRSWIFATDSLNDCPSSPSSSRLRAWKLTVMSPPATRSIIRPRSFRVARVET

SEQ ID NO: 26427 - protein, 183 aa, Pseudomonas aeruginosa
STVFTQTSPDCSYRSERCRRVATLTHGVRSVMAFRNHADTFTCVPDIGLVFCNLRLTGNRRRIPRRCAQRNSAQKANTAYQSTAARTSNCQSASRLATPAAPSSTASTSLATRPALPSSAAAEMSQASSQCSSTRITARKLPTRAKLSTSARTGNQSRICRTRAACSRNAGWRACSSASASRR

SEQ ID NO: 26428 - protein, 573 aa, Pseudomonas aeruginosa
PFCDSFPMNDSIQLSGLSRQLVQANLLDEKTAVQAQAQAQRNKLSLVTHLVQNKLVSGLALAELSAEQFGIAYCDLNSLDKESFPRDAISEKLVRQHRVIPLWRRGNKLFVGISDPANHQAINDVQFSTGLTTEAILVEDDKLGLAIDKLFESATDGLAGLDDVDLEGLDIGSAEKSTQEDTSAEADDAPVVRFVNKMLLDAIKGGSSDLHFEPYEKIYRVRFRTDGMLHEVAKPPIQLASRISARLKVMAGLDISERRKPQDGRIKMRVSKSKSIDFRVNTLPTLWGEKIVMRILDSSSAQMGIDALGYEEDQKELYLAALKQPQGMILVTGPTGSGKTVSLYTGLNILNTTDINISTAEDPVEINLEGINQVNVNPRQGMDFSQALRAFLRQDPDVIMVGEIRDLETAEIAIKAAQTGHMVMSTLHTNSAAETLTRLLNMGVPAFNLATSVNLIIAQRLARKLCSHCKKEHEVPRETLLHEGFPEDKIGTFKLYSPVGCDHCKNGYKGRVGIYEVVKNTPALQRIIMEEGNSIEIAEQARKEGFNDLRTSGLLKAMQGITSLEEVNRVTKD

SEQ ID NO: 26429 - protein, 406 aa, Pseudomonas aeruginosa
SMADKALKTCVFVWEGTDKKGAKVKGELAGQNTMLVKAQLRKQGINPLKVRKKGITLLGKGKRVKPMDIALFTRQMATMMGAGVPLLQSFDIISEGFDNPNMRKLVDEIKQEVSAGNSLANSLRKKPLYFDDLYCNLVDAGEQSGALETLLDRVATYKEKTESLKAKIKKAMTYPIAVVLVAIIVSAILLIKVVPQFQSVFSSFGAELPAFTMMVINLSNLLQEWWLVVLIGLFSASFAIKESHKRSVNFRNTVDRYMLKIPIIGGILYKSAVARYARTLSTTFAAGVPLVEALDSVSGATGNVVFRNAVSKIKQDVSTGMQLNFSMRTTNVFPNMAIQMTAIGEESGSLDDMLGKVAAFYEEEVDNAVDNLTTLMEPMIMAVLGVLVGGLIIAMYLPIFQLGSVV

SEQ ID NO: 26430 - protein, 196 aa, Pseudomonas aeruginosa
PGPICNSPDSNDPTLDTRPHGRYRQRQERSRRAFHFPRRPPGGRRPCCPLGGGAGASGPGEDRRTLRRRHPPARWPARPSRLARADLPGAGGTALAGAIAAPADRRGDRPVPGQGRIALRHPGLAAAGGVRPAPDDPPRAGGGYPGTSATTAHHASRQGLRGAGALDPPGPGPARRALEARRRRAGQRRRPVPPAA

SEQ ID NO: 26431 - protein, 82 aa, Pseudomonas aeruginosa
SRTTARLLPDLARRPSMSQPLTVECPTCGAPVEWKSDNKYRPFCSDRCKLIDLGAWAAEEHAIPGDTLEDDIFSADLPPREH

SEQ ID NO: 26432 - protein, 385 aa, Pseudomonas aeruginosa
TQRASQSGWPVPSGAHESVVALVIEILRKKLQFAGQVASIALRPVQFDDCAEQRAQAHCPVRLVALRQQLSQALSGPFMDTHVPLLTWENGRIAAGFVRNTDASQPLPAMNLANDWSSGLALFVLPGCLQVARAIEGFQPLRVVDHQAGDHRAVDEGLGEHDQPQVTGEVLQPGRHREKAVDPDHAKAEQQDHHRGEGRREETAAEDVDEQVARLALFHEQRRQLRDQRGDRHQQHAVDADRQPILAAEQAQAQLRHQPHHDRQRPVEQQGDGGHADEMEGQPRFEVPAHQPEQEQPEHGTEHQVLAAGIADQLDPGRAPGGEQQHRRIDGPAQFQAFRRQQLGSDHGCSCSRAMRRATGESNWRVSNTRRCSSLTQSTLPSSEA

SEQ ID NO: 26433 - protein, 204 aa, Pseudomonas aeruginosa
PFGRSASAALTSFEPPMSRATSRTRVESSSECAFSNWSCNVQGSRVEPFSRASARPGSSMASRTQCNRFTRVPPEWKIPGCPCAAPSPTGLARMPGPPRRHPGRRHGICRSPPSPGVPTPRRASAAPAPALDNRDRPPGAGGNHGDRHARPSGRRSPPLRFRPAGSARGCVEGRRGRRDRRPPHGGGYLAFATIARRVPGDRRR

SEQ ID NO: 26434 - protein, 228 aa, Pseudomonas aeruginosa
RARHRPRRTGPAGLRQPEARGARFQYALPAAHRIPAPRLALSVDGRSDLCPGALRSLRRPRIPARQPRPQHPVRRRGRPVSEGRVKWIGVRSGSRAPIQELEAVEARRGLGLTGDHPHPPRQVTLVQWEHIEALGTLLGRPLLPNEMRRNIAVAGINLLSLKDRRFRLGGALLETTGWYQPCGRLEKHIDHRTLKSVREQGGITARVIGSGVIRLDDPLVIEPPVCLE

SEQ ID NO: 26435 - protein, 112 aa, Pseudomonas aeruginosa
PTSKTEACHVQPTEPRRPAEGRAVPRLAAAPGRACAVPPVVPDVRPARRGHRPGPAQPPPQLPGLSRPVEPRSRRPPHGIPTMRYPHVPSHRDRRRRRRRAGARHPSRPHPG

SEQ ID NO: 26436 - protein, 203 aa, Pseudomonas aeruginosa
IGSRARHRLRHPGDRCRQHHQRLRHRGRCGTLHFPRYPRPGRTLPPTTTRPVPACAYRARREQQRSEYRHHRRRRHRRRTGCGTAPRRADAGRLWARPDPPGRPAHQPGRSRPAGAAGAARAYQSAGTPDPEQARRTGDDRLRGEQGRYGRPLDRRRRVRPGDAQGLGGGHPGSGLPQGTRRPGKQPYQPTGGPPDPADHPRR

SEQ ID NO: 26437 - protein, 686 aa, Pseudomonas aeruginosa
PPRSRYGIALSRYFRPTVSAASAAEPVITGVFSYSSPPSPLRKPRSSTGQRQKTTIVAVSASPQAIAHSILRLETDRSATCLRISVSFPCKNRAPGRLTMHPAFPRNQASLSFPPPSPKPSGSSTSIVPSLRAGPLLRTGLMGMAMLSSGLASAAPDAGQALRDVESRRLNLPAPVELDAERPSPEDGVSRAAEEGGPTVLVKRFQLSGNRQFDDRRLLALLHDLPGQELNLSQLHAAAARIGDFYREKGYVLARAFLPAQEIQDGTVRIEVLEGRYGRIELHNTSRTLDRVLLRPLSALERDTAVQGSELERALLLLSDIPGLQAKGTLLPGQAQGTTDLRVEARPGPLVGGRLEADNYGGRYMGEYRLGTTLDFNSPLRLGDQARLSLLGSDRHQRYYRAAYQLPLGSRGTRIGLAHAETTYRLVRDFSRLDAHGRAITDSLFVSQPLLRSRSLSLSTQLQYENKRLRDDQERTGRHSRKEIRLWTASISGNAQDRLFGGGQSGFSLAYAHGQLAIDSGEERLLDRYTIGTAGSFDKIMLNAVRLQHLGDRLQLFAQLNAQWSGGNLDSAEQFDMGGPYGVRAFPLGSYKGYGDEGWQASAELRYSLAPGWQLSSFVDQGAVKFLKHPNTTEGNRNRMAAVGSGATWYGTDHQVSLTAAWPLSQENNIEPERTPRLWLQATRYF

SEQ ID NO: 26438 - protein, 1415 aa, Pseudomonas aeruginosa
ASSRPPCRRAPLKGKAMNKSYTLVWNQATGCWNVASEGTRRRSKSGRGKALVVAGASLLGLFCQAPAFALPSGATVVSGDAGFQTSTDGRHMVIDQQSHKLITNWNEFSVRADERVSFHQPGQDAVALNRVIGRNGSDIQGRIDANGKVFLVNPNGVVFGKSAQVNVGGLVASTLDLADRDFLAGNYQFSGDSGATVSNAGSLQASEGGSIALLGARVSNDGVIQAQLGDVALGAGQGINLNFDGDGLLNLQVDKGSVDALAHNGGLIRADGGQVLMSARSADSLLKTVVNNQGTLEARTLRSAEGRIVLDGGEQGTVRVAGKQDASAIGGGNGGLVLNQGANVEIQRTAQLDTHADQGATGTWRILSHEVSVAAVGQANAAGDGSGQVHVAQGPAGANASDSNGVTIVQQQPAVDLAAGANGTSAVQSQSGANIGSGANGISVVQSQNGANIGAGASDISVVQSQNSPNIGSGVNGVTVVQSQNGANIGSGASGITVVQSQNGANIGSGASGISVVQSQSGPSIGSGVNGVTIVQSQSGANIGPGVSGIDVVQTQTLTNLSPGANGSSIVQVQTLPDIAADAGNVHVVQVQTGGNKVFGNSATNVRSRTVQARSSENVGSGLANPSSAGKGPTLHADTLARNLSTSNVEVVATRGNAHVGAPLSWDSSNGLTLTAERGDLRINGALTAQGENASLTLNAGQRPLRIDDSLSLTGQGARVEFNSDKGYALAEGARITLSGKNAGFRANGRDYSVIQDLQQLRGIDRDLGGSYVLGNRIAGGHSSFLSIGNASAFGGTFDGLGNTIDNLAVYGTGAYSGLFSVNRGTLRNLNLERISADGAQATHYNVQVGSLAAVNLGRIDNVNASDIRIAAASQLNSLGGLVALNLGSIDNASASGTLVGNRQTYALGGLAAENISTARGVASISNSRADFAISGQLKDHASHYGAGGLVGRNRGGLIRSSGSQGTLSLSGHGMNLGGLVGYSSAGGLADVSASVDVSGNGQRGLYGGLIGLNVNSGIAHATASGKVRGTDAEALGGLIGRNLNAAINNASAHGDVSLQAGRYLGGLIGHNQAGNLANVSASGNLSGGSLLQAGGLIGLNANASLVNASAKGNVATRGAEAVGGLLGENLYGSVINGSASGEVTDGSGKTLGGLIGSNLGGNHSNLKASGWVNAGANSDVGGLIGHNRGGNHSTLAASGNVTGGKGSRVGGLVGYNDAASLTNVSASGNVSASGSRAIGGLIGSDLRGSLMLASSHGIVNDKTGHNLGGLVGRGENTSIRSAKASGAVSGGAGIRAGGLVGSLEGWQALILGASAGGDVTAGYDSYIGGLVGFSTATISGASASGKVGGSGLLGGLVAWNQGNVMGSSASGRLEPQIPNQIHGGLIGINFGWQSWNSVYGAAATVPMIGRHYNL

SEQ ID NO: 26439 - protein, 312 aa, Pseudomonas aeruginosa
EGFPLPLQRVCLAASNDPTLEAVDMNAKATSVVSTKGGVGKSTTAANLGAFCADAGLKTLLIDLDPVQPSLSSYYELPEVAQGGIYDLLAANITDPARIISRTIIPNLDVVISNDQNNQLNNLLLQAPDGRLRLANLMPSLKQGYDLVLIDTQGARSALLEMVVLASDLVVSPLQPNMLTAREFNRGTMQMLDGLRPYERLGMRIPKVQIVINCLDQTNDSRAIHENVRAIFDEHQDISVLETTVPDAVVFRNAASRGLPAHRLETRQPSNRTSAPALEIIRNLAIEVFPEWTDRFLALTPEAVAALVKGGR

SEQ ID NO: 26440 - protein, 195 aa, Pseudomonas aeruginosa
LHRTDRSDQRGAGNPSALDRRSAIGSGGPHMNLQNRNNLILSLIAETQFDAYVQGYMAKAGAAAGASDNLLVEAEGAAMLQGLVAPVRAQQRACGQPLQNALLQIAHDLLLQTKSQLAIAANASSIHVIQRDMNRAIWNIATAIDHLAEFAQPSQDTVKVIERLMLFVGSSPSPEGQQLAAEASAVLGMSEGGLA

SEQ ID NO: 26441 - protein, 220 aa, Pseudomonas aeruginosa
IVTSTTHTTWCARFFPPRTPQKEKPRCWSAPAAGATTSISWRLSLMNTEARFPSIHASAAFTDSAVVHANQVGVNPIELDALSQVISRLSRDESTVAPSSMERELRELEELGYIEISTTQAGTLVVTTRAPGQLLSAYFWSVWIPRHLFSCSLKVSLVPHLCCGTQDSQHLTAVFRIAGSKDAAREFLHQLANNYPGHEPELPELVAVQIGDALSKEAES

SEQ ID NO: 26442 - protein, 81 aa, Pseudomonas aeruginosa
RAMPDVTAYRPVADELAQLRTEVRMLRSAHDDLACSRQNDRRCLQELVKRLLTAAATDSLPRSLAEMETWLQLNSEETTDA

SEQ ID NO: 26443 - protein, 415 aa, Pseudomonas aeruginosa
FPSRRPGKRPPAGGLRSSRRLERRPLRRRPLEAQQDRLRLDLHLFHAKRRTRRAQCPRPAPSSRQAAFPEPGVFLMPIKHAIVHLIEKKPDGTPAVLHARDAELGDSQAIENLLADLNESYNAKNKAWGFFQGESGAYPFSGWLGEYLEGDRDFVGFSREAVEHLQKLMEESNLSTGGHVLFAHYQQGMTDYLAIALLHHSEGVAVNESLEVTPSRHLDLGQLHLAARINISEWRNNKQSKQYISFIKGKGGKKVSDYFRDFIGCQEGVDSPSETRTLLKAFSDFVESEDMAEEQAREKTETLVDYATSQARIGEPMTLDALSELMDDQQPRAFYDYIRNKDYGLSPEIPADKRTLNQFRRFTGRAEGLSISFEAHLLGSRIEYDEERDTLRISSLPTQLRDQLKRRKAEQESTS

SEQ ID NO: 26444 - protein, 631 aa, Pseudomonas aeruginosa
PPLGQQRDRLPAGAQQRARRRTRSSEPNGRRALRQEPASAGRAGCGEHASGGGGMSMAKINPQDLKDRLLAPGFTAPPVLEQLSDPISDTPMVLTLDQVLPWHDNPRTTRNPKYDELKESIRHRGLDTPPPVTRRPGEDKYRIRNGGNTRLEILNELYKETGDERYFRFNCLFRPWDKQRGEIIALTGHLAENDLKGDLKFIERAVGIQKAKAWYEEEKGEPVGIRELSRKLTDDGYPVSHSHISKMLDAVEILLPAIPVMLYSGLGKPQIEKLLSLRKSASSCWARLYAGEGIDFEMLFQDTLAIFDSSPDEFIFDRFQDELIDQMKRPLGLRYDQILLEITNGQQEQRRGTLVDLPAPAAPPEIPPVGQESPAASTTGQAQSQSPAAGLQTSKTNSLPGNPSTPPTPPLPVQQQQLTDEERAALLAGHIVSPVSTKIQQTRQRLAALEGEHLPVFDETALQAIPVQVGGLHPITDLWYIERSIDTPEILRQHIADLAEEIALHVGAPGEIVRIQGGVGYTYREPNEDPEITDSALHLMTLLQALSGQVQVVLNSHDQQTCRDALGEFQFSAGLAQLLLGQPTTSDQPSNQAGRLNDEALVKLFRIIRLARRLVDLELPPATFEQAATDQ

SEQ ID NO: 26445 - protein, 260 aa, Pseudomonas aeruginosa
FRTIWGEIDMSKSLINEAVLTQVLNHLRNGQLRRCAEMGLRPEILAQLQQPAVMSILTNTPVSWVDVRVNIDVMEKILATAERSAQEELQIERALKLGATTTMIQSFFGLSPEDTATKRLILEIHPRRGRWRQLDEQTERQIWFRWEHLMQENQVRLEDSMELLDIAMILTEEVNAGVEQDSPEFISLAIVWSLIQSWLKDSLYQPNRKEQAKPATLYLANVSAHLPSPTAHPPQSPRLEIESAQQQLLNLVQSEGDTTP

SEQ ID NO: 26446 - protein, 159 aa, Pseudomonas aeruginosa
CGPASLCQVLTSAPVANWVLPLATLCQGSNSVPSTSWVVPLAPLHQDPASAPSRSWVIPLESPHQGPTPAPAASWVLPLATLCQGSTSAPSTSWVIPLESPHQGPTPAPAASWVLPLATLCQGSTSAPSTSWVVPLAPLHQELTSAPVASWVVPLEPLH

SEQ ID NO: 26447 - protein, 113 aa, Pseudomonas aeruginosa
ELTSAPAASWVVPLESPHQGPTPAPAASWVLPLATLCQGSTSAPSTSWVIPLESPHQGPTPAPAASWVLPLATLCQGSTSAPSTSWVVPLAPLHQELTSAPVASWVVPLEPLH

SEQ ID NO: 26448 - protein, 94 aa, Pseudomonas aeruginosa
ELTSAPAASWVVPLEPLHQELTSAPAASWVVPLESPHQGPTPAPAASWVLPLATLRQDQASAPSTSWVVPLAPLHQEPTSAPVASWVVPLEPLH

SEQ ID NO: 26449 - protein, 180 aa, Pseudomonas aeruginosa
ELTSAPAASWVVPLEPLHQELTSAPAASWVVPLESPHQGPTPAPAASWVLPLATLRQDQASAPSTSWVVPLAPLHQEPTSAPVASWVVPLEPLHQELTSAPVAAINFSHPIGTEKMCDSIVYAPMDELEFERLLGLATLFNDNDEWPIDFTELQELSELLGKLKSCVDVAIDNAPEAAKS

SEQ ID NO: 26450 - protein, 294 aa, Pseudomonas aeruginosa
RRPTSMSRRRDDDEPALPAEIPQRRTMYFLLRAPTPISTMWPNPFPIKEHCTMAETHRLQIGSLRSDVALTLHTYHAARIWTGRQKSDAKHSILGLSGFCAYVNRMHRGAAQDDPYSDWWLVQIEEKVESCQAALKAIDQRLDDVMAKLPATLDISENLSVTPVKVPLFISNPLGFKAVYLLTNYDELARRILLAQHVGLVGRRDMEVWLDEGASVLRSLFGLAQSYQFSGATRDDFAANNARAEVARKMYEKFGEIPQDILEGTRRSNFAPPITRGRSDGDADDDADRVELED

SEQ ID NO: 26451 - protein, 183 aa, Pseudomonas aeruginosa
TARVRGQPRHSLPLQTTLHPLTPDSTDWRFIMATPVFWEGNIGSAPEHRSFPNGNNPPRQLLRLNVMFDNSIPDGQGGYKDRGGFWCSVEWWHQDAQRFAELFAKGMRVKVEGRAIMDRWPDKESGEEVQALKVEASRISILPHRLAEVTLLPSTNGQATQHQQTRQVSQQDYDSAFDDDIPM

SEQ ID NO: 26452 - protein, 722 aa, Pseudomonas aeruginosa
PRTGRLPCRPGLPLVHGTDSLWSHSDEPELARHDRPHDTLRRWSLEGGPRRSHGEVAAHSVGKPMSRPRLVNRTSATPSTLLQRAIFDGYDFGLKIPYIAGSNRALLELSGFFISAREHPLHRYWRVPKGKLLPELDSLYNRLAELAGGLHSQSWRDFSGMVESAQASLDRQAFTWGLLLRIAPLAEGGVLLSGEFHPGVVAVARRMRGVFLRPSSSWRIDATPELLRSNLILELGLAEEQFEILDTVQELLSDGSFAPATELPSMSIGGPQQEPAAPSLEDESACDIYLAAVPEIERTEYSSADIEAALQGYSLLAHQPAGIAHLLQRTSALLADDMGLGKTRQAVIAASIRAAGRPILVITLATLLINWQREIQEVYPSATVAIQQDNPEAQWILVNYEQLSPFVANASRFAVMVIDEAQRMKEPTAQCTRHGFDIAAQVPNRYLLTGTPVLNRETELHTLLRLSGHPIGQLPLKEFCDRFAGNPEFRQSLRAELGDWMLRRRKDVLPSLKGKQRQLLKVALSTEERQQYDVLRLEDRPIFARLGALRRYLETVKVRVAMDLLSELDAEDKVILFCEFKPTVAALKELCEQAGLGCVTLVGNDSLTKRQKAIDRFQQDSDCRVFICTTAAAGTGNNLTAANYVFFLGLPWTPGQQEQAEDRAYRNGQLRMVVVKIPLVEGTIDEQLWQLLNAKRQVAQDLIEPEQVDGNRALLAASLAER

SEQ ID NO: 26453 - protein, 91 aa, Pseudomonas aeruginosa
RTTAVTAVVDHIVVDVNQLFIFEPFTTFVARPGLYLISCYGDTLVLSEDLVSLYGAGGGLAIDKNCIGGTLSVFKRLVWEEGGHAQGRIAG

SEQ ID NO: 26454 - protein, 146 aa, Pseudomonas aeruginosa
NAQLAGQGCLAVAFFIDALAQLDCGLVAESITDDHGYTLATVFLELRLYPAFVEVLLVGHTGDLPMCQALFGFYAVAPVAAQLVEVPVGIALLNFFIELLQQFHMSTLRRSHIASIGAVEAVQLALVGLVQRLRAGIVEAGTKLQA

SEQ ID NO: 26455 - protein, 77 aa, Pseudomonas aeruginosa
YRRPVQPERRLWVDSPTTVRVMLLDEATGESLLLTGLPCRISLSRAEIAGLIASIDADAAALRPALLNKLKRPRLLG

SEQ ID NO: 26456 - protein, 105 aa, Pseudomonas aeruginosa
CWKTMARSTPGPSMGLPSSRISPRLSVSRPAMMRSRVDLPQPEAPTKVTNSLGWMSRSIDCSACTSRRSLTKVLPTWCTRILASDMVISSSRERRGGATSGRPDR

SEQ ID NO: 26457 - protein, 196 aa, Pseudomonas aeruginosa
CSANDVLRARSGWGVMAIPPVGSAADGCRSRCRTGRLPPRSSPAQPHAVAGRPRRRRRGRSGSRSQGRWPGAASRPRRPRWSRRSGSAARCRGGAGSVRDRYGRRRCSPACRSPARRRAVAARRSGHGRIRRAPAGGRGGQGCRWQRRWPGRGGVWARAGRKDPVDGLHGCAPPACPRRARNPAAPGSPRSVRAGG

SEQ ID NO: 26458 - protein, 673 aa, Pseudomonas aeruginosa
SSALCMSHRRQERDAHGAVEVVGLVRPFADHPVVIVQHATYAVAVEAAEQLAHRDDLVVGAAVQLGVQLGQAIPGRHRLLVVGVVEGKVEQQQVQRRPALGNHVAVGVLLLVAAVAALVLRQLATVLQHGEGLVGVLIGIGETQHAEHDHPGHGVEQQGLQREHREPGKEQCANGQHRGDLAAPGAVLVVVGDEGKGDHIEMHDQLHRRHIGPFQRQHQLLEPQRACLEEGLAVEGDHVGAVDVVAHVLLAQVLELGVAAAAQPAADIAGPFVVLGHAEDGAVGEFVDQVGGDDHAVGQQQRAQRVQPAVTGEQQSQAAAVGERGIEDRQRVGQAAIGVTVQRFGSHGFSPAQAGRGPPGVGLLGERFGELGVVGLAEIRDGRDLPVVLEQLGDDRAAAMEGMGVVAWGEALAHLRKGDVVGAGHLLDGFLGADAEHVADDLRRLLRVRLHVGQAVEIALDHRLDGGRLLGDHRLVEDQHIGDQPRCVLGRIDHLEFVAAAHGEDLRDVGLVGHADRQVARGHGAGDAFRSHVDGVDVLVAHAVLLQRVGQQEVGGRQRVEADLLALEVGDGLDRRVGNDGVTAVGEVDGHHHAVLQALGDRGHYLIVGEHATVQRAAHHGGGDQRRVVEELQVHVQAVGLEQVELVGDVEGAIAGPDHGADLQLLGGLAGQR

SEQ ID NO: 26459 - protein, 75 aa, Pseudomonas aeruginosa
LASAAVAVKKVTQSSVRQAGTTPAVEISPLLAFRPTRLFSAAGTRPEPAVSVPSAKEQSPSATASEEPALEPPEG

SEQ ID NO: 26460 - protein, 443 aa, Pseudomonas aeruginosa
RPWPYFSMTSSAFSTPPKLSCQPQVSAVMAASTRPMSEYRQCPAVSLAVCWPLRVSGRFSRSLFSWALSSIRLTLAPPSRSVRRSSWPRLRMKEVWPPPGTVSSYSVGRIASEALMSGSLIGSAKRVGEGGRHACGRAGSMAALVQRNVVGHPCAIGTRGVGIDARFVEDQDAAAEGEAFREVMGDHEHRQPGFPPQLQQQLMHVLANAGVEGAEGLVQQQHAGLHHQRLGDGQSLLHAAGELCRVLVQRMAEADLVQHLRSLLTGIALAASEQTTQQRGAREFQAEGDVVQHRQVRKYRVALKDHAATGVRFVCQWLAIQQDLATAGRFLAEQQPQEGRLAATGGTDQGAELTFGNLQVQALQHHLVAILLPDIPDLDERSGIACAAAYRCVVLQVGDGSARNGCALSVAHALAPSYQGNSSWVRRRSEKSMAHASRVIQAT

SEQ ID NO: 26461 - protein, 594 aa, Pseudomonas aeruginosa
RCRTALPGERQPAAVPDHHQGAQELMRAPLKNLLPCLLIPALASCSVTRVNESADRVEATADSASTIAAQMRNTRPDRRDTVVFSDKPWVSTKPLSVSHTLSSDCIVTWRPAGAASLQEAAQEVINQCHLAVSITPDALNPAAFALQPQQRASNAPPPIQGGQDMATMLFPASVANGMSLGAGGSIGSSFGSYGPRSLYNIKWNGKVSGFLDLIAARAGVSWRYNPTEKRVEFYYLDTRTFRIYAFDDVNTVDSTVRSGMTTAAGISGDGSGSTGQNGSSGISGDSGSKQTTSSELKTSILSDIENSINSMLTPSMGRMSLSRATGTLTVTDRPEVLNRVQQLVNRENESITKQVLLNVNVLSVALTDKDQLGIDWNLVYKSLNNKWGIGLKNTMPGIDQSAISGSVSILDTANSAWAGSKAMVQALAQQGRVSTVRSPSVTTLNLQSAPIQIGRYDSYLASSQISNVAQVGSTTSLIPGAVTSGYNMSLLPFVMESGEMLLKININMTSRPTFEMQTSGDSKAQFPSYDIQLFDQKVRLRSGETLVLSGFDQTTEDTNKVGTGDAGFFGLGGGLTRNTKREVIVVLITPVVLG

SEQ ID NO: 26462 - protein, 442 aa, Pseudomonas aeruginosa
TMEKPDIGSRGPDVSILSYHGNKFVSGLFWRPLSSQRQYMKEARKLGKEEHLDIVAIRHSPTVIQAGFVSKSQGAVKGMYSLASALSGQFEGDFLACWKVDEDRYALVATLDGAIVPGQDLVTTFDEARDRIRKLSTRGVLRNAQVFVPEGFEFPVKDFDIEELLAPKRLRRDYRLRQLTFGLSAREWTAVALLGCLVGGSLTAYYLWNAHQQELARQAALLEEQRRLAELAEKNAQAKQPLDLASLQKPWTLMPDLEDMLRACSKATGVLSLSIQGWLFESSKCDGRVLVATYHRTGNSTAADLTAASQHLFADRPAFVIDNGNTAALKVDLKVAIGSDEPLQPADDALQALTSHLYRQGVEPKLSISQETTPPLPGAEAATEQQVVLPSWKKFTFSAQTRLPADLTFQGLPAAGVRITNLETTLKDSQLDWTVTGEIYAN

SEQ ID NO: 26463 - protein, 596 aa, Pseudomonas aeruginosa
RRQRRGAAGQLPRRVDLPGPGRTHRQGRQPRARGLLQRCPHPSRLLGPRRLRSAGAARGGTAAVHPVGTAMTNLQIAALAQPSMVTQLLTADGGEWEVSKHLQEIMALAADGTLYLSESHQNDIHVLSFIDRLDRRGFRYQLNLTDLQTIHQLYRAVAMDGLVDSDGQRATQMQERVVKIIRKATELRASDVHFVVSPAGTGSKIRFRVDGLLKTVEQYRSQELHELCATIYQSMCDVAEPLFKPQLDQDARMSQAFVEKLNLFGARIATRPRAGGFLMILRLLYDDTGLDSLEQLGYLPEQNALFDRMMRMPYGINILSGPTGSGKSMTLKVTMEGLDKLHGGSKHILTIEDPPEYRIRGEGINQTPLVYDATDPDAERQAWAAGIANGMRLDPDYMMIGEVRDLFAAVAAFRGAMTGHGLWSTLHTNSAIGIVQRLKDLGVDPGLLFDPALLTGLINQSLLPKLCPHCKVRFQDHQDQLAPDLVERVQRLTDVSQVYVKGPGCQACRGSGVNGRSIVAEVVLPTLAFMRVFAKGGPAEARNYWVKTMQGITKHAHAIRRINEGMFDPQIVEDFIGPLDFDEHLLDDSFYSQEAC

SEQ ID NO: 26464 - protein, 94 aa, Pseudomonas aeruginosa
SNTGPHPEGLSLPTLCATLHRIPTRGAPSPPGRGVLHYLEIIMSNIQIVDLPALPEVEEVSLSDVEDELLLSSQFCNFAWLFLASNNAQVSALA

SEQ ID NO: 26465 - protein, 248 aa, Pseudomonas aeruginosa
GHGLPGYWRYPMTQYNPFIHGYTDFRIERTLQITYEDDCPPCYRALHPSQQILSDTQLQCFPCIFNDDFALVTEGREIDTALSDRCPYNGLVRNVLYGILAEQDGQQKHIGDLYSLAEAQSVVRHLSFGGGYNRCWEIRKTHLPISAWNSLYERFSTKMPIRLPSVLVSLFWCNEHGAVGFRLHNTPWTDECLEILEMTAAALRQEQLAFGLDEHLVDLLHLAGQADIRFLVLDPFAPTLKGLPLYDD

SEQ ID NO: 26466 - protein, 250 aa, Pseudomonas aeruginosa
AFLPAHRAAGRKPPGQPGYRVVLPSPRSRFGGIILFAGHAMINIPGQLAIRTINGRNGEFNVGKLSTSIGEFVIKDALLDQHIEGKYRGDFAITEIRPSYYTTGGRLVVEIRAKLDSMTLDDVDNLSDEEAERLSGNEVDPLDEVPAIQQPTVAPAVPPKSPQKPKPLRPAATGEDAPFGMSPPAPAEQAATPDTDADAELFGTVWPLGEIVKLDTTVDRKRLRQQCVRLGALGYELDFKQQVWTRKEAA

SEQ ID NO: 26467 - protein, 101 aa, Pseudomonas aeruginosa
GAPSRALLVYHQERTMNPLFTNLTQETLAYLEDQLSNNDVAGDDELIDLFIEELSLTLEQAEAAVALRDQYLCQVFLVGQGPLHRPEADGLSFDPHTKSVR

SEQ ID NO: 26468 - protein, 787 aa, Pseudomonas aeruginosa
RLLTSPPRRFLPLHPAGYGDTRKGRACPAFFLHLQEMHMNAQTQPAALAASSLNINLTDFIDEFGDELLESLNRSNPPVYTGSDNAHRQLVMDRLKRKPFAAQAEVVQAITALLLDRNEQAGIINAEMGTGKTMMAIAVAAVMHAAGYRRTLVVSPPHLVYKWRREILETIPAARVWVLNGPDTLLKLLKLRDQMGDAYDGRQEFFILGRVRMRMGFHWRLACWKKRAAGGQLLAACPDCGQVLEDLEGNLVTVEEFERGDRRRTCSSCRGALWTLIRPGKPDGGNRRATILKSMCRIPTIGPVRAERLLNDFGEDFLATMLVDNVSEFINLMDAKGDFVFSDRQAKRMERSMANIEFGFGEGGYQPTEFIKRQLPNGYFDLLVVDEGHEYKNSGSAQGQAMGVLAAKARKTVLLTGTLMGGYADDLFYLLFRILTQRMIEDGYRPNARGSMAPAAMSFMRDHGVLKDIYTERDGDSHKTARGKKLSVRTVKAPGFGPKGIHRFVLPFTVFLKLKDIGGNVLPDYQEEFVDVPMAPDQASAYQRLAATLTAELRQALARRDTTLLGVVLNVLLAWPDCCFRPEIVKHPRSRDTLAFVPAIFGDEQLMPKEQALVDLCLEEKAKGRKVLAYTVYSGTRDTTSRLKKVLEQSGLKVAVLRASVDTARREDWILDQVDRGIDVLITNPELVKTGLDLLDFPTIAFLQTGYNVYTLQQAARRSWRIGQKHPVRVVFFGYAGSSQITCLQLMAKKIAVAQSTSGDVPESGLDSLNQDGDSVEMALARQLIAA

SEQ ID NO: 26469 - protein, 178 aa, Pseudomonas aeruginosa
PSPRRQPTGDQSMKKILATLAFCTAFATQAWAAGLIVVEDLGGASALPYYQGLDPQPSAAAPGPGDLGVRGSGAFPVRSARLSPGQVQGRAINAPGLQPLFLVGDDTLSQTWLKERGDELRDLQAVGLAVNVASEARLTEIRAWGKGLQILPAPADDLVDRLGLQHYPALITSTAIQQ

SEQ ID NO: 26470 - protein, 517 aa, Pseudomonas aeruginosa
LHSHSPLFNQTPTNLEALVSPETPMQWTHEQSPIIQSKASKILVRAFAGTGKTTTLVGFAKANPTLRILYLCYNSSVEKAAKGKFPRNVVCKTAHSLAHAVYGIQYAHKKTKNLRLTDIARGLDTQDWELVRDVLATLNNYMASADAELGRPHFPRFRDKAFLTSAQERFLKQGLDMARVVWRRMVDLQDTGMLMPHDGYLKLYQLSKPDLSQRFDCMLLDEGQDINPVIADIAHWQRIRMAIVGDPHQQLYRFRGAEDALNSDWMVGAEEHYLTQSWRFGPAIAHVANIILSYKGETRKLQGLGPQTLVKKSLPADLPHRTFIHRTVIGVIENALQLVRNHPEPKFHWVGGIDSYSLRDLEDLYAFSRGLRQNVQNKKLLRDYRDYTQYVEIAEISQDGEMLRSIKIISTYPDLPARILELRSLTLDDELDATITLTTAHKAKGLEWDFVCLYDDFNADPLSPDTDPGKRDDELNLIYVAVTRAMKILAINSLVLSIMQRYVDDRQLKEQIAICKK

SEQ ID NO: 26471 - protein, 67 aa, Pseudomonas aeruginosa
PSIDKPKLLVPTIPWSVYPVFDSSSPPHYIATTIHCGPFNFTAIRVAALPKHIINQVTLTNNCRPAS

SEQ ID NO: 26472 - protein, 95 aa, Pseudomonas aeruginosa
PFRPIWELHPARRADAVSMSGAQTSAFQAAAGFPPSAGEGLFIGAAMTFLLLWSAWAMYSTWRGWATNNLDSATAGASAIRILVLLGITSFILLS

SEQ ID NO: 26473 - protein, 144 aa, Pseudomonas aeruginosa
SFISSPKPPPSCKGLPMPEEHLFQDGTLSFLPTRLNRQPVVIGGLTADEMWITVFTSGAAGFALGIPAALVVGNAACIPLGALLVGALGLGIGSRVLRRMKRGRPDTWFYRQVELALSLRFPVFGNRHLVTRSGAWTSRRTESP

SEQ ID NO: 26474 - protein, 525 aa, Pseudomonas aeruginosa
RAAAALPTRSCPPPSARSIPKEAVVALTGNPLLKLLVIPVVIGAILIGVSMMGKKESAQSQGAATPTVTSEEAATLGIDGDTPADTLRTIVAESRQLKDQISKVIQENDSLKAANENLQGRLRSIDQNIEQKLNNTAQELQQQQENRSQTILDQVQKRLENLTHVPEAGDTDLPVGFGVRPEDGQHFQGAGSSSSDIVWIEPQDARAVDANGQPLAAGSTTQPSGFSFPTSFGNAVDRGQNALERIDDGLHPVGQQRSDLENRKLVRKTYTLPQNSTLMGSVAMSALIGRVPVDGTVNDPYPFKILIGPDNLTANGIELPDVAGAVASGTASGDWTLSCVRGQIRSLTFVFNDGTVRTFPAPAEEVNDNQSNNNQTASADQKTIQGGLGWISDPYGIPCIAGDRRSNAKEYLGNQSLLTAAGAGIAKLLDADENNTSTVFSGNGTSFGTTGTNSNSALNSILSGGVGDIRQWMNKLYGEAFAAVYVQPGARVAVHLDQQLAIDYELKGRKVDYSSGAAHATADLD

SEQ ID NO: 26475 - protein, 1049 aa, Pseudomonas aeruginosa
PGRLHPHGQQRDPQPVQTTAQSRPGHVCVPAPGRQRSRPGPGLHHRVPLLPASPVRHAGRAHGGLLMELLQFFRRRAQGHDAAIQEGQNTAPQEAKVQDALREEATERYLARLAAMGIPLPNTGSKNGATQAEASRLYDHDPSFVDLLPWAEYLPDEQVMLLEDGRSRAVFFELVPLGTEGRDPNWMQNARDALKEALQNSFDEHETSPWIVQFYAQDEISWDNFQEQLRQYVHPRARGSAFSEMYLALMKHHLEGISKPGGLFVDTAVSKLPWRGQQRRVRMVVYRRIRKADAQIRGQDPTAYLKSICERIQGGLANAGIVASRMSGQDVRNWLIRWFNPHPDHLGKTDADLRRFYELVCRPDEPILQDELPLADGTDFSQNLFYRQPVSDATQGVWLFDAMPHRVIVVDQLNKAPLTGHFTGETLKGDGLNALFDRMPEDTLLCITMVVTPQDMLEGHLQQLSKKAVGDTQASIHTREDVATVRRLIGREHKLYRGSIALFVRGRDHTQLEERCITLSNVLLGAGLVPVEPQNEVGPLNSYLRWLPCNFDPNEKRALEWYTQMMFAQHIANLSPIWGRTTGTGHPGFTLFNRGGAPLTFDPFNKLDRQMNAHGFIFGPTGSGKSASLTNLISQMLAMYLPRMFVAEAGNSFGLLADFAKRFGLSVHRVRLAPGSGVSLAPYADAIKLVESPDQVKVLDAEDIEASDSVQGSKADLEDDQRDILGEMEIVARLMITGGEEKEDARLTRADRSAIRQAILAAARTCAAANRTVLTQDVRDALYQASRSDGSAPERRARLAEMAEAMQMFCMGADGEMFNREGTPWPEADLTVVDFATYAREGYAAQLGIAYISLLNTVNNIAERDQFKGRPIVKITDEGHIITKHPLLLPYAMKITKMWRKLGAWFWLATQNIDDIPASGAPMLNMIEWWLCLNMPPDEVEKISRFRELSPAQKSMMLSARKESGKFTEGVLLAKGKEYLFRVVPPSLYLALAMTENEEKNQRYNIMQATGCDELEAALQVAADLDKARGLPPFPIIFPDQPAVECQDE

SEQ ID NO: 26476 - protein, 674 aa, Pseudomonas aeruginosa
RDHQLQGREQHRPLQGSGCDRPSWRGHVQPVRQRLWVRLPWCHLPAGAVLPQHTGRHWLAAWNSRAGVPRSVGPRAARGGGSLLRRHVGEPLSAQRIPAPDRRLQDGSRHRPARRRHHHASRPTPRLPSHARSPQGRLLAGGRAERGRCLDREMAGADPVPEPQLRGVSQLRAEDASRRRRLRLGALASLLLLPAQGADLPRQYRLPIRTRRRIMRMNITSVALTCLLAAQLAQADDPINVSKTGTVLSDEVLYSIGGGSAVSMGSAGQMDSIGVGFGWNNDLMCGNMNLSTTLENQLNGATQGFQNIMGSVIQNATGAVMSLPALIIQRANPQLYNLITNGILQARIDYDRSKGTCRAIAEKMADIAGEQTGWGKIAEGQALGATLASGGKDAVSALEAVEKKGGNDGITWVGGDKAGGSGQKPIRIVNDVTRAGYNLLTSRSVNDSSSVPSATCNNGLVCNTWSSPQEAAAFATRVLGEQQQQTCEGCQKTVTAAGVGLTPLIQETYDKKLQSLQELLSKSKPLTAENLAAAGTDALPITRGVIEALRDERDQDVLARRLASDVSLMDVLSKALLLQRLMFAGAKEPNVAANGLATQAVDQQTSLLQQEISNLKTELELRRELASNSPMRVIERGQQRASGSSGVFESAPDADRLDRLQAPSAADGKTGGRP

SEQ ID NO: 26477 - protein, 234 aa, Pseudomonas aeruginosa
SNSSATDSVSACEVIVETSRLGDPLETEMSPLTKANPTRKTHSRVIDTPASHIKFCDTTRAANKNRLTRLTQRRAGRRSCRQKRTSIPRPKPIREAKPLLVCAFIINLLAPKGRHPAITYTPKKMIWQALWHIMPLAICRLEYLMATRNVVLPDPLEQDINELVETGRYQNRSEVIRAGLRLLLQQEAQNSAKLEALRNATSSGLMQLERGEYDEITSDDLTQYLDELGHQASH

SEQ ID NO: 26478 - protein, 421 aa, Pseudomonas aeruginosa
GQGVSMSRKPRTQPAALPVIPSELLESFGDGSMTAEAINAASLAFKKALIERALAGELNHHLGYPAGTAKPERMSNQRNGKGAKTVLTQEGPIRIDVPRDREGSFAPLLIPKHERRFTGFDDKIVAMYARGMTVREIQGFLLEQYGTDVSPDFISSVTDEVMAEVTAWQARPLEPMYPVVFFDALRVKIREDAVVRNKAVYLALGVLPDGTRDILGLWIEGTEGAKFWMKVFNDLKTRGVGDILIAVTDGLKGIPEALAAVFPATTLQTCIVHLIRNSLDYASWKDRKALAAAIRPIYTAVSAEAALAALDAFADGPWGQKFPTVCAAWRNAWDRVIPFFAFAPEIRKVIYTTNAIENVNSQLRKIIKTRGHFPTDEAASKLIWLALRNITAKWSRSAHDWKQAMNQFAILYADRFSRPSV

SEQ ID NO: 26479 - protein, 646 aa, Pseudomonas aeruginosa
IVMEPPMFQLLSWISRKPSPSQLTKAAPGGFLPPLSSMELLGTPRRRQLLENIWQRASLSKQQFEEIYRRPLANYAELVQQLPASENHHHAHPGGMIDHGLEIVAYALKVRQTYLLPIGAAPESQSAQAEAWSAAAAYGALAHDIGKIVVDLQVELQDGSTWHPWNGPINQPYRFKYVKSREYQLHGAASALLIHQLLPRTALDWLSRFPELWAQLIYLFAGQYEHAGILGEIIVKADQASVAQELGGNPDRALAAPKQSLQRQLADGLRFLVKDKFKLNQPSGPSDGWLTQDALWLVSKPAADQLRAYLLAQGIEGVPSSNAPFFNMLQDQAVIQTNAEDKAIWTATIDNGAGWRNKFTLLKIAPALIWADPAERPDSYSGSLVIEEGNASPEKPETTCEIPNDPIEQQQAPETKMTLRQPSPSVAKPSKEIRAIANPSIDDQEETDDLYALLGNITSPPSGLDTTSHASPAASPTNTRGEENLQQPLGTAEPADCAPETVEDVFMPSRSTDLGQGFVGWMKAGIAARRLFINDTKALIHTVDGTAMLVTPGIFKRYVHEHPELEKLAQAKETTGWKLVQRAFEKQGLHRKTNKNLNIWTIKVSGPRKTKELKAYLLQDPKLLFPVQPLDNPSLTVITDAEGGVE

SEQ ID NO: 26480 - protein, 147 aa, Pseudomonas aeruginosa
RERGILRSRTSWMRIACRLLLAGPLSTLAKAAAMVVPIGRSDLPPICPAPAPLLVSRGFVHLAETPPMARKKTLDFEQSLTELQTLVERLESGELSLEESLGAFEQGIRLTRECQTSLSQAEQKVQILLERDGELSEAPFDAEGDEA

SEQ ID NO: 26481 - protein, 174 aa, Pseudomonas aeruginosa
TLHDQPGEYPGQDVVEHDPDAAVHVAVHPTDRPGLENIHDAEHDEADQQPPPALRHQPEGYPHADHLVPDDAFVVVHAQVVGDLAAQPEAEQHGHSQHQPVAPVRQHLPQRDERDGHQRPPGARRLGQGAGAEAEGEEMPGIAPDRRRHRLRRRLIRMLSHVGFRNVGSRPRPV

SEQ ID NO: 26482 - protein, 181 aa, Pseudomonas aeruginosa
KPARSRRRRPVAGARLPRRRAGRSTRRLPASAGIRPTGQRRKRGRYARSRRAARRRCPGRRWPCRAGRGPDRIAGPASSSAPAAVRPPRRAPIFAPAPVPAPLQPRRAGPRRRAGRPGAHRRGSAPGRPAPCRIRSGSCSAGRAWCRRRPGPGRTAGPWRRGRGRSPATTRRRPAARSGPG

SEQ ID NO: 26483 - protein, 301 aa, Pseudomonas aeruginosa
SLPCRARRCGCAARRWTAAGWPARPGRSRPAGGPGRARRWSPARSSVAARRAGSRGSRRRRPRRSRCRCGTAPRSRAGAGRRSARSTGPGRPGCGPCGERRSCLSAAWLPGCRCLDCSLGLQLRQQADHFQGRQRGFGALVAGLGAGALDGLLDGVDGEDAEGDRDAELQGHLGQALGALASHVFEVRGAATDHRAEGDDGVEAALLGDLLGHQRDLEGTRGADDGDLAFSHAVADQGVDGAADQAFHDEAVEAADHQGVAAFGGNEGTFDGLQGHEQVSSVKEPGRRCAPSEKGRKVRPA

SEQ ID NO: 26484 - protein, 284 aa, Pseudomonas aeruginosa
RPPRSCTRRAGQALFGGQVFYNFQVETGYRIEAHRRTQQAHLAHAEVAQDLRTGTDGAVGGGGLGRRSRRRSDLADMGEQVVAADLVTEQQHHAAARLGDLGHRRAQAPAARLVDLQQVAQRVHVMHADQGRLFRADLAEGQRQVHVALHRVAVGDQVEVAQFAVERLLSDALDGALMDQPVVDQVGDGADLDPVLGGERLQFGPASHAAVVVHHLADHPGRLEPGHPRQVAGRLGVPGASQGTARLGHQREDVAGAEHFRRPRRSSPPQPARCGRGPRRRCRW

SEQ ID NO: 26485 - protein, 268 aa, Pseudomonas aeruginosa
NADSSGTRRAPVDQHPQRLASRGERGKLGVQAQFVGAYVEPRIVRQQRIGAGQHHAGASAQALHRRTRGGPGDPLAFPAGHGGAPVQAHRQLDPDERQAMFHALDETDVEFPRLGFEDAALHRDAGLHQTQQAATGDLGVGILHRRDHPRHPGAHQRIGARRGAAEVAAGLEGHVGGGAACILAGLAQGMDLGVRLAGADVPALADHLAVLDQHAADARIRMGGVQPLARQFQGAGHVQRVGGVHSLAGSRARRSISSRNSLRSWKRR

SEQ ID NO: 26486 - protein, 424 aa, Pseudomonas aeruginosa
RIRARPSTRRIDRRRHAGKGERNRTLRPTRSATRITLCAIQAPPGFHRYGAAHDPAPDRPAGRPSPRRLFQRQAEACANAASFAQRDHGRAGATGPPARAERNAEQHPGQPATRQRGADGTAGDRRARPSTAAAGQRDGAGHRRTHALPPAVQPRILPAGRWRAARRTARAGDPVRPVGLAPASVADRPADHPVPRRTAPGTRAVTAPQALTQALGELLGDARLSATALPGTDLRLWLIDAQNMDRQFSPEETRRILEEPPYWCFCWASGLVLARWLAERPQWVRDKRVLDFGSGSGVAAIAAARAGAAEVVACDLDPLALAASRANAELNGVELSYSADFFAEDDRFDLILVADVLYDRANLPLLDQFLSRGRQALVADSRVRDFRHPLYRRLDVLDACTWPDLAEPAEFRLVSLYHAERGQA

SEQ ID NO: 26487 - protein, 222 aa, Pseudomonas aeruginosa
RAAWRPMPATTRQPTSWPSSSSPGSSTRRPWTDCSSCSCATAATRTTCRARPWCRSSTCLATTTRWSPPTAASCTRRSTESPSPVRGAQSSSQTNTWVPSTTSTLTRASCRRRTSSCLAAPALPLNPSNSASNCGPSIRPLPRSRSWAVCHRRSTGAAGAGALAAATCGSPSGGGGTCCASWRQSSASSSRVRSTGQSPMLPRIRTISFLHKRIAPCSHVGA

SEQ ID NO: 26488 - protein, 266 aa, Pseudomonas aeruginosa
SCRIVPEAPRGIRRGAPPSILEAPAERSAPTPMSALITLTNLGFAWPGQAELLDIPSFHLERGESLFLKGPSGSGKTTLLGLLGGVQKPGRGSIRLLGEDLEKLSAARRDHFRVDHTGYIFQQFNLLPFLSVRENVELPCHFSALRRQRARERHGSPAQAASHLLGQLGLGGELHERRADSLSIGQQQRVAAARALIGQPELVIADEPTSALDADSREAFLQLLFAECREAGASLLFVSHDQSLAGLFDRSLSLSDLNRAARPAGL

SEQ ID NO: 26489 - protein, 116 aa, Pseudomonas aeruginosa
WRSSPGVALQELWGLMGTAEKALFVVSLFVVLTGLIGMLTAILTSLNGSPPGDGHPALGGRAPLAHLRPAAGRGLQPGAGRRRPRPRPALPRHRRQPGLRPGQLRHLPAAGLAERL

SEQ ID NO: 26490 - protein, 214 aa, Pseudomonas aeruginosa
VEPARGYPGGRRADRLRAGLARLPPVPGRWPVDPPMTRRYSPMLRSLTVLLLAFALLLGSAVARAAPRELTWSQLIPAGAPPAPAPLPIHDLANALSEAGPAASQQSPNAPVVKALDGIEAKLPGYIVPLEISEAGLVTEFLLVPYYGACIHVPPPPSNQIVYVKTAKGVQMDELYQPFWVEGTFKVENASSELAAAGYRMQASKVTPYEYEGG

SEQ ID NO: 26491 - protein, 245 aa, Pseudomonas aeruginosa
QHQHFLIQGMELIMRKSWLTASLLALTVASPFAAADIQGHKAGDFIIRGGFATVDPDDSSSDIKLDGAKQRGTKATVDSDTQLGLTFTYMFADKWGVELVAATPFNHQVDVKGLGPGLDGKLADIKQLPPTLLLQYYPMGGTNSAFQPYGGLGVNYTTFFDEDLASNRKAQGFSSMKLQDSWGLAGELGFDYMLNEHALFNMAVWYMDIDTKASINGPSALGVNKTKVDVDVDPWVYMIGFGYKF

SEQ ID NO: 26492 - protein, 144 aa, Pseudomonas aeruginosa
GAGGECSGRRCRPAPRTTGTTGAPRCAGGRRACPDSGAAPAGIARSDAPRAGADCSHRARPAVPPIPRRRAVAPARAGRSAPPATPRPRPPPPTAAVLRRTPAAPAGSAGDRWRSSARVCRRPAGWVAGAGIPLRGRDGTRCVR

SEQ ID NO: 26493 - protein, 855 aa, Pseudomonas aeruginosa
  UNSURE (184): Identity of amino acid at the above locations are unknown.
VWSWTSTYPRRQRCCCCSCVRPCGTHRRPVRSAGRRGVSNKRLPRRAAKEPNESAPPDSSISVGDAHRLVLGVRLDRRMAHLASDAGLLEAAERHRRVEQVVGVHPYRAGLDPGYQVHDLAQVVGPDARTEPVDAVVGQAHRFVEIVEGRRHQHRPEDFLAHHQHPRGDVGKDRRLHVEPRLAXARPAADHAGALSHPAFDHPQHPLLLPGRDQRVDLRGRIQAGADAQVAGDGRQALQHLVETLALHIEARASGADLPLVEEDRAGGTGGSHVQAGVIEDDHRGFAAEFEGKTRHVLHRRMPDQLAHRGRAGERQLIDARVRRQCRAGLGARAGDDVHHPWWNPRLQAQLAEAQGGQRGFVGRFEDYGAAAGQGRDDLPDRHQQGEIPRHDGSDHAHRLRHRVGPVARAWDRGDRQVEAATLDLGRPAGHVADELHRGADLQGPRQVDRLAVVQGFQLRQLLAMRLDPFRQSQQQALAIGRALACPAAFERAPRGSDCPVDVFGAGAGHASQLGAGRRVVQRHVGAGTRRPGLTVDQQAMGTAQESADGRVDGNTHVCSSAWRRRCVMHAPTTREYSGPAAPPLACSSLPGFLPLPAKPGRERQDGAPGHGHSARQAGQWTSRRLVPRESRAMPSTLSPDLGPRCMQAFTQVVPASLCVFYRIDEDCRAHDFQLLRMPAGMHRDYLRHYRDYDPLQPRHCLASASPVVPLRQGIARQPAEDSALYQGFLRRHGICDVVEVLAHAHQRPVAALSLLRDARLGAFSDQELRQLRALHGLMELAAQACATPAASAERLQGLTPREREIALLLRDGVSNKCLAQCLGLGLPTVKTHLLNLFRKTGARSRTELVKRLFL

SEQ ID NO: 26494 - protein, 1007 aa, Pseudomonas aeruginosa
KTTDNVFSTGKTGVSAMSKDSVLGLFRQHADTHPERPALVDRERSFSYRELDRLSDRLAAHLARRGVARGELLPLLAERSAELVIAILAAAKCAAAYVPVDRRQPDRRKREVLRQCQAPLALATHAEDLPGQPVEVIAQALATSAAGAAPRPALDGSEALYVIFTSGTTGEPKGVVIESRSLANLVGWHNRRFNMDQRSRTTLMAGVGFDVSQWEIWSTLCAGACLHLVPDEVRPDPAALLAFFAEQRISHAFAPTVMVPALAEQPAPPSLALRYLFCAGEKLPPVATGGLPYTVVDYYGPTEATVFATCRIVDAEAHRRPASIGTPIDGCEAFILDADDRPCHGDRPGELNLAGVCLAREYLRDPDMTARRFHYSQALRRRLYRTGDKARWLADGSLQFLGRLDDQVKIRGHRVELGDVEAALLRQPAIHGAVVLAHADPRSGSQQLSAFVVPRQQDGDARAVLAAIKTALRQELPDYMLPSRYLSLDSLPTTVNGKIDRQALRRHLDEQCQERLDEQRFGTPGELQVALSWQEVLGHTDFGLDDSFFEVGGHSLLAAALVRELSRRFGNRAYIHDIYRTPSVRQLAASLARRAGEAPPALDSEPAQELQRDVRLPADVDFSRPMDTAQLLAPRHILLTGASGLMGAHLLAELLASREADLHCPVRAQNDAHALERLRQAARQHRIELAETDWRRVRAYAADLAEPGFGLPAETYRELAGSVDQVFHSASAVNFIQPYSYMKRDNVEGLGQVLRFCASGRCKPLMLLSSISVYSWGHLHTGKRLMREDDDIDQNLPAVVTDMGYVRSKWVMEKIADLAAERGLPLMTFRLGYATCHSRTGAYADYQWWSRLARTCLEYRAVPLLRELREGLTTVDYMVEAISVIARQPSALGKKFNLVPSIPRCLTLDEFFGRLGRRAGRPLRQMPFDDWVSLWEDNRDAPLYPLLSMFRDNMYAGRSTVELYQDTYLWDCTNVEEHLRGSAVREPEFDDRLLDLYLAGLGGSAMR

SEQ ID NO: 26495 - protein, 253 aa, Pseudomonas aeruginosa
RGRRGGYAAGRAWVSCPLYRPENLMHNVLIVGASRGIGLGLADAFLQRGAQVFAVARRPQGSPGLQALAERAGERLQAVTGDLNQHDCAERIGEMLGERRIDRLIVNAGIYGPQQQDVAEIDAEQTARLFLTNAIAPLRLARALSGRVSRGGVVAFMSSQMASLALGLSATMPLYGASKAALNSLVRSWEGEFEELPFSLLLLHPGWVRTEMGGDSAPLSVEESAAGLVAAVEDAAGVNACRFVDYRNQPLPW

SEQ ID NO: 26496 - protein, 172 aa, Pseudomonas aeruginosa
PAHAPPGKPGACSSGTGSPAWRTAPCLSPCRWSARSPHARASLCHCRTSSSGRPRSGPRPGRRSGSRGRERAPAEPARQAGGAGKRGREITSCSWNSPRLRLRKRATLQARAAPAGKGGPPGTSPAGLTRCCRSRYRQAAGAPPRRSRSCRPGPHGSRRPAHRRSGRNGTEA

SEQ ID NO: 26497 - protein, 574 aa, Pseudomonas aeruginosa
NGSRSRTARRRHRPPAPPAGPRPCRIVPGRRRSQRALPVGGRRRATCQLQDGRRRLARAQRIVDQALLLRLVAPAHPNRAAILLDPQHQAAALADGAHRLPAVGIKHFRGERQGLAAGHPAIHQQGPCHPRRIVEAHHRSGGGRHVARTGPQFDLVGHAVGVEVDAVQLVGQQVGNHRIAVAVDPASRVAGSRAPGVWRVDQADRLAQGLCRGDPAAVRDQAPRGLDRQLPIARSLREAGAEFDLRQSIVEAGALRGLPAVAVMGGRQRVGGLATLAQHAGNPAGELGSAVAVAGQVAAQGRRPASRAAQRNGQVQAEQRAGLAALVTAGKAFVVAAQALRGNGVTDVAPLVAVADGEVDRPPAAAPVALRGAVQVQVAAVAQLLADVGVETVAQARERLQRLASLYPVLHEGRVAQAEIATGGVTIGEQRKVGAGVRQVLAVGETVAGAAKAVVAGNLGTRQRHVTGESAHRRVQRRAHQPGHVAAGEGPARVCGDVVAQAALVDALQHVRPTLQAGIVEPPGRQAVARGSGAQQLHGGGERHDETADFPAGFGHPHFQVPAIAGGLQFVQTV

SEQ ID NO: 26498 - protein, 152 aa, Pseudomonas aeruginosa
SAPRRRCSPPYSVESRSMEWRSIISSARPPPRATQVSGSSATITGRPVSCASSLSRSRSSAPPPVNTRPRSAISEASSGGDCSRALLTAWTMVARDSCRASRTSLEFRVKLRGTPSARLRPRTSTSRTSPPGKAVPISCLMRSAVDSPIRLP

SEQ ID NO: 26499 - protein, 155 aa, Pseudomonas aeruginosa
TTPLREIRAISVVPPPMSTTIEPRASSTGRPAPMAAAIGSSIRNTSRAPAPRADSRMARRSTWVDLHGTQISTRGLGCRKLFSWTLLMKYCSIFSQTLKSAITPSFIGRMAAMLPGVRPSMRLASVPTATTLFWLPWLRMATTDGSFRTMPRSRT

SEQ ID NO: 26500 - protein, 220 aa, Pseudomonas aeruginosa
TLRRGKNRPSRPPGPERGRSSAHHRDPEQHPRPDRPDAGGRHQRRRTARPSAGSHPAPAPGRGHRDRSPRRLPDHRPRRGRRYVPGSESHRVIRTRTHAASIDPRRDRPRPRRQAIFRRRADPHPARSHPAAGSPAQQFHQHHRRPGHRPGQGSRRTARQRRERRPARRADRPQGPVLHPGRTHQLRFEDARQLRLALRRHRGREAHRRRRRYPRQAEHG

SEQ ID NO: 26501 - protein, 402 aa, Pseudomonas aeruginosa
IRHGLVEPVQPLRRGEEPLEPRPRAGRLLRRFRRGSRRAPAAGRHRHRYRRLDPPTGGADQPHRDQANLRPGFPLGHDRLRFQPRPGRPAGAHRRGLRADAGGDGRIRSEGLDQRRTAGGRLPGRPAEAAERPAHRPAAGILRRRPRQPHRRRGAGRSRGAEDARRHGEGHFPAEHAARHPSLLRDRAGRGVLQPVALRRRALWLSLRRPAEPGRPVQALARGRLRQRSEEPHHGRHLRTLGRLLRCLLPAGSEDSPADQERLRQRLCRSGRDPRPDHAEPGLEDRREERRPGFPVPGRHLHHHRQPRRPAGAVHARRLRRRPAGGCPVARALLPGRPPAQRRAPVPAGQRLAHPHPGRLLSHGNATQSPPLSRRGEGDPQGRQRDYAGTEGLRNTTCNGKP

SEQ ID NO: 26502 - protein, 254 aa, Pseudomonas aeruginosa
PAPASAVAAVPDRATRPVPGAPAISRARPPAARRGAAARNTARRSAPGRGHDRSSGHSRSSRPPRGCAPGRYRAARPGRCRSARRRRTVSTGCPAEPANRPATAGARAPAGDPGSPVRSPGSCARPAGPAPPLREAATARRTAGPARRATQSLDLDLGQRRLGFQGLLFRRVETQVAGRWQVEAAFLGETHQVTETLLATQAVHRHPVEQLARFVARALQGGRFVAGQAADLDAPGGALDIRAGRQRQFQHAVA

SEQ ID NO: 26503 - protein, 698 aa, Pseudomonas aeruginosa
APAPGAGSGWTGRWRAATCHRGLSAPRWRRSAPGRRSPAGASADSALGATVPGRCARTRRGIPAIAAGRALPRARRGQRRWPAGAAPGRRQSGVSQRPPFQRQPLPRCVGLASGRQPEGVAALAGEGFQARHQVGVGGIAEYRLHVLRQAVEGFPLQQFGERLRRQVGRYQRILRQHLGERRIAFVEGVQGLAEQLVVEGEQQGLAMARHADAEERAAADALRVVRLAGRIGAEVRADLAGPAAGLAIHPVFHREAATLDLGFLRADHATEQLAQLVVEFGTGRRAQLAHQQRRMQPRTGVPAETGSAAEMLGEGLGHLLLGPQTLQHHPVQARGDRQRHAGAGAHRHGLPDRGEVQRRLAFHLVQRQVAAPALLALLEAHPGEARDEALVAHGQDAGIEGDALAQLAAARQAEALGEQFVAVEQCLQVFAGRSVQRAVVAFATIVEEHPWVRQQQQPVALGQEQHRLVVAVAQAIDRGSRQLADLAQLLVVGGDMGQRLEHPRQAAALEHHHEVAQAAVGAAPEGDLGRLVEQFLDQAVLQGQVVLVDDPPQRTGQAEAVAIVLVIEDEVLGQGIAQQRHLEDFLRQAAQRHALDQRVGLAQVTVGTWRVGVRGCLGADRLAEVLFGRAPSAEPLQPAHLPGQHTAGGQRGDDPQHRPQGASGARSGGRRGSVGRAGGVVLAHGSLIPCHPYEGMLQ

SEQ ID NO: 26504 - protein, 355 aa, Pseudomonas aeruginosa
SWTDRCAARGKPWSLPSRVRRYRSAGSAAEAEGIVDGRARLGEPARSFLRHVEVILQANAELAGHADHRFVAEAHADIQRRAIATHQVRAFVDVHADAMPGAVRQARQAVVRSQAVGLQRTPRGGVHRLAGPAQTRGLEGRQLGVALHPPEFALACAGRAEHIAAGDIRLVAVDLAAGIDQHHVAILQHLRMLHPMGEGTGGTEQDDAEGRTGRAHLAVRLVDELGDFGGADAFAENARRGLLHFQGHVLGPLHQRQLLGRLAHPSLVDQRRGADEVPARRLLAQALEHAERQARTQCDRAALAHAERLQAIEQQAIGILVFLPGVDGAIDHLEVAHRTFLEGRRKVFEGALGGQ

SEQ ID NO: 26505 - protein, 202 aa, Pseudomonas aeruginosa
RPALGILRLSTRVSPMTVDRIGERLRRYRRAAKKTLHQVASESGLTASFLSQAERNLTGVSISSLANIAKSLNIPLNALFDQPAQPQPDSHEGERVRYTIEGQPLAYERLSSSFPGNLINAVKMNMPVGYQSELISHEGAEFSYVLSGQIVYTIEGRQYPLGAGDSVHFDATKTHCLANVGSDVAEVLTITTMGLFDDHPTP

SEQ ID NO: 26506 - protein, 496 aa, Pseudomonas aeruginosa
NRCHDNNKGSNQVMRYQRVTGATLGLALMASAAPGWAADEQATPPTPDNPSYAAQVQSIPSVEKPIKGQAGASGLFEGQSLTLTTRNFYSRENMKDSFTFRIPKAGGGSQRIHQRNAWVQGTVLKYSSGYTQGSIGFGFDVAAFNEIALERGKGRIGGGGNRTLANSDGEAIGEWSKLGVANIRLRASNTEFKAGRFLVNTPVFSYIDNRALPSSFTGFAVTSEELDNLSLQAGSFRKVSPRTGSGDEDMTTEYGTRQVKGDRLNYLGGNYKPLDGLEISLYGSHFQDVWNQYYLGVTHDIGDLENGIALRTAFNGYHTGDTGAREAGYIDNDTWSLAFTLGHRAHALTLAYQQVDGNEYFDYVHETSAIFLANSMLADYNSPNEKSAQIRYETDWSYYGVPGLSTGVWYVKGWDIDGTHYDGDRNGAYGNYAEVRAQDGEKHHELGLMAAYKVQNGPIKDSTFKLTYMMHKASQNQVDGSVNELRLVSTFPFNLL

SEQ ID NO: 26507 - protein, 339 aa, Pseudomonas aeruginosa
CAVDLPARPRSEASLACLGAARLRLLRRDGHGRADQVGGKGRRAHRALRPQPSRSAVPARYGDALRVHLFRRVRRPVARRRQAGPAEQPADRHRAVRLQALRQGRPGPLYGEPGLLRRQAADRQPGVRHYPRSQRAHAEGPCRRVPGLAVPETGGRAAPEAGPEPGGGRDRCPADHLHCHQHPAQAARRPARAPGDQPRAGQEGHARRGVRPRRGQSGGRSLSPDPARLQPFDPGLAARSRTRQGAAQGSRRGKSQDHPVHSQRHLAYHPQPRPGGTDAAGRPGQGRHPADHSFPGMGRAAQAFEGRRARPVAAWLGRRQRRPGQLPQPEPELRRRRVG

SEQ ID NO: 26508 - protein, 371 aa, Pseudomonas aeruginosa
STPSAVATTRWCRTASCWSPPWSSWSISSWTSSTAWPTRAFATNADEPADERHAQRSRQRPEPGLPVPAEGILAGLRAQQGRPRRPAVHAADRVLRAVRPLGRPLRSERAVPGLPADPAILAGRRPGALPARHRRAGPRPALAADPRRPPVAADRPVLGGDLADPRHPPRPARRLLAEPCRAADHAPDGHHAGAAVAAAGGGHRGDPRPGPDQHRDRHRHRLAAGLRTPDPRRGDDRAKPRLRHRLAPGRRRHPATDVRLRAAELHGAADRPGHPELLFGDPRRRRPRLPRPRRATADPRVGHHARLRPRLHRARLVGGQPARPDHPAQRTGDQPDGRRPARRPRSETEERGMRSTTMNSASVSAPQETAA

SEQ ID NO: 26509 - protein, 159 aa, Pseudomonas aeruginosa
PPHPRRPPARRPPEQRPVGRGDRPLPVPLPAPRAPAGRGRGDSRLPGQHRPRRGRPRPHGVRRDQGGTPPPGAGRGLPPCGGRPAGGDLGAPRLRRVGLPPASGGPRPARLRTPAQRDPAAPARGQRHSQQLRDQDGQGALAAAARPPGRLSAQPRKKR

SEQ ID NO: 26510 - protein, 320 aa, Pseudomonas aeruginosa
RLRRAPRADVWPARPGAQTGPLRALRRASAAGLRHQRVRCGSQAVQGRAQAPEDRQRLRVVAMHAKTVGGQAQRVAVVVGEGFAAGDGQGLFDDPLRIVMHRAAKPPRRQPTVRQVGAIGEGLEQQRHVGLVGQFQLAAVVGQGQHHQRQALAIGGAGVEHGAQQLIIADQVVVQRAMRLDIGHLGTEGTAESVQRTDLVQHHGMHLFGRAGQRAPAEAAQVGIGRVRADAHAMAYRQLHRAPHGERIASVEAASQVGLVNQRHAVDIVAHAPGAKAFAHVAVEQDTPAGVVHCAFLSRPGLRKNERSAGELASGSILRH

SEQ ID NO: 26511 - protein, 310 aa, Pseudomonas aeruginosa
ILLFCTDDLAFMKVLILAAYALSILYVHFRGRVRHKLSRQLSDHSSFLAPINCLMYLFSKVPNRPYLAPQTFPELQVLVDNWQAIRSEALHLHDAGNIKRSEQYDDIGFNSFFKSGWKRFYLKWYDEAHPSAGQLCPQTTALLRQIPSVKAAMFAELPPGSKLVRHRDPYAGSLRFHLGLFTPNDPACFIEVDGERYHWRDGEAVVFDETFIHYAENATEHNRIILFCDIERPLTQGWATAFNRWFSRNVMAAAAAPNNAGDRTGGLNRIFDSLYKIRLQGKRLKKRNRKLYYLQKWGFFALVLAFILWI

SEQ ID NO: 26512 - protein, 743 aa, Pseudomonas aeruginosa
LATKRLPWEPFSFIRSVHVASVTSFVGQALQGLLTEHFAQYPVDTTGHALQAAADVQGRALVDPAPQFIRRFMQAVLDIDLLRLVAGEGQVQALQLAPGQGLLQLRTTVVVVGEIAFAEQQPVALAPGGNAGAQQAAQAGEPGTVADENQRHVILRQVETRVAAQAQGQRGAERQVLGEPAGADAQAAVGMLLLAYDQLQVAIALQRRDGVLAHGKRNQRIQQRLRVQADQVFERIRQQAPGQGLLQALLDALDRHPHLAVQVMPLQPFADARGRLVRNDLQQIAGAPLDGAVGRRTQVQQPGRLALAARIQALPPRQRPDLEGRRFPGRRGGTAGHLGQAFLPLAQGRGVAIIDLHRGEQAPRALPLQPALHAPGEAAELLVLAISQGQQGVAQAIEAGGLAKHLAFEAAGAVRRLTVAEGADHEQRLARLGELPGIQARQRFDPHRQPGRLQLAGALPGQLLGKTALAGVADQPGLAAGAGAAAQVGAARPYCAFLAPAVEVEQPAGDEEQRHRQAGEHHQDASGHAEIAAYVQCIDAGQQLAAERTVAIALVAFHLAVGRVQGQGVEGTLVRRVGQAIEHCRRLAARRRQAQVVGLQAVAAGLADAVPYRRVVDHQRSRIGRALATSARLAALRLLAGGRVVEQFEQAVAVPLVGPVQAGQRSQQVERQAPGAGHGMQVPVETAPLARPVEGQPGAPVENLARPAQVETGQAEEDQDQGAGGGDLLAVLAHGEEPVQLHH

SEQ ID NO: 26513 - protein, 243 aa, Pseudomonas aeruginosa
PMQINIIGNHFAFMDSAMLLHIPAIFTAEEVSRIRAALEQAEWADGKATAGYQSAKAKHNLQLPQDHPLAREIGEAMLQRLWNHPLFMSAALPLKVFPPLFNCYTGGGSFDFHIDNAVRDVHGGRERVRTDLSSTLFFSDPEDYDGGELVIQDTYALQQVKLPAGDLVLYPGTSLHKVNPVTRGARYASFFWTQSLVREDSQRTLLFEMDQSIQRLTRDVPDHPSLIRLTGTYHNLLRRWSEL

SEQ ID NO: 26514 - protein, 185 aa, Pseudomonas aeruginosa
IFQPVLQPLDDSRPGALQPGRHPPLAPPAPGLPAALQRPAGGGAADRRDHRLSVLQATGQPGPTLRRSPGQGPGAHGTGGALAIADRLPAIPPATGQHAGAVAKERGPTTAEEPRRCQWRYAAHAGPGDRRIHVAQAHEPLRLSTRNDPAVGRTEGREPEPHGIQQRGGVAAIHHRGAAAGADVR

SEQ ID NO: 26515 - protein, 68 aa, Pseudomonas aeruginosa
SPLDRQPLCPQWLARLRQAAAGQGRRRAAGSPGRTTRANDTARTVPPAERRLTAAKENAPPSGAFFHP

SEQ ID NO: 26516 - protein, 481 aa, Pseudomonas aeruginosa
KSPAEAGLFVAEATALEVERLQRREAVELHRTVAGGVGAGRQPVKAVAARQVQRQAILVVLVHDVGAVAGRAGDHHLFHLALLLGPDRELDRLVHGFDQSGELADVGIDPALHGGPRLAGDQHHFADQDAGIGDQRTARLEDDFRQVVAEVLLEEADDLLRIGFQVVGLGDVVGREAAAHVDHLQDDTVFFLQALEDHLDLGDRRVPHRDVALLRTDVEGNAVGLQAQLAGQDQQVHGHVGLAAELARQRPVCGSRALGENTHVDLGAGSGLGDVAQVGFGVGGEQAHALLVEVADVLGFLDGVAVADALRTDAGLHHLVQFVDRGDIEVRTLVAQQLGDFGSGIGLHRVVDPGEGEAVGQLVVGIGDGLLVDDYKGGFLLVGEGLHALEGFRGEIILDLDGHGWDSQWQNTWIRRGEAERLIRFPTLVRLLPKACRRVSPACRQPPPVHPGRSRACPARRPGRLSSGRRLATRRSLVVST

SEQ ID NO: 26517 - protein, 262 aa, Pseudomonas aeruginosa
RRRGRDCRPPPEDAAEGSASHRPTAAAMSATGPAAATAGLPRAAAPARSGGTPRADPRPGSARRARRHRAGYAGASRRTSPAQGPAATPGTSCFLLGIGQSGAVARPVESLAGIGLALRGDIAVALDAFRGDPREGRAQQPRQPGQGSVLRVRVRFRVGPLQFDAKGEVVARLATVEAGNPGMPGAVVTGDELGDGAVAFDEEMRGNRQVADLLEIGMFVRVQAILEERLDLTGAELSRRQADIVDNQQRHRVPLRTQVEIR

SEQ ID NO: 26518 - protein, 292 aa, Pseudomonas aeruginosa
SSLCIYRSSNWVPLCKDGTPRLPGQPSAGLCLVRYPPWPAGRQLPQRRRASPAEDDGAQLEGRSPRSARAGAGTQAGDLQPGAAEFGVPALRPRDPPLGKHPAGQLPGAGRQVLVLQGRHRQTLPPGGTGHRAAFRLRRLAFRLHLAGGRDAPADLGSAGDEPDRCRSPTAAGRAGAAAALAGPDRQPFRPLRQPRRCAVRRGVRLPEPVVGVLAVQAGDRQGGHGLRRLQAAGHARCLGWLADPAADHPAVVAGRGDPRGDHAAPAQRRKRHADPLRSLSGYCRVDCFALG

SEQ ID NO: 26519 - protein, 216 aa, Pseudomonas aeruginosa
SNNPDLSAIRRIQMTQPWILGLTGGIGSGKSAAAEHFISLGVHLVDADHAARWVVEPGRPALAKIVERFGDGILLPDGQLDRAALRERIFQAPEERRWLEQLLHPLIGAEIVQYLARAESPYAILVSPLLVESGQRQMTHRVLVVDTPEHLQLQRTMLRDKVSEEQVRSILQAQARRDERLKHADDVLVNDGDLSHLQREVERLHAFYLTLRGGRA

SEQ ID NO: 26520 - protein, 183 aa, Pseudomonas aeruginosa
PASSRPCPAPPAGPGWSRPASAPFRTGPATSRVPGWSPSPGPVPGRAAAWPAEPNAIVSRVSLPSGKYLDVLAPLPVRLGSPECLGLLGGIQDEDMGFADPLPRQACQHLVEHPPRQPQPSITGIDHQVLEVTTATVMPGHQAGDHLPFGFDQQAQPGVALKVGEEEGIGVLRTEADTWRSRP

SEQ ID NO: 26521 - protein, 212 aa, Pseudomonas aeruginosa
AEPMNEADYLRLLTRQAEQANDFLSNARKWDRERWVCQRFLEALNVPYRQEDFAAPGEQPPDVMFKGAGFEVFFVLDEGRRLNEEWREELTRRRQAVSLRQLIRREERPQRIAAAELQARLAPTLRKKAHNYSERGIDHGELDLLAFVNLKRAVPDFNTPFPPPTEYLRQGWRSLSMVGPTFARVLFAHSGAPEFLRANLGRSILFDAGVGL

SEQ ID NO: 26522 - protein, 66 aa, Pseudomonas aeruginosa
NDRHRKRRPAMSSRLSPEDQQKVEQYLASPLHQVERAPFRPWFLMFVLLAVVIGLGLLSRLLSYLA

SEQ ID NO: 26523 - protein, 438 aa, Pseudomonas aeruginosa
DIHMSHRIVIVGGGAGGLELATRLGRTLGKRGKAQVTLVDANLTHIWKPLLHEVAAGSLNSSEDELNYVAQAKWNHFEFQLGRMQGLDRAGKRVRLAALADENGVELVPERDIAYDTLVIAVGSTTNDFGTEGAAEHCIFLDTRAQAERFHRQLLGQYLRAHTGHDANNNAVSIAIIGAGATGVELAAELHHAAQMLAAYGLDRIRPEDLHISLVEAGPRVLPALPERISQPVHQTLSKLGVRVMTGSAVSKVDTDGLWTGDGEFVPATLKVWAAGIRAPAFLKELDGLESNRINQLVVRPTLQTTRDDDIFAFGDCAACPQPAQPGEQPRNVPPRAQAAHQQASLLVKSLHARLEGKPLGEYHYRDYGSLISLSRFSAVGNLMGNLMGSVMLEGWLARMFYVSLYRMHQMALYGPLRTAMLMLSGRLRSTEPRLKLH

SEQ ID NO: 26524 - protein, 67 aa, Pseudomonas aeruginosa
QFIERTAQGIGPPLAAEHAVMKPAKERMEMRPAQALQIGAAKEAIHQPALAAPDRPPQVEAARRLPE

SEQ ID NO: 26525 - protein, 158 aa, Pseudomonas aeruginosa
ACPPSCNMKTSDFAMTRSVPGGIAARRSACGPPASAETPRTACSAVDRAASRWPMPTASSPSTPAKSGCWTATPSVPPAASTRSCSTPYACSTWATACSCSPNSTPSGAAATSTARNSSTWAAPTAFGRSPWAATRATATKAGKPVRSCATAWLRAGS

SEQ ID NO: 26526 - protein, 254 aa, Pseudomonas aeruginosa
QHWSREGADMAKPPITQARDVDAELVLQLNKFGSAADLRSQQAKLTGAAREIRKLTGGGTDLFGKLGCYLSFEQKQLLQDAARLLDSVNQQVEHAKEKRDRDEKQAKKRRELRGRLAKQLVDSNYPLPGNTLEERLEILQIALIYNRAKVFDPLYSTHQLHSKLKRWLERPKQLIGWHSEAEYFASQVGSLRCDFISHLTHEIAYDDGSEVEERLRVIKQKVADCTAQIALTSEEQETLQLWTDALQSAPEGLI

SEQ ID NO: 26527 - protein, 94 aa, Pseudomonas aeruginosa
PGFAARRLGARQKHSPAPRRQPASSGRARAGRFPMTRKDNNKQNVVIDNLELITRAERMRRNSIHRYPPELKSAIRVISKLKRTIQEVEHEKQD

SEQ ID NO: 26528 - protein, 511 aa, Pseudomonas aeruginosa
SPLCHHRRAAGRRQAPGYRTRESGGSCGFGDHRVRQGGGESAGDHRRPGQQRKHIPADRPGGLEVSALELTPPHSVEAEQAVLGGLMLDNAAWDIVGDHLHKEDFFRHEHRLIFTAISELAAKDAPFDVVTVSEAIEDLPEAGGLAYLGQLADNTPSVANIEAYAQIVRDRAHLRQLMSLGHHCTRTASNHQANPCEVQEEIEQKLFALGQDQHKSDFVDINKGLAKIVDTIDYRFNNNVTVTGVPTGLKDLDELSGGLQKSDLIIVGARPSMGKTSFALNLIDAALQSDQQKSVQVYSMEMPAEQLLFRLAALLGHLDLGKLMKGQLQEEDWPRLTVAIQRINDYGSRLVINDQGNLTPTELRAKVRRAARKYGHPVLILVDYLQLMRCPGLENRATEISEISRSLKALAKEMDCPVVALSQLNRSLENRPNKRPNNADLRESGAIEQDADVIMFVYRDEVYHPNTEAKGIAEIIIGKYRNGPIGTVRAAFIANQTRFADLAPTWQGALA

SEQ ID NO: 26529 - protein, 402 aa, Pseudomonas aeruginosa
VRNACLDLDKHLVVSKAVFVLHAGPPVVWVGLFGDANLTTGCVRLPSSSDRHAFSATGPATSFFISSIELPISRRREPARSLVMRDQQTTTNPPEACAQNPDWRQDLSYALIESLMAEPEEQAKAFLKAHLERLPYYERFGLSHENLVLLMEDLFKQLQYTFSFLGIDATWLRQRQLERQVAQTNAYSVLKALQSAVTQLRTHEGPSPVLWFTGLGRTTRPFVRATALEHALRQALTDKGWSTPQIEDAWPSAGLQPYLQALGLCRQTLAFALDDPSQALDLPTQRAAVLAAHDELIIELRGRLLWESWNSPPADYEWGESAIVPMTSSSPTDATGQVLPATPRGRPPYYLWELVPAPASHRATPDAPLPGHEAAPAHRIWLAIFEQETAPAPAGASRSSAL

SEQ ID NO: 26530 - protein, 143 aa, Pseudomonas aeruginosa
WTTSNRGRSTTTSVTRTTACRRKSRRTSAPSTSSAASPAAPKACRSASRRTCWAPGSSTTRSATHSGSAASPLSFATSSSAARRSRRARHERGSSPNPALPRRQVETCSLDHPAPGATSHLRRALRRRSLRPAPESPQLRRDL

SEQ ID NO: 26531 - protein, 111 aa, Pseudomonas aeruginosa
CVSIALIPDHGRSVLSDLQENNMKNVTSIDRKHAEDKFVVRMPQGLRDQLKQKAAHNHRSANSEIVYRLERSNALEEELARANRMVDELFAKNQRLQAELAAANTPQVAEA

SEQ ID NO: 26532 - protein, 412 aa, Pseudomonas aeruginosa
ACPGTAGPGSSPALHSSAHPTHRAAHIRTHHLSSLAAHCNPADGRRGVGGNAAPGQDPGIPAARPLRDGAAAHHPQHADQPDPLHRQAGRRVCGKDGPGRGRVHGPTAAESDPPWFRGHVAVPLYLRRNDHQRRDNMSNISSKTVSNTKAQPSTEVSVEIIGGKPTTTSLDVAKHFRKRHDNVLRDIKNLECPEDFALLNFEECSRTGANNRPEPYVRMTRDGFTLLCMGFTGKEAMHWKVAYINAFNKMEQAIIEQPEILSHNHLLQFAIKTLDLMRDHTLGEPARPRTEQVVCNYLAVESLDAANPEQIKQALNFLQGQIIGEGVAAKSLPSVAGSSIAKDLLYGLLRSAHDAELLFNSLYDSGVEKLASEVFKEHMANTLAATSRQTRELLGYVASRATRSPFKPRSTH

SEQ ID NO: 26533 - protein, 661 aa, Pseudomonas aeruginosa
EREILSNRAEHFRSIRNTPAGHSATRLHRSKRLPPLDNASPTEQLPDPSLARYSERQLAVANTWATHFSLAGTARTKFIRHYLRSTSTTRCWCITVAADNGVRYTIMRAGPLLQVFDGQLIGAWECRPAHRVPASAPSPAGALKLLQRLQKFDDAVPVLSSYTQRAHGLATQLAREDLGSFPKSQYPSVSHNRYYSPRRQFYLKQIGAVLRTFRQFLDQDLLFAIRSVRCLSPQLYNWLAQGNQARRLQMLKAQPVLTPLLVDCEEGVWPHTTTNDNGESICHFLPCPFSLLVSERPQAAAVPCDLYLDMGRILGQVADEGISVINFFAWLFQAPRASIRFLSHVSPGRAGGALFHRKREGRYSGWHTLLMAASLGNRRPITRAQWTAFYAAYNAIPWQIHNAKPDYNRLFNGCPLDWQDPAWLAITARLRDIKEFYTALDQGNSQVVRQARSALKAYLGHCTYRQAGNLVDDYHQVQRELRATVQSSLPDLVDTDEYTTWEGMLPVSLIDCPNGLQIVELRCPADLYAEHIALAHCIDSYDQAAYRGDCRLLSVREAGRPLASAELELRREHGEPLGRPWNPQHLSTVQLRKLDNDPVPADSPAGQAYRWFMERIRSGAIATNLNWPDMTVHMTRFADGRWKAGLAEATAKWLLTRLENR

SEQ ID NO: 26534 - protein, 463 aa, Pseudomonas aeruginosa
LGALRRVAGHDCHHLVPGAGDCLAERGVVGQRLAVDDQQVLDMARHAGRVEDLMCIRCGGDFLQQRTPGRHVAYIGRAEGSDDVGVGGVDHLHVLLRQAYAVQRLGQDVMRHRQFHQVHLLALDLFEIAGALHHQAVVAVGVAADDQRGGVDATGRRNRQRIHAGGDHAVELAGAVLVDGLDVVVDLADVHLDPVLVGPFLHDSRLVDVLPGHPADVNGPGQVEGLFLLRLGQRGEGGEGNGPGAKQLFHHGAVHGGTPGSEELQIALDFPVGNMGVVGIPFVALELDKGLVHGIAEHLARQRVGLEGVDGFAEGARQGLDTHLRDLPFAVVIHVLAVRLAGIELVADALQAGGEDHRGTEVGVAADVGGAAFDPRALGWNAQHVGAVVVAVAAEHRRPGRAGHGALADQPLVAVDRRRDDRADGLGMFQYPSDEVIGQRGHAAAVGVFAIDFEQILAGLDVG

SEQ ID NO: 26535 - protein, 327 aa, Pseudomonas aeruginosa
RRSCRPGVHESWHRTWSFPHPGKGAAVQPAEGLIGDQADETDQQDAGEDLVGVHVALRLEDGVAEAGVGRDQFGYHQVGPGPATGDAQGVEQRRLGRRQDHQLDDLAAVGAHGLRRLDLRHGYAAHILGDHQHHLEKGADEDDQYLGAFVDADPEHHQRNEGHGRHIADEVGKRFEKGLHWPVRADVQPQRQGDQCRGAEAGHDPPDADADVSQQPLAGPPAADALEHCAGAGHEHRVGQAEGGPQPPDDEGQAQPGAGEQPGVAPREFAANTPETAFAHHRFGLYGGCCGVSLLSGGNADLCGHAGTFSVAVGTSSSTRCQPPAAG

SEQ ID NO: 26536 - protein, 291 aa, Pseudomonas aeruginosa
ASGTVFMGNAPQMTCFGRDQAGGSWRSLQLAQQPMAVDHAAEQAAFHLDHRQRSRMQLRVGRGAGVADGQAVEAKVDGLAQRRGHADLGGHAGQDQPLDAAAAQDQFEIGMGEGAVARLVDHRLAGARLQLVDQVMAEFAAHQQAAEGARAADGSAGGLGAAAFGLGQVGKIRSMAFTGVHHQHAHAARAIQQRLDRRDRCAQAADVHSGLVGVSTQRAEVALHVDHQQRRVLEEQRMRRQAHSANSLHTAAAMPSTMSWASRWPFAALEPLAEDSTPEGGTHSVRVGYMS

SEQ ID NO: 26537 - protein, 197 aa, Pseudomonas aeruginosa
AGFPSSCSRGSPARRRHRPACPRPPTPARGCRRCGSRCRAGRRRAGRPRRGLRRLPRSRSAPGPIRSSAGARRRRRRAAGGGRRRCCRPRRQESPGSRTGAARCSRSSAGSGRAENRGGFSTAPRPRPGRSGSGRRSATATAGRRTPRPRGSGSTSAGCGRRTGSRPGLPCRRCTCRRRRCPPSSPRSRCAPGCTWW

SEQ ID NO: 26538 - protein, 181 aa, Pseudomonas aeruginosa
TPGCSGTRARPCAPWSCTSRWPTGRPGRPRTAAGGRCARAPSDPARRTRHPTGRRRSPRDPPAPGSRAGSAPAGSGCRGSGRSPHRAAWLRGPASVHDHGSAAPGPAPARRFPATGGCRRRGGRPGGCPLHRYPARWATAELPAWRPLPPARGWRTRHRRPWPTGVRSAHPPGRSAPCRRP

SEQ ID NO: 26539 - protein, 407 aa, Pseudomonas aeruginosa
GQTPAAVPASGRRRRSRRPRRLRQTPRSRRGIRSRGGWLSRRFHGRCGESSPRPDRSAWPGLRPGCGPRRPAADAGWRRRPRSRRPRRSHSGCAAYAGCGRQWRRGWRSAVCRTWSVTLEGLAGRPAFIHQCHGRPWLGRVSSLPAARVAARRAPAATAAGSDATAASVPHQHLGRRRVPAVAGVVQLRAVGDQHDHVLLGLELHILAWRGDAVGEGQAAFGGHRHVHEEVDVGANVAFGQATVVEARAQEVVTAAVHVALVQRVAHHVALLGAGPAEGVMAAAGVGGDGQKRIAEVRIEHRAGGEVDAVLPAQSALRVVALARVFRAEEQRVHRLVAFEIEQAQGLSGLDFEQVRFAGRDHMAERGGFGVQAAFGKAHHGHLLRCTGVRCCERHDRFPGARCGRAR

SEQ ID NO: 26540 - protein, 144 aa, Pseudomonas aeruginosa
APGAWGSMRGLSKTRMRLPRVKPSERSWVTMNTVSRVSRHSSSSSSCMSLRMPGSRAPKGSSSNSTRGFITSAWAMASRCCMPPESCAGYLSSAWPRPTLCSICAACSRASRLRRPSRRPSSGARGSSRPRATLSSTVRCGNTE

SEQ ID NO: 26541 - protein, 135 aa, Pseudomonas aeruginosa
KTTPRLASGSSANGWPSSRISPRLGASWPSSSRRKVDLPQPEAPTRVQNSPSAIFRFRRSSTTWSPYCCQTFLTWMNGLASPALRLIDASCSRWATDPPATAALFLSLMPWLLHTRGTAAGSGAAARNPWPTPAG

SEQ ID NO: 26542 - protein, 130 aa, Pseudomonas aeruginosa
TFAILSRIVQSLPGGVMRHSTVTCHCCGKIMVPRTTYSRGLLGYSPTSSHCPFCLSDNWHGGNPSLHERIFWLMGFGLGVLACVMVGALLFKLQWLAGIEGVYPWLTLLTNAVAIWAGYRFYAWFLAEED

SEQ ID NO: 26543 - protein, 390 aa, Pseudomonas aeruginosa
SMAIGLPLCAPSSKGASMTRQLTTLTLCLLLASCTTHKAEPARPAFDSSRNPDLLSPDLYPNGVQPEKEPVVRYGRYTLVSTQPDAGQRDLMAQIIDVTIPSSMNPSVKDAMQYVMSRSGYSLCPAEAGHVNILYTRPLPAAQYKLGPMTLRNTLQVLSGPAWQVKVDEVARQVCFVLRPGYQLPPAPRPKPVQQLYAKPAAPTPAAVAQPSSTEKVSTLESPVVVASVPTPAPITTSPAPTKKPESTTVFPPAAPAKDGHPSSPPAALAPIKPLASAVKSMPPTPAVASAPPVKVLTPAEPSRQLAQSWSAETGSTLRDTLEAWAKRARWTVRWEPQDLNYPIEAPLSFHGSFEDAVSELFPLYDAAERPFLVNASRPQSLIIIKERKN

SEQ ID NO: 26544 - protein, 209 aa, Pseudomonas aeruginosa
PSRGCPPPGSASPTSKPRSRTASWTGLSQEKSMRTEPIGMAVAVLFLLASGQACAGTVGELAEIQAQAILTEAKVRLATAQRQLEGKGETGQIVSAQGQTFAMPVPAAPPTITQPVPPVVRTIYGAGGKMTATFLFPGGYEIDAASGAELPGNYRVESISLDQVVLTDKDGNRVPVGFSSVAPTQAASSAQGASVPPALPGAVPQPFIQ

SEQ ID NO: 26545 - protein, 466 aa, Pseudomonas aeruginosa
GTASVSSGGHRQSRSADGAVQRQASGHRHGALSARPGASADRGRRDERQPGSGHGRCRLPGRGPGQDPRHHLAGAALSLGAVRHDGVPAVHRGLSHGPQPGQALRSSHVDRPARHAQRHCQLRHRTWYLRSGRRHHPHGGGHRHVTDLPLERPGLAGPDAAALVHLPHAPGHHLPAEHGRHAQRRHTPLRQPGQHDQDLPALAEAALGSCPLRRGPGPEPGSRPSQRRSRFPRPTGHPVPVHPRQPGRLLRSSGQVQPPLAGDQPQADRAGRRAGEELRPDLHRRADDPGPARRLPGTAAHPIHEPLKPHQGALHEHYATHLPSDAGRFRFHRDDHRADHHRHRGRPGPGRSGWDVQFVQRQRGTAQHQRHCGQRTCPEDLFGLRLQRYQPDPEPDRNQRRAEEHECLLRRRLQRLRRIGHCLVHRHGLLDHHQQAAQGCLYHPGHQNREEHLRADQDQQRHRYHW

SEQ ID NO: 26546 - protein, 327 aa, Pseudomonas aeruginosa
QQHYLDLQFVSVNPIIQAQFVDLYLGEGFADVKGLAGVGARRVEVPREWESHAQELLQLCRQTLEELQDPEFAIVVDGVLLRVTQLEDAFNGGSVFVLRRSTAQVRSFEDIGYPSEVVATLLNPQLQGLILFCGDMATGKTSSAASLILARLQTLGGVGFTVEDPQETNLSGQHGLGRCIQVRTSRRSGGYSEALLRTLRTGADLILIGEIRDEDTAYQACKASLNGNLVISTIHAKNCPQAIERLITLAKPLASNAYDVVAEGIQAVICQELVSDGGARRLHAEPLLFTGVDSVAMRDKIRRQQIHLLEDDVNRQARKSLWEPIYE

SEQ ID NO: 26547 - protein, 191 aa, Pseudomonas aeruginosa
RRLDLRHGESRTPVLPLQHRCARRIRQLRRHACDGHLPQLGSPPDIMPLLWIALLLTLLTGTWLSVQSDHATSSAELAEVDTLARSLLLYRSRLAEYAHANPGFSGSPADSALGLPAWFRKPARLQGYIAADTSYAFIASPPAGLAAAVDAGTESDLVGVRRNGQLVTRRLGATAIALPAPIPEGAVVAVK

SEQ ID NO: 26548 - protein, 217 aa, Pseudomonas aeruginosa
KLPSATQRGIHFPARASVFSAPSTCRRNTMSKQSTSFEIGFALGSVVREFRRALRRPPVVVQAQAPVALSVQRIDPAFLAGPTAGELEHISDIPAIVRLKNVNLNDWYLANTREVQKPKRARKPKPAKATAKAETPVRKELKMGSLDHLIAPNSESEMGRPPLQLESLNDHEIALLPAPPGSAVSWELHRRTQEQYHQRWQDYLSTMTDEQVAALGR

SEQ ID NO: 26549 - protein, 199 aa, Pseudomonas aeruginosa
WKPSPSDLPPNTDPCGEYFSLTGKVFLRFRLRNWRTIMSNNTQAQEAKYFDLHTTGIGYLNRIREVPIRRGEPFLAATVAALHGAADSVEYSYIDCKVVGAQAEKLVRRCKEAVEAEKKVLISFRIGDIWADPFTYEKGEKKGQSGASLKGRLLFISWIKVDGTTVYDAKEEAEKAQQGQGEPQGEPAAPAEHAEQAAA

SEQ ID NO: 26550 - protein, 82 aa, Pseudomonas aeruginosa
GTSVPLGLVFPTERRITMQYGKRALAHLRLELPLQVLMSNAGFYIGTLDEEGPASRESVEYYPSRELAQQALDNGTWSQREY

SEQ ID NO: 26551 - protein, 140 aa, Pseudomonas aeruginosa
WSASYPPTRGPHPRGRGLRIRRPLMTSLNNHSSAGHTAAYLKLPIVLTNAAWLRLVYLANPARVDEMGTRLASVVQTAWQELSLQPTAKHIQFHLYHKEEEGQDRALALLVLSIVEPSDEPSYLRIELQEESLPGNPDTE

SEQ ID NO: 26552 - protein, 507 aa, Pseudomonas aeruginosa
ADPRKHSYHRCSGTSLSHPSQTQGGPMALMFPRLARNFARNGYFPTDEVTLERALQALAPAPSGRMRICDPCAGEGVALAEAAHILGRDKVQALAVEYDRERADHARGLLERVLHSDLFDTMISRQSFGLLWLNPPYGDLVADHSGASQYQGSGRRRLEKAFYQRCLPLLQYGGVMVLIVPHYVLDDELTGWLSNHFTGLRMYAAADPTFKQVVIFGIRVRRQDLARADANQVRSRLQAIGAGQEKAEEIPAAWPWEPYVVLPATSELEHFYRVTLEPEQFAGEIQRLRGLWPDFNLHFAQAGLQPRPPVRELSRWHLALALAAGAISGVVRSKSGRILVVKGDTYKDKARKTEFTEDEDGNITEVRILTDRFIPIIRAWEMTPSSVNQGRVLTISSSAATTEEAEEPQPEPAPEPLLFSPGQVVMTAAVSHLVETGQLNPAPLLNRHLAGDWGTLDQEDWNTNQRALKFGDRLLSSYDIDAGGESRLWIITEADRSSTTLLLPSDY

SEQ ID NO: 26553 - protein, 70 aa, Pseudomonas aeruginosa
AFSSVIRPLPTRPPELANEWVDEATTPERAEQMVLQESEAPEVFTWYRVDRAVGNVRNQGVHLIEPQRTG

SEQ ID NO: 26554 - protein, 272 aa, Pseudomonas aeruginosa
RIRPGDSPESYPKKSHPHSPSISYCLNGGSLRGCLWLRARTLMKRPSPASMILGLCLTAMAGLLGYQQYQLIQLRSGVDSAAEKTSLEAILARLNRVDERLDAVDGQHLVSNEDFRSGQQALSNRIDAAQAFAKQASDAVENLAQTTASAGDLLVLKATVETLDGSVRTLQEKQAKAPPLIVPPPKRGAFPVKPKPKPKPIEPPPFSILGVEYRGGERFLSVAPPGSTQLSQIYLIRQGDAVAGTTWRLTDLDDRTAHFDVAGASRSVRIQP

SEQ ID NO: 26555 - protein, 216 aa, Pseudomonas aeruginosa
RGPLDGPGTGRGPSRPGPGGERPMATSVIRALQLAALLVLANIAQAAVDPPPAYKQIALPKGVPAEVLYSVALTESKVLLRGEYVPWPWTLNVAGKSYYYATRTAACTALLAAINLYGAKSVDSGLGQVNIGWNGHRFSSPCESLDPYKNLDATSDILIEQRDALYASAPGRPVDWIQVAGRYHRPAGGAPAAKYRRTVSRHLSQVLGVNLLVTNP

SEQ ID NO: 26556 - protein, 450 aa, Pseudomonas aeruginosa
PVGTLQRRRPVRPDLRGRHPRRRPALRRRQQRGVPRVRLAVRQHHRPRAARAGYPPGLPADPPARREHRCVIRRVCPEVHQRARPEGLGHHHPHRGQAQRQERAIQHERAALPCRGHRPVPDTETHRRPGHGRPEERRALRQDLLRQDRGLAAAATGETHYRADLGASFAQLRGPQRSATDLRLDAGHPQARRGLRRPRRTIGYRGPPPRWATPCSATWSRWRVTSTSMESMTALPGSLARRQGPHQPACRRVQRADWRRVHPHGQQSGRRRCASDGLHPDHERHRGQDRLPREGRSDHRQLQQPVHAAGARDRHGRTSDQPAPQSPDLHQHASERRQRRDQQQEGSLHLQLTRPGADDQRADARAGPHRWSAQRTSVRATRGRQSLEDPNAAAGGRSRRGDAEKPAGAGCRYAQGPGRKQRVVGGTGILRPAGWSAPGPGRRFPSPRRR

SEQ ID NO: 26557 - protein, 252 aa, Pseudomonas aeruginosa
GCRLMAEVTQRAEQQQESQKTLVGTIISTPFQFLGVMFGSLVGAIIVEWVCLYFFWPDAGWKHAQAMFEYELSWLSQGLLHSVVVQEPGRTATWLAQLAYDWLFVKTGIVDWMTNMTTIAQAGPRSPLDVRYLTAQGVSTLQNYGLAALYTVLTFVVRLVILVMTIPLFLMAAFTGLVDGLVRRDLRKFGAGRESSYLYHKARGSIIPLAVVPWTLYLAIPISINPLLILLPCAALLGVTVCITASTFKKYL

SEQ ID NO: 26558 - protein, 397 aa, Pseudomonas aeruginosa
GKEICNQLIQPRKYSHQDFNVRSQRSIEMKLILDFDGRLLNPSNMLEALSKAGKNTSISISNAQALNIDTLLKATTAAENTKNLSTTFNGAELTANNLQQVINSAGSLTRVSTIAAQAININTLLSAISTAGNSKSFSAEFNGAQLSSDNLLRAVNAAGTNTSISVNTAQAANITALLQTIHAAGNTKTFSAEFNGAQLTSNNIQQALDAAGTRTSISVNTAQAVNISTLLALINSAKDTKKFSADFNGAQLTADNLQQAISAAASGTSISVNTAQAANISTLLQAINIAGNTKRFSANFNGAQLTSNNIQQALRAAGSNTSISMNSAQSANQSTLLELLDIASSSKQFQANYNGGMSNPSNLQQIVSRAGASTTVFISDAQGLPIANILTLISSAG

SEQ ID NO: 26559 - protein, 112 aa, Pseudomonas aeruginosa
NRAVRPEPLQEHVMKQTFEYHVENIDIPYKTLTKGVAMFKHKEETLEPDDHALLNPLRWAEVVRLGREGWELVSVQPLMRGVTEIGNQNAQGWAWGIALPVSYLLFFKRATS

SEQ ID NO: 26560 - protein, 143 aa, Pseudomonas aeruginosa
KNTPDPRRVFLAEWNQGDRQADRTLICKRFAVNTPHQPLRRTCLAVLACGALVAQGAFAASASEQANLAVMIRQLNALEDTARRSAQGADEPGQRFYFDYSRLAADLQRIRQGLQDYMTPSRAQPRDPSDLSGNYTLRGGPMP

SEQ ID NO: 26561 - protein, 362 aa, Pseudomonas aeruginosa
LDRQPGHGQHGVLRRREDQAGAGPLPVARHPRRRRPGDQSLRPAVGLLLRHASTYRTRGAGRPHQAGGRSMIRKSTGSLLLMLALPTLAHAVEILRWERIPLAIPLTVGQERIVFVDRNVRVGVPRDLQGKLRVQSTGGALYLLANEPIPPARLRLQDATNGEQMLIDIAASEAAADQQPREPVRIVAGEPVAPHYGQPREAQPSAAAKQTAQAEAPKAVPRETPVPVVLTRYAAQMLYAPLRTVEPVDGVGQVRVKRQLDLNTLLPSLPITATALGAWRLDDYYVTAVKLQNASAQHLALDPRDLMGNFIAATFQHPYLGTPGRRFRHHHRVSGDARPRPCRRAPALRHQPDRSQRRPSWR

SEQ ID NO: 26562 - protein, 192 aa, Pseudomonas aeruginosa
TSCTGRPSPPSTCSQVRGSPCISISNWRSTMNSRAARSITALEPLMQQQTWTNPLLRLCAGLACALVLAACSTSKEEMLPHGEANMLDVWERGATSSIGNSRGRLLLDARQTLRRPIDPQQAASANDQADYTRTASNEIHSQFKRLPNPDLVMYVFPHLAGSDPAPVPGYTTVFPFYQRVQYAMPGERTEAY

SEQ ID NO: 26563 - protein, 241 aa, Pseudomonas aeruginosa
YGPTGAHRGRGPRGNPTAEASVRLLKGGWAAKRFQGPALPWAGLLLVLLAASAVAVELLVKGLPANHSLYGDAKARWTINEYADLECPFCKVYTPRLKRWVDSHPDVNLVWRHLPLQMHGEAARHQARLVECAGIQGGAKAFWSAIDAIFAQSAGNGGGLPGGTLDFPELDQSRLEKCAKDNELVDSSIKSDIDIARSKGITATPSLIIQDNQTKRSVKLEGMADETTLLSAIDWLIHSGD

SEQ ID NO: 26564 - protein, 98 aa, Pseudomonas aeruginosa
VIYNDHPIEIRQQSIFINIVPAPIIIIDITRVELTIIHHNRGFSHNLRGFPHNPFKNPYPLKRIKRVANKAGNILSTNNYSFKIPSILKYQTKDQPSI

SEQ ID NO: 26565 - protein, 322 aa, Pseudomonas aeruginosa
ADRQGQEVALMTSHNLRRLAAAAATFSLSFTASAAINSAAIVSSTLSPQCLEYKVVGICYWLLCGPHGCKVKTSVKVRHYVPDAVVSSYANTGSNPWTEVSALGTPNPLAQAGNDATTNYKAENSIGRFKEADVIGHPGGATFSRFASASGYVCPGATFPLVPYFLSTLDAIGWRHGIPEQVYPEALVPGLREVGGVFSGDMWGNLYPRSGFLHQTDDYKTAAVIAQRAGDITTRVGQLHVYLPMRAAPKDGYWPAGELKEGDASTGKWQELTPSLSLNCAVFPNSGPKTQAVDGDYAWALWRPYSCCQRKGQIFLGSTDFQ

SEQ ID NO: 26566 - protein, 534 aa, Pseudomonas aeruginosa
AAAHSADRDPGAVAGPAHRIQQSLLPHGRRSMTFMTNDYLEYYLTLLGWIINNGIWNMISDTGLFAVPFVAIVMREWLKVRGEGADEGNKGVLSLARIETHIYVGYIVVALAGIPVVNVSFDTIEFDQARAQQCQYNLPAPADTGWSTSFSSLAGKSAQMPLWWAMMHALSKGFTAGAVAAIPCGTDLRQMRMEVDNTRVNNPLLAQEIADFSRDCYGPSRARLFMRQPDLGSIAEDNKALQDLNWIGSRFLLNTPGYYDTDYSKSPRQSWPYNATRDAGLPQVGGGGGYPTCKQWWADSGIGLRDRIKGQVDPDLMTSFLKWAKWLNQDEVTEAVIRQVISPSSQVKGNVYTDYGGQVGGTVWNGIARTAGTFGVALGSLAYFPAMDMVRQALPMVMSFLKMAMVICIPMVLVIGTYQLKVAMTMTVVFFAMMFVDFWFQLARYIDSTILDAFYGSGSPHLSFDPVMGLNTATQDAILNFVMGSMFIVLPLLWMTAIGWSGIQAGSVLNGLSRGTEGVQAAGKEAGNRVKNAV

SEQ ID NO: 26567 - protein, 67 aa, Pseudomonas aeruginosa
SIQPVSISHPAPPALGKFGDHPFMLGHFQALKNGAQAKGEGVMFILQRKDELVMAQAPAVIPVLLLE

SEQ ID NO: 26568 - protein, 67 aa, Pseudomonas aeruginosa
RAKGMVHKGKSPTRKGLPEGRKGCVRAGEHEKATGEHPPAGAQWLSLAQFLPGKAQDGPVSNFVFGA

SEQ ID NO: 26569 - protein, 169 aa, Pseudomonas aeruginosa; identical to SEQ ID NO: 20992

SEQ ID NO: 26570 - protein, 147 aa, Pseudomonas aeruginosa
SWRGCSRDRRSAAVPLPGVPGRRADRGSRRRRRPVRAADSLPPAPGVAPGSDAAAGRRPWPRHPTAPCPGRPPRRSVRRGRRASRRASSGPRLATDRCHCRRRSPGCPPEPPAGAGRNARGSARPGRSALPRRGRSRPHADRRARYR

SEQ ID NO: 26571 - protein, 356 aa, Pseudomonas aeruginosa
ARPNRRYRYSSNATASSAKRRSMRKATRHDRGLPGALPGARRCRPGRPVRCSPRRTATPLRGHALQRDERWQAGSPAARLRRLRGPRRSAAARRRRGLRGGADPCLLAGPRRPAGDGRRRPAPWPADHPPGLRRSHRDPRRRRLAGAGLRSARRHPAQSAGTCRLSGNAHPPGARRRLRRHGRRPGDRPRLGRRGPRPGGPGSHAPAQDRRADRSQRAPRRPRQRSRRARLAGRPGALRRSDRPGLPGAGRHPRRGKRHRHPRQDPGQGPGAQQADLSRPARPGGRQRLCPGAARPGPGRPRRFSAERRPAAPTGPLHRRATQLTDGSSEVPGKGRGSLAWARPVHQVNCWPLRIA

SEQ ID NO: 26572 - protein, 144 aa, Pseudomonas aeruginosa
DSPRAPRHAPARPRLFAGRTAPAGRGGPGNPGRRAAPVPAVYRRPDRRSFRRRPRRGRADHCPALRLRHSGRPPGLGRRPPGLSAQDPHRAPRADGHPAPEERPGGLPAPRRERVRHLRRRPLQHLHQRRPGHGHRRPPARQGA

SEQ ID NO: 26573 - protein, 211 aa, Pseudomonas aeruginosa
LRHLLPALHPRHAGDDPQRRGRAAQAAHHRLPVRWPGRGALSARQRPQPSDRSGPATGGDRQGRGPSARRQGRTAGLRRAVGGGDEGRRKPRRHGRRHAFRQTPRRSPGTRIGGQPRTAGDHRGKRRDGRRRLGGRRVPRQRGPRSPAAATGPARLLRRTRQAQRDARRMRPGCRGHRKGSTPASRPAVAPNPATTADNRVAVIRPTPQLP

SEQ ID NO: 26574 - protein, 300 aa, Pseudomonas aeruginosa
TAASPGHGEGVAVRRGRTRPGSAATAPTPVATTRHVPARRGLAGDSRGFRLALVQAAEHVPELAGLGRQVAPVVLVQALLQRHALRHGDGVAFQRLDLARIVGHQAQGGDAQVREHRLAHGVVALVGAKTQLQVRLDGVGTAILQFIGTDLVQQADAATFLAQVEEHAAALLGDGGKRAFQLETAIAAQAEQRVAGQAFGMQATKHRRAIGDVAHAQGYMFLAALLVEETMHGEFAEGSRQFGGGDEHDGHRGTPRETEVRHCTSSVRRPVSSKCRKYLSRWTMNRTPGYERATFNAWPR

SEQ ID NO: 26575 - protein, 240 aa, Pseudomonas aeruginosa
QAEPAQALQWRRRIVFQGKHGDRIDVIGPARVKRFVDFPAVGADPGVGLAAQDQADRPGIGLVGDPQAYPGRLVDGPQQVPGHPATVLLGVARPGFADHADLAHGGGGGSDAGQQPQAAEKDEQTHGRPQTSQCTHPQTRPCMTSQANTPARTSSSMIPTPPCTLRSTQLIGQGLRISTMRNTTKPISSHHQPSGTSQRVIHMPTISSQTMPSWSCTRRSSATLPHSQKPNSMVTPSISQ

SEQ ID NO: 26576 - protein, 633 aa, Pseudomonas aeruginosa
SGCSVTLGSEMLVAGRGRYEFLSVGVEQVHPLSRLDPADGGRGRPRGANLAKVLRRQGENQHVVVAGGQLLAQGFLAGEQAAQRGACLQALAFDQQGNAGSAGDMPAVGEQPVGDVQGGAGLAAQGEAQTELRGRRPVARQQRFGHLGGRRSSLQHQFQRRSSLAERAPDAEQVARARTGAGQRLAGRHPAEYGQGHAQRAARGVAADQGQAALPGHGVEAAGEALQPLGVGLRQGQGQGEGQGRGAHRRQVAGGDRQGALGKKERGATGGKMHAFHQGIGGDRQLFAGWRRQQGAVVADAEGHVRRRRRAGGRGEEAADQLELTHDAAGAGSALAAAQLGGAQARRQLVEHAVDELVAVGGAEGLGQLNALVDHYLVGHVDAVAQLVGGQPQDGQLDRVDLGQRAVQAGLEGGVQLALLSRHAVQDLVEVGAVDLGEVVVGAELRLDLVQGLAGDLPGVQGLDGQAAGLAASGGLAFRRLGCRVAAVLIAHLASNCASRLTISRADNAASAPLLPALVPERSMACSMESTVRTPKATGMPNCRDTWARPLVHSPATYSKCGVPPRITAPRAMMASKPPCWATFWVTSGISKAPGARMMVISLSATPWRTRASTAPLTRLSTTKLLKRPTTRA

SEQ ID NO: 26577 - protein, 237 aa, Pseudomonas aeruginosa
WIRSAMVPILIPCSAANASSSGRRAMLPSSFITSQITPDGSNPAIRARSQAASVCPARARVPPGWAISGKMWPGLNTFGGHGVLRRRSLHGAGAVRGGDAGGDALGGLDGDSELGAEAGAVALHHQRQAEALATLAGHRHADQAAGMLDHEVDVFGADAFGGHDQVAFVLAVLVIHQDDHLALADVFDQFVDRVECHGHPLMQFVGYLRKPFSARNASLMPEALGSAALSPSSRRSR

SEQ ID NO: 26578 - protein, 365 aa, Pseudomonas aeruginosa
PCRPAVAGPASARGLGALRAITAGGDFHPALRTLRPPRWPCGVLPQLRRLCIVRRVAAQRSSGVPRMGPRGDQPVVAHRADVVDPQLRRIGHPRQRPVEQRTGAGAEELRRDEQPVLIHQPQPGEGAGQTRAGLHQHFVGAARRQFQEQLVQIDVALGGGQRQQFVAGVLEAFARRGGGAGRHQRRTGRGRTPTPAAPAGRPSTSTRNGWRAAASAVSSAFRPSSSGRTLSRASSASSVSAPDNTTLERARKRCTAERAEGPVIHWLSPLAMAVRPSRLIANLTRTNGRPCSMRLMKPMLSSRASASRTPLCTAMPACIRRSRPRPATSGLGSCIAATTRATPAPTSASAHGGVRPKWLQGSRVT

SEQ ID NO: 26579 - protein, 210 aa, Pseudomonas aeruginosa
RKPHGSASAPDRAPAESTGAGTLGKARGIGRCGLREARQESHFALYKRRPDSTAMEQPMTLRPIALLAVLLLAACSSDKPKPAPTPQASRSVTMVEPVLPAHLRELSGTLSSIQGSLPRGSEVQMALLVIDERDRPQRLLASETVLATGELMPFRLPFNPESFPPAGGALRVELHARVIQSGQLAWRLHPLRIAQPTTQSLGELRLVRAP

SEQ ID NO: 26580 - protein, 325 aa, Pseudomonas aeruginosa
WSPPCVSENRHERYALHLRRHRRQLRAAGHRELVPQAGPGGLLGRLVRPVQGADATAGADRRVLPGRIAAGQGQLRRRAGHRDALRHPQPADRGPVQGWPAGRRFRRRPARIADPRPARTPCESTGAARRRPAGSGPGAIRRRPHRRRRSDPESPAGGEQRERRGADPLRPLPGRARRTGRGAGHPRRGEERRAQAGPGRRPRAADLPAPGCRPARQRRAEEPPGGRCRRRRGSLPVGRPAARPAAVRGGPGRTAQAVPAQPRLPGRPAAQDPGAGLRPAWQRPPAGHRLPPQAVPGALLSRRAPSAGLSPPARRTPGCRRPPRP

SEQ ID NO: 26581 - protein, 197 aa, Pseudomonas aeruginosa
PRPWQPGQARARRRPVERGAGRQDPRTGAGQPGDEPGRFRTRRQHRRGQGRRGQGPRAAGKTAGAVRPASHRRLLGGQPGTAESAVRRQGAGPRAQGEGRPRTRTRSCRYPCPLPAQLREARAAQAADPRRVLQALPRHPENSGTTDRSRRPERRRPGSGQRRAEAVGSFRRRREGFGAAPLHPFSRLRRSVPPLPP

SEQ ID NO: 26582 - protein, 156 aa, Pseudomonas aeruginosa
PTSASPGPARRSCWTFPASISNAARACSSRGLPAAARPPCSASSAACRSPAAAASACSARTWKSCPPRAATISASTTPATSSSSSTCCHSSRYARTSSCPVTFPRCAVSAPANATVARRRPPAICSASSASAANCTNAAPTACPSASSSGSPPPAR

SEQ ID NO: 26583 - protein, 117 aa, Pseudomonas aeruginosa
SACSRRSSPASTDRRREMAILRSVGARPWHIFGLLLAEAFSLALAGVALGLGLLYLGIAASQGYVQANYGIYLPLAWPSDYEWSLLGAILAAAVLIGCVPAWRAYRQSLADGLSIRL

SEQ ID NO: 26584 - protein, 469 aa, Pseudomonas aeruginosa
LRQREQRRAVGARQVRATDAQQHHGEGHQQVGGAPGADRSQDQVDDPFAVAAQPPGVQAGNRRCHGDAQQRCLEARVQVGEGLRQGAIQRHPVENPRQAGHQGVDGGGSGKQQAHAQPDASERSHHLLGESRDRHRRLQQVQAAAEVEVFHLPAHRRAIDEHAAGHPDQPQGHRPRQGPRSVAHLRRHRRDKFATDEHEHRHAHQRQQGRQVVADHRGPEPALQLHRGQAQQAGHGENHQGAPHAEGEDHFGATEGGDPQRIQQAEAEHHADAHQPGAAARLGEGIQRLEVDQRHGAAEHGLGGAGEHMDDQVGRQRAGDREEAPEAARQVVVDRATGRQQAGGLGEGGGLRQHQQQRHQHRHGEGSAAQAEAGGGGEDHRAGHDQPDRTGQGGGETNPPAEQVLGESGVGHRRILDGSVAVVVLASGPAGRTGVPYAPPAGEACRTKGCRGGQRKSRTNRLPPIHRYQ

SEQ ID NO: 26585 - protein, 154 aa, Pseudomonas aeruginosa
RREPAVQTCPWLKKIAPAEPAAAMSRLVSSRMITGDLPPSSREKRVMFSTAACPISLPTGVEPVNASLSMPGCAASAAPASAPVPVTMFTTPGGIPASRHNWPRRRAVSGVSSAGLRTTVQPQARAGTIFQIAISKGKFHGTMAPTTPTGSGTV

SEQ ID NO: 26586 - protein, 328 aa, Pseudomonas aeruginosa
RMNSTEAPTSRARDRLIDLPLFRVSNCASCSPCASTRSASRSSRRSRSAGRWPAQLPSNARRAAATARSTSSAPARATRASSAPVAGSYSGMSAPERAGPDSPSISRPWGLRKKALTDGSMAILMCAPRLGDGAASCMRLLPGNTLDPPLPRSLAPACRVSCRCLPSQAERDKTARRGMDILPGRQDSGRPAASSHGSPAPCLRPCRPTSARAACRPSPRWYRPACACSIASTRTAAHTISSSCGCRPACTATTCATTATTIRCSRATAWPALRRWCRCARASPASPRRTARCTRASCDATGSATWSRCWRMRISVRWRPCRYCATPA

SEQ ID NO: 26587 - protein, 297 aa, Pseudomonas aeruginosa
RKNREIPRAGSTGTRPGRRRRRNAALPSLRRLPPAAAPRPPAGRGRNPDSSAVPPAAAPFRHSPRGRPLPSPSLPAKASPCRCKACLTKNSLPSNVKHPLHGRFNHDPQTFLPRTASRAGRLCRCRSDQRPVAGGHGTGRRPGLPRPAAGATDGRPGAGGDPLPAAPRRNGPAHPSRSPRPGLRRHRPAHLHLRFPRNHRLSETLDVLRLAPDGRVLGHRLRPGTEALRMRNRVRELRAERGWSQAELAGKLEVSRQTVNAIETGRYDPSLPLAFKLARVFGLAIEAIFDDREGQLD

SEQ ID NO: 26588 - protein, 1144 aa, Pseudomonas aeruginosa
PHAHGTLQDCACGRGPHSRRERPRPGREVRQGPPLPALPDVAVVDTGRRQERRLADHVVAAQDPMVLADLRTVDLAVMGLRLEVDLAADAGVLDRSQVDAGQPAHGDVVVATDGAFRHGRNDASLDLVLADQAADAAAPAAVDGTAAARRQDRTGVAADQAANRRTRSGADPAAGIHVDQFAAVVADEPAHQTVEPAAHVAARDRMGDGTAEVVSNQPADATVAAAADLARRLGGLDGALAIVADQPAQIRAALVRDAAAGFQVSEHAVAFCLADQPAGRQAALAVHRPARLRAEYLAAGTQADQPAGIPRAAGLHLAAGATIGDVAEHVVADQAADVQAGPVGLDLPLAAGRPDRGLRIQSDQAADAAQAVALGGLCSHMDVAVGVLDDRLRPPGGGEVLPHQTSDRRARRISGDAAADGCVRDLPVDIAPDQAAQCVGAQSAADDRDPAGADVGDTPAVDPDQGAERRRTGAVGVIGYPQVVQFQVAQGARGAGEQPDIRPGVADREIADAVAETVQGAAEDAGGPADGLQCRAVIAAAQDIAAEHVQAVQVLVDRLQLRQVLHHRVVIAAGDVGRVGPGQGDRRRAVHPVAFAGIHGQRAASPAENDLVIDIDSAFGLQLQPSLGATGIQPAIQRQVGRGAQPQPVARCPAHRAVEVQVALGRNQFDIGARQVPRQGVGMNGDAIRHRRRAHVDLVGSNLPGTVEAIAGERVHLGAQGHLHRLPPDLDRPAVPRSVQRIGGQGASHHDLAVRAAIEHDPPVLAAQRAGLDGTLGVHHRVEQRIGGHGRHQDSPPVGLEQTAVACQRIGDPGVDADVEQLVAVEIQCQVAARTEPDTAHLRQDRPAVVDLRAEQGDAAAFRRGDGASLVEDTVGRGTRETVSGGVAVELGIRDVQRGSHQAADIDLGAATEEHAVGVDQEDLAVGIDPALDIAGLGADHPIQGNRATARLVEDHPLAGGNAEGVPVGDELVDLLVDRQAVAARQVYLPVRAPADHRSPAWQRIGRSQGRGAQQGQDGGDRRLGAGGLAAPATAFADDVPAALGYVPDQCIAFVHVLPSSSETPRPIRRAVLRQEPNSPGPAELLRVSLCRRVAALDLAVIPHRIEMDPRRLAGHGRQTQRGNGERRQGDAAEGHGEVALAQL

SEQ ID NO: 26589 - protein, 215 aa, Pseudomonas aeruginosa
AHQGNVIGTAVVRLQQHPLPRPYRRTQAPDDLARGGSRIAGQTLRTEQELHPQAVAHQQQVAAAVLPPRHLQQVDPEQRFPVVRQRLAGMANLERLGLLRVHAQQRRRQDERHRDSARVRRLVAAIEPGLDQGRARPDVTDADRQRGNARRIDETGPDHGQRGGGIGHQRHQQDPGRAASSQADAGHSVRSRSAADAGRHASCRTGGVVSRGPSA

SEQ ID NO: 26590 - protein, 182 aa, Pseudomonas aeruginosa
RRDAPGPGPGLARSRRRDGGPERCHGAVHPVAAAVAHGPAGDPGAPDSPYRRAAAGRPGIAVLGQPAGGAGAGGRQRQPAAGELPPADEAPVPSAGSGRRSASRRAPGRLAPASGGTAGAAGAAGGGQPQSLSRFPGAPRAGRGRPRHVPRQRHLAAFRRYPVESAGRARRGGAGPFRCGGG

SEQ ID NO: 26591 - protein, 335 aa, Pseudomonas aeruginosa
LDCPESGDRHQGQRYPGPDRCQRPGLPGQPQRRALRSRRPGQCRRPGGFHAGHHGCRVQRQLLQIPFHGSLYQRCPQPGRRHHRGGRRQHRPARRAGRQPRDGPGANGRCRARCGQRPDTEFRRQQAARHPRRRRGRQCAGKQRRSAQGRRGASPDGGHDRQCAALHGGEHPGCHRGPLAARQERADRARWRPGRQGHGGRRLVRQCAERTGARRDGRGPGAGGGGGPGHPGEHARQQWPQRYLEDCCRQDRRAPVGGVGWRHRSCRHPVAEPGEHQYRTGFDQGRPGPRRLGELGIGQPAGAGLRGRPDAEWQAECQWRQGWAGAEGRRRYRYQ

SEQ ID NO: 26592 - protein, 154 aa, Pseudomonas aeruginosa
HLRLRSVFARRPGRDQQRAYRQRQRQRGLGRRQPTALQRTGRPGRAQYQRADHERIRQRRRHRLCGEHGGRRSGGGELHHRLGAGGGHRERPQQRPCGCTVHRAQQPGRRRRPGRTECEGHDQGVRQPGEGRDLPARPERRRPGRLQHVRPRLR

SEQ ID NO: 26593 - protein, 328 aa, Pseudomonas aeruginosa
PERHRDRRGDGQGQRRQQQSRRRADWTQPRRFRRPCDLARRRERRVQQSGGRARRPQRRRTGQRGCQRQGQRRCECVGWRPGRQQRRFDPVGAQQQYRQRQRAQPHRRPGRREPDPGTHRFVHVGRHRQWRLLRLHGRAGRRQPGIDRVLRRQRQDRLQASVPLRPDLRCAGRREPWGPGRQLRDRRGGAPAACRYRLRQHLVRPAGEVPGGPPFPAGAALAWSVALFRRRNLGEFHEHEVISRPRFPAPPAWRAGSAGARSRPLLPDRRPGLGPERGRPELLVRQWQRLALACGERADQRHGERHGAVRQAGEPVPELQAPGFPGGA

SEQ ID NO: 26594 - protein, 218 aa, Pseudomonas aeruginosa
GDARMSLHRIRVMVADDHPAISLGISYELSQCGSLEMLGQVSNSTELIGRLDEGDCDVVIVDYTMPGGKYGDGLALLSLLRRRYPHLQLVVFTMLNNPGLIRAILKQGINCILSKSDSTSHLLAAVSAAYSRNQYFSPSIRDIFVNQVLSSHNERLTPREAEIVRLFGSGLTITEIAERSHRSVQTISTQKVSAMKKLGIKRDADLIRYAAEGYCRMP

SEQ ID NO: 26595 - protein, 94 aa, Pseudomonas aeruginosa
SGSSWRSAVLMAASTALASPSCWRGTTKALNCWLPERGSACASTTAPWIAGWRNSAASTSPSSTRWPRIFTWSSSRPRNCRLPSASQRALSPVR

SEQ ID NO: 26596 - protein, 140 aa, Pseudomonas aeruginosa
IVRVKGALHWTGGCFLSSKLYICMDLPWRVDSGMVAGGLWVNGEMAPPPEAPHWNLGFARAQLEAAELLPVAGGEGWEVLHFADVGALAWYLLNLPWVFPGFSFRRHRKGLRGLHESGEPLVVRQFLFWLEARNPQAARG

SEQ ID NO: 26597 - protein, 638 aa, Pseudomonas aeruginosa
TPTTCSTRRCRSAASSSPASDARWAMRRSRRTPRTSRCASPTDIDESGGADSFGSFAALRGSLLFDTPRLPAERTGRRCVPQGLTQEQQQQRCRRGYVDVQLQTHPAPAPRAGWFPHRPGQFGRVDHGQPGDPHRHHRLRPGRRNLRRGDAGGAAADAGAVHHLRRGRLPAADPWLGLRLPVVRPRALLRDHRHAVGLPDRPCVRRHRRDHAQRHHGAGQLRVAEYPHRAGRRRLAGGRRHGALLRPAECAGDHRLRSRRSDPHLRHVEHPDDFRRGRPVAPARGGVAGLVRGLDGRRRPADPAVAGGHGDVHVRRLRICHADGAGGAPRFADPAAGDGPGVDRGGLLHVHLWRGDAPAGGKLRLRRRPAPAGDADGDPAIRRAGDGTVRTHLAGRGPAVCRSRHHQHPDGRPAADSLRDGAGWRLAEGLHLPAPALQDTVAVHRRGSGDSLPARLVAGRRQRRDHPPGPGCGLRLGHRLPAGDPLRGAAAHPSPGPAARLPLAAVPVAAAILQRRNPAGDVLHHAAGDEPRRHLPAVRPDARPGGRLRPVLDPVRTAGESVPSAGGGRGAGEGIRRRGPAAAGEGACPPGRAGMSVTGATGGQPPIAPEPPWPWCGATWLRATARRRTAGCCCVRKS

SEQ ID NO: 26598 - protein, 111 aa, Pseudomonas aeruginosa
LPRHTTITMAVAVRRCPVHTLSSAHNSFEAWNQALRQVCGRFESQPALNRTLFIGDISRQDLGGLELAQIRTNAGRIARQATHADHDDDRHCFLVVQRSGHAQLRQGGDSI

SEQ ID NO: 26599 - protein, 260 aa, Pseudomonas aeruginosa
PGARGNGADGLRGRLRNHSPRTHRTHLVPSLPRRGMPAPATQPAGLRQTLAELRQRSPAEPAGAAGVRRRTAAVGGGGRGRGVAGGADRPARAGATARRRGIGGTAGRALWLQSAPARGASDRAIPAGAAPESGHARRPPAHLGAPVVPVVRGAGRQRLPLHSPPAPQPQRRRPRQPTAARRIDHLHRLQVGFQRLGAFQPGVQEAVRGFAQGLSGRRATGLTPPRAAIRPADPRRRRSWPGECLTLHRRHSKNAACQVA

SEQ ID NO: 26600 - protein, 339 aa, Pseudomonas aeruginosa
WSARRSSTPSASSRAPGAQVCRLYWTGTTGMFERPILITGGAGFIGSHLTDALLARGYRVRVLDNLSTGKRDNLPLDDERVELLEGDAADAATLAAALKGCAAVAHLAAVASVQASVDDPVATHQSNFIATLNLCEAMREQGVKRVVFASSAAVYGQNGEGTAIDEDTPKSPLTPYASDKLASEYYLDFYRRQHGLEPAIFRFFNVYGPRQDPSSPYSGVISIFTERALKGTPITVFGDGEQTRDFIYVADLVDFLVQALEATAVEPGAVNVGLNRSISLKQLLAEIGQVLGGLPPVTHADARAGDIRHSRANNERLLRRFRFDQPTPMGVGLARLLGR

SEQ ID NO: 26601 - protein, 150 aa, Pseudomonas aeruginosa
SPPGLVQRQVEDPAQQGEAEDAEQALAGAPRHPQGERRADDVAQQQPQLRQQPERQRPGHRQVHQAERAEQQQGVHQMRSPAADAAGLAPRPVPGQAPDEQGGAAEGEGDVQGLQPEVHGVRFRRMKKGARRRLFPLGAQAPRQSTTQNL

SEQ ID NO: 26602 - protein, 464 aa, Pseudomonas aeruginosa
RPRPAAGRRCARGARPPSAGWPSPGGDPLRLVRIAVSMPIRPVRTTNSETTNSAFSAVPIRPHSSCRATPGEDRHQRFAGIVVDLALQGEGRHLALQADQERGDRLWLQVHVPRLLGTDAPGAHRRHPVAPVDVQRLHAGEGYVQGAVHRGTGALEDADHGERLVVVLDQAHRAHPMGQHDLLAEPVVQGFGHLGAEHHVEQVLAEGAALGQLQFLAAAVAVVLEIAGIGTHYPVAAVRVAEGDRDRPLHPRVSGEVPVAVPADVVGRVADAEYRVEQQVHRAGARADDQVGSGDGTGEAGLGLGADPLHREQQAGGEGDGEDRQQGGEAAVGQAGQCQSEEIHAQSPAGRAARLRSERDRLRSNSPARLWSWLTNSRLAPASRHSAKSNWRNASRLSASSAEVGSSAITSSGWPISARAAATRCCWPMDRLSARRSCSSPPRPSWPSRWLAACAGLPWRSRAR

SEQ ID NO: 26603 - protein, 140 aa, Pseudomonas aeruginosa
PGRFGPYAPTWEHGAIRLWRNEMVRIRGSIGDWPVDLTLELDAEDWRQLAQHVPPPPLGEPQVAAARAPAPAAPVDRLWQTAQDLLRGSGRIEGPQLLAELEGFSGNAGAAKQLLVRLRHDARVKVEVVDGTQVFVWLED

SEQ ID NO: 26604 - protein, 215 aa, Pseudomonas aeruginosa
RWNPGGACIAQSVILVALRVGRNVRFLSPFPACRRRSILRVLGRARMRYHAASFSYACISTMHCPFCGAHDTKVIDSRLVAEGDQVRRRRECLACGERFTTFETAELVMPRLIKQDGSRQPFDEDKLRAGMQRALEKRPVSVERLEAAIGHIKHQLRATGEREIKSRVLGELVMAELQKLDEVAYIRFASVYRRFQDLNEFREEIERLAREPAKE

SEQ ID NO: 26605 - protein, 269 aa, Pseudomonas aeruginosa
VRADPPLLRRGRLRGAGGGRGPRHRRRLRPAGAASRRTTGGLHRYPGGRRAFSRRLRPFPSCPARPGGLRQRPGGDGRRAPGLHPGPDLAAGRRRVVAGLRPRPRRHGPAVRPGPGRRRHHARPAEHDPDRIRQGAGRPGADPRRCAPGRPALRRGPARRGWSGAGTGAGAKIGARRGGRTAAGALLDAGPAIRSGPRPARQGQRRPGHLRRAARRLRAYRPRFRRCPVGRMPALAGKRRVERPARRRGSLAPATGRRRRLRAGFHPAA

SEQ ID NO: 26606 - protein, 256 aa, Pseudomonas aeruginosa
AAGAVRPAHAAVACQRRAGADLRPLELALCAVEGNPATQGVIMLRLCVALFSSVLALSSLAAPQVFVVGLFPGAAVLNVDGQRKLVRVGQTGPQGVQVVSADSRKAVLRIDGVERTYELSREYNEAGYSAPQRQSFSIARGTGGHYWVAGSVNGQNMQFLVDTGATSIAMNENEARRLGIDYRVDGKPMVASTASGTSRGWRVTLDRVKIGGIELLGVEAAVIEGGYPTEALLGMSFLNRVRWREEQGMLLIEAKH

SEQ ID NO: 26607 - protein, 238 aa, Pseudomonas aeruginosa
IAGWRCRHRRGEPATGFWRRPARLRHVPADARAPGRLLPAPDDQQSAQGQGAGKLRHHRGGARAAAKGPEQAQQALPGDQGRQARAHARQPAPGRGGNHVSRQQARGALGRAWWLQLALALLPLILVEFFLGELQPLPHGLAMPLFIAALLSMFVNLPLFGAYKRGLIATQKALDTAEEAAAWTRLAQVRRKALFGASLPAWIGVPGVFAGLNGVALILLGVTSLVLFWLYRIPRQLG

SEQ ID NO: 26608 - protein, 1504 aa, Pseudomonas aeruginosa
PQRGYPPLSLGLALLPVETLAYCLFDARGIQAAFGEHLAGLGVFDVVVGQAQLQQRDFEALAGEELADRRAGAAHHGVFLDGHQQFVAARQFAYQGFVEGFDETHVDDRGVEAFGDLHRLRQLHAEDQQCDPAAAPTDHALADLHRLQVRIDRMVGAAAARIAHRGRAIEQVAGGEQLAQLVLVAGGHHQHAGDAAQVGDVEATGVGRAVLADQAGAVDGEQHVEVLHGDVMDQLVVGALEEGRVDRYHRLHALAGHAGGQGHGMLFGDGDVEVAFRITFAEGHQVGTFLHRRGDAEQARVLGGHVAQPLAEDAGILGSAGLLRRTAGSFQLGDRVVADRIQFGRGEALAFLGHHMEELRALHVAHVAQGSHQGRQVVAVDRAYVVPAELLEQGAGDQHALGVFLGAPGDLPGPGQAREHLLAALAHAAIGAAGEDLRQVVGEPADVVRDRHVVVVEDHQHVGVDFRGVVECLEGHAGGQRTVADHGHRLTLLALQAGGDGHAQGGADGGAGVADAEGVVLALCAAREGRQAVLLAQGAHQLAALGEDLVRIGLVADVPDQAVVRSVEDVVQGNGQLDHAEAGAEMTAGLADGIQQVLAQLVGQGFQVRLAQPAQFGRRRGAVEQGRGGALAGNLMERLGHQAVVMQSGEASSLPDAPAAPKQGSPYLCRGLPTTRRSVASLDDVAGQLAQRVGARRKTVEGGQGQVAQLQGIAFGGLQAEQGGIGRLVVRLVLALGLAEGGGVAFHVEDVVLHLEGQADRFGVALQGGQRGGLGATAGEGAEAHAGFDQRAGLVPVHDFQGRLVEGHADRAEVDRLAADHAGGACGARQAGEHFQTDGMFLRIAPGVGEHFEGQRLQAVGGEDRGGFVEGPVGGRLATAQVVVVHRRQVVVDQRVGMDQLHRAGRGVGALRRSAEGLAGGVGEQRANPLATVHHAVAHGLVEALQFFAGSNEQGVQGGIDARLAARLVGRDHASSPSASNGASLSSPSRSRSICTFCSAWLSDVWHSRVRRMPCSKAPSDSSSDSSPLSRRSTRVCSSVRDCSKSRVFLRAIGGVSARCTKPRDTSRGAGAGQIGGRSLRPIGTTMAAALAKVERGPARRSRQAMRIQEVRERSIPLSRYAGVAAATGGLSTSLVAVLTDIVRDGRRVVGYGHASVGRYAQGGLIRERFAPRLLGAPADSLASDDGSGIDPLRAWDLMMRDEKPGGHGERCVAVGALDMALWDAAAKAAGLPLHRFLARRLGLAEDYPQRVPVYAGGGYPYPHDDLGRLEEELRRFVDLGYTHAKIKIGAARAGPGPAPYRQGAAGSRRRFAAGGRRDEPLRRGGRGRRSESPGAAGVVVVRGHLRPPRFPYPGRSGGYLSGAHRCRRGLVLPGRGSLAGSLWRLAAGARRAGVRPRALLWPAGLPGDTRPPVRPGLAARGLPPARRLPVQPALGGGPAPGLGRGYAVGFPAIRRFRRCPAVFLGIGGIATIAWYRLRAPGDTCRAVPQASGGLDVKRQEVIS

SEQ ID NO: 26609 - protein, 261 aa, Pseudomonas aeruginosa
PELTRAERRAVVRQQSLHGDAQAGVIGHGIAQEQDRLRRLLIGMHGGERQPCVIIDGHEQRLPACTIDRVATVACDAVAGPHDAPELLGVDVQQVPGRLVLVAHNGFDGLQVAQPGHARSRQNAADRGLRDAHTACDASLQHSTFAQLDDEQSLARIDGPGRSQRPGRGIGQGGLATGQVTTEPLPGRWRSDAVRGCGSHGIQAFQRHLLDHLESAGKGKSGMLMGVHPVGRPEWIGCLATSSLSNPIRMNTGYNLLELHI

SEQ ID NO: 26610 - protein, 420 aa, Pseudomonas aeruginosa
RIDVHDVPEDLLVVRADTQRVQRAGDDVDEPPGELAERRAVAFAGELAGDAGGDLGDPAEPADGVVACRQVRVAEVEHVELIEAAGTFAFHVHTLQQVSVAFRVEDDHHLVVRLLLCAPAPVAVVNRLGPPAHLRPPASAPAVGTANILGDEQLRESRLTHPRSAEYQCVADALAQLQAYVLFARLDAMEPRQTAHGRQRPCGVPGHVPGSGFGDQLQREGGELKLLLQPARALVERRGLDVGGELGQVGIYQALRMLLRPAKALADEQVFVADRHFGTGHRVLRQSADVPPVAEHHAGLLQPHDTQPGEAQCGHDAEQRSEGERPRRDDTERGRGEAHGGGVELHGRPQERFQRVLASHGLHLQARRRVQAARLAALGMKFQHLFPGLLYLIIRQHLFQQLAEGRLVLQGLGRHLTAVA

SEQ ID NO: 26611 - protein, 90 aa, Pseudomonas aeruginosa
LPRKMLMTKQFYPRLTENKNQEPSRQAWVFMVAMPAFVLGCIFTFAILWFGPVAVRDKVIAEYEADVMLLAKQLDEAEKYRRIPSPAAAN

SEQ ID NO: 26612 - protein, 93 aa, Pseudomonas aeruginosa
GQCGRCRWLNFVSLRLRLGQSAQAAIDKHTTSKAVSMITPKVVWLISRFLLSQVDTCRPDYHTYRQRKGSQDAMLAEKNTDQTSGYRRGSNLA

SEQ ID NO: 26613 - protein, 100 aa, Pseudomonas aeruginosa
VEAAMTEQIYDYDPAQALDSPEAMALFIADALDTGDTAYIAKAMGVVARAKGMTELAKETGLAREQLYKSFSERGNPTLKTMLAVMRALGVDLTARPHAQ

SEQ ID NO: 26614 - protein, 312 aa, Pseudomonas aeruginosa
SARSSCAIPKHWRVCHVPARIGSAVHHPARSSSCRKPGHLSMRLINRTPSRSGWLALAILPFALMLALYLTSSTQRLEINPNDKLLPSFDQMSAAVERLAFTPDKRSGDYLFWQDTASSLKRLGSGLAIAAVAGLCLGVAAGTLPLFGAPLSPLLTVLSMVPPLAILPILFIVFGLGELSKVMLIVIGITPILARDLEQRAREIPRELLIKAQTLGANTWTLILRLVLPQLLPRLLISLRLVLGSAWLFLIAAEAIASTDGLGYRIFLVRRYMAMDVILPYVAWITLLAWAMDFSLRRLTQLLFPWYEGAKA

SEQ ID NO: 26615 - protein, 277 aa, Pseudomonas aeruginosa
PTTFRCTRAAMLPARPQACRPPSPTLFALPIKEPDMSASLAIRPTLYEETVPGGGHTSFILKRGQLLRLTDLEGGANVSLMLLNAQEKSERLNLPDTLKGQHTAKLTAGHCLYSDMGRVLAAITADTCGWHDSFGGVLNADEVMEKYGQGRYQELRNGFFRNGTDNLLVEMGKWNLNLQDLLMVLNLFSRVDVTADGAFAFHSGNSQAGDYLELYAPMDTLVILTALQHPLDPNPVYAPRPVKLSWHQVASDGISVLCRTSRPENGRAFHNTERLYI

SEQ ID NO: 26616 - protein, 1212 aa, Pseudomonas aeruginosa
RRDGPPALRGLLTMFDKLLIANRGAIACRILRTLRNLNVNGVAVYSEADAASLHLQQADEAHSLGEGPATQTYLDVEKILRIARETGAKAIHPGYGFLSENAAFAEACEAAGIAFVGPTPEQLRVFGLKHTARALAKQRGVPMLEGTELLDSLADALGAAEQVGYPVMLKSTAGGGGIGMRVCRTAAELTDAFDAVKRLGQNNFSDSGVFIEKYIERARHLEVQVFGDGAGDVIALGVRDCSVQRRNQKVLEETPAPNLPTGMAEALCEAAITLAKAVSYRSAGTVEFVYDAEAQRFYFLEVNTRLQVEHGVTEQVWGVDLVRWMIELAAGDLPPLVELVKGLKPSGHSIQARVYAEDPGRDFQPSPGLLTAVAFPAADGKSLRIDTWVEAGCEIPPYFDPMIAKVISWAPSREAARAALDAALGDTLIYGVETNRDYLRQILAFTPFASGNPWTRCLKGLSYKANTFEVISAGTQTTVQDFPGRLGYWAVGVPPSGPMDSRALRLGNALLDNPEDAAGLEITMSGPILRFNTDAVVALTGAEIPVKLDDVAQPMCTAIFVPAGSTLTIGTITGAGARSYLAVRGGVQVPEYLGSKSTFTLGQFGGHGGRALRAGDVLHLAPLSDSSAGARLAAELCSALPAVRELRVIYGPHGAPEYFTEGYIARFFATDWEVHFNSSRTGVRLIGPKPEWVRESGGEAGLHPSNIHDNPYAIGAVDFTGDMPVILGPDGPSLGGFVCPVTIIEADLWQLGQLKAGDKVRFVPVDVLTARQLAKAADAECASLAPAAVVATPVALQSPIVLDIGEADSRLVAPLSGDTHLLLEIGAPELDLVLRFRGHALMQALEAKQLDGVIDLTPGIRSLQVHYQPETLALEDLLEIVAGLWDAVCAAQDLKVPSRIVHLPLSWDDPACQLAIEKYMTTVRKDAPWCPSNLEFIRRINDLPNLDAVYRTVFDASYLVMGLGDVYLGAPVATPLDPRHRLVTTKYNPARTWTAENSVGIGGAYMCIYGMEGPGGYQFVGRTLQMWNRYRAVEAFGGQPWLLRFFDQIRFYPVSAEELSRIRRDFPLGRYPLKIENTELRLSDYQDFLAAEADSIDAFRRQQRGAFDAERQRWIESGQAHFESEEVAADLGEDAPLGAGQLGIESHIAGNLWQVSVAEGTRVDAGDVLVILESMKMEIPLTAPVAGVVKEVRAQPGSPVRAGQRVVVIEEA

SEQ ID NO: 26617 - protein, 643 aa, Pseudomonas aeruginosa
GPSAPEATVGWIALYRSTHRPSGPATNIAVEKVSPFSPYEGHEMTTTFDLRLATLSAAYTAGDITPRQLILGLRDKAAALNGEFNAFIHLLSAEELEPYLATLESKTPAELPLYGVPFAIKDNIDLAGVPTTAACPAYAYTPETSATVVDQLIALGAVPLGKTNLDQFATGLNGTRSPYGECRNSVHPDYPSGGSSAGSSLAVALGLCSFALGTDTAGSGRVPAALNNLVGLKASKGLISTAGVVPACRTLDCVTFFTATAAEASQLLALTTRLDPRDEYSRSNPLCNDGSAFGQIKTFRFGIPQHLEFFGCAESAALFAATIEQLKALGGEPVEVDFAPFLEAARLLYEGPWVAERYSVAGALIEQQPDAVLPVIKAVLEKAPGTTAVQLFQAQYRLQQLKAVCDRTMAEVDCVLTPAYPRPVTLAELHAEPVKRNSDLGYYTNFMNMLDYAAVAVPAATMHNGLPWGVTLFGRVFTDQYLLSLADALQHQTGLKLIGGNALITPPPRNPARNDRARLVVCGAHLDGLPLNWQLRQRGGRLLETTRSSPDYKLYALAGGPPLRPGMVRVAEGGAAVEVEVWELPNQELGSFLTGIPAPLGLGKVQLADGRWETGFICEPYGLDGAQDITELGGWRTYLKRRS

SEQ ID NO: 26618 - protein, 367 aa, Pseudomonas aeruginosa
GRRGATGLHCGHPVALSEHPAPGRPPMQSHADSGRHHLHPKEDSMRITLPRIGLGGAPLGNMFHPLSEETADATLNAAWDAGFRYYDVSPHYGAGLAEQRFGRLLSGKPRDEYVLSTKVGRLLQPASQPENAKPFVDELPNKRVPDYSADGARRSIEDSLERMGVDRLDVVFIHDVSEDQWGPQWREYFQQAMNGAAKALTQLRDEGVIRGWGLGVNLVEPCRLALEQSDPNVFLLAGRYSLLEHDEALDTLFPTCQARDVGVVVGGPFNSGVLAGGDHYEYDQIPPQVAQRREQLKAAAEHCGVDLRAAALHFCLANPVVASVIPGTANPERPRQYMEDFNAQVPREFWQTLKQDGLLREDAPVPI

SEQ ID NO: 26619 - protein, 114 aa, Pseudomonas aeruginosa
SRAISTAWPTCRRTLRSRRRSSATCSASAPRKPSSRWPAPTTSPLRRWARASPQATTPIPSMAAARSSPSCSRTTGRSRPSRISARPTTPSSPKRSPSKPTPGGPRPACAGEKP

SEQ ID NO: 26620 - protein, 266 aa, Pseudomonas aeruginosa
RRCDMHKALDYRGRCVVITGAAGGIGRGLAQSFAAAGATLELLDRDADALARLADELAGETLLHCTALDLGDRQAVQQYADDLACRGLNADVLINNAGVEYATPLGECSFEADQRWSALLENNVGSMQRLTRALLPRLRAGASVINQASIWGLKGVPGFSAYVASKHAVVGLTRSLAWELGPRRIRVNAVCPGWIGTDAAMRSLKVMADANGRSDSAELAAILANQAIPELLTPADLSGTFLFLGSPLAAALTGQALSVSHGEVMH

SEQ ID NO: 26621 - protein, 683 aa, Pseudomonas aeruginosa
RATTSCSPPSGRFCCRPARGICVNSWPPSSPRCGRSCWPASCPSAATATAPRPGRSPIRRCPAASATLCCRATGTSPTPPVCPPRTSPRWAVIRRPAAGNASNWMCPPLQRRSPHDRTDQHSLRSTTTHHSTRRTGRTGGAQRQFLAYSRRTLAAQRLAAHRRRAEPALRRLVAVDRPRPGRPDVHAQPRRSARAHRPLVDQRGAAGRHRHQRLAGHGRLRRLGTDRPAAGAVHRHVPASAGLSRTAYRLHPLYAGRGLHSAGDALGRHRRRLQGTDHLHRHLFPDGADGRRGCAPRTHGADRGGADHGRQPQRDRQAGDPAVGQACAARHPAHHLWLGLDLPGGSRTGRGQLRPRLRHPQGAALHAHRQDLRRHPVDRSHRPDHRSGLPLVAPPRLSLDEEMTMSDAKIRVHQVGKTFVSERREVQALQSIDLDIQPNEFVTFVGASGCGKSTLLRIIAGLETLSRGEILLDGRPIDGPGVDRAMVFQHYSLYPWLTVMQNIKFCRQLKVIGDTVRHDGDVESAAGRADALLNLMGLTRFADAYPSQLSGGMQQRVAIARALLPKPATLLMDEPFGALDAQTREVMHDLIRHVHRLEKSTILFVTHDVEEAIYLGSRIVLMAPRPGRIDSIYEVPLPAQRHQDMKLAPEFTELKREILARIRETSGMQTDLEQLAKLSAVAG

SEQ ID NO: 26622 - protein, 799 aa, Pseudomonas aeruginosa
LQGAQADDQLSPLLRRGVETAVAGQGCEVRDGQLRRHPRRDQGQVRPNRPSRPDAPRLRALHRCGAGRRPAGDQRQRGGRDARPGDRHPVQLEPRSRLVRQRPLPGRQALRRLLARHPQAPDRSRCSAGLHLQPGHRDRVLPVQGHPGWRLRAHFRARRHGQALLRPAPADGQPAHRRRTGTGDERDGLGRLLLRPRGRQRPVRNRFQVHRRPRHGRPLRVLPHDGQRDRPQARRLRHLHAQALGQPHRQRRALQHVASRHRDRQESVRSRWRRPLRLRRDPAGLSLHRWGTETCQGHLRGHRAYGQQLQAADPQGRHVRLDLGAGVLLLRQQQPHQHAAHSIPGRAGRMPRRRHRLQPLPRCRDDPRRRPGGHPRQARSRPAAPREHVSLQRTGGRADGYRDPAAHPQRSHRRLRGRPAVAPGVRRCHVPGLCRVQARRMECLPHPCFRLGNPALSEVLLNREYRHARHHDEKAALRRGHCPRRPRPAGPGGGEKDLQPGLDHLRRLDALEVRRRVGNHEEMGRQVRDRGEHQPDQRLRRVHQPVQRRPVRRRGRHQHGCAVDSGGRWRRHHRADRRQLLQRQRRPGDEGHQRSQTDQGPTGAPGGTVGVALHPGQGAGQRRPVGEGRAGGQHLRRRHRRCLQHGRCTQRGDLESAAAGSRRHTGCTSGLRLGQRAGPCQGPADRQQRDAGRQPRVRQGSHRRLVRGDGNHGQRHAARRRATRPAGRSFRYRPGRLRGATQGHPHVLSASRSGRLHLRRTGPRSDGQRAQVLLRPRPAGRRCRFGGLCRYRHAGRRAR

SEQ ID NO: 26623 - protein, 131 aa, Pseudomonas aeruginosa
LVLTALQSLHLFGLRAFGACGNEEAYTLPFVKGLVTASFDLSEVNKNICAAFRGDETETFNFVKPLNSTSLASCHDVYLQNLRVRRFKAWLELNAERRQTEEMRIEQTEHQGGTLNWARSRDHHTGFGEIR

SEQ ID NO: 26624 - protein, 207 aa, Pseudomonas aeruginosa
PARVVEVRLAVPGGIADFAAGGAIAAAAPEVEAALASFLAVDQGQTALAAEEVTGRRRGSAGGRACSRVALCAGVRAQRLQLRLQELVELLDHVHVGVLAVSDPVQGDLQVAGKVEAEEAEVVLQERDGGLAQLAGDQASALHLHLALVDDVLHDRGVGGWPANPAALHLAHQAGIGEALGRGGFLLQDLAAVDLEDLAWLQLRDGV

SEQ ID NO: 26625 - protein, 74 aa, Pseudomonas aeruginosa
SGASGTTQLVDGAEAWSWRSVASGNTQLAAGAGVGPWWGDSSGTTQLAAGAEVSSWWSGSSGTTQLAAGAEVSS

SEQ ID NO: 26626 - protein, 74 aa, Pseudomonas aeruginosa; identical to SEQ ID NO: 26625

SEQ ID NO: 26627 - protein, 99 aa, Pseudomonas aeruginosa
TTAESVNAAEAWILGKRASVFIKDSLQLMDVVAPAAGADQHLGFSFWGVLGGKNLAHQVVWVVLVTIHALVGDQGLGSVHVWAPCRRGPATGSGRRDEK

SEQ ID NO: 26628 - protein, 184 aa, Pseudomonas aeruginosa
GCRTGSAKGVTVAARREPDASGGKVGVAKQTHPDHRRSGMKGDKIGTSQAVEPYERTLSRLIERYRQENGLEKEQPLTTEDVMVLQQQYLLSVLGTALAEKHSWSLGEIVAIDFALIRRYSWTPQQVQALSPAQKWLAICDELEPLHVPEEARRVWRDERQVRGPVPIDSREDDLEVWREALAQ

SEQ ID NO: 26629 - protein, 85 aa, Pseudomonas aeruginosa
WRPIIGTVAAAPYTEFQDCQPKLMPISPPWIWLGICGSSLPLAEEPMTFPWFQATRPPSRPEPPTLPEAEAPLMVAVLKPTSPPI

SEQ ID NO: 26630 - protein, 201 aa, Pseudomonas aeruginosa
TVRDLTLVAELPKTLLPPVWTCTTCTLPASAAISGSVWTWTMLEPLAPGLRLVRVWVWTTSIPLTPGPMLAPLWLCTIVTPLTPEPMLGPLWLCTTLMPLAPEPIFAPFWLCTTVMPLAPEPILAPFWLCTTVTPLTPEPILGLFWLCTTLMSLAPAPILAPFWLCTTLMPLAPEPMLAPLWLCTAEVPLAPAARSTAGCC

SEQ ID NO: 26631 - protein, 222 aa, Pseudomonas aeruginosa
TMVTPLLSDALAPAGPCATWTWPEPSPAAFAWPTAATLTSCERILQVPVAPWSAWVSSCAVRCISTFAPWFSTRPPLPPPMALASCLPATRTVPCSPPSRTMRPSALRSVLASRVPWLLTTVLSRLSALRALISTWPPSARMRPPLCARASTEPLSTCRLSRPSPSKLRLMPWPAPRATSPSCAWITPSLLTRAPSRAMLPPSLACRLPALLTVAPESPENW

SEQ ID NO: 26632 - protein, 233 aa, Pseudomonas aeruginosa
RSPWLPPAPGGRSRLSRAGAGAADARRGVGTPGEGGDRQIPCLRPGCRRGGPGILASPVGLGAAQGHPGIFHSGGTRVKRLHWVLLAMLLPGLALALEKGSTLEPWTLQDQFEKAHSLDDSTRVLLVARDMGGSKLVKAALAERPKGYLEARHALFLADISRMPALISRLFAVPAMRDYSYPVLLDRDAAIASRYASDEGKVLWVRLEQRRVLETRQLDSPVALRIALEQLQP

SEQ ID NO: 26633 - protein, 151 aa, Pseudomonas aeruginosa
PARRRRASSARRAGPGPGGSSAPAPRRPCREAWCAVVADVPGYPPPARGGSSGAGRTPPAAARPGWRRAIRPWPGTGRSPRRSAGAAIAPASAVPPAPGRSARARRLGRAGHRAGGCRRRSVRRSSPGPDAPAPPPSGQHGRRPPGGRRGK

SEQ ID NO: 26634 - protein, 294 aa, Pseudomonas aeruginosa
GLVSRVGSFESGELQIGPGYLITPEQSNPPGNSQIGTEGDRRAAFGVAQAQHDHPEDRPDQRRQQDGQRQDLPATPGTEHGQQLEVAVAHALLAGHQLEQPEHRPQAQVAEHRAEQRIVEAGEEAEMVGDQAQPEQRQHQHVRQQLVIGIDQAHRQQTPGQQEHRARLPGEAEMPGDVAGKQRGGQFHQGVAFADGGLAGRALAAQRQVADQRDVFPGADLVAAARARRIRQHQVVGRLLGFRLQPERFAGFGLPVALHHLRQAMHDDVEEAADQQAKEDSAQDKGQRMAGQVV

SEQ ID NO: 26635 - protein, 163 aa, Pseudomonas aeruginosa
SRVSLGTSCSFLQCEQSFRARRWAMIRFTEVARLNAGTPMFSRRVRVSAALLVCRVDITICPVCAALMAISAVSRSRISPTMITSGSWRRKARSAWEKSMPWRGLTLTWLMPSRLISTGSSAVEMLMSVVLRMFRPVYSDTVLPEPVGPVTRIMPCGCLSAAR

SEQ ID NO: 26636 - protein, 221 aa, Pseudomonas aeruginosa
EGRGFDSSIRHQLHKKAPLRRGFLLPAIRSEGEAHGQVDGPDVLGQGADGDVVDAGLGDVAQGALVDSAGSFQLGTAGGEGDGGAHVVQAEFVEHDDIGAGLQRLAQFIEVLHFHFHRLAGCYAPGFGDCPIDTAAGGDVVFLDQEGIVEADAMVVATAAGDRVLLRQAQAGQGLARVEELHRGAGDQVGVVLAAGGGTGKQLEEVQRAALAGEQGAGRTF

SEQ ID NO: 26637 - protein, 580 aa, Pseudomonas aeruginosa
  UNSURE (556): Identity of amino acid at the above locations are unknown.
RLEIDVTDDANRSSVPDFCHSMRGREGGRRVPMQNDANVVHLTRVASEPSPNAGAGRLPVILVQVRDKAALQLKQALQALFDNADDTLFEMADRATSNLEQNAFFEAMRDLRLKRKSIERVYLQKVFEEFSALNQVQSGKSVPTLDTVSFDSLSLVQNEELEESVAVDAMVARVMSRDATALAHLSTRLNTLVGRKVDEKSNPLAPRPLTAAFLDACQGLGVEIKVKLIILKLFEKYVLAHCDQLYAEANQILVAAGVLPELKSALPRRQPAVRPEAVRDAGTKQAQVAILEGGQQEVFGALQELLAQVRDNPSFYRRETPENAAPISSNDLMRLLSHLQQHLPGPGAAEFDVRDGVDQLLQRVSHKSGRSRVVGQVDDDVINLVSMLFEFILDDRTLPDSLKALIGRMQIPMLKVALLDKTFFSRGSHPARRLLNEIASASLGWAEHNDARRDSLYQKIEQVVMRLLNDFVDDPAIFAELLEDFIAFTGDERRRSELLEQRHPRRRGRPRQGRTGSAGRGAGAEPATARQGPAGGGGAPAAGCLEQGDAADLPQXWQGFRRVAGGPGYHGPADLERRPA

SEQ ID NO: 26638 - protein, 417 aa, Pseudomonas aeruginosa
GPGVLPESPGPERTSLFRGDPPPDGFRAFPHRTRRRHHPVRLLSRPRLACRGFLLRRSRGVQRLLPWHRTGGDRHGTVHGRAVHCPGRADAAVARGLPGDHPGTHPGPLRYRPGAQDRSRRGFRLVALPRRIDRFQGGNMTFLVLLLALALEKFSGWRRRIQRDGAWLAWLSLVEDLPSVSRRSWLGLLLAVVLPLLPLALLLTLLQPLAYGWLSLPLHLLVVVYSLGRGDVMADLGPFRDAWRREEAQAAFHVAERDLGILGGSESELIGRVHGHLLWQGYQSFFAVIFWYALLGPVAALAYRLLALALEHARQPALREQAARVRHILDWLPVRALVLSFALVGNFLAVIRVLLHWLLAWDISAAALLGKAGRVASDVEAVELGAAGVASLDALWQLLVRAAVLWYAVFAFCALFL

SEQ ID NO: 26639 - protein, 680 aa, Pseudomonas aeruginosa
EQSGDVWVKTVLYPAIALMNRLSFGMKFGLISVLFFLPLLITSFYLVRDAYRQFSDTRIELQSLTLLGSGLQIRRGLESLNDLLQINAVIGQSGKAGDLEARIADVQKGLRGRLEALAPLSEDGAAVAEFEAQRDRLLNGLQAVEAEGSLQGKGARAEKLLGSAQVFIKLLIAQAGLSQDSQRQVRQLSELVGSITPEVTAAISKGRAIGAYSLGQGFLNSSSSARLDELLLEFEKLHGEYGLKLQESLAGSPPALEEAAQASRETLKSLGQLFEDRVIVAETLDTPWTQFYDQVSAAMDKTYQLDDAVLGYLDTQLQKRLQQVRTQMLLLVAALAVVFAAILYLYGGFYVSTRATLKDLGRMMERVAGGDMTVSFQARSRDELGELGQSFNESVAKIHDLIERVSQTVGEVERQTLRVESVSAESNQAVAGQRSQIEQVATAMNQMAATAQEVARSAAMAVSSANSVNQETLSGRSLVESQVGSIQRLAGEIDQSVAAINRLASDSASISQVLDVIKGIAEQTNLLALNAAIEAARAGEQGRGFAVVADEVRTLAKRTQQSTAEIEQMILRLQGGVDAAVKAMGSSHHTADGTVNESAQVQQALENILGAVGMIVDQNQQIAAAAEQQTAVAHDIDQNIVEINQAGERTAEGASQTERASRELGAQVTQLKRLIGAFRV

SEQ ID NO: 26640 - protein, 415 aa, Pseudomonas aeruginosa
NLPAHEGLRRQAGNPLCSHRQADHRRCLRPTDRLLPLRQDLLRGEGQSRYRNHRAAARQGFELRYRLDLRTGQGDEDRRRSGAHQLRQHHQEIQGHPLLLREGRAPVRHRLRSRPAQHRQGRSRRQGLRAYSHRGLDYRRLAVVAQVRLPDRHGHGPADPGPPAGPGALRHFLPRRFAAARHLGVGRGDRQGQGDLRAPEGRRRYRPEDDQHGRRLPGQLHHQDQRPGNLCGGDHPLPQGGLRRRPAGNHPRAGPFADRQCRHPGQRSGAGRPQVADRRGALGLCRRRQVLRTDRNHGRVDQVPDLDREAGRDGRGGDRRPDLRQRRHHVRALQVWPAAEPGERRPPLLAVYRRLHHQLQCGGVQRLPAAEGVLPLAQSPLLRRAPPRRGFFMSLWKPRGARVSLVRQPMTRTPT

SEQ ID NO: 26641 - protein, 529 aa, Pseudomonas aeruginosa
PSGSPIWPAPLSTTRRWAGSPLRTATSRWYFSRAATWSSASTDAAPSPRMRRWKIVRPASRLSPWPATAPRGMRWTVCSPQLRRPAGRRPRCRRKCSGVATPDMSPTRMDTFGKLPTTRSGRSTSRATWSCPEGATDGKTPRSAGRFLWRRSAFVRLAGRCARCRWRGSSGLGYLLPGVGLVQRQLVEVAQAIVGIGVADPADFMLEVVAHQALGRIEEVIVEAGEVGPGMDQVFAAVASVDQGLQVARMGLLPAGRSPDQEGHGVHAAGRVAFVAAETVVRGFVEDFLAMVREVDQEAVRIAVGEALDQAGDHVVVVQHGVVVAVVDLHLVIAEGRRGALAVDEASVVGGIAVLVVHVGAEQMDHDEFLRRRVVQHLGEGRQHRAVQLAGVLAALVVQVELRIGLLGEGRQHGVALGHGLLVGDPEGFVAGLLHQVHQRRIGEEAVGMLLVSERQHLLQHLDGVWPRRHHVVEYREVPVRGLQCVQLRGRFAWIAVEAHVLARRGFADHQDQRARRIAIGIDEVLQRW

SEQ ID NO: 26642 - protein, 199 aa, Pseudomonas aeruginosa
WRRRGPAPMAGKPGRGDRRCRPGGLGSAGLRGLVAGAAGVPESWQPGRVDLAAGPACAGRQRHPMARRRSAGDRSAPGARAHPRMAAAASPGRPGAGGGRGRRAEPGAGPGRAPAAGFFRTPGRLAPAGAAGCADSAFRAPVLHRVAAERWRPATDRTPGAACRRQPGHLLRLAHRVPAARRRADPAPAPQRGFPPAGG

SEQ ID NO: 26643 - protein, 348 aa, Pseudomonas aeruginosa
AAARRARRLRRLSQGPAADGAGPGRQRPRAGTGRRGRRAAAVRGLRRSRLPAGRSAGAAAAWRRGASRSAADHRTGPGHRPRRSLPRLRRQPAAPDRRQSLRAWRQPAVAGGPPAPARGPGQPVIRIEPAGAEALLLTLAEEPEVDLSVRLAELARRLREGLGEGVRDLVPGWTTLMLHYDPYRIAPQVLEERLGPLLAEWHAWRPAEDAGRLHEIPVWYAGEDLATVAVACGLTGEGVIELHSAAEYRVGAIGFAPGFAYLGGLDPRLVLPRRATPRARVPAGSLAIAEAQTAIYPQASPGGWHLLGRSPWRPFDPAATPPCPLALGDRVRFVAIGREDFLDLGGRE

SEQ ID NO: 26644 - protein, 222 aa, Pseudomonas aeruginosa
NRYPGHLPGADTMDTSAFLIALAVVYLVPGPDMLLLFQTGARQGRRAALVTALGLALARACHVLMAATGLALLFRTAPWTFDLVRLLGAAYLAWLGLQMLRGGGLALPTSDAGSAPVVPHADRRALLRGLLTNLLNPKALLFCSVLLPQFVSPGAGSLAVQFAALGTVLVLVGLAFDCAYALAGGRLGRWLASRPRAQRLQQWGFGGLLIGFGVRLALLRQL

SEQ ID NO: 26645 - protein, 197 aa, Pseudomonas aeruginosa
SADTQPGASIRPIRAIMVTDLPEPDSPTMASTSPLSTLRSRPSTTGTAVVSPKRTLRFLISRRLMRRSPVARIRMRCSWLCSSCRVLQFRIEGVAQAVAHQVDRQYAEQDGQAGQADHPPGALDVVAGGGEHGAPLGGRRLHAEAEEAEGGGVEDRRREAQGGLDDQRRHAVRQHADEHQSQGAGAGQARGGDVVAV

SEQ ID NO: 26646 - protein, 204 aa, Pseudomonas aeruginosa
LGHHRGAGQAYVGRQRDDGDGDHGVDQARAEDRHDGHRQQQRRQRQHDVHQAHDQRPGTVRREAGEQAEEDAGDQRDHHRGQADQQRQAGAVDQPREQVAAQLVGAEQEARLAAFQPGWRGQQEVPELLARIVGGDPGGEQRAEHDQQHEQQAAEGALVVREGLPEFLQRGRVDQARVAGGSVVHGVHRLAHQRWWRMRGLARP

SEQ ID NO: 26647 - protein, 607 aa, Pseudomonas aeruginosa
SRYCWYNGLSRPRRCRASACICGSTRRSPIITSTGSPGIRRISAKVSSVTPKKVGISNPNRRAMKLSMLAGNSSSRTVRPAGGGAVVLVLLRLHRGGGEVVVAQRIDHVALHRVPPDVEQLRVGQRYPWGLFVEYHLGLLVQFRPLGRIAHLAGLAHQRLEVLVAPARLVFTRLGGGAAQVRAEEVVRVAVVAGPAKQRQVVLAGLRTLEQLAPFQGTNGQLDAGLGQVCLQHLCRQGGVGDGRRGAVANEQGDPEIFRAGFLEQRPGAFGIVRPVLDRMVVAEQGRGIGTDRRTGRAGAEHRVEHGLLVQREVDRLAHARVVERLVLGVDGNVGGQQGIDLVHRQVRVLLQARHVLRFRVQRDLALAGTDLLHAHVGIEGNGEHQVVDRRLAGVVVRVRRIADLGVLGVALEDERPGADRLVVQLALLAGGEQLVAVLGGIDGREGHRHIAQERRFGTVEDEAHGELVDLFHRLDQLAHAHRVEVGVAAQRRGMPGMLRIEGALEGPQHIIGIQAPGRLEVVGGMEFHAGAQVEGIAQSVGADVPALGQPRDHLGGAGAEGEQAVEHGFRGGVGGHRAGVLDDVEAFRAGLGADHQVLRLGRAGGA

SEQ ID NO: 26648 - protein, 566 aa, Pseudomonas aeruginosa
STGRAVLLHPGRFTTGVASASGLVGYAIEGVPREGADLEVMHRLVHRLVHGGVGDRGDRHLLLEDVLGLLVQLAALVLVGDPLGSLDQLVVGRVAPFRYVVAVDRVAAVEGRQPVVRIAVVAGPAEQHGVMLAGMGALDVLAPLVADDPGLDADLRPVGLDHLRHQLGVGVVGTLHRHRPQGDLGALGDAGLLQQFPGLGRIERGVLDGFVIGPLGRRHAVHRQLPGTLVDGVDDGLLVHRHVQRLAYFELVERLVGDVVGDVAEVEAWLRGHLQVRRFLQGLEIGGAWVEGDLALAGLELLCAHRGVGVDREDQVVDLHVFGFPVVLVALEADLRILLVAAQDERPGADRLLVDLLWLAGLEQLPGVLGGLDRGDVHRQVLDEGGVDLVEGELHPVLVELLDPGDVLVQAHVGEVGKLGGVGLAERMILVEHALEGEQHIVGVEFAGRLEVVGAVELHTLAQVEGVGLAVVADVPAFRQGRDRPGAAALELDEAVEQGDRGRVVVGAGGVLGGIEAGRAALRAEHQVAGGVGERGAEDQTGCQPGPKGKDLTHANLIFSFSKGIV

SEQ ID NO: 26649 - protein, 190 aa, Pseudomonas aeruginosa
EALPMSEELLFEGEEQPHLLLVDDDPTFTRVLARAMSRRGLRVSTAGSAEEGLALAQQDTPDYAVLDLKMEGDSGLVLLPKLLELHADMRVVILTGYSSIATAVEAIKRGACNYLCKPADADDVLAALLSEHADLDTLVPENPMSVDRLQWEHIQRVLAEHEGNISATARALGMHRRTLQRKLQKRPVRR

SEQ ID NO: 26650 - protein, 720 aa, Pseudomonas aeruginosa
PAQARRADRERVAEPPAEGNPRGAVAARYPDRGLRLLLREQWRPPRPDRYVAADHLRARPDPEGQPGRGTARPTGPGRPLARRRRPPARLRGGAQARRPGAGARAAGPYRRRRPAVAQGRRVGGNLGLSPALRQRQGDAVPVQGRPAVVAVEPTDALRRWWRKRRQPAERSGQRRPGGTARRRRTVPRALRPAGPRRAAPAHHPQCQRPGHGLPALHPELRRGALREGRAGLEQLPGAERGGTPAAAGLRPGLAGHADGRQRLRGAAGHPWPVRGDAGASGGRAEDGPGLLRASQRRCRSLLVRQFAAAFAAAGGPVERAGQCRTRRRAGQAVRSRDRREGSQGRGWQLPGGRPGGWPDPPLDPPGQLELRRLSGQPGGQPGEHQRPRVLPHRHGAPWPDPAVLPRRPVARQGPGHPRQTLSAARRGVAEGCAGTGLPGAAAALRTAATGNPRQPAAGHGAGIPQCRRHLPDAAPENPRRQGQLRPRAACRKPGQRTVAMAAAGMAVAVRRLTAFGLALLLLASGVARGEPAVTLDPQQSQVFRAWFVRIAQEQLRQGPSPRWHQQDCAGLVRFAANEALKVHDGKWLRANGLSNRYLPPELALSPEQRRLAQNWQQGGGQVGPYVNAIKLVQFNSRLVGRDLNQARPGDLMFYDQGDDQHLMIWMGRSIAYHTGSSTPTDNGMRSVSLQQLMTWKDTRWIPDESNPNFIGIYRLAFLSQ

SEQ ID NO: 26651 - protein, 153 aa, Pseudomonas aeruginosa
SGAGRLASARVTSPTSACSSSTRANSRSRPSCSAGRLAASAARPWSWPRESTTFRWRNSRSAMATGAPSCARTGRSATAWRCASTCWPTAGRWSRCRTSAWRRRATRCNCRRTRATYACAWPMARPRPTWAISMICWSIPTAASSRPPANCCR

SEQ ID NO: 26652 - protein, 392 aa, Pseudomonas aeruginosa
GRLAVHRCLAGLSLGRGWPAGQRSAATPGAGAIDPGTRPGPDLAAGRVGPGAAGQAAAAAEGLAGAARRQRRNLLAMARPRHSELGRPGRGAGPAVAGCAQLPQRPGAERATAGADQPSSAAPGARRGSVRVQGRGGRRQAAFQRRTVSRRSDPERSGRHRSTLRHAGTAAAARRGCRAHHLGHQDQRPGRRRSDHPGARAQRTGRVVLRGAGGQPEWRAAFPSPGAFLPERQLQPATGPLPASLRAGTAGPGSQAGAGQGQGRVIALRAWLVLLCAVPLLLRAAEAPVQLAWRTTQGYELVSLDRQRVLERRPLPADLQAPLGSLWKLFVFAWLSDTGQAEPPYTCQGRSREEVYCCENGQTIGRDRALVRSCGLYFEPQRLALQPEAWRG

SEQ ID NO: 26653 - protein, 420 aa, Pseudomonas aeruginosa
WQARQAPAWLLDLERLQPQTRVPVKELLEQLQQLQAQGEARRVLLDVALQAGDGHAVASLGGRLRVKTWSWLDDHDPQARQGGFAGWLVDGTPLWLGGPGTSKMILDRYAEVLGRFLPSPWPADPGRCVEVNLFSRYPLRSVSDPSGHPAAEGLLHGPQQVLFANGNRLDIASAGDLFLQRVDGVPRLVARVSREEYVARVLEREASAQPKEAARALAVTIRTYLLQNAAPRGECLAIDDSSQRQRVAPRPASAPTRRIAAWSADLVLAGATVNYHSDQPGPARLSWKHAVEQAGQGLGYDSILAQAFPRSSLSRWDNPVAACQPLPAAEDWLRKQRRQWRERLDREPGYEEIPSFSVCRLASGRPYVDRERERIFVRGLYSLQERLDLTHEYLHLAFRAHPSGQDENYIESLARRLLLE

SEQ ID NO: 26654 - protein, 410 aa, Pseudomonas aeruginosa
TAQCSSASRISSTVQPLFSAPRTCPLSSCGHFRAVRAARVIRLRVLRGSASRAQTEPQACSLTKSCNGWVKAVALPMARSTKASPMTSRRISRPVLPCSLIGRFLSWVEGGSIQRLYPNRRHAAADHTQAFGGLARYIDDPPAAERPAIVDPHHHAAAVVEVGYPHAGTERQRAVGSGHCVGVVALAASGTQACVAAAIVGGFAGIRGTAAGEAGAAGEEQGQDGEGEARGGGWGGHGQQAPGGQEDAGRTRRLALTHASSFFFSNSFTCCGLALPFEAFIAWPTKKPNILPRLASSAARYCSTCSALAASTSSSIFSMAPLSVTCFRPLASMIWSAEPSPLAMASKTILAILPEMVLSLMRRIMPPSCSADTGDCSISRPSLLSRLPSSTITQLAASLASPQMPWTFSK

SEQ ID NO: 26655 - protein, 605 aa, Pseudomonas aeruginosa
FLRANTFCRSIRASIARPNRQAMRTASSLSTGRVPGMARSTRLAWVFGAAPKAVELPEKIFDWVASCAWISSPITVSHCMWCSSILLCLRSPAADPAGRPLRAGRGEGTAWRCHGLEAGRGAGVPVADLLVLVRDVEQAAFLEVGREQLDTHRQAVDEAGGHGQPRQAGEVGGDGVDVFQVLGNRVVVLLADLPGRVRRGRAEDHVHFGKGADEVVLDQPANLLSLQVIGIVVAGRECVGADHDAVLHFAAEAFRARALVQVFQVLRGVATIAIAHAVEARQVGGRLGRRDHVVGWDGVLHVRQGNVLHRGAERLQLLDYGQHRVGDAAVEAGAEVFPRQADAQAAQRLLQGGQVVVHRLFDAGRVLRIESGHHPQHQRAVLGGARQRAALVEAGSVGDHAPAGNPAVGWLDPGEVGQRRRLADRAAGIGAGGGRQQARGDCRGGTAGGAARHAVEAPGVLHRAVVAGLVRRAHGEFIHVQLAEGNGAGGGELLDHGGVVGRDEVVEHLRTAAGAYALGAEQVLVGDRRAEQGAVLAVGAPFVGCLGLGDGQVVGDADETVELGIQLPDATEQGAGQLFGGKLLVGEGAGDLGEGQLMQHVSASL

SEQ ID NO: 26656 - protein, 222 aa, Pseudomonas aeruginosa
ERIIKPLFSKGPSLGVRLLVLAVLSVSLMVVDARFDYLEPVRSKLGMVLTPFYGLAEMPVRAWEGVRDQFSSRSELIAENERLKAESLLMQRRVQKLAALTEQNVRLRELLNSAALVDDKVLVSELIGVDPNPFTQRIMIDKGENDGVFVGQPVLDASGLMGQVVEVMPYTARVLVLTDTTHSIPVQVNRNGLRAIAVGTGNPERLELRYVADTAEISRVFT

SEQ ID NO: 26657 - protein, 317 aa, Pseudomonas aeruginosa
CPQRAVGGRRRPGQPPGAAGRAGSRLGSGALGQRAAAAVPGRLCAGPARDDASRPATGMSPGVGRRPGAHAVTGVGLGRCGTAWVLLVALVADASASLSVIGTRFIYPAGVSALTIRVGNVGTRPALVQAWLDRGDETADPSAVTVPFILSPPLLRMDPQETQALQIRHTGEPLPDDRESLFWVNLLEVPGREDGSGNLLLVSYRLRMKLLFRPQGLAGDPRAAARQVVWRLRPAVRPGQRVLLEADNRSPYHVSLVRLELGEGDLAMSLGSVTLPPFAVTPLSLPAVPGEAARVHFDAVGDDGQIERGDAPAERYP

SEQ ID NO: 26658 - protein, 1034 aa, Pseudomonas aeruginosa
HGPANRSRGFTGGRKHMNKCYALVWNVSQGCWNVVSEGSRRRGKPAGAKAAIASVLALLGATALAPAYALPSGGTVVGGSANGEIHLSGGNSLSVNQKVDKLIANWDSFSVAAGERVIFNQPSSSSIALNRVIGTKASDIQGRIDANGQVFLVNPNGVLFGRGAQVNVGGLVASTLDITDAEFNGNSSRYRFTGPSTNGVLNQGGAITAAEGGSIALLGAQVDNRGTVLAQMGGVGLGAGSDLTLNFDGNKLLDIRVDAGVANALASNGGLLKADGGRVLMAAMTANALLYTVVNTQGAIEARSLRGKNGRIVLDGGPDGKVMVGGALSANALNGPGHGGTVEVRGQAVEVALGTQVNTLASNGLNGTWKIAADKIDVRPSAVSDGVTVHADTLSRNLASTNIELVSTKGDLDLDGSVSWASGNRLGLGSAADLTLNGRLNASGAKAGLELKAEGAIDINDKIVLGGAGSALAMDAGEGHRVNGTASVSLAGANATYVSGGYYYTVVQNLAQLQAINKNLDGLYVLGGNILGGSYYCTALQSIGGPAGVFSGTLDGLGNSIGNLSISNTGPNVGLFARSSGTLSNLKLNNLRVSDNTYGSGPSSLGALVGINSGRIANVSASGVSVVGSRLRSNALGGLVGRNINGQITNASVSGGVTAYAASTAVGGLVGENFTTAWGPEAVIENAHSNVHVAAQSTERNSLGGVGGLVGLNAKATIRASGSQGKVETYRPGLNVGGLVGYNMFGHVSDSSASGQVEAGGAGNTGGLVGLSSGGEIFRSQASGSVYSKGGLATGGLIGKAEGNGMLGNLKASGSVTDQGGADLGGLVGNNSQSAIETAEATGKVSGGSNSRVGGLIGHNLGGSVAHAISRGDVSGGFNSLVGGLVGHNGGELVNVDASGRVSAAASASVGGLVGSNAGSILSARSSSTVNGSGRSRIGGLVGENQIQGRIVSSMSEGTVSGDYYVSMGGLAGVNLGSIEYSGVSGKIDFKPQSHYGQIYGAQVGENHGVLGGNYVIGEAALLPPAGIDYGNIW

SEQ ID NO: 26659 - protein, 414 aa, Pseudomonas aeruginosa
GRQGRSLADLPSRPGPLSPGVWPSSAGAILESSMSMRLFPGRVSLRRRPGAQARQALVLGLCCLTGGQAWALNEVALNCSFDNGKGLPWRVVNELTSGTAKGTVLFARPVSLFLNYKPQASQEAHELVIGGNWSGVGYPGPYGTVASDVKGIGYRISVDAQDGVKRVIPVDNQPHALDKRVTSFSGSTTSDYLQELVLTVDPGELPAGDLKVTSVSGSATLNLWAVDRLKGEASIGSVLAVPADNYPTGVCRKPYSLIGPASIGIGGGPPPPPIPKKCKVEVGREINVKLGSVALKNFPRVNDTSTERSFDISLSECAALAKPEIAFRDKYVSAQQADPTILSLKSGGAAGFGIVVKNGLDQQRIRFDGTPYPMRRVGDSADLPLSAAYIRIGAEGELKAGVADGAAEFTFTFP

SEQ ID NO: 26660 - protein, 163 aa, Pseudomonas aeruginosa
RRHAAAGRSPVPSASGLAGARRWPLAWRMPAPPAPSGHAGRAIVAAPGRRRPLGGRRAVTTGPPPDADAHAPAPRPRRRSRGVAGSPGTARCPPRAGGRCPGAAAPPAKRWPGSGAAAADRSRGSGAGSRGACRPASAGAGNRVRGSPRRCDRTRTGWPVPPG

SEQ ID NO: 26661 - protein, 216 aa, Pseudomonas aeruginosa
VRAGAFRRRHAAVRPGDRRRAGSRGPRRRRRRRPGSRCRAARVRRQLGRPAPGRSRAPAAATGGTGRGAWRATGAVGNPEQRQVDQPVAGPGGRRLGGVHPLHGRLGDQDRGSQPRPVDRRGPRRALPGLHGAGAGGRGRSHRAVEFPLADGDLEDRPGPGLRLHRSPQTGRRNPADRPAPRPVVPGGGDSTRGGEHRHRHGRRGRRGTGGAPGHR

SEQ ID NO: 26662 - protein, 174 aa, Pseudomonas aeruginosa
  UNSURE (12): Identity of amino acid at the above locations are unknown.
GRQRGLRRGAPXRDGVLRAADDPCRRHPGDAGGARGNLRAGAGGDALRRSRRSGAPGQRQHLRARCEHLVQRPAPGHGPGTQDQGRHGMGERPQPARPVDAVRRLQAVRHRTRDGPCGDRGVHREQVGVHRLLISMNRGEPIRSALSLPSAAAFCSTRLACRRSVRDAGASRRA

SEQ ID NO: 26663 - protein, 510 aa, Pseudomonas aeruginosa
RKNNNSNAAVEDTSMSNSRLTQHLLRGRVGFPTALASSVGLIMASPVILTATTGFGLGGGTFAVAMLVALLLMLAQSTTFAEAACLLPTRGSVYDYLSCGLGRFFAITGTLSAYLIVHVFAGTAETMLSGTMALVNFESLNTLTEPGGGAWLVGVGMVLCFGLLNALGITAFGRAEVILTFGMWSTLMIFAVAGLLRLPAVELQGWFGASMVGDDLPTLLSLVGMAMFMFVGCEFVTPMAPEVRHASRTLPRAMALGLIGVACCMFIYGAAMRRQVENFDFGGGLHLLETPMAIPRFAEQVMGPFGRIWLGVGLLFAGAATINTLMAGLPRILYGMALDGALPKAFTYLHPRFKTPLLCIAVAAAIPCLHAWWLGGDSEGIIHLVLAAVCAWGTAYLLVTLSVVLLRIRRPDLPRAYRSPLFPLPQLFSSAGILLGMFYITPPGMNPADIYLPFALMLGLAAAYALFWTLCVQRVNPFRPLAVEEVLEKEFAEEDQQQRERAHVRLGALV

SEQ ID NO: 26664 - protein, 207 aa, Pseudomonas aeruginosa
ASLARLAASRLSPRSHPGPGAAQPGCVRRRGAGRQAVAAYERAEPRGSRAGPGAPVHAYRQHRVQPVRGGARGAAGQPGAASRRLLAASRHPLQGTQRERARAVAGGLAGGRPGLAGAAHAAGLPEFAPLPRRQGLDREPGTPGGVRGGQPLPRLSPLHPSGRRAAPGPAGRLRPIAAPAFSRLNGPCRLSRMRIRRSICASLWVYR

SEQ ID NO: 26665 - protein, 285 aa, Pseudomonas aeruginosa
TGRCSLAISRGRTSAVWSWRRSAPTQGASPARPPMPIMTTTATASWSSSAAAMRNCARVGTAYNLAPGEMALMDSAGGCEIIPHGLIEHTSFHLSREEVCRHLPPSQRAFGKLSPNCASGRLLSLLVQQVCAGELQPWAVADEGGALQEALIALLGPALQHAGEELEGPLAGLYGYSLRRHAERLIEQSLQEPRLSPDMLAGRLRISVRQLYRLFEEQGDSVCRYILRQRLSRSAADLGNPRLRGESITSIAFKWGFSDSAHFSRAFKKQFEVSPKDYRAGALPA

SEQ ID NO: 26666 - protein, 287 aa, Pseudomonas aeruginosa
CPWTGADPPRGGGRHRFPRAQTTRAGLGCRQPHHPAGRNAPRRGDQPRLLPRLVPGRAGRGGAPGRPGARRRAPRGALPALRDPAGPAVQLPGLRRRPRHRLQREGRDPSAGPAWPGALAHGAERARGLPATCADPLRLAAGRKPERLAGTFPQPRRATAAAVPRRRPARQPDAGGRRRAGGALGAQAARLPGAAVGHLPLRRTGSDHHPGAGTGDPQRGAYLSLQPDPGAFGGGPCRAPGRARRAAARGDGLQEDPPHLRHQAARLARRFAGSIGQVLQACLNAPS

SEQ ID NO: 26667 - protein, 415 aa, Pseudomonas aeruginosa
WPSCRSSTKSPTSVSPRSTGASRTSTNSARRSNASPASRPRNERRRPAVHGPRPGTGAPGAVLHPSESARRLRAGQGRPGGRRGLARPRRRAARRGPCPAPGRRECTRRHRLRDPRALQPLRPHPAVRRCAGGRRGGAGGRGDAGSQPRGRRSRPAASDAGRHRGAERRPRSRGAGTQHRFHQAHGTWPAVRPGQVGDEPGRAHRHGQRGKPVDHRALRAFGGAALARSLQRGVVRRRYAAGGRCAAQRTPRRTGPERRAYRARRGSPAVAGAGRRAPCGCRWSRRSTTPGPALVATCAAASARERFQDAGHELLALPSAEGHVDLHKLLLELAARGANEVLVEAGPRLAGAFARLGLVDEYRLFVAPKFLGSSARPLLDWPLARMADAAQLRIDDIRAVGDDWLVTARPHPRDA

SEQ ID NO: 26668 - protein, 496 aa, Pseudomonas aeruginosa
RENGIACLGVPCAPARSPSIQKALFFTKQEFVICLHLGIPALWHAGRSASRRPCCAPVRRKNGRSHVHRHNRVDRQRPRNDAQGRRPAGLHRHRQARPGRRQARRQHRGQRRLPDRGGTARRWLLGRRQPREPGAHRLPAPEGGQPGEPGKGPDADHPPRRTPGERPRRRRRRGAQARGERPRHPVHRAGPARTGQVHRAQGLDHRRRHQPHGERGERRGVRADHRPAYAQRNHHGRVPARTPGQPRGRPAGPLPGAPAAWRQGRRAQRLRHQRSVSRRERFSQVTHELHKGVPMALNTIDELIEDIRQGKMVILMDDEDRENEGDLIMAAECVRTEDINFMVKHARGLVCMPMTRERCERLGLPLMVQRNGSGFGTKFTVSIEAAEGVTTGISAADRARTVQAAAAKNAVAAESVQPRPHLPADGPAGRYPGSRRAHRGGLRPGADGRVRAVRGDLRGDERRRQHGSPARTGGVRRRARDQDRHHRRPDPLPADP

SEQ ID NO: 26669 - protein, 270 aa, Pseudomonas aeruginosa
KRDHHHPRPGCLRDPAGDPEGRPARRLRRHHRPRRGDPWRHPALRIRGWRVHQGPGPGVPAVRHPGRLRRPHRRLHRAGHRALRHQGRQQGRRSRVVGPGNGQPAGAVGGQVSNQDSGNPAAKPPKGKTAARRKARSLAVQALYSWQIAGQPLHEIEAQFRTDNDFSEVDGAYFHEILHGVPRQKSELDSTFEPCLDRPLAEIDPVELAILRLSTYELRNRIDVPYKVVINEGIELAKTFGATDGHKFVNGVLDKLAPRLRAAELRGGKR

SEQ ID NO: 26670 - protein, 328 aa, Pseudomonas aeruginosa
SRAGGVMGEFELIRRFFAAAACAAPAADVALGIGDDCALLAPPAGEQLAVSTDTLVEGVHFPAGCAPFLLAQRALAVSASDLAAMGAAPLAFTLALTLPQADAEWLQGFARGLDAMARQCGLALVGGDTTRGPLSMTLTVFGRVPAGQALTRAGARPGDLLCVGGPLGEAGAALELVLERRSAPAEVAEPLLARYWTPAPQFGLGLALRGKASAALDISDGLLADCGHIARASGVALLVECQRLQASAALSGLLAGEEALRQQLAAGDDYVLVFTLPPEYLGEIRAAWPATAAIGRVEAGQGVHLLDADGKELIPAAAGYQHFGTQRD

SEQ ID NO: 26671 - protein, 417 aa, Pseudomonas aeruginosa
SGAGAAGAAVGLAQSLAFPRLRLRLRHPAQGAGHLGVAGGHPVHPAVADAAGLGLLADAGSDHAVRLLAVRQGRRRPARARPRRHRLGRDGRHVDNPLAGAGGLVVAADRLRRVPHRGYSQALADQLGGPQRARRRRDHARRRPGRGIRLAGHAGSSLGMGTLAGLRPPMRLLVLFCCLWLLPGVASAAPAVGEIRVVSETWTRYTQEDGRGVAWDLLRAVYEPAGVRLRIANEPYTRAVGLVLRGEADAWVGAYRGEIDEALYPRWPYDVDPIAVLSLKDNPPPPLEGLSRFRLSWMRGYAFARYFPTLTPHSELQRRTSALPMLLNHRVDYFIDSRPELEEMLAGAGALAAEYRITDVTRLPLYLGFSDSPRGRELLALFDRRMRQLHASGELERIFARWNWPYAPLKAILPPKE

SEQ ID NO: 26672 - protein, 232 aa, Pseudomonas aeruginosa
VFAAFRADRAPDAAGTMADFRFPRSSPVSVVFVAASKLPTPFGEFTMHGFLDEESGKEHVALSMGDIADGAPVLGRLHSECLTGDALFSLRCDCGFQLEGALAAIAEEGRGVLLYLRQEGRGIGLLNKIRAYELQDGGADTVEANLQLGFGADQRDYAMCQPMLAHLGVSSLRLMTNNPRKVKALESYAITVAERVPLQKGLNKHNRRYLATKAGKLGHMLGSLHQGEAETT

SEQ ID NO: 26673 - protein, 361 aa, Pseudomonas aeruginosa
SCSGSPAWCCSGSTVFRVNSVDALVLAARLPAPQPFRRGGAAGGQPGAFADRQRPRTRRSAPPGRRAGWRRASGGDWRPAFRRPLRPGQSRTPAGTAARPDPGLARQRARGAVAAPAGLRHRPLHRRTAQPRRTGPATGCAGRGIGRGRGRPAVVGQVPRRHAAPGRALPAGQAAESVLPGLGPAAVHHWRTPGDQRCAARLRRREPIRRPAAAGAAGQRRGGSGARSGGHRRRQSRPARTLAAMAGAGGDAARTAVPDRRQEPRAAELRHAGGDRETLPLARRGALNACRYRALYRRITPVALFALRQLGGRANNRNAVIRRCRWVWRYCRSRRWRTAFSMPAASRPHSASISLGLACST

SEQ ID NO: 26674 - protein, 114 aa, Pseudomonas aeruginosa
SGRPSCSSGTSRPSLARNSPTAEPAPPITAFSSMVTSSSWLPANSRTRASSRGLTKRMSTTVASRLSATFIASANCTPKTSSATLPPRRRTTPLPISTGCRSGSIGWLGPLPRG

SEQ ID NO: 26675 - protein, 131 aa, Pseudomonas aeruginosa
RSRAASEAGSARPLARAPRRTLASISAPVLCRCMTSRAAWSRATPTEPRSIAWPPTMPAEPAARARRVSISRQTACSCGLRRVSASTSKASACKPSAARIAVASSKARWVVGWPRRRSSSSIAGRSSWTSE

SEQ ID NO: 26676 - protein, 295 aa, Pseudomonas aeruginosa
CATRSPAATANAASRWAPWTWRCGMPRPRPPACRCIASWRDAWGWRKTIRSAYRSTPAAATPIRTTTWDAWKRNCGASSISATPTPRSRSARPGLDQDRRRIDRALRVLGDASRLAVDAMNRYDAEGAVDAAKALAPLGLWWFEDICDPHDFPTQAEVADIYPGPIGAGEALFSLAEARLLDLYGGLRRERDVLVFDPVHCYGLPGYLAILDHLCARGWPRAAFRPHAGYLFSLHLVAALRLGWAEATPSAFRPFDDFAGALPFSSGLAGLPQSPGIGFERQATLAGLFRKLLEA

SEQ ID NO: 26677 - protein, 275 aa, Pseudomonas aeruginosa
VSPPLLAGWVATTTAHLGQPGVAGGVVGPRLTGTLRVVGVVVPRGVQQESGADPVQVLQRLVVLGDGAQIGLPHEQPRTGRSVAVPGKVSDFLCQQRVVHARIVHFHSHLPQIRAARNGRDRAGGEALGQGVHHRPPERHLRTLAGQAAEGGRPAGVCRRRQVVLALLGAGLVELDGVEAHVDDRDSRQGDHDVSDVDMRLDAGQRQHAFVALVGAFPANFQPLTHHNGHEGHREQPCIRDHVPDPVVDDPTEEGEVILQVVIGHEGHAAPPVRK

SEQ ID NO: 26678 - protein, 222 aa, Pseudomonas aeruginosa
VGKHRAVEAQGRGQLLPFPGRGIALFQLARRPVAVLGGCAHGKVDVELADSRGDVAGALGDDGCRLVVVGLVQESAARIEVPPHVAGEDSPHLAQPWDQRFGVHLLGNSMPPANGVQCAEEVRHQREGGTRANVPRGAGEPAERGPARMADHIRFLEAADAVLGLVVGGRVIAGLGEWIRCTQRRHLGPGVAPCIRVAGDDCVRHVVADLDRRLHFAAMRAA

SEQ ID NO: 26679 - protein, 282 aa, Pseudomonas aeruginosa
DCMTVRLVGTAVGCINYKGQFAALIYNLKFSDGSSLSVSMGEMVCAQLASLFQGYLVEVGGVSESPEAEREFKRNEGVMPRSMLENPSLDTVVSHVVSRMLDGGLVLSLIFKNTGDLKTVVIRREDVPSFIGYTFNALQGVGVLERVMRESAEIMTKPSIMVYDCKFNSGDIDYNDRRGYNIDEYRLLPYLYGVVIVDNSGAGRKVVAGFFLKSALTSNDPKLREHLADAAKQIVGSDYFVSKELSLLHTNVFVSDGEPLSIEEMQNFLAKLYLEHSVGGVA

SEQ ID NO: 26680 - protein, 485 aa, Pseudomonas aeruginosa
AAVCLGDDPEPGFAAGIDVVGRQQPIAELQGSLVGVPVFLVQRPPISRQMAVQQRRWVELTGFHQVAHGSGHYDLARAEQQRFGGRLRLGLFSLFRGRSRRADGQHAALIDRGGCHFPCPDDRDETVCEDPHLGDVAVFVFGEFGLAGLVLVGVTLHDQDPARLRAHDAGNRAGGQGQGQVPARQLADWWAGLQPRLREVQVEVRPETSQPLDLAGELLRLQGYSIEVLQLAGGRQNHIGFPRPSRWNFLGLFLARADRLQARPHLIGVRPGQVLSTDPDAEDHHLFEGRIRGCVHAQAGEVVAQPTGQLIVQDVVRNNQDHDAAVLQQRQAALVERFLQTPAAAALVLRRTGVVRHQVAIRRVEPEQSERLPADHGVEKVTVQHSLKQASSMVGALAVVLDSEGLDLVAAEDVCCLSQGNPLTGAGITDPHPARRGGSEGLQSAFEGDLIGREVAVACKVARQAREHEGHGASLSLRGMAQACA

SEQ ID NO: 26681 - protein, 100 aa, Pseudomonas aeruginosa
SMVEVKQTATFMAWESKLKDRRAKAVIAARIFRLANGLPGDVSPVGQGVSELRIHYGPGYRVYFQQRGTEIVILLCGGDKSSQARDIEMAKRLANEWRPQ

SEQ ID NO: 26682 - protein, 234 aa, Pseudomonas aeruginosa
MPTTRQVEEAPSQGNAMNDLAVLPTPSKVFRSLLTATGYRPCLEGKGFGRDLDHLALEERSGSNFDLLENCQAQWLRTIRDDAGADWSNLAESAWNRHSNLLRSLARKADTTGMIQDRARPAIFRMLVIPEISGFVRRVHQELPLLDIRQWWDSPFATWLIAAQQQSSLSAQKLLERLANHVDLDERTLERWQQGNAIGKSLWPYRDTVTPRAACTTTRRGLPEIQAAPRAHAP

SEQ ID NO: 26683 - protein, 271 aa, Pseudomonas aeruginosa
SSPPCSIRWTRTRCTRPGRSSCPGIRWPATASACSAAPRARKTVVPFTTPNACTSEEVAVMSLTESSLHPETAAFRHVIPAGEPYLFEVKAGQTLRLLDLEGNQAVDTLFFSAKNPRERYDPQRTLRRQNRVYLTTGTVLYSNLGNPLLTITADTCGRHDTLGGACAQESNVVRYALDKRYMHSCRDNFLRASLNDGRLTKRDIGANINFFMNVPVTPEGGLTFADGISAPGKYVELKAEQDVIVLISNCPQLNNPCNGWNPTPAEVLVWN

SEQ ID NO: 26684 - protein, 127 aa, Pseudomonas aeruginosa
TAWPSTPRPTPPACICSRPTRPTAWAKARPRRPIWTWRRFSASPVKPARKPSTPATDSSPRTRRLPKPARPPGSPSSARRRNSCGCLASSTPPAPWPNNAAYRCWRAPSCSTASPMPSAQPSRSATR

SEQ ID NO: 26685 - protein, 96 aa, Pseudomonas aeruginosa
RSRTPSCACPTTRTFLPPRPTASTPSAASSAAPSTPSASAGSNRARRTSRARKSPQTSARTPRSAPASSASRATSPATSGRCRWPRARGSMPATCW

SEQ ID NO: 26686 - protein, 167 aa, Pseudomonas aeruginosa
FAAGAWGSTWWSHAAWLWSRATRTCSCWPAATRCWSTTRRWTPCSRPARHATLASSLAGRSTPASWPVAITMSTTRSHHRSPSAGSSSRPLPSTAASICGPPPCISAWPTRWSPRSSRARPIPSVPGSTWKTSTPRCPGSSGRPSSKTACCARMRRCRSDPCQAVTG

SEQ ID NO: 26687 - protein, 364 aa, Pseudomonas aeruginosa
RRGDPGKALSRNQRGGLGKGTGRRPRRRLPLLPPCTGTDAAAAQRRHRQCRLGPRISRPRTVRRLLHGQGRGDRPDPLTGPRVRCRRHPHQWRRTRPHRHGDGQPGAHERRVDGQGAGDPHGAPGHAGGSRGGHRLPAFAAGELFHRTAARAQRRLLDGRMNSLMPQGMLIGGAIMWGLGWLPLQFFAARGLAGMPLVLLTYSLLSLLALLVLWQQRRQWASQYRQVLTMGLCGGWATAALVTALAEGNVVRVMLLFYLAPVWAMVGGWLLLGERLSGTRLFALGLAMLGIGLTLGVTSEALDAPGANDWLALSAGLAFSLNNLATRAADRVPLASKALVSFIGQRAASGGLFCLLLPPTHFRP

SEQ ID NO: 26688 - protein, 370 aa, Pseudomonas aeruginosa
VPSPRCAPPGAGARPLREPVVRRRGHPAGAARPRAGRRAGGNAPGALGFLPRADPDRHLPGRLPRFRAGACRGDRDLADAAFPSATGRAGEDSRRRPGRLSALRHVPHPYRMGAALRGAVLGQRLQRGERPAAGPRHRRRHRRRGVQGVCAVSLTTHPLLLEHTALLVIDMQRDFCALGGYADQAGMDVSRLRAPIAAIQALLDCARGVGMLVVHTREGHRPDLSDLPEPKRRRAQATGAAIGSPGPLGRLLVRGEFGHDLIDELQPRAGEPVIDKPGYSAFAHTDLELILRRRGIERLILTGVTTEVCVASTLRQAIDLGFDCLTVRDACASADPQLHAAALAMIEVEGGLFGSVIDSHRLLSQLEGSP

SEQ ID NO: 26689 - protein, 379 aa, Pseudomonas aeruginosa
TAGRRRARVVAAAAGLRAVLRPPPQRRHALADHPFDAARPRRRRSAVELLELRRPRQSARRGPRRAGPLSGGRRLATRRTGCAHRYREGPRMTAQISIPSAQQRHTTAPAVQAEPVVRKGSFWRIRGELSRRNAWLLTGAGLSLPFVVWWLWTALGLADPMFMPSPGAVLERIGRWWTSEGLLGDIGISVWRVMAGFGASALIALPLGLYIGTYRPVQAFLEPLTDFIRYMPAVAFIPLVMLWVGIDEGSKVLIIFIGTFFQMVLMVAEDVRRVPMAQIEAAQTMGANRSEIVKLVILPSAKPALLDTLRITCGWAWTYLVVAELVAANSGLGYAILKAQRYMHTDKIFAGILLIGLIGLITDQAFRWLHRRAFPWMRK

SEQ ID NO: 26690 - protein, 531 aa, Pseudomonas aeruginosa
QSRALRRRSPFSRRISPSAKNFFSLFISIICVTPTVARRAPGGTSVGPFLYTLACILDEGIVPAAPAAIHDSKERKPMTSFPLSSVEELKQQLQDKGVKYAMASYVDIHGVIKGKFVPIAHLGQMLRGSELYTGAALDGVPQEISDNEVAAMPDPATATQCSWNRDLAWFASDLYLDGKPFDACSRGILKRQTEAAAALGYTFNLGIETEFFLFKDTPDGGFAPISERDDMAKPCYDPRLLMDNLPIVDELVQAMNEMGWGVYSFDHEDANGQFETDFKYTDALGMADRFVFFRMMANEIARKHGAFATFMPKPSANRTGSGAHYNMSLADIETGKNLFEVDGEDPYGCGVTPLAYHFIAGVLKHAKAICAVIAPTVNSYKRLIRKGAMSGSTWAPVFCCYGNNNRTNMLRIPSQGARVECRAADIGCNPYLGAAMILAAGLEGIRDKLDPGQPHRENMYHYSEREVAQMGIETLPRTLSEAIDAFEADPLSRQVFGDAMYQAFVEFKRDEWNAYHTHVSDWEIQRYLKFF

SEQ ID NO: 26691 - protein, 360 aa, Pseudomonas aeruginosa
TGSTAMHGTMMKKLLCAGAIALAALAPLAQAEEKKTFNLAWTIYVGWMPWKYVDESGIMKKWADKYGIEVNISQINDYVESINQYSAGQFDGVVATSMDALSIPAAGGVDTTALIVGSYSNGNDGLVMKGTSDLKQIKGQQVHLVELSVSHYILAKALDSVGLSEKDVQVVNTSDADIVAAFSTADVRNVATWSPLLQEVAATPDAHQVFDSASVPGHVKDLLIVNSETLADNPAFGKAVTGAWYEVMAIMASDTPQGAELRAQLGAASGTDQAGYEAQLKGTHMFYQPAEAVAFISGEPAHEAMDSVRKFSFDHGLLGDGADSADFVGIAMPAGALGDQGNLKLRFDTTYMKMAADGAL

SEQ ID NO: 26692 - protein, 156 aa, Pseudomonas aeruginosa
ACSAERAEARRHRHRWRRSSQRFQRATARCGTAGRSAAGIRQWPHRATSRAPWLASPPKVAVQVALACGTTPDDCGIHIAGTTDLGRKADHDLLTLPSPYLLETAVLQSSIRWETQRGCPSKCSFCQHREPGIRLKHQWFDGHRLIPAFVSAYLMS

SEQ ID NO: 26693 - protein, 70 aa, Pseudomonas aeruginosa
PGEKVDDRNPFVRDLPKNTAHIEVQVAWHGGGLRSFTDKQGKRARKEMADALAVVVGRRVRPDSLLAIHQ

SEQ ID NO: 26694 - protein, 78 aa, Pseudomonas aeruginosa
TGHAVETTIQVSVRLDSFHFTEVRNLTDGGHEWKLEKLPENDTGNTCCLLFFRSIRGAANTTYSPRGLSKSGWPFLVG

SEQ ID NO: 26695 - protein, 615 aa, Pseudomonas aeruginosa
PPPAPKSVPGEVVPVEPPNSPPARRSVPGEVVPVAPPSSSTAPRPGPGGVLPVATPSSPPALGSVPGGVIPVEPPNSPPAPKSVPGGVVPVEPPNSPPAPKSVPSGVVPVEPPNSPPARRSVPGEVVPVAPPSSSTAPRPGPGGVLPVATPSSPPALGSVPGGVIPVEPPNSPPAPKSVPGGVVPVEPPNSPPAPKSVPSGVVPVEPPNSPPARRSVPGEVVPVAPPSSSTAPRPGPGGVLPVATPNSSTAPRSILGRVLPVATPNSPPAPKSVPGGVVPVEPPNSPPAPKSVPSGVVPVEPPNSPPAPKSVPGEVVPVAPPNSSTAPRSILGRVLPVATPSSPPALGSVPGGVIPVESPNSSTAPRSILGRVLPVATPSSPPALGSVPGGVIPVEPPNSPPAPKSVPSGVVPVEPPNSPPAPKSVPGEVVPVAPPNSSTAPRSILGRVLPVATPSSPPALGSVPGGVIPVESPNSSTAPRSILGRVLPVATPSSPPALGSVPGGVIPVESPNSSTAPRLDPGEVVPVAPPSSSTAPSSILGRVLPVATPSSPPVPRSGPGRVMRGRITKKHDARPRLSHGSSPRSDGTLDPCLGRMRSLSRLRTSFPVRVSPFG

SEQ ID NO: 26696 - protein, 187 aa, Pseudomonas aeruginosa
GCRTGSAEGVTVAARREPDTSGGKVGVAKQTHPDHRRSGMKNEYRFGYDEMLIQIQACVPDSQKGDGLPMTMARAQWISQVFVLCTLGNSLARDKGWRLWGMDAIEYALMRRYSWPLETIREMPIRDRWLALHEELADLQWDEEAQQVWLAKIEPVLPGAPGTDYDVWRSDAPGFQLPQAPGYLVVR

SEQ ID NO: 26697 - protein, 227 aa, Pseudomonas aeruginosa
RGSCKSSLPSWCKVGEAGLVGDEGGADGADRAVAVLADDDFGNALGLGVGVVDLVAVHEHDHVRVLLDCAALTQVCVVRSLVRPVLQAAIELGQGHDGAIHFLGQCFQRAGDFRDLGGSVFQAWAAHQLQVVDQDQYGVAVLPGCTANLGAQLCRRQVALVVDDQSAAIVVYALDRDGQPGPILFLQLALHQLAKVQVAEQGSKPEQQLLCWHFHAVNLDRLLLVAL

SEQ ID NO: 26698 - protein, 379 aa, Pseudomonas aeruginosa
NSVSVYGPSQAEHQRRVSFGSFSRRSPMTGTKPKTPVARYFHQEAQRRGYVLDAAQGNAILHLDRLAERLRRGPSLFRQAPRSLYLWGPVGRGKSWLMDGFFRSADLQGLRRTHFHAFFRRLHDGMFRRQGRPDALGGALDELLGDCRLLCFDEFHVHDIGDAMLITRLFRELFRRKITLVCTSNYAPRQLLPNPLYHERFLPAIRLIETRMEVLEVAGARDYRTISPRQEIASGYASGGYCWPASCACLDELGLSAPEPSQRVTLQSGARTLQARAVCGDLVWFAFADLCEAPTAVMDYLALGERFSTWVLEGVPPMARCSVAAQQRFINLVDVLYDNDRRFFLSAEKALPDLVEGSDLPADMQRTASRLAQLRQLRC

SEQ ID NO: 26699 - protein, 196 aa, Pseudomonas aeruginosa
RFHQQRGLLVRGLGAWRHVARLLSRLRRLGTGGAVAEGEDVIVAGGLQGRADHQLVDTVAFQAVEFLEEGRSPDARRPDLERRRDELAVAGPEAVRIYLAHRGAGHHPYAELAQGLVYRLTDTLGQRRQHPRAGFDQADVQVFRADPVEPIGGQHLRGVVQFRSQFDAGGAGADDGDTHCVVVRVVPGMRTQVLAE

SEQ ID NO: 26700 - protein, 154 aa, Pseudomonas aeruginosa
LSVEAFGLGAGIEENAMFRSALGAEVVGGAADSDHQGVVGDVALGNQFNAILVRQCGQADPLAGAIQALHAAELEFEVVPLRLGDVVQLVLGGVERAGSDFVQQGFPDVGEVGVDQGDLGLAAFTQGAAETGGELQPAGAAADDHDAMGHVDIS

SEQ ID NO: 26701 - protein, 437 aa, Pseudomonas aeruginosa
PGAAGAGGRLSVPGRAVPPPPPVPGSARGCRSARRSTSPALRSQAYPGVEQDAAAEVGAQEFGGAGVSEEHPGKGRTDHRQRAPALAQVFGGRREGRIEIGHRALQVDEGQQVQFAVVDAALAIVVRLLAQGWRQPCLQLGGGDPLWPLFAADQLAQADGLAATGQFLAPLLVQPATFIEDEEHLEAGTLEHDVRRLFPGGGEVLLAIGHVEGFEEALADPALAVPFTCVGEEVVGLFGLTGEQAQIIRFVHGLSLVCRRARFPARRRSGCDNPSRSAPAARLGVHCRSPWAGAVPMQLRSVIAADHPALFALWSRTPGIRLRAEDAYPFFLAYLQRNPGLSLLVETEGEVIACLMAGHDGRRGYLQHLVVDPGYRGLGLARRMLDEVLARLAREGIGKSHVFVLDAAEEAQAFWRAQSDWERRKDIQVFSTREGHA

SEQ ID NO: 26702 - protein, 174 aa, Pseudomonas aeruginosa
VLVEDQALGLYISMEKFMKAAQKGFTLIELMIVVAIIGILAAIAIPAYQDYTARAQLSEAMTLASGLKTKVSDIFSQDGSCPANTAATAGIEKDTDINGKYVAKVTTGGTAAASGGCTIVATMKASDVATPLRGKTLTLTLGNADKGSYTWACTSNADNKYLPKTCQTATTTTP

SEQ ID NO: 26703 - protein, 315 aa, Pseudomonas aeruginosa
  UNSURE (87): Identity of amino acid at the above locations are unknown.
TTSSTTRRSSPSCWRTSLPSPATSAAAASSSSSGTRDAEEGRAKAELARQDVEQVLNQRLLGKVLPEVVVRLLRDAWSKVMLLICLXHGKASAEWREALDTMDQLIWSVGPHDDPLSRQQLLERVPGLLKALREGLASAPFDPFSTGEFFSQLETLHVQGLQRDKRGEAAVADSPLLDEASPGTAAEKPRAPVMLRVVEEIVLTSPDAAPAPVESEVRLPDNDEALLRVDALRVGSWVEIQEDAEHKLRCKLAAVIRPTGRYIFVNRTGMKVLEKTRMGLAVEFRRQAVRLLDDALLFDRALESVIGNLRRLKGA

SEQ ID NO: 26704 - protein, 205 aa, Pseudomonas aeruginosa
SSFRRRWIRVGARSGARMHFDSVTGWVRGVRHCPSPNFNLRPQGDAVSLLVIHNISLPPGQFGTGKVQAFFQNRLDPNEHPYFEEIRHLTVSAHFLIERDGAITQFVSCHDRAWHAGVSCFDGREACNDFSLGIELEGTDTEPYTDAQYTALAGLTRLLRAAFPGITPERIQGHCDIAPERKTDPGEAFDWSRYRAGLTDSKEET

SEQ ID NO: 26705 - protein, 405 aa, Pseudomonas aeruginosa
TFSFTPTNPCVLPLGVPTMSIKVEDYFAPETFQRMKAFADKQETPFVVIDKQTIADAYDQLTDCFPFARIYYAVKANPATEITELLRDKGSNFDIASIYELDKVMKTGVGPERISYGNTIKKSKDIRYFYEKGVRLFATDSEADLRNIAKAAPGAKVYVRILTEGSTTADWPLSRKFGCQTDMAMDLLILARQLGLEPYGISFHVGSQQRDISVWDAAIAKVKVIFERLKEEDGIVLKMINMGGGFPANYITKTNDLETYAEEIIRFLKEDFGDDLPEIILEPGRSLIANAGILVSEVVLVARKSRTAVERWVYADVGKFSGLIETMDESIKFPIWTEKQGEMEEVVIAGPTCDSADIMYEHYKYGLPLNLASGDRLYWLSTGAYTTSYSAVEFNGFPPLKAFYL

SEQ ID NO: 26706 - protein, 290 aa, Pseudomonas aeruginosa
LITILICNKFRDLHSSRGGVSNVASVHGYRRFFATSAGFGHRCGHHRHRRTAGSPRRRGRAEKDRQGPSTVAGCGHHRRRAAGRNHLQRRPLGVEEVHRAAAGYAEDRHRDPAAGDQGHWRPDPGRRTAHHPGYHLRRGRGRQPRRRPAIHPWLQRRERYVPRRYARRRLANPRGVQRRADRGQQGPGLGLHRRRLHRWQPEPDQQDRQAGQLHRRRLHLGLRPDSPHYSRREPDDWRQRRLPPQPDEARCPRRRARRSQRQPLGRGSDRYLRVRHADPRHPVLLPSQHR

SEQ ID NO: 26707 - protein, 884 aa, Pseudomonas aeruginosa
LSNRIARRRPRVVWPALGVGVVPLLPRGGREGDPVKKVWFQLHWFFGISAGLVLALMGVTGATLSFQDELMRALNPDVLVVQKRPEGVLPLDELVRRIEGAEPGRKVAFVWVEMDSDKAGRIFYTPPPGQRRGESRWIDPYTGAFVGEPRGEGFFNLMMQLHRFLAMGEYGKQVTAACTLILIFFCLSGLYLRWPRKVFDWRAWLTLDWSRKGRSFNWDLHAVAGTWCLALYLLAALTGLYWSYEWYRNGLFKLLDDAPAGQQAQRGKPGGRGERPADAAPLVVDYAAVWNSIRQAGGDRLQAYNLRLPPAGGQPATVFYRLTDAPHERAFNTLTLDPANGQVKSDQRYSDRSFGSQLLASVYALHVGSYFGMAGRILMMLASLAMPLFFITGWLLYLDRRRKKRAVRASRADLGSSAGASGEPWLIGYASQSGFAEQLAWQSAGQLQAAGLPVRVESLARLDAGQLAEARKALFVVSTFGDGEAPDSARGFERKVLGQAASLDGLSYALLALGDRQYEQFCGFARRMQGWLQGQGARSLFAPVEVDDGDAAALRQWQESLAEVTGGAAPAAWEAPAFEVWSLARRECLNPGSQGESTWLLDLRAPADSAIQWRAGDLLEIVPHQAPARIREWLQRHHLDGQVRVAVEGVEQSLEQALAGRLLPDSFEHLVGLHPQALLDALIPLSVRQYSIASLQSDGDLQLIVRQEQHADGSLGICSGWLTEYLPLGAALTLRLRRNAGFHLPEDDVPLILIGNGTGLAGLRSLLRASIAAGRKRNWLLFGERNFAHDYYCRAELEQALARGELQRLDLAFSRDQAEKIYVQDRLHEAADELRRWIDEGAALYVCGSLQGMAGGVDRVLREVLGEEALQRLADEGRYRRDVY

SEQ ID NO: 26708 - protein, 340 aa, Pseudomonas aeruginosa
RRWRHAPHGASGALRRRASDPQDESQYQGEEAPFLQVVELAVALLQTFALQADLVEAVEDPIESAGPVACVVRGGRGSHHVAAEPAVEGGGPALGQRPLDVAEENDAVVFGGVFRVVDEGFIEHHRLAVAPVVALAVHLDEAGRVVGGEQSQVEAQRAGVGIAVSHQLRARRQFGEHRRLDRGNLPQQGGGLRAELSGGGMGLVVPFQVEALPAALEERVETDIVVLFGTLDVAGVVQVQRLAADGLPVVDQNLQFGEGLRCQVRAVRYLREQVHQAVDRSEEAGVVAQLARQLVAYPAAEMDIEDAQRIGRQDENFHECKVVGAKEENLLLFSVPEYAT

SEQ ID NO: 26709 - protein, 259 aa, Pseudomonas aeruginosa
SWPRKERTMNDTGRRILLNCDMGESFGAWRMGDDVHSMPLVDQANLACGFHAGDPLTMRRAVELAVRHGVSIGAHPAYPDLSGFGRRSLACSAEEVHAMVLYQIGALDAFCRSLGAQVAYVKPHGALYNDLVGDDELLRAVLDACAAYRKGLPLMVLALADNGRELELADEADVPLLFEAFADRAYLPDGRLAPRRLGGAVHHDPQRIIEQALAIARGEAFPDYDGNPLRLTADSLCVHGDNPQSLAVLRRLRAALDSL

SEQ ID NO: 26710 - protein, 134 aa, Pseudomonas aeruginosa
GWRCCASSEGLRGGERPVALSRGIARRGGRPPGAGRAGAARAPRCGSARWRRGSACGRRNPPAGSAGSAVRPGCGSSASSGPGGSPGSPRAAHGYRDAAGSRRACPPAPSPPVGRGTSPGRRRRRGGPPPGCAR

SEQ ID NO: 26711 - protein, 158 aa, Pseudomonas aeruginosa
ASGIHGACSWNTTWACSYSFARSAGSLTSRALRISASKSLSHQRAWFSPDSAAAQLRFGLRKLSGSPLSPAQPSSDRSCSPAFERLSSSPHSRERMVSWMPALARSACSICAARAGLGMVGEVPLRMNRVILRFSAPASLSSALARSGSCGQSWIEWL

SEQ ID NO: 26712 - protein, 668 aa, Pseudomonas aeruginosa
LSPSALTSQRSASPGITSVVPGRKASRRLNTVSAEASAVTAPVYWTMSKRSGLASVQTTRFFAWAAPAAHSARARGRCRSNGWSMGSSSWAPSPGPPVVAGLQQVEGEGADQAQFVDAAVDLVLAGLVHHVGELEGAVLDRPVLHLVGRHQAQLVVLLAVLGAHLGVVAVGTVAIAVVVGAVDVPALHVPHAGAQAGDPVVAPVGLVADLRGLLVGAVVVGQHRVGQEDRRGLVHVVEVFVAVDLLVGQGQGVGAMAESEGQAPGVVVDVAGLARAGVAGVVAVEGGAQGDAVLEVADVVGHAQVVLVPDVLEMRAIEGDFQPVERLVVAAQVVQAVALDLAGAVLGGHVLVAGTGPRADLAEAAGLQAEVVQLLAGHGEAGEAGGQGTVVDIAEHWSVDQEATGLEFGIRGAQADVGDAQLGPLADRLAIAVRQGPVAAAADAALAALQGDLVEGCDVEAEADAALGVARAVLEHRALDPGVALVDALGAAAGLGNAEGEAVLHVFPRVEVAGGQGQALPLEQPAGAGLALDRFLHAGDALHLGGVAGIVRGRRGCLLVRCPAWRGRCHQGQSQRRAGHSLVSHHLIAPFIVVMAPVLPTRFAPVSPAPGRGGRIRRGERSWRNARSAVLEHGQEKQRNEVRVVPFFCTPVVSRPGWRRHQGWLATP

SEQ ID NO: 26713 - protein, 416 aa, Pseudomonas aeruginosa
ISARSRRGEQQMTVGVGGSTPAQALERLRNMMDGAQPIGLASYRARIAAAQAWMGEHGIAAAYLHAGSNLRYFSGVQWHPSERLVGALLPAEGALEYLAPAFEEGTVRDFQVVDGAIHTWEEHQDPYRLLLDRLEALGVGERSTVALCPSLPFGMFERLRQQAPGRNFVSAAPLIDQGRMRKSAEELALMQRAKDMTLEVQKAAASILREGISTTEVAEFIHQAHRKVGAPGSTFCIVLFGAASAFPHGVKHAQVLKDGDMVLIDTGCQVHGYQSDITRSYVFGTPSARQREFWGMERDAQLAAFEAARLGRPCEAVDAAARRSLEANGLGPDYRLPGLPHRTGHGIGMDVHEGPYLVRGDRTPLDVGMCFSNEPMICVPGEFGIRLEDHFYMTKEGPRWFTQPSPSIDDPFGLGG

SEQ ID NO: 26714 - protein, 423 aa, Pseudomonas aeruginosa
VTLPQSCRQRLGYTRAYSGRKHARTGFPALRQSPEPWPSAPHPYSRAGRAGRLGGFRLALRPVAAAVAGARPDPWPVRLPDSVHRAAPARAVAGDRPGVRGTTGLRPDHPQHLAVLLGRLDQPLRLLLPGTADHRRCDPALDLLHGALRPGPDRLHPAADLVPPAAPAGGSARGDADQPAPVRHVAELRPVGGLHHLLRGEDVRGAALAGAHAGRAARGKHARPAVARGGHPGGRCRARTGYAAGDHERAAQRAAPGAPAGPDPAGRPGIAPGTGQAVQAHPPATGTGGRGRPSSGDRGAKRRGMAGIGAAPLAPDASGGFLPLPVPGPRLRAAPDPADRPQPGSAEPAEQCGGRLSRRPRHPPGLGQQQYLPEYPRPRRRGAPGDRRTDRQTVLHHQGQGLRPRPVSQSGQRDPRWWNGEVV

SEQ ID NO: 26715 - protein, 287 aa, Pseudomonas aeruginosa
IARPGIDHAYLRFECRLPVGAVRTGLRAACTSRAFGGPGWSDGRLALFRPARAARCPACRLSDSAHRSRRPARPQPDRRTPARTGRHRARPAPGGQRQSSPSLYRRRRALRPPLCVRPRLQRRPGRQRRRQDPQARTVLRGQSLPTAAARARGAGLGRSEGRARPAYRHPRWPARLLGASAPEQQRRPRSGRRRRARPGDVHHGRAAARHLPDLRELLGQPQQPGLQLPGRQQRTGRDHRAGQPGVQRKQRRREARDLRRAPAHHRRPGAGQDLYLLKHPLVRMTRD

SEQ ID NO: 26716 - protein, 591 aa, Pseudomonas aeruginosa
RTMSENNTPSPANGTPAPAAARTRSALWPVLGIVAALAAGGVLAWQMGWLERLGGGRPAEEDLGQPIGAQAPADADAPRAYRDLRKPDALIESVSLSRLPKEILEVPLLRDTLTEDFVFYYENNGDRLGLTGTLRRIIYEHDLTLKDSLVEELLDQPAQVALWRGADGRLRDFVVVLKRGGLARVLEPLAHIAADDQQLRKVGELAGTSVYRLRYGNDKAMLFLSKGDRLLLLSNPRMLFDDGGESDDSPLNAPASEDLEALLDGDELFPERFGLPGRGELRQRITLNASVLAMGYQRFIPSFAGVRFEKGEQGWSSYLALNEVERQPPLDFAPVWQAMPMGASACVALPVTPGLYGVMLERLGAEQKMAQAFSEHLSGAAGLCWYASSRLHSPLLVGQLSAPASAELDDELGKLFGRVIGAKEAKVEGGSFPVEDRVDGQTRRWTRQVSSNFGAYPASQADNPESISGRAFFRIGMARHGQTLLFSLDDQLLGKALDTLDKRYPPLAEVLPKDALVPAYLAPQPLSELLQRETLDSLPQDMEPVFRNAADTYLMPRLKTLAGKGSYALGLPAGSQANAPWQWLPLEWRSL

SEQ ID NO: 26717 - protein, 776 aa, Pseudomonas aeruginosa
PGGRRPGPAAVRRRPGGRHGGTERLHADGRRILLPARRQQLRHRRGSAGPSRSARPRLPALPHGALWRGRRAPVPDRTAAGVPQAAEEPAPGPGRGTVQGRRPVEHPGLSLGQLVSQVAPGDAARLLLRVAATGHRGGARAEDGQRHDRADALRRAAAIRADSRPAAGQPVPLSAVGRQAHRAAAGRQAGRFLQRVHQRRAGQCLHPAGQAEAGPVPGRGACRQVPRHHRGVRLQQRGGEQGRRRRAAGLDRTQARRHPGARHQGAVDRRPGRDEQRQYRRRRPAAAQARQSGALLRDRRGPRGRGLRLRELLLRQRDLRHQDLRLHRPPAVPAGRLGLVEDGRPRVQGRPAIPGRRQRAGAPERDRRQRHGIAKPGPPLRREERRQWPLPTAGERRRRRLRVALRLPRADLQQRLPRRRIHQAALRSRPRPGQAGLQDRRAGEGRDRPALSGRQAGGQRAPATEPARPAVVDGGQRTAVSRPVPGGTEQHRTDHRRQGPRRHRIAAGRETQSLHADHLRQRRRRLPGQDQQGDPHRARRRALPPERAAALQRRRREGRVQLCQRTADPAQAEQLPVDPPGGPRHRQRSGRRRPLRADLRAPRYLFRGAARRQGPAPWRHRPLGERRGREVGAGHRRGGVRQARVPHRRGSLRTDHLPRAGGGCAVVPGARQGRGHRPAVQGRRLAAPGKTQSDPVPRVDPGARGVLTEPDLLGALHQGRRLQLPERRDQGRHAPGRDRHRHRQGALRTGRDGDRDPGHALRRQTGFQPPDRQRGG

SEQ ID NO: 26718 - protein, 469 aa, Pseudomonas aeruginosa
SAGVSLRRRRADRQPTAAAEHRLSGAGRRRAADSRPPAPDHAEQSPAPGADGRPGRLVRLVGWRRRWRRFPHRLRLLRRLVRQPRTGDPTAGRTLAAHPRALRQAGDADPAAAACADPGFRPRHAVAGEHPARRPAQRSGQRRQRAGRARTPLEADDGLVLGDPDSAVGLAAARVLAVDLARQLRVAVPAPLAAQAETATQRLREAGLPFTDALLASRSAVDGQQASALLQRLAPAQSTLERALALTWLQGALAQAPQGKLPQPPKDWQAQRGASGETYWQWRGRGIPSWVDLDEAPARPLPVALSYRSAQAPSGQLPVQISRRLLRLVPGEGAFEFKVEEVGDKPLSSDELYLDEVTLNVPEDTALRYGMLELPLPPGADVERTTWGIKISGLAGDEATTLERARNEPGELFYGVPVDSLSGEQRFRHLVRFSQKGSFNLPPARYLRLYAPEQQALEAKPALAKVKVE

SEQ ID NO: 26719 - protein, 372 aa, Pseudomonas aeruginosa
AAGTTRWPPASRCRLPKTGCASSAGSGASVSTESPATRRFRVFPCAAWLPGGPMSIASANASSSAACIPYRNAWTSPTNTCTWPSAPIPAARTKTISKAWPGACYWNDSMNRMSLAALLSCLPLVAWADNPVKLDTPVSGWRAGDGSAANYRQVVNYPASSVNVAADQATTARIRGAIESQPKDRPATLVVNGVSMPLKVDADGSFDRPFAFPSGSNSVEVRNAAGQSRRVQFYHGGGGGEVPAKLRVLLSWDSDNTDLDLHLVTPDGDHVWYGNRSLANGATLDVDVTTGYGPEIIATPTPQKGPYLVYVNYFGGGYGSSEDGAEQAAQDLTTARITLVTEEGTPNEKQETFLVPMRKPGELTLVKRFSYP

SEQ ID NO: 26720 - protein, 230 aa, Pseudomonas aeruginosa
YNVQAAVDAKHHLIVTYEVTNDGVDRDQLSAMAKQAREAMGVEELSAVADRGYFKGEEILACHEAGITVFVPKTLTSGATAAGRFGKGDFIYDAAKNEYRCPAGQSLIWRFSSVEKGLKLHRYWSSHCQGCALKEHCTPSSERRVSRWEHEAVLEAMQSRLDQAPEMMRIRRQTVEHPFGTLKIWMGATHFLTRTLDRVSTEMSLHVLAYNLKRVLTMLGSGALMAAMKA

SEQ ID NO: 26721 - protein, 549 aa, Pseudomonas aeruginosa
SPSLAAFLHGLDELQTASYGGDLEVRVTEASGEVRSFIVPFATTVQLLRPGTTRYSLTAGRLNDPSLERRPNMLQGVYQRGLGNDVTAYAGGAFTGSYMSGLMGAALNTPVGGFSGDVTLARTEVPGDDRLSGSSYRLAYSKNLPNTGTNFSLLAYRYSTGGYLGLRDAAFMQDRVERGEPLESFSRLRNRLDANISQQLGNGGNLYLNGSSQRYWSGGGRAVNFSVGYSNQWRDVSYSISAQRLRSHYEGFSSGDKRGETSTLFSLNLSIPLGGAGRGSPTLSSYLTRDSNSGTQLTSGVSGMLGKRGEASYSLSASHDRDSRQTSKSASLDYRLPQVELGSSLSQGPGYRQLSVKAAGGLVAHSGGITAAQTLGETIGLVHAPNARGAAAGYSGSRIDRHGYAVIPNLLPYQLNSVDLDPNGMADEIELRSSSRNVAPTAGAVVRLDYPTRVARPLLVDSRMPSGEPLPFAAEVLDAHSGQSVGAVGQGSRLVLRVEQDRGSVRVRWGNEPQQQCLVDYALGPRETTPPVLQLACRPASAADRERTL

SEQ ID NO: 26722 - protein, 141 aa, Pseudomonas aeruginosa
AAGSTVWWAGSSATTAANWSTWMPAAGSAPLRVRRLAAWSAATPVRSCRRAAAVPSTAAGAAASAAWSARTRSRDASFRPCRKAPSVATTTSPWAGWPASTWDRSSTPASAARSTSSLSPITARSTVRRSARTMGSWAATT

SEQ ID NO: 26723 - protein, 685 aa, Pseudomonas aeruginosa
SETWFCEVGGVGPDPSPVRLGEFDAVLPGGLAQAFEGMGVVLRTDRTMQVGLAAGQQLGEQVGAHQPAGAGEQDVPWRQQLGGVHGAAEIHVGGQAHVPLQLLGRFAVQRRRRFAGAPRQAGRQLAHARGAVDVVDVGTVAEASAQFAYQGGGQQGMAADLEEAVVQAEVGMPQHFLPGQGHLQFAGGAEALLVESFLALFVQVSTQGLAVDLAVDRGRQAVQRQVAAGQHVVGQFLAQCGLDGGEHGPGIAVLLAGDHEGAQLLATGAWVGMRQHHRAVDSRLAQQRGLDVAEFDAVAADLHLVVQPTEELQAAIGQPAGLVAGAVEPTPQCLRVVEAPGGHVRVAQVFARQADARQVQLTGSVAMARPVVGVEDECLAAVDGRADRGGSPMCFGVDDAAGGEDRGLGRAVVIHHGIGQPAGCDRRQFFPGAEQVAQRQRRRGGLLRQRGHHHGRREGVADPLLGEECQQRRRVWAHLVGHQVEAGACAQGGPDFPLGNVEADAGHQGGAAPLIHIEAPVVPAHEVGQGATLDHHALGFAGGARGEDHIQRFAAVERRSRRGTRRTRRERLCDDLHRLPRQVLGMGGEGQGGLALAEDFPLAPVGLPTVHRYVGRCALGGRQDGDDQFGRAFGQQGQQLAPGDAAPGQVGGQPVAEPVEFAVAERALAIDEGGAFGMGICVLPE

SEQ ID NO: 26724 - protein, 692 aa, Pseudomonas aeruginosa
  UNSURE (571): Identity of amino acid at the above locations are unknown.
RQGRHRTLMRMRQHLDHVADPVASQEALVQRAVLRGLAGDALAQRHHRRSAGQAVARLQRIVVAVVAQVVAVHAGRHPQELEIVCAAVLVDAIEHAQAGRYHLGEGLHAARAEVGRQGRRHGAGLPWDEAAGRPLSCLPGRMSMPRRAVLSLSAWLGRQRQETRQAGASERGSGGSRVFPGSRRMHDAAPSPSRGAHMSIAIDPSVSAFLRSPHGLLIDGESGPARSGADMPLYDPATGAELARVARAGAEDVDRAVAAARRAFEGSWAGQRPADRERLLLRLAERVEAHGEQLAQLETLNNGKSINLSRALEVGASVEFIRYMAGWATKIEGRSLDLSIAAVPGARYRAYTVPEPVGVVGAIVPWNFPLLMAIWKIVPALACGCTVVLKPADETPLTALRLGQLCLEAGIPPGVVNIVTGTGAEAGAALAAHPGIDKLAFTGSTPVGKLIGHAAVENMTRFSLELGGKSPVIILDDTSLDMAAAGSAGAIFFNQGQVCTAGSRLYVQRKRFDQVLERLAAIAGDLSIGPGLDPTTQINPLVSARQQERVLGMIESGVAEGASVVCGGARXGETGFYVQPTILADVTPGMLVVREEIFGPVLVATPFDDLDEAVRLANDSIYGLGASIWSNDLRQVMDLVPRIKAGTVWVNAHNLLDPSMPFGGFKQSGIGREMGHAAIEAYTENKSVCIAY

SEQ ID NO: 26725 - protein, 219 aa, Pseudomonas aeruginosa
IRSVRWRWKRCWRRNSPKRTSSSGRGRMSAWARWYERHWRDWRPAAYRPGATLALVRRNLAACDGEAQDGRLLLRTKELSLEVRERVQAHLFMHIVSTEFSLFVAAPGGPPASLELRHAGCLRRRGILCKVRSGSGLEPLREALQGGDRVLLEQLMPLDFRSLRLCRDDRGWTVSLEHLGACEVVNRFPAYRRYIPLVAEQRLALLGAFAQLQRLLSPA

SEQ ID NO: 26726 - protein, 363 aa, Pseudomonas aeruginosa
MLDASPEAQQECGVSGCMKITAALSGVPAATSSTRCPHLSCRQRGAGCHCLGACAASLFTIRFRVPPYTMRMRLMLLGGGNALGQALIRLGAEEDIGFLAPRPPEQGWDAASLTTLLDETRPDAVINLAFYHDWFQAEQVEAERLGAQERAVERLAELCQHYEILLVQPSSYRVFDGARATAYSEKDETLPLGLRGQALWRMEQSVRAACPRHVLIRFGWLLDESPNGLLGRFLSRAEQPQPLFLADDRRGNPTPVDDAARVVLSVLKQLDCQAPLWGTYHYGGLEATTTLALGQVILNEARTYRSNLIQEPSAEAHAARPDALDEPQHAVMVCKKILHTFGIKPRAWRAGLPALLDRYYRHV

SEQ ID NO: 26727 - protein, 277 aa, Pseudomonas aeruginosa
CAGSSARGTWGPFPQDEKRRPKAPFPVGGASPATVYDSELVAETDHVDPRIDVHVDLGLVHAQGARAVDAGLGVDVHVPDGHVEQRVLVEHVVEAQFAGQAPGVLQLHAAETLRLAVAGEVFVEEGGVVHAQAAVGLEGAVGTAHGVILEQQGRRQLLDVGQLAVQARAEALDVDLVVERSGGDQFHAPLVGEHVGEGQAELGVAVDSRLGTALLGAVQLDVGTAVVGIDGGEAATDDEVTGLVSLNIRSGERGGDGEGQQGSGKPGLTHDELHSLY

SEQ ID NO: 26728 - protein, 314 aa, Pseudomonas aeruginosa
SGGWPGWPVPVGRDTCSESCRPGGAVEIGKGQAAVEQPGQALVVADEQQAGAGLAAFGEEQLEKRLAAVGVERRGRLVGDHQLRLADQRAGGGDPLLLADGQAVGAAFVQFAAEAELAEQMAGGLRRATVAFAGALTAQRGKVTGQLDVLAYREEWQQVELLEDVAGVVDAEMVAARGGQLFQVLAEQADAAAAGLLHAAEEAEQGGLAAAGRPLEEQALAAFEMEAGNVQQLRLAGPGEAEVGQGDQCAHGGRGGTLRRSLENGWRGAAPNPSRRLRNDPTASARRWPEPGRRLSGRRDRSVVPEFSGWRGSA

SEQ ID NO: 26729 - protein, 141 aa, Pseudomonas aeruginosa
TGLRQGRKRVCYVITNFSACLAWPIWPLRADVGAWRDSLVEKRDGADSRKHRRLAGGPDPGTGRRGLAPAGATRAPAAAGRAAGRGGQGAGAGSAGGSPVADRPGPAARQRADRGAAVAGGVGGVQRQCRRRQATACAPAA

SEQ ID NO: 26730 - protein, 158 aa, Pseudomonas aeruginosa
AVRPGPPRTAAGRAAGRPTGRLPRRRRHRPPGGSSALRCRAGRQPGAGRSAARGRRPGPACARRSSPRRGWPAPLPVRRARPGSGRRGSAPRRSRCSPPAGLSGSLRRRRCGLRRIAPGPLPAGLRRAAPVLSHGVRAGRGSAIRAGRRRNRRPAGHP

SEQ ID NO: 26731 - protein, 480 aa, Pseudomonas aeruginosa
RRRCRAYRSCRFSETQGGDHYKWGRAARKQARASGLPAFGVIQADQAEFGGLGEVRPGTGVEHVQAPVQRMTEVTDPRVGDQRLAAAAEELVEQRQVGAVVEHVGHQDQVEAIVLGEEVRRIAQLHSVQFGVRPARCQRQGIQVASHHLGGAGAGRGDRRHPGAAAEVQHALVADPLRALRQPARQDQPAGPAEAPVRRLFEDAAGFLRAELAVHVLRVDQPQAQVGAGQRGGAEPGVAEQLAQRLGQGLRCRHGARTRRSSPRDWVVGWAIRNGCRRQANWPDWITRACSSTRSAPPAGGKDSGLNGRRKGMSSPVASTVSLASSRCGRSRSSITSSAICTSLPRGRLPWMLLSVPLSSRRWAGSTGSTMVTLREACGVGAGFGLSLEQAARRRTASRAIGRRVMGCSIAVESGRRLYSAKCDSCRASRRPQRPIPLAFPSVPAPVDSAGARSGADALPCGFLQLRLYQHHALSLLRCP

SEQ ID NO: 26732 - protein, 547 aa, Pseudomonas aeruginosa
LATGRRGRSGAPAPRVPGLRRTLHHLRDRRAGHAAPDQAGRQPPAVRRGQAARRHAARPGEASGQRRAPGSGHRPHQAPVARHRRARDQVAGAGRTGDGRAAEARRSRLHPFRLGLPALPGPQRIPRGDRTPRPRAGQGMNAADPLYMARALELARQGLYSTHPNPRVGCVLVKDGQVVGEGWHVRAGEPHAEVHALRQAGENARGATAYVTLEPCSHFGRTPPCADALVGAGVARVVAAMQDPNPEVAGRGLLRLMQAGIAVQSGVLEAEARELNIGFIKRMEHGLPFVRVKLAMSLDGRTAMASGESQWITGPSARSAVQRLRARSSVVLSGADTLLADDARLNVRPDELGLNAELTALAAARQPLRVLVDGRPAGAAGVGVLPRPVRRWWRPAPPPRRANASRTPATNCWRCPPPRATSICTSCSWNWRRAAPTKCWWRPARVWPAPSPGWGWWMSTGCSSRRSSSAPAPVLCSTGRWRGWPMRRSCGSTTSARWATTGWSPRGPIRGTPELRCAATRRTMHKRRNCGKTPHGHLGGRNVLRAG

SEQ ID NO: 26733 - protein, 327 aa, Pseudomonas aeruginosa
KSPPAVMARKAPSPRALAGPATAGRQGQQTRCDSGADGHSPDKERTGLPAWAYPVRPQDPLRSKKPCFSRNRSSSYVFILEYPRYGTQAARRRAGHAARLCGGKTGGRMFTGIIESIGSVRAMTPKGGDLRVYIATGKLDLGDVKLGDSIAVNGVCLTAVELPGDGFWADVSRESLARTAFQHLKVGSRVNLEKALTPTTRLGGHLVSGHVDGVGEVLKREENARAIQFTVRAPRELARYIAHKGSITVDGTSLTVNAVNGAEFELTIVPHTLSETIMAEYQPGRRVNLEVDLLARYLERLLLGDKAAEPSASGISEAFLAENGFLK

SEQ ID NO: 26734 - protein, 293 aa, Pseudomonas aeruginosa
WCSATAPASAPSSLSPSRPPRASPPASPPRTAPAPCRLRRRRTPWPPKVFSPGHIFPLMAQPGGTLARAGHTEAACDLARMAGFEPSGVICEVMNDDGSMARRPELEAFAAEHGIKIGTIADLIHYRLIHERTVERIAEQPLDSELGHFNLITYRDSVEGDVHLALTLGKVCAEEPTLVRVHNMDPLRDLLQVNQPGRWSLRAAMTKVAEAGSGVVLLLGHQIGGDDLLAHVREIASAPAPAPKATTTYSTVGAGSQILRDLGVRKMRLLSAPMRFNAISGFDLEVVEYLPAE

SEQ ID NO: 26735 - protein, 161 aa, Pseudomonas aeruginosa
DLLMTLKTIEGTFIAPKGRYALVVGRFNSFVVESLVSGAVDALVRHGVAESEITIIRAPGAFEIPLVTQKVAQQGGFDAIIALGAVIRGGTPHFEYVAGECTKGLAQVSLQFGIPVAFGVLTVDSIEQAIERSGTKAGNKGAEAALSALEMVSLLAQLEAK

SEQ ID NO: 26736 - protein, 247 aa, Pseudomonas aeruginosa
AACSPARKPCASNWPPATTTCWFSPCRLSTLARFAPRGRPRPPSAGSRRDRGCTCSTPTERNSYRPRPATNISEPNVTEHPDQAPAQPVPPSVWRNPWHFLAFGFGSGTLPKAPGTWGSLVAIPFIPLWQMLPDWGYWLMLGVTMLFGFWLCGKVADDLRVHDHEGIVWDEMVGMWITLWLVPEGWWWLLIGFVVFRIVDILKPWPISWVDRNVHGGVGIMLDDVLAGVFAWLVMQGLVWGWVHWLV

SEQ ID NO: 26737 - protein, 434 aa, Pseudomonas aeruginosa
TSTTGATWRPRPASSGTCSAACTRARRKPRESPASPRRAGTCLVVATGVGAVAADPGRVLPRRTATPSPWPGDAAVHRRAAVDVRQPAAVRCLQAWSHRHPESAGYGGGSRRLDPSGAGAPQGPVRRQPAGLDRRAGCVRRAQRRCADPARGHQPGAVLALPYSASTRLMRSFWLLACLLLSLSAGAAQRVVSLAPSLTDSVLELGAARRLVGVLDGGERPAAIGDLPSVGRYGQVNLERLLELQPDLILVWPGSVPEAQLQRLRDFGIALFIAEPHSLDELALQLAALGEALGEAEAGQRLSARFREGMRRLAERYRRDKPLKVFYQVWDRPLYTIGGRQVISDALRVCGAENLFGDLPQPAPQVSVEAVLARDPAVIVAGSHAQLELWRQWPALAATRRGQLYRIEDKNLERPSFAMLAATEKLCRSLAGAR

SEQ ID NO: 26738 - protein, 142 aa, Pseudomonas aeruginosa
CTGRAQAREPLPLPGTSDDPSVSCVARRCSGPVGAAGRRSAENRRGRPGPGRAAPGHSLWRPPGRAGRDRSACCAPGPCPGSCRGWRCRFPRRGCRPAPGRPGRSLRRSAPGRPARRARRDRWRGRRGARWLRSARRSCAGA

SEQ ID NO: 26739 - protein, 233 aa, Pseudomonas aeruginosa
AFPDRRHVPADCAGCRRALRRPAPASRRRRGSRWLRRRPGGWSAGHGAGRRRPSPAGRRGPASRHGSAPPRRPRRRRAAALRRGPRRRRRRAAGEPACHRSSRCSAWPRRGVAVLRGEQRTGRPGRHRRAPGSAPGRPRSCLVAFRIERRFAELAVAFEEYLYLLFGLAQRRLAFAGQADALLEGAQRLFQRQLAAFQAFHQGLQLGEGLFEIEGFLAGHRGSLGEVYKTPRH

SEQ ID NO: 26740 - protein, 315 aa, Pseudomonas aeruginosa
IDYFHGERCAMDVYKLKPEETDERPIERERFEEETRRQEPWFSTSENGTEGHFAVCPACDNPVQIIGLYHLPANVTRPYGRHYARSVRDLAEADEEARENCPYFKPRVHQKTERKASVDGTPLKILKILIEQFDRVVYLLRKELGVNISQNLAIRMLEQYRREKGYLYTGATLTNIPWIFAYMADSQSLFGQLLLDDELIKAVSTEVSAASIDEYGRVSSKVDASGRKEYFDLNMCFVKHRFRKDSLEGELIEGMEMLVSTERKGKAIDIYKKSIVFNRQYFQRLIALPEDHPRRDRSLVEAARRVLGDLLPGER

SEQ ID NO: 26741 - protein, 363 aa, Pseudomonas aeruginosa
VETRGNHTEEVLLALGQEHALGEFAAFLAGREHHRLLRRRQLAEPGDLLYLVGGHVQAQPPLDHVKHRRPGGWDVVDVLGGEPEPGAQFPPHLGDLHGVGQQQRVLGDDVPLIGDLDDGPALELVAFGDVVHGVQQRDVGDPELGGVAFARVSREIHHGEVGFRPGRAFAIEHLAVGTHAEHLHGFRHFGQARAAFWRGAIAPGGLVERIAHILGQHRAVRGGAGPGRRQNRLADGAAIGTGQARVFLFLAAGDHQAGDDLHLAQDVSLVVLEVGLAALDRVRGLDVFGIQDLHLVGTLDQLDGVRVRRQADPGARGEADPVDREAKPLGEVGQQAETVARFRDEHPWQVHGEHLADEVGQGR

SEQ ID NO: 26742 - protein, 272 aa, Pseudomonas aeruginosa
LAGPGWPEDEAVGIHLPVQLVERVEGQRRTATVEQREARVPGTGGAPPDGRQVGDVLREHHLGVPLQGSLLVRIEIAGQPAQVAVQRSDFVLRFDRHKAGAEQHVAQGDAALLQLGMVAAAHEQSDRTAIELVLPADQAANGGHVLAGVDRGLGVTNGLFRELLQMPFQHVLRRHHHGDTQQRVLGHAIEQGVQAIAFERLASEVACQRRLVQLVDHDHTVRHGIEEPYALGGIGNRLPIEQVLGEVGAVGQRQLVLQDRFVRPAYQFVEAT

SEQ ID NO: 26743 - protein, 217 aa, Pseudomonas aeruginosa
IRIGLAEVIRVRVEPANQPVPDVLAAHARSDDAGVRQAALDTLADGFQICRRVLSANLRIRLADPAVDDHPHAPLLSSPGQLADGGVDEQSARLRNALQVMLHERQVHLAEGRSSRSRMDVLPQLLLEIVPADLVLGVELDDPGRGFVLVEGVLQGFFQCVPGVLHPIGVAALGAQGHQLEEDGTRTPIFQEHHLFVGQVLSPGQQVDERWVVIVEA

SEQ ID NO: 26744 - protein, 222 aa, Pseudomonas aeruginosa
ALIAQVLLGIGSAITGDAGDAVGVADPAEAALDGFLVGAGGLVVVALVVIHLLGRRREGAHGPVVEHEREAADLPTHAGECPVARGGPAGYRAGDVRQLDAVGGEVVRADEDFERVRIIDRPVDRHTTDQRRHGHRAHERRVLRQRVGLADELAVLEVGSLLADGVQPVIDPLQRVLAAIDRIAEGGREAESARLGGGAGGQRLAIGIDCAGVLGLDPDDVR

SEQ ID NO: 26745 - protein, 338 aa, Pseudomonas aeruginosa
ASAECVQILQVAQRVTVDTAYPVEFGLRMIADQLQGILDDADNGAVNESAVRKVRREGLFHQRLRAQSLKFPCLALVGEDDVGHVRNRGAEPPALGQVVLLGADHPVAVQGIFRASEPVELLVGIADDSHSDALPVGNVRDHWVDVLSLVQEHAVEALAQIGLAQLIQLQVAVMGHQHAGVLEIYHAPPDYSRHVQALLEEAFLGTGEERLVAEAREVRSAEFRVGAGHVVVQRGQHVTYQLPVLGIESAGDIGQTQVLRLLVGVLDAVHRMSQAVGGLAHYVAGKLALRGFLHRAVVAEIEDSQGRVRLGKAHQGGRLASAGEGPHQDLRCLRLDDR

SEQ ID NO: 26746 - protein, 66 aa, Pseudomonas aeruginosa
AMNTDLPQLEQTIIDIARQELAAVAAFYRKREAGIESAHVDEAWSEYLARYHALSTLLVLGQLPIG

SEQ ID NO: 26747 - protein, 95 aa, Pseudomonas aeruginosa
GVIMSGENSLLERMVNGKLGPGSDIGPADSQIEGTYRRGYHQAMAEVAYYLKNGGTLSAASLNDWVSEDLRRWRQGKDNAPIHRQILPPAIPGSR

SEQ ID NO: 26748 - protein, 80 aa, Pseudomonas aeruginosa
GRCYAPGQTAGRGRKIPAHTIASSGKLIEGSDVSLLAIYSLNIKRSLGRREKGHAAIPRPFHVRAPGEGAFQQAYETNRH

SEQ ID NO: 26749 - protein, 465 aa, Pseudomonas aeruginosa
HCHLQPGLLEHFLQPGRGVARPAVDGVCQNLAALRFLLEAEVHQRLLLGHQLLVAEDRWHEGQCVPASRMLDDLRSETAVRPSQQHVEDHAQERGISSRQSLAELRCQRGRQALIGRSLIRRHRHVDELLLVVGQYVATDILELQEHGERQYEAVDALRAEAGSLHRAYRELLAPGCLVRVTIAFGVDVLEHAVVAHERHGCWSHAATRVGPVAVLDHALGEDAEQEVEQVVGVAAHERSGQQHGFPCLGCENAHGLALGRTAVLVLMPLIHHQQIEVAVGKLSFYELGRLVAAFAEAELDVRHRSLHAFGLPIAEDEVALGVHQVDELRDVVHQHRGQEVLAEVVQQALRPDRADGWNPTHRLEDRCAPVAAVRLAWPDQRPERPTTGGTGTSTVTTLELLHRDQVAFQVLEDLAAIRARSEQLAAGGALLPAGEPPMETHPHPHAAEDEELLASVVGVAHLIS

SEQ ID NO: 26750 - protein, 71 aa, Pseudomonas aeruginosa
MCFSDLPAAVVTATERKVTNDTLGFGQGIQIAYVLLLTVLLGKDAVEHIAHQTVVRTAVRKCSIDLSTFSN

SEQ ID NO: 26751 - protein, 431 aa, Pseudomonas aeruginosa
LDRRAWPGWGPCDRPRCTAGTPSWRTAPRDRAAPARWWRGSWPGPRPGRRHRPWPEPGCRSSRRPRSALAPGRADRAPWRWPDACRWTAPSALRDWRWPPDETDAVPHERRSCAPLPQRPSTGPRFRAGWTCFRRTAGVPCGRTACCRRRTATAPRSPPSARLLRVEAVVEQMLIEVEWPNEILDYLRVEHALVDAADGVGVLGDALHGLDPVVACLGWAAFGEHTHEGQGGQHHLGDDRAAVDSGATAGLAARPLDVHLGNIGQALDPFDQIGRELVLVVLEAHFAVGAELGQQALVDQTGQQGRIEQQAGVDTQVLEALDNADRAIGVQGRPQAVPGHRATEGGDSGEEVAHFADHHVVRIQAHAVGDACGPGLAFCVWVSGVIDQWGLVDAFAANAVFRWILDGQDMLGSAMQLIESFHGDLQGHRLP

SEQ ID NO: 26752 - protein, 447 aa, Pseudomonas aeruginosa
RPPEQAADELVAVVAQDRDVWSTATDVRLLHGSAQHDGGDQHHDDLAFGIAGQPAAKAEESGVAGADLVGVLGGLVEAGEHQGLTAAQAYLLVEQLDVVARELGFGVPAGLHFKCRAGGHVDVDLQQHLAAFHHERQQAHVVAAGHGARDQRGGTADLGDVGDLAGGQVAVVAADLDRRRLKVERGHGRGADGRDTALLGQRLDHGLGSCPGAVGGIQDAHGAGDRTLVDARHGVLQADAPLVVERLVDQVPVDPQLILVGQGDREHVDVQQHLLGDALVLPVDQLLDAVEDLWSVGDGQGARGTRQRHASHARRQHRVDAVLDVAEDRCLQLRTGGLLAAGVAADAGAAILSGGSGAVPADAGGRRHTGTHGGVHRVDVVKGVDAEGPSVQVVELDPFLGWVVAPGHAGAGGDEIEEPADLAVPFDVVQRPRAVGPEARPDAAAGT

SEQ ID NO: 26753 - protein, 158 aa, Pseudomonas aeruginosa
LRSCGSQRTVQRARLAQASKVSRRVDPVSADQDCANCRLGSAGVSTLTGGAEATAGVGGMDFTAEAKGLIGAKAAGGEEGWPSLAGAAGGNTVVDSGFLVGAGLVVIGAGVGTEATTTGDSSVLTFSVEEGCATAAGVGAAGFAYSCWTGFGLGAGGS

SEQ ID NO: 26754 - protein, 299 aa, Pseudomonas aeruginosa
RSQGMSDRKSAAVAGGSVAHLEHDASISRSAGDARPFIQVRNVWQQYGDQVVLERLNLKIAEGEFCTLVGASGCGKSTFLRLLLGQEAPSRGEILLDGQPLADEPDASRGVVFQRYSVFPHLTVLDNVALGLELPRAPLLGRLLGRRKRDAREQAAQMLHKVGLGHALDKYPAQLSGGMQQRLAIAQALVMKPRVLLLDEPFGALDPGIRKDMHELLLELWRETRLTVFMVTHDLSEGFTLGSRILVFDKPRIDPHAPGAYGARVTYDIPLHEGRHAPGASAGMPTALADSFRTAYQGA

SEQ ID NO: 26755 - protein, 449 aa, Pseudomonas aeruginosa
SGQPPGRPPLRRHPPVAGNRRAGAGPGAALPWSCTDAGPRSQAARWGDRPDPRHPLPAGALPARDPGAGGSLGDRRRPVGCRVRRAGSEGALAHRPPAAVLGRPGLPVGHREVHDHGAQGRALVPEQPGVHPPHQRPAQPRRGVPHGVRRQLLGDGPRRRVSRCAGGHSAGPAPPPGHHQVQPGAHLDRGELGGHRRRLHVHLRHGRPGRLPVRRPHPADVEPLPRGRGVRRPAVAVALLRPDPLLPGLGRGAVENPPRFSARPLPAEDREHRAAPVRLPGLSCRRGRQHRRLPPPAARRLRRRAPALDRIGPGALRERGSRRRPRRGRPARRRPARHREPHRRQPLAGVGGRGHAGRCRRRAGDPREHEDGNPAHRAGRRRGQGSPRPARVAGARWPAGGGDRGGVRPLGTRSNRRVDRALSIHPPAQRAGNEHRGGKGFAVFTLRGT

SEQ ID NO: 26756 - protein, 211 aa, Pseudomonas aeruginosa
RLGLRPDQDLPLRHTPAPGIFRLRGKRGVVRRHHRTAESPRRRAGGSGLRPLPRSCTPALRRPLGGRTLQRGGRADRAAARRRAAGNKSRSGESPRYNRRAAVPGAIPPAATQGRLRPHHGRGRLCADARLPAPSDARRTSRRAGQAQFGPGLLHQLHEHARLRRCRGAGRHHAQRPALGRDAVRPGVHRPVPAEPGRCAAASDRAEVDRR

SEQ ID NO: 26757 - protein, 337 aa, Pseudomonas aeruginosa
GNHAMSTLRSLNKTLLAAGLAVATLFSPLASQAAEKLKIGTVVWAGYGPFYVADKLDLFKPHGLDVDLQFFNDPALIPTAMVSRALDGGMLTYDQVVASVAKGLKHRVVMPIDFSNGGDAIVADASIQSIADFKGKKVGFNPLSPSDFLLAYALQQNGMSDKDINAVNMTPEGIPGAMASGNLPVGVTYEPNVSQILSMGGGDKFKVVYSSKDAPGLITDVLVFDEAVIAKKPAAIKAMIQGYLDGLAYMQAHPEESAKIIGDVLGVSAEEAVEQMAGAYNIPLAEMGKSFTPGDDTHSFHGSGAIIAKLLKDNGQIPTIPDFSQTYDAQFTEALAQ

SEQ ID NO: 26758 - protein, 355 aa, Pseudomonas aeruginosa
ADAGRAAARLCWRKTMTAKPLYRYADGRLPNTLAILYTALAYGGGLALLFAGNGWLNALGTLLLAHGMIIAAYLIHEFAHGAIFSVPKHNEWAGNVCSWLCGSCYAEFQDLRKKHMRHHVDRADVITFDSKAFLKARPLWFQKLVLALEWAYVPAVELIMHFYVIALPFITDNDKHRARRGKVAAVLAIRTLLFAGLAVLSLKALLLYAVAWMIMLSVLRFADAYQHTYEAFAVLEDGGKLPEDKRRDRSYEQQNTYSNVVSERWPALNLLLLNFSFHNAHHEKPVAPWYRLPKLHAELYGSTYNQVIPMRKLLGSFHRYRVRRVLDDDYGVVSEGPNKADNFYGAVGVSFLTAV

SEQ ID NO: 26759 - protein, 436 aa, Pseudomonas aeruginosa
PRLPRPQRRCADQQRRRRVRHAAGRVQLRGRSALVGPAGEQRRFHAAPDPRIAATPARRRQRDQPGLHLGTERRAGLFRLCRQQARGGRPDPLAGLGAGPATHSGERGVPRLDRHRCGHALAEGDGGRQRPQRQRRARGDTRQPGHSGAADTGRSKRHLPVPRLTAGRRPDRPGAVGQPRRGDALMAAIFTGLTALVTGAATGIGRATALALAAEGARVWINHRDQHDLAERVVEQIIASGGCAWAIEADVSDPVAVAAMFETIEAQGPLDLLVNNAGVILEKPFLETSEADWARVLGVDLAGVYRCCRHALAQMQPRRSGAIVNVASDLGFLGREQYVAYCTAKAGVIGLTRSLAREFAADGIRINGVAPGPIATAMVSPEHMSDEWMAKELAIPMARLGTPEEVAAAIVFLLSPQASYFTGQLLGPNGGSWMGA

SEQ ID NO: 26760 - protein, 415 aa, Pseudomonas aeruginosa
PSASRAKRWTHPARTTGWRFPPASPSASTTSPLAPPTGCHWRARRWSVSSGNALPREGCSACCCHQPTSAPESDPELADRPARPRLAGQHGRRAVRPDSSGSRPRRGAGGVRADRRGAVVRLVRQPRHRPERMARRRPDHHRRADRRLAGTSPFNRDKEHLRMTVHMDQLSWVDYERRVREGAVVFLPCGATEQHGPHLPLGTDALLASAISADVAARVGGLVAPALSYGYKSQPKCGGGQHFCGTTSLDGATLSALVRDAVREFHRHGVRRLVLVLGHYENQWFVAEGIQLALRDLGPDAGLEVMRLEHWDFCHEQTLTDIFPEGFPGFALEHAAVIETSLMLHFHPQLVALEKIPDDAPADFPPYDMYPTRTEWVPPSGVLSSARGSSAAKGQRLAHDIVEGIAAAVCKEFAL

SEQ ID NO: 26761 - protein, 281 aa, Pseudomonas aeruginosa
SRPKHVICGALPMKTVPDAYLGVWRRRLLTTTAGLRDETSEVYWLQTACLHADLRLPGGQPVAPAASLETCSHAQQLALSEQAGFAGITEVNGDICQWHRLIDFQPPGGPADIGLMRFETPERLLEDGLDGSYHEIWQRLPESQGRNWGIWLRASEQPARQACLLVAGDYFLFAAERPILLPASSGHLREQLAAVEPALWPQLLACELSFGRHRNGATPWQITHSTLPGRVGDALLSSYWNFADPASLPAADLAALGRYPAAGGWQRVELDVPTATEKVPA

SEQ ID NO: 26762 - protein, 312 aa, Pseudomonas aeruginosa
GAGAAVDRPGHPAQRVRHLRRRLGLRQVHPAAHHRRPGDAESRRDPARRQAHRRPRRRPRHGLPALQPLPLADGDAEHQVLPPAQGDRRYRAPRWRRGVRRRPRRCPAQPDGSDALRRCLPQPALRRHAATRCHCPRPAAQTRDTADGRAVRRAGCANPRSHARPDPSRAPAGEEHHPVRHPRCRRSHLSGQPHRADGATPRAHRFHLRGAAAGPAPPGHEARAGIHRAQARDPRPDPRNLRHADRPRATGQTQRRGRLKASGQAVRPLPRTPGAWPPRCGPAHRHNGPSPIRAPAARHPESARPRGGHPRR

SEQ ID NO: 26763 - protein, 158 aa, Pseudomonas aeruginosa
NTDRCCRASGWTAHGCDPALRPASPQRNCGPGRPIARYAARRAGRWRPAPDDPVPSSRAAPRGSRNPSRATAHDDRTPANRPSRHRHGRKPAARVPAACCSALPARRRRRTAPPSPLRETPGYVASSVPYSRTAGWHASVPDRPLPRTASACRPWTSR

SEQ ID NO: 26764 - protein, 104 aa, Pseudomonas aeruginosa
WQSWPATRRKAPSYAPSWAQLPVPTRPATRRNSRAPTCSISQPKRSPSSPANRPTKRWTACASSPSTTACWATVPIRRTLSVSPCRPARSVIRAISSCASTPPT

SEQ ID NO: 26765 - protein, 243 aa, Pseudomonas aeruginosa
RWPPTALCEGLPRSGPCRHAAWPPRISRSLMRRTKEDAEQTRLKIIAAALELFSRNGYSNTTLAMIAEAAGFSRGPIYWHFKSKDELYEAVLAYSQEPLEQLIEQSRQLAGSPQAALEHFVGEWFRLLLDERWYRQSFEILLNKTELTAQMASTLKRERKLTRAMVQLLEELIAKAHADEGSARSLALLLYSSLMGITHTWLLSPKLFSLREQAPFLTRRLLSSLAPGLEMAGGTSGTGRSAE

SEQ ID NO: 26766 - protein, 951 aa, Pseudomonas aeruginosa
ANGACRHCSEYHSLDCGSLGNRIGAEDQTAPAQLSKHARGRIADHAFAPAMLRDSSGRLLPAPMGNLYSRAQGISWMDSKQLTQGLHQAFFAENHRIVFWYDPEQNFADALNELDLPDVQVLNMQGKSTFGTKLQLELEDTQGKYLLYFPCAEPDAEDDWLLDIKLFSRSFYADRVSMIFNELGLQQVSLREHLSRRESFLKSTARVSALKRLIQSNATAEELDQAMIAVLLGSAACDITTLLCTLADQIVRDDLGLESNPGVIDELYQHGLMPALLQALRDEVGYPASAEEISGEKPFSFGHFLIRLLATGFCESISEIPDWASAIAIPSASARATSRALLSRWRDSSRFYKSYDVVSSWVGEALRISDKLGELSLETLANVATFEAVERQIIIDLNQAIPSAAPSDLQVFSRIIGERLDNYWASRHKDDEIRRKYRLLYSALAAAIELFGLRLQFGAGFHYSGTEALYKAYEGELYRFDSAYRRYVAASQRAHVELLKKLDEEVEQCYAYWYLDQLGRNWGDCVEAEQRLTHWKIAGVPNQQNFYERWVQPQFEKHRSKRIAVIISDAFRYEAAVELRERINEKRYSEATLSSQLGVLPSYTTLGMASLLPHQTLEYRESAADTVFVDGQSTAGTIQRDKILAQYQGIAVTADEVKAWSRDEGRERLKDKQLVYVYHNVIDDRSDSGGPSESDTFQHVEVAIEELTELTRKILMHFNTSTVIVTADHGFLFQQSKLEAADRTALVDKPGSAFKSKKRYVLGHTLPEAKDVWQGSTKHTAGTESDTRFWIPKGANRFHFVGGARFVHGGAMPQEIVVPVLTVNQLRGEKAEKRTRRKVGVISPKSVLKMVNSIQRFDLMQTEAVSEQVLPVTVAVAIFEGGQIISSEEVVTFDCTTDSMNDRLKQVRLSLAGSDFDRKKDYFLVIRDKDLNTELERYRVTIDLAFTDDFF

SEQ ID NO: 26767 - protein, 726 aa, Pseudomonas aeruginosa
ERARMDNELNKDLDHLLNEHFAGRVVRKDLTKLIKEGANVPVYVLEYLLGMYCASDDAEVIEQGLKNVKTVLAENYVRPDEAEKVKSLVRERGTYKVIDRVTVRLNERKDRYEASFSNLGIKDAEISAGIVKEYEKLLVGGIWVIATLSYYHEEGQSGSPFGVTLLKPIQMPNMNMQELFTGRSALTTLQWRETLIRSIGMEPSTLDESVQWHLLARMVPFVENNYNVCELGPRGTGKSHIYKECSPNSMLVSGGQTTVANLFYNMSSRRIGLVGLWDVVAFDEVAGINFKDKDGVQIMKDYMASGSFGRGREQMEASASMVFVGNINQSVESLVKTSHLLAPFPEQMIDSAFFDRFHAYIPGWEIPKMRPEFFTNKYGLIVDYLAEFFREMRKRSFADAIDKHFKLGNNLNQRDVIAVRKTVSGLLKLLYPHDQFTKEDVRQCLEYALQVRRRVKEQLKKIGGMEFYDVHFSYIDNETLEECFIAVKEQGGGGLIAEGPGKPGFIHTIGLSGKGMPGLYRIELQVTKGSGKLATSGLWNSTMAKEQVKIAFDFFKANASRISASTKVLEHDFHLHVVELQNTGPLTHMALPSLVAFASGLLGRPTQSQMVVLGDMSLGGNITPVESIAECLQVAFDAGGKRVCLPMSSAIDIPTIPAELFTKFQTSFYSEPVDAVFKALGVDQCHQPKLQPCPRQAPRSSQPPWPSGDDQASAAQSGGLAGLAVM

SEQ ID NO: 26768 - protein, 397 aa, Pseudomonas aeruginosa
RALLLRLAALELVAKLSGEAADPECVALLVVLDPGAQQVRLEADRQAFGAAGEAAELVEGALVRRDFRRQAVVLVTDVVVERPRLLVVHQFRKRVEGHRLADARLGGGVVDQRLGLLAGLFLGHVLAFHEIAEGFQQGARLARRIHPFLAADEVAEIVGDLLPALALDERDVLLRLLVVAPFGNVDPRGQVQLAEVQVARRGDLQRLVHRHAFAVVQQGDRQVVGHALLVVGEQDVAAGGEIGLLHQLLQVLDRFAAEADEVAVALQVFTEPAAERVGPGLALEEAPGLVLGVVAFVEVGQQVLDGLGVAQLGVARVEHGRGAVGLLLDQVDDGVFDRHQKDSWFRERCLSARRSRARALSSPRASLGVEEMKIEAQPILLSFKWPPAERSTLQPSA

SEQ ID NO: 26769 - protein, 436 aa, Pseudomonas aeruginosa
GPAAPSNRKPPGTGTGRIDSQVVVATYHWNGRRSPVYRVPGLPAKIDADQSAMDLVGDLWLQPAAGRRTHDIPLVPGDQAAQQTRASDLAGSGSAADGGGAEAHQPANIAVVARRHIAAGRGPQDESLPALQGADQSAGPDPGASAHRTAGLGGADRGVFTAADQPSQVVAGLVVHDSMTAGEHQRTSQVTADQPADGPGTTGADVARSRDVRQRGGIVIADESADATALAPGDIAGCRQGAVVAAPVVADQPSHVTVRPCVYPPGGLQVGMIAAEVGPYQATQGFAAAVGDFATGGTVDDGAVQVFSEQTANRFCSAGSDIALGGGIDQRGIGVETDQAAGLEQRPTTQVAAGTDVGQVACLVVADQASQVATGLQADIAMGAGVVDGRVQVPADQPAQCFRVCAPDLAAGRGVGDTTVYVEADEPTVQAALSVA

SEQ ID NO: 26770 - protein, 181 aa, Pseudomonas aeruginosa
WPGMTVAVVTSSTWWSIPVIEGWGWRGGCSTRCWHAWRGRGSANPMSSSWMPPRRPRHSGEPSRTGSGARTSRYFPLGRDTRETIALGSAGHAAARPGTGPGEGLHPGTLDVAGPVRKGALAGRLHPGPAGGAGHGRLEAGQGGAGGTPKGLPGGAPRAVPGGHQPHAGADFPAFRGAGHA

SEQ ID NO: 26771 - protein, 284 aa, Pseudomonas aeruginosa
LQLSGAARSRRGHRFSLCLGRGQGALGQAGAAPRVGNPPVGFAGGPAHRPGTTAAVIAAELLSAESLELGWAIYAPVLLLAAWRAPWVELVSDTRRQHLVFGTMLGLFLLWLVRRDFESGLSFHFIGMTAVTLLLDWPLAIVVGLVAQLGLCLLGRQDWLAIGVNGVLLVAIPALIAELAALFVEKRQPRNLFVYIFCCGFFPAALTAVVVLLLGLGVVWIDGLFPMPPWLEDFAGYLWLIMFPEAFINGTVITGLVVYYPEWLETFNRTRYLQAPWKDEERKP

SEQ ID NO: 26772 - protein, 103 aa, Pseudomonas aeruginosa
PVIRQVHGGQRLTCVSVSDEAGRDPAVFPGEERNMGVHEWARQGLRELLSKSDEADRAMRLRALLSAIVELNRAERDAGDLASELQFLAENLDDQRDYAFMRP

SEQ ID NO: 26773 - protein, 85 aa, Pseudomonas aeruginosa
KACSRSTSRCRWDRSPSLTSTSSACFKRSSRRAWAWRIERTCSSETLSRSMVRCSCRCSGVSTTSTRWVIWRWPDSTSSGETRMA

SEQ ID NO: 26774 - protein, 278 aa, Pseudomonas aeruginosa
RYRLARAGGAGDQDHALWLLECGQVEFLLVLLVAEGVDAHLCAGGVEDPHHDLLAPQGRQGVDAEVDGLALRHAHLDPSVLRFAPFGNVQAGHHLESRGNTAGQLDRRLGHFVEHAVGTEAHPVDLLVGLEVQVGRATLYGIQQHLVDETYYRSVVRFCAGILLGGLFRATDIQSLEVNIVEACETIGSAFEQFVDGQAKLVVFDQNRFGRQAGAELDIIDGLVVGGIGDAYEELVAAPPQRDDPVLADQLFADGVPRKAFLVQAIQVAVGDTELLGG

SEQ ID NO: 26775 - protein, 188 aa, Pseudomonas aeruginosa
QRLDQPGAGCDQGHRRTDQPAGAQCGDRGRSCRGAGARFRGGGRRGAHAGQAHPAIHRRDRTDDPAPAGRRRCGGEGDGQQPPYRRWHGQRVGAGAAGTGEYPRRGGHDRRPEPADRRRRRATDRRGPRYRPEHRRDQPGRRAHRGRRQPDRTGQPRTGRPGDPAETPDRRVPGVGARPARDVFRPSD

SEQ ID NO: 26776 - protein, 185 aa, Pseudomonas aeruginosa
RRSTSSAVASATKSPASAGLFHVALEASRRSCQPCSTTHDKDADMTGNGVSLVTLGVADLARSSLYYQALGWQPSSDGNEQVVFLKGRNLVLGLYGRSALAEDAQVEDRPTGFAAITLACNCASRDEVDRLFSAATAAGGQATKMPQEVFWGGYSGYVADPDGHLWEIAYNPFWPFDEQGNLVLP

SEQ ID NO: 26777 - protein, 769 aa, Pseudomonas aeruginosa
SAINSATFTAPGEGFRMSRQSTDTAVSSQRLLASAIGVAITAIAAPQAAHADEAGQKKTDKDRVLSLDAATIVGEQQDETTYNVDRSASKKYTAPLLDTPKTVTVIPQQVIKDTGALTLADALRTTPGITFGAGEGGNPAGDRPFIRGFNAESDTFLDGMRDVASQTREVFNVEQIEVSKGPGSAYTGAGSTGGSLNLISKTAKQDNFTDAGFTWGSDQTRRTTLDVNRMIGDNAAFRLNLMKHDAHVAGRDEVSVSRWGVAPTVTFGFDTPTRATLSYYHLSTDDMPDYGLPLTNVNRSKANPSKPASVDRDNFYGLKDRDYRKSTTDSGTFRIEHDLNDNLTLSNSTRLVRTTLDNIVSNPDDSRGNVANGYVYRSAKSRNSTSKGWVNQTDLKANFETGFIKHTLVTGLEFSYEDVHNRPYAITSGGGAGNTCNARLLASGDCTSLNRPTPGDNWTGSITDGLAYTDTDTKTSAAYVFDTLKLSEQWELNLGLRYDDFDTKSSGYQTAGRNGPAGYFKRENNSHFWNYQTGLVYKPAPNGSIYLAWSTSSNPTGETGGEGQADISVGNNGLDPERNRNLELGTKWAFFDDALSLNAALFRTDKTNARVASPDVSTLQVLDGEQRVQGVELGFNGKLTEKWKVFGGYTYLDSEIRKSTVKSDEGNKMPQTAQNNFTLWTTYDLLQNFTIGGGTTYVDKQYGNTANSTYIPSYWRYDAMASYKVSKNVDLQLNVQNLTDKRYFDQVYSTHMAHVAPGRTALLGVNFHF

SEQ ID NO: 26778 - protein, 561 aa, Pseudomonas aeruginosa
PPTVFACMATTRSRWRSSGACARPWTACDPHRTRWCRSPAADARRRARSGPVCAPGRAGQTSARGARRRRQGSGAGLDHPDAALRPLPHRPAGTGRTPGSAAGGVARLAPRRGCRAPARDSRLVRRRGPRDGSGCLRIDWRRSDRTAQRGRIPGRRDRFRSGIRLPRRPRSAPGPAAAGHPAGACTGRQPGHCRGADGDLSAGLARRLAPAGTQSVASVRSGRHSSVPTGAGRPGALRRHRARGLPRPGRARMNGLRVVKAGPQSLLQDDGRRGWQHLGVSAGGPLDRQAAAWANRLLGNPWGTPLLEIAFGGLVLECRVEATWLALTGARLALTVDGRECLPWSRFRVRRGQRIELGFAEAGQRAYLACAGGFRARPVLGSVACQVRDGLGGLQGDGRILAEGDCLPCAEAGAACPWDASVPWRFQPDYRQQRPLRVLLGGDAAAFDAASRQAFFASAWRISPRSDRMGVRLAGEPLRGAPRAWSQGVVEGAIQVPPDGQPIVLMADRQSMGGYPLLGFVHPLDLSRLAQSPAHSEVTFVESDLATQQADLLRFYRFFRG

SEQ ID NO: 26779 - protein, 934 aa, Pseudomonas aeruginosa
AGGKRKHLPCLAGIESLSGSPSWSRYDGHERFPDCPGGGLPGARTRHAPAVPDRRPPGPSRGAGHRPRPGAGSGLPCADGRDWTGAAVPYRSLDLRPGAPARRRLPRLAWPADAARWRTGLADQRRGLRAGGPSRRPPGLAARTPDQPAEPQGPAVLFGAAAAVRQPRGRFAGRPVRRARYGPGSGWPGLRLRLCAGRWPPGPLAGVPAAGTAPAAVGLRWVVDRVRGKAGAAAPALKGCGAASAPWRSAEELLGVVAGHLALVEQAQLGHLAAAALGGVGAALVEGATLRRVQRVRQFALDADLRLRRVRVDRRGRREQRTGIGMQRVLVELVRRPHLRRSAEVHHQDVVGDVADHRQVVRDEHVGGAELLLQVHEKVQYLGLDRHVEGRGRLVRHQHLGLQHHRPGQGDALALAAGEHVRVALVMLRPQADLAHHLLDLFAAFLARQRGVDQQRLGQLVADLLSRIERGVGVLEDHLHVAAQLPALVLAGALDLLPGDFQRAGGGFLDQGQGARQGRLAAAGLADHGEGLAGFQFERYAVQRAHLGVALEQAAGDFVVTGQITGGQNRFPSGHLVQQVQRIEAAHRAALVCLQGRPLLAAMLLGIGAAWRQQATARAVVAPRNDAGQGGQAGFAGTVLGDRLDQRLGVGMGRAVEQRRHAADFHRFAGVHHADALGGLGDHGEIVGDQDQRHVLVALQVQQQLHDLRLDGHVEGGGRLVGDQQLGLGGDSHGDRHALAHAAGELVRVGVETAGGGRDLDPFEQFQGALAQGLAAQAEMQAEDFLDLVADGVAGVEGGHRVLEYHRHVLADDAPALAALEGEHVVAVEAQVIGGYPAGGVDQAHQGHHGHRLAGAGLADDGQHLALVDAQVEAVDHGHGGGVAEAHAEVLDIEEAHAAVSCGADTDALFMVVLLMPRSSVSDRGRRAGRRPSG

SEQ ID NO: 26780 - protein, 382 aa, Pseudomonas aeruginosa
TAGRRGRPCCARRPARIPSAGTGRPGSGRWRERCAWRSSAGSSALVANARVGQAVEDVHDEIDQDDQGGDQQDAVLHHRVVATADGVDQPLADARPGEDGFGQHRAGEQRADLQAEYRQHRNQRVAQGVHEDHPGRRQALGAGGAHIVFAQHLEHRRAGHAGNHRQRDGAQHDGRQDQVAHGIEERALFVGKQGVDQHEAGLRLDVVEQVETAGHRRPAQRHGEQHDQDQAPPEDRHRIAGEGHRHHPVVEQRTAFQGGDHPGQQTEGAGEEHGGQGQFQGRREQGEEFVPDAFAGGQRFAEIALCQVAHVVQVLLVQRLVQAQAVQGLGMHLRIDATFAHHHLHRVAGNQADQREGEQRHAEEGGDQQPQSSCNETKHVGG

SEQ ID NO: 26781 - protein, 496 aa, Pseudomonas aeruginosa
RRTREGKDQGFPRAAQRSVQLHPRKVPRRHRAHAVAADVLALRVEHQRMRQRQPGHLLVEDPLRFLVQRYPLALVVAHARLADGFVEALVAPARAIFPGLHRGAAEVVGEEVVRVAVIADPAVEHHVVFAGLGALDHLAPLELADVHPDADGGQVGLDQLRHSRRVAAGAAAGADVEVQGCVRDDAGFLQQGLGPFGVVGPVADAVVVAEQHRRVGADGRAGLVAEDDLQVGRLVEAHGDRPAHARVVERFVPGVDRGVGGDHRRFFQHRQLRVLAQRGDVFRLGRQGDLAFVAAQALHAHVGIEGDRQHQVVDGRLTLPVVGVGRVAHLGILVVAGEDERAGADRLAVEFVALAPGDQLAGIFGGEDRAERHGQVGKERRLRVLEDEAHLMFVDLLDALDDVAQLHGVGVGVAAGRKVVGGVLRIEHALEAEQHVVGVEFAGWLEVVGAVEFHALAQAEGVDEAVSGDVPAFRQGRDHRGAARSERGQRVVQRMG

SEQ ID NO: 26782 - protein, 582 aa, Pseudomonas aeruginosa
LLWSGTAGSAAPGRGAASLVAGRRGWQAKLLADADLVERVQAEGTDPEVVYRLAHRLVHGGVGDRGDRHLFLEDVLGLLVQLGALALVGGALGILDQLVVAGVAPFGEVVAVHRVAAVEGAEPVVRVAVVAAPADQHGVMLAALGALDVFAPFVGDDLRLDTDLRPIVLQHFRHQLGVGVVGALYRHGPQGDLGALGDAGLLQQLPGLGRIVGRVLDGLVVGPLGRWHAVARQLAGALVDGVDDGLLVHRHVQRLAYFQLVERLVGDVVGDVAEVEAGLRRQVQVRVLLQRVEVGGARVEGDLALAGLELLRAHRGVGVDGEDQVVDLHLVRLPVVLVALEADLRILLVAAEHERAGADRLLVDVAGLALLEQLRGVFGGLDRWEGHRQVLDEGRVDLVEGELHRMLVELLDPGDVLVQAHVGEVGKLGGVGLAERMILVEHAFEGEQHVVGIEFAGRLEVVGTVELHALAQVEGIGLAVVADVPAFREAGKDLGAAALELGQAVEDGFRRGVEIGTGGVLGGIEAGRAAFRAEDQVAGEGLGNGGDQRCAEQRGNDRGADDGVSTHGVTSGYFDCLRGTAS

SEQ ID NO: 26783 - protein, 459 aa, Pseudomonas aeruginosa
QRSAKQGRMATCEVSESLCRRVADSVLAILALIPEENMRAPVFLLSASRQNLGRLLLIRILVLAAQAGSVGFAWLSDLLPLPWLALGLTLGLSACLILFTALRLRAPWPVTDQEYAVQLACDLIIHSTLLYYSGGSTNPFVSYYLVPLTIAAATLPWIYSMVLSGLALTGYTLLLIWYHPLHLQAVQHEAMLINLHLFGMWLNFALSAAFITFFVVKMSEALRWQAHMQAERREESMRDQQLLAVATQAAGAAHELGTPLATMSVLLNELRQERPQDPTLQEDLALLQEQVKQCKHTLQQLVRAAEADRRQAIEEQSAAEWLESVLRRWHLMRPEASYRYQCLGLGSAPRLTPPTDLSQALLNLLNNAADACPDDLDIRLDWDSSSICLSIRDHGVGVPLAIAEQIGKPFFTTKGKGFGLGLFLSQASVTRAGGTVKLYNHEDGGTLTELRLPRSYGMA

SEQ ID NO: 26784 - protein, 319 aa, Pseudomonas aeruginosa
QRGRRMAPLCFPLSVESRWISHIPPVAGDIQRTAQSLRCSFHESHDQGLIMRIFGSSAGCLSVLFGLAFGLPALAEPSVDLDGPTAGWRYSGLLEQPDAPRVAYPTPPIDRGGQRGRSLIEGHLRELVGTERAQRLVVNGNPLPLYTDGAGRFVRPYAFGHGSNGVQVGSADGKILKRVQFYEANRSQLPPRVRVVLGWDDPKAELDLHIVTPDGQHAYWAHPRLSNSGGLDPDGVDGPGPEMFTMGAPLHGTYLIYVNYWGNLNNQGYNFQAGSNVQDVITAQVNLVFNENSVDEKHETFVVPLRTIGDLVLVKTFTY

SEQ ID NO: 26785 - protein, 1341 aa, Pseudomonas aeruginosa
RHALGQPATTHDMEGHPMDPRRIQSQLYRHLSAGFPLSMNRVPVKTTAMSNLRRFSRSLAVAALVLLPFAAVQAEDTVEPSGYTPMAGESFFLLADSSFATDEEARVRLEAPGRDYRRYRMEPYGGVDVRLYRIEQPLEFLKRQKNLHRVLAEGQFKGEGLSNTLAYLWDNWYRKSRRVMQRAFSYESRQQVTEAVPELKMGNAMTAPTPYDAQPQYAPIPGLPLVSQFRYPLWDAKPIEPPQDVKLAGSSSEFINVVPGNVYIPLGKLKPGLYLVEALVGKYRATTVVFVSNSVAVSKVAGDELLVWTARKHEGTPVPDTKVLWTDGLGVMSSGNTDADGLLRLKHASPERSYVIGEDREGGVFVSENFYYDSEIYDTKIYAFTDRPLYRPGDWVSLKMVGREFKDARQSQAAASAPVRLSVIDASGTVLQSLDLRFDAKSGANGRFQLPENAVAGGYELRFDYRGQTYSSAFRVAEYIKPHFEVALDLAKPDFKTAEPVKGEIVLLYPDGKPVANARLQLSLRAQQLSMVDNELQYLGQFPVELSSTELTTDGKGRAAIELPPAEKPSRYMLTIFASDGAAYRVKTSKEILIERGAARYRLSAPQRFSAAGEKVEFSYASEQPTPLKPSSYQWIRLEDRATDSGPVADGRFALTFERPGTYSVELRDDKGQLLGATGHSVSGEGVKSVPGTVEVVFDKPEYRTGEEASALITFPEPVEDALLSLERDKVEATALLSKGADWLRLEKLNPTQYRVWIPVREEFSPNLTFSVLYTKGGDYSFQNAGIKVGMPQVEIDIATDKERYEPGETVTVTLATRFAGKPVSSHLTVSVVDEMVYALQAEIAPGIDQFFYHPRRNNVRTSASLAFISYDVALPGSTSAPGRANRSERGVKVLERPRREDVDTAAWQPELVTDAQGKASFSFRMPDSLTRWRITARAIDDNGQVGQKKQFLRSEKPLYLKWSGPTRFRQGDQPDLGLFVFNQGEQPVKAELLSGPPGSQRSQTLELAKGVNYIPLAQQPLSDGDWSAELRQDGQVRDRLAVRFNLLADGWQVEQVQNLSLAAASNPLQLPADARDVRLRLADGPAAAYLGNLDDLLEYPYGGVEQTASQLLPLSIAYPALAGGEPRIRDRLRLIMQNSRLRLVQMAGPDAWFAWWGGDVDGDAFLTAYAYYADWYASRALEIQLPAEHWQRILEPYAKQATQTPLLQRALILAFARDMQLPVNTLLGGLLNDLANAGKGQGARGPRWRPTTAWCWATRTRPSAWPRRECWRWTLHGNCGSRCPRRWPPRPRRRRSACVRPACRSPMPCWPLARPWMASRPALCCNAWRRRNRPWNAPWP

SEQ ID NO: 26786 - protein, 179 aa, Pseudomonas aeruginosa
RRRSCRCGWLLGSGGLFALPGIDRFLRRTERIDRRRHPGIDRAVQQCLADFLHRAAVVQRTAHVPLEFLRAFQGGQGGQGDQAAGLARQRLAGPDRAPGMLVDEVLQWLGEGGGVAHGALDEGVAHDFTSDLQAGLALFAHRKVPVVGRRWLNPATLSEPAPRRCGSYPGLRRPCAIHR

SEQ ID NO: 26787 - protein, 560 aa, Pseudomonas aeruginosa
RYAGLRGGCHSRRLRRYPRNRCRRGWSSRRGTGAGRRGRGARRRMGWAWTTGSWRTRRRRANPASGFDSRFELFLQQLVHLLRVGLAFRGLHRLADEEAEHLAALGLVGSAVLLDLLGVGRQHLVEHLLDGATVGDLLQALGLDDLVGGTLAVGHGFEDHLGDLAGDGVVLDAQDHAAQLLGGHRGLLDLQAVLVEQAAQLDHHPVGRQLGVAADALDLLEVVGHLAAGGQHAGIVGGQAVLALEAFALLHRQFRQLLAQLRQVLGLDDHRQQVGTGEVTVVVGFFLAAHGAGLVLVRVVQAGFLDYLAAVLDQLDLALDLVVDRLLDEAEGVDVLDLGAGAEFGLALRSYRDVAVAAQRALGHVAVADAQVAHQGVDRLDVGHGFLGAADVRLGNDLQQRRAGAVQVDAAHALEVFVQALAGVLLQVRAGDADALGGAVFQGDVEMALADDGMVHLAGLVALRQVGVEVVLAGEHVLPVDPCVDRQAEQAGHAYGLLVEHRQGARHGQVDQAGLGIRRGAEGGRAAGEDLRLGGELCVDFQPDHGFPLHVVFLNPSVPA

SEQ ID NO: 26788 - protein, 167 aa, Pseudomonas aeruginosa
CGSSLRCRSLPRASACTGLPGSAGRRNDSHSARRRSATGWRTPRPARSRSRLGWRAACSAGKCPSPWRRASSAPRLRPAPRRRCGCRGRRRSIPAAGRCAGRSAASAGRPGSRPPAVRRWSSPSDRIRPSPPASARSPRRCAPAGRPGRGWKRRRSCPSGKPGRRLA

SEQ ID NO: 26789 - protein, 349 aa, Pseudomonas aeruginosa
GFFPMFKKLRGMFSSDLSIDLGTANTLIYVRERGIVLNEPSVVAIRSHGSQKSVVAVGTEAKRMLGRTPGNIAAIRPMKDGVIADFSVCEKMLQYFINKVHENSFLQPSPRVLICVPCKSTQVERRAIRESALGAGAREVFLIEEPMAAAIGAGLPVEEARGSMVVDIGGGTTEIALISLNGVVYAESVRVGGDRFDEAIVTYVRRNYGSLIGESTAERIKQEIGTAFPGGDVREVDVRGRNLAEGVPRSFTLNSNEVLEALQESLATIVQAVKSALEQSPPELASDIAERGLVLTGGGALLRDLDKLLAQETGLPVIVAEEPLTCVARGGGRALEMMDRHSMDLLSTE

SEQ ID NO: 26790 - protein, 172 aa, Pseudomonas aeruginosa
SRSAGGSPPATARVAQPPRTPGVRTASSPNLSASPGPAPGSPPACRSRVVRGPHPPVVAGRDRAFPAAGCPAPDIRPGPAPATVPRHDDRDCRASRRRSLAARPPGVRPVAAGSASRRCAIRRFVPSADRRALPGSANQAAAAVGTGSRPAADRKRTGECAWRLLQRATISG

SEQ ID NO: 26791 - protein, 148 aa, Pseudomonas aeruginosa
LRPARCLASAAAKASATICTSRSRPLEWGSRPKPTTASTGKAKPSDELCGSTARRCARATPGQSSRPRSSSSTSPSAGSSSPQRAPSKVLLPAPLGPSTPSISPGRSSSSRPSSTVFPPRRMDRFSTRSIRPAPAIADKGRTARRSVP

SEQ ID NO: 26792 - protein, 149 aa, Pseudomonas aeruginosa
TVRSPRRTARSRRSLPATWWPRWSGHRGGQVDRPARSPPGRRRRRTATAGRARGTPASHPARRRIRWPAPRRGPRRWTPRPALDRPAGCGTGPASPPRTAPAPRPRPGRAGSAAGGSGRGSFPPGPGPFHRAAARPGAARRAGYRPAAG

SEQ ID NO: 26793 - protein, 321 aa, Pseudomonas aeruginosa
RDRGRGTTRGPTRAKSPAHRTVRGDEQPISMGGFRTQRFRGRIKGCGESRQAIRQARTEAAHQERRVQHQQSSVTRRAGCGEAGVLLEQRGTRRITFEAAVGDHHRDRIERCQGFHRDRLVTLMGSQVACSGPVQDPIAAGIAPGYQQLTAGVADHQQDARGRLALLRGRDPVRLAPQPLTIVKFGGLGALGHAEPVAELLQIAFQCLQIRLGGEGLDSHAGAFELLEYRRRPHFLGADEDIRTQRQHALGSQLALVADARQLFQRLRMLAGGVHPDQLALAAQRHHPFAQRAARAHPALRQLGGLGHAGAEQDAQRQPVE

SEQ ID NO: 26794 - protein, 335 aa, Pseudomonas aeruginosa
SIDTHDLSSERLEGFGQFAPVVALGLAGLARAEQLHDQFAVGVEGLPAGYDAIGARLAHPPKFGDAGGLQVQVEFRIEHVEPVVQPLQVAHWPGMDLDAVGVADEHHDRQSAFGRRFEEFRQVAIVQALGPFAASQAQRLGALRAMLLQQGVEMMGVLQRGPAFAQGGGIDLRIDERRSRCAGFVQRQHGILLGSPQALDQRLPGADVAGLGKEHLVHRHALLVEHLDAALGTPRCLLGNGEDSVPTPQEQAQVDIRRDHQAHLPIGRDRHFAIRPLAFVDAMLVAGQRHDRPQFAERRQQGGPVRPQAHSIDADPAGDQLAFADLQQRGGVARA

SEQ ID NO: 26795 - protein, 83 aa, Pseudomonas aeruginosa
PTTSPSTTPGTANTPRASARPPPRRCTVDSRTCRRATTSSLTPTSSRKRARASRPGCAASSTKAASAWRCSTTNIATSSTKTP

SEQ ID NO: 26796 - protein, 208 aa, Pseudomonas aeruginosa
GQQTQTAPTSSLRQSVPAQRQPGAAGSASLRHKWIQLTGWVAAGASGMLPAFARSKENPMRRFAPLAVLAATLLHGSLVQAAEPLAIDVHRDANCGCCKDWIKHLEANGFKVTDHVEADMSAVKSRLGVPYSMGSCHTGVIDGKFVEGHVPAADILKLRERADLVGAAVPGMPVGSPGMEMGDRQDAYQVVGLTRSGQASVLAEYPGR

SEQ ID NO: 26797 - protein, 179 aa, Pseudomonas aeruginosa
RPIGCLSSPPSRFSFHFTGKGPCPDATGNSMCSPSVRSPATAWPYSTTPAPSMTPPCRPGPANCASSNRSSCYRATTHGPSAHGSSPWRKNCRSPATRCSAPPPCSITCAAATTNSTGRCTWPANRWPCAACGRAAVSTPRWTRAAPNSAPPRTPGPAAGSPKPSRYRPTTCPGIHRGW

SEQ ID NO: 26798 - protein, 306 aa, Pseudomonas aeruginosa
RSETYRRTAMLWRKGRRSDNVIDARGEGGAGGGGGMRIGGKGLSLGGVAIVVVVGLLMGQDPMQILGSLLGQMDSPAPATQQQAGGRAPAANDEQSEFVRSILGDTEDTWEQIFASGQAQYQQPKLVLFSNGVNSACGFASSATGPFYCPADRRVYLDLEFFREMEQRFSAAGDFAQAYVIAHEVGHHVQNLMGISAKINAARQRGARMEGANGLSVRQELQADCFAGVWANRAQQRLNWLEPGDIEEALNAANAIGDDRLQRQGRGMVVPDSFTHGSSAQRMRWFKTGFESGSPASCDTFKAQTL

SEQ ID NO: 26799 - protein, 480 aa, Pseudomonas aeruginosa
SSWASSTHEPSTVRPQRLRRTTGRQEVPPRRFAGPVRGTRARDLRVAARALPAARRISSVAGNRQREASLRDVRAGRQAHADPDRGFPHRQPPHQRTDAAPEGGLGRPGAGLQAVPGGVSHHPGRRRADHPLLPPADRRRLATGSGKAGGGTGREPGRAFARQAYRRRTRLCGGGTVGRRPALPLPPARGGFHPAQRRGQPEDARLGLRGARPARRRPARTVLRQRQLHPAPGHPGTQGAGHRDQQVLGQCGAGQPGRQRGGQRQPGAPVGRRADPGAERGSPVPPPGRHRPEELRLRQCLRRSATSRHGSGHLRADPALRAHPVHFVQPGNPGAEHRSTARHAPDQPLRAVRPVPLHPPHGKRRPARTPLSEWPRPTARPCLRVAPGGAAPGAILPSSPRRHRPAPRRPLAPPRATPCHRLDRSRRRGAPPRPRKGSRSTAAPRGSPPAPAPPVRAGAWRRAASPRRERPPRRFRRSPG

SEQ ID NO: 26800 - protein, 177 aa, Pseudomonas aeruginosa
VRPLATAGPESRRGNPAADRISESERRPFMSTKAKQQSSQQMTRGFEPYQETKGEEYMSERMRAHFTAILNKWKQELMEEVDRTVHHMQDEAANFPDPADRASQEEEFSLELRARDRERKLIKKIDETLQLIEDEEYGWCDSCGVEIGIRRLEARPTATLCIDCKTLAEIREKQLGS

SEQ ID NO: 26801 - protein, 205 aa, Pseudomonas aeruginosa
GIRRDLPGLLPRRRARPRGCGDPPARAGAGISLRRPRAGRSPPASRPRGRRFRHPAPRWLLRLPTGGGAGRRLAGHHRHRPRRRPARVDPAPALPPGIAGVEPAALPARAADRPAGRAQARQVLPLPATARRAGRRAADPRPARARPAAAGRTGPGQRQRGAGVGRRALGRHAHPALRYPSRGTPVARPAACRHPPAACSLPAQA

SEQ ID NO: 26802 - protein, 148 aa, Pseudomonas aeruginosa
IHGTYSDRRRRNHYPICIATPAGAQPVPGQRSRLGAGSPGALHHPLLRHGGQRPAPAGRPRHRTDQARRRHSGADHDQLRQPAFGGGFDEDGRGGLHRQAFRPRRNAPGRGAHPQGPPGEPQRGPGPPPTAARPAASAAPARRQPTAR

SEQ ID NO: 26803 - protein, 71 aa, Pseudomonas aeruginosa
SNPSCSAMKKAPSPVPAPGAPGWSKRPTAAPCSSTRSANCRWRPRPACCAYCRKARSAGSARCNRRRSTCA

SEQ ID NO: 26804 - protein, 180 aa, Pseudomonas aeruginosa
SRPFVPPCAVRAPSVQPRKSSVTTSTPCAGTSSAGTPSRSSRSSSGPATRPTWSGAAYATRCSASLPRTSMSPPAPRRSRSAPNSATRGSSAAASNWYTCTSAARSSRSPPSAPIIRKARTMAIAARPATKAAASCATTSMAAWKTTPSAVTSPSMPCTSTSPASGCWTTPMAFTTSAIA

SEQ ID NO: 26805 - protein, 473 aa, Pseudomonas aeruginosa
QRFPDRHRPGLRIQPFRGPDPCRRGPPDAGRRTHGQAGGWGLAGGADRPPGTDGRAGLRASRPDPAGGQPVRRLQGPGPPGNPGAPVARRCHRPGAGRRRHAAAGVRAQRAGRRDHPGGEDPGDRDWRRCGDRWPGAGHARHARSLADRPLAQVRQGFHARPGEHPGRHRGLCPRRQGRVLPRRRTRIQRMNTVKTVRELRAAVARARSEGKRIGFVPTMGNLHAGHAALVKKAGERADFVVVSIFVNPLQFGPSEDLDKYPRTLAADQERLLEAGCHLLFTPTVEEMYPDGMDGQTRIHVPGVSEGLCGASRPGHFEGVATVVSKLLNMVQPDLALFGEKDFQQLAVIRKLVRDLNLPVQIFGEPTVRAADGLALSSRNGYLDEQQRAAAPAIYRTLRQLGERIRAGAEDFPALLADARQALEQAGLRPDYLEIREPISLRPGVPGDRQLVILAAAYLGSTRLIDNLSVHLD

SEQ ID NO: 26806 - protein, 146 aa, Pseudomonas aeruginosa
ALTTDSPYSAAPRGPDRSRPMHAIMLKAKLHRAEVTHAVLDYEGSCAIDGDWLDLSEIREYEQIQIYNVDNGERFTTYAIRAENGSKMISVNGAAAHKAKVGDRVIICAYAHYSEAELASHKPRMLYMAPGNQLSHTSEAIPIQVA

SEQ ID NO: 26807 - protein, 158 aa, Pseudomonas aeruginosa
RTPRPHAPGTWPRAAPRKSFTAISSPSPATRKPRSPSASARKTSSPCGTGSAAATRCGRPSACRSPCPSASPTSRNCCPAPTTWTSISRPRRSNATSRCCSACSASGTATSGARTATRSCPTTTICGISPTTCNNWTWNPTARACARTARRSPAAPGR

SEQ ID NO: 26808 - protein, 700 aa, Pseudomonas aeruginosa
AGLFHSVRRLTPAPSPLAPLALEHGSRLAHPWSNLERGRVRSLDTLRSRKTKETAMFEISVHPVPDAVRQRAYLNDDDYQRLYRQSVENPDEFWGEQAKAFLDWFKPWHSVHHGDLRKGQATWFKGGQLNVAYNCIDRHLERRGEQIAIVWEGDNPSESAHITYRKLHHNVCRLANVLKSRGVEKGDRVCIYMPMIPEAAYAMLACARIGAVHSVVFGGFSPDSLRDRILDADCRTVITADEGVRGGKYIPLKQNVEKALKDCPDVSTVVVVERTQGDIPWVEGRDIWYHEALHAASADCPAEAMDAEDPLFILYTSGSTGKPKGVLHTTGGYLLGAAMTHKYVFDYHDGDVYWCTADVGWVTGHSYIVYGPLANGATTLMFEGVPNYPDASRFWQVIDKHQVNIFYTAPTAIRALMREGDAPVRQTSRSSLRLLGSVGEPINPEAWEWYYQVVGEKRCPIVDTWWQTETGSILITPLPGATALKPGSATRPFFGVQPVLLDEKGKEIDGAGSGVLAIKASWPSQIRSVYGDHQRMIDTYFKPYPGYYFSGDGARRDEDGYYWITGRVDDVINVSGHRIGTAEVESALVLHDAVAEAAVVGCPHDVKGQAIYAFVTLMAGSQPSEALQQELLALVGKEIGSFAKPDHLQWAPSLPKTRSGKIMRRILRKIACNELDSLGDTSTLADPGVVQGLIDNRLNR

SEQ ID NO: 26809 - protein, 297 aa, Pseudomonas aeruginosa
RAPHGKRPSPYRKPGAEPYRARRRRCRLRVAERRSGPVRPRCRLLEGPRRLQQHDDRRHRRAAPADAPSAGPGGGVGPLQFPRRPARAPASHRSVHLGHHLRPAGRCRATDRAGPAHPRKRHRPVARRHAPTPPADPDLLTWVHVAEVSSFLKSYLRYLNPDLPGSEQDRYYSEIALVAERLGARAVPRDRQQIAAYLEAMRPRLRCDERTREVVRILFNAPAPSTLARPFGALMLRAGAELLPEWAGSMLDLPFSPLQRRLIRGSVRRSVPLLRWAVRNASMHRACRRMGLPPVSH

SEQ ID NO: 26810 - protein, 1124 aa, Pseudomonas aeruginosa
QREYPSKGSETARITVGTLRPCHTPTHRLERKTKESHAQRTETRCQRPADHLPRLLPAGLSAHTRHRAARRQPATGAIRHRPRTSRTYRIQPLQPGIDPLGSAPGRGEKPQLAFRRLYANLQLDSLWKRQLHLADVELEGPHTELLFDEKGQLNLASLFRIPPSESPEPEQPSDPFPLRIDRIQLAEGSLHFQDLRPSEPVDFSFDPLGFELHNLSTLPDDGAKMTLVATGPNGGRLDWEGDLTLVPITSRGHVSVKDIQLKAWWPYVRDNAPLVLENGVVSLSSDYRLDLSKDTQLLLDKAALKLADFSINSPQGKPLAKLASLDVAATTLDLAKQEVVLGEVRSQGLEAWAAREKDGQLDWQKLFADFTPPPRKAPAPKPAENTDPAAAPTDAAKTTREPATDGAAKAAVIASGEAGKDRPAEKDASVAETERATDDKESAKVAEGAADKVAKQETSKAPKTGKATGQETAKTAEIDKAASDSPQQLADTAKTPPPESTKAAAETPAKPWHIVLRDAQLRGYKAHLVDRQPATEVPLEVGPLDLDLQNVDSLGKTPFDLKLKTGLGNRGQVQASGQVVLDPVSARLKVSTRDIDLRVAQAYISPFIRLELRSGFLGSELAVDLKSVEPLAFSVDGSAEVSQLHTLDTIKDRDFVKWTKLTLNGLAYRHEDSLSIQSVSFEEPYARFIINEDRSTNVSELIIPQPGSSSGKAAAESKNAPASKPLGIHIGGVRINNGSANFADLTLMPPFGTAIQQLSGEVGTLDTRNSQPAKVDIKGKVDKYAPVTIAGELDPFDPLKKLDITTSFKRVELTTLTPYSGKFAGYRIRKGRLNLDLHYQIERSQLKAENKVLLEGLQLGEKVDSPDAVNLPVKLAVALLKDTKGNIDIQLPVAGDLNNPEFSVMPIVWQTLRNLVLRAVQAPFKFIAGLAAGGNEDLGTVPFAAGSDELTPEAQANLDKLADALKERPALRLEVEGVASAAADGPSIGAKRLELEYQNTYYRMLQRRGDKVPSDAKQLEVPENMQAPLLEGIYRTRLKQQPPAEWKELDSDERTAKMREAVIASWAKSQVLLRQIGQARATRIKDYLVEKGQLPDDRIYLIDVSFAEGEDKGNVDTQLHLDSE

SEQ ID NO: 26811 - protein, 202 aa, Pseudomonas aeruginosa
YLAQAIRRPGGPPALPCLRERAGRHHALRQCAGQRRRPGLRSTAKVRRSGSPRRRRLYPGQLRSAGIQGRGVGVRPAQRRDLHPDLRSQQAETHRVQALNRSLPRTGLVALLSLLPLAHAQADSLRCGSRLVSTGDSSADVLARCGEPRSRDSLGYREVVGEWGKRYEVEVQEWVYGPWNGMLYFVRFEGNRLSAIQSRRGD

SEQ ID NO: 26812 - protein, 174 aa, Pseudomonas aeruginosa
IFTLPSSSMSIEALVSSQIPRMVAPPLPMTSRILSESIFICSMVGAFSDSSARGLAMTWFIWPRMFRRASRAWPRAISMISSVIPLILMSICRAVTPLSVPATLKSMSPRWSSSPRMSVRTANFSPSLTRPMAIPATGALTGTPASISAREAPHTEAIELEPLDSVISETTRMV

SEQ ID NO: 26813 - protein, 218 aa, Pseudomonas aeruginosa
PISGWKPTRAAPIGPANGMPEIARAAEVPIIAAMSGSDFLLVETTVQTTCTSFMKPSGNSGRIGRSIRREVRVSLLGRTSFTLEETAGDTACGVGLFLVVHGQREEVAAFGRRLGADHGDQHADVVHGDQYGAGGLASNTAGLESDGRLTELELLGYRVHGVFTFYVALGEIGGMPGVGPESIPRKREAGSPTPIPASCAGIDARLPAPCFKLPTGVA

SEQ ID NO: 26814 - protein, 1554 aa, Pseudomonas aeruginosa
WSGGYASPGPRSVLGLVAVAAAVFGHRTFDQRGQLGAAADAFVVVEMQLRHAAQLHRLAQQHAQVAGGVVEDFHVQGDLAGIVLAHDGDEHLGVRHVAADLDTGDGDQAQARVLDLALDQLSQFALHLIADTLGTAVVFCHFSTCLQRHPATGKKSDKRPGQLEAGPGAVVTHSPSKAACDFDLLEHFDLVADLDVVVALHADAALHAGTHFGDVVLEATERLQLAFEDDHIVAQHADRTVAVHHALGDHAAGDRAELRRAEHVAHLGDAQDVLPQIAAEHAGQGLLDVLDDVVDHVVVTHIQTFGFDDLARAGVGAHVEAEQHRVGSQRQVGVGLGDATDAATDHADLHFVVAQAAERALQSLERTAHIGLEDDVQGLLLFLAHVLEDVFQLAGMGTRQFHLTELALTEQGDFAGLLLVGDHGHLVTGIRRTVQAEDLDRDRRAGFLDRLAVLVEHGADTTVVDADQHHVALAQGTVLDQHGGHRAASLVQARLDHHATARGRRSGFQFEHFRLQQDRFEQFIDASTELRRNRDEGSVAAPLFRDHVESGQAVLDVVRVGLGLVDLVHRDHDRHARRFRVLHGFLGLRHDAVVGRDHQDHDIGRLGATGTHRGERGVAGGIQEGHHATLGFDVVGTDMLGDATGLARGDLGATDVVEQRGLAVVDVAHDGDDRRAGDRLAFELQGLGQLFFQRVLADQLDLVAQLFGDQLGGLLVQDLVDGHRGAHLEHELDDFGALDRHLGGQLGYGDGLTDVHFTHDRSCRVLEPVLVALLQLRLATTTAATVTIAFLVGAAWSHARSRNLFLLLDRGTVLGVLAVAAVIVLVTLGRAARLFLLAFFHGGRLGHRFGSRDIRHHGRLGTGSSRCFLGSLGTRSFLGLARFLFGTLAGSGLFGLQTLRLFRRALLLEFALALGLDLVGAALDIGFLLANFDAHRLAATHFQRGSGLALQGDLARLAGAIAMAAFQVGQQGLLLAIRYNLFGTGVRQTCVTHLQQQALHRCVDHLGQFFHRDLRHALLSSGRDCLLEPMGPGGHDQLAGTLFVHAVDVEQIVDRLLGQIFTGGYATQRQVQGQLLAHAIEAEQVFCRLCVGELLFGRNGLGQQAILGTGAQLVDDVFVEAIDAEHLFHRYVGDFLKSREALFHQYLGQFLVDIQLVDEALQDIPGLGLLLGLDIRLGHHIQGPAGQLAGQTDVLATAADSLRQIVLGDGDIHGMGILVDDDRRHLGRSHGVDHELRRVVVPQDDIHPLSTDLAGYRLDPRTAHADAGALRVDAFVLGTNGDLGARARVTGGCHHVDQLLGDFRHFDAEQLDQHFRRGTRQDQLRTAVLGPDLLQQGTHAGANAEGLARNDLVAGQQRLGVVAEIDDDVVAGDLLHGTGNDLADLLAVGIDHLGALGLADLLHDDLLGSLRSDAAELDGFDLFFDDLANLRARLLLLDVLDGDLGGGVLVVLVGDDVPTTESLVAAVMTIDLDAQVDLVLETFLGGGRQSQLQRLENHAGRYALFVGYRLNNQQYFFAHCTPRLSIHWIRGFASQSKRGMMLALSIESIGSRYS

SEQ ID NO: 26815 - protein, 461 aa, Pseudomonas aeruginosa
RNLGFRKQLPKHLHRKKPLHPHPCHAERGSGQQDPMPSAGARQLRPFPASSASRGTTDRAELIRIEGGSTYQPPIDIRHAEQLGCTCRLYTAAVKESHTFCDLGIFRCQLRADRRVHFLGLRGGRGQPGPDRPDRLVSHDCASKSSNTQLVDHASQLPCDNLQRLARLALRPGLPDTQHRHQAARLSRGKLATHNLVTLAENQATLRVAHEDHATTDIRQLTGSSLTGQRALHRLDGAVLRTYIDRLAGQALDDLADEQARRHHSYIDSARQRQLTQAFDQLGHTGMRTVHFPVTGHQGSTHAVPRGAKWAQMLLNSFQTGKQNQAHTSETIFASCSAWARTLASSSPSTITRTNGSVPDLRSRTRPRPPICSVTRTLASFTEGCSSGSFSPLKRTLISTWGHLRIPWRASARVWPRCLSAISTCSAAMMASPVVVFWQQTICPEFSPPSIQFRASSSAIT

SEQ ID NO: 26816 - protein, 896 aa, Pseudomonas aeruginosa
AAVEAFVHLPPQYLADHALARNADQQRQAQAMECLQMPEQHQVVLQCLGKTETRIQQQPLAVDSGRHAGIHTLLQERADFRHHILVGRRILHGLRFSTHVHEADRQAAIHRSIQRTVALQRTDVVDQTRSETRSFAHDRGRGGIHRNHDVQLASDAFDYRSDPLQLLRRRNAARTGTGRLAADVDERCAFPHHALGMPQGIVQPVVTAAIGKGIGGDIEDAHDMWAGQIKNPTAARQSGRVLRIAHSGLSVLAGRPTDGRGILAAARLFQVGRRGAGTRTTLPVTRLARHATGHDVVDLVGVDGFVLHQCVGHHLQLVAVLVEQSLGGTVAVVDDAPDFLVDHLGGLARHIGVLAAGATAEEHLALLLRVHQRAELLGQTPLGHHVPRQLGSTHDVVGSASGDAFEAEGHLFRDTAAEQRADLAFQRALGQAVAIFLGEEHGHAQGASARNDGHLVDRVMLRHQATDDGVAGFVVGGVALLLLGHDHGLALGAHHDLVLGQLELAHVDDALVGARGEQRGLVDQVGQVGAGETGRTAGDDGRIDMVAQRHLTHVHLEDLFAPADIRQADHHLAVEAARTQQRRVQNVRTVGGSDDDDAIVHLEAIHLHQQLVEGLLALVVTTAQAGAAMAADGVDLVDEDDARRMLLGLVEHVADTGSAHADEHLDEVGTGNGEERHLGFAGDGLGQQGLAGAGRADHQHAARDTAAQALELARIAKELDQLADLLLGLVAAGDVSEGGLDLVLGQQARLALAEAHRAAATAAATLHLAHEEHEDGDDHQDREAGDQQLGPDALLFGLLALDHDVVVDQVADQAVVLDRRADGLEGIAVATLAGDDIAIHGHSLDLAILDLLDEVRVVQRLWLARAREIVHHGHQYRRDDQPQNQILCHVVQLTTL

SEQ ID NO: 26817 - protein, 143 aa, Pseudomonas aeruginosa
ALAKASAKLSPTPITSPVDFISGPRIGSTPGNLANGNTASLTLKNGGMISWVKPTSARVLPAMTRAATLASDSPTHLETNGTVREARGLTSMTKISSPCTAICTFIRPTTPSSRAIFLTCSRISSWMCCGSEYGGSEQAESPE

SEQ ID NO: 26818 - protein, 171 aa, Pseudomonas aeruginosa
TGSTFSLWRWLRRFFSVTPSSLARRASEKPLRLSLYISSRSMEDRPRVLTFSSSLTRSSICTRNHSSMRVSSNTSSTLLPARKASATYQTRSALGTVSSRLRMLSASGSFRSSFGSKPVAPTSRPRKAFCTDSWKVRPMAMTSPTDFIWVVRRASAFGNFSKAKRGILVTT

SEQ ID NO: 26819 - protein, 146 aa, Pseudomonas aeruginosa
PTASLAAILAIGKPVALEARAEERETRGFISITTMRPVFGQMPNCTLEPPVSTPISRNTASEALRMIWYSLSVRVCAGATVIESPVCTPIGSKFSMEQTMMQLSFLSRTTSISYSFQPISDSSINSSLVGDRSRPRAQISSNSSRL

SEQ ID NO: 26820 - protein, 271 aa, Pseudomonas aeruginosa
SGQGCGGQLHTKADEQGADARSGAGSQPLPPAEPGRQPHTGENQEAQVKGADQFQDHRQHQERQPRIGIAGIDELDEEGDEEQDRLGIRQAEQQRLAERLVDIHLFGLRRRRLGIAQLAPGAPQHADAEIEQVGRTEVLQADEQHRLGLQQGGHTEGRQQHQHRVSEEHAAGGPVAGRHATLGRSREDEQRVRSGQQDHENHTQHVGPEIGYPQGRHGSAPQRRSAIAEMKRSNSGATSCGPGLASGWPWKLKATLSVRSIPCRVPSNSDL

SEQ ID NO: 26821 - protein, 419 aa, Pseudomonas aeruginosa
VVEETLHAFEPATGLGRMRGVALQRLAELLEQLALALVQVHRGFHHHLAHQVAGAAAAHRGHALAAQAEQLAGLGAFRNLQLDPAIQGRHFQLAAQRSVGETDRHFAVQMLAVALEDRVLAHIDHHVQVARRTTHAAGLAFAGEADAVAGVDAGRHLHRQGLLLFHAPLAMAGATGIGNHLAGAVAARAGLLDREEALLHAHLADTAASGAGDRCGTGLGAAAVAGLATDQGRHADGDGGATYRLLQVEVQGVAQVRAALRAAARATAGTAATEEIAEHIAEDVGEARPAETGASAPTHIRIDAGMAVLVVGRPLAGIGEDLVGLVGLLELVLGFLVARIAVRVIFHRQAAVGLLQVRLAGATLNPQNLVKVSFRHNLSVSIKDPPDTPTREQAPAWRIMRTGLAGTRGRSKPGLTCCP

SEQ ID NO: 26822 - protein, 135 aa, Pseudomonas aeruginosa
SRWTAACRWPCPSPRRAGCRWHRYRRSPRSAARRAEPAECRPGRTCPATCSARPACARPAARGWSPRPGCRRRWRTPATSWSGWWCSSRSDRSSRRPGSRCRGSAGSRRAAARPSRRRPGPRPGWRHRQPRLRPG

SEQ ID NO: 26823 - protein, 226 aa, Pseudomonas aeruginosa
FCPYSLSRNFDSVRPARGSRARLTTQMGSSRRISSLLVDGRRGFRRRLADYHHRRTQQAAVEQVAFLEHLEDTARLGRSAFLHGHRLVLLGVERLAFRVQRLHLVAAQGVVEHLQGQFHPFAHRLDRLVVGIGHLQAALEGVDHRQQVAGEFLQRELVRLLDILLRTPAYVLQIRDHAQRLVLGGSQLLLQFLHAGGQVLGGAGGLLGGLLIQGLLFVSHATLLQK

SEQ ID NO: 26824 - protein, 191 aa, Pseudomonas aeruginosa
SGFYLPSQDSGSRSPMQNAKLMLTCLAFAGLAALAGCSFPGVYKIDIQQGNVVTQDMIDQLRPGMTRRQVRFIMGNPLIVDTFHANRWDYLYSIQPGGGRRQQERVSLFFNDSDQLAGLNGDFMPGVSRDEAILGKEGSTTVTQPADQQKPEAQKEEPPKPGSTLEQLQREVDEAQPVPVPTPEPLDPSPQ

SEQ ID NO: 26825 - protein, 607 aa, Pseudomonas aeruginosa
ALAFVNWSYQLCELCQVRLPSALAHTGLGACPIWSQANPTTIREPTPMQAWQQLYTPLGSLGLSAAAAVIPIVFFFLALAVFRLKGHIAGSITLALAIAVAIFAFHMPADMAFAAAGYGFLYGLWPIAWIIVAAVFLYKLTVKSGQFEVIRSSVLSITGDQRLQVLLIGFSFGAFLEGAAGFGAPVAITAALLVGLGFNPLYAAGLCLIANTAPVAFGALGIPIIVAGQVTGIDAFKIGAMTGRQLPFLSILVPFWLVFMMDGWRGIRETWPAAIVAGGSFAITQYLTSNFIGPELPDITSALVSLVSLTLFLKVWQPQGASEALAAGGGAAVAGGSFGGQRSVEPSAYSFGEILKAWSPFLVLTVLVTIWTLKPFKALFAPGGELYWLVFNFAIPHLDQLVVKGAPIATSATPIAAVFKFDPISATGTAIFLSALVSMFILRIGVKIGITTFKEVLVELKWPILSIGMVLAFAFVTNYSGMSTTLALVLAGTGAAFPFFSPFLGWLGVFLTGSDTSSNALFSSLQSTTAHQIGVSDTLLVAANTSGGVTGKMISPQSIAVACAATGMVGKESDLFRFTLKHSLIFAALVGLITLAQAYLFTGMLVH

SEQ ID NO: 26826 - protein, 314 aa, Pseudomonas aeruginosa
PRPDRPRVGDTAQEMARGGSPTIVGPAPLAISAVSRSTALDAKPFDTTEEPNDHFRFHRLPRRRPTQAAAVPLPLHRRRRLRRVHPAPQRRGPVGHRPASAGAEEHVRAEPGNPPVRRDPSDAGGARPGRSHRHVCPPRRGPGGARGGGEGRALHPVDGIGVPDRGGRPGHRPADVVPALRAEGPRLHAQRPGAGQGRRRHHPGVHRRHAGPRRPLPRRPFRHERPLRRAAPHPASHDPPGLGLGRRPAGQAPRPRQHFRLPRQPDRTGGLHRLAGRQLRPVDFLEGPGVDPRVLGRPDGDQGHPRPGGCQGMR

SEQ ID NO: 26827 - protein, 729 aa, Pseudomonas aeruginosa
PSSQGRGKPMSLPIPFLETVERLIPRERRFDDPLSTLAFGTDASFYRLIPKLVLRVESEDEVAAILSAAYREQVPVTFRAAGTSLSGQAISDSVLLVLGDNWNGREIRADGAQIRLQPGVIGAQANAWLAPFGRKIGPDPASINACKIGGIVANNASGMCCGTAQNSYHTLAGLRLLLADGTRLDSEDPASVAAFRASHGELLERLAELGRETRANAELAAKIRHKYRLKNTTGLSLNALVDYDEPLDILTHLMVGSEGTLGFISAVTYDTVPEHPHKASALLVFPTVETCCTAVAVLKRQPVIGGGLFDRRSMRSVENMQGMPEWVKSLSAGACALLIESRAASRTLLHEQLGRIMASIAEYPLEKQVDFSEDPAVYNQLWRIRKDTFPAVGAVRETGTTVIIEDVTFPVERLAEGVNRLIELFDKHRYDEAILFGHALEGNLHFVFTQGFDSPEQIARYSAFMDDVAHLVAVEYGGSLKAEHGTGRNMAPFVELEWGEDAYRLMWQLKRLLDPRGILNPGVVLSDDPQSHLKNLKPLPAADEIVDKCIECGFCEPVCPSRGLTLTPRQRIVLWRDIQAKKRAGVDTTALERDYRYQGIDTCAATGLCAQRCPVNINTGELIRKLRGADARHAGGATWLARNFAGAMRAARFALLAADGARRLLGAPLLASASRGLSQASGGRVPQWTPALPQPVRLAPPPAPLDDERPRVVYLAACVSRAMGPAFGD

SEQ ID NO: 26828 - protein, 216 aa, Pseudomonas aeruginosa
REPLLDKTRRLLEKAGYQVVFPDNLDNLCCGQPFASKGYAKQADDKRDELLAALLQASRGGLDPIYCDTSPCTLRLVQGLDDPRLQIHDPVKFIRSHLLDRLEFIPQDKPVAVHVTCSTQHLGESQALIDLVGRCTREVVIPEGIHCCGFAGDKGFTTPELNAHSLRNLKDAVQFCKEGVSTSRTCDIGLSEHGGIDYRGVVYLVDRVTQAKGTPR

SEQ ID NO: 26829 - protein, 216 aa, Pseudomonas aeruginosa
RRWRCSPYVRRNGCSGVVGPRRVGQKSVVKHLLSQPRLSCLPPRGHPSPKRKQEAFMAIQPLRLDPITVLGKQLVIELFDCVDQRFDDIQWIEESMLEAARQANATIITSAFHKFSPIGISGVVVIAESHLAIHTWPEYGYAAVDVFTCGDVLDGAQAVRVLSERLGSRRHLISSMDRGLGGHRLGLLSRSLAGNGPVDEDSPTLRWALGQGTGVA

SEQ ID NO: 26830 - protein, 361 aa, Pseudomonas aeruginosa
ARPVTPSTSPAWCRRRSPPGLPPLPPNHFYFYPPDPLLEGDGAITAIEDSDPFDQYVYRLRRVLYQGRTRWQNVLIADTYNYDRVLMLDGAIQSAESDESLYHELLVQPAMLAHDEPRDVLIIGGGEGATLREVLSHASVRRAVMVDLDRELVELCREHLFQWHQGAFDDPRCELLAEDGRAYLERDPSLYDVVIIDVVDMLDNGPAQALYTRQFYELLHSRLRPGGVVAVQGLEFSHSDDKPHAALARTLRSVFSQVHSYRATVPSFLSSWGFLLASDWLDTNHWQAEDIDRRIERKLGPLWLDHLDGDYLKACFVMDRETRFLLAQPGPVLEDGVPFVAPPDIEEIEFGPAQLPALART

SEQ ID NO: 26831 - protein, 225 aa, Pseudomonas aeruginosa
NEAAMRILLAEDDLLLGDGIRAGLRLEGDTVEWVTDGVAAENALVTDEFDLLVLDIGLPRRSGLDILRNLRHQGRLTPVLLLTARDKVADRVAGLDSGADDYLTKPFDLDELQARVRALTRRTTGRALPQLVHGELRLDPATHQVTLSGQAVELAPREYALLRLLLENSGKVLSRNQLEQSLYGWSGDVESNAIEVHVHHLRRKLGNQLIRTVRGIGYGIDQPAP

SEQ ID NO: 26832 - protein, 154 aa, Pseudomonas aeruginosa
VRCFPPPPVPAAASPRPAPRRCRRSAGQPRRKRRPRRRRPPPAVGRIHCRRRPGSAAPPRHAPAAAGRRAGWSVHRSGRPGRRSAPPGESARPQGLPESPGHPSVRDDCRRSAGRSGGIRKAGRAAARRWPGRRARRGYGPVAGRCRRRPVARG

SEQ ID NO: 26833 - protein, 428 aa, Pseudomonas aeruginosa
RRWRRLLHVRSGARGDRSGRQAETQWRILGLGAVLALAEGPALDGVLAEILLDRRLDGLAAGAHVTGATAKEHQDHTDDQRFHLRTPVSPAHPGAAPQHGAARLRDRLRHSGSGAAGAPLGQADEHHGADDHQHRQPLDTADPLAGEQGAEQHRHRRIDVGIAGGRRRPYVAQQVLVGAEGDDRAEQDQVHQRQPAAGARPMLQALAAGQAADQQHRAADQHFRGAGHRSGRQRQAPAPHRAEGPGRGGEQDQAGAGRAGLEVRTEVEQDDAEQPEHDAAPFQRGVALAEQLAEQQGEQRHRSHRKGRHPGRHAPVLGHRHPAVAATEQEDSDDPRAAPLAPGRQRRAAPAQPGEHQAAGDDEAHPGHQHRRPGLDAEADRQVSGAPDEVQGEERTEKQQRKATGRHGKHSTGQAGERLHFMRSLPAG

SEQ ID NO: 26834 - protein, 226 aa, Pseudomonas aeruginosa
GTAAGYRDVTLFFPWKSAMLSGRFDNRGPIMDKYDRALLAALIDNGRLTFAELARRINLSPPAVADRVAKLEAERGDHRLPRLGEPGQARPAHRVRDRTADHREGLPVGARRTGPDPPTDPLPPDHRRRLRADEGRRGFDAGAAGPDRPADEVRHQQDLDDPLHPLRRPPAGKPAGAGRQWRMCGVSPTPGLSGRRRDPYFIAATNPNGRAHNANGVIRRSGTPGR

SEQ ID NO: 26835 - protein, 394 aa, Pseudomonas aeruginosa
AALDVELAAVDGAQRLVEAEAGLAVLGVFPGLQGAEHLGGEGLVDLVVVEVLQAQAVACQQPRHRVDRRHQQALLAIDEVHRRRLAVLEIGQDRQAARLRPLLAGQQYHRGAVGQRRRVGRREGAARTALEHRLEGADLLQVDIRAQFLVAGQAAERRHQVVLPALLIGRGQLVVALEGQPVLLVAGDLPGLRHQFAGLPHRQPGARLAVARDGRDHVARADLQQALELVQVALAAVGLEENLAQALVDPDRRVGSGIDAAGDAAVDLPEGDLVGHQDRRLQAGTAGLLDIVGRGFRGQARTEHAFAGQVEVARMLQHGAGHHLAKALSVQVVALHQAFQGGSEHLLVARRGVHGVRAGEGNTVAADNGDPAQLGHGRTPCWNRLRRAEARPVN

SEQ ID NO: 26836 - protein, 388 aa, Pseudomonas aeruginosa
PTRCSPPSRDSSSCRAGPPKHSPRAKAVLFDASGLTRFEQLVALRDFFQPVLKGLDTCPKVVVLGRAPESLKDPVAASVQRSLEGFTRSLGKEIRRGGNVQLLYVGKGAEDQLEGALRFFLSPKSAYVSGQVIRLAANSAQVHDWSKPLAGQRALVTGAARGIGAAIAETLARDGAEVVLLDVPPAREALEGLAARLGGRAVALDICAADAGQQLVDALPEGVDIVVHNAGITRDKTLAKMSSDFWNSVINVNLNAPQVLTQALLDGGKLHDNGRVVLLASISGIAGNLGQSNYAVSKAGLIGLAQAWAPALGKRGITINAVAPGFIETQMTAAIPLTIREAGRRMNSMSQGGLPQDVAETVAWFAQPSSGAVSGQVLRVCGQSLLGA

SEQ ID NO: 26837 - protein, 116 aa, Pseudomonas aeruginosa
SAPRPSPGVRADVGPACRGARRPAPGWRLRPPATRRSVRGPGAPGPGAPPRPVAGAPATRACAAVPGRRGARVCPAPRHRIPARSAACRGSSGSRRPHGSAPSARRFRSSVALPAA

SEQ ID NO: 26838 - protein, 133 aa, Pseudomonas aeruginosa
SPAIRPATAPRARPPPPVAPAGCRTAGVRSAGNGAGRRRRYRWRGTGIPGAGRGTPAGARPGAGRHALRRTRRRRPSRTGSVRNGGNGRPAGHPVAARHGPGPGPDRSRWRAGRRSPGASALHRRSDHAWCFF

SEQ ID NO: 26839 - protein, 722 aa, Pseudomonas aeruginosa
PIPHDGKTLRSTSRRRGRKSRCRRIPEPIDRPASGVGQAANACCGCSTKLTATYFEEMSNAHRLARPARPTRPARPVPARRTAPRHPRQGPARARPAQPGHGGPEAPRALPPGLRLPRRRPAAADLPAHPRLPAADGAAHRQALPLPAARPGPPGEPHRRAARARRPRPVHRERRGGKPATARQGRHLQHRHPPGRPAWPALGRRQQGALPRRQGARRNSAESRAGAAAAGAGRQLEGARRHRPALCPCRRRLQPDPPVGAQRQAVRLSPRHRPRPVEQGSQPGRPRRATASLGLSGRGALPEAGAAAGQPHPPGQRGGGGRPVQPARQGRPAAHGRALEPATGLTPVRHALKLRAQSPKLCGCLPPPRRIPHGPARTHRAPARHPRPQRLAPIPQPEEPGHGRQRRDGRTGGDLPVADGRPVAHAVGRAARTRWPGSWRHRPLSAAVLRGNRPRPGTGGARQAGRLRTALPAMSDRHFDELATRFAEKIYGGAKGAIRLAVLQADLAEALPERPLRVLDIGAGLGHMSLWLAARGHRVTLAEPAQPMLDGARQRFAEAGQAAEFIQAPWQELLGQFTEPYDLVLCHAVLEWLAEPHAILPVLHQLCAPGGWLSLAFYNRDALIYRNLLKGHFRKLRKQRFAGEGQSLTPQRPLDPRELEQALAARWRIEARSGVRVFHDYMPSEFQAKAERLDLVEMELAYRRHPAFAGLGRYLHWLCRPQ

SEQ ID NO: 26840 - protein, 141 aa, Pseudomonas aeruginosa
SCRYSPAWPPSVPARATIPTAPALCPTRRSRPPRPIPASIPAPIRRRRATTPATVAGAGPPPGSAAFPRAWTTTSCATPSASSSTSAACARRGRAARPTCRSARSCAANCAPARSPTTTAATTATTAAGAIPGTAMAPATR

SEQ ID NO: 26841 - protein, 339 aa, Pseudomonas aeruginosa
TYSRRSSAPARPGSTGRPRRRPGSGPPGQRGDRAPDGHRRSTAPTTIARRRRCPAPCGSPAGCSPGSPRCRRDGPPAAGPGHPPVPPSVPRRSRSATGPAAGSQYFDSFHSPVAPYRAGARQRYLWRRFKPAFPLAFHPALSLDVNSDWRKTMIRRILLLGLLLSLAACETTQLDRDFDSSRDFAAYRSWSWSQPAFEYRPDDPRIKSDLTEQRIREAVAQQLDQRGLRPAQGNARGDVTVRAYLIVDDRQDQITTNYGGGYWGGYWGGYWGGPAMAETRTVNYKVATLQVDLFDGKDGKLVWRGSGEQIMRTSPPSPAEREQAIRETVQKVMSQYPPR

SEQ ID NO: 26842 - protein, 266 aa, Pseudomonas aeruginosa
RRWRYSPYPSSPSPPISRISPESAMSSPQPPRFDGQRWSNADDDRIEVLPADPAWPQHFAAEAEAIRTALALPGLGIEHVGSTAVPGLDAKPIIDILLLPPPGHDPQRLVAPLEGLGYQFWRENPNTQRMFFVKGMPPFGHGRTHHVHVMPLAQADRYLLFRDWLRNHPDDARLYAETKHALARRYPTDREAYTRGKDEVVARIFGRALAATRHPMIQSGLVRGEREMHARELRETLVAGAELTPGGPADTAYFESLRSRVSKPQD

SEQ ID NO: 26843 - protein, 554 aa, Pseudomonas aeruginosa
RASLTTATVRARLPPTFRSPPPPSPARQPPPSANARTADPRAGRCICGGCLRRWSMTRAGSNPWSRTPSAAIHGCRGTGGCAAGPGPGCGEGPGRTPSSARNSAIPRGWRGPRATRGRRCSCRRRPSAAPSSPAPRRARSVRGARLASRGPSRVGRVRHAYNPAWRPARRRRLSSRPRWCRPPPHAAARLARPRRRSCLDRDQRVAHRDRQRSVLVEVVEFLAVRVRVLLEVTQAQAGAEQPAEDVAERVDVPVAGDAGIAAAAFVDDGLPGYVGRVGEVVVAQFERSLRLGFEHLQERVGLIDRQLPARLQQAAHRGEEARDVGHPVEHTDGDQQQVELTVQLGRQLVGIGFDETRLMRRALGQLPRLGEEGGGLVDPHRPRDAEGVQRKHFPAVVAADLDRRLAGQVQIAQHASQGLVQATEAGFLYRQRQFLPAAATQVTVGGRVPGASVAFHRVFKIRHAKTSEVFPGRPAESRTRSPLNRGIAARYGLGSRVVPGCLPGKRRRRGFSEAASVPPRSPAPRSPVGAARRVAAPDAGRSGCRPRLAGCAGA

SEQ ID NO: 26844 - protein, 665 aa, Pseudomonas aeruginosa
HPGPPAEAEGAAHPVVDAAVGGEGGAQLGGHHGHRQEQQDQHVEPPEQARRTEGGSQGDLVHEEHRRDRVEHHIAQPQDLVLVVVHWGSPECSGGAPAAPRRLPVTGADKILHGFLDALAQHPDHGIDLFAGEDQRRRHHVQVDDRTNQQAALLRPQVDPLADVQAFRKQRLARLVGDELDTGHEAHPAHVADDGQVAETLQALLEVAADLVGVGEQALALDDLDVLQRRRAGHRVAGVGETMAEAAALVRLGDHLPDAPGEDARAQRLVAGGEALGGEDDVRLYAEHRLAGEEVAEAAEGGHHFVGDVQHVVALAQIPHPPVVARGRDDHAAGAEHRLGDERPHPVGAQFEDLAFELLHQAIEELGLAHSFRSAVVVGTGKVVDALVEEVELGRPVGALAAQRHAEEGRAVVGVDPRDDVLLGALAAAVLVVVHEADRGVHGGGTAGGEEHVVEVAGGQLGELAAEFDGARVGHVAEGIGIGQQAGLLGHGASHFLAPQADVGAPHAAHRVEVAVAGGVVDIGAVAGGDVQRAVDAVVVEHVVAVHVVGLVGTDQVGVAEGGRGVHSCVHRAVALLGWMLRGCKSTARRAIPHFGVSAGCGRRGLLSCGDNDKNEPYRPCRPSPRTRSTAGTNTWRWRSGACANPTSSPRWSTPSTNWCRSSRA

SEQ ID NO: 26845 - protein, 182 aa, Pseudomonas aeruginosa
SAWNARATRPPCSTSAASPSASARRSSAATSPAATCSTLSAWRWMNAFRNASTPSARSPPTTSSRAPTTRPTTSAPERWRTSTTSSTSAPPRSSRSVSTTAFRRAATATPRSPSSPAWRRRCWSWPGSSAPGAPTSRRTRRPTSPRAFRKCCAASVATCSPTANARPATCCSAATRRNPARG

SEQ ID NO: 26846 - protein, 327 aa, Pseudomonas aeruginosa
SCARRAGVRRLRAGAAPSSTRPPPRVRCADWSRSTRRSPCRAWIGAFSTSWAKARWPGSSCSPSSRARRPVTSWVPRCRCTGVQWVKSRSSSGNRRKSMSTRVVGACSAACSSQSPRWICSSARRSPAMFKATRWPAQACCAGRFCACRPRTRTGRPALPRSSSSPTATCPEKAVPVTTMPLPATLKARSTARRKYPSRLRSRTSPASPPSASRNASTPSPVLLESGKIGERASGPEASRCSTWVRTCCTRCGSTRSILVSATSARRIPSSSTIARCSRVCGIKPSSAATTSSTQSMPLAPASMLWTKRSWPGTSMKPVGLPSPRSA

SEQ ID NO: 26847 - protein, 283 aa, Pseudomonas aeruginosa
PTSMVIPRWRSAGRRSPSMPVRARSSEVLPWSMCPAVPTITTARSAVAATGRGTPARRRAGADRARGRRPRADRSPAAAARAGLPRGCAGRVRAGAWAAADAGTARRWAAAPPAARRCRSCPGASTTATSQPSPSASPSAGARRSAWARISAAGRLSRRRVVRRSARRSGSRYRPSTASRAARVSLSTRRARLSGFFLIRPISSRLPRISPAWGPPSNLSPLKVTMSAPSARASCTVGSLGKPQRVRSTRVPLPRSSSSGRPWPWAMAASCAVGTLAVKPWTL

SEQ ID NO: 26848 - protein, 65 aa, Pseudomonas aeruginosa
RWCRGAAAALRSRRSTEGKRTELMEKPYPQGRVTDTPIIDASAHARSAFGYSPPGASNRFGERRR

SEQ ID NO: 26849 - protein, 1127 aa, Pseudomonas aeruginosa
NASPSTSRPSGPWGCRRCRGCGRPRRAARSIPSRRPGRPCNRCTWTRRSVSPLPPGSAPRASAWWSRSGRGCPDYSCFTSRLFHVDQERLELRRLGIPVAHEGGQGIGQEAVARHAGEAPVDRDADVVHGLAVHLQRADALGHHRHRLDVAAVGGDLDLVAGIDAQLLGQRLADLDELLGLGDRIQPAVLGPVVEVLGEPVGGRRVGELVGRAEQFHVVLEHPCRRVADRLAVVAVQGVHPDRRLERLVVLGERAFGHLVDGEQASHPFGVHDERVHPGFRRYVGLVVGHVGAAPGLAVPPHQALLLRVPRLAADVGRGAVVENPPVRRPGPGPAEGLAHAVGVAVVAAAHLVALLGPGAGEDPAAARRAAVVAQQGETRQLLAGLGQDHAVGRVDQVAQGLAVELPGQFVRARFVGLEVGPVEAEDRVGEGPAVLAVHLAQAVEQPGHDGDVRTRLARRLGALPVPLQPAAAVDDRAVFLGEAGGGQAEHRGLDAGGVDVVVLADVAPELRGLGHQRVHHHHPLQARQRGADLGLVGERGDGVEALAEVTVDLALVHHVEVAQHVVAGARHVELGQPVVAPVVFLGRRLAEPGLHQADVELAVVLPVGQLSRAQRLGRALGDVGVVVLLGVHRQGQVARQRVGQQAEVSQALDVGVAAQGVHAAAGHADVAQQQLDHRAGADHLRAYRVLGPAQGVHDGHDLARLGGLGDFRPDLEHHVLRRTADVAHHVRGVAAVVLLEQVEHAARVGQGRVDLGIAVLTDLVAPGGLVRVGPLLGVVAVEQAVLEAEAFLHDERDIGVVAHVFVLDLVVFQQVVDQAAEEGDVGAGPDRRVVVGDRGGTGETRIDHQQPRLVVRLGFGDPFESARVGFGGVAAHDQHQIGILDVGPVVGHGSTAKRRGKTCHRRAVSDTRLVVESQDAEGAHHLVGDVAGLVGRGGRGEEAGGQPAVDGLALLVLLDEVGVAVFLHQLGDALEGFVPLDALPLAGAGLAHFRILQAVRAVDVVQQAGAFRAEGAAVDRMVGVALDMDDVLRDVLGAVALAVHDQAATDRTVGTGVAGLDRVRQLEVADLVGEGLRGGHPERRKARSSKAYTADLEELPTVHIHRASPASGKGHPGHGRMSLVKR

SEQ ID NO: 26850 - protein, 690 aa, Pseudomonas aeruginosa
SVPGYRNRAMRNPYPPVAAAPYPHLLAPLDLGFTRLRNRVVMGSMHTGLEDRLWDFGKLAAYYRERARGGVGLIVTGGFAPCREGWLLPFGSSLTSALEVPAHRRLTQAVHAEGGKILLQILHAGRYGYHPMAVSASPWKSPISWFTPRELSERGIRKTIRAFVRCARLAKAAAYDGVEVMGSEGYLLNQFLCPRTNRRDDQWGGPLENRMRLALEIVRGIRRIVGQRFILCYRLSLLDLVEGGNTWDEVRRIALALEEAGITLLNTGIGWHESRVPTIVTSVPRAAFAEVSARLRHELKVPVIASNRINTPEVAESLLATDKADLVSMARPLLADPQFVAKAGAGRAEEINTCIACNQACLDHAFANRRATCLVNPRAAFETELRYRKARTQKRIAVIGAGPAGLSAACVAAERGHRVSLFEASGEIGGQFNLAKRIPGKEEFRETLRYFRVRLERLGVDLRLGHRVRQGELDGQFDDVVVATGIQPRRPRIDGIGGPTVLSYVDVLRGAPVGARVAIVGAGGIGFDVAAFLVAAPSDGQPRALGEWLAEWGVDLDNSQPGGLREPAPTRPARQVWLLQRKPGAPGAQLGKTSGWVHRAHLRHNAVRMLGGVEYLKIDKRGLLIRVDGEERWLEVDNVVICAGQEPLRELQISQAAESLRFHLIGGARVAGELDAKRAIREGAMLAARL

SEQ ID NO: 26851 - protein, 478 aa, Pseudomonas aeruginosa
SASAFSTPPVRGKGSAQAIHPTHRACDSRPDGGQGCRGDRMSFSRILGDGRINLEQQRKRAKELLRQWRRDPASRTGLPGQAPRLADAQWQVARELGFASWPRLKAHVDAIAFASRHPDLVGGDEAATLHLRCGNDIAHGLKLAGFRGGFRMFADPLTMGPVPNLPLPEFLALRSDYLSRAFDLDPADAQARQRQEYAGLERLGEYSRVALWCEADAYDQLFLVRVLAGMQTPPEHLELIEIDRVPGVERFVGIGQLAPELLAWLWTRRRPLDAEALALARAAWDAYRDPAPLRWAQLAAAPTPALPLLGPALRRQLHELPALRDGLSLSERLTLEIVRDGERPSAGQVFARADRRARAAALSRRPDVPRPAPRAAGRARRAAAHAGAGTALGTPTAGPDRCGPRGPGRAALPPRPRRPRTLGRRRMPARRHRALGAGRAGPAGMAGGPTALTLIARTSATGAQPLSCAPVFPAPARR

SEQ ID NO: 26852 - protein, 218 aa, Pseudomonas aeruginosa
SSTSTTSARSSPSPAWPTATACTSTARPACAPSMPAARTPAATTRASARVPATAPTGRGSLSQAAPRPGIAGTVPPAAGSASAGAPRRARRRTNASGSPAGRRDATSRPARCPPPVAPARRCRTLPSTAASARTPAAARASRRRWPAARRWTSARRASPAAGSRGTARTAMGSVPGKPTRHAAARRCAPAARAAGRRRATPGPAGRAARRSRGRCRRR

SEQ ID NO: 26853 - protein, 177 aa, Pseudomonas aeruginosa
RSAANARRAGSTRGSPASSTPPAGTRARPPGASAGFRGSMAGPARARASATPARPTGRSAVRRGSASAAPSPAARGRGRGTSASPRGAGFPPRHAGPARSRAWPGPAPGPGPCRSLPPRRRRRTAPNCPAGRRRSAPADDLREPASPIPATAPARPATSAAGGWRTRWRRAEAGRRR

SEQ ID NO: 26854 - protein, 307 aa, Pseudomonas aeruginosa
SSRPVRPSSAPPRHSGPRWCPSADSCPGSAGGWRRPGRAGTRPAASRAAPSRIGPADLRRQVAVDQVERAAPRFHGHPPEVFAAHADGQQLQAADQEQRGDHRPVFVDLLLAEDPGEQGRQGRQQAEQAEVAGDLQRRGGKPGDAFQGEVPQPPVAPLAVAGDAGGAAIGDIDLAETDPGEQSLHEAIAFRQLAKGIDHPPVEQAEVADVARDRHLAEAVDQTVKGARRGALQPAFAGPAAAAHVDHFGAADPGVEHLRDQFRGILQVGIDDDHRGAARQLEPGAHRLFLAEVAGEAGHAHPAVGGL

SEQ ID NO: 26855 - protein, 440 aa, Pseudomonas aeruginosa
QVFAGFPAAGLEAASDKEYTAGRGLLPDMKNGFSAGLAAVAILPGRSGGPHEPVARCLAPRPDPPQGLGAGRADDSVERFRSPGAPGGQHGGRPPAARLPARRGSRGRQPVHPDGRRARLPAHGHHRLRRPGRRPRRWRRAAPDPRPGPGHGAAPGPAARRAGPAPERLGPATDATVGGTDRRGPRLLPYPPARPAGGPGQLRTGRLVPRHAERTGAIGDPVDHQPEQHRPGALVRPRPRLGRARRGPRLGAGGMERRPARPGPDPPRPGPAPRAGAVATPAPLAVLAAAADGQPGYLHPQPGPATGVFPAHRTGHPPRRRHGSRQRPAAQRPAPDVLRPRRSRPRGGGALRPRHRRPRPSRPAPRAGGSRWLVAAGKPGVRRAVRLVRPPVHRPAERHRRRPRSRLRLSAVPGLPAAAGDVELSARRPVHRRHPRPRDA

SEQ ID NO: 26856 - protein, 325 aa, Pseudomonas aeruginosa
RGMPGSSDCASSGNRRASSAARGPVKPIASSARARLKALWNQTAAAPPSALAGCASAVSQGSTSRQPSRRTSRLPNGRRRATRLPATPNAGKAPPRLAPSTRARAMGSETSPAWARDATSSTTATLEWQAQVSSAASSRAISGSPSRPWITATKAGEASICCREWPSNASARSIRPSPIRHWPRLSRRGPSPRRNSSRPDSRASGASNEVSKLSSCTTRVVPTLAPSITASAGARPRVPLAVKDAAIRLVAVLLCSRPVMPSPASRASQRLPRWRPSQLRSAVPKPRSTPLETMCVPHNRRATAPARLIRRMVPSMAELPVRNGS

SEQ ID NO: 26857 - protein, 397 aa, Pseudomonas aeruginosa
VVMSKIDEVGPIQTMKRPMFFESHLRGLARNSLSILSHGSDSWEMSYIRFCSSRWIASIGRKGMKALATSTENTLPKLELAVMFRYFMMLPKVSRPLITPSSRTIRLFSRRMMSADSLAMSVPLSTEMPTSASRSAGASLMPSPRKPTVCPLPCRALSTRDFCSGVSLANTVRSSARRCRVASSIRSMSRPSSGSPTSRPTSRQIFALTTGLSPVSTFTATPFSRNAAMAGPAVSFGGSRKVSRPAITRSRSSLAPYWAWDSVRERLRVPSRSTRKPSRLYCSASASRARRRSSSSGRSTPSWCTRVAISSISSTAPLHTSRCSPSLPSRITERRRRTKSKGSSSTLRQASDGVMRGFCSTKATTARSIRFFIPDWWKLFSQAICRTRSQRRPATST

SEQ ID NO: 26858 - protein, 180 aa, Pseudomonas aeruginosa
VRAPVATTTAVAVPLTTLVPMKQMFGSSSRSCWSAAIRLADFSRTAPRVSYFSTGSASPVSTAWLMNRSRDSIRRMSAGIMSPADRRTMSPTTSSPMGISRSSPRIPRSSRRSTVAVFRTMALSASAALPERYSCQKRIRPLTRTMQRTMMTPVRSVSSPSCRGSQKSVKKLIAESVIST

SEQ ID NO: 26859 - protein, 409 aa, Pseudomonas aeruginosa
EAVGQPRMPLNRPTRCGFRRALVWVIAPAGICWAGRRLLGILSMALFVGGKKVPGSAGGGFIDLLPDEVNRKSRFVQASMEHRKIPAGVRRKDTGQKRSGGDQSRQPSRQRRHFGGRVEAQAKTGLQDVQQFLDVAQLALQRLAVAGALAEQPVGQGQAQVALGYGGLQALAEHAVGVGRGVPVARDVIDPQLRAQVEAVQRQPAAATAHGAFVETGVRVDQAHAMHLSGVRLVTRQRQCSRRIGRAEADIHQELALRQVQTQHQMRLLGSGGRSPGSPQRSRANQQFQVVAEGQQQAGEQRVEFEAITAAAALDDLGENLVGVDLDGAVEQHVEVLEGDPAQMRVDQPVELRQARRTGIVDADMVQVGMGLLGRQRGHGGLRKMASSILDAFSGNTGSAVRHIGPGSA

SEQ ID NO: 26860 - protein, 279 aa, Pseudomonas aeruginosa
LCPSHPEERRHGPGNRRLPALPVDLPAVRPAGVAAPPAAPAAGPGARPQPGGDRPRLRPLRPGGTGQRAGAGAVVRQGRRLLPAQWPVPRQGRAIRPRCPGLAVADRYLPRLARHPQGPRSAGGDAGPGPAGGPGGAPATAPAAGHSVAGYADGARLRHARLSPQFCMARPYTSIAAWRSASERVGCGWQVSARSSAEALNSMATQASPIISLTPGPIMCTPSTWSLRASERILMKPSLSWLIFARLLALNGKRPTLYSRLAACSCSSPRPTLATSGWV

SEQ ID NO: 26861 - protein, 250 aa, Pseudomonas aeruginosa
SACSDSVAPPAAGCRSSSTPCSPLRAATTRVPRRNRMPWRVRARCRVLAVSPSSPGQIRSRYSSTVTCAPSRRQTEPSSRPITPAPITTRWRGTSTNSRAPVESRMRWLSTGTPGSGAGSEPVAMTMSRASSCAWPPSARATPTRPSPCKRAQPLIHCTLCLRKRNSTPRVRAATLSSFCFIICARSSSGLTRMPSRANSPPLAAAYSSEACNRALDGMQPTFRQVPPRVSRPSTQATFRPSWPARMAAL

SEQ ID NO: 26862 - protein, 223 aa, Pseudomonas aeruginosa
ATPAQIEETPRRGTESDCISLVMQSLYDDRNFPATLSHHDRSTTMEQPGREDRLNAWIATERAARARLGASGTLELAQVAALSPQEFFDRIGSGQLPCPPYGELVDFVPIEWSEGRFLFQGTPDRRHYNPLGSVHGGYAASLLDSCMGCAIHTRLQAGQGYTTTDLRISYLRALTDKVGPVRAEGRVVHLGRSTAVAEGRLYDVDDRLYAVGSTTCLVLHMAG

SEQ ID NO: 26863 - protein, 414 aa, Pseudomonas aeruginosa
YSSLFSDDQPSHAQLHLQFLPPAQHRRPARPGDAVHAARPCPRDLFPAPPGRRPDGRRQHRAGAVPQPHPGAPVRAGVRLPHRPVGIPLRREAPGTPGGLGVPVQARVVPGGAGTDPGELRLDLPVAADGDLPPGDLGDRPEHARPGRPALVAAPSARGARRAAGGRPQPARSAAFRSRLGLAPAVGGAPRPRLDRSGRRPAPAHLLPPAAVDRCDRPGLCRRQLVQRRHAGNHAPTLPPGGRWRAAARLHPAAPAQRLWRETLGLRRDAGDHPDGLLQRHQVSAVAAVPRPHPGNRPAAPGLVRTPGLERSRQGPGGVRRSADVLLPAASLPTEAAVPAGAGDLGRQPGRLLRFLLGAGAMAVQHPAGRDAVPGGALVRRFQGAAAGYRLVEILLRRGASRSRWKRPALPPHG

SEQ ID NO: 26864 - protein, 674 aa, Pseudomonas aeruginosa
  UNSURE (18),(19): Identity of amino acid at the above locations are unknown.
RVARNSQTMETKRPAGAXXPPAIAWFASHRRRASQSGQVRRAGQPQAQRIQVLVALAGGEIGPGDLVAVEGHQFLRRQVHVAQHVLDGVVGLDAGVIDAAVCALVDVHRVGVAEQVVHVAEDLLVGADQEYPDQVVLALLHLVHRQAGLDALLVDVLGDLAVGVAGQVLQYRAPIRLLAQAVQRQDRQHLADGPGIRQALEHREVADVLVGELVVEFVEDLPVGALAGLELVVQAPADSEVALLGEGFLRQADLAVGILRGGVADVVGGAPVGLGDHLGIGRAEQFGQPADDLRLLVEIDDLRHVVVVPLDVGDLGDQHRMVRGQRPAALREDVRMRQALGVAELLEHADHHAGIVIDVVVDRAGVARMGAVVVDAEAAANVDVIHRQAERAQLAVVADGFLEAVLVVGQVGDLRAHVEMQQAHALVETGLAEALDHRQQLGGGKAELGLLATGVCPLRRSQRGQPHAQADLGLHADVGGLLDHQLHLGFLLDHDEHVVPELLPHQRQLDELAVLVAVADDGAALRGQRQHRHEFRLGACLQADGDVLGGDDVLHHRFLLVDLDRIQRGVAVLVFEALDVRVEGAGELAHAVLQDIREAHQQRQAQARLAQLADQLVEIDGRRVGTLRTHFDIAAIVDGEITRTPVADAVYAAAVGHGPVAAIVFASPSSGHAR

SEQ ID NO: 26865 - protein, 770 aa, Pseudomonas aeruginosa
ESRGNPLMRVSAVSHLGKGLARPRGAGPARSLQGRTRSAAGLLRLETALEEFVDQQFDMLALDLHHAVLETAAGAAAPLQRAGQLLERIAGERQATDGGHRLAAAALGLAAHARDPVADRRYGLPADAGVFGLLAVRAMPAAIRGIHQPAEGGQGRSFFDHRAFPPEWPRRARSTTMAGGSRPRRPTQAGAAQGRHGDRPKRSRNLAALRANAKSENAPLIGEMATSAAQASRYRRNACRESGQYGRLRASSSASSGRMKRASEISSACRRKGASETAENTAHQSRLPGSSKKKRPCSRRTASRIPSSSSSSRAAESAYGSPAWTHAAGGEVPVPGIDRLAQGPALHAQLAGGVEQQDEGAATDQPALAQLRARQATERAVLLVDPGDEFGVGGGPVGHLFGADRRGHGSALGKQLAQVDHRGVGAGNVVGHHQRVVGQDAVAAAVQHHRAPQRLLRGLQFADDLPHADRGVLLRQHVGEVDLDGAQQVRQRPGLAPGLVEDVVDLQPGGFLDHFLDLGRLARLYLFGVLDVGVQLDPADARRQALGQRAQAGGDVAQPVVQVVGTGIELRVGLVRVGQASQVAVQRLDAFLVLRLGRRQRPALVVEVETRLGASQFGVLGGLRLRTGEILAQRPADVAHLDQHAILPAGHVVHPDARREDVVGDVAARLGQQGVDYFLEVLHRGVAGDHLPPGALGGGLGVLLHGEQVGFLAPVPADQHRHQQVDAQQASHHAHQPGAAEVGTHIIHGIVHAIAHGPTTLLPVQHGKGP

SEQ ID NO: 26866 - protein, 480 aa, Pseudomonas aeruginosa
PDPGPPEAPLRPASDQPGAPGSGGLATPDPRGVEQRRHGRTGRRHPAPAALRRTLRASRACPVGRCHRPYPGRRRGQPRPAFQRVDQRTQPVDAAPVAHRPAAWRPARAHRPAAVTQTGLPGTEGPRTRRAPGPATGVLRSAGAELRDRRRLPRQHARTLPGGDRHGSRLRRPRHGPATGQRGPGRPRTQAAGAVFQRQRDRHPDPPGRSPRRRPGILHRHPGRLQRAGKDRDPQPPELLRTLPGTDRRRLPGPGAAHRDGPQQRRDHHPRAHRAAVGDGRAERLPARPDHPGHVHARVPGHRVGQGDPPARTPRQRADHLPVRRGRPGQAAGRHERRRRRLPHQADPPAPPDRHRAHPRQPRAQPEGADGARQPDRPVQPHPYPATARGRPSARTSRWPSAELRDARHRPLQAGQRPFRPPHGRPGDQGPGAVPQATPAQDRPHRPLWRRRVRRGPSGHRPGRRAPGARRDSPALRRDP

SEQ ID NO: 26867 - protein, 670 aa, Pseudomonas aeruginosa
PAVSPFRSRTRLAMRLKQLTNLNTLLLLTVCLALGITLWWSQRAMERPFQLLDQYLELSQRFDEQVARNIRQYLGSGDAVRQQAALQALESLAEALPELPPDLARTLAPSLAELREFSAGDLLAAGKLAGDPQGLLLQAERDLTGNLEQWSAYLDAAAGQPQAGAYRTPLLLASLHLTRLSLARAKLVESANPALAGDVERELANLREQAGRIEALPLLGVLDEQRSASDDFAAMMGLAGDAEAGAGNAEDRGVALRRELASLLQRYPDELRRTRDLIERRQQLSADTGARLDAVRQALATLEPQVRGERQRLQGQVRLIQGGMIALILLIALAIDSLQRRLARVLGQLVPALSAWADGDFSRPISLRTRTEDLRNLEDSLNRLRSFLAELVGAIHRRAEQVAGSSQTLAEVSSGLHAGVERQAGDTGQIRDALGDMEAAIQQVAGDASQTADASRSAGQAVEHGQRVIGESLGGLRELVDEVQGNAQSIERLAEESATIGSVLTVIRSIAEQTNLLALNAAIEAARAGDQGRGFAVVAEEVRSLAQRTAGATEEIQQLIGRLQQAARQSVEAMRSQVEHAERTAEQAGAAEGALDEVVAAIHTIGVMAERIAEGSTQQSQAVGEIRSHSERIHALGGENLRLIGHSREQGEQLRQLGGDLRTTVQAFRL

SEQ ID NO: 26868 - protein, 568 aa, Pseudomonas aeruginosa
SDEISMRRLLTLILLLVALPAGAGLFDSRPGASLGGGLDGGGFLKVDQAFKPSVERSDAQHVLLRFVNAEGYYLYRHRFQFKVEPAQVSLGQVQLPAGKQHHDEYFGDTEVYYNIVDLEIPLNNPARQPYTLVVTYQGCADKGLCYPPETRRFDIDGGAATPAASDAAGKGPLEHKGKRSLLFFFLAGLTLTFTPCVLPMLPILSGVVLRGRPGGGRGFVLSLAYVLPMALCFALLGALMGMFGASLNLQAQLQSPWVLVPFAAFLRAVRRGHVRLLRAAHARLHPRTARPPGRRCARRLDPRRGHPRRAFQPAGLALRLRPAGRLAALYQRQRRCLGGRPATVRPRPGHGYAAGGVRRRRRRPAAQERSLDERRAQRLRRAVAGGRRVAAGAGGVRPGGADALGHARRRRRPGPGRPRIHPEERRTPPAATAWPDVPDLRGGRLDRRPAGRVGPDPSAGPLGAVDPCRAAEHARRMAEPDHPGAVGRRPGRGTSGRQAGAAGLVCGLVHQLQGHRAPGSHRSHGAGTTAGLPPAALRHHRKQPGPARPAGPLQPVRSAGDPVLRPGR

SEQ ID NO: 26869 - protein, 162 aa, Pseudomonas aeruginosa
CPLAVCSLYRTINKTMATLLVLHGPNLNLLGTREPGTYGSTTLGQINQDLERRAREAGHHLLHLQSNAEYELIDRIHAARDEGVDFIIINPAAFTHTSVALRDALLAVSIPFIEVHLSNVHKREPFRHHSYFSDVAVGVICGLGATGYRLALESALEQLQRP

SEQ ID NO: 26870 - protein, 179 aa, Pseudomonas aeruginosa
TTSKPKLAAPSSRSWWRTASRLSSTSRCSPSSKPRGTCDVGKSADRQPRRNRLAHPSRMQGAGDQDGGGTLHRRPRVDAPVARRRIGVHRSGPGHPVVPADPGDHRRGRGHRRHRDPPRLRLPRRERRLRRADRTLRLHLRRPDRRGDPPDGRQGLGQGRHEARRRPHRAGLRRPAAGR

SEQ ID NO: 26871 - protein, 158 aa, Pseudomonas aeruginosa
RNRPGDRPRGRLPGDHQGRRRRRWSRHARGLRRIRADQVGQADPHRGRRGVRQPDGLPGEVPDQPAPRGSPGAFRRPGQRHPPRRPRLLPAAPPPEGDRRGAGPRHRREGPSGSLRPLRPGLHRDWLPRRRHLRVPLRERPLLLHRDEHSRAGGAPGI

SEQ ID NO: 26872 - protein, 474 aa, Pseudomonas aeruginosa
DGHRCRHRQGDAAHRLRREALDPPGGRGHPRPCAGMPDQRRRPEDLHAQPGQGQALPRPRRQRRARRLAPLQRLQRAAELRLAGRQGHHLRCRPRRGAGADAQCPGRVDRRRYQDQYRTAQGPGARRRLLQGRGEHPLPGEETGYGQALIRQSLRTRAASGRPLSFPPAGRPNGAILVAPPPPDSCMERIRRWYRQSLAAATEAATCFALGFRESLQPAALFRSASLCILVSVLCTWLFVHFFEPIIRLCGWAALYTAFSVANFALIPSGSLIEAGSGGPYFDPLAAFNGLAGLAQLAFYFVGYAALFFVALYAASIVFGIRLGLRIGLLGQLKEQVRQRYPRLAPASGERISLWRAAGFRLAPWLGVSGSILVGLLVPLYNGVLLLLALAYLNIRFLLPATLAGLADAGEQLAVLRARRGSLLLFGLLILLLALVPLLNLLLPAVLGGGTCHLANRGLAQLRGEATAESGSAG

SEQ ID NO: 26873 - protein, 211 aa, Pseudomonas aeruginosa
PSWTPKTSRSSSRTSAPPRCGRAPTCWRCSKRTPMRPPCSPTSPCLPAATCPSTMSRKSPTRIGNAAGWTTSSRCVSAAACGSCRAGTPPPSRTRSTCCSIRAWPSAPAPTRPPRCAWNGSTARNWPAGRCSTSAAARESSPSPRCCSAPNGRSAPTSIHRPWKPRATMPRATVSSPRGSLSTCRRTCRSDRPTCWSPISSPARWFPSPRN

SEQ ID NO: 26874 - protein, 236 aa, Pseudomonas aeruginosa
RRRGKRRGTVRRAPGQRPQTGRGAGRESRPVARRATATGLGEAPAPMAAASRLAAADPAGAGRSRRSVHRLPFRRTGAPGRLSPLVRPALPGNRLHPSLQGRRGADQEQQPGGPQPSRIQRRAGGRRDHLQSRQLLAAVPAAGTALRRPQRPPHRQSPLQARRVPRRRAGRTNGNATAGTDPRVAGHPRPGSEGGELQPELPFPGVTGKTSPVAAGPLRPPARAERQAQVPLVFQL

SEQ ID NO: 26875 - protein, 369 aa, Pseudomonas aeruginosa
ELRNRLFRIYPKQPLSGHPERVSCPPFFRSTARQGSPMSVVRIGPYTLPNRLILAPMAGVTDRPFRQLCRRLGAGMVVSEMVTSDVRLWNSRKSRLRLIHDGEDEPRSVQIAGGDPAMLAEAAQRNVELGAQIIDINMGCPAKKVCNKAAGSALLRDEALVAEILDAVVRAVDVPVTLKIRTGWDRDNRNGVTVAKLAEQAGIQALAVHGRTRADLYTGEAEYETIAAIKQAVSIPVFANGDIDSPEKARKVIEQTGVDALLIGRAAQGRPWIFREIDHYLRTGEHLPAAPLPEVQSILLEHLAELHLFYGEEMGVRIARKHVGWYLATLPGAREFRAQFNRLQDTDAQCASVRQFFAERQNNGTGVAA

SEQ ID NO: 26876 - protein, 577 aa, Pseudomonas aeruginosa
TAGPCARNSSNTIFFKSGGGLRPRARVPAGTRGRKPALRTLAMTDQTTRLPIRRALISVSDKTGVVDFARELVALGVEILSTGGTYKLLRDNGISAVEVADYTGFPEMMDGRVKTLHPKVHGGILGRRDLDGAVMEQHGIKPIDLVAVNLYPFEATVARPDCDLPTAIENIDIGGPTMVRSAAKNHKDVAIVVNAGDYAAVIESLKAGGLTYAQRFDLALKAFEHTSAYDGMIANYLGTIDQTRDTLGTADRGAFPRTFNSQFVKAQEMRYGENPHQSAAFYVEAKKGEASVSTAIQLQGKELSFNNVADTDAALECVKSFLKPACVIVKHANPCGVAVVPEDEGGIRKAYDLAYATDSESAFGGIIAFNRELDGETAKAIVERQFVEVIIAPKISAAAREVVAAKANVRLLECGEWPAERAPGWDFKRVNGGLLVQSRDIGMIKAEDLKIVTRRAPTEQEIHDLIFAWKVAKFVKSNAIVYARNRQTVGVGAGQMSRVNSARIAAIKAEHAGLEVKGAVMASDAFFPFRDGIDNAAKAGITAVIQPGGSMRDNEVIAAADEADIAMVFTGMRHFRH

SEQ ID NO: 26877 - protein, 460 aa, Pseudomonas aeruginosa
TCPGLESRPGPARGEGLRRPGQRRHRHRSQVRERRHRRAGPGATGRLRREERPVDHRRSRGAAGGRRGRPVPRARPGYLRPDRRRRPAGRLEGLHQGLPRPPPDPHRRLSQLHRGRAGPGLPARAGRAHRHQGRWPGRGQGRDRRHEPGRSRSRRARHARRQCLRRRRLARGDRGVPRWRGGQLHRHGRRPERAADGHQPGPQARRRWRQRAEHRRHGRLLAGPGGHRRGPPAGAGRSDLPDRARHGRGRQRLYRLPLCRPDDRQERRAQGHRIQLPLRRSGNPADHGPPGVLPGPAGRGRPGQGAGQGRGDLGPASDRGRGTGRRRLSGRLRQGRGHRRPGRGRRAGRQGVPRRHRAEGWPGGHLRRPRALCHRHRRERVRRPATGLSPGREDPLERLLLPQGHRLPCHRPRARRVLTGPEAAGAARRFRGICRCHGHLAIIRPFTFEGTSPWYGFGSP

SEQ ID NO: 26878 - protein, 148 aa, Pseudomonas aeruginosa
DYSSASCCFCSVRCRRRSRTTPAFPAFPCKPPPPPPASTRTGACCATRARNCGSPTSSSARSSSARWPSAPSSSPPAPRRSGCRSSFPRRRCRAGCGSSPRGCSTWTTTWCRTANWCGTSTPASRDRSRSARCPRAPTCSRCRSTASR

SEQ ID NO: 26879 - protein, 333 aa, Pseudomonas aeruginosa
SPTGSANAIAAARATPCPPEGSDVLQRCTRPPPRRITARGYSPYAPVVPAPVGRMTPTALSADTATSATADNRTRLFALRPGGPASRRAHDANGVIRRHPASLSHATRTGILPTRRTSHRPVARYAHAHTRTGSASMHLLFSVYLKMLVLYSPFFVLSCFISLSRGFGPRDRKRMAWRVALAALIASVALYLFGRYIFILFGITADAFRIGAGSVLFISALGMAQGRAAVQSDNVQQDVTIVPLTIPLTVGPGTIGALLVMGVGQGWEAKLISLVAIFLACLTLGTTLYLSDRIERLLGDQGLQIVSRLMGLFVCALAAQIIVTGLKGSLFPG

SEQ ID NO: 26880 - protein, 1364 aa, Pseudomonas aeruginosa
MENNTNETSQSAQGLHAVRVHRFHGPVLVHPGRRNHQGRHPPLAVRDHGDLRDLAEGHGPDDHRRDQRQGRGQRQEAGGGGGRSRVELAAVRGKGPPVADPGQGRGGLRLLDLGVAQIGVAGVRGTQRIAVLPGPVRGRGTLAERLLYRRGAEPAGDPGGGVPDERGRRRRQALLPARHRLCLPAHHQQDPARLPAQQGRGRQGHPGGLHAVRPQRLPDHRRRHQEVRRRRQDRGGLHRQWRLQRALLQGTGQPGPGSHRGAGGGLLRRRGRTARHRHQAAGRQPRGMELLRVGEQSGQREVRRRLESLRQGKEPAELRHRGDQRPHGSHLRRHPHVGAGRGKGRQHRGRQGSRGDGRAKLQGAIRLHAGHGQEQPPPAQAGDDRRDPGRRPVRSGLEDPRAASRATLEPVHPGQREKAGACAEEQLSSAVKNPAPLTRRSPERNGNAPVARLTAPSSFRERAGDRPYRTSPRNPSMPLALLTRPLQACVLVLAALLAVTAYAGPAQDFAAADNGGRAHLLEHWAATPDAGRLAFLEALRHNRIALDSRQQPFILGADQRFQAAEGDALPDGEPKPLRLNNRLRGLLNTALASHQLVANEVPLRQAAAQQLQKTAKAAQRPLLEARLRIESDAGVKEALGLALANLQLGDPDPALRLSAVRLLGESGDPLARTRLENLLDPAVEPEEGVRIAAATSLAQVKRRLLVGDLLGQAFSGLSLGSILLLAALGLAITYGLLGVINMAHGEMLMLGAYSTYVVQLLFQRLAPEWLALYPLLALPVAFCVSAAIGMALERTVIRHLYGRPLETLLATWGISLVLIQLVRMLFGAQNVEVANPAWLSGGIQVLPNLVLPWNRIVIIGFALFVLLLTWLLLNRTRLGLNVRAVTQNRNMAACCGVPTGRVDMLAFGLGSGIAGARRGSPVAGRQRRPGPRPGLHHRLLPGGGARRRRPARRQRPRRLRPRRGEQDPRTADRRGAGQDPDPRADRPVHPETPAGTVRPEREGHRLNQPLTVTLARRAGGRVTAIALGAAFATLLAMPLLHLLPADSALHLSAYSLTLTGKILCYAIVALALDLVWGYAGLLSLGHGLFFALGGYAMGMYLMRQASGDSLPAFMTFLSWNELPWYWAGTQHFLWALCLVVLVPGALAFAFGYFAFRSRIRGVYFSIMTQALTFAGMLLFFRNETGFGGNNGFTDFRSILGFPITAPGTRAALFLATVALLAASLLLGWRLARSKFGRVLTALRDAENRLMFCGYDPRGYKLFVWTLSAVLCGLAGALFVPQVGIINPSEMSPTNSIEAAVWVALGGRGTLLGPLLGAGVVNGANSWFTVAFPEYWLFFLGALFIVVTLYLPRGLLGLLRKEKEQ

SEQ ID NO: 26881 - protein, 269 aa, Pseudomonas aeruginosa
RLPSGARRVGRMTARGYPPSQVGNRSEEPSRDKWKRTMLQVDKLHQYYGGSHILRGLSFEAKVGEVTCLLGRNGVGKTTLLRCLMGLVPAREGQVAWEGRSLTGLRPHQRVRAGIAYVPQGREIFPRLTVEENLLMGLSRFSARDARAVPDFIYELFPVLREMKQRRGGDLSGGQQQQLAIGRALASQPRLLILDEPTEGIQPSVIKEIGTVVRSLAARGDMAILLVEQFYDFAAELADQYLVMARGEIVQQGRGRDMESEGVRGLVAI

SEQ ID NO: 26882 - protein, 178 aa, Pseudomonas aeruginosa
TDWDTLPLAQPGPCAGNLYALVFPQEVEMTVTLRPAVQADAGFAALCVAAAYAPWIAVIGRKPWPMTQDYHEVIASDRVLIAEHDGQPVGLLVTRETADGFLVDNLAVLPECKGQGIGRQLLERAERDATSLGYRSLYLYTNERMTENIELYARVGYLEYERRQEEGFRRVFMRKALA

SEQ ID NO: 26883 - protein, 223 aa, Pseudomonas aeruginosa
RGATPDRCGCRSTSTPKARKSASTSSCIRPAASPAATAWPSTCASANAPGPSSPAPARPSGTAPPARRGRPWRSTWSPAPPWNGCRRKASSSPAPRPNWKPVSSCAATPACSTGTWSRSAARPAASASSAATSSRPWTSVATTACSGTSASASTAATACSTRRSASPGIRCWRPWSPAARSTPTCCNAAARSPAPAAATSASCPAACWWRAAWPTRRCTREPG

SEQ ID NO: 26884 - protein, 125 aa, Pseudomonas aeruginosa
SNSGACCGRRCSAARPFPHASGVPEMDLSPREKDKLLIFTAGLLAERRLARGLKLNYPEAVALISAALLEGARDGRSVAELMHYGTTLLNREQVMEGVPEMIPDIQVEATFADGTKLVTVHQPIA

SEQ ID NO: 26885 - protein, 105 aa, Pseudomonas aeruginosa
ALRSATPASPTCPASSPSTTTPWAIPRRSGTKPRWTWPTARPGSTPAPARATRSWWRATPPAKCSATPPTATGDPSRASAAPSSTPSTCATTSAAKASACNCCRR

SEQ ID NO: 26886 - protein, 137 aa, Pseudomonas aeruginosa
TSTRRAARPEPQGAPMIPGEYDIQPGDIELNAGRRTLALSVANTGDRPIQVGSHYHFFEVNDALAFDRPATRGMRLNIAAGTAVRFEPGQSPRGGAGGNRRRTAGIRLCRAGDGGPLGPHWPGSTKDSEHRRSPKER

SEQ ID NO: 26887 - protein, 566 aa, Pseudomonas aeruginosa
MKISRQAYADMFGPTVGDRVRLADTDLWIEVERDFTVYGEEVKFGGGKVIRDGMGQSQLGAAQVVDTVITNALILDHWGVVKADVGLKDGRIQAIGKAGNPDIQPGVNIAIGAGTEVIAGEGMILTAGGIDTHIHFICPQQIEEALMSGVTTMIGGGTGPAAGTNATTCTSGPWHMARMLQAADAFPMNIGFTGKGNASLPLPLEEQVLAGAIGLKLHEDWGSTPAAIDNCLEVAERHDIQVAIHTDTLNESGFVETTLGAFKGRTIHTYHTEGAGGGHAPDIIKACGFANVLPSSTNPTRPFTRNTIDEHLDMLMVCHHLDPAIAEDVAFAESRIRRETIAAEDILHDLGAFSMISSDSQAMGRVGEVITRTWQTADKMKGQRGRLDGDGARNDNFRARRYIAKYTINPAITHGISHEVGSVEAGKWADLVLWRPAFFGVKPSLILKGGAIAASLMGDINGSIPTPQPVHYRPMFASYAGSRHATSLTFVSQAAFAAGVPQQLGLRKAIGVVSGCRGVQKTDLIHNGYLPTIEVDAQNYQVRADGQLLWCEPADVLPMAQRYFLF

SEQ ID NO: 26888 - protein, 467 aa, Pseudomonas aeruginosa
FPRDGSRRHAGTSTAPFGQLGLSALAATMAPTRSRRQSVHVLPPIVPQRFHPVSGQGLPGNGHRRGELLPLLDLPALPVRRDSHQQEGRDAAPSHPRALSGGLRGGDQGRRPARLRREIPGRLRQSALRRQGLRHGRPGHRAPGAEPGTDQPAAGEGVLHRRTRPPLLAAQPLPVPGYPEEHGRAEPPGIPEDPVGPLRSGREAETARAVRNRLCLPPAVQPQPNGSRRLRRRRPRRTAPGLPVLRRRFGRDALVGDLRPEGRRADRPFRLSGNARHRRRPVHPGGQPVRRPRRHPATRPASAGRRGRPRQRALRADRRGAPGTGRRPAAAGRLRQGPDEPFAALALRPRSLHRPRRRQPTEPGPAPYRRLLDLPRHRREENLRRSLLRRRRRLPLVRASLASDGFPLRRRSLDLGPHHQRRQLQRAMAAQRGAAGPQRRFRHLPRPGPGGPGLVLHRPALDRLQPA

SEQ ID NO: 26889 - protein, 245 aa, Pseudomonas aeruginosa
LTPLAETLEPPDMGVRPRLCKGGATIGLAWHNRQPSLEVHRMMGPFRRLAHLIDQGRQLDAALAGDPFALPAPEDRYSVRQLHGLYPRRHPGLYAPLLGSLALLLGAAPLGLAALRLALPEAPLRPLGWLSALPLLAAWLWLIALLSRGASLGPRLARDASLLLVATGLLLRLASGETSGLVALGGGACAWLLFNSRAMQRYMELVYAQRLYRAQSANRPGSAQRRLANQAAYRERKRRERSGRS

SEQ ID NO: 26890 - protein, 564 aa, Pseudomonas aeruginosa
SGRSPAPPGPAGKPPNRRGCRTRSRGRRRYAPTWDRTRKRCGSNGRSPTARETSHATHGVRLYAWRNPGQHGKTEWESSANIAPCAGPLANPYTKVGAARTDVPGRFLPIAGGEIYDALAYTARPFFSRTVSRHEPEHRRPRPGHRFWHLQLHRRLVAAGGRTADRAGGRQDHPALGGVLQRRGAPPGLRPPGARRVPGGLRGPADALAEEPAGLQAAEERDHRARQRPAVQGPARPVHRPAQGARRGRRRASLRRGGAGSPGVLRRRRPGGRPRGPGHPGAGGQQARLQGGFLPVRTDRRGLRLRALHPARGTGPDRRHRRRHLGLLPGAPGAGAAQPGRAPGRHPGHRRRTHRRYRLRQAAQPGRRDAAVRLRQPDEERRLHAHQLPPEPGHLAHHQRGVRAEVAIGAEEHALRHRRQHRHRPPLQAHRGTRRALAGDAGGRQQDPPDRNRAPAPLAGAHRGRARRGADPWAVRERRRRTAGARAQQRRATAGLGRGRPGPGRHGVLHRRFERHSGAAPERLGDAAQRPSCRGQPVRQHRQRPGHRGEEALRLSRPGRAPAL

SEQ ID NO: 26891 - protein, 175 aa, Pseudomonas aeruginosa
WRSSWKTARFAPATPSISSCPPCRTGPWRRSEAIRRDSGRTLREGLRSNVGKHRSTTRSHSMYKQSLAALFVMATLAGCASTKVQNPVNYITFRNEPLVKDVEKGMSQQEVLRIGGTPSGTQKRLMKPGSCNSYILNKDGQQQPFYVSFDGSGKVDGSGFLSCSELDRHERDARP

SEQ ID NO: 26892 - protein, 280 aa, Pseudomonas aeruginosa
SAGIPQQEPEMLTIGQLARIFEISTKTLRHYDAIGLFVPARTGSDNGYRYYQPEQIEQLSRILALRRLDVPLEAIDRLKRDGALDDPQRLRHFLQRHQHTLREEISARQRLLAELDRTLATLAHWRIRNMHARIVERPAFSVVGMEYFGSAPGDTIGQLWERFIPREHEIAGKHDPEVSYGICAQQPNGEFHYVAGFEVQEGWPVPEGMVRFQVPAQKYAVFTHKGTAPQIAESFQAIYSHLLAERGLEPKAGVDFEYYDQRFRGPLDPNSQVDLYIPIY

SEQ ID NO: 26893 - protein, 373 aa, Pseudomonas aeruginosa
LQRNRQPTRSHRHESFPDPRPRPRHPDRQRRLRRRRLQPHHRPAAQGYVQRRTAHRRQRQRADHRPPAQGHDQSRSPPGRRRQRADRRPPAQGHDQGRSPPGRQRQRTDRGPPASQHEPFRPAHRLTARYAARREKSPARCRAFLFSHPCRAGRMARGKPHSPASDSAEPVVTLVLPVTSGIAVADEDLHHVLGVLEAELGGNPQAQRIAVLLRQRLSGHLQRQQRLRMQRAGHVEAGVVAVGALEANVLRRGVGADQLQKGAQRHSAPLADRAPALDADQLRDLAGLRQPAQLLQAPGALVADPPGNLQAVFRQVDLRHVVGRVERVEGERRGHLRRIEGRRQPRTAEQPGLDPVVPARHGPEYLVDRIAIL

SEQ ID NO: 26894 - protein, 267 aa, Pseudomonas aeruginosa
ASMVAPPAVPGDDFRMTKMSPSPRRALARMAANEGERDMRILVIEDDTKTGEYLKKGLGESGYAVDWSQHGADGLYLALENRYDLVVLDVMLPGLDGWQIMEVLRKKHDVPVLFLTARDQLQDRIRGLELGADDYLVKPFSFTELLLRIRTLLRRGVVREAEQVQLADLQLDVLRRKVSRQGQVIALTNKEFALLHLLMRREGEVLSRTLIASEVWDMNFDSDTNVVDVAIKRLRAKVDNPFPNKLIHTVRGIGYVCEERPCPPAAP

SEQ ID NO: 26895 - protein, 112 aa, Pseudomonas aeruginosa
AWRTPATGCRPSRCRACSTASTVATPRAATPSPAVSAWPSSRRSCACTAAAPKRAPRLRDASASTWRSRLRTERASRRRPARRRSGRYSPAPPPPTPPALPRHAGRGWRPSG

SEQ ID NO: 26896 - protein, 484 aa, Pseudomonas aeruginosa
RCGPAPCSRGSCPGREAGCRAARSAAASRTSAAPCRSSSRRAPPRGPGGCSARRPRRDRPGYAGAGHRVRRRRPPVVPGSVRGRRASQGSQVGSQVQRQVAVGGADAEADRLAGLAAQRAAAQVAHAAAEQDAGATGADALAATVGRAQAVGLGLFQQADGAVAGDFPLRPGEAQAHFARRLPAAPARDAEGFRLQAGEACPQLLAHRLDESRRPAGQGLAARQVGCPAVQVARLEMPLQAAIGPRPAGQAPAQLQVRVARRQRLQLAEPGALAGMTDVVQPQHGTAIAVLQRLAEQAEQGRQAAAGGQQADRLGLHRPAQIALRGLQLDTLADRQVFAQPGREQPVRVTLDGDFQALADHPGQAVAAPDPHPVALRQQLDVLARPRRRPAGGGTQGQGEHIVGHPVACLDPRIVAVQRRQRMGVAQQAVDIGLTQPATGGETAQGCEQRGQEREGKQVHGKYFSERSFTKLCPFRAIESTSVH

SEQ ID NO: 26897 - protein, 255 aa, Pseudomonas aeruginosa
SAASTGTACPADPAPPLRTSGSAFVRGLDARAPFRCGKKVVAHQPGALQYFVTSLWPRFPGTGVPHRPGKALAGACCDPFPVALRKLPMLVIHQRLPARSPRWDEELHLTYEARSKSRLRCFAASGEEVGLFLERGQPPLADGDCLEARDGRLVRVVARSERLLHVTCASPLELTRAAYHLGNRHVALQVGDGWLRLLDDYVLKAMLEQLGATVEAIEAPFQPEHGAYGGGHHHSHHGEAEFNYAPRLHQFGVRR

SEQ ID NO: 26898 - protein, 220 aa, Pseudomonas aeruginosa
PTKPSTAVCSVPRRNPMTSQPLRVGIGGPVGSGKTALTLALCRELRERYNLAVVTNDIYTQEDAEFLVRNEALAPERIIGVETGGCPHTAIREDASINLEAVDQLNRRFPGLELILVESGGDNLSATFSPELSDLTLYVIDVSAGDKIPRKGGPGICKSDLLVINKIDLAPLVGASLDVMDRDARRMRGDKPFVFSNQKTGQGLDEIIAFIERQGLLTAA

SEQ ID NO: 26899 - protein, 247 aa, Pseudomonas aeruginosa
NCPSCSPPSPCSPLRRWPSPTPATANTAWSPASPIRSPASTTCWRCSPSASGPPSNREPRVSPCPAPSSAPCWSAGCSASRACNCRSWIPASPPRCSPSASAWPSPCARRCRWRWPPPRCSPWPTGSPTAWSCRTSPAPGCTRSVSSPPPPRCTPPATRWCASWRRRPRPWYVSPGWPRRAPGSGCWPAEPPRLPQRLISTRRPWCTRRRPWVCASIARASGRSSTGKVPETRSASSDGSHSMLSPP

SEQ ID NO: 26900 - protein, 327 aa, Pseudomonas aeruginosa
SAPKPSRQTCARHPHQTSGAPPSSRARPRRTARRPLPDGRSSARRASAGGSEPIFASRRSARRQARWCSGLRERQDSSSACCAGASGPSCISSSQEAVSLSTCGAIASAAGGPESSVSPACGARREARSFIGHQAQAGHVGLVDELLHRRQRDAQRLGDVLLLHAVQRRHQECLFHPRAQGVEQRVDLVQGLDDHTLLFRRRLQRLGQRGQGLQPGEFQRLATAPADQHAVGDAGEVGARLTDRVTLAAIAAGEDAQESVVGQVVGHATSPGAKAVGQPVAQPGMVFTVERGDAVAVRLQAGAWRIHRRRIHRNSQLDSIANENYYH

SEQ ID NO: 26901 - protein, 160 aa, Pseudomonas aeruginosa
PAAARRRRSRVATAYWKACSESCRTPACRSRREPPAPTCWSSRACPEKPRPTCRRWWSRPPSWPIRRRKPIPRHARRCTSPAKTSTASAGFPWVTCSRASRAYRSATAATVARWTSTSAASRGRAGWRCGSTARSRRWTSTAATPAPSSAATSIPTWSAA

SEQ ID NO: 26902 - protein, 127 aa, Pseudomonas aeruginosa
PSTRVPRPARARSAAAWKCAPSASRTSWSTARTSACASPATSGTTASPRSTAAPVRRPRISAACRTMTAAACSAPRPSPAAPPSPTATSIWTWSPPMRSATRATTFPARKARTAIASTTATVARKAA

SEQ ID NO: 26903 - protein, 123 aa, Pseudomonas aeruginosa
QSIPRGSPTWSPATTTARRAAAAAAVSRRHSGSISSWPRIPSSTPPIPKACVCRRCSRPARAPSRSSRARTSSPSVRAAGRSVPARCATACWPTATRRRSSWPTSTTPSRTTSPAITIRARWA

SEQ ID NO: 26904 - protein, 179 aa, Pseudomonas aeruginosa
SSRRSPRGGGRTPPPPCTVPPRVPRARARPMPAGPRRPWRRRHRGRRGRPARSPATGCRRTGCSPSAGGRPGRGATRRPGAGDRGRYNGNRSSLFSSFENHRGFFAVASTDASAGTRGRRWMQAIASAPITPGAAKARKFCWNGSSRASRLPPSIGPAMAPRRPTPAAQPTPVERTQAG

SEQ ID NO: 26905 - protein, 113 aa, Pseudomonas aeruginosa
KADITVTRVLRRPAGANSLIRLIAMGTSAPSARPVKKRPAPSSSGSRACPVRKAARLASRVVAITRRRRPKRSASGASRVPPKSMPNSAQLPRVPACTGLSCHSCIRRGTTEP

SEQ ID NO: 26906 - protein, 139 aa, Pseudomonas aeruginosa
TGSAPPSPRRSSPPNAETPAALTQRLPASASARDAAHRAAATRRPRRRTPPRTPHRGTAAASRRRAGARPPAARGSPRRDRRRSPSRPRWHAPKRRRGSAPGHTGRPRRRWRKARSAVPAARPRRAARRSARTARAERR

SEQ ID NO: 26907 - protein, 396 aa, Pseudomonas aeruginosa
TSTPAACRPGVSSSACWRTSARPPPPTAPRPDGSLRHDRGHRRRHPPGGAGYPQLRTVPGRRGGPAVLRAGRTHRPAPAQRPGPPVLPLRPRRTAAPLPYRRTPLPRFARRLGHAARRTAGRPAAAHRRAAQSLPAVAGARSAPAVRRRHRHHAAAGDGRTPGPRWRRLPVALLRAFRRARGLRRLPWPVRLRRPRALPLRPRRKQPARGPSRPAGDQSARRPAIPLRAGGLHAVDRRKRPRTGLGSKPLASRALRRRATRRQCGRHLRSAVGEQRGADPGRRRADRAGGPARSRGGPAGLLRAGHLRHLPDPRAGRRAGASRPLPQRRGAGRQRLLHALLFAFAQPTAGAGSLVGGDVAVKHGDTLPLRIEVVGVAQGRVGVLAHDRLGARPPGR

SEQ ID NO: 26908 - protein, 176 aa, Pseudomonas aeruginosa
WCGGNACSCAGSAPAPPAGPGRWRTIGRPRPGIPPGSPVPRRTARARPPGVPPGLPERRAPRPRRRYPRGSPPAPCSRARSCTAGLPARGYAGRCAPACARPAGVRRWESRRCARRRRVRRKRSACVARPARVGPVCSWNSLIRSGRPGHHSVPRPPPPVSFRGGWRSRPRTGSPA

SEQ ID NO: 26909 - protein, 401 aa, Pseudomonas aeruginosa
DRAVRLFRLSPHQANHGFDPALCRVFFCPRKRSAIRGSRPRALPSTCLLHLRAIVLVRLCRRVPGVVGLTRRYRLPGLDQHQYLRALLRTKVAQVDRYAEVASGVEAAGDEHRRQWRIAKTLGHAAVALLLDGEHRRQLIVGKHAAVGFANLRKQRQAHAVTPGGRSGKRRSLPVDAHDLAPLEVRRQQRRGLRNRPGHQGSVLRPVPTFLPVQGLLQVRHRLAGPELYADRIHPWLLAGIEHFQQQAALRPIFAQGLRQPQFHGMMIGIVVLLADDHSRRGRQACDQLLRAQRHAAAQFDDSSRLRIVAPFRALPIRQRRQLGLAAAQQQTESEQANAHGDSFNGRRSADDLARDDAGPGPRGRTPRATARGAGLPRAYRAGAGDHSATAAGGRNSARPG

SEQ ID NO: 26910 - protein, 181 aa, Pseudomonas aeruginosa
CAGAAGRAPRSVRRAAAPAPARPATAAPAPAPGARAGVRRRTAPGSCARPDAWRRPPPRPRRRSAHRARGRWNGAADRSRPPPPPERRSPATNSAAAPPGAARERRPASRRGRARRAAPALRPAPVRHRERQARCSCQRRWGRVRRASRQAAAPARGLPVQSFRHGGWTGSPRAASGPPPQ

SEQ ID NO: 26911 - protein, 234 aa, Pseudomonas aeruginosa
PAGHQQRHQQQRPESWVAGAVQAAQVPEGQGTQGGVIGEIGKQSDHRAGQRGQGDPCQQHGGHAGLAIAAAKSIDQPGHPQAAAEGAQRQQVGREERRQATQRGAEYDGQRRAEGRAAGHPDQPWIGQRVAEQALHRHPGQRQHRAHGQAEQGPRQADLAEDHFRLGQARSIERQPGQAQRGAQGIAQRQADGTEGEGQPEDQHERNPQRTEQCAGTNNRFQWAASVLSGFAEG

SEQ ID NO: 26912 - protein, 194 aa, Pseudomonas aeruginosa
WVSFNAAQPSRKAAASICASTSVAAGARGSCSASTASCSAARRRSTSGSQARTSLASVRNTLCTATPCWSNTWMLRWVPRAVSSAMAKTAFQPPRNRRRSISGETTRPICPLAETVTSRYGPLRSWTQCSLRVSAMIGPSSPSAGSKAAQSGRRRTASMPTRLATSSPSLTCNSAAASRARSCGRSARRSCQAR

SEQ ID NO: 26913 - protein, 183 aa, Pseudomonas aeruginosa
ACGTKIKKRKERAMRRFSLRFVLLLLFGLLLYACRNEPGPVRLAPGVTAADYRTFFIQAVRAEGHRIDFEERFDTAVRRALEAKGYRYQAEHGDLRVIYALGLQRQPGLEMRPVITQDGVFTQTQLTEDTEARLALRILDESNGRVLLESVLSRQLHDPALTQEAFDRGVAQLLKDFPSRSQP

SEQ ID NO: 26914 - protein, 409 aa, Pseudomonas aeruginosa
GSLRQAIDLPLRRQQPVGAEHRLDPAHRLAQAVAVLDQGETHMIVAVVAEADPRRHRDLGVLQQLLGELQRAQMRVGLGDLRPDVHRGLRVLHHPAGLAQPLHQDVAALLVLPGDIADALLVAFQSGDGRHLQGREGAVVVVALDPRQGRDQLGIADHEADPPAGHVVALRQGEELHGDVLGARHLHDRRRFPAVVDDVGIGQVVHDHHVVLLGQRHHALEEVQLDALRGRVGGEAENHHAWLGNRFTDRPFQLVEEIDARHQRHRAHLGAGDHRTVDMDRIARVGHEDGVAMVEGRQHQVRQAFLGADGDDGFAFRVDLHVVAVAVPVRDGPAQARDAARGGVAMGVFALGDGAELLDDMRRGRPVGIAHAQVDDVLATATSGHLQFGGDIENVGGKAVDARETARRA

SEQ ID NO: 26915 - protein, 266 aa, Pseudomonas aeruginosa
TPRRPPRGPWGAWVVSCGSRIFGTQPSAGIVRDTAPTRQRCNARHAEIRFSLVGGRLHGRPLLLAPWGSLQSTFRGIQHAGKAVSTKGAQHHGAHRDPGGDHHLPDHGLHPLRQPEHPRRDRHGQGRGVRRHLPGSGHRLDHHGPDRQLPDRPGPRHGPQRLLHLHRGAAHGPQLAGRAGRSVHFRHHVLPAVDLSHPRMDHQQHPPAAALGDRRRHRPVPRTDCPAERGHRGGQPGNPDRHGRPDQAGTDPRHPRLHPDRRPGGA

SEQ ID NO: 26916 - protein, 605 aa, Pseudomonas aeruginosa
RHRRGADRYPGGHRHRHPARRDPVRRRGLDAAVAGADLPPTGHQGRAGHRPGQRDLRLPLRRPVRQLRHPDRRCQARRTDGQGRPHAEDGPRADRRQYRRHGRLAAGHLDHHQLHRVRRGRQRRRPHRPDRHRRRHPVPPRAVLRPAGWQRTGLRHRPGAALRRRTDGLGPGRNRLGRHHRRRAGGRHRAGHAVHLFDRHRHRLRLHFLDRDQGAVRALARTEPGAGDPLRPVRDQAGLLQRMSRPQFDPSAYAAQLEDKKSRLAGLLAPFAAPAPEIFESPREHYRLRAEFRLWRETGNEKRHYAMFEQGDKHTPILIEDFPIASRRINELMPRLKAAWADPALGFKLFQVEFLTTLAGDALITLCYHRPIDDAWRQAAEKLAAELGVNLVGRSRGKRIVVGRDYVEEELSVAGRRFRYRQPEGAFTQPNGEVNQKMLGWAYEALGQRDDDLLELYCGNGNFTLPLATRVRKVLATEISKSSVNAALANLADNAVDNVSLVRLSAEELTQALNEVRPFRRLADIDLKSYAFGSVFVDPPRAGMDPDTCELTRRFERILYISCNPETLAQNIAQLHDTHRISRCALFDQFPYTHHMESGVLLERR

SEQ ID NO: 26917 - protein, 362 aa, Pseudomonas aeruginosa
SKTKSTAGATPAASRSASVAWRRAPPRPSASTARPSRKSARSNSAPEPDRRGAKAPRFVSAVPRRTARAMTSSYVGRFAPTPSGYLHFGSLVAAVASYLDARAVGGRWLVRMEDLDPPREVPGAQQAILETLERYGFEWDGAVERQSERFPDYAAVVEQLLRSGLAYACTCSRKQLEGFAGIYPGFCRDAGHAREDAAIRLRVPELEYRFVDRVQGEVHQHLGREVGDFVIQRRDGFYAYQLAVVLDDAWQGITDIVRGADLLEWTPRQLYLQELLGLSQPRYLHVPLIVQPDGHKLGKSYRSPPLPAEQAAAPQTRALRALGQRPPAELAQASASEALAWGVAHWDATRIPRCATLPEERL

SEQ ID NO: 26918 - protein, 81 aa, Pseudomonas aeruginosa
PARRLAGTHPQPVACRPKHEGSGMYIYRLVLLLVVGIYLFSPAIMDWWIDPNGAWYRPYLLWLILIVVTFILQSQRDADEL

SEQ ID NO: 26919 - protein, 841 aa, Pseudomonas aeruginosa
PDPADPDQRRLPLHPLRHRLDHRARLRAAPAGTPPAGLHPVAGRLRQCLGVLRHGRPGLPVRLRVPRHLPGDFRGLPARPGAALSDPPGDTRIPAVLAGRPLRLPFPQYLGRRPDHAVHADRRAADAGPADPGGHRLDQHSHPRPGPGAGRVRLLHPDHPVRDPLRRSPHRHPRTPRGTGVRHRLRVAGQAGDARQYRPLRPVRRLRRAGRPGSLAAAEPDRADHPAHAAGRRSMANAAAGVLRRGHRDAAHVPHDLHREPQPARADFRQLGPAAVPAADEPGGTADPLGRAAPRRLDHTGVLHHRPRPGGGQPGPGPGRLHRRHLRRQRADYRDDPGALGNGPQPPGAAALPAAGAGQHLPLAEMDPAPADRRHHHGQLRLLPAAGRRTGPLQPGHSVLRRHPAIPSRRPLGAVLADRQPPWLHLRADRRHAGLGDHHAAAPDGERTGPVPAAVRRDLRAGRFELAPGGAVLAGGQRAGIHPGVAVHRGQRRGKRRRRGLRGGQRTPSATPRTVRRFAAGVRQPVGQAAGRQDRAEGGRAGPARSPPALRRTSPLCPASLARPHRGEPFRADGTQCRPGHRGDLPSLQDQRRKLCHRGHPLHREPPGGLSLPADWPGCRTRHPAPLPPADPARPADGRLLPGQGPGSADVEPRHRGTHRGRRAEGRRFAPVGLARTLEGPAGTFHRRPRRAPAQAAPGLRRPHPLAEPAQGGHRGTPGAGQQRPGATGGRPHRNPTVGRQAGPLRAPGFHRPPSRRGGPRDRQSDHRHRLPGAEPARGTRRRRRADRNQRADPRPDQARIAHRPVVDELRPLRQPPAGPGTGVPERSRPGGHRTAVAEPA

SEQ ID NO: 26920 - protein, 366 aa, Pseudomonas aeruginosa
RRSRVLQPLRSGALGRGRLAAPGPGADQPALQCSRRQPAGRRDPGPQRSLGTYRGPGRRGRGQRHSEGDHGPVVRTVLHHQGPRQGDRARPRTGLFDRGRALWTDNHREPDGSPARRRHSLPRDPAAAPWPDGRAVDEHVERAEYMAHILIVEDETIIRSALRRLLERNQYQVSEAGSVQEAQERYTIPSFDMVVSDLRLPGAPGTELIKLAEGIPVLIMTSYASLRSAVDSMKMGAVDYIAKPFDHDEMLQAVARILKDRQENRSAAPVLRQRRQGRRRARRQPGGSRRRDRHHRLLCADARAVQQDSQGRADRLHGTDPGRVRHRQGTGRPRPAQPVEARQGAADLGELCGDSGNPDRIRAVRP

SEQ ID NO: 26921 - protein, 472 aa, Pseudomonas aeruginosa
LHHQCPVLRRHQRAAAGLRQWRSRHPQSPDPPDRRSGAALSGRPGADAAGGTFRRQARLRNREAQRRADSPAGPAAAGNPFGAPVRRGAQAVPRRPGRAHFRTAGRVRTVRAAVPGQRQGTAGQPRLHRQADPPGPGQYRCAHSPGQAGNPGLPLRRAALAGPAGARRAVAGERHAGHPGDAGSRPRTDQRTVPADCHSQAFHPADPRDLGYAGTSAATPGQARRPAPGKPALPRRLRLPPAARKCRRGNRRTRPMVDRLPGSQRQRAAQHDPRPGQPGRRQRPAQASPRRQQRPSAPRAAQGRQRRKRRMIQRVYVALGSNLAEPREQIQAALDAFERLPETRLVAVSPLYISDPLGPADQPRFVNGVAALDTNLAPLDLLDALQAIELEQGRVRDLRWGPRTLDLDILLFGEQLLDLPRLKVPHYHMQARAFVLYPLADLAPDLRLPDGRHLPELLAACPFEGIERLPGA

SEQ ID NO: 26922 - protein, 303 aa, Pseudomonas aeruginosa
RRNNAVTPAIDFEPPHPDYKWPFAPRRLITGPTRSLSMPDVTLTTLQGLKQSGEKIAMLTCYDATFAHTASQAGVDVLLVGDSLGMVLQGHDSTLPVSNEEMAYHTACVKRGNKGSLIVTDLAFESSHSVAQTLADAVRLMQAGAHMVKLEGGAWLAEPIARLAQMGVPVCAHLGLTPQAVNLFGGFKVQGRQETQARQLRADAIALEQAGAAMLLLECVPSVLAEEITQAVKIPVIGIGAGAATDGQVLVMHDMLGLSLTGRSPKFVKDFMQGQESIPAAIAAYVRAVKDVSFPAAEHGFNA

SEQ ID NO: 26923 - protein, 103 aa, Pseudomonas aeruginosa
SASWSATSTCRCRSSASRRCAPPMASRCPRATVTSTSSSAPPPRRSTAPCGSSANASAPAPRTSRHCSPTPARPWNRPGCAPTTWKSASRSACAPGYPATANW

SEQ ID NO: 26924 - protein, 379 aa, Pseudomonas aeruginosa
TGQPPERRDHPVHRFLQVLRDPGNPEERPGRTRLVPGPGRHRGRALPPFHRRLQQQGSRDRLRHPRGKHLPHVGLGRRPLLAVVGHRPADRHVHRHLQLQGTAVRRLQHGPAFPDRAVRTQHPGAARPARRLVRRLLGREQPRDPALRLLSAEYHRPPATTGHGIQRQERAPGRHAGHQRHRAGDLGWCRLQRPARLPSVAAPRHPVDPGGLHRPGEQLQPGGRPSPVAVRQLPVAEPGADARQEPRGGRGRTARQGPAGSRSAAPGAAQGDSGQPTEQHPGGRAHQRPPPRRADRHVRAQGLRTEHPLGHQRLRPMGRGAWQGTRQGCLFAPGRQRGNPGRGRLDPRPDRLLPRPPSRLIRLSPKPGSRPGFFIPSGD

SEQ ID NO: 26925 - protein, 176 aa, Pseudomonas aeruginosa
STTASTADPRNRPAALRRGTVPVSPAPGLSSCLPCRSEPPMESVRRHIESQVLSLTGLAVGGVDFESPKGDPGLFGPDAACWKVHGDFSSMMIGGIGALLLQMLHPLALAGVWDHSNFRDDLLGRLRRTGQFISATTYGPLADAERLIERVRRIHESVIGQLPDGTPLLRQRTRTC

SEQ ID NO: 26926 - protein, 195 aa, Pseudomonas aeruginosa
NGKRKRAMPKGLKRAVSALLITFLVYCLLGFLLIPGIGLRVANQQLAQYATVPARLERIEFNPFSLELTLWGLRLGEEKNPSSPSAGCTPTCSWTACGNASCTWPTSSWKVRIPNCCSTRRASSTWPACSGSRRANRPSLNSRATRSRCASTASNWPRAACTSRTCDRASRWTSASIRWASSCTTSAPCPTTARR

SEQ ID NO: 26927 - protein, 171 aa, Pseudomonas aeruginosa
PSKRRARLRRPARQPGRKRPRLRKSTRQPATLRNSSPTLQRRLRRKVRKPPRRRPPSPGTSSCATPSCAATRRTWWIASRPPRSRWKSARWTSTCRTSTASARPPSTSSSRPASATAARSRPAARWCSTRSAPGSRSVPATSTCAWPRPTSRRSSAWNCAAASLAASWRST

SEQ ID NO: 26928 - protein, 122 aa, Pseudomonas aeruginosa
STSVSPKAKTRVMSTPNCTWIASDTLHKRFAALAAPLLYLACASAQADTMRCGSALVSVGDRAFEVQQKCGDPDHRDDVGYTLGSYDRREFKVEEWVYGPRNGVTYILTFEANKLKRIEFKR

SEQ ID NO: 26929 - protein, 171 aa, Pseudomonas aeruginosa
LVQRLSVFLQRRVHRRYLLYVATEARQGLFEIVPTDGHVPLGEQFALGVAGGGGDAHAHHRLVTLVGIEKILGELGRLAEAQRQHPGGQRVEAAGVAGLLGIEQPADFLQCLVGTHAARLVEHQDAADGAADTLHLGHAQSSVSSPWRRPSSATARSISADSSAPRRMLSS

SEQ ID NO: 26930 - protein, 171 aa, Pseudomonas aeruginosa
LMPTSTMSPWRRVPSWTSTVATGPRPLSRRDSTTTPRPGADGVAFSSSTSACSRTASSSSSTPVPSFAETGTKGASPPHSSGITSRAARPFLMLSGLASGLSILFTATTIGTPAAFACCTASWVCGMTPSSAATTRITISVAWAPRARIAVNAAWPGVSRKVTMPRSVSTW

SEQ ID NO: 26931 - protein, 138 aa, Pseudomonas aeruginosa
PSLSSSVLRGATRGAGTFSFSLTEGRCWVCLRSRRSSSSSRLGARRGSSFLRSSTAAGLATGSAAATSATTAGSAPAVAAASWAALARAASSALRASSSARWRAAASSAFRRSASSAARCSSSSRWRSASISSGLRLT

SEQ ID NO: 26932 - protein, 206 aa, Pseudomonas aeruginosa
VFFLRTSTLTVLLPPTFSVVVVLRCRVILRGSLARSPWLPFRWVSRACFSLSVTTCSALVCGRPASRICSSRRSTGVSTTWASSFTVTCVMHFSPQAATAYSNQWARAAMINLPARSSSMPSMSSRSSIDCSARSSRVVTPRSARSRASSLLMPSRLSRSSAGCASASFSSVAMALVSRRSLARERSSLTMSSSKPSMLSISSIGT

SEQ ID NO: 26933 - protein, 191 aa, Pseudomonas aeruginosa
AISSRVVKPSSTSTWASSSSTSSSSTKRCRISPVSACCLAWISASVITFRVQPVNWLARRTFWPLRPIACARLSSATAISMVWVSSSTMIAATSAGAMALITNCAGLSSHRTISTRSPPISPDTAWTREPRMPMQAPCGSMRLSLERTAILAREPGSRAAAITSINCSAISGTSMRNSSISISGAVRDRTS

SEQ ID NO: 26934 - protein, 144 aa, Pseudomonas aeruginosa
AVLRFSFSDMTMVLRSAPIMILSLASSNSRMSTMRLLERAANSEASLTRLARSAPEKPGVPRAMTAGSTWSPSGTLRMCTLRICSRPRISGKPTTTWRSKRPGRSSAGSRTSGRLVAAMTMMPSFISKPSISTSNWLRVCSRSS

SEQ ID NO: 26935 - protein, 216 aa, Pseudomonas aeruginosa
PPPRPAPRWRPTASISSMKMMHGACFLAWSNMSRTREAPTPTNISTKSEPEMVKNGTLASPAMALASRVLPVPGGPTISTPRGIRPPRRWNLPGSRRNSTSSLTSSLASSQPATSAKVVLTWSSDSRRALLLPKLIGPPRPPPPPCIWRMKNMKTAMITRIGKLATSNWVQMLCCSGCLPSTTTLLLTRSPIRPLSWIAGRMVLKVSPSLRLPVMT

SEQ ID NO: 26936 - protein, 200 aa, Pseudomonas aeruginosa
PFMNPRPSRHNRSSTNRQAIGSIIPVYSPRKPRASRYCSRERSRDDRGLRICTLSNISRACLWYWSKPSPWKILIRKSPPGRSTRPARSSASSQRYMARGWSEARTPLILGAISEITRSTGWSPIASRIRANTASSVKSPWIKVTSGMLSISRMSEAISRPRSPITRLVTCDHPPGAAPRSTTVMPGRRMRSFSWISSSL

SEQ ID NO: 26937 - protein, 114 aa, Pseudomonas aeruginosa
NRRLFPRGLIMALTQEQKKQFKSIGHHLKPVLIVAENGLTEGVLAELERALNDHELIKVKLALAERDDRRALLDELCAQSRSDLVQSIGKMALVYRKNPKPNKNLSNISRFAGI

SEQ ID NO: 26938 - protein, 144 aa, Pseudomonas aeruginosa
SSPRRCPGPAPGGWRRGARGPSSGSWRQRPGPATDGRGRCRTPGSRYRGIRGSPGSRSRTVRGRRGRWKGRCRQGSAPALRWPVSAPAPRTGGSRAPPACAGCSASRRSRRPPRDTAVHRPGSPDDCRFPGSRRWSATRSARRW

SEQ ID NO: 26939 - protein, 539 aa, Pseudomonas aeruginosa
AEHILHVVQAVLLALQPQRRTHRATGEGHAAGSLVGDLHALALGGEQHGVVAHHVAGAHGGEADGFPRPRAGLPLASVDRHFLEVPAERLGYHLAHAQGGAGRRIDLVPVMGLDDLDIHFVAQHPCRSIQKLQAKVHADAEVGSEDDRDILRRFGQQQLLVGAEAGGADDHRAARLAALLDVLQGYGGMGEVDQDVELLADLAQVPGQRHADPAETGQLAGVRPHQGAIRTIHRRRQPGGTAGLLNGLDQVLAHAPGGAHYGYTSHKTTPRGTRTRLSGRAHGFVYRSSKKRFMPSNQPLALGECEVSLCNDLRNSSSSSRWRLSRFTGVSTTTLHIRSPAPPPRTGATPLPRRRNSLPVWVLSGIFSLTRPSRVGTSSSPPSAASAKLIGTSQYRCLPSRWKIGCSRTLTTTYRSPAGPPMLPASPSPVRRMRSPVSTPAGTFTDRVFCSSTRPWPWQEPQGSEIILPVPWQRGQVCWTEKKPCCMRTWPIPPQVVQVTGVVPGLAPLPLQVLQPTRVGTRMVTVVPRTASSRSRSRV

SEQ ID NO: 26940 - protein, 701 aa, Pseudomonas aeruginosa
KSRFAITFPSQLRTLQTRQRGSRLPRGGSCVPAWPARGAEASRGLLVVLDLFELGVHHVVSGFRLLALGSVFALLGLFGVHLLRQRGGSLGQSVHLGLDLGLVVALHRRFQLAQRLLDGRLVLGGGLVARLGDHLAGRVDQRVALVASGSQFLELAVLLGVRLGIADHLLDLILGQAGGCLDHDGLLLAGGLVLRRDVQDAVGIDIEGHLDLRHAARSRRNVGQVELAQRLVLRGLLALALQHVDGHRALVVVGGGEHLRLLGRDGGVLLDQTGHHAAQGLDAEGQRGHVEQQHVLHVAGQDRALDGGTDSHGFVRVDVLARFLAEELGNGLLYQRHAGLAADQDHFMDIGNIQAGILQRGAARLDGALHQVFDQGLQLGAGNLDVQVLRTARVGSHIRQVDVGLLGRGQLDLGFLGRFLQTLHGQRVALQVDAAFLLELVDEVVDQADVEVFAAEEGVAVGGQHFELVLAVDFGDLDHRHVEGTAAQVIDDHGVVALGLVQAVGQRRRGRLVDDPLDVEAGDAAGVLGGLALAVVEVGRNGDHRFGDRLAEVVFGGLLHFLQHFGGNLRRRHLLALHFHPGVAVVGLDDAVRHHLDVFLNHVLFEATADQALHRIQGVLRVGDRLALGRLAHQGFAIVGVGDDRGGGTRALGVLDDLDVTVLQDSHAGVGGTQVDANDFAHIHSPETLIPCDPPVGLVLG

SEQ ID NO: 26941 - protein, 137 aa, Pseudomonas aeruginosa
PDKTHGAARHAGSPVRSQLRHRRASGSRTRYRHERDHRRNRCGQVDHARRPRPYPRRPRRQRRGTSRSGQGRHSRQLRRQRHRRGPRLARRARPGTGRSVHPAPGDHCRRSLACLHQRHALPAGRPEEPGRTADRHP

SEQ ID NO: 26942 - protein, 437 aa, Pseudomonas aeruginosa
RRRTARPPPVAQLPAGRTGKPVPRRKRTGKPGAGAEDPEQRRKPARRLPPSRGNVQRERCRQRPFRAQCQPQPPVLVQRPARRSRRSGQSVVQRADPGRGGDRRTEPLRRPLRCRSQSPAAGRGAPGRHLLPGAQAPGPARRTGRPAAAPVRRAGGAERRRRSGRTPGRRAGRLRPALPGKSRRTEPPAPGRGRTSCRQRGAGNAAPGHARGALRHRPASRRQRRAAGQRTGKRGVPGQRQPRAAAERAGQGRLGRRTVADQPGDPGDHGTDLAHPHPGLRRSRRRHRRPHRRSGRTVAAPPRRTRPGPHRDPLAAGRRPGPPAPVRAQGTRQQRNPYGGRHPEQGPADRGDRPHARRRRPDQGIPGPREETGQPGRPELNVPSMENENGDPRVAVFAWNRCATTSSCARRAPDCDRPARSRARGRFPSGASRFPHP

SEQ ID NO: 26943 - protein, 250 aa, Pseudomonas aeruginosa
NSHFCCRAGDSPSIAGGTAASATAARCARRPGPGFGRKNAQRSLTPLEDFSYKTLASGQEKSGHCPKFASIPQARRRPIAVKPATPYNAPPMAKQKKHPSGTIAQNKKALHDYFIEQRFEAGVALAGWEVKSLRAGKAQLVDSYVLLKDGEAWLLGSHITPLTTASTHVIADPVRTRKLLLHKRELGKLFGAVQQKGYACVALSMYWKKHLVKCEIALAKGKKDFDKRHTEKERDSDREIQRAMRHGKDD

SEQ ID NO: 26944 - protein, 378 aa, Pseudomonas aeruginosa
ARLPWPFPPCPAPLRSMQNLSTQRKSPMIISASTDYRAAAQRKLPPFLFHYIDGGAYAEYTLRRNVEDLSAIALRQRVLKNMSELSLETRLFDETLAMPVALAPVGLTGMYARRGEVQAARAAAAKGVPFTLSTVSVCPIEEVAPAIDRPMWFQLYVLKDRGFMRNALERAKAAGVTTLVFTVDMPVPGARYRDAHSGMSGPYAAPRRILQAMTHPAWAWDVGLLGKPHDLGNISAYRGNPTGLEDYIGWLGANFDPSISWKDLEWIREFWDGPMVIKGILDPEDARGCGEVRRRRHRRLQPRRAPARRRAVQRPRRCRAIAGGGEGRTGDPCRLRHPHRSRRGADDRPRRRQRAARPRLSIRPGPPPARPGCATCSN

SEQ ID NO: 26945 - protein, 152 aa, Pseudomonas aeruginosa
PSAPPAPASPARPSATRCCSSSATTGTAGKSAPTARRSACSRVSSAPRRTPGWRRSAARSVPTRPRSTPARSAASSPTTPAACAAAPRRTATTPSPACACCWPTAPAWTARTRPASRPSAPATASCWNGSPNSAARPAPTPNWPRRSATSTG

SEQ ID NO: 26946 - protein, 199 aa, Pseudomonas aeruginosa
SASCAAPTPATLVAPPGWRATLPEPCALRASPCSLPTAPGACLARPCWPAPAAASARPAAAACRNGRRRCRSRYAWRRRPPRSTTSGRGWSISPPASRVPWARPSATNSASRCWTRPAVYWKRPATRWCSRITWTTSAAASRSRPRGMRSRPTTSATSCSPPCSRPAAAASTRSTATPAPAPCAWSRVWTIRDCRSTTR

SEQ ID NO: 26947 - protein, 172 aa, Pseudomonas aeruginosa
WSISTGSWWNCVANTCSSGTRAPSTTHAANCSPRTAGPISSATRRSMTWSSSTSSTCSTTARPRLSIPASSTSCCIRACDRAGWSRCRGWSSPTATTSPTRPSPAPCAVSSPRSTATAPRCPRSSPPGASCWLPTGSTRTTGRPRTSTDASNASSARCGSTTSTATTSRPAS

SEQ ID NO: 26948 - protein, 323 aa, Pseudomonas aeruginosa
WTGKPASCSPNRDRYWKTAYPSSHRRISRRSSSARHNCRPWRGPEDVRRSPGQRTAGRQRRALPAAPGTLPLRRGRRRPAATGHPARSAAGAGRPGATHRAERRRGTAGDRRRRRAAGDLRQRRATDRARLAPAPGSLDGRRRGRAPADPGSALVRRAGAVAPRPRAGHRQPRALPGAARRPGRLRLARRSPAPPGRRDRGGLGTGPGRCRTDPATAPCRPAAPGTCEPAGATHYTLAHGLCPPGVAPGEAAAATERRCAPALQRTGHAGRSARSPGDPGRSHRSAAGPVRTGRRPPRRIPLLPGRTAGRMADRRHPSCWRPA

SEQ ID NO: 26949 - protein, 239 aa, Pseudomonas aeruginosa
NPHATGQPAHPCPSRAAFGRPQGPRPRPAASQSQRRADQHLDGADPAPRPPRRRRPAGAIPPGQPRHPGRRRTLRTGAPGHRQGHRAVVAPGDRARDGHRPVAEGDGRQPGGQRPALHTGRGPGRDPRRESRPARRAAGARQRPRGRPGRAAGDLHPLLPQPRHQQRRGQRPGPADRQAHRRTALRQYRPGQGTGGQRAGSAGVPAEDPAGRDAAAGQRSGQRAVTYLIACALAGKGIG

SEQ ID NO: 26950 - protein, 205 aa, Pseudomonas aeruginosa
ALKAMIEPNRIRYTSASQPLVLGQCSRRSPLARLPTSSTAPPTSISAALAIGPAGSDRRRLHTEPKAQDAAANRIRPAPAGLAWRFEPRLSRTMPNSPSTMPPHSSVVLRWPNNWLNSRVNSGTVATARAATPEDTPQCSATVTPPLPQLSRRIPTIPAPRHSRQVGNGAPRQRNQANIRPPAMTKRTPAISIGGQDSTPKRIAR

SEQ ID NO: 26951 - protein, 137 aa, Pseudomonas aeruginosa
PSPNWPGASTCRPRRWPTGWPSWRPKGVITGYHASVNLAKLGLPIECVIELRITEKDCQSVLDELARIPQLTLCHRITGDACVLMKAAVASMPELQDLIDRLMKFGISKTSMILSTPFADRQPASLRGQDGNGGCAA

SEQ ID NO: 26952 - protein, 410 aa, Pseudomonas aeruginosa
  UNSURE (348): Identity of amino acid at the above locations are unknown.
CPRRRNSTGRLADPALERAIEGVRLGKPGAFDDHFDALVGLQQQFLGQSAAVVGDQVVEAHPGHRQAFAQTSGRHAEARGDLLQGGASVHQQLADQFADLAHQVQALHLGQLPARQRLVHAQQFRGGVARGFVQHRGIEYQRVARHAEDRRAAVDRTVALHRRAGFVHQLHFQRLELALGERAEQADHRAGEHFREVAVDRRRFAQRQHRALALHLQLRLQGVGQQAYVAQGMAQAGAEGIAGEEQVFQEQAVERRQVLGQVQADMLFAALVGGGLPEQVLCGMGETAGRQATRWQPDTDQDPVRIAAAGAQGVDHRAHQRYIVGQITHGVFSSYPWGGPILCSFAKXPPPPLSRRGHRNNPSRMTEKPSDRLAAGVVENLDADASRSRLTALPAASARRPMPAAGARLS

SEQ ID NO: 26953 - protein, 294 aa, Pseudomonas aeruginosa
QPPISRRCPMPTAWLDLPAPPALPGLFLRAALRRGIRGKALPERGLRSQVTVDPKHLERYRQVCGFRDDGLLPPTYPHILAFPLQMALLTDKRFPFPLLGLVHLENRIDVLRALGGLGPFTVSVAVENLQPHDKGATFSIVTRLEDQLGLLWVGDSKVLCRGVKVPGEIPPKAEQEPLPLEPVDNWKAPADIGRRYARAAGDYNPIHLSAPSAKLFGFPRAIAHGLWNKARSLAALGERLPASGYRVEVRFQKPVLLPASLTLLASAAAADGQFSLRGKDDLPHMAGHWSRLQG

SEQ ID NO: 26954 - protein, 121 aa, Pseudomonas aeruginosa
SFGRKARSYAAAYRHREESPMDLHELTARLHAIRDRNDWRQFHSPKNLAMAASVEMAELVEIFQWLTEDQSRTLSAEQLEHAGQEVGDIVLYLLLFCGETGLDLEQVVRAKLADCERRFLP

SEQ ID NO: 26955 - protein, 218 aa, Pseudomonas aeruginosa
ITRLPPSRSTCSTARTASWSGAAAASRSCAPARRARPSASRRSARRCRKSCRNTRRADMQLSHRPAETGDLETVAGFPQDRDELFYCYPKAIWPFSVAQLAAAIAERRGSTVAVHDGQVLGFANFYQWQHGDFCALGNMMVAPAARGLGVARYLIGVMENLACEQYKARLMKISCFNANAAGLLLYTQLGYQPRAIAERHDPDGRRVALIQMDKPLEP

SEQ ID NO: 26956 - protein, 276 aa, Pseudomonas aeruginosa
HPRPARPHHRLQRPEHPGPLRRALPHRHPAGLHGRRGDPVPQRRRRAVGPPPRRRPVARAGRRRAAAPLHPPGPRGRRAPADVPPTRGEHRRKRTDRGTRRNLQRRRTGTADPRIRAGADPMSANLHGLEFPDGLFYAPDYNLWLREEVDGSLTLGLSAYGCALYGEIFAFTPKRDGWHIERDRSFGVVEFAKAASSARSPLAGTLLASNPAVVKRPALINRDCYGEGWMVRLQPDDWASARSAFLQGDAAREAFAERMRLDGFDPQHPGVQALDV

SEQ ID NO: 26957 - protein, 148 aa, Pseudomonas aeruginosa
PEQDRIPGAERHPQRFTVAVGQAGAQQAPGQGAAKDPGEHRPAPEIQPYHVGGAAPEQLADGAVVAVGDPARRRRRPLHGVLEAFVGHGLPAGAPVESVEFDMRTTQPGGQRGGEGCLPGPAGADHHHTQRRASLGLDAGHALTATSV

SEQ ID NO: 26958 - protein, 260 aa, Pseudomonas aeruginosa
SALSYGFAATKAPSPAKRSAAANRLFPEMLPSALLANLCHPYPRQPHDADRRRPELRPPRRPATQPRRPPAPDAYRPGTGRAPAGVSRTVAHRLRTHRCRRPRPADGHAPAATAAPARRAGTDDHGGRPAAALAEACQAADRRPDPRRRRQPRRLCQAAPARGRGTPLLSRRRRPPAGDRRPADGVGGLRRLQPTQPPGPRRPCRRSPLHRQRADRRKRLPGRLGPTGRLCPRARNGRAAGQPWRADGWLEGGGQECVLE

SEQ ID NO: 26959 - protein, 134 aa, Pseudomonas aeruginosa
GRAAARSCRGRCARRCRRSRQLAPQSRQLGEEPRLVVELAQIEPEGVVLEPTDHRQRQPAQGFLEVAQGASAQAPGLPRTQAQRGAGQPRHRLRAAADHAQGRRPRRPPSPRRAPRPAPAPDARPGRGSPPPGG

SEQ ID NO: 26960 - protein, 165 aa, Pseudomonas aeruginosa
ARRWPRPCVGLHRLRAIVRVPRRRRRWPVPGSPRAGHPARAARRLRAPAGRRPAAACRARGSCAGARGRAGPGPAGCPAAPAGAGRDRRPAAGSRPSGAPRPVAADARRGGRTGRATAGAGAGECWRRLRSAPAEEWCVTRELLGSAPAGRWAAPQRSGARRGAE

SEQ ID NO: 26961 - protein, 412 aa, Pseudomonas aeruginosa
ISFFHFRLLRERRRCRRVAEDRRQRPRAGSTTLVRVKGVYRRIDLVHRCLGLPVVFLVVRAVGTDAHIVEEPGEHRGAHGQQRQRLGHALPQADQRADARLVGQAGIERRLVGVVQHVHHVGAAHPFGVVQAGVLVTAALQVDDAFGGVFLHVLLAAEDDGAGRAGLHAGRLHAHRDAVGTQAALVGLVVLLRDPWDVERATGDAVAATDALVLVEVDDAVGVLHDRSRARAGLQAARLGAVHAAILADQPLEVAGLVLVLGETHHRPRVGRQVHGVVVGAVVVADLVAQLVPFRAGDLAGLATDALGHVDQFRHFLLVPHRGHRRGGRGAGVDVLTTHVSPHAFSTLTRNDLNSGVWVFPSPTKGVRVLARKPLRAMPAKPQWIGMPTWCTVLPSTCSGRMRLVTTATALM

SEQ ID NO: 26962 - protein, 217 aa, Pseudomonas aeruginosa
SAPAPPGSPPPAWPPSAGIGSACSRRAGKSAGSSTWPSGFPARRSSAKPCATSACVWNASASTCASATECARASWTVSSTTWWWPPASSHAGQGSTASADRPYSATWTCCAARRWARGSPSSAPAASASTSPPSSSPRPATASRGRSANGSRNGAWTSTTASPAASANPLRRGRRARSGCSSASPALPARSSARPAAGYTARTSGTTPYGCSAGWST

SEQ ID NO: 26963 - protein, 196 aa, Pseudomonas aeruginosa
GEQPLAVTRRAESEGVRWGLAFSSSAPAWCILCDSPYHSGPSLAMRGARSPSSFQESCMPTPPWWLFVLPLLAGACLPLQAGINGQLAKQVSSVLAAALISFFVGTLGLLALTLSQREFPGLAALRGLSWWHWCGGFLGMFFIFIAAFAAPRIGALMFMVLVLAGQLGMAMNLHHFGWAGFREAPISALKLGRGWH

SEQ ID NO: 26964 - protein, 118 aa, Pseudomonas aeruginosa
PWRSSATASGRAPARSSPELTAGREPLPYLGDLMFRVLLRALLEEPGALLRTPAPELPWERQPLALTAAGREVLAGRRYRLDLGAPERWVGGVCLRAGTAHWALDEQDRPVWREDPRH

SEQ ID NO: 26965 - protein, 166 aa, Pseudomonas aeruginosa
RSSPGRAQRARSHYHARPFSPHPPADEENPARRRRPRPPGYLGEIPRRPVRRVQRDLLHAAGGSAHRRPDPHGTGRRVRARGAGQANRQATGKGWRDRALQPQARDLHPHPHGQRRLPVPRPQDPPVHHLCPPPGHLPQPPAHRPASRLLRLPAEVVSARRRHALA

SEQ ID NO: 26966 - protein, 479 aa, Pseudomonas aeruginosa
LVLSHRRPAAQALAHLVGQGAERTRADRQQGVATQPAGQLAVLRPLRPPAAVEHCRVRPLRPEHQRPLAPAGVAGQQRGGGLLLGARAQQQGAEEQREQQWGQCQASQPATPQPGAARQRRAQQVGGEQRQGRQAGQHVGPEDVAGEGEEQARRQSPEQPVAPARGDAIDHLPALAPAQPEQQRQPEAPGKRGGQQEQPDAAVGIGVGIAVAVAVPAGGDEALPMLAEQEVLEEARRLQLRQQVPGRGHQEHQQASADPWQAPPERAPAPLQQGPQADRQSGEDQRQRPLRQQPEAEAEEHQPALAAPDSLRAMQAQPEAAHGQDQRQGQGHVGHYRPGGDEEQRRTAQQDAGDPRLPTIFASLPVPYQPQHQHAQQPVRQAAGELGGAEQKLAAGAEPEGQRRLAPERHADVVPGRDPVAQFGHLPRHLAIAGLGGVHQRIAAQAQQADGEGQGEQEPGQRPAAQRPHGLAPPTCAGR

SEQ ID NO: 26967 - protein, 474 aa, Pseudomonas aeruginosa
KTGFPQASPPSLYCPADPEDPMSLLRDAWRHAPTHHRVWALAGPMILSNVSVPLVHLVDSTVVGHLPHAYQLGAVAVGGSLYTLMVGVLGFLRMGTTGFAAQAAGRDDGGALRLILAQGLGMALLLALLLGALALPLSGWALQLMQPSAELTGEARAFFHTRLLGLPAALASYALVGWFLGTQNARAPLAILLTTNLSNIALVLWFVHGLDWGVQGAARASVLAEWSGALLGLALTRRDLARRPGRAQWQRLRHWLSWLPLLMVNRDIFIRSLALQLVFFLLTVQGTRLGDATVAANALLLNGLLLTSYALDGLAHAVEALCGHAIGARDRAALRRALVVAGGWSLLASLAFAALFALFGHLFIDLQSDIADVREVAYAYLPYLACLPLLGMWSYLLDGLFIGATRAREMRNAMLVAVAASLPLGWLLQGLGNHGLWLAFLAFMLLRGLVLAAYGWRLTRRDGWFAAQGADSGR

SEQ ID NO: 26968 - protein, 176 aa, Pseudomonas aeruginosa
KHCGTRPPPHRRVRWPAAPAPSARAAPAGNRAGAPAGCPTAGAAPPGYRPPPTPARRRRGWHRAPGPGRWAARPVRPGPGTPPAVPPRHWNGRPRSAARRAAGRSADRLRGRGSPRQRLARPRSAAGNGRATPAPEASGRVRSGTGQGSPGADRRPGGTAAGRTAGPAAPATRCRS

SEQ ID NO: 26969 - protein, 138 aa, Pseudomonas aeruginosa
APSPPRRSRATRRWPGRRFPSVDRGRSAGRRSPGRARRWRRTGPGTPCARGCGCRAGARGSRRGCIARPAPAGPGGVPRRAAGRHRPGARGWRSRAFPRPRPCTPAGVRRPCPRGSPRDADGRNRRAVRRPCARHPTA

SEQ ID NO: 26970 - protein, 181 aa, Pseudomonas aeruginosa
THSRGIPEAPSGTLARGLLDCAHPTPRSAAMAQAIVAYLHYLSIFLLFALLVLQHRLLRLPLDLERARSLAAIDRGYGLCALAVLASGLARVLWYGKGVDYYLHNGLFHAKVGLFVLAALVSLLPTVTFLGWRGTLKAREVPAVTPARGRRVVLAVRLQLLLLLVIPLLATLMARGFGMRG

SEQ ID NO: 26971 - protein, 119 aa, Pseudomonas aeruginosa
TPGSPPSGPPAPASAPAEPWSWRKSPRSPRRSSSTASAAANCPVRPTASWSTSFPSSGPKGASCSRAPRTAATTIRWVACTAATPRRCWTPAWAARSIPGSRPARAIPPPTCGSATCAR

SEQ ID NO: 26972 - protein, 195 aa, Pseudomonas aeruginosa
RPAFQGIEAMRYPEDHKQKTRRRIVEEAARLFRQDGVGATGLQPLMKALGLTHGGFYAHFKSKDDLVETALRHAAAQLDEITAPLAEAERPLALLIEQYLSPRHRDNPGAGCPLPTLSAELGQRGTPSPTTDSIVRKRLAMIEAALEGEDAGERAVLLLASLVGALQLSRSVQDEALSQRILEATRKKLLEQMER

SEQ ID NO: 26973 - protein, 228 aa, Pseudomonas aeruginosa
KVRTHTTPTCPTMALSIAGGSCVMYHGERLNAWTHLIGAVAACTGAVWLTVQASLNGSPWKIVGVGVYGVTLTLLYSISTAYHSVRGRAKVVMRKLDHLSIYLLIAGSYTPFCLVTLRGPWGWTLFGIVWGLAVLGMLQEIKPRSEARVLSVVIYAVMGWIVLIAVKPLLAALGSAGFTWLAAGGVLYTVGIVFYAYDHRFRHWHGIWHLFVIAGSLLHFVAIWRYVL

SEQ ID NO: 26974 - protein, 174 aa, Pseudomonas aeruginosa
PGGSVPAPRFSAAPAKRSGNAWHRGKTPVPPAAARKTACVPPAPGSERSRGHSPGPPRRCPGSTNVRRPPAPAPGPRSAGHRSRRTGPVHRHLSPRCRVRRGWIPAGYPGSGPSRRVHAARPGKGASPVRRGPAPPRRAGAGRAPATQDRPNRPATAPGCNPPRSVRSDGRACA

SEQ ID NO: 26975 - protein, 750 aa, Pseudomonas aeruginosa
AGESRIPVRGGFPAAVCVLAWHGFLAAVEGSVVQGQAHGQVARLAGGDPDVVIGTLVVATIEEVVDVHPEGGIARQRIVREQVDGGVGRQFEAAVAAVAGALADIVDRRAGIGAVQPAFAELVDAHQAAAVLRHVEQAAAASDVLILGHFGVDIGVGADQPQLLGELAAELQVEALAARLAGGLLVTGIARVGGEHVLLFQVERGECHAQPAIEQVELHPRLVAAPLLRVEGLAGHVGTAIGLEGFRGVGEQADLRGRLVQHADARGGGTLGLLRAGVAEAAIVQARGVHVLAVAVEAHAEQAAPFLAELDLVLQVEGHRVDFLVVAVVASEGWFRLAVDRPADVDGIGVARRDATQDQFVVVVALVLEAHQQLVADRAGMEVAEQVELGDAVVPLEVAVAVLPAQAVAVGGEAGVLRGVAVQVAMLVVAGQAQAPLLVEVMAQGGLEGFVVVVDLAVVRFAEEPRARQAAQVVVRRHGAAVEDLAVAHHLGFHQQRGVRVQLPAERWRHQQALAVGVVAEALAVLHRQVHPVEQVALFVQRRVQVQGRAVAVPTAGAGMQAGEALGLGLLGHQVHRAAGIAAPVKAGGRSLEDFHALDGGAVRGVHIAAVGAEAVAVELRSGEATDVVLEHRQAAEVVLPRDPAGEVQRPFDTSAVKVVEHLARHHADGLRDVLDTGVGARRAGRPIGPVALHRARRALRFGGDSEDLKLRGTFRFRPERRTAATEADTEDKRHTDSHGKSHQKRNDIL

SEQ ID NO: 26976 - protein, 419 aa, Pseudomonas aeruginosa
RYQFDSGLAIQCPALSRVSPPGCDTHPSFPTTSPAMPNSISNSSRLHSIDALRGLVMLFMLLDHVRETFFLHRQVGDPMDVASTEPALFLSRTLAHLCAPVFVFLTGLSAFLYGEKHQGRRAVSAFLFKRGLFLVALELTLVNFAWTFQLPPTVIYLQVIWAIGLSMLALAALLWLPRPLLAALGVLLVAGHNLLDPLHFAPGSAWHLPWAVLHDRGWIEAGDALRLRTSYPLLPWIGVIALGYAAGNWFSGATPATTRRRYLLAGGGGLLLGFILLRLLNGYGEKPWAFGETPAITLMGFFNVTKYPPSLLFLALTLGIGLLLLAWFERLDWSGRGKALVAFGGAPMFFYLLHLYLLKLLYLLALAIWGANRGDYFGFSSVPALWLCSILLAVTLYPAVHWFAGFKARRRDIAWLKYF

SEQ ID NO: 26977 - protein, 561 aa, Pseudomonas aeruginosa
HRAIIRSDALPRRPRKKRVMMTEHDDPTLDRLKHHFAQRVINQARQVLEVWQRLTRAEWNSDGMEELADATLRLQRYAERFEQAEHAQLAGAIDRTLDVVEANRGRLSSESISELNQLMQRLSRTGLRHGDQLEHTVLPPLRKPVYLALKDRERAERLAQQLEFFGLQALSCETADAFRASMRERYPAAIVMEVDFAGPDMGLRLASEAQAGLEHKLPVLFFSDSETDTPTRLAAARAGGQEFFTGTLDASSVLEKIETLSRLSFYEPYRVLIVDDSRAQALHTEMVLNSAGIITRALTEPLSVMAELSDFQPDLIILDMYMPECLGTELAKVIRQHERHVSVPIIYLSAEDDLDKQLDAMSEGGDDFLTKPIRPRHLIATVRTRASRARSLKARMVRDSLTGLYNHTHTLQLLEDARLRARRDGRPLSFAMLDIDHFKQVNDRFGHPMGDRVIKGLALFLKQRLRKTDHIGRYGGEEFAVVLPDTDLDAARLVLDEIRQRFAEIHNPAQPTDLRCTFSCGIAELTPDLDIKSMAKQADEALYRAKHGGRNRIEVYRPDAR

SEQ ID NO: 26978 - protein, 181 aa, Pseudomonas aeruginosa
PNGNNLRSRRSVVGRDSPCASSNSPTSTPCSCSPSASPWESPCGGRNAPWSGPSSCSTSTWSCRSASTNRSRATSASTSAAATPCASRPRCKPWKASPRPCRSYRRTSPGPSRQASRSCANSAPATCSPPASSPATRRACCYRPSATSPATWNNGPPTWTPRRGSPRPAPTAPRCCSPACT

SEQ ID NO: 26979 - protein, 357 aa, Pseudomonas aeruginosa
WACSAPASISRRNCSHPGYWCHSRRFFALFAVAMFGFFELRMPGFIREPLDRLAGDARGGSILGAATLGVLSSLLVSPCVSAPLAASLLYISASGDAWGGGLQLFALGLGMGTPLVVFGAGGGALLPKSGAWMNGVRNAFGVLLLAVAVWLLERVVSGPVALMLWGMLAGGAGLALGALEFTPKSAARRLLQLLGLMFLTYAVAAWIGALQGESDPIHPLGRSVPSIHAGPPSTPGEWQNLTTPAQLDAALAEARQAGKPVLLDWYADWCISCKVIERQVLTDPTVQARLPAYRLLRFDITESNPAQRGLLDRYNLFGPPAILFFAPGGDEWSDLRVIGEIDAAGLAERLRRAATRQ

SEQ ID NO: 26980 - protein, 465 aa, Pseudomonas aeruginosa
VRPAAVHHRLSRGEPAMLEKVLIANRGEIALRILRACKELGIKTVAVHSTADRELMHLSLADESVCIGPAPATQSYLQIPAIIAAAEVTGATAIHPGYGFLAENADFAEQIERSGFTFVGPTAEVIRLMGDKVSAKDAMKRAGVPTVPGSDGPLPEDEETALAIAREVGYPVIIKAAGGGGGRGMRVVYDESELIKSAKLTRTEAGAAFGNPMVYLEKFLTNPRHVEVQVLSDGQGNAIHLGDRDCSLQRRHQKVIEEAPAPGIDEKARQEVFARCVQACIEIGYRGAGTFEFLYENGRFYFIEMNTRVQVEHPVSEMVTGVDIVKEMLRIASGEKLSIRQEDVVIRGHALECRINAEDPKTFMPSPGKVKHFHAPGGNGVRVDSHLYSGYSVPPNYDSLVGKVITYGADRDEALARMRNALDELIVDGIKTNTELHKDLVRDAAFCKGGVNIHYLEKKLGMDKH

SEQ ID NO: 26981 - protein, 249 aa, Pseudomonas aeruginosa
DRPARPPRLAYRRRPARAPCRGNRRPGLGTQLDGQLPADAFRPPPVDRAELARRPRAGRGQPAARSGPGLRHRHPPDHRAVPGMARRPGTGRPAGARLRLRLGNPRHRRAAARRRTGGRHRHRSTGPGSLARQCLAQRYRARAVPCLPAGGPAAATGRRAGRQYPRRPAGFPRPATDRPGTSRRPAGVVRHPRRAGRGGPRGLLRTLRSRPDRRARRLDPHQRPPPRRLMARRQPPLIPPHCLRARSLG

SEQ ID NO: 26982 - protein, 436 aa, Pseudomonas aeruginosa
TSRRIFPTDRRMSESVITQCPHCSTSFRVNDAQLGAANGAVRCGTCLKVFNALQHQVGGAPRANAPSAAEAKPAAAPPPAPSVAAATSAAPPAARPRDETLWIHDDLDLDSLNLDEELAKLDEFELNQEFSSIEKAPRPAESLLARRDDERDPHDERWAEALIADAEPAQPARGNPRQEPSLGEPLAEERVSFVPLRRAEDPPELRLILDDDDDDEPSLGKRRHGLSALDEDDEESAEEQSVAPLGSARKPDEAPVESLDQLRDEPLQLAWEKPRRQWPRRLGWLLLILLALGGLAAQYIAYHFDELARQDAYRPWFAQLCPEIGCTLPSKVDVEQIRSSNLVVRSHPEFSGALVVDAIIYNRASFSQPFPLLELRFADLNGHLIANRRFKPGEYLGGELAGRTEMPPQVPIHVSLDILDPGPKAVNYSLSFHSPE

SEQ ID NO: 26983 - protein, 241 aa, Pseudomonas aeruginosa
SVGPPREDRGFSARSTITCGPASTCRRRRFPKCRASCSNTSRSCTFFMGKKWVCGSPASMWGGISRLCRAQGNSAPSSIVCRTRMRSAPASGSSSPSARTTEQGWPHDNDDDRDFSEWNNARERQRQPETAPHHADARRADPARQRGEGIAQLLRPPRRAAGHGRLQHGALRSRSAAAGNRHEPRQGEPDQGLRATRPEPRDPAQETQAIRSSLRAAAGSGQGRASRPAPAAGSQPSGPLQ

SEQ ID NO: 26984 - protein, 458 aa, Pseudomonas aeruginosa
ARCGQPPYPRISRRADNAARYPPLRQENPMNVLIIGSGGREHALAWKVAQDPRVAKVFVAPGNAGTATEAKCENVAIDVLALEQLADFAAKNVQLTIVGPEAPLVAGVVDLFRERGLDIFGPTAGAAQLEGSKAFTKDFLARHRIPTAAYRNFTEVEPALAYLREQGAPIVIKADGLAAGKGVIVAMNLDEAEAAVRDMLAGNAFGDAGSRVVIEEFLDGEEASFIVMVDGQNVLPMATSQDHKRVGDGDSGPNTGGMGAYSPAPVVTAEVHQRVLDEVIYPTVRGMAEEGNVYTGFLYAGLMIDKSGAPKVIEFNCRFGDPETQPIMVRLESSLVLLVEAALAKALDKVEATWDPRPTVGVVLAAGGYPGDYAKGEVIEGLAEAAALDGKVFHAGTALKDGQEVTSGGRVLCATAIGESVSAAQQQAYRLAEKIRWNGCFYRKDIGYRAIARERGES

SEQ ID NO: 26985 - protein, 969 aa, Pseudomonas aeruginosa
SGHSPSKGLRRGTASDRHRTTRQLPAASARSDVAGGRGRRRRFQRSPANHRHHPQRQPELAPAARRERATADRRRPPAQGAVPPAGQALLHLPRQPPGGLAAGPASRAEGAELAVDLRPAGAVPGLLPGAGRPTGAGPAHRRVATVPGAPAALALLPVLAAGRRQADDPVRADDLQPSADGLVRPDRRSRPGRPGEARLRLRHAARRHAPAADVQPDPLRLLAQRQQPVAGGGARGAGGLRRGEPGAGGVLAAGTQVQPVADRRPRRPRRCGEPAVVRLQLLPRHCGKPPEPPPARRGAVDPGGRRDHRLHPATLVQLADLPAGDPQFAQRPADRGLALVSRLPAGAPDRCRDDRVQRRLHGVPAGTVRHQATRSGLAGARRVQLRHPRRAGPERLAHRTPAADPAAQPATAHQRGGAHRGIADQGRVPGQDQPRDPHAHERRAGHDRTAPRHPVVGEAARLRADHPQRRQRAAHADQRDTRHLQAGVRADRAGRSAVRPQRVDRGLPGYLPGQGRAAAHRADQLHPAAGAAGHRRRSDAPAPGGPEPAGQRVQADRGRRDPAGGGPRRPGRDATPAHRRAGQRPPVRRQGARGAAHRRAAQRRLPFRQQARQPPRPDHRPPTGAADGRGVRHPVRQQPGHHPVADPAARPAAAGEPHRRPGRPAAGRPAAGGGRQRNLPQGAGAAVQRLGPERQRGVVRQGGAGPVAHQGAPARVLRRGPARPGHARHDRHATGGEDQGRPQPQPRHPADHAHRDQQRAEQDHRPQRRDQAHPGQAGGRLHAEGDPRRRTRPARRQWRHQLPATGQGSAGAEPAERLPDPRRRGQQHLHQGHPRHVEQAQPPAGHRQQRPGGAQRDEGDPVRPGADGLRDAGSGRLLRHRAAPRLGSPRTAPAYPGGGAHRAHPQRTQGTRAAGRHGRAHGQAGGAVAIARADRLLGRRTRSPPPGRRPALLRAATCSSAAPGLRHGG

SEQ ID NO: 26986 - protein, 502 aa, Pseudomonas aeruginosa
KRSLPRHSQTCSACFPGDSRRLFADRYRPAPRRGTAFALEPRRRDPGRSAHPAVHRTDARRQARRLLKTAAPTAGEWRTTPMKRRSLLKAFTLSASIASMGLSWSIQAAETIKVGILHSLSGTMAISETSLKDMALMTIDEINAKGGVNGRKLEAVVVDPASNWPLFAEKARQLLTQDKVAVVFGCWTSVSRKSVLPVFEELNGLLFYPVQYEGEELSPNVFYTGAAPNQQAIPAVEYLMSEDGGGARRFFLLGTDYVYPRTTNKILRAFLHSKGVDDKDIQEVYTPFGHSDYQTIVADIKKFAAGGKTAVVSTVNGDSNVPFYKELANQGLEATEVPVVAFSVGEEELRGIDTKPLVGNLAAWNYFESVSNPVNEKFVADWKAYAKAKNLPNYGTAVTNDPMEATYVGIHMWAQAVEKAGSTEVDKVREAMAGQSFKAPSGYTLVMDKSNHHLHKPVMIGEIQDDGQFEVVWKTPEPLRAQPWSPFIPGNEKKPEHALKSN

SEQ ID NO: 26987 - protein, 120 aa, Pseudomonas aeruginosa
PRTATWRPAAGCPQGAWTCSPSVSARASPGLGGVALSQVGNVGPDLGQGYIIDSFLVVVLGGVGQLAGSVLAAFGLGVANKILEPQIGAVLGKILILALIVLFIQKRPQGLFALKGRVID

SEQ ID NO: 26988 - protein, 346 aa, Pseudomonas aeruginosa
TARIAGSPWPSRNTGCSSSARCSSSSPCTCRAACSACCARRRSNEDHPAPDARTGLPPRPRYRRQRPRRHRPGRRHQRPAGRAPRHHPQPGRHQRQLRRLQGPARPDPVHRRRRIALHHRPQRRRQDHPDGRDHRQDPPAERYRVFRRHPRPDPHERGADRPGRDRPQVPEAHGVRGPERVREPRTGAEGRQVGVGQPARAARRHAEGTHRGGARHHPPAGVAAASGGFAVPRPEAVPRDRHAAGAGTAVAAARRAGGGHDRCRDRIHRRAVQVPGAQALADGGGARHGFRRQHRRPCHRAAPGPRAGRRLAGGGTGRRTGDRGLPRSLTPAIRSAGSACQVAPVA

SEQ ID NO: 26989 - protein, 329 aa, Pseudomonas aeruginosa
RKTSSSTPGSATSNTNAARKRDSAACSCARPWPDPTDDRRPPRPELPPRLARPTGAGLRPRRRRHPPGDAAPLRTAAGAEAPLRRRPGSLPAHPRASARRHRRRRQPGLRRAPRRTRLGPAHQPRRGQVVPRRLPVAADPGDPPGARRHPGMAAAGKHRLRRRPGRTGNPYPAARRRPPVLLGHGRARPPGQRRALRQRPLRRGPGHPSRRPPALARAPAHRRRRPPARLADRPRRASGAGDPGRQRRDRHRPAATLPRAPLRRPRQPQPVARRPAGGALPGRRGAARASLADRTLAPAAAGAARPRGRSPTHLEYLRWTCPPARKTSC

SEQ ID NO: 26990 - protein, 189 aa, Pseudomonas aeruginosa
PSTSPSPEAGHERFDPRRRRRRPARHPRHLQRRRGQYHGDLERNPGGPGQPPGLVRHPRPPGPPDPGGERRRRRSARLRLLRRLATLRGLPRHRRALRLRARRPARQRPRRATAAGADRTCAGPGPARHGGRHRKRQCRLDRPAPAPRLRDQRADAAGGPEVRPLARPDLHATEPRPDAQRALSPKEPP

SEQ ID NO: 26991 - protein, 469 aa, Pseudomonas aeruginosa
RRQWRLPVAAGSPSMSSRQSSRNASTPYLAKAFQATAIVVVSYFLYWTYQLYQYGEIPISKKDVMLRQAILARFPADYEVEIKGADLLGFGEKFLVAYGNRRFVGKAFAMDDQVIERLERNQGRTNLPLVKVFYIAEPGLLSSLLNLSPFLDIQKNMVELSLREYRKIQLVPFDPDAKRKPREQFETDYAFPQLFSLSQMEVADYDGDGRDELRLGYLSYAGGSGGTRWSVIYDLKDGALTAHSGYPEMLDIDVARFIQAVNLYAGLDGTLPRDQRQLEDVVGRGSERFALTAAERQALVADPPQRDDYARVLMSLSPRSPYAPDRFIDLGDGSRLSLAPRHTDDYSTFLDIGGKKIFVEAFYVDDDACHWCEHRWRVMAFHYDDGRWISDRTINGDSFNGQWLRNAEPLGLNDVFGTYRDQGPAGLAWSFIDPRWTASSQHDMDDPLGVGMRTLSPVEQWVKERYREN

SEQ ID NO: 26992 - protein, 472 aa, Pseudomonas aeruginosa
HHAQAPWQIRIQRSGRPARTSQDASCRSPAVKSTTLSHTLRGRFFPGPFRAMNPSTAARALGIDFGTSNSTVGWWRPEVEPLIELEDGKITLPSVVFFNVEERRPVYGRQALGEYLEGYEGRLMRSLKSLLGSKLLKSETTVLGSALPFKDLLGLFIGQLKARGEAAAGQAFDAVVLGRPVFFVDDDPEADREAQDTLVQVANKLGFKEVSFQYEPIAAAFDYERCIQREELVLIVDIGGGTSDFSLVRLAPERRNLAERQDDILATGGVHIGGTDFDKQLSLEGVMPLFGYGSRMKSDAFMPTSYHLNLATWHTINAVYAQKSQLALKNMRYDIVDSTGIDRLFRLIEERAGHWLAMQVEDSKIRLTETERLHLSLERIEAGLGVELTRGLFENAVDGLLERVRNSVAQLLASAGVDPDRVDTVFFTGGSSGIPALRRSVSAMLPNARHVEGNLFGSIGSGLAIEAKKRYG

SEQ ID NO: 26993 - protein, 229 aa, Pseudomonas aeruginosa
TDASHEEEFHATGHRGEPLRHPRVQQAGASRHPPPERPRRRGRRPPRRHREAPLAGAAGPDPAEPAPGPPDPRGTARRATRQRLRHRPGDHGREHHHPWRRPARPAHRHPPAPGGKRPGRADRPAQSLLAAGQLPARTDRRRARPRRTGQPDSQGRGDGDRPGRRRGSPRRRHRYPAAPLAAPGPGEGLRQSAAIPGELCARACVPMLASTAQPQGVTACTSSHWRHCS

SEQ ID NO: 26994 - protein, 641 aa, Pseudomonas aeruginosa
NAMARWTTRNACGISCNDTSTPCAKRSAPASACWRNSTEPWRRSPTGGSATCMHESSNVPPSAWWAWNTSAAPPATPSASSGNASSRASTRSPASTIPRSPMASARSSPTANSTTSPASRCRRAGRCRRAWCASRCRRRSTRCSPTRARRRRSPRASRRSTATCSPNAAWSPRRGSTSNTTTSVSADRWIRTRKSTCISPSTESALAGRHLGRLAHALQQGGALVVVALARRHQRQQAGRRAHRHAEGDHSRAARHQRPGVDPGVGLGEGAAHVQRRAQREDPQALAVRGDIEVELLVGEVHRAVDVDQRVLGVEDEQPAGHQALLQAEVGGRAVDLHLVVAEQLGHQVVSDIEAGDFGQAFADRTVVDQHLQFAIGAAEDLRHRIATAAETGVAVQLAEAGLHRREAGEQLLQLEAPRAHLHSALHRLLAAVQADVRLQLAAGHTEAQGLQAQQAVVEHQMGIEVADRQLVAVHDTLAGEFHVGVHVAPALGTEFLHRQHLVARLAAGLPALLFFGIAVGADQRAEVGEAQLLGGQLAGQLRPRLASDEGQAAVQVAGADLAVEVLVAEQCAALLLEPRQQVSVGGVGRSVRQGDAGQRIEIGHAGPGQLQAQVEGAEVERVGQGADHRGTGAAGTDLGL

SEQ ID NO: 26995 - protein, 328 aa, Pseudomonas aeruginosa
REGLARILQRQHPADLARAGQSLALVGALDLPAEHIVLGVRRIARGQRLAGQLTERHRLAERVDQHFQTGLQTLVVEADATLVETDLADVQLPGGRLVAVAGRQVEIPIGAAVGQAQELGARLGQLDLWNADGLPEQRQRREAEFDAFQAGELARLGLARRPLRVAEGDVLGAEARPGDPGAPAFLALLAAPGHGEVAVDGERAVQRRRDLFVEGGLDQVPVEGGDEHHQRRQQQDQAGEAPGQDLSAARHAQLLFAASVVGQARQRASLSPSVCRLAHGLASANTPARSVRTGETPALLPVPRISGKRPVRRRVDKTFSTAWDSHLR

SEQ ID NO: 26996 - protein, 154 aa, Pseudomonas aeruginosa
IIRKHIITHVDRHYHRTSFLNRLIRTENDSNAIDNPLGVTVMKASLILGLALATLTANAAFAADGSSRTIDRLHKDMSSVELRIADNGSEQTIDRLHKDMTKAEARLADDGSEQTVDRLHKDMTKAEARLADNGSEQTVDRLHRSMSRFDLRTA

SEQ ID NO: 26997 - protein, 174 aa, Pseudomonas aeruginosa
SSAAGCAAPTAPAAGARRRTRRPRPWPGNAPSAPPGSHRTARSARAVAPVSRSPARTAPAARRAPGPASTAGAAPRCSGPAHGPGAGRGRGAGRARRRPRSKAGSRDENARWTVRGRGSTGRCRAAATWRQDARRWNRRASRRGSPRRENGNPAAAKRCRCPSRCRPGRPWHRH

SEQ ID NO: 26998 - protein, 267 aa, Pseudomonas aeruginosa
SIPCAASVTSARSARARPPLPDPLRGAAVRRGGGAGGQRGRLLPVPLGGRGDAAAQRRDGRRPGRALPQPAARQPHPGRAEGAPASVREHARQRAGHPAPRSARRGADRRGQPAPRTPAVATGGRRRPGVESVRRARRADPRRHPDARARRRGPGRRPRAVADHRRTPAAGRDADARPVPRPGHRRRAAGVPWHRPARLAGPAPRPAPAAHAGGEGGGDPSDQPGYPPRRRRRACRVAAGGTVVQRHARTPRRRLPASAAVLRRPRP

SEQ ID NO: 26999 - protein, 886 aa, Pseudomonas aeruginosa
DPHAHRFADGPRPGGPAPAAQQRGVPGADRLQPGRAGAHRADGREHPVPRSRRRRTGSGGAQPPGPGRRTAAPGGVFRRAGRGTWAEPRHPGQRPATRRSATVPPGAEQPAGQRHPLRQRRQPDRSARPAPLGGIPAERGERLRQAAGRAAVAPVRPLLPWRRRAQRRPVQRSRPGHRPGDHAPARRPRRSERPGSGTHPLRPGVPGSGLSGLLAGVRLAVGAADIRRRLHHQLLRHFLDTRVEGGGHRADRVRHRHVLQRRLVDPVFAGDALGLHPEHQQHRVAGHQHVEQSRTEVAHQRAGHQRADTSADPIGGQEHRRQRDPARLLDVVVGQRHRQRIEGEQQHAGNEPVGQQQPVRQRHQPPHRDRGQAQQHRIAADQPTAVEAVGQPAQRPLRTEAGDDAHADEETRLRGIQAVAVGIDRRQAVEGADHQAGDEDGAQRLRHALPEETHFQRRGDQLGRVHATGHGQRDQARGEADGDQQQRLVVEGRAQRQQALAEHQAKVDGDHVAGEHLAALVALGLLVEPALDHHVLVHHHRTGDEAQQQPDFQLIDQGMQQHGHGGNPGASHVGADMAEAGDQLVSEFSTADQAEIVGRHQPADPQVACAFLGQAQADVGGEQAGAGQHEQGGGVERGKGDERAEHDGSWTDGPHGRHPPSIDRFGKDRRCWPIAGAGRPAFGETPTPHGGRKPRRGAQGGIIPAPERPRHGRRERSVGSAAPRRERLARRQPIYPDAPQDSEELPSQASAVVGLPVAPGDFADLAGQRGVATRRQVRVEVVLDLVAEVAGQDVEQRPALQVAGAAQLAQVPVATGLSLQHRGREDHRLLGEVAAEDHREGPQVAQHVGQQVTDEHRAEAAGEQAEKREQQVVLGPLATQLGTQAA

SEQ ID NO: 27000 - protein, 80 aa, Pseudomonas aeruginosa
TRAHLSGAAKKSLRTNLARCNILLHPYGPVFPVQASRIDLARPLLVLVVIPFLSHCGNCPCWSSTNACPPARPAGTKNST

SEQ ID NO: 27001 - protein, 212 aa, Pseudomonas aeruginosa
PPPDATSQRQGTTNETAQAARRPRPARRSGAGLRPPRPRRTRPGRRPRPSAHRPRPPAGDVRRRPLGRPATGSRASRPALHLRRHHAGRRAARLRGPATAVHGYRHRRLGARPRPLRGPRRAPAAAAGDGRHRAVRPGPRGRPRPGAAGPLQPLAVRARFRRRHRRAARRRLPAGALPGAGGRAPGTSRRAGLGGRRGLVAGRLSRRASLSA

SEQ ID NO: 27002 - protein, 133 aa, Pseudomonas aeruginosa
PAPGHPGRTGRRQPQRWRAGRQHPRHPGAEPGGGAGRRRGAGAGRLPRLRRHPAAQLHRSRPGQQRDRRQGSLDPLGRDRRQRGNAHHRRQGHPGRRQGPRRALHRRRLEQRRRPAAPQRQFEDRESQQRAAR

SEQ ID NO: 27003 - protein, 722 aa, Pseudomonas aeruginosa
PRQPVRLPGQVRQRRLRLPQRASGPGRRLCAAQPGQLLFRQERPGPLSRLQPLRSRGKQRSQGLQRGRGSAQLVVGDRVLPAQGDLAHRRRAHPGPRLSSLRRAHRGDHAVGHLPFRHRRHLPVPIERSEDRHLHRTLPLPAREQSAGGPQHRTVDDRREERHADLGAGAALPGLSLRPQLDAPGQPAHRRRPEQRGALRNRLRRFQARPRRLVPGRRHPAAEKRGHHPPRHQRQPHPEGRHPPGIRPQRQARVQAGRAPDAMGRRPLQPLQQQGQRHLRLAAARGSRHALHHGEQARLLRLDDVVPRPERPVHRRHRSPPQQRHRHQQHQQSVRRHSLRRVRPGQRDSPSLAGHQRGHRLQLQQEGQQPRRRFLAGIRDQFRAGPGYLRLRLLYRRPASAVAVRDQPGHPPGRAGQGPQARAFAQLGDRCQRAARQPVGRRRLGGDQAGLLQQHHQELHHPLLRSGPDGPDDLQQHRQLPHQRSRTAIALRRRAGVRRPVGDLLPEDRDLRRRLRRQAARRRQPLPAHREHAELHAGQLHGLLYQHAEPAAAGDQPDRRPALLRPGPDPGRTHDLYLRPHRHGGQALAGRRHHTADRVPLGAAVRPVPQVQAVRAHRTECLAAEPHRPLLPRPAGTEFHARARAYPAGGDAGEVLSRPLPLQALSAERRSGRANNRPAAIRRSTGPPAPRPSGTVRRSGETASVTTTTDNSPPAASGRSRC

SEQ ID NO: 27004 - protein, 684 aa, Pseudomonas aeruginosa
SNSCAGPGRSSHPPGSRPRQLARQDRRASAGPPLHCAGLRFYDGFSLLLCSVFQGRPGPGSLCGPPGDDGRVSGGARAPPPGSERVLARRVLHADPVVGGEFLDGPVAVEAAKSGVLLAAEGRVGLVVHRNVVDVGHPRAKLAGKAHRAFQVAAEHRAGQPVFAGVGQLQRMRLVARAEQADQRAEDFIAGDLHRRGDLAEYVRSQQLPIDAALVQRLGAFLAGQADLFQQAFELARVDDRPDRGIGALRIADPEALDPLDEARGESVVEAVLDDDAVDRHADLPLVEELAEHRGIHRLLQVGVAEHHERTVAAKLQRHVLEMRAAAGDAADVAAHRGRSGEGHQARHRVLDEGVADLAAGADHHAEQPGRQPGLFEDPRQQQSAADRRVAGRLDHHRVAQRQGRGDGTLGQVQREVPRADHPDHADGAAVDPAFLARHVGLDDAPVHPCRERRRLQGDRARRAPFDLGLQAGAAGLADDPVDDLLVAAVEHLHRLVQYRRACRGPERGPCRLDLGGLGVGGIEVVAVGLLDLQQQAAVERVAHLQPAAGPAVAPLAGQGLETEVGITGIAHRSSPLSKITGVSSPSRRRTLPPARAAAGGCRRSPARRSRRARRRPGSSAGTAAPGPAGCRRASARRWRRGGRRRRPSRPRWSAPRPDRTARRRHGSPPGCRWWWRRPPPAGR

SEQ ID NO: 27005 - protein, 1427 aa, Pseudomonas aeruginosa
SGQRRSPPQRIACSYQPLSCSCYGRTRASVGTAHSGMGRRRGTSGFDGLRRHLDQNRAISGQGMLQGAFQLFAGGCVERLDAIAAGDRAEVQAGHVEPRRIGHLEHPGEPAQGAVGTVIEDDEHRRHAVLRGAPERGDAVVGRAVADDPDHLPPRLRQLRADRRRQAEAEAAGGREEIAARLAHLHALPEGGHGGSRLLDENGVARRQRIDHVEHGFRTQRSALLGQRRRSRQRLGQRPRTGADLFEQCLEGQRDVADQRVAHRRPCRFAGIAGDLHQLGAGRQVIAGGELVIAEHRRADHQDQVVAVQQPADPGDGRRQHAAEAGMAGGERTTRGRRRDPGRHPQLLRQFHGQAVGIRPVDVRTEHQHRVARARQALAEFGQQCRRGQRGAADLARSQVFDAGRRRLRPVVVGNRQVHRRPRRQAGGLDRLAQRARYILGAGRLVAPFHQRLGQLSGIDVGEHRLDPDHRAHLLPGGDDQGAMGVPGVGQGPHTVAGASRRMQVDEGRAAAGQGEAIGHADHRALVQAEDVAEILGKVLEERQLVGAGVAEDGGQAVATEDLVRRGMDGFHAGLQARFLDLRYCCSRSIINQIDTLSIKNRTGLYESDRSQPDPHLRHPLRSRQRDPRRGAPARTVRRRVVHPHPRRHPADLRRRAALRHLPRVADAHRGRGTERSPLRSGDHRATFPHRPHRSRRSGFPLADPRTPDPRRAVRRSGSAAAAGGRGRRLAEQRQGRRGDLPPAGARRAQPAGPARALRVPAQRPPPADRRQPEPGAVPGRAAHRGDPYLRPRHRRGRARGHAGAAPHQPAGAALLGAAEDHSRYRAADHPAGADRLSLRRRRRHAHARTALHPAAVRRLPALAREQRTLGGAELVPHHHRRGDHRRPTLKRRRPSRSVSQRRRALATPRTEQRQHGGRDDEHRRERPIEGQRLPAVVEQEPGHQRREDRPAATDADPPADPGGTHRSVVEARRQGIQAGHAGVGAKPDQQSQRQGRAGQPGAQREQREQSGGKQHEQRQHPFQAKARGKPAEQGGTEDPADAQQGAAGDAMGGGQAGGDQQLRRPAHDEVEAEHHQEKQRPEQQRGTSLGNAKQPGEAATVLRSATGRARQFRERRAAQAPGQRVDPLQRPRRPARQEEVQRLRQAQADQRDHRQGQASAEDEHRAPAPGADQPYREQSAKGRAERVAGGLQAYRQAAPAARGVLAGDHVAAGEDAADTQSGQPAQQRQLPGRLAQRRGEHAQARQRQAGEDQRAAPPAVGPGRDEQRAGGHAEEAGAEQQADLGAAKVPFGGHRGCGEGHHQHVEAIDQVEHDAHSHRQPLERTHRFVVESAAQVPVHGRPSPERTGKKRRQAGARRGNAGIHHREDPFSCCCRHGKRRHPGTVASMPQSYWIHFGDKKTDGQRISHCQRNPRKALERDNLAIYS

SEQ ID NO: 27006 - protein, 524 aa, Pseudomonas aeruginosa
PDGPDPRDLCPCVQHRPEGNRRGRADHAGGRRRGDHQPPHAECHGPAVLAHGSARQRPGRRRGGGPLADLPLHAAQPRADRGRRGPRRPRRLPGAGGAQGGEHRGRLHHPGERHFHLVLLGHGAQLPGPRPGAHREHSRRPGKDLRRRPGNARKPAAQPAAPSTARPAETEHRRRRRAGPAYHRAPAGGRAPGRRPQPRPGLTGAFAMIEVIVGAIRLEAQDIHSFELFRADGAALPSFEPGAHIDLHLPNGLVRQYSLCGPAERPRHYRIAVLRCRDSRGGSATLHAELRVGQRLHIGEPRNLFPLSPEPGPRLLFAGGIGITPLLAMAERLARDGADFQLHYCAHSAERAAFVDYLGRCAFADRVHCHFDHGESSRRADLRALLATSPRDAQLYLCGPAGFMQWIEESARELGWEASRLHREHFAAAPRDASADGTFEVQLASNGALIRVAAGQTVLAALREAGVDLPASCEQGICGTCLTRVLDGEPEHRDLYLSEEEQAANDCFTPCCSRSRSPRLVLDL

SEQ ID NO: 27007 - protein, 151 aa, Pseudomonas aeruginosa
LGQHALARFAHGIRLFDRDVRGIIACPGRLRRSAFAVDGEAGPGLAHRHDLEAVDVQVGGLVPDPADGLGDVFRLDRMGSGLGLVVARLVAAEADQGEIALAQPRLEVGHAHPGCPAGRHAGSGRIARRKPWCRRRHGYPDRATCRPPNPG

SEQ ID NO: 27008 - protein, 340 aa, Pseudomonas aeruginosa
SGLSCFSPTITRGAAARRATSCCGLSVTPLRNSTIRPVCGSSRPSGLCQSGSGGSWDWQPPSSRQKANRRMRMATPSTGDDQRMTSLGMTLDQDLEAEHRAQRLGAQDFLGRTEQVRATILQQQQAVAIARGQVEIVEDHQHRGTAAGEIMHRLQGSVLVQRVERRGRFVEQQHLPRLARPQLRQHPRQVHALAFAAGQRQVAAPGQMPGVGRRQGLGDDLHIALAAAGMGQPTEADHRLHRKGEAQRRTLRQHRQALRASDARPVVEAALVEQHQPFGRLQFATESAKQGALASAVGAEYAEHLARPQLQLEAFQYSLSATADGQVLHAQHQARPRNSR

SEQ ID NO: 27009 - protein, 186 aa, Pseudomonas aeruginosa
GARNAGKPPSEAPNTMASAAPRAAPLDTPTSPGSASGLRNRPCIATPDSASTAPTARPSRVRGRRIWPRIISAWARPVPSSGSPARRSAARRVSPSGRLTGPRARDNQRTNTSEIPSAPNSARGRTTDFNGRLPYSAVSRKDKRLRREPPGHPAGADRGRPPGASGPAPAVVRHAPRGLRRGRGSA

SEQ ID NO: 27010 - protein, 104 aa, Pseudomonas aeruginosa
SAIRFRPPLRRVSPGRHCPGARPIRRQPGAAPGCAARHASSAGRGNDGCPSTRPSLRARRRHRSAHRRASQPVRGVRAAPARHPARQPAGARPAAPRRGRRWPR

SEQ ID NO: 27011 - protein, 789 aa, Pseudomonas aeruginosa
RFSGSTLCARRPPGYSPPARPKESHMPLSPPFALRPCLALLLLSPSLALAGNAIPLTPTTITATRTEQAVDSVPSTVSVRTREQLDRQNVNNIKELVRYEPGVSVGGAGQRAGITGYNIRGIDGNRILTQIDGVELPNDFFSGPYAQTHRNYVDPDIVKRVEILRGPASALYGSNAIGGAVSYFTLDPSDIIKDGKDVGARLKAGYESASHSWLTSATVAGRADDFDGLLHYGYRQGHETESNGGHGGTGLSRSEANPEDADSYSLLGKLGWNYAEGSRFGLVFEKYKSDVDTDQKSAYGGPYDKGKPAIPPSMLPGGMYQWRKGNDTLTRERYGLEHHFLLDSPVADRIQWSLNYQLAKTDQATREFYYPITRKVLRTRDTTYKERLWVFDSQLDKSFAIGETEHLLSYGINLKHQKVTGMRSGTGTNLDTGADSPRDALERSSDFPDPTVKTYALFAQDSISWNDWTFTPGLRYDYTRMEPHITDEFLRTMKQSQNTAVDESDKKWHRVSPKFGVTYDFAQHYTWYGQYAQGFRTPTAKALYGRFENLQAGYHIEPNPNLKPEKSQSFETGLRGKFDEGSFGVAVFYNKYRDFIDEDALNTDSTGGNGQTFQSNNIERAVIKGVELKGRLELGAFGAPQGLYTQGSVAYAYGRNKDNGEPINSVNPLTGVFGLGYDEADGNYGGLLSWTLVKRKDRVDDSTFHTPDGTASQFKTPGFGVLDLSAYYRLSKDLTLNAGLYNLTDKKYWLWDDVRGYDSVGEASALAPANIDRLSQPGRNFAVNLVWDI

SEQ ID NO: 27012 - protein, 123 aa, Pseudomonas aeruginosa
KPSSGSGIMIPANGAPMIHLCPSSHLAEGNSRGFLVDERRLFAVRRDGRAYIYLNRCPHRGIPLEWQPDAFLDDSASLIRCASHGALFLIESGECVAGPCAGERLRALPCREDAEGLWVELDD

SEQ ID NO: 27013 - protein, 335 aa, Pseudomonas aeruginosa
RKRPEPSERRRPLRRPGKRQPGAFLSANIKADRLLVESPLAFFIPFHRKRPMSRRYWQLDVFAERPLTGNGLAVFDDASTLDDAAMQAWTRELRQFESIFLLPGDDPRAFRARIFTLEEELPFAGHPLLGAAALLHHLRGGDNEQHWTLHLASKSVALRSVRAGSGFYAEMDQGRAEFGATPDAGTCRWFAEAFSLSANDLSGHPPRVVSTGLPYLLLPVTAEALGRARQVNDLQEALDKLGAAFVYLLDVDGREGRTWDSLGLVEDVATGSAAGPVAAYLVEYGLAARGEPFVLHQGRFLERPSRLDVQVATDGSVRVGGHVQLLARAELLTSA

SEQ ID NO: 27014 - protein, 567 aa, Pseudomonas aeruginosa
GTAENLGGASVRTPTPMLTPTAPGGRAGPSARRRSTRLAEIHPSPANWYDARLFEPYEPHAGRREAPGVRGSFHAARAFSGLSRLPGSFAIPRRRDSDATPATRKFGFPWSAAGSTAGHFCWRHGDRCRAHSGESNMLEKLFQLKAHNTTVRTEILAGITTFLTMAYILFVNPSILGETGMDKGAVFVATCLAAAIGSTIMGLIANYPIALAPGMGLNAFFTYTVVLHMGHSWQVALGAVFISATMFFLLSIFRIREWIINSIPLPLRSAIAAGIGLFLALIALQNAGIVVDNPATLIGMGDLTKPAPILATLGFILIVALEARSVTGAVLIGILVVTAIAILLGVTQFGGVVSMPPSLAPTFLQLDIKGALDIGLVSVIFAFLFVDLFDNSGTLIGVAKRAGLMGKDGHMPKMGRALIADSTAAMGGSLLGTSTTTSYIESAAGVSAGGRTGLTAIVVAILFLLALFFAPLAGSVPAFATAPALLFVAVLMASGLAEIDWEDITVAAPVVVTALAMPFTYSIATGIAFGFISWTAIKVLSGRWRELNPALVILSVLFVIKLGFFNA

SEQ ID NO: 27015 - protein, 86 aa, Pseudomonas aeruginosa
PGASSASCTFRATRKPWRRTSLNCTTRTGSAAARCSTSSPTPTTWKAASCSNAAERVAAPHGAAMPQSRTGRRRARCNPSVVTSAP

SEQ ID NO: 27016 - protein, 176 aa, Pseudomonas aeruginosa
EAAIHVHQSKTTEQPADDPRLRTLSGNQGRGVHERAHARALHRDPEQMETGADGRGRPYRASHAGRSGQLPRSGRPRQPGRRIQPGTARPRPRAQADQEDRRDPATDRRRRVRLVRLLRRRDRHPSPGGAPHRDPLHRLQDPRGNPREATRLLSRTDGAPRRPVSFPPFPAAPLAP

SEQ ID NO: 27017 - protein, 202 aa, Pseudomonas aeruginosa
AASPRRPAATCTSVPWWRPSPPTWTHVPSAAAGWCAWRTSTRPAKSRAPSRRSWKPWSATASNGTARWSGRANASRTTPQWSSNCCAAAWPTPALARASSLRDSPGSTRASAATPGTPARMRRSACACRSWNIASSTACRAKSTSISAARSAISSSSAAMASTPTNWRWCWTTPGRASPTSSAAPTCSSGPRASFTSRNCWG

SEQ ID NO: 27018 - protein, 996 aa, Pseudomonas aeruginosa
SSSWSLSSCRASAMLTSFSLTQLILISVAYLSTLFGIAWITERGYVPRRLVRHPLVYTLSLGVYASAWAFYGTVGLAYQYGYGFLAIYLGISGAFLLAPVLLYPILRVTRAYQLSSLADLFAFRFRSTWAGALTTLFMLIGVLPMLALQIQAVTDSISILTRDPAQERVAFVFCTLITLFAILFGARHIATRERHEGLVFAIAFESLVKLVMLGSIGLYALYGVFGGPEGLEVWLLQNQTALTTLHTPLAEGPWRTLLLVFFAAAIVMPHMFHMIFTENLNPRALISASWGLPLFLLLMSLAVPPILWAGLRLGASTTPEYYTIGLGLAVDSPALALAAFIGGISAASGLTIVMTLALSGMVLNHLVLPLYQPPAQGNIYRWLKWTRRLLIVAIIMASYAFYLLLGAEQDLSNLGIVSFVATLQFLPGALSVLYWPTANRRGFISGLIAGMLVWAITMLLPLMGNVQGLYLPLFDVIYVLDDSNWHLAALSSLAANVLVFTLVSLFTEASDEEKGAAEACAVDNVRRPQRRELFAGSPQEFASQLAKPLGAKTAQKEVEQALRDLHLPFDERRPYALRRLRDRIEANLSGLMGPSVAQDIVETFLPYKTSEESYVTEDIHFIESRLEDYHSRLTGLAAELDTLRRYHRQTLQDLPMGVCSLAKDQEVLMWNRAIEELTGVGAQKVVGSRLSALPEPWKGLLERFIDAPDEHLHKQRLVYDGHTRWLNLHKAAIEEPLAPGNSGLVLLVEDLTETQLLEDKLVHSERLASIGRLAAGVAHEIGNPITGIACLAQNLREEREGDGELTEISEQILDQTKRVSRIVQSLMSFAHSGSHLQALEPVCLSEVAQEAIGLLSLNRRSVEVEFFNLCDPAHWVEGDSQRLAQVLINLLSNARDASPPGGAIRVRSEASEHTVDLVVEDEGSGIPKAIMDQLFEPFFTTKDPGKGTGLGLALVYSIVEEHYGQITIESPTDHQREGGTRFRVTLPRHPGPTAEL

SEQ ID NO: 27019 - protein, 390 aa, Pseudomonas aeruginosa
RWARWTTSPSLSTTTKCSRPWRASSRTARRTAARPRSSANGGKAGGERGASPAAADGEIGIIGSCAPMQELYSKIRKVAPTDSTVLIQGESGTGKELVARALHNLSKRAKAPLISVNCAAIPETLIESELFGHEKGAFTGASAGRAGLVEAADGGTLFLDEIGELPLEAQARLLRVLQEGEIRRVGSVQSQKVDVRLIAATHRDLKTLAKTGQFREDLYYRLHVISLKLPALRERGNDVMEIARAFLARQCTRMGRAPLSFAHDAEQAIRHYPWPGNVRELENAIERAVILSESQEIHADLLGIDIELDDLEDDFAADLCLGPAGAAASNHEPTEDLSLEDYFQHFVLEHQDHMTETELARKLGISRKCLWERRQRLGIPRRKSGASADS

SEQ ID NO: 27020 - protein, 483 aa, Pseudomonas aeruginosa
ATQACNHPHRAPDNTPMLKKLIQTIRSPLRRPRAVRTTPEVIGNNQHSLRRDQFSRNAVKVVEILQRAGYQAYVVGGCVRDQMLGIAPKDFDVATSATPEQVRAEFRNARIIGRRFKLVHVHFGREIIEVATFRAHHPEGQDDGDSRASSNESGRILRDNVYGSLEDDAQRRDFTINALYFDVTSERLLDYANGVHDIRNRLIRLIGDPEQRYLEDPVRMLRAVRFAAKLDFEIEKHSAAPIRRLAPLLREIPSARLFDEVLKLFLAGRAERTFELLVEYELFAPLFPASAKALQANPDYTGKLIRQALANTDARIRQGKPVTPAFLFAALLWPALPARVAQLQEKGMPAIPAMQEAAHELISEQCQRIAIPKRFTLPIREIWDMQERLPRRQGKRADLLLENPRFRAGYDFLLLRESAGEETEGLGQWWTDYQEVSDSERRNMIRDLVSQEDGSAPRKRRRGGNSGRRRRGPRKEGSGGSGE

SEQ ID NO: 27021 - protein, 302 aa, Pseudomonas aeruginosa
TARRGGARPQRRQAHRLRADHGQPPRRPCRAGKESRRTRRLRGRQHLRQPAAIRPQRRPRQIPADPRSRPGTPARSRLPPAVHPDRRGNVPRRHGRADPHPCSRRLRRPLRRQSSRPFRRRGDRGQQAAEHGPAGPRAVRRKGFPAVGGDPQAGPRPQPAGADLRRADGARRRWPRVVLAQRLPRRAAARRRPGDLPHPAAARRTHPRRRRGLPGIARRRPPGPGTGRAAPRLPGNPRADQPAPRGTRRPPTGDPGRRLPGQYAADRQPLSPPRLTHAEPPVPGGLSAHHGLAILCRPPRTR

SEQ ID NO: 27022 - protein, 565 aa, Pseudomonas aeruginosa
VRHRIPTRRSAMKHHLTPLDATQLDSWRALAAHRQELQDFRMRQAFIDDPERFKRFSFSACGLFLDFSKNLIRQDTIDLLVKLAEEARLSDAIRAMFDGEAINASERRPVLHTALRRPIGDKVLVDGVDVMPEVHRVLHQMTELVGYVHNGLWRGYTEKPITDVVNIGIGGSFLGPQLVSEALLPFAQKGVRCHYLANIDGSEFHELASRLNAETTLFIVSSKSFGTLETLKNAQAARAWYLAQGGTEEELYRHFIAVSSNKEAAIAFGIREENIFPMWDWVGGRYSLWSAIGLPIAMSIGISNFKELLSGAYNMDQHFQTAPFERNIPVLLGLLGVWYGDFWGANSHAILPYDYYLRNITDHLQQLDMESNGKSVRQDGTPVTSGTGPVIWGGVGCNGQHAYHQLLHQGTQLIPADFIVPVSSYNPVADHHQWLYANCLSQSQALMLGKSREEAEAELRAKGLPEAEVQRLAPHKVIPGNRPSNTLVVERISARRLGALIAMYEHKVYVQSILWGINAFDQWGVELGKELGKGVYSRLVGSEETPAEDASTQGLIDFFRGRHRG

SEQ ID NO: 27023 - protein, 428 aa, Pseudomonas aeruginosa
RAEEPRRGKGRPGLHLHADDSRGRLRHARLRPYRGGALGGVRRLLAGLAARPHPRCRLPHRDHRRRGRARRQVHPAEAECGKGTEGLPGRLYRGGGRAHPGRHTLGRRPRHLVPRGAPRGLSRLPGGSDGRRGPAVHPLYLRQHRQAEGRVAHHRGLPARRGDDPQVRVRLPRWRRLLVHRRRRLGHRTQLYRLRPAGQRRHHPHVRGRAQLPGRLALLAGDRQAPGEYLLHRADRDPRADARRRRPGPPDLAQQPAPARLGGRADQPGGLGVVLPGGRREALPHRRYLVADRDRQHPDHPVARRHCAKARLGYPPVLRRATRAARRERQGNRRRGQRRTGDQGQLAESDPQRLRRPPADDRHLLQALPRVLLQRRRRAPRRGRLLLDHRPGRRRDQCLRTPDRHRRGRERAGPARCGGRGGSGRLPA

SEQ ID NO: 27024 - protein, 537 aa, Pseudomonas aeruginosa
TAERPVPAAHRPHPTGRGQPALPGPATERAGGLQLRSAGLRAAQPQHPARRRREDDPGRHRPERRPPRLGRRPDPGADHVQGPRERQGYPAQGMVALCPRQCPAGAGERRGQPLQRLSPGPVQGHPAAARQGRAETRRLQHQFAPGQAAGQARQPRRGRYHPGPGQAGSGARRSPQPGPGGLGRAREGRPARLAETVRRLHSAATQGACTQAGGKHRSRRCPDRRGEDHPRTGNRRCRQGSRDSLGRSGQGQAGGEGRQRRRDGKGNGRQRVRQGRGRRCRQGSQARDEQGSEDRQGNRAGNGQDCGNRQGSQRLSATARRHCKDASAGKYESRRGDARQALAHRPARRPAARLQGAPGGSPAGHRGPAGSRPAGPRPAERRQPRQDPLRPQAQDRPRQPRPGPGQRPGGARPGQRQAQGQYPRHRPARGPGLHLAVHPPGTAQRLPWQRAGGRPEERRAAGLQRRRQRRSQPVAYPGYHQGPRLRQMDQADPQRPRLSARGQPVDPERVLRGALRPLHHQRRSQHQRQRADHPATG

SEQ ID NO: 27025 - protein, 153 aa, Pseudomonas aeruginosa
GATQPGPALPDRTQPTEGGKQGPAGRPATRREGRQPGCRKPAGEAGGSPAQGHQGQHRYPVAGGRRSEQPGVQRHADRLADPAQPGPARRAGAVQVHRRPRRRRQRGSRHGTLRRGQRRADAGSPGQPRQARRCAQGAAGAAPGSGRRGLRRG

SEQ ID NO: 27026 - protein, 675 aa, Pseudomonas aeruginosa
KTGRKRDGCRMPNWRWQGLQNARIHPLRREARRGNENRARGPCFHRSRLDLHAGSFGGSHVLDRQLDAATVVHVEHQDLHFLAFLQHVGDLVDALVADLRDMHQAVLARQDVDEGTEVDDALHLADVDLADLGFRGDRQDAQLGSLGGFLGFAVDLHAAIVLDVDRGLGLFADTTDGRAALADDVADLVRVDLHLQHGRGVLGQLGARLGDDLVHLAEDVQASFQGLAQGDLHDLFGDTVDLDVHLQGGDALVGTGNLEVHVAQVVFVTEDVGQDGELLAFLDQAHGDTGDRRLDRHTGIHQRQGGAAHGGHRAGTVGLGDLGNHANGVGELVLGRQHGGDATTGQTAMADFTTTRAAHAAALAYRERREVVVQHEGVLALAFQGIQQLGITRGAEGRDDQGLGFATGEQRGTVGLAEHADFDAQRTHGTGVTTVDTRLAVDDVLANGTVFQQAEYVLDLGSRELALFLAGEQGHGLVAQLAQTVVAVLLDGDGIGLGDRFAQLCLDGVDQHGVFRRGFPVPGRLASFGGQLLDGTDHRLELVVSEQHGTEHLVFGQFVGLGLHHQHGVFGTGHDHVEAGTLQLLVGGVEDVADFRMETDAGGADRAGERNAGDRQGGGGADHRGDVRIGLLVGGDDGADDLHFIHETFGEQRTDRTVDQARGQGFPSRKDVLHA

SEQ ID NO: 27027 - protein, 211 aa, Pseudomonas aeruginosa
SRRAGRPRPRNVSWWRSPEPAPAPRKSRRPVRPFRWIPTQQPAVLLCSLYASPFNPLDPRIRVSIKTGNDVGLVDRIDRQQVLVIVHQDHHILLLHTTENALVVTPPLIGRTQPDLHLLAGMLGELFEGEQRPIHARRGHLQGVLAADRVFDVENTADLPTDGFTVIDEDAFGAVDIDAQHRMTTLGNELDAPALIAERLDHRGQQGLQLF

SEQ ID NO: 27028 - protein, 187 aa, Pseudomonas aeruginosa
GRLHLPAPHRYPACRTTRLHLPPLHCRRKGVAHLLRPRHFPLPVARGSPRALPGLARGTRSTRSRSPRPARKPRLREQKLQHPTRRSRFPAALRQPPASCPPRAPPGSPRHTAPAPGRTTEPRQTCDSQPRHSRRESGDAPSGPRGPCYNRHPPTDWEQSHRSARLASARRRCSAHLHRSPCRPGPG

SEQ ID NO: 27029 - protein, 425 aa, Pseudomonas aeruginosa
RRDDGIARRGVLAADDMSRILPSQHPVPSQQFGHHIAIADLRPHERDMQFLQSQLQAEVAHQGADHTALQAPAFLQVARDEEKQFVAIHDRTGMVDHHHPVAVAVEGDAEVGMVLDHRSLQAIQVSGTALVVDVQAIRAGRQHRHFRAQFPEDAGSDLVGSAVGAVEHDLETVEVGAGRHAALTEFDVAPRRVIDPRNLAETGGLHHGHRRIEQFLDHQLDVVRQLGPLPGEELDAVVVVGIVRSADHHPGLGVESPRQVGDAGGRHRSQQQGIGAGSGEPGLEGRLEHVTRAARVLADQDPAVALPAEGHAHRPAQLENEVRSNRKLANTTTDTVSPEVFSAHLLSSVLNPPFQRRRSFASRRRSPPRHALELSVRPWPAPGPPELGCRRGVRPPPAPVPCRSCSCAKRRPTTASPGHGVPADA

SEQ ID NO: 27030 - protein, 252 aa, Pseudomonas aeruginosa
NWRWPSATIAAPCSTNSARSRAATWCKASARWRWSIGRTRSRTRISRTSAVSPASDAPSNQGRETSRPGSDAFLVPPRYRLQHQQQATHRHRQVVEQQPAHRLGRQPTHQEIHQAEQRDGEQQLTAKVSPEAPRPVARHQHQRLQRRTESGEADQQRRQRRGYGFHQQRRQSGLGQRRQDHELQQPEAADPERLGQQPTDRACAQRGALRYGEPRRSRTRRRRPGFSPARHRLRSCRSAHGRSANSPRSCHP

SEQ ID NO: 27031 - protein, 595 aa, Pseudomonas aeruginosa
SAGAARPSGVSLLLPGRGRPGRSWGTCSCLDSCVEILQTPNGLLGTELERLTDRLPTRNGGGAADLVLQGVSTNGVGVSDGLPALGGVDDQGDLVVLDHVHHVRATFGHLVHATHRQARGLDDTRGTGGGYHFEAQRDQVASHLGGERLVVFADADEGATGGRENLAGPQLSLGKGFGKAITDAHHFTSGLHFRAEDRIDAGELGEREHRFLDAEERRDDFLGEADLGQGLAGHDAGGDLGQRLADALGDERHGTRGARIDLDDEDILALHRHLHVHQADHAKLQGHFLDLLADLVLDVLRQRVRRQRTGGVAGVNASLLDMLHDRADHHDLAVAYRVDVDFDGAVEEVVEQHRAVVGNLNRLTHVALEFFFLVDDFHRPPAQHVGRAYHQRITDGLGRGQGLVFAARGGVGRLAQVQALDHLLEALAVFGTVDGVRTGADDRHAGLFEGAAELQRGLAAVLDDHALGLLDADDLKDVLEGHRLEVQAVGGVIVGGDGFRVAVDHDGLVAVFAHRQRRVHAAVVELDALADAVRTAAEDHDLLAARRVGLALFLVGRIHVGGVGGELGGAGIDTLVDRQHLQLVAMAAQVLLGDA

SEQ ID NO: 27032 - protein, 552 aa, Pseudomonas aeruginosa
QLGQARVGEALALELVHQLAIDGGQAEGLDLLLVLDQVLDLHQEPFVDAGQLEHFLDALAGAEGVGDVPDTLGAGHGQLALEDAVGLRVVQVELRIEAGGADFQAAQGFLHRLLEGPADGHDFADRLHLGGQAGISFRELLEGEARDLGHHVVDGRLERRRGAAAGDVVLQFVEGVADRQLGGDLGDRETGGLGGQGRGAGNPRVHLDHHHAPGVRADAELHVGTAGFHADLAQYRQRGVAHDLVFLVGQGLRRRHGDRVTGVHAHRVEVLDGADDDAVVLLVADHLHLVFLPADQRLVDQQLVGRRQVEATGADLFELFTVVGDTAAGAAHGEGRTDDAGEADLLEHAVGLLHAVGDARARTGQADILHRLVEARAVLGLVDGIGIGADHLHAELLQHAVALQVQGAVQRGLAAHGRQQRVGAFLLDDLGHGGPLDRLDVGRVGHRRIGHDGRGVGVHQDDAVALLAQGLAGLGAGVVEFAGLANHDGAGTEDQDALYVCTFWHGTLVAIIRTGLRWPASHQSRRTGRRRPKWRRQPTVAAGGTRPPAAHR

SEQ ID NO: 27033 - protein, 461 aa, Pseudomonas aeruginosa
TASARPSAGRPHRGPTAASAPRLRGTRRRRPGSRSPRHAGPKSRGRTTSSVRATGSRKPHPARRSRNRLSPGSAWLCSSATLGHRRDEAVEQRGDVMRTGARLGVALEAESDLVGALDTLQGTVEQRLVSGSQVVRQGALVDRETVVLAGDHHHAAVQVLHRVVGAVVPVAHLQGLGARGQGQQLMAEADAEHRDLGIEEFADRLDRVVARFGVAGAVGKEDAVRVQRQHFAGRCLRRHHGQAAAARHQHAQDVQLHAVVVGHHVIRQFTGRDLRMTVAFQVPDAGAPLVALGGGDLLGQVHALQAGEGASQLQRAFLGSVGTSQDAAVLRTLLAEDAGQATGIDAGDGDGAVGFQVVRQRLLAAPVAGDQRQVADDQAGGPDAVGLGVFRGGTGIADVRVGQGDDLLGVGRIGKDFLVAGHGGVEHHLANGLAVGTDGFTAKNAAVGKCKYGWLSQEDLP

SEQ ID NO: 27034 - protein, 431 aa, Pseudomonas aeruginosa
GPSRHANAGAGSRVADHAYRPGRHAGQKQAGAYLLSLTSSNSASTTSSAAFACSPWGASSPCWACSAYIFCASGVEAWDRAFILASISALSSPFTAASSSPSAFSMVALSSAVALSPASVIILRVAWTSASPWLRAAASSSNLRSSSAFASASRTICWISSSDRPEDALITMDCCLPVALSFAETCRMPLASISKVTSICGTPRGAGGMSARSNLPSDLFCAACLRSPCSTWMVTAPWLSSAVENTCDFLVGMVVFFSIRPVITPPRVSMPRVSGVTSSSSTSFTSPARTAPWMAAPTATASSGLTSLRASLPKNSATVFCTSGMRVWPPTRITSWISETSRPASFSAVRHGSMVRCTRSSTRDSSLARETLTFRCFGPLASAVTYGRLTSVCWVEDSSILAFSAASFRRCMASGSPFRLMPLSFLNSSTR

SEQ ID NO: 27035 - protein, 708 aa, Pseudomonas aeruginosa
SPRRWDRTSPGRARGCRPPPAGRRRISPARTCAPSRHPAPHAGVRSADPRPCAAPGPGRQPAAPPVPARGRSGPRRRRWAARGSVDPGSAVRQPCHSPSKISWQIQGERISSQRCRLYGDGFPRFKGRAAIASRKKYCINNQTKPTEPPAMLVHLSVHNYAIVEHLDLELATGMSVITGETGAGKSIMLDALGLTLGDRADSGAVRPGADKADILASFDVSAIAEARDWLAERDLEQDGPCILRRVITAEGRSRAYINGTPCPLGDLKSLGELLIDIHSQHEHQSLLKSETHRRLLDEYAGCQELARQVQLAAQRWKQTSQELERLSRSGDEQRARHQLLSYQLEELENLSLGENELESLEQEQKTLSNAESLLAACRQVVEMCSESDAGNVLSALNASLNRLSSFSGQPAALGEAVNLLSSAQIQVEEAIGELNRFVDHFDADPNRQQQVEERLDVIYSLARKHRVQPAELADLQQRLFDELEALNADDEAVGRLGDELAAYARHYQEKADELSRLRQAAAAPLAASVEQEMQRLGMPGGRFAIVLHPGDSAEPQANGLESVEFLVSANPGQPLKGLAKVASGGELSRISLAIQVITAQTSRIPTLVFDEVDVGIGGPTAEVVGQLLRRLGERGQVLTVTHLPQVAAQGHQHLFVHKERGSSETRTAVATLNKAQRIEEIARMLGGVDLTKESLAHAKKLVNLAAQN

SEQ ID NO: 27036 - protein, 184 aa, Pseudomonas aeruginosa
TFLQWKMKTATPGSPFSHGTVARLLLLAHVEHQIVIDQLEAALADDFLLALLDFRIHELDHLAGIDADHVVVVAAIGELEHGMAAIEVVTHHQAGGLELGQHPIDGCQAHVLACVHQRLVHVFGAHVALLGRVEHLQDLDPRQGHFKAGFSKFAIFNHVCFLSAGCFAVSRNTGMIGLLFAQPR

SEQ ID NO: 27037 - protein, 165 aa, Pseudomonas aeruginosa
TTSTAISAIELLGALAERVDHGVGGLGEQRPKGRLDQRPGVIEGQVEGDLAGLLAQRLELPDAMQFGERSVFQVHLDGSSRHQHVAGGEALAEATLGHGQLGAHQAFALLQDLAGRTPGQELRIALHVVHQIEQRAGGIRQQRRTLDMGAHRTLTSAVERATPQA

SEQ ID NO: 27038 - protein, 259 aa, Pseudomonas aeruginosa
ALVLLHQLRAGFRALRVHPADIGHHVAPQQVEQALDGVQQHGVVAGLGDRQVEARVGGALFRADLVVARIAGLERLEGLGQALVIEGGRTQRRVVGTRPFQRVAKLQQVALGLRVTFQQVQQRIAESRAQRFGHIVAATLAADQQPLRHQFLDRLAQRRPGNPELLGKHALGGQPLAGLQRALQDHRLQLRNDVIRQTALPDLTKFHIPTPLPEVSSQSLCHAPGAKKRGSVPSRSPHHKRGATSPARASLDKSRRRAN

SEQ ID NO: 27039 - protein, 568 aa, Pseudomonas aeruginosa
GANPHASLATTLYPPGQSRPVGRRGRHPDRVLLPRPGGIPPQGPHRRQHHPGAGHRGSHLRLPHARRHGLRRRRLRLPLRSLADRLDHRRRGLPLQTDGEERPVRGDPQLGTVDYRRPAPAGTADRLLLRRLPRRRRRFRRAGGDHRRPARRPRLQSALRRRPVPDRQHCAGGLRRTGHPDHRRRPGDRHRRLQDRRHDRPPTAVPVDPGTVLAGVHDGRLARHPRNLAGRHRRRRQLRHHPVPDVQLHRPGVAGHHLSTGQPGLPDPVPQGLAAAGRQRSARRRRRRGRGRWQLRRATQRRTVRLQLRRDPQGLVAVPGAHRTGDHLDPETFQGPVRPGRRALLASVQLRHPAPRPTGGQGRADRHQRHADRGGIQVRPDLRHRHGDLPLGVGIDVHSAHRSENWYYHFQGSPGRAEVADPVHRHGPGLRLRHQLLGHVHHPGPGPGRYRRGVPVLLAVPRLAGGIPDRFGYVLQRPVQLPAVDHRAPDRGQRHPAGGRQYQRRRDRQDDLPAIHRRGLRRDRDGRQGIRPVPLHPEAQPDLRRAGRTDHPGPGIPIHRHAGALTAP

SEQ ID NO: 27040 - protein, 124 aa, Pseudomonas aeruginosa
SRASSTRRMPGDAVKFGADGIVVSNHGGRQLDGVLSSARGAAGQSPEAVKGELAILADSGIRTGLDVVRMIALGADSVLLGRALVYALARRRRGRGAQPARTDRKGNARGHGPHRGQVDRRDQR

SEQ ID NO: 27041 - protein, 453 aa, Pseudomonas aeruginosa
LAGPRTGRLRRPPEKPENARGVTVVPGPRKADEPADSLSRDRRAADTARTPLRRPAVDPGLRHRRQFLPVDSQAGAARRKRGRGRRDPIRRLPRAGPGDLPRRRHQPLRPGHQRLGAARPRRQLERPGNPRRRRADPPAAGCHRRPGERLAGAVRPQDRSRPGLDQRLQDRRHRRQQRQRHVLRHRAEQLPHPRRPAPAAGRRHPPGQRGPGQRRGLPRQPRRAAGTARRTRPRDPRQRRTGREDPPQVPAEEHHRPVAERAGRLRRAAGHPHPPDGRLRGHPRLHQRGDLRHRPGTPAQGLGAAGFPHGGNLLHGGRGAQAPAGNRGGTVRSAQHALGGEHAGHAGMGEESFRRCMRPAHRVPRGEPHAAARTARADHGLHRRISAGEAGRLQRRPGGLQPALAHPQGHLPGCRRGARDRHHGDHRGRHLPRRTTGRGSQPPDRAVRQAPLR

SEQ ID NO: 27042 - protein, 309 aa, Pseudomonas aeruginosa
PGQPLLRPAVRVQGVCEAGRRQARRAARRPAPGQPRRPRPDLLRHQPLHPAPGPGSGRSATADPRPGEIHPQSPARSPGVHPAGQTGSGARHLQHPAPRREPGADRPGRPLHPRGGDPGRHSLLRLRRRQGLHHAGTERSLPAQPEGCRAVLQGRRVHQPYLRHRPQRARRDRLPRGGLPGGPGDAGEGHASVGRITASRLFAGPCSAKAADSAAGAIRPTSRLSPVGRVSASRLSAGPCSAKAADSAAGAIRPTSRRPPVGRITARGYPPGHAPQKRRIAPLALFALRQAKWLLRRRRPAPGRAKIRR

SEQ ID NO: 27043 - protein, 299 aa, Pseudomonas aeruginosa
APLKSAAPIVPSTARTSLAETEAGGLHGNSTVATRSDHRARQATGHRAVRLRRPALRRYPVDRGKHARGRPPGQRHHHHLGVPQVQPDRHLRRGGDRRIAPGDPYLAGVRLCRGRRVHLRRRTRWRPGRARAQRTPGQPSAPDLEHGPRPRRPSPGAAQPQPGRQWPGRRRQPDPALGAGPGHGGGLMDTPIERAPLAPDLSQARYAVDLTGLVPAEVAAGAAAAAAEPLLFLSAGPAAGRRRRDHRDRGQRPLRPVRLPPAPGALPGPHALAERADRRHLQLRPRADARRRDPERRER

SEQ ID NO: 27044 - protein, 526 aa, Pseudomonas aeruginosa
RGHHRRRRHARQRPGPGSLYPPVLRAAAFAPATGRGGRGAGAGVLPQRRQAPRGPRPHPAQCLLPGPQLPRHGALVPLLLGLPAGFRLARHEPLAGRGHRPTHRTQARPAVARPPRRRLPQGLLRDGPGNPLPARPTGTGTGRRRTLRRTAGYRGDRVRPGTIAGPGEDLKMSAAPLASVPLAVNGAPCLLHRVRFRSAADGGGLPLLATLRDPQPALAVLAQRIELSEDAELPETAVDDELLVIFANAGLQTGHAWRQRLEAWMAAGEDERQPTLEAPSFGERVLWRPGRALVIGNPERCRELLEGLAVFAWHEGHLRRLEGETAAAWEPAQADVELTQLPRRAALRRQEHVNRQVRRTTLWRMAYARLESHLEKPPLQLNGAVRRLYNELAMQAEVHDRLATLDDRIEVLQDLYELAADRLGEYRYFRGELRVEWLIVAIPPAGGRPEPVGIVESLKRGCHENTAGRGRPAARRRHPRRAAPGRRYRGMGDRRRGRGERAGHRRVRPAGARHRTAAPQRPGHPA

SEQ ID NO: 27045 - protein, 642 aa, Pseudomonas aeruginosa
PAPPGPAHPGAAAHRAGQGGRPGRRARQRCRRLPDQALRSRRTAGTGARPDPPHHRSRPAATGARRAAPGPGDPPGDPVRAGGGTGAARIRTAAPAAGEQRQGALAQPTGAEPLRLERRRREQRHRSPRPPPAAQARQPVDPHRPRHRLRHRPAGALKTAYRSPPMSRAAVPSVRRRLLVNLLVGFVLCWLSVAALTYHLSLKQVNRLFDDDMVDFGEAALRLLDLATEDQAGEDGSITEIIERSREAIQGLPLLRRESALGYALWRDGQPLLSSLNLPPEITAQGPGFSTVEAQGTHWRVLQLNIDGFQIWISENLIYRQHTMNLLLFYSLFPLLLALPLLGGLVWFGVARGLAPLREVQAEVQQRSARHLQPIAVEAVPLEIRGLIDELNLLLERLRTALEAERRLTSDAAHEIRTPLASLRTHAQVALRSEDPKAHARGLLQVSRSVERISTLMEQILLLARLDGDALLEQFHPVNLATLAEDVLSELARQAIDKDIELSLHQETVHVMGIDLWLKAMVGNLVGNALRYTPAGGQVEIRVENRAQHAVLRVRDNGPGVALEEQQAIFTRFYRSPATSSGEGSGLGLPIVKRIVELHFGSIGLGKGLEGKGLEVQVFLPKTQPDATRPPARGPDSGRSHI

SEQ ID NO: 27046 - protein, 143 aa, Pseudomonas aeruginosa
ASGFATSQETRMNIGEAAKKSGLTPKMIRYYESIELLRPAGRSASGYRHYNENDLHTLAFIRRSRDLGFSLDEVGKLLTLWQDRQRASADVKALAAQHVRELNRKIEELSTLRDTLQDLVEHCQGDHRPDCPILKDLASGCCH

SEQ ID NO: 27047 - protein, 286 aa, Pseudomonas aeruginosa
YPAAASAPSSSSPAGAAGRPPACRRNARWAAPSAPAGRQRPAVPVAPGVRRRAAAPPPCTFPPSGTAHRRNPGRAGRRCAGACAPGSSPTRVPRSDGATRPRSRRRPAGRGPAGRNEIRRCPPAAWLRRSHADGPIPRCARSRRRSRRPPGRPRAARGADAGARNRRRTARGCLPPFSSQPPHRPGEASQQAGRQQGDGQPDEHQRAGQQAVQVEAFAEQQPAGEHARHRHRQGERGHQAGRVVAQEETPDGEAHRGRAEGDVEQRAEAAPAHVQHGALDGLRTFE

SEQ ID NO: 27048 - protein, 139 aa, Pseudomonas aeruginosa
PSMPGMFTSSRIRSGRGSSTAARSPAGPLPAVRTRYCSSSSSRISSRLSGVSSTTSTSSCSGLSSMLSIAPPAFATGPPGGDRHSVLKTLETTSARPVRRPGRPFRASGGNAVANPRPRRRSRSRRRPGARWGPGRNTP

SEQ ID NO: 27049 - protein, 390 aa, Pseudomonas aeruginosa
PVASHWPPCRYPGQRGQLRRTGGCVELSTLLPAFPRHRWPAESTFSLGAFPPGARSMTDRYIAFANSPVGRRLVGAVGLPSPLRLERWQAGRVRPVDGPLVIGGSGALAEAVLPFAGKLTDAVFAAVEGQFELPRWTAETQPAGQGGAVRCQRPDPLRAVGGAARLLPAGAQGPRHMPEGGGPRTRPRVSQGPGRRQRATQPGRFHPLPGQGNPSRRQRAVAVRRQGRRGPTGRRAALLPLAEERLRLRPGDPSCRQQRPGPRLEQAAGRPARTGHRRRPRHWRGHRGNPGARRRGSGAARRAAGQGGPRRPRRAPRRSCRGPRHLRRGRRAATGGRAAGGRRYRRAQRRDHTRQDPGEDEQRLLELGDQRQPQCPAGADPGPARRRQAA

SEQ ID NO: 27050 - protein, 245 aa, Pseudomonas aeruginosa
ASRWKTCNRTTRAPPSASSPAWKTSLACSGSATARCSAAASRCPAKFRRKPSRSRCRWSRSTTGRRPPTSAGAMPVPPATTTRSTCRRPAPSCSAFPAPSPTACGTRLAAWPPSASDCQPRAIGSRCASRSRCCCRPASPSWPARRRRTASSACAARTTCRTWPGIGAGYRADAGPPCLEASGAKPEAMRLLTATAKNPPWTCTNSPRACTPSATATTGANSTARRTWPWPPASRWPNWWRSSSG

SEQ ID NO: 27051 - protein, 213 aa, Pseudomonas aeruginosa
RGHGASSMQSRLLILPLLASLAALGACQGDNPYRASSLPYPPQPATAANPGLDPGAYPAAPRDYARYRSWSWAAAGVSGFPQGLDDNQLRDAVSQQLDQRGLRPARPGSAADLQVSAFLRSELRTRQVTDYYGGYYGNYGGWRDPWYGYGASYPVTRSYTVQVTVVRVELNDARSGQPVWGNSAEFDSGDSASEQAKALREAVKRALSSYPPG

SEQ ID NO: 27052 - protein, 232 aa, Pseudomonas aeruginosa
LELVATRLRIPPRRPTHQERPHRATHPRSRRPAARPARPASGPGQRQGRRHGARLPDRRRSPGPDHHQLRRRLLGRLLGRILGRPGDGRDAHRELQGCHPPGRPVRRQGRQAGLARQRRADHAHQPAEPGRARAGDPRDGAESHVAIPAALTCSSATARRRPVTWRRSPASPRTATNSSIATPRRSGRSASPSWPPPSPNAAAAPWPCTTDRCSASPTSTSGSTATSAPSAT

SEQ ID NO: 27053 - protein, 131 aa, Pseudomonas aeruginosa
SRWTSPLNPDTHAQRVLIIVSSGPSTPARCAAPFHTATLLACMDAEVTLFLSGEGVQLARRPVADQLRALDGGEPLRHFIRQAREAGARLLMCRQPGVNIDESELIEELDEISSGGELARLILESERVLTL

SEQ ID NO: 27054 - protein, 306 aa, Pseudomonas aeruginosa
STGIATARAGWYGCNRTTGPRRGARFSRETRRGRHSPSACAWMGSIRSIQGCRRWTSETPGFYPHPARGRRITPLALFALPQLSIAANLPHIPGVRHVLTPTAPLRRPTLEQRRRRPHRGAACRPRLATTLRRRSRGHPHGAGAARAGHRACRQHRGARARRQADHRHPPAAAARPRSAAAGSPAGGPRLPVLAREPEHPADVLCQRHAALRPWPHPPCPCHAPGPGRPLPAVPRLAAQPPRRRPPLRRNQARPGPPVPHRPRGLYPWQGRGRRKDFRPGAGGDAAPNDTEWPGKGRTRNARQGTA

SEQ ID NO: 27055 - protein, 346 aa, Pseudomonas aeruginosa
SVTAATICAGVSSAATPSKASPCACSSASCCCRSVESGLISAIPVLPRQACAPVRRARHEARYLTASRRRKRPPQPNVAQPLIASSRKCCLRLYWRICAIHTRDSPMTLIAAAQSCAHPADLPRNLDDHLRLMRIAQARGVRLLVFPELSLTGYEPTAAAALAQPTDTPLLQPLRQLAEQARMTTVVGLPLRSPKHAKPLIAALILGADGSLGVYAKQHLHAGEERHFSAGDGGPLLEIDGLPMALAVCADFSQPSHPAHAARAGARLYIASALIGENGYPADSALLAGYAREHGMGVLLANHGGPTGGWKAAGRSAFWNERGALVRETTGTGETLLLLERTEIDA

SEQ ID NO: 27056 - protein, 356 aa, Pseudomonas aeruginosa
RGGRRTRGSRACSGPGRHGPGRRRRGGTWRAFLRSSGCRSSRMDAPRVQEHRAAGHTPFWGKRWVRPTRLAILRRQRQERAVPSMQAIAPNALDRWHEHLALAIRRLRQPDFLAALVDAIHQLVPIESSMISLERKGHAPTLLYERGIAERFREAIIRRYFSRGYLLDPFCLAVDECLPECFYTLGEIAPDDFFQSAYYQTYYLGAGAVEDVYYILDLGPTEKLSICLYNGLSASRYSDAQVAVLAGLAPPVLELARQFCAGRADLSPNPQADLAPRLQEVLRGFGRDVLTDREREACHLLLSGHSAKSSARLMDISPETVRMHRKNLYTKLEVGSQSELFALFIECLSQGQRVGP

SEQ ID NO: 27057 - protein, 925 aa, Pseudomonas aeruginosa
LFVEAPQAGEQLLDQGEPALPGEQPGAEAGLHLDHLFRQPPVLARAVEGLHQALRVEAVLGRAEQGRQRLLQAFLAQRLKLCQTCRRSSVARRRGAVEHPPAAKGALRRLVAQHQAVAMQGLDRRVQHQLGEGAVARLQLFAFEQGQAPGDVLGAQVQVHRGPVGEVAEFVGQQAEVDVDPRGRRVQRGLQQPVAALDLFQREALAGDVQGHALAGPGLLRGPVLRVQAAHPHRPSGVAEEQFVAHRDLSGEGRAGDHDAAAGDAEGPVHRQAEVSLAATLADFAGEPAECFAQRLDALPGAAGEREDRRARQRAGGQQVFDLGPHLLHPLRLDPVDLGQRHQRPADTEQFDDRQVLAGLRHQAVVGGHHQQHAIDAAGAGQHVVDEALVAGHVDEAGGAAVAKVGVEIAHVDGDPALALGRAAVALDAGEGAQQRGLAVVDVPGGADDHDSSLRSRGNWARNPGSSSSWRRSSQRASSSSRPITGSGSPRRASSRLRRARPRRRLGCRGRRHSAALGSRATGCAPLPIMPRGVDHGDLPALAERLAQRRRQTLGLGADLRRRAAEQAQGGQAFGEAVRIAVQAEHRLEGGEGQLVDAQGALERVLLDPPDQFSVAEDQPGLGPAEQFVAAEGNDVGAVGQGFLHRRFLGQAPAGQVHQGAAAEVFQQRQAMAMGDGRQLRGGHAGGEALDAVIAGMHAHQQAAARADGGFVIPGVGAVGGAHLVQAHAGAGHDVGNAEGTADLDQLAARDDPFLARPQAVQRQQHRRRVVVDHGDCLGAGEFADQPGDQVVAVAALAAGQVELQVQRVARGQGDRLDGLVRQQGAAEVGMQHRAGQVEHPPHAAGMLRGEAFAGAPGEHRLAQFDLGEGTASGRLAQFVEQVAEGRQQRLAAVALVQGSGRRAAQQAVDRRQANGTHGETLSTG

SEQ ID NO: 27058 - protein, 326 aa, Pseudomonas aeruginosa
GHRHAHHRRVGACPQRLRLFAAGGQQQVRRTPQVAVLGQAHVQRQAGQVVGKGIGVAVELQVELLQVALATGAGLGAQHGFFRRLPVMLQGQVGQVLAFLAVAALDPHVVPFAGAQRAAQVAQTGFLAALADHPGHRRRAAGGAQGPALGLDHRALLQSQQPMAPGYLQGGAEERHQGRRQEVELTAEQGDGPGLALAFIGFAQLFECRADGGVGRCRVAREQGIQPGQPGAFAHQQVVGQRRHAVLAALAQALGVERGQGRRVVQQRLLEPAETGDQPQVVAHRVPLGQLQQTLAAAGEQVARRLVQVRGNVGGGFDLPRLKNGA

SEQ ID NO: 27059 - protein, 231 aa, Pseudomonas aeruginosa
HGNSSGLRRRAGGPRRNDRAPGGARNECKGPIAGASGRAMATLYASVLLALADFLQPAVMVLARPGAADLAVEHRAHRALDPDAGVDVHDDAGDQDEGGEGVQERRQADRLDAEPGAEVLAPDHDAGDQQGQHAQQQHPEQQLLPGVVAADFREVLLAVADHVAPLLEPLDIALLHPVVVGEAHHQAEEEDEHRQPQEGVQDTRPGTAAEQVGQPEQRRVEQRQPGQPGHE

SEQ ID NO: 27060 - protein, 386 aa, Pseudomonas aeruginosa
PDQHPRGRRIPARHRQGRPGVDGPAAAGRPAVCGQGRRRPGRGDQHLHRLQPGLPRSCLRQPPRHLPGQPAGGLRDRIALPQGAHAEAHRGDRRRPRRALRRLRGRRARASGQPVRGERGNRRAVQPGQADSRQGGVPRNPALLPRASGTPRRRPAPRPPSAPGRAGRSVRRRGGGHRHPATPAKDRRHRRTDRTQLRGRAARRAGGRAGRHRRRRRHRLRRRRLPRRRAQRRPAAGARRMARGMGRGPRQQPARRPPRTRSDAAGAPGLAAPAQARRSRRAARQDQRLGTPRAPQAQRRTDARRGGVPEDRQTRPVDPRRRRGTLAGGGQRGDLRRPGAAARVADQPGGGKPALPPDRWGAGGRGTGCQAGDSRGGHAGGALVGG

SEQ ID NO: 27061 - protein, 208 aa, Pseudomonas aeruginosa
PLRAARSWPGGATASTSAPPNAGSAAYACAPAPRTGRWTSRTGRYGGRTHGTDAHRPDERNGRAATIMRARFPRTRPPMKKIPLAAADPDRLDTWVKYREGLCGECNATCCTLPVEVRIDDLIRMGLVDEFEREEPAKRIAKRLEKDGVIEHFNHKREIFTLTRMANGDCLYLDRKTRLCTIYARRPDTCRNHPRIGPRPGYCAYRPR

SEQ ID NO: 27062 - protein, 741 aa, Pseudomonas aeruginosa
NGVRRRSGGACRSLPLPWLVRPLRHRIDAAAFEQRIGQGGDMMVDASVVAENALEHVTGLHPGTAIVAQATEALATGIGLQSLQQLLARHQAQRGVQVFAKERADRQVQALLDRRLQRQHAAQLELAAGAAAPGPAHRQGQQAVGDEIADVLDVDGEQKDFLGTIGVAVAEAVLAEVCQVGADRRTQLVEGLVLATDFRRHLRLRSLQQAAGGAQHQTGHVGQPQDFASSVGQADVGHLQPGFVEVARHARVVGLCLFRQQAREQRRKGAGEADRQQCQGQVESTVEPDRRRTAECVGRLRQRRQPGQHQQATEQAHQQVAQRQAPRHPATGHPQRRQGAAEVGTEHQGQGDGQRDQSGLGQGRHQQYHRDTGMAGPGQQRGEQQGDQRIAFEAVDHRDKGWRGLDLLQGMAEQRQRQKHQAESDQALAKALQARTVAQAEQQQAGQQGQRRQQRGVEAEQLHHQSGADVGAEHHCQRRRQAQGATGGEGRCHQTGGGAALQQAGDAEPGEQGQPAVAQVAAEPVAQRSAETAQHAAGDHVRAPQQKGHGTGQVDQEDGSQHGGTPGSEWIVKGTGSLTHGQPERGTVERARAVQQVFHFDLAQAAAGVCAHADHHQQVRGLRQQPCCQATERAARRAQAFAYDVHGCFLGGGACRSAARPWAQKRKVAPETSHRSRSPRRWPPTSRSRSSRSPRCSRGPACQPLSPADSPKRSAIRVNGWPTRYSMPTPQFQRCRRSPSA

SEQ ID NO: 27063 - protein, 1008 aa, Pseudomonas aeruginosa
APPAARASDSSASSRTQASAAATKPRRQDRARRSAAGSGWKRGARGRRSCRVMMRLSMRGSGVRCAARRGLPTRRERPGRSPADGSEPLAEAADVEGLHGLRGDAVAEQRAHQPGEVLPRQRLQADHRPQRRERHVDAQRHHQPGHQHHRQRRGALDEGNLLGTQHVHHQGLREQALDEPAGLEQRLHFRAVGGEHEPHQRVGGDVEDRRGRADPDHEAADVLRVPLARLGEELLVHLVPRQRQLGDVVHQVLQQQVDRQHRQEGDEGAGHQYREHVAEVGAGSHVQVLHDVAEGLAALDNALLQDHQAFFQEDDVGRFLGDVGAAVHRDADIGISQRGGVVDAVAEEANGVSVALQGLEHPRLLQRRQLGEHRALLGQALQGGIVHQVDVATEQRLADVQADLAADLRADHRVVAGEHLHRHAVLAQRGDGRAGGFLRWIEEGQQAGDHQVALVAGAVLGLGLRAREAAGAEQEHAEAVAVVLLGQRQQGPAAFLVERQVDTVLVHAGGDLEHFLDRALAHQQVFAVLALEDHRETPTDEIEGQFVDLAPGIRRRDARVLFDEGDHRAVHQVLHPGLVEAVQPGHLQDPVAAPAGNVDVMLEDDPVLGQGTGLVGAEHVHGAEVLDRVEALDHHLAPRHRHRALGQVGADDHRQHFRGQADRHGESEHERLGPVALGETVDQQHDRHHHQHEADQQPTDAVHPTVEGGLRPRTDDGTGQRTEIGARTGGDHHRGGRAADHVGAHEADVRQFEQVLLVGGDPLGGLLADRAEGVVFLHRQRLAGEYGLADEQVARFDQADVGGDHVAGGQAHDVADHQFAHGDFPQLAAHPALVAAQHGGGVPHHGLERLGGLARTVFLPEAHQAADQDHAEDDDDAGEIGFLTVLQGQPEVGEEADRRERHQHVDEGVVERLQQLHQDVWRTVVGHFVGAVGVQPGGGLGLVEAVLATADIGEGGFQAVLRFAGGAHGQSVVAALGVELGIALGRYAHDSVSCRELRDGDTSRLPVR

SEQ ID NO: 27064 - protein, 419 aa, Pseudomonas aeruginosa
WRAASACAAEPSVLHGPAIHVHRRLAQRLGAGRMRMAGQREVLRRGAELHGHAGFADHLADARPDHVHAEHLVAAGIGEDLDEAFALVVDLRPAVGAEREASDLVLAPRRLQLLLAEADAGHFRLGVDDRRNHLGVHLRRMPGDPLDADDRLFLGLVRQHRSRGHVADHPDARRRAALSLVLQHAATIAGQADRLQPQSFGIGAPADGHQHVVRLQRFRSAAGGRLQVEFDALLATARGDHAGAEAKPHALAGQGALQGPCGFPIQPRADPLEVLQHRDLCAQPAPDRTKLQADHAGADHHQVARHFDQLQGAGGVEDALVVHRHAGQRRRFRTGGDDDVARLQLRVAAVGKGHADPALALQARPALDPLHLVLAEKEFDATGQGGDALVLLLHHLRQVQFRADPDAEPGELAAARRGV

SEQ ID NO: 27065 - protein, 330 aa, Pseudomonas aeruginosa
SKRPWRARTQASAPCCCSLRWSARCNCRAACRMRRCRNGYWKRRARSCWSRWSARASAEVALGRPLPRQIGREPGPRRHQRLPIGRIRQRRDGHRFTPIETDQRRLHQVLDLHHHLRGNPGDSGAAALPDLGTGDAGQHRLDVNAAAGQLVLQRLAQAQHVGLGRAIDGIEQLRRQRHHRTKVDDGAAATPAEPLRRAGSQAGQGHYVEGDHPLRPVHVGIGQRTVHRHAGVVHQQRDRGVVAQPSLDPQPIVALGQVGAQDLHPDPVGLAKSIRQGFQALPVARHQQQVVATAGQVLGVGRADSGRGAGDQGDAIANLFVHVGSRWKKA

SEQ ID NO: 27066 - protein, 394 aa, Pseudomonas aeruginosa
RRTPAAACAPRRVAPRATRGPRPGNCRPARRAPGSANRREAQRGPGGRRPARRCRTASDAAPALPAAGRRRAPGPRRSAGCAGRDGSARRGDRHRGGAGPARPGSPPRPDRPAGRCPGSHQRHSSTGLLQDQGVVQRLADPLRANPPAIQFGRLHRIVEQSLDTAAVTQQDLGVSAHDLADLCQHRAFLLHQRSDQEMRGIAGKRQFRRRQRGKLHACLQPLAASDLAGTAQGLLVDVQAAQMCADLPRQHQGRGRQGTGADEQDPCIGIYPRAVEFAADGFQQATQVAAHLAGFMQHALAKVLLQFAEGLHRRVAQAQAERLQRRIVRIGLPLRPAAILPDQSAQTVELAPEDLVAAATLAGIDGEQANLAFQFAEGFQQRCASLHGMASWRR

SEQ ID NO: 27067 - protein, 92 aa, Pseudomonas aeruginosa
AARPPTPSAPACANATRRRSSWKSTSPAPTWACDWPARPRPASNTSCRCCFSATARPTPRPAWPQPAPAARNSSPAPWTPPACWKRSRPSAA

SEQ ID NO: 27068 - protein, 638 aa, Pseudomonas aeruginosa
SDETRHAPQATHQPQHPAPAHRLPRPGNHPVVVATRHGAALPVARPVPGAVAALRRTGRAQHPPVPRQRRRRAPAGRAASPGKPRRGLAGATAGPRPDPRAKPRGVARIQRRRPARRRQARRRPAGPAATGRARPHRQPGTMVRLPGRRGGAAPGRRLPHPAAARQPAPDPPQPGPRQAGGKRQPGPGRRRRARIGQPARAGRADRGLAAARRARRATLGQRRLRRHDGAGRRRRGWRRQCRRPRRGAAARTRQPAATLSGRVAPHPRPDRASPATVRRHRRQTGRGAPGPGHPGTAGARRTPAPARPGTPDPGWDDRPDPAHRPRHRQPAKTPGAGPRATGAGALGLGRRRLLAPHIPAYPHRGPAQPGRFAEPPAQLPRRAGRRDPPPRRTGRRQQPDPGRGQQRPARRGRAPGRRYRADPRRPRRHGSGDPAGRRRRQPDRRRQSQRRPGSGAWPAGDRREPGRPARAGRRGARQRPVDRAPGRGVGDHRQRADGDPLDRRTDQPARPQCRHRGRPRRRPGPRLRRGRRGSPLAGPAHRRRHRGDPAAHRPPATGRAAIGGGHAQPGRACRTHRRTGRRGGRRAGRSGRRDPYHRRDGRTHRRRLDPAEPGGRRDSLAQRTHPRPGRGKPAADRP

SEQ ID NO: 27069 - protein, 170 aa, Pseudomonas aeruginosa
TTSTPLTSLGVLALMDIRKVKKLIELLEESGIDELEIREGEESVRISRHSKTAAQPVYAQAPAFAAPVAAPAPAAAAPAAAAAESAPAAPKLNGNVVRSPMVGTFYRAASPTSANFVEVGQSVKKGDILCIVEAMKMMNHIEAEVSGTIESILVENGQPVEFDQPLFTIV

SEQ ID NO: 27070 - protein, 661 aa, Pseudomonas aeruginosa
TSITWRRNWVWTSTDPSVAAHKGCLRAALVVSACRPPQRCYPRRPSTTGLLHGTHPPLVPPIAGRRDRGRDLLRLGFQGKPATRRTLPLREPVHSRQRAVHLAVRAFLRTDHPPLRLGRAVHGIQRGQLRPDPQRLADRGRQRWPVLRSAGGLQRPGGTGATGVLFRRLCRAVLRRPVRRQHRLRHPPGPAHRPARTTEGTGPPTLPATGTCLRRKDLAVACRRLPPGTLAGRFRIDPGRPAGSALQRCTPAAGAGLPEHPLPAARHAGRAGRCRRAARRASCSPRQPVAVRPADTAPGAGAAAQPAAAGGARRRYLPPGQSRPGATARRGHGREWQRRLASSKLARWKTGRPWAARFVYSRNRGRPMPWLQVRLAITPEQAETYEDALLEVGAVSVTFMDAEDQPIFEPDLGTTPLWSRTHLLALFEADTDETALLAHLALLTGGDLPEHHVEEIADQDWERSWMDNFQPMRFGRRLWIVPSWHAAPEPDAVNLLLDPGLAFGTGTHPTTALCLEWLDGQELAGRQVLDFGCGSGILAIAALLLGAERAVGTDIDPQALEASRDNASRNGIEPARFPVYLPADLPQRQADVLVANILAGPLVSLAPQLTGLVRPGGLLALSGILAEQAAEVRAAYSAHFDLDPTAEREGWIRISGRRRAD

SEQ ID NO: 27071 - protein, 138 aa, Pseudomonas aeruginosa
SCWRWAVSPLSTSPTISTNWRARTPIAPGSPSSARKSAAPFPPRSTWSRSGAATWWSAAIPNSAARWWSTRSSTIAPASRSRSRCWNCASPTSTATSSPIAASSPASTSAASWPDERKCHRRYRSTCRWTSSTRVRRR

SEQ ID NO: 27072 - protein, 286 aa, Pseudomonas aeruginosa
RRHRREARRTGGDPGSCGAWPDPRRPVHRGGGVRDHRGDQAGRVDTGVRQWRHRFAGKGQESHRADRGGCPADRSGRPGKTVDFPRDRPLPADRRAPAGGAASRSAEHPARTPRGAAPFLWGRNGCADRPQACGVVSRDSAGRKGIPRPVQSFAGHGCAVRQRQAVLRRAPEQRNRGGRMTTMTTETLVSGTTPVSDNANLKQHLTTPTQEGQTLRDSVEKALHNYFAHLEGQPVTDVYNMVLCEVEAPLLETVMNHVKGNQTKASELLGLNRGTLRKKLKQYDLL

SEQ ID NO: 27073 - protein, 287 aa, Pseudomonas aeruginosa
AGRPRRGNPFHRRHLQAAPGQRHLCRGSGRLHRLPGNDGRSGEDPAPEGAWRYPRSPRPGRRGHGAARHQADRPGGGQPVSLRGHGGQARLRPAYRHREHRYRRADHGPFGGEEPQGCRHRGQCRRLRRRDRIPQGRRPDLRPAFRPGPQGVRAHLRLRRHDRQLPGYHRPDPRYPRHRRPRRLPAHLQQSVRQGPGNALRREPAPERGVLRRGEERRGQRLHRHPVAGQGTVVQQRRRHRRRPGMREELPQAGLRDRQACQPLRRRRGAGRRRRHPQGLRPGLRHR

SEQ ID NO: 27074 - protein, 254 aa, Pseudomonas aeruginosa
RIGVRRHHRLQPRAGRRNRQGHRRAPVRRGDHRAEDFRRRPRGGRRQGQRTPARMRRMASRARPGLGLQAGQRRPAGTEPRHRHDQGRGPEDRHSPRAHRAGDPRPDLRLEGGQVRQVQRHRLRQEPPDRRRRRRPDEPGQLRTDRRDQGRARRPGSERRGDGFRRLLPVPRRHRQRGQGRHHRGDPAGRLDARQRSDRGGRRGGYRDGVHWHAPFPPLSITAAERDAVSRPTHEFHAGRITRRVTRRCARRTP

SEQ ID NO: 27075 - protein, 1036 aa, Pseudomonas aeruginosa
RMARRSPPAAACSVPPPSARACPPPSNRPIAWPRRSAGTAASTARTSATVPSPASAASPDRARSRGRRTALPRHMPLPRPLGYNPAIHLRRDFAVVRLRIAIGLLVSFLLLLLGPMSPAVADDAGVSSVPLQTTATTPSVNQNWRLLRDESAQLRIADVLQRKEQFRPLAKRSFIFPASPQAVWLQVQLPAQKVPSWLWIFAPRVQYLDYYLVQDGQLVRDQHTGESRPFQERPLPSRSYLFSLPVDGKPMTLYVRMTSNHPLMAWFDQIDEAGLVGLEKPAYAFGMLLGGMLLLLMYNLIRFAYSRSASSLWLAAVHAALAVCAAANLGLVAFWLPGLKFNQSLTADLGALGAAVSLLWFACSFFRGTAESRLNRLLQGEALLILAVGAIIAFTQQLWFSWLIYLLVILSSLSVPLIAAWHWYRGYQPARLIVAGMIVFNAGFMVFLPVLFGTKQLDPGWLVLGVFSFATLAGLVLSVSLTERQRLIQQLNLQQRTSEAAHTAELQTKAEFLAKISHEIRTPMNGVLGMTELLLGTPLSAKQRDYVQTIHSAGNELLTLINEILDISKLESGQIELDEVQFDLNALIEDCLDIFRVKAEQQRIELISFTQPQVPRVIGGDPTRLRQVVLSLLDNAFKQTEEGEILLVVALDDQGETPRLRIAVQDSGHPFDAKEREALLTAELHSGDFLSASKLGSHLGLIIARQLVRLMGGEFGIQSGSSQGTTLSLTLPLDPQQLENPTADLDGPLQGARLLVVDDNETCRKVLVQQCSGWGLNVSAVSSGKEALAQLRTKAHLREYFDVVLLDQDMPGMTGMQLAAKIKEDPNLNHDILLIMLTGISNAPSKIIARNAGIKRILAKPVAGYTLKATLADELAQRGVSGVTNYLQPAKEAQAPSLPSDFRILVAEDNSISTKVIRGMLNKLNLQPDTASNGQEALSAMKATQYDLVLMDCEMPVLDGFSATEQLRAWEAHEQRPHTPVVALTAHILSEHKERARLVGMDGHMAKPVELSQLRELIAYWVGERDRRRQGDALPS

SEQ ID NO: 27076 - protein, 186 aa, Pseudomonas aeruginosa
PLLRAVLLHQPQPRLRPARPQAHGLAGGPGGADRQRRAVPVRPLHLHPLRYHRRRLPHRRRQRAVHLRAGHGPGPRGGAERQRAAGRDHRPADHSSHRRPRHHRRAAGDGRRPGLGGQADLPGGDLPRLPDPRHHALSFRPHRTPAWRPGTTDRQSPDGPVRLRTGGADHRHRPEGFAVPRLSAPA

SEQ ID NO: 27077 - protein, 122 aa, Pseudomonas aeruginosa
GGRPGCRALTHRGGARTERRRTHGRAAGGKEGGQRDASPSGAHGAFSVDIRRKPVENAAFPGIARPARHASPATRGAFSPTDTGQRQEEAQPLLWSLDEEIQAAVRTPPSTGRMPDDKHDAS

SEQ ID NO: 27078 - protein, 476 aa, Pseudomonas aeruginosa
TERERPGRAPNGPLVLQGEGGGPAIPHVAQEPQHAPCPPHPPAPGLCPGPGRPSRGDGLRRTGAGLRRCRQRRSRPPARTLGGDARRRSPGLSRSAAPQPHCAGQPPAAIHPRRRPAFPGRRRRRPAGRRAEAAAPEQSPARPAQHRPGQPPVGGQRSAAAAGRRAAVAENRQGRATAAARSAPADRERRWREGSPRPGPGQPATRRSRPGATPFRRAPARRVRRSAGANPPGEPARPGGGTGGRRAHRRRHQPGPGQAPTAGRRPARPGLQWPVAGLDPAARGARPGDHLRPARGDQHGPRRNAHARRLFHLRGATAVPAPGAGMAGALPVAGATGGVLRQRRHRHGPGAHGDPPSLRPAAGNPARHLGHQPGADPTGADAVRRAERRGSQPGLAVRRHPGAAEPGAAVEPHRHHRLRPVRAAPHLAAAEPHAARPERPRGDPEPQHGGLLRGAHRARGHARLRSRLGHRRGSAG

SEQ ID NO: 27079 - protein, 324 aa, Pseudomonas aeruginosa
KGGSSIEPATHRHPRPPGRRPRHRYRARRSLRHAAGHAAAAPAAGGQRAAPLGLQPDPDRQDPLLRHRRPRPRPGLGLRRPAVPRPRAVLRPRRLRHGHVPDAPGLRRQPAGVHDLPFLERTALVLGRHPALPLGAVPGGAGARRAGLRLRLLRLPLADPRRVLLDHDPGPDLRRHAAVLPQRDRFRRQQRLHRLPQHPRLPDHRAGHPRRPVPRHRRAARGQPAARLAPGAKQVRPGPHRAARRREPPDVLRLRPARLQALRLDPERGALRPRRRAVRAAGGDHQPQRDVADQLHRGRRLGRPRRTRHPARPAARRRRGERRE

SEQ ID NO: 27080 - protein, 324 aa, Pseudomonas aeruginosa
LVHRGLPGILAVLPRRAVHRRHPVPAARPARPAAQGEGAMRTTPHLMLEPAFHPGLDTAGSGRDAIGLGAATSGRLDARHGTILSLEDINVSFDGFKALRDLTLYIGVGELRCIIGPNGAGKTTLMDVITGKTRPQSGTAYFGDTLDLTRMSEVQIAQAGIGRKFQKPTVFEALSVFENLELAQRADKSVWASLRARLDGTQRERIEEVLATIRLLESRQRPAGLLSHGQKQFLEIGMLLVQEPQLLLLDEPVAGMTDAETEFTAELFKSLARKHSLMVVEHDMGFVGSIADHVTVLHQGHVLAEGSLAEVQADEQVIEVYLGR

SEQ ID NO: 27081 - protein, 361 aa, Pseudomonas aeruginosa
PYPPWPELRGEGGRGDLPARSQRGGQDHPAALPDGPGPGPRGPGRLGRPFAHRTQAAPAGPRRDRLRAAGTGNLPPADGGREPADGTVPFQRQGRPGGAGLHLRAVPGPARNETAPRRRPLRRPAAATGDRPRPGQPAATADPRRTHGRHPAFGDQGDRHGRPQPGGARRHGDPAGRAVLRLRRRTGRPIPGDGARRDRPAGPRPRHGERGRARAGGDLNGLGHTAAGATGALRWQSLCPRLSAGGRNDRHSAPGRPGRRGLRRALRRRRLCPVDRGDRPQALADDPGLPRGDRQRPGPHRRARRPAGRPAGDAGNRRRLPRRQPRRASRMQGPGHRPTTAGACRARRNEPRLPLAVPLHQ

SEQ ID NO: 27082 - protein, 319 aa, Pseudomonas aeruginosa
ADDGKHRALRQGRLPRIRTPPGRGIPPRVHAQGPGLTRPMTAALPDLSFHPAWHAQLELAYARAGDATRPVTRRHSGPLRVQKHLYAEGPEVCQHILVHPPGGIAGGDSLAFDVRLGERAWAQLTSPGAAKWYRAACPSRQTLEIHLEPGATLEWLPQESIVFAGAQAELETRIQLRGDARLFYWDMVALGRPASGERFVSGHFVAALDIRRDDRLLWHERQRIDGGDRLLDSPIGLAGHPVLATLVASGEIDTDLLQRCRALPCAGRGNLSQLPGGLLVARCLADEALHARAWLIELWRLLRPALLGREAVPPRIWST

SEQ ID NO: 27083 - protein, 276 aa, Pseudomonas aeruginosa
DGLVPPRERQAADLHRRPARRAPAGTRSQAELPGGGGADLRRPAGGRARRPQRRRADALRHHPAEPRAGDGGRAGDDPGHPGGGHLRRRHQAGDRPPAHRLRPAMSASIRDAGVADLPGILAIYNDAVGNTTAIWNETPVDLANRQAWFDTRARQGHPILVASDAAGEVLGYASYGDWRPFEGFRGTVEHSVYVRDDQRGKGLGVQLLQALIERARAQGLHVMVAAIESGNAASIGLHRRLGFEISGQMPQVGQKFGRWLDLTFMQLNLDPTRSAP

SEQ ID NO: 27084 - protein, 316 aa, Pseudomonas aeruginosa
HPARGEHRHRRRHRGDRRRGHDPHRRRHRHAHPLHLPAADRRGADERGHHHDRRRHRPRRRDQRHHLHLRSLAHGADAPGRRRLPDEHRLHRQGQRQPAAAAGGAGARRRHRPEAARGLGQHPGGDRQLPGGRRAPRHPGGDPHRHPQRVRLRRDHPRRLQGPHHPHLPHRGRRRRPRTGHHQGLRLRQRAAQLDQPDTAVHPQYHRRAPGHADGLPPPRPGHRRGRGLRRVAHPPRDHRRRGHPPRPRRVQHDQLRQPGHGPGRRSDHAHLADRRQDEGPARPPRRRRCAQRQLPRQALHRQVHHQPGDHPRHQP

SEQ ID NO: 27085 - protein, 194 aa, Pseudomonas aeruginosa
RPATARPVSAPSSRSLRTAARQPGAAARCRAAGSCRAAPGIAGGSFAAAGLALRPAAAGGLAVADRPALPWRQPRPAPGPRRQSAAGRHRAPAAPGQRRDVGPGGARRRRLCLAAVQQPGDATLHGTGLRPAPVPRPVGQPPRFGAAAPGQPGRLPRTQATRALRAILSQTVALRPSAHWRASPTCRRGSATWA

SEQ ID NO: 27086 - protein, 213 aa, Pseudomonas aeruginosa
RLRRALQGLGTRPVRLRQASCFAARLTPRTRRSSMQQVIAVSLCATHAFSKQVRPAIRLLKGLGVEGDAHHGVTVKHRSRVRQDPTQPNLRQVHLIHEELHDELRASGFAIGPGTMGENITTRGVDLLGLPTGTRLRLGESALVELTGLRNPCSQLDNYQPGLTAAVLGRDEQGNLIRKAGVMAIVLEDGEVRPGDAIDIQLPPLPHRALEKV

SEQ ID NO: 27087 - protein, 383 aa, Pseudomonas aeruginosa
RQRLPLLPAGTDRAALAHTRAAPAGRSAGSHRPPETRWRAGRPATPAAFPATTPAHPARRDQRPPAPAGGTRPNPGDARPLEDPQHACTNRRTSRLQRGGHGILRQRPRRHHRPALGTLHPARARDRRQARSRGLLWHLRAAAQRRIPLRRRLRGAGGLAGAGGHGALPGAGAEVRGVHPQGHGAADRRELPGDLQPPARRTRPGAQGGGRLRILRPAFPRTAGSELASRPVYPHLLNQRLPAGTLAGWRMRCSRAVHWLSSLLLGATSASRLAAGPTATPRAIIPAPRATSGPAWTPASGLAKVPRTYSGERSEKIRRPLLCGVTSRSSFSLAKFTVPSTLTSAFSVSKTNSRLVIRPFCRPKSAAAQLIFTSSSPNSLVTR

SEQ ID NO: 27088 - protein, 473 aa, Pseudomonas aeruginosa
PNGTGLPSGSTSTSRRVFKRWSSRLTLPLSKPISRMSSCQADGSSLSLAGRSKSQLARPSARRRSSARGWVSLICGMRMVCQSNGNGARRNSMRSRLANSLALVLPAVHSGLPRVMSSALKRGQGIQARQPSSPSSRRQATARLPLMANGRFSAAETFSLRVGLIRFQSKVAMNTTNAASSRTRLARLQVRIFRPRVMHNSFSPRRLSGRRGSAPRSARQCAGWPMDSPARIRRPVPLGPAKRRHCSPSHAFQAKGQFGGGSIKLFRPRGTHTLGKQKKPAAEPALFTGSASRRKPMTTVQLTDVQTLRDRARKNIQEGAVTEGYSADRQTVLRLLNEALATELVCFLRYKRHYFMATGLKASIAAAEFLEHANQEMQHADQLAERIMQLGGEPDFNPRGLEERSHAEYVEGKTLKDMVTENLIAERIAIDSYREIITYLGNDDPTTRRIFEEILAQEEEHADDMADILDDLA

SEQ ID NO: 27089 - protein, 520 aa, Pseudomonas aeruginosa
TARPGPGRSSATWPRVPCRPNRHPVAGTPRASPGRPGTGRRATAGGVANRPSAARWTGRPRSSRASSPAPSSFAPPSAPPLASDDHRQQGARHQQHQQQVHDDEPDDPGHGQEMHPARPLEATEQRGQPVQLHRFPDRQPGQHQQRAERQDQPVQQALHRVVAARLMDQAQAEGEAQVAPDAGRAQRQEVATKMPAGQSVGEVAQAVAEQQPHGGKMPGDGTAEPAAEGRPGGKTEIQQRRSVVDAPAAADQAGHGIGIEPVAESHRPGVQRTVHGFSPRKPGRDGRAVPAKPHIGGVTPSLPTEMARAVRLPSAPFCGNSTTLAPGLSRLRSPGSRLTMGTSSGTTTVFSPSPYFTVMRRPWLTTRLPTVPLVMVEALPSAFSQGRWPSPLPRRLGAKTCTSRAFRVPSGCGTAAVPMKLSGWMSSGFASDTARIAVLSVSLTVSCWPLRAFSCRWSSAACWMVPRSGCSMPAGGCAAKLAALARSRPKNSAGEALSRSIGRSSVGLSLDGRPAGGTRR

SEQ ID NO: 27090 - protein, 591 aa, Pseudomonas aeruginosa
RLPGETLLLHRVAAAYPYPAAPRRGPRGRAGATGRSAAGRAAAQGQPPGAGNRPDQQGVRPPAPADAPRGRGAVAHPDRLGGLGHELRQRHQRRRRGDQAPARQGRQSLPEQADPYRARHRLRLRGAPVPARRSLTLYAALLFAAVAALVVSAVGFYLYRSVEEAMLRRSDVMVAGRVEHFRNLLRDNLTLAELKARPRLFENMLGNEQDILLLGQPGEAPIVAVNPRHERLPSLRVVAAGQALNPSVVHAALTHDGIPMRVLAAEVLVGGREPLQITAAHLLLGETRMLAQYRDRVIAAVLLAFLGTALLGWLVLRHGLRPLRTLAAKAAEIHPTSLDTRLDVAAAPAELQQVAQSFNAMLERLDDGYQRLQQFSADLAHEIRTPIGSLMGHGQVALRQPRSNEEYQALIASNQEELERIARMVESILFLARADDVRAAVERSRLDLGEELRRQAEYFEGLAEERGLSLDIQVSGQLRADPQLFRRALSNLLANAIRYASADSLIEVRGLRRSGEFLLSVENACDRLPAEPLSRLFDRFYRGDAARSDAQSSGLGLAIVQAIMRLHGGRAEASAPAPGRIRFDLAFPAQD

SEQ ID NO: 27091 - protein, 160 aa, Pseudomonas aeruginosa
RIPSASRRSVPPVARPPPRRKPPARRPGPGCAPGRLPSRPGGAAGNAPPGSHRPAPRGSGSSATPGSGGAPPAPPARRARRAGRDDGRSAATARDRDSRSPAPRGAGRARASGRCRRPAGRPPRPASASADRLARVATRHAGRPPGVRTTRARAARPGDA

SEQ ID NO: 27092 - protein, 256 aa, Pseudomonas aeruginosa
TIVHKTLPVPRNRVNKRSLMYPSTAAVPGSTGSQGFCYSRRSAKGSRMSSPRAEQKQQTRHALMSAARHLMESGRGFGSLSLREVTRAAGIVPAGFYRHFSDMDQLGLALVAEVDETFRATLRAVRRNEFELGGLIDASVRIFLDAVGANRSQFLFLAREQYGGSLPIRQAIASLRQRITDDLAADLALLNKMPHLDGAALDVFADLVVKTVFATLPELIDPPAADLPPHLMPAAKITHQLRFIMIGGKHWHGLPG

SEQ ID NO: 27093 - protein, 400 aa, Pseudomonas aeruginosa
SLSCRIAETAHAGHPPTPARPLAPLGRRTPPDLRGAQQEPPALLRGERRGGRPVPRARPASAGRRRLPGGPRRSPGAGRRPLRTSAPRHLRQPAGTDPSRLPPGQPSRRPAGRRRLAAPARRLRAESHARTARRHGGGHRGAVPAGARCLRRRPPPLAPWRGGVQLRAAPAPVRRAPVNSIWARLRLASSQLPIGGYSYSQGLEAALDNGWVRDAESARTWLVDQLQLNLARFEAPLLAGLLRAALIGDWAACDAASERHRASRETRELAQESRQMGFSLHQLLEALPELDAPGRAWLARQDPPNLAAAWAMAARAWRLDAEEALSAWFWSWLENQLAVLMKTLPLGQLAAQKLASSLLPELDRACAEALRRPAVEGSAAFGLALASMTHETQYSRLFRS

SEQ ID NO: 27094 - protein, 408 aa, Pseudomonas aeruginosa
EKPHDIPTPACRHRRSGGLRQDRPDPGPVSRTARALQPRGGHQRHLYPGRRGVPGAQRGPRPRADHRRGNRRLPAHGDPRGRLDQPGGGGPAQPALPRPRTDPGGIRRRQPVGHLQPRAVRPDPLRDRRFRRRQDPAQGRPRHLQVGPAGDQQDRPGAAGRRLPRCDGPGRPAHARRQAVRVQQPEDRPGAGRNHRLHRAPGPADRRLTPLRNDKEPPMKLPKLLAALALLAAPALAFAHPGHGEHGLVAGLAHPLTGLDHLLAMFAVGLWAAQQQGAARLALPCTFVGTMLVGGLLGFEGLQLPFMDTGIAASVLALGLCVALAVRPPLPLAMAATALFALAHGVAHGLELPDLSSPWLYALGFVAATAALHAAGYPLVRFLAQAAAPLVRLAGLASAGAGVWLLAG

SEQ ID NO: 27095 - protein, 992 aa, Pseudomonas aeruginosa
EPAMPGANPASEEVMSLQRPIPSLARPLSRLSPLTLALRWALLGLSAAGAGLLGGGLAHAQSVGQHSAATRLDDATPRSYDIPAGSLGASLGAFASQSGLLLSFDPELTRGRTAPALKGRYSVLEGLQRVLSNTGLQVAAGTSGAYLLVEPRMPGETPADLSPVVVSAAELADPQKETYTAPRSSVYLSSEDIDRFGRVSVGDLLQGIPGVQVGDSRNGGALDVNIRGIQGQSRVAVRVDGAEQALDVYRGYAGTQQRSYIDPDLVSSVTVDKGPSTRSGAIGGSVEMRTIGVKDILVDGKDLGVRFTGDVWNNGVAPQHRSASSKTENLSSVPHDDRGSLFGSQAKSGSAAFAYRNEHLDLVAAYAQRNQGNYFSGKKGQDRYRVYNRYGREESSVAKVYNAGEEVLNSSSETESYLLKATWRIADEHTLDLGYRRYDGRTGEIMPSDIFRFGTAGIYQYPLSEVKIDTYTARYRYLPENNPLVDLSTGLWMTDAKSDMLTSVLAPRSQAYRSDRNWTRQDNRRIGGDLNNVARFETDFGDFKLDLGGSFQVEDIQPQKSVVTTLHDINANRTLRDATRQEYGLNGKLEFKPVERLTLWGGGRYSHFNSKDNGISASPRREDRDMRFITVSRPGYYGSMMWFPDQNGQYTDATDPRLNNGIVTNNTNNPFEGIPFDEFGPANVTVHPSRVTNVVTGYNYSKKGSSRGGGFSPAFGINFELAPDTFVYASYTEGLRLPSLFETSQGTLQVEPGKDLKPERSRSWEIGASALRDSLLADGDSAAIKLAYFNNTIKNYITRYYDPGQMGLMTFSNTDSYRTSGLELQSHYDAGRVFADLSATYYLKTETCDAAFAARLRAGANRYQRTENTPNCTPGSFMGSYTNTQNPPRLATNLTAGLRFFDQALTLGGRMTYTSGPTATADKPWQVGATTPQIEYRSVQLFDLFLKYKLFEHTELNASLQNLTDRYYLDPLAQSFMPAPGRTLRVGMQAKF

SEQ ID NO: 27096 - protein, 688 aa, Pseudomonas aeruginosa
AALSPSRRCRRSAAPVGRITAQRLSAEAPGLPLPVPPELSGGAARQRPSPRQRITHHQPRLVEVAVEAASVAGVVEAHVEPRQRTALHGVAELDIALPFLAAATGLGGGVRAMAVADHADQAGPAEADEIVVVAHLPGAFVGVGEVAVEHVVAHAPPTAAVDRLPAAVAADLLQAKVEGVQADAGGKQAVDGMAVDLSGARGAVVAVDEQAEVGAQGPVADTLLVQQVGVALPVDVLQLPVPQAQLGALAVEAVLGAGVVETVRFLRRRAPGRQVLHVRRIAQAHRVEASGLQSQARQLAGNHGEAAERLRQQASVVVAQQRNVREHLADLQFAGRNAQLGGHADTPIVVRRATVIVQRKKLGIAGATSAVQLHAEQADGVEADADRARGIAGTELEDEALRPLVHQALAGIVVAEIAVEVIVAQDQVGLRILQEAALGSLRGKTGEHRQDRPCIARDCGFTTDFHCYCAPFFRDDRAPAASAGHLATTVGSAAGRGPRRQGQNGYWRGACCTLIQWSVVNSSMAQSPLKRPSPEFFSPPKGALASSFTGMSLTWVIPARSWRAKRTARSRSRLNTALDSPYSLALANSSACASSRARSRPTSGPKISSRAISIVAVTSPNTCGASNCPSTPPSYSGLAPSWRARRIFSSRPSSWRALTIGPTAVSARCGSPTRRPLTRSTKRAAKAS

SEQ ID NO: 27097 - protein, 161 aa, Pseudomonas aeruginosa
RLSSTMMQLIAMQICPWWRNLPNTAAFTACSRSASPSTTNGLLPPSSSATCLRCAPPLAMRPMLRPTGVDPVKVTRPGTGCSTKASPISLPGPTTTLNSPAGSPASSKIRASSSPPQTGVSLAGLTTTALPSARAGAMERWVRCSGKFHGLITPTTPMALR

SEQ ID NO: 27098 - protein, 296 aa, Pseudomonas aeruginosa
RESLIALLLFRKSQGFLRRRVDGRFRRHARPQVDAGDRQRADHAGRGEGQEVLLERQLQGQQAAAEHRPGDGAEAADAGGPADPGGAHPGRIELRGVGMDHRQGADGGGAGHHQQAVEQPGAWPQAEGREGGRGQGEEQHQGAAGAKAVGQPAAEQRTEGRPDIQGDEERQARTESVAAAGHQFRQPSVEPVAHQHAHGEGHPQQQGAHCLAPLEQLGDPSARRFGRDSVRPLGAGPVVGIDLAQQRVQFGAAALEFEERRRLRQPAQHQRHRQHRQHRHVEHRLPAPGGDHGDRQ

SEQ ID NO: 27099 - protein, 290 aa, Pseudomonas aeruginosa
KIELVYMSPIDLNLIRTFVTLYEAGSVTLAAERLRELFDDALFTRTRDGIQPTFVAEQLYGTFRESLTRIEGAVQSVRHFDPATTERRFRIALTDLGEVGFLSLILERLTRDAPFAEVEVLPLQVDEVGAWLSSAKVDAAICRQPVPGARSQRVLHERYVCLLSDRHPRIGDSLSLEQYLAERHIVVTRTSGHGIAEDVLEAMQVQRRISLRVPHFSVLPKIIPGTELLTILPAQIAYRFVAEGGMRMLELPFTLPPFDVSLHWHESSERSAALNWFRTTIAEAIIAAQR

SEQ ID NO: 27100 - protein, 629 aa, Pseudomonas aeruginosa
PVDCRLTARPRQRREAYSLAITLLLARMPPIPSPVSPRSNASCQAAWLSAEASMPRPDSARQARISGRRPQRSAQGATNSEPAAMPKRPALSSRPISAPPRFHSAATEDAVKAITSTSKPSIRLSTMHTATASHWNGRIGSSSRARRKSRFMGGPPPSGQERSDGRRERGAGMQESIIGKTLFLVVVGTASAGTLAPLRRCRNPIGSILATRKRMASGYPTVSEIRERLWNEIIWQFIPEVFYVRLSNRLFFVQKRLTWKSCLANHWIQLQKQREDPTMFPKNAWYVACTPDELAGKPLGRRICDEPMVFYRGEDGRVAALEDFCPHRGAPLSLGFVEDGVLVCGYHGLAMGEDGRTRAMPGQRVRGFPCIRRFPVQERHGFVWVWPGAEEQADAALIPRLEWAESPDWAYGGGLYHIHCDYRLMIDNLMDLTHETYVHASSIGQKEIDEAAPTTRVEGDEVITSRHMQNVMAPPFWRMALRGNGLADDVAVDRWQICRFTPPSHVLIEVGVAHAGHGGYQAPAERKAASIVVDFITPESATSIWYFWGMARNFQAHDQALTESIREGQGKIFGEDLEMLESQQRNLLRHPRRDLLKLNIDAGGVQARRIIERLLADERQAAAPNRAQA

SEQ ID NO: 27101 - protein, 240 aa, Pseudomonas aeruginosa
SRSSSAPSAWRRRISTASNCSGPTGRPCRPSSRAHTSTCTCPTAWSASTPSAAPPNGRATTVSPYSAAAIRAAARPRCTPNCGSASGCTSASRAISSRCRRSPVRACCSPAASASRRCWRWPNAWPAMAPTSSCTTARIPPSARPSSTTLAGAPSPTACTATSTTAKAAGARTFAPCWRPVRATPSYTFAGRRASCSGSKKAPANWAGKQAACIASTSPPRHETPVRTAPSKCSWRATGR

SEQ ID NO: 27102 - protein, 188 aa, Pseudomonas aeruginosa
RAWSPPKRTREKSLSHNPGSRLVTRTPGALQVATQVQGELLDESLGAAVDMATRIGPLAGHRTQVDDARPGAVGDQPRQQQARAVEQALEVGVDHGVPVVQVAGLRRVGAQRQAGVVDQAAQGGELFRQVVHGRAHRRAVAHVQGQRQHPGLRRKLTGQGLQTLLATAGEHQRPAGLGETTGAGFAEA

SEQ ID NO: 27103 - protein, 103 aa, Pseudomonas aeruginosa
AFGEDPGVAADPGRARPRGDERGRGQPAGRVRHPARPDQQRRPGAGLRPGAVLRPGRLGHHGRHQLQGPALQHAPAAAAADRPRRRGEHRQPGFGGRQVALSG

SEQ ID NO: 27104 - protein, 138 aa, Pseudomonas aeruginosa
RSRCSGSPSSTRVRQVPQMPCSQEAGRSTPASRRAASTVCPAATRISAPLLANCTSKVPSALASRGAAAKCSRCKRLASQPSSRALSSIHCMKPAGPQRYSWASRGLVASRARRSARRLLSPWSKWQCTRSAKAHRPR

SEQ ID NO: 27105 - protein, 225 aa, Pseudomonas aeruginosa
SPRRLPPAWSARPRRFPSGRCWTHGHRSRGSGPSGYRSSGDSRSGCGTARRHRPNRGFPPIPGGVSARRRPVLPRPARPRRSRAVPAPGSDGCRGSRGPAGRASRGCDRPRPLPGRGSRRPARRPRRSPATAARHGAGRNPRGPPRGRPRLGRKPSARRRCVGRAACRPVRRGCRPRTRRSSETSSDPLVVFVIGSNDSRGNFSKSTASVQKIICSIVAHKKLQE

SEQ ID NO: 27106 - protein, 439 aa, Pseudomonas aeruginosa
PYSLADPRLGVFHHAVRRLRHGHLWLSGATPDAGVAAEPGAGRHPRQLRAVRHALRRHPAGAAGGPFRPAPPGDRHHPAGEPRRLPHRARPRPAGTGRRTLLHRPGTGRAGAHRDQPDQRIRPGRAAQHPGHGDVGLLLGGRGALGATGDRHDPRLGLAIGVLRGGAAGAGGAADVALVAGVGGVPRTQGPPRRTGRAAAQGRSRLPARRRAGERCRGRSAERTGRPVVRGAPGSGHPAAVGGLRHVHADELRAQHLVAETDGRRRLRSRFEPGVPRHPECRGDPRCVVRRLAGRPPWRRPHPGAVLRPGRGLPRGPRPGARPLAAQRPAGGGRRHHHRHPGGDPCLRRAVLSGLGALHRGRLGRRRRPPRRHRRADARRQPAGPGAAVPAELPGLRRARRDRRAGDRLHPPAAARAGGSVRRRDGEETPVIFERGEER

SEQ ID NO: 27107 - protein, 159 aa, Pseudomonas aeruginosa
MPRCSASSSTRGRSAWRSTASSSRTASTTLSPRASSSGSRASGSAIRSAPIPRSGRSSTRASSKACWKRSAWPARKAPSRCTRAASMGSCWLRTYSARSPRRWRSPAMKSSARWSACSARATRRMRWSWPTPANTGCPARCSAATWNARCALPASFARG

SEQ ID NO: 27108 - protein, 251 aa, Pseudomonas aeruginosa
RSRGGQLWACRRGRQAARFGQRTEDRRDAPGHSAVALRRRTPAAADVPRLRRGFPRAAGPGSAGRTLRRGEPAQFGGHAGPVGLERADAEIGRFQLRRRRVPLQPRAHPTGPVARATGGRLPAELRQPAAQAACRRLDPGRQPRPVRRPRRRRRARRRDRQPYRLRPVFRRHRPAHLLPWPAEGRRRQRLAIGLRQQWAEHGQRHVQRQLHQRRRTLLAGALRLRFRRPRLARPDRHGPLRPWLERHHQGR

SEQ ID NO: 27109 - protein, 189 aa, Pseudomonas aeruginosa
IQLTIPMNAPPMNAPSPCLQADRDCVATLYRENHAWLRNWLAYRLRSWGRGVADDLAHDTFLRILASRDGGQRDAIRQPRAYLTRIANCVLVSWRRRQSLELAWLEALATLPEPLQPSPEQQSVIVETLHEIDALLDTLRPRVKQAFLMATLDGMKQKDIAQALGVALPTVKKFIHQAYVTCLSLMPDE

SEQ ID NO: 27110 - protein, 446 aa, Pseudomonas aeruginosa
PRFPPGAAGGRYGAFRAAGRRGDRPAGAQGDRLLAAADAGGAAGSGAAGRAGVLALAQPRAPARLAARRASAGEYRFAAAGAGPACARASVRQRPARGPARPRPAARRRTAGLVGMSRAGLARRLRRRLPHCRRRAARPGAGGRQPGRDEHRQRAGRALRCRPAPAAPVSRRDLPPHRGGSARAAAAVPGAHRTGPDARAGYRLQRPTRGRRDSAGGVRRRGPGASGGRRERGGWPGDRSWPAGALRSPADRPRRVRQRGRAGLAPGPAGGRRHAAAAVGGRTDALRRREHRVRAVAGRASCLRHLSRRRPAAGPGDAGTDPWPAPRAPRPTGADQALREARRLSRPATRPRRPPRPARRDVPGARPPAPGSAPAGSRRRAARRWRRRNRARTARGWRGPAAPGRGRPRGPGRTARWRPSPAAAAGARRGPRRGRGRAPRRRCRYP

SEQ ID NO: 27111 - protein, 679 aa, Pseudomonas aeruginosa
ADGRGRRPGRVRRGRGGRRPAPERRAGRGRRAAWAVSLVVPCRCEVASGGGQQALALDEGDDFVQPLAGLLVAEHERLVAAHAPGVPVHHIEGGADQRRQVDLVDHQQVRLADAGAALARDLVAGGNVDHVEGQVGQLGAEGGRQVVAAGFHQDQFEAGEAPVELVHRLQVDRGVLADRRVRAAAGFHADDPLGGEGLVAHQELRVFLGIDVVGDHREVVALAQFATQGQGQGGLAGAHRTADADTQGLGCHGVSPRNGTDGCTGFRGSCWPAPDRTRRCPRRRAAAAPRRRRGRVPAVGWKQVSARPVGRAAGFSSAPPTGFPASSRTRHSAPPRRPGARRARPSPRRRRDWAGPGAPARRGRERRARAGLPAIGAGKSPSAGSPGPARGSRGWPYGVRWPHRRRPSRRSARRAAGRPAAAPRSAPGSVAAGRPARSARSRRRAPSHCRGPPPGPGNSCIRRSATASWPGAGAPRCCSPAHAELVQARRVVELRLAMVRVVVASAVGTVLRLERRLDGLHRGAELFEHGFQHVVVEQAQPAVADLQGDVTVAQVVGGSGQFQRAGAGDVEQTFGAGDDPHQATVAGLQAVAVGQRRLAALEEQADLLAARREAAQAALAARLVGQVEFFVPAGRAGGQALVDDQHGQFPQCDRKGITTSTSKGLARSMRDACTGKTGP

SEQ ID NO: 27112 - protein, 385 aa, Pseudomonas aeruginosa
LDCAERAKFCERSFTEIFSMDLLPLALLTPLLAPLRRLAARGWLREADVDGLLRHAHPLASLNRHYARVEARYWVADDMLALALRTAPGWPPARPGQHIQLLAERDGVRVGRSYSLTRVVGERLEIAVKRHPDGLLSPWLCEHLAVGQRVELQPAQGDLRWPMQAEAVCLLAAGSGLTPLLGLLREALENGYRGPVLWLHYVRHPGQRAWLGELEALAARHPNLELRWSLTRGARADGCLEGHFQPRHLDGWAADLARSQALACGPAAFVEAVGEQLGARFAGLQTESFSVPRWRSGEAPREVRLRFARSQREVSGDSAVSLLEQAEAHGLRPAHGCRQGICASCTCVLLSGCVRDLRSGALCSEPGQPIRLCVSAAHGDLALDL

SEQ ID NO: 27113 - protein, 83 aa, Pseudomonas aeruginosa
RCRRCCSSTRWRSSICAWTSTPRGAWTRPNSCRCYAACVPSWVASGPRTTCCSRFSACSPAASARCSSVTCWPTCCATCGPSR

SEQ ID NO: 27114 - protein, 263 aa, Pseudomonas aeruginosa
PPAPPPRRTAAPRRGSGSGGRARALLADVTDAAHGMDQLVREGIVDLGAQALDRHVDDVGVAVEVHVPDLRGDQGARQHLALAAHQQVQEGELLVGQGDYLPLAADLAPQHVQLQIGQLHLLCLADHAAAQQGTDTQQQLGEGEGFHQVVVSTQFEAADTVLQLVAGGEEEHRHIVLLAQHFHDLPTVQAGQHHVEDHQVVAVLQRQVETVGAVLRPVDRIARLAEALLQVLAGLRIVFDHQDAHVSFPLVRRHSSQRAARTR

SEQ ID NO: 27115 - protein, 349 aa, Pseudomonas aeruginosa
AGPLQRGAAPAVLAGPGARRAAGAVRAGDLETGATARADRAVRWLPGGALGAFPGHGRGRRVRRRAPAAGAVGAAHPAADDHRTRVAARTEERRMKGPEKKRAKIAVDPSSERQMVDLQRRLLLRGGLSLGALAMLSGCRLQDGDSVDKVLWAMSRWNDRVQAWLFSRTRLAPTFDPSQVASPFPFNAFYPAYNVPEIDLPEYRLQVSGRVRDKRPWSLEQLRRLPQASQVTQLICIEGWSAIGQWSGVPLRTFLELVGADTSAKYVGFKCADRYYSSLDMPSALHPQTLLALEMSGQALPEENGYPLRLRIPTKLGFKNAKHVVEIFVSNSNPGGYWEDQGYNWFSGV

SEQ ID NO: 27116 - protein, 340 aa, Pseudomonas aeruginosa
PPRSCRRSTPSPRNTRPGPATTWKSKSRRFQARPMLRCRACRSATPANAQKVAGRQSGSGSPGALASLAFAVGGLVGQAPLRRTGAVGRLGAVQALGVDQFHVALHRPAVEQQPGTGAAAERHQARRLAAGQAQQEPGGDQQQTGVAGQARAEAGATGEQGDQPQPGRQQRQGGEPAQRPQRSLRQCQAQRGKTQRRGTEQQRQAAEQRCVETGMTARIQAVQLPDAIAVLRRRQGERIAGERGVELAALVDQVGEAAERSHHAVYLQAWLAIVPRQADGRAALAKPRANAHIWRFQGFSQRSQSWPAGGRTTVRCRNRSTARSRMPSLVRAASCLVARA

SEQ ID NO: 27117 - protein, 550 aa, Pseudomonas aeruginosa
VAVVDQVGLLHTATAADHADGLAQAELLRYAGGEGGLADEGQAGRVTAAGVAGEHRSVVHRLRRGDRAVDVAHQAGGDGPALEDQARLDAEEGRAPEHQVGPLAGFDGAHFMADAVGDRRVDGVLGDVAPGAEVVVARTVAVEAAALALHLVGGLPGARDHFADPAHGLAVGADHAERAEVVEDVLGGDGLAADARLGEGHVLGDGRVEVVADHQHVQVLVDGIAGERPCRVGRAGQHVGEAAGLDDVRCVAAAGALGVVGVDGAALEGAEGGLDEAGLVEGVGVDRHLDVVALGDLQAVVDRRRGAAPVLVQLQADGAGEHLLLQRQRQAGVALAGEADVHREGVGGLEHPRHVPGTGGAGGGVGPGGGAGAAADHGGDPAHQRLFDLLRADEVDVRVDAAGGEDHALAGDHLGAGADGDVHPGLDVRVAGLADGLDAPVLETDVGLDHAPVVEDQRIGDHRVDHLRRAQLTLAHAVADDLAAAELHFLAIDGEVPFHLDPQVGVGQAHAVADGGAEHVGVRLSADFHLTLLWRSSVFAVFGRTWPVGP

SEQ ID NO: 27118 - protein, 270 aa, Pseudomonas aeruginosa
RAGPGPAHVRSAPAAVARRGLCRAGRRARRRSARRCRGSPRRVASRRRRRSRALRRRRRSPPGSGGPGGRGCRTRPGGWPGPPGFRSRSPWYCPRRRCRWRGCRAGRRRRRRGSKRSWPASGDGLVDGHQLGAVGEGGLHLDVRDHLRHALHHLLAVQQGGAVVHQLGDAAAVARALQQGGGDQRHRLRVVQLETACQPALGEQAGGEDQQLVFLAGGQVHLRYSRCVGERPRGRAAPAAAGARVRSARLARAAPRRPGSAPPAGRRATG

SEQ ID NO: 27119 - protein, 506 aa, Pseudomonas aeruginosa
AGPRRVRRGARRRPGCRRRRCRRADARGCAGRLPGLRRRGASAPAAVRSGAASPGGWRRRRGRRPAPVGRARRGGSSGRGGRRSSVGSGQGLAHEHAAESLFLAAFVFEVADPGVELDVFRHPLIGVEVQRAVAEARCVALGTLQQLSADALALAFGKHGEVVDEEAVGGFPRHQQADRLAVVLGDEDPVAGDHLVVVLGHRPGLAADHRDPRGIGGGDAERGEARVGLDGRAQSDGHFDLLRKDEGIEIASAGPRLRQRQCVPVRSNRHQPAHALALHVAAAALLDDLAARHHQVLVGQFGGEVVELLDQQDRHVAARRQAADDRADLLDHRRLDAFRGFVEDQQSRLAGQGAADRQLLLLAAGEVAAAALFHFAQDREQLVDEVRHRPGVPGAETGQSHQQVLFHRQPGEDFPSLRHVGDPGADPLVRPESGERTAFPGDLALAGRDQAHQAAQQGGLAHPVATEQAGHLAHLRLEAQATEDMATAVVLVELVDLQHGSLPFVP

SEQ ID NO: 27120 - protein, 133 aa, Pseudomonas aeruginosa
IRSRHRSCPPPARRAAATAVPAPAACRSRGTASGRGTANPPDAAATPAGGWWRAPPRCVPSACRRAARAGWPTPTCRPSAPVRGSRTRSGPRTPWASGTCGRSRPGRSAPRSCGSGRGCRRNTRYRSAGGSCR

SEQ ID NO: 27121 - protein, 473 aa, Pseudomonas aeruginosa
GWCRGARPAGRWWRRPGRWRRGRCRRYRGRGGRPVRASGAGWSSLLLLLAQQAEQAARQVQGDDDEQRAEEEQPVFREGHGEPAIRAVHHAGAEQRAEQGAASAEGDPDGGLDGVGRRHLAGVDDPHLRHEQRAGEAAEHRAQGPDEELVAARVVAAEHQAVLGVAQRGEDPAELASRQAPAEQQAGREQRDGGEEQGGAGARRGDREAEDAAEVGEAVVASETGLVAEEQQHAGEGQGLGHDREVHAADPRAEGEVAEGEGQRAGHQHHQAQRPEEVLGAGPVPGQFVPGKEGHERRQAVAGGLAHQVHAHGVAAEGEEQPVAEGQQAGVAPDQVEGEGDDGVAEDLAGQGQAVGREVQRAVRRQQVQQRHGQQRGEGCAERDSGDAAAGPAGEGDGEWLVQSMTLPFRANSPCGRFWMNRTISARIRILPSTAPICGSRILFATPRPKAARTLPASWPTPPSTTTRKESMM

SEQ ID NO: 27122 - protein, 156 aa, Pseudomonas aeruginosa
PWPRSGPTLPTCDRATPPSPGDARAETEGEHVHAPCGHPAAGRHVAVLGHRADVQAEPRAVQQQPGEEQHEQGEADDDDAVPRQHQVRQHLDAAGQPGRVGYLDVLRAEQHPHQLDQHQADAPGGEQGFQRPAVEMADHRALQGHADGGADAERHR

SEQ ID NO: 27123 - protein, 298 aa, Pseudomonas aeruginosa
NSNPLSSSNTGNTDLRDTEVQQPKTTATLSWVSNWRAFSANSGQFDAGSTTTASSFLPLTPPLALISSMVIRAMSFSEVSEIAMVPDSEWRMPTLMVSAAWMDQDRPMEAMDADSVKALSRLRRFIGVVLHSPAVGAAVFRRRRACRRASVRWTAGCALRPGSLRRGSRAKAVPLLGAGRYRSAKRRRESPGKHAEQVWLCRGRLRFQRVFAGYRRRRRRGLRKGRRRADLPPCRRRRVHGYAVAPSWHHRGASGRGIQGVRLRLVRSAWEQRTLQAGDDDLRRQCADEQAHQATDDL

SEQ ID NO: 27124 - protein, 164 aa, Pseudomonas aeruginosa
VPAARTPPAPGSPRRRPPAPRAPPPATGCWRCASRRSGSGCTSAAGACRRAACRRRRRASPGRPGRLRRSGRTRPSADGWRSSARTGSSACRRPAARTGRSARAAGAPGTVATRRCAGPAPVGRPAPGSSPGTAPAGRRSTASSAPSAREAGPAARPPGGWRGR

SEQ ID NO: 27125 - protein, 332 aa, Pseudomonas aeruginosa
YSMAEMAHASEHHRDIRLVGRRDHFVVAHRAARLDHRGDAGLGRVVDAVAEREEGVGSHHRAFHFQAGVLGLDRGDPCGVDPAHLAGADADGLAVPGVDDGVGLDELGHLPGEDQVVDLLLGGRAASDDLQVLGLDHADVAALYQQAAVDPLEVPARGALGWPFAAFEQAYVGLGGDHLAGGGGNLRRDDHLDELALDDGLGGFAVQLAVEGDDAAERRFAIGGVGQVVGLADAAFVFRHHGDAAGVGMLDDHAGRLEEALHAFQGGVGVGDVVERQFLALQLDGGGDAGLAFLRLDVERRALVRVLAVAHFLGLDELTVEGAREGAAVGGA

SEQ ID NO: 27126 - protein, 237 aa, Pseudomonas aeruginosa
GIAGLVDGTQVVGDHAVVGGGVLERLEGQVETLGVGQAAGLEGFDHGGVVAGIDHDGDILVVLRRRTDHGRPADIDVLDGGRQVAVGPGHRGLEGIQVDRHQVDRLDAVLLHDRAVQVAATEDTAMHLRVQGLHPTVHHFREAGVVGHFHGRDAVVPEQLVGAAGGKDFHAEGDQLTGEVDDAGLVGNADQRAADGQAGGLVGHCKGPEGWLPAAGAGRDARPWPEPAAALKEDRIA

SEQ ID NO: 27127 - protein, 371 aa, Pseudomonas aeruginosa
GAVSGWRCRSRALFHSLKSRSSSLSCGHPCSVVLALGEELPDAGALRIRVLQTIELGAEFPCARQSREIPPHMLAGDPHTHFFPIKKVQLREVFEQDALHFGKRRRRQVLAGPQVMVDLAENPRSSLGGPTDQQGIHPGLLDDFPGLFRRIDVAIGEHRYRHGLLDRRDGLVLRLPGVQVGAGPAMHRKSLDPRLFGELRDGDAVTVVPVPAGPDLQGDRYVDRPDHGIEDLGDQRLVPQQGGPRCLVAYLLRRAAHVDVDDLRTEFHIALRGLGQHGRIAAGDLHRARLVLAIVDQAQARLAAVPQADVAGHHLRYHHPGAKATAKLTERTIGHPGHRREDQSVGQCIWADAYHRHGASLSCGAAKKGRA

SEQ ID NO: 27128 - protein, 325 aa, Pseudomonas aeruginosa
AARPPSASRISSSQPRRRGHWRRGFSQASCSGSSRNWSRLSTGASSGLRALPRGATDCSSALSSSSSSRALRPWRRLPRLGSSSSSSSRMRRSSGGSSARRSGTKDTRSSASGSPRLGSWRGLPRAGWAGSASAISASAQRSSCGSRSSSRRASRLSAGRGAFSMLENSWFSSNSSSLASSSSRLRLSRSRSSWIHRVSSRGRAAGGAAEVAAATLGAGGGAAAGFASAAEGAFARGAPPTWCCRALKTFRQVPQRTAPLAAPSCASLTRKLVLQWGHWVMTLSLMRRSVGKIRRLVYPKLLARRQWGGISGGWRRAINRRGGGR

SEQ ID NO: 27129 - protein, 160 aa, Pseudomonas aeruginosa
CGSSLRARRSGRDRSVRSRPRGPPRPARRGCRTTPAGRRDVPGRSVAGRGKPAGRRGYWRPARRPVAAAGPPAGRQGTARARYRCARHCRARLPGPVDRCRCRPPVRRRAAARRWRGFPSRSRSRAPAGRPVPGRRAIPGTARWSGGCRCRRPGPDRAAG

SEQ ID NO: 27130 - protein, 372 aa, Pseudomonas aeruginosa
PGELVTRAWGDLCCGCKRNGPPRGDPFSTAQAYLRLAGAATLCRGLAAQLRQAAIGQVAGTAAEHRRQQQVEQRHQRQEQYQQAEQQQAAAASTKHGELLAGIGQPGQRGGQQEADVQVGQRQQQEYTVVERNQQADQDRSGNAQPGCQAEAGGTPQRDPFAGGRCQSRVALADLFLQLSEQADAQAQADAEDDAGGVQGDEEQRGIADEIERQLRQSRQAVEGRQRIEVRATAAGLDQRAAGDQGEVGHAECRVQRGPAAEADDRFEEMHEQPGAQHADENAQARGAEECGGLQAFPETQGEAGRGLGRGGQRLAVPAADAFHAGVRWWRGDEDSTVGAAGRRKRQGPPGGSPCAQRLTDQCLSIPSFFSR

SEQ ID NO: 27131 - protein, 836 aa, Pseudomonas aeruginosa
LQLRLEIEAGAEHAHQRAEQGEAERHRQHVGERQDEAATTARPAAQDHSGEDRQHRQHAGGEGQGQAGEEEEQQAALALVLERALAGRVARGWRRGTAVDVEAPGFRGVAEALVGAALVRHHEGIGLPGRVVQGNLQVDDVVVDLGIAEVLVVVLLARRQLHLAEADLGWLDLELEAVAVEVVALGVDEAQQHVLRVAALDAGLERLVDLEEAAAIEAAAEGGAGTAVEQARAGGQGDQQEDQGQQAAHGYLVGSKAGMIAESRARSSPVRLIRSCPGSAERYPTGPKPDGSSGALRHVAAGSQAEGLHRGAQVAAQLPQLLALFAAMADQPQVFPAQGVDAFAVRANLADRLALLGRAFGDAFGHHADGMDRGDHFVQRAFRRAGLFGGAFGMLDLAAHGLHRLPRGLLQAADELLDLLGGAGGALGQRADFLGDHGEAAALVAGAGGLDGGIEGEQVGLFGDRADHRQHAADGRRLLGQALDRLGVALHLVDQLAQAAQALADHPLAMLHCLACAATGVGGLAGVSGDLLDRRFHVAEGVADLPGIAGLALDPGVQAAADLGQGLAAAGDLFGAAVDRADQLGEEAAQAVQRIFQVAQVLGAGTQGYGAREVAVGPGRERRHQLPEDPRQASLQAVDGEGDEQDQGDHPTLDQAYLALQALAFAAHLRFQGGQGLAHRVQSGAGVGGQLLATLDQVAGAAQLVRIALQQAGEFAPQRHAAVFGIAGASLGVAGQPHHGGEVVAGRALLVEHAEQRQGLDPPGLLAQVGQFALDVAGQGRVGAFHQLGAGQAEAGQVQAGEQQRGAVGAGLGLPRRGVQVGGPLFQVAGEVALGL

SEQ ID NO: 27132 - protein, 393 aa, Pseudomonas aeruginosa
KPTMPRFSASWKGWRLARNAFAMVQSPIYRAVLRTLAMLDWKKRRGTMRDRVDNSVDDVRTYFGGPWLVRVVGGLLGIYLLVAMLVGWYWSQEPDLFPVQQDAQAAAERAGRQMVTGYTTVENLKEVVDTLLTKPGGYISNDIFPPGIWMDNMPSWEYGVLVQVRDISRALRKDFARSQSQSTEDAELARAEPRFNFDNKSWALPASESEYQEGIKSLDRYLARLSDPNQPNAQFYARADNLNNWLGDVATRLGSLSQRLSASVGRVKLNTNIKNPEEVQPGEAPKVEEVVQETPWLQIDNVFYEARGQAWALSHLLRAIEVDFADVLAKKNATVSVRQIIRELEAAQEPLWSPMVLNGSGYGILANHSLVMANYISRANAAVIDLRQLLSQG

SEQ ID NO: 27133 - protein, 203 aa, Pseudomonas aeruginosa
PMAAPISAEEVAHRAASDAELIAWVDEQDRPLGSLPRAELRERGLIGRGTFILLFNSAGELCVQRRTLSKAVYPGYWDLAAGGMGPGRRAIRRLRRPRTGGRAGNPRRGPARTWSLLLRRTGQPALVRGVFRRLRCALAPAGGGNLRGPLHPSRTGAGGGSQPAVLPRFPAGVAPVPGRLSRGCRHFTDQWRIFALSICSQCC

SEQ ID NO: 27134 - protein, 135 aa, Pseudomonas aeruginosa
PGPSRPFWGKRPVVKKASSLSALGGLVYSTDGGRHCPDCQQPKDACICGQAVAPVGDGIARVRRETKGRGGKTVTTISGLPLAGDALKELASALKRRCGTGGSLKDGVVEIQGEHVELLIDELLKRGFKAKKSGG

SEQ ID NO: 27135 - protein, 697 aa, Pseudomonas aeruginosa
MGDCGYPHERISSAFLNYRPVWRSTRQRHILRLASTTGVPAQGHPEIPAPARPRTLRRSPRMAARRTRKDDGSNWTVADSRGVYGIRHWGAGYFAINDGGNVEVRPQGADSTPIDLYELVGQLREAGLSLPLLVRFPDILQDRVRKLTGAFDANIERLEYQNRYTALYPIKVNQQEAVVENIIATENVSIGLEAGSKPELMAVLALAPKGGTIVCNGYKDREFIKLALMGQKLGHNVFIVIEKESEVQLVIEEAANVGVQPQVGLRVRLSSLASSKWADTGGEKAKFGLSAAQLLSVVERFRQAGLDQGVRLLHFHMGSQIANLADYQHGFKEAIRYYGELRALGLPVDHIDVGGGLGVDYDGTHSRNASSINYDIDDYAGVVVGMLKEFCDAQGLPHPHIFSESGRALTAHHAVLITQVTDVERHNDDVPKIVDLDEQPEIVRWLAELLGPTDAEMVTETYWRATHYIGDAAAQYADGKISLAQKALAEQCYFAICRRLHNQLKARQRSHRQVLDELNDKLADKYICNFSVFQSLPDTWAIGQVLPILPLHRLGEEPDRRAVLQDLTCDSDGKITQYVDEQSIETSLPVHEVKEGEDYLIGVFLVGAYQEILGDMHNLFGDTDSVNVYQRADGGIYHAGIETHDTIEDMLRYVHLSPEELMTLYRDKVAGANLTARERNQYLDALRLGLTRSAYLS

SEQ ID NO: 27136 - protein, 158 aa, Pseudomonas aeruginosa
TWRWRTARASATTPTASACWWRHRSAGNWTRTPRCWWKPRWCATARSSTAAPWRRTTTWAACRARGSSANRTTARSTTTTKPSRPPCAITSTSSGACAWPATTSMATWTATPRRTPASPPTATACAGSTATATSSGTTASPSSTCSATSIPARSATSC

SEQ ID NO: 27137 - protein, 761 aa, Pseudomonas aeruginosa
RQGPAASRQRYQGTVQLSGGAGRTGWLAGLRGAGQPAAVRHPDPGEGRSMNAADESLGNVLLVGLGAVAIQVALDLRRHGAGRLGALNHPGRRSQRIAEALARGACLQLEGQGQHRWLSGNAALDVFHQDPAELRDDWQTLVLCVPADSYLDVVRGLPWERLGGVRTLLLVSAFIGANLLVRSALPAGCQATVLSPVQLLRGDQGDRRDTTAAGPDQGGQAQGLPGFQPAGLPGAGDLAASPGRQRGGGGTPGDAGSGGGPQRHHLRAQSVLSRRVRPRPDTFRAGATRFHVQALPGGTYHPRGHRRHAAAVVRAERTVAADGRRAVEPAAVPQRRQLPGARDDAAARGHRRFRRGRRRAPGIPAVRALRGVAGRSVLSGRRAGSPLRLFRRAVPPRQSRRRRTLAAPAGAAGGLSQAGADRRAGRPLRPGHAAGAQPVGELRERRVPIHRLPRSEPVPSKPVSDRQPSGGGRHLSPMVLDLLKSGVLLAVLASFTFSVMNALVKEASATLPAAEIVFFRSAIGTLLIYLLMRQAGVALSRQGVPMLLVRGVMGALYLVCYFYAIAHIPLADASILAHMSPFFVILFSALFLGERIPRAVYWLLLVVVLGALMIVKPFSYSSYSVYAVVGLLSAVFAAGASVAIRQLSARHHTYEIVFYFLAVATLVAIPLMWNDFVVPATLREWGLLLAIGVVSLLGQVFLTRAFSHESATIVAVTRYIGIVFNAGWGWLFWSEVPDALTIAGGVLIVVACIALSRTKKG

SEQ ID NO: 27138 - protein, 544 aa, Pseudomonas aeruginosa
RDRDRRRSGGLQRCHSRRPAGPEGGLRGGSRNPRRDLPERRLHAVQGPVARLGAIRRGERRRVRPARHPGQPGTGPGADDEAEGRERRRPDPWRRIPFPQAQGAVDQGLGALARRGPGRRGPCRRRPRATGGARHRHRHRFGTGAAARRACGQPAHPRLHRRPGVGRSASPPGGDRRRRDRPGAWFGLAPAGRTGHGAGVPRADLPGAGWGNRKDPAARPDPPGHAVSPRHPRGRRAQWRAGRRTRPATGRRRRYGIAAGGLRAGGHRPAPLYRRTGAGDGRPGQRSSRHAGEPGTAQRGAGRLGDRRRDLGTDAGAQGRGRGDRLHRADRRACGGDERRGDSVGHLHPAGSGQRRPRRGAAAGGEARVQGRTLPVQRQQPGEDQPRERRLHQDPLRCPQRPGARRAHDRAGRQRDDRRSLRGHGVQRLGGGPRADLPSASDPLRGAAPGGDGRVWPGHAELRAQPRMPKPRAISVASNGMTSSRSSCRRTARTTRRPRAGVTAGTSRALRVPRQPRKVTVGNSETRAARTNSPTLAWNRPLCR

SEQ ID NO: 27139 - protein, 118 aa, Pseudomonas aeruginosa
NRAGHFPEPAMTPLTPEQTHAYLHHIGIDDPGPPSLAKLDRLIDAHLRRVAFENLDVLLDRPIEIDADKVFAKVVEGSRGGYCFELNSLFARLLLALGYDLELLVGTGTLGAPRRTPP

SEQ ID NO: 27140 - protein, 171 aa, Pseudomonas aeruginosa
TQQSHLMLRLYLAEGEFLVDVGFGSANPPRALPLPGDEADAGQVHCVRLVDPHAGLYESAVRGRSGWLPLYRFDLRPQLWIDYIPRNWYTSTHPHSVFRQGLKAAITEGDLRLTLADGLFGQRAGNGETLQRQLRDVEELLDILQTRFRLRLDPASEVPALARRLAGLISA

SEQ ID NO: 27141 - protein, 60 aa, Pseudomonas aeruginosa
ALLAGVFSPDSCGNFPMFHRSLNETAFSVDLVWQEVYKTPARRAGHFLSPYEESHGQYSQ

SEQ ID NO: 27142 - protein, 830 aa, Pseudomonas aeruginosa
GNRSHRRHHRPLHGPGQRPDALLAGIPFGQGRRGAQGHGAEHRHRAAPRRARDARRAAGNPHGRTGGRRHRAPVRRRHDPRRHPPDRIARPVHQPGRTHRRGAAGGEIRHPRRGPREVRQADRRRPAGPARTAEHLLHGHQRGQRHGHRGGGRHRCAHLFRFAGPFHRRFAGADRLRPWGEQRQLAADPLHAGDGADRAADQRFHQGRLDRGVHVRSRRGGRPDPGNAADDRQRQPGQGRGGDVAAQGGGQAPQRDPELRRHGRALHRQDRYPDPGPDHPRASRRRCRPALRPGPANGLAEQLPPVRDEEPDGPRGGRLRRTEPAHHAVGCLAQGRRTALRFRPSASLGDPRGQGRRTPAGVQGRGRGNARDRHPRAPGRCRPAARRGTPPGPAGAGRAIQPRRLPRAPARHPQPLAHGVPGPVRRQRRARPGDRRPADLPRSTEGNRRPGHRRVARERRGGEGAHRRQPGGQREDLPRGRPGRRRAAARSRHRPDGRCHPATPGRGAHGVRQADAAAEVAGAQGPAGQRTHRWLPRRRHQRRPRAARCRCRHLGGQRHRHRQGIGRHHPPGKKPDGPGGGRYQGPRDLRQHHEVPEHDCQLQLRQRVLGTGGQRLHPLPADAGDPPAAAEPDVRHLPAVAAVGQDGQGVPRQAAQVGLEEHRPLHGLDRPDLVDLRHHHLRADVVRVRRQQPGNAVAVPVRLVHRGPALADPGGAHAAYPEDSLHPEHRGAAGDADDRAGDGAGHLRAVLAAGGDGRPAAAAVGVLPLAGGHAALLLRHRADHEDPLHPPLRPVVLSHRPGFVPAFPGASASLAAPRNAHRTHAWRDAS

SEQ ID NO: 27143 - protein, 272 aa, Pseudomonas aeruginosa
PGGAAPAVGQPAGAPARLPAGAALADGAGAAGQRTRRCGGGLVPQCFQPGPGTAGDRLHRPPCGAARAPVAGRGTVRRPGHAALPRRSRAGGGQHRPGQRYSRSPAAGRHGQSDAARHQRPVAATGGEGGGGNPSPGPGPRPVECGDPRLPGRPRPGRPRRQRRRSCPGNPSVRHQHRAHRRSRRQQPAAPGDALGRAQPRRQRVRAGPHAAVAGGDRGEPAPGDQRVPSRRPGRRAAPGGAQEVAAATGGRCQSRALPSPARRSRCLGGVR

SEQ ID NO: 27144 - protein, 168 aa, Pseudomonas aeruginosa
RVPAHSPRLPTHPPSCHRPGLSAARTQRHRSDGEAAGRARARGGIGMRLLICAGRHFKDAERLRLALDQCHGLQPVALLGHLLHAGSGLPDEAERWCRERGADSRAYDYPERSGSDNALREYGEAVLGDAAPDLVLVFPGGRLASELIQVAHAADVPLMLAYRPLSAP

SEQ ID NO: 27145 - protein, 135 aa, Pseudomonas aeruginosa
DVRSRPLSSRALAATVASPRRVPCTVSRKNTSCRARLRMKISRLTISSGSQDSQWRRRCHCARPGRRARSRRVRARPSRAPLHSASTEARAAPCTPQSRPWTNQSTRAMLLRLVVNRIANGARAFCVPRNQPTSA

SEQ ID NO: 27146 - protein, 497 aa, Pseudomonas aeruginosa
QTSACRVFLVRRGFQACRGEPCENLSGSLRSANRGALRTFLECRRRLFPEEAMHAPGAFRLGRRRCHRRSLPGADPPGRGLRRRRRRGRRDGSRLRGSGCLPGASPEDFPPPWPGVPFAAALLRRQPALRTRQRRPGVAARRPRRTRLPPGPARRDRRTAVGDLSPSSTLDLLMMIEPSLASKLEAPCLLSVVVPVFNEEAVLPAFHQRLGAVLGDLGDDCEVLYVDDGSTDRSATILAQLQAADRRVGVARFTRNFGKEQAMSAGLKLSRGAAVIVIDADLQDPPELIPQMLDAWIGGAEMVNMRRRSRAGESWLKRASASAFYRLINRLSEVPIPRDVGDFRLLDRRVVDALCELPEGNRFMKGLFAWVGFRQVDIAYSRAARVAGHSKWRYWRLWNFALEGITGFSTAPLKVAGYLGLLSLLAALATLLAGIFGQQEIHEHWPVIAALFLIGGLQLLAIGVCSEYLGRMTMEARRRPLYLIDRYLPAQVGGANP

SEQ ID NO: 27147 - protein, 103 aa, Pseudomonas aeruginosa
WTPPRPAMARWRGRWPNWATGSRPGTTSACRSGASRRWPSGSAPAASFCSAPPSSPAACRTGCWACWCCGWYGTGRLAKIVGRRGSPASCWAVRRCSSSPPGR

SEQ ID NO: 27148 - protein, 923 aa, Pseudomonas aeruginosa
AGRRVRGKTHSALADHPDAGADQCQPRPSFSALIGASRKPAQPKWWRFMAMPSWPASTSTMNISAPMRGAAKAAMKMKNMPRKPPHQCHQLSPRNAARPGNSRCERVRASNPRVPTKNEISAAARTLDTCLANWPLIPACSGRQAPASRGRTNSHQGGVGMQDSWNDDGERAPRMARDGPEWYGESHSMHQAGAEEENARPHRTPSDSARRVTASGCSPYGSHTASGVIPLQARRQHGPLANRPLGIQFPCHPRPTDQVEAQAFRRLADLQLAQRLLAGADHHVVHLQPAFLAVDADQQAAFVDLQVLHPAEHPYGVVPEVRAVYPAAGLAELRAGSAGLALEQPDLARRPRRSGFAEAAGLAVVEVHAPFREPFAERPRLAVAGRGDEEGGDVEADAAGADDGDPRAHRRAAQHVHVAEYGRSADAVDPWPAWLDAGGHHHVVELTVQLALAHSVAEAQVDAEAFQTHAEVAQGFAELLLAGNPLGQVELPADFPARLEQADPMPALGGHAGGGEPGGAGADHRDALLRARLAVAQFGLEGRPRVDQAGGAAVGEGMIEAGLVAGDAGVDLLGPAGAGLGHKLRVGQQRPGHRHQVGLVGGEQGFGDLGGVDPVTGDHRHLQLVAQPCADLGEGRARHRGDDGRHARLVPADAGVEQGDSGFLQGQGDAPHLVPGIAALDQVEQRQAIAEDEALADDPPDAADDLQRQAHAVFQRAAPLVVAAIGARAEELVEQVAFAAHHLHAVVGGGLGQPRATDEGADGLADAALGELARGEPTDRRLPRGGGHRHRVVAIAPGVEDLQQDLAALGMHRLGQATMGGHLQGAGEAAAEGQQPTFAAGREAAGDDQPDAAPGTLAVVGSELAEVPQTILQPGVHRTHHHAVAQTGEAQVQRGQQVRIGSGGDRRVGVAHGAVPVARDASP

SEQ ID NO: 27149 - protein, 201 aa, Pseudomonas aeruginosa
CRRCTMDMNRRQFFKVCGIGLGGSSLAALGMAPTEAFADQVRHFKLAHTVETRNTCTYCSVGCGLIMYSQGDGAKNVAQNIIHIEGDADHPVNRGTLCPKGAGLLDYIHSPNRLKYPEVREAGSSEWKRIEWDEALERIAKLMKEDRDANFVEKNEQGQTVNRWLTTGFLAASASSNEAGYITHKVMRSLGILGFDNQARV

SEQ ID NO: 27150 - protein, 829 aa, Pseudomonas aeruginosa
HGPTVASLAPTFGRGAMTNHWTDIKNADLVLIMGGNAAEAHPCGFKWVTEAKAHNKARLLVVDPRFTRSASVADYYAPIRTGTDIAFLGGLINYLLENDKIQHEYVRNYTDVSFIVKEGFSFEDGLFNGYDAEKRTYPDKSSWGYEIGEDGYAKVDPTLTHPRCVFNLLKQHYSRYTPDVVSNICGTPKDMMLKIWAEIAETSKPGKVMTIMYALGWTQHSVGAQMIRTGAMVQLLLGNIGMPGGGMNALRGHSNIQGLTDLGLLSNSLPGYLTLAMDAEQDYDAYIAKRTAKPLRPGQLSYWQNYGKFHVSLMKAWFGKSATKENNWCYDWLPKLDMPGAGYDVLRYFDMMYQGKVNGYFCQGFNPIASFPNKAKVGAALARLKWMVVMDPLVTETSEFWRNVGEYNDVDTASIKTTVFRLPTSCFAEEDGSIVNSGRWLQWHWKGAEPPGQARPDIAIMAGLFHRLREMYRKDGGAFPDPILGLDWSYLKPDEPGPDELAREFNGKALSDLVDPANGMILAKAGEQLPGFALLRDDGSTASGCWIFAGSWTQQGNQMGRRDNSDPYGMGQTLGWAWAWPANRRILYNRASADVSGKPWDPEKKRLVWWNGKSWGGTDVPDYKADVPPEAGMNPFIMNPEGVARLFAVDKMAEGPFPEHYEPFETPIGVNPLHRDNRKAISNPAARVFKNDMELFGTADEFPYAATTYRLTEHFHYWTKHCRLNAITQPEQFVEIGEALAKELGINAGDKVKVSSNRGYIKAVAVVTKRIRPLQVDGKTVHHVGIPIHWGFAGMARNGFLANTLTPFVGDGNTQTPEFKSFLVNVEKA

SEQ ID NO: 27151 - protein, 186 aa, Pseudomonas aeruginosa
RLAEGSRQGRGALTRIVSPSPDRRPQRWGLCIHSAPLRAPDRCGAAHRPAGADPRSSRVTHHSSAGADRSRRQHSPAPAPAVARPVRPPRRASAATGRGAPDGRLPAAGRRSLPAPAGAAGQPAGPGPARPRAPAQEPRARHAAAGLRPAGARRRLAALAGCPARGLPGTGQRRRRRGTRTIARSR

SEQ ID NO: 27152 - protein, 483 aa, Pseudomonas aeruginosa
RAAGGKSRAARRDLPQLPGLPEAVLPGVRPPRRCPCRRPGQPGAGHAPGRGRLPAAFAEPVAGPRRRIAEGAAGMRRRVYDGRVGDPTLWIRFLHEFRSLAFGRPPAAQRGGRSPAPALRPRGVAGDPPRPARRTARAGPTRCPRRDRTERGGARRARRRTPRRAACQPRAAGVQPDRHGVAYQPRPRPAAGRGHRGDHPGRALPAEPGVRPGQRQARRPRRPDRRADPRTHRRRGSHRGQQQRGGGAAGAEQPGGAQGRDHLARRADRDRRCLPHSRHHGPRRRALARGGHHQPHPRQGLRSRHRPAQRPADARAYQQLQRPGLHRQRAHRATGGHRPWPWPAAAGRPRQRHPGGPDPLGLAQGTDGAGSPGRRRRHRYLQRRQIARRAPGRADPRQPRTDRADQEEPAQARPARRQADPRRPRGGARPVPRSGPPRRTPDHPAPAQPPGGGDPRPGRASGAGAGRGARRGLGGRRGRRPWA

SEQ ID NO: 27153 - protein, 204 aa, Pseudomonas aeruginosa
SVGSRTTPSGSICASSTTSRGSSPSCRDCGASCRDRRHRRAHRPRQDLAAARPHRHRGRPPPGRAPTRDHHRRGLSLRRPWRRQPHRLHRRARPRALRPQHAGRRQRHRLRAAGGGRRRRLDAADPRAPGDRRTARYPPGAGGADQDRPGRAAAGAAGADPGRTPAGLRPAGALADLPALQQHRGGRRGVARSTRRARRRSPRA

SEQ ID NO: 27154 - protein, 334 aa, Pseudomonas aeruginosa
PRGILPPGGGPGLQRRRQRHRGHRHGLLRTGRGGRRTAPRQRRTAGAGARPARAEPARATGLGRPARGLEHRRRAPRAGTDPARRLAAAGRAARADHAGRHRLPPVARRTPRLHPLDPGAPAPGHPGRHRAPGPARRRTTGAWPPRLRPTGAERADPGPAWRPPGAARPVGAAHPWRRAGARRRRAGAQPTNAGTSGTASGAAPGKPGGGAADLARRGRERPRPATPGAILQPPARALAAAGRGGRGADPPRPPVVRRGALVRPGRATARRPAALPRRATGRTRSRPRPPASLRPAAAGAAGVHRPARRRPGRRRCAQQRALAAPARPRSAPER

SEQ ID NO: 27155 - protein, 133 aa, Pseudomonas aeruginosa
ARRDRSRAALPEGAGRGRPAGSARGRRARRRTAGPAPAPAAPGRRGRRPGRRCSGSPKGRCRDRSRASRWGRGRGCSRRPPPLRRRGSRSGSRRSGRSRRGRSRRGCRSIPEGIHPPPGRKGRAGSRGRSSGG

SEQ ID NO: 27156 - protein, 503 aa, Pseudomonas aeruginosa
QAASAAPSAYPKMGYGPPRGALAPSEHPSEKSDSPMNARMHATSPLGDADLVRADQAHYMHGYHVFDDHRVNGSLNIAAGDGAYIYDTAGNRYLDAVGGMWCTNIGLGREEMARTVAEQTRLLAYSNPFCDMANPRAIELCRKLAELAPGDLDHVFLTTGGSTAVDTAIRLMHYYQNCRGKRAKKHVITRINAYHGSTFLGMSLGGKSADRPAEFDFLDERIHHLACPYYYRAPEGVGEAEFLDGLVEEFERKILELGADRVGAFISEPVFGSGGVIVPPAGYHRRMWDLCQRYDVLYISDEVVTSFGRLGHFFASQAVFGVQPDIILTAKGLTSGYQPLGACIFSRRIWEVIAEPDKGRCFSHGFTYSGHPVACAAALKNIEIIEREGLLAHADEVGRYFEERLQSLRDLPIVGDVRGMRFMACVEFVADKASKALFPESLNIGEWVHLRAQKRGLLVRPIVHLNVMSPPLILTREQVDTVVRVLRESIEETVEDLVRAGHR

SEQ ID NO: 27157 - protein, 481 aa, Pseudomonas aeruginosa
  UNSURE (227): Identity of amino acid at the above locations are unknown.
APGRRRRPTRTFRRTPMDDNKNKVLRLRDVVLYTVSAMLFMDQIALASSLGPSSLFWWLYVLVLLFLPMAMMTSELGTAFPANGGVYHWVRSAFGFRWGARVSWMYWVNNALWMPSVYTLFGSMLGAFYFPELSLWGKIAIGIALALLTAAFNVVALRLGKWLPNLGALLKLLAVLALGVGGLHFGWNHGFANDFSLDSIVPSSPGQMAALGVMVYGIMGTELACCXAADMRNARRDIPRAVVISGLIVGAFNIFGTLGVLAAVPAEETDVTRIFAHTLYNIYGHDGAGGMLADLVGAFVLFTLFTNMVTWSMGTNRAAVEAAKAGELPALFGVVHSRHGTPIGSAVLASAVSIVLLLLYGLVAHTAEELFWTLLSIFAMVFMMPYVLMCLAFVRLRRADPRPRPYRMPLGDRLASLWALFVALHVLAGICLFVVTPGAPMDWAYAGKIVGGVALALAVGELLIRQAARRRGVMSLRGAYG

SEQ ID NO: 27158 - protein, 326 aa, Pseudomonas aeruginosa
WVAAQHGEGRHVRTRALATGIREQAVRRGELVPGRGHAVSRPDPTHRRAPRGGDHRCRRRRLDPGRRPARRRLRRPDGARPFRRRPACRPQPPRRARRRGALDRRRHYRRRPAGSHLRCLARPRRVPLPYHCRSPPRLRAPGDEGGPPRRPRDRRHLRRRRPDRMQRPASHALRRRRTARRVRLRLPAHRAPRRTPRHSRRPGPALRLLPLPETPVKCSEAGLRSARPAMRTTFHDIRHFFFGPRPDKLPSRGKPLANQRGRQSRPVAWPDFKSGGGRQPFLGGFDSHCLPPILRSLSAAIVSHRIKRLSRSVPAEAASHPSPSSP

SEQ ID NO: 27159 - protein, 269 aa, Pseudomonas aeruginosa
GFRMTDLEHAVESNRRAWDASADSHLRGSGWQELSLAVQETGFSCLDETLAGVLRNLDLAGKAAVQVGCNNGREVLSLYAFGVARAVGIDQSAAFLAQARQLAERSPHQPRFVEANAYELPAELNGQFDLLLITIGVLNWMPDIARFFASVSGLLKPGGQLAIYETHPFLEMLEPESERPFELRNDYFTDTPHVSREAIVYEGSGSDTGIASYWYVHPLGDILGGLLGAGLRLSHFKEYPHSNREELYDLYEDGPLAIPMCYTLVAVKA

SEQ ID NO: 27160 - protein, 483 aa, Pseudomonas aeruginosa
GLSERGLPGRRPVAGESGAASGPQQALPAHPQHLAADRAGRRLGEPGHRFGDVLRQAALAHGVHPPAGLADGQRNGGGHLRLDEARRHRVDGDAALAQRRRPGLGQADQAGLAHRVVALPEVAGDAADRRQQHHPAVVMQLAAVEQGLGQHLRGIEVDVDHRVPEVAAHLRQGLVACDPGVVHDDIDALRQRVHQLLPGVRGADVEGHGTTAEARGEAFEGLPGRRHVEQHHFRAVARQGFRDGRANAAGGAGDQCALAGQRLAPVVDLGAVGGKTDHLAGDVGALRREEEAQRAFQLVLGALADVQQLHVAAATDFLAQGAGETFQAALHAGGDRVLERLGGASEDHHLRACVEALEHRLEEVAQRHQLLEAGQAAGIEQHRLGPRAVFRRSSAAARTVPRRRRTPRRSACRRRAARPRPARRSRRSPAGRPPAAPGRPASAPGAAGREGRRRQPGGGRRGSWRRRCNDRSWNGLPVERLQG

SEQ ID NO: 27161 - protein, 64 aa, Pseudomonas aeruginosa
RWIPPANDAEGTRVTVWTTLRSHLFAAIDRADRDNGRAANATRPAKVSLCATDRSVNGSSLGSA

SEQ ID NO: 27162 - protein, 433 aa, Pseudomonas aeruginosa
TIPARSSSMTQLRRVAIVGGNRIPFARSNTVYATASNQEMLTSALEGLVERYNLHGERLGEVVAGAVLKHSRDFNLTRECVLGSRLAPETPAYDIQQACGTGLEAAILVANKIALGQIDSGIAGGVDTTSDAPIGVNEGLRKILLEANRGKSNLDKLKSLLKIRPRHVVPAIPRNGEPRTGLSMGESCELMAQTWQIPRDEQDRLAFESHHKLAAAYEEGWQNDLMTPFRGLTRDQKLRPDIDLEKIGTLKPVFERGSRGTLTAANSTPLTDGASVVLLASEEWAKARGLPILAYFKDGEAAAVNFVDRQEGLLMAPVYAVPRLLARNGLSLQDFDYYEIHEAFAAQVLCTLKAWEDPEYCKTRLGLDQPLGSIDRSKLNVKGSSLAAGHPFAATGGRIVANLAKLLSLAEQGRGLISICAAGGQGVTAIIER

SEQ ID NO: 27163 - protein, 313 aa, Pseudomonas aeruginosa
RPHKMKSFSRLPCRVLSMPARRLPLLLFGAFFALYFIWGSTYLAIRFGVESWPPMLMAGVRFVIAGGLMFAWLRWRGAPLPTWREWRGAGIVGILLLSCGNGGVTVAEHWGVSSGVAALAVATVPLFTLLFSQLFGQRNTTLEWGGIVLGLFGIVLLNLGSNLQASPAGAGLILFAAASWAFGSVWSRRLSLPAGPMASAAEMLVGGAVLLVGSLASGERLEHWPSTSGWLALVYLILFGSIIAFSAYQYLLRNVRPAAATSYAYVNPAVAVLLGTLFAGERIGGIEGLAMLVIISAVVLIGLPQWRASRAAA

SEQ ID NO: 27164 - protein, 89 aa, Pseudomonas aeruginosa
AIPKAGCAMLRRSARMGRADGGTKMKALVIGVVLVFLGGCASHVSPGGKAIESPIKEYFGQDPIERRAFGESENGAEAEDSPLRFRLTP

SEQ ID NO: 27165 - protein, 494 aa, Pseudomonas aeruginosa
RGLKFSGGRHACCTYPARPAGDPDLGSELRRDQGRPRRLPAAAVLRPALRPGGAAAAGPARADAGAVRTHPTDRRAPRGGQVRPAVRRHGPGHAGRAVVAGAAEPGILHHPHRRPMAGRAAVAARVVRPLAGGGGAGPDRPGTAAGRQPAGIPAGGRRSAGLVLRQYRHQAFRGHRHAAPDLLGQPGPAVAAAGAFLSIRRSASHRARRAEHELGRLRRAALHRLRRDHGGLRHLEFPPAPLPGQPGDPVRPGGACVGHARRLAAARRTPRPGQPAGLRAGVRRAGHHPVAGQPAATLRLAGAAVGMKTAEDILALFAADSSRLHLLRVLREVGPEGAWIGAGFVRNAVWDHLHGYGEATPLADIDVFHFAPRALDPQADADFEAALRRRCEAPWSVKNQARMHLRNGDRPYRDCADALCHWAETCTAVALRLVGERLELLAPLGVDDLLALKVRPTAHFAGKPEVYRRRLREKNWTARWPLLDISGSSQTPGP

SEQ ID NO: 27166 - protein, 91 aa, Pseudomonas aeruginosa
RSPAALPGRPRGRCRAPAARRAGRDSRRGSRPGPRPVCSAGRCPPGCRPSPSATGRCPSRARSPGATTARCPCRWPGAPVRRVRLRPGWRG

SEQ ID NO: 27167 - protein, 346 aa, Pseudomonas aeruginosa
PAGAGGRRGRRHGTSGDSGRRFSGRRLVDAVADAADGADQLVAELAPQVVDVDFDGVALDVAAPAVEALLQLVAREHLAAVLQQQAQQCVFARRQFHRLPGQGHLVGRRVQAQLAVHQLRQGATGGAAGQGAHPCLQFVEIEGLGQVVVGTAVEPGDPVGHLVPRGEQQHRGEPALVAQVTQDVQAAAARQSDVEHQQVELVGDQRVLRGHAVGHPFHGIAFQAQPGADAVAEQQVVLGQQYSHGSLVSVIPQFPQAQAGLQQEGWRRSAIRPAVRPGSSGIRRGGRRPVRTGPAALRCDRPGSPGDRALRPAWPVRCRAGAQRRSVAAAASPGATPGGHRPCARV

SEQ ID NO: 27168 - protein, 366 aa, Pseudomonas aeruginosa
RPAVRWPGERRTSSGPRQGRQLCRAELDLLDIRRCDEGYAVFQYRSRLGEQEAGFPVHHEAGLEVVAVEVVEPQRAELAFDASVDVLGLPVVRVEPVGSQQEAPGGEERGHRGAVAVDLGEDTAQGAGEGRVGLVVAVGELQPLHRDHPARSQARMQQLVELAGIESLGRAVVEHVDDVDDDHVIERRVALEIGPAVLGEQFAAWVVEGALVPLEQVFATQFHQLPVEIDHHRPPHAGMGQHLAQGGAFAAADDQYVARLVVGEHGRLHQQLVVQRLIALGALDRAVEHQHAVVVVGVGDQHVLPARAALVEHPAQAVDVLVEGVAVLDRGDRAVAFQQRVRRIEIEVVRRQRRQPRRRPPPAPGR

SEQ ID NO: 27169 - protein, 541 aa, Pseudomonas aeruginosa
AGGGAGVDALVAVVALQRRGVDAGALLRLDVAPQDDALAWREGQSARRADRFAETALDALVDDLVGGRQRLEVLQVTLRVVAEDHARVEDAARVEQALELPHQAIGVLAPLQFDERRHVAPGAMLGLQRAAVLHRHQVRHVVHERRVAGDLLGRVEALGEDEVQVALQRVAEEDRLIVAVLVEQLDQAVDSLGQSFDGEGDVLDDHRGAGLAHRADSREGVLADAPELVVDRRVFAEVDLLLQRIFGDGGHDPPELFVQQRAARRAGLDEQGACTGGKTLHPFRHALHVLHRAHAAPIEQSPPDYRLALEHRDRRAAGFHRGENQQRRGLVRVFRDGVVGHRADEAEGALGADHQVGEDVQRLVVVDQRVQRQAGGVLQPVLVADLRGQFGVGAGLAAEFGEPFQQLAVAGAEGRDAGRVLAVQAGAVGQQQAQAGEGVVAVLRGAAAHAAGVVGDDAADLAGVDRGRVGTDLAAERRQPGVRLGADDTRLQADLRAVGADFPAVPVVAEDEQHRVADGLAGEAGAGGAEGHRDLLAVGGG

SEQ ID NO: 27170 - protein, 242 aa, Pseudomonas aeruginosa
DRGDLVLAFDAQHQLGNQPVETGVGAEGQGRQRVVEAAFARYQPLDGLEKGNRQAHRLSSALGRRSRPGRFQAFLVGVSGAQFADQRVSADLADRLGPGEDHGHAHFLFDQFEQVAHPGLAGGGPGRILRRGRAARCRRRGRSSAPRRDRCGCRSRQGSPVRPSPPPAIARQRRGRWTARRRAGARRGWRRRCRRRRTSPHPLASSGSRMPLITIGPSQNSRIHSRSFQEIDGSKLAPSQPM

SEQ ID NO: 27171 - protein, 210 aa, Pseudomonas aeruginosa
VCLGQGDQSDQRGEDQAVLQGEAEQVGFLADHPGRGAGHGDGLRGDHLAGHAAAGIGGHQQGVADPDLVRGGRLQGAEQGVGGRIRTGQEYPQPAEERREERERRAGTGQDQGQGGGHARVVGDEGEGQDHADGQDRPLQLYQDFLESGNTNFHSDAQNEHRYQRREEDRRAGGGDRVELEYRRDRRGAGGDRRALDHQLVEVRDGEVEH

SEQ ID NO: 27172 - protein, 265 aa, Pseudomonas aeruginosa
GDVRQLRADEVGRQVLGDGEAAAGDDGGRPGFADAAPAVHHEHQPERYQDRQERQLAAGHGADLEGVDAGHLAGDDDRDAQCAEGHRRSVGDQAQAGGVERIEAEADEQGGGDRHRRAETGGAFEEGAEGEADQQYLQALVAGNRQYRAADHLELAALHRQFVEEDRGDDDPGDRPETVEEAVAGGGEGHVGGHVEGEDGYRDGQRQGDAAGDVALEAEYRQGEEEEHDRDDGRGGRQAETAQGGIELLPGLHGGWLPNCCWVCL

SEQ ID NO: 27173 - protein, 216 aa, Pseudomonas aeruginosa
TVESRPHIAGNVANLCVRLVFASLFLKESGMADEQQTLDQQTPEQPTGAAEDLTARVQELEEQLAAAQDQALRMVADLQNVRRRAEQDVEKAHKFALEKFAGDLLAVVDTLERGLEMSDPNDEAIKPMREGMELTLKMFDDTLRRYQVEALNPEGEPFNPEQHQAMAMQESASAEPGSVLKVFQKGYLLNGRLLRPAMVVVSKAPAETPPSIDEQA

SEQ ID NO: 27174 - protein, 381 aa, Pseudomonas aeruginosa
DGKVMAKRDFYEVLGVERGASEADLKKAYRRLAMKYHPDRNPGDKEAEDKFKEANEAYEVLSDASKRAAYDQYGHAGVDPNMGGGAGAGFGGASFSDIFGDVFSDFFGGGGARGGSRGGAQRGADLRYTLDLDLEEAVRGTTVTIRVPTLVGCKTCNGSGAKPGTTPVTCTTCGGIGQVRMQQGFFSVQQTCPRCHGTGKMISDPCGSCHGQGRVEEQKTLSVKVPAGVDTGDRIRLTGEGEAGSMGGPAGDLYVVVNVREHPIFQRDGKHLYCEVPISFADAALGGELEVPTLDGRVKLKIPESTQTGKLFRLRGKGVAPVRGGGAGDLMCKVVVETPVNLDKRQRELLEEFRKSLQSDTSHSPKASGWFEGMKRFFDDL

SEQ ID NO: 27175 - protein, 237 aa, Pseudomonas aeruginosa
RRPAVRPLHLGDGRASLRSRAMPTLGITDFWTYVLGVVFVILLPGPNSLFVLATSAQRGVATGYRAACGVFLGDAVLMLLSALGVASLLKAEPMLFIGLKYLGAAYLFYLGVGMLRGAWRKLRNPEATAAQAEKVDVHQPFRKALLLSLSNPKAILFFISFFIQFVDPGYAYPGLSFLVLAVILELVSALYLSFLIFTGVRLAAWFRRRQRLAAGATSGVGALFVGFGVKLATATLS

SEQ ID NO: 27176 - protein, 191 aa, Pseudomonas aeruginosa
LLQRESHAKTYRHKEHPDPRCRPHRDWPGLRIRLLRRPGLQGPARGGLPRHPGELQPRDHHDRSGDGRRDLHRADQVGHRGQDHREGTPRRAAADHGRPDRAELRPGPGAPRRAGEVRRGDDRRQCRYHRQGRGPLALRQGDEGYRPGLSALGHRPQHGGGLRRARAGRLPLHHPSVLHHGRHRRRYRLQP

SEQ ID NO: 27177 - protein, 238 aa, Pseudomonas aeruginosa
CPPDHPDEVGRRSHGHRPDLPGVGAESLARPGSRRHRLRSEARPERPGGRQHPQARADRAQRRACLVRRRRLPRRQERRGSVRADPHRRMVPGADRGPGQGRGEGQDPRPVLHRSRADVQAQAQGLLRRAPGQAARRHREEPAQPSPQAEGAAGLQACRYLRRRVRHRHRLHVFDLRGRVRGQPVEPREDHDPRRRSEPHRPGHRVRLLLRARGAGDARRRLRDHHGQLQPGNRLHRL

SEQ ID NO: 27178 - protein, 180 aa, Pseudomonas aeruginosa
GAQVRSREDRSASAGSPRRNQGMSKFPMTVQGARALEEEVKHLKGVLRPQISQAIAEARELGDLKENAEYHAAREQQGMVEARIRDIEAKLSNAQVIDVTAIPHSGKVIFGTTVDIANVETDETVTYQIVGDDEADIKGGKISVNSPIARALIGKTEGDAVLVRTPGGDVEYEIVEVRHI

SEQ ID NO: 27179 - protein, 242 aa, Pseudomonas aeruginosa
VSAIIRPLGKSRLFYPSFSPSDAAPADRGCPKRYSVARSKTSQRWLKEHFDDPYVKMAQRDGYRSRASYKLLEIQEKDRILRPGMTVVDLGAAPGGWSQVTSRVIGDRGRLIASDILEMDSIPDVTFIQGDFTEDAVFARILEAIGDHPVDLVISDMAPNMSGVRASDQPRAMYLCELALDLAGRVLRPGGDFLIKIFQGEGFDQYHKQAREMFDKVQMRKPLSSRDRSREQYLLARGFRGE

SEQ ID NO: 27180 - protein, 667 aa, Pseudomonas aeruginosa
YFWPEGVWPSCEAVSRTEPASEGSQLNDMAKNLILWLIIAAVLVTVMNNFSSPSEPQTLNYSDFIQQVKDGKVERVTVDGYVITGKRSDGDTFKTIRPAIQDNGLIGDLVNNNVVVEGKQPEQQSIWTQLLVASFPILVIIAVFMFFMRQMQGGGGGRGGPMSFGKSKARLLSEDQVKTTFADVAGCDEAKEEVSELVEFLRDPGKFQRLGGRIPRGVLMVGPPGTGKTLLAKAIAGEAKVPFFTISGSDFVEMFVGVGASRVRDMFDQAKKHAPCIIFIDEIDAVGRHRGAGLGGGHDEREQTLNQLLVEMDGFEMNDGIIVIAATNRPDVLDPALLRPGRFDRQVVVGLPDIRGREQILKVHMRKVPLGDHVDPAVIARGTPGFSGADLANLVNEASLFAARSNKRIVDMREFELAKDKIMMGAERKTMVMSEKEKRNTAYHEAGHAIVGRLVPEHDPVYKVSIIPRGRALGVTMFLPEEDRYSLSKRALESQICSLFGGRIAEEMTLGFEGVTTGASNDIMRATQLARNMVTKWGLSEKLGPLMYAEEEGEVFLGRSAGSQHANVSGETAKMIDQEVRRIIDDCYGTAKRLLDENRDKLEMMADALMKYETIDSDQIDDIMAGRVPREPRDWQGGSGTGTPPANLEESGRRENTPPIGGPAGEH

SEQ ID NO: 27181 - protein, 283 aa, Pseudomonas aeruginosa
MSNPQYPTRLPCGSRVLDLARPHVMGILNVTPDSFSDGGRYDRLDDALRHAERMVREGATLIDVGGESTRPGARSVSPTEELERVAPVVERIARELDVVISVDTSTPAVMRETARLGAGLINDVRSLQRDGALDAAVDSGLAVCLMHMRGEPQTMQDAPAYQDVVAEVGAFLQERVNACVAAGIDRERLLLDPGFGFAKTLEHNLVLFRHLQALHGLGLPLLVGVSRKSMIGKVLGREVDERLYGSLALAALALAKGARIIRVHDVAATVDVMRMISAVEMAD

SEQ ID NO: 27182 - protein, 262 aa, Pseudomonas aeruginosa
HLRPLCPARYSMRRPLVAGNWKMHGTHSSVAELIKGLRQLALPSGVDVAVMPPCLFISQVIQGLAGKAIDVGAQNSAVEPMQGALTGETAPSQLADVGCSMVLVGHSERRLILGESDEVVSRKFAAAQSCGLVPVLCVGETRAEREAGKTLEVVARQLGSVIDELGVGAFARAVVAYEPVWAIGTGLTASPAQAQEVHAAIRAQLAAENAEVAKGVRLLYGGSVKAASAAELFGMPDIDGGLVGGASLNADEFGAICRAAGS

SEQ ID NO: 27183 - protein, 498 aa, Pseudomonas aeruginosa
KARRTMSKEVLLVVESVSNEKGVPAGVIFEALELALATATKKRFEDEVDLRVEINRHNGSYETFRRWHVVADEDYQDPATEITVEDVQEQKPGAKVGEVIEEKIESIEFGRIAAQTAKQVIVQKVREAERAQVVDAYREKVGEIISGTVKKVTRDNVIVDLGNNAEALLARDQIIPRETFRVGTRVRALLKEIRTENRGPQLVLSRTAPEMLIELFRIEVPEIAEQLIDVMAAARDPGSRAKIAVRSKDKRIDPQGACIGMRGSRVQAVSGEIGGERVDIVLWDDNPAQFVINAMAPAEVAAIIVDEDTHTMDIAVAEDNLAQAIGRSGQNVRLASQLTGWTLNVMTEADIQAKQQAETGDILQRFVDELDVDEELAQVLVEEGFTTLEEIAYVPMEEMLSIDGFDEDIVNELRSRAKDRLLTKAIATEEKLADAQPAEDLLSLDGMSKELALDLALRGVTTREDLAEQSIDDLLDIDGMDEERAGKLIMAARAHWFE

SEQ ID NO: 27184 - protein, 844 aa, Pseudomonas aeruginosa
GEKCMTQVTVKELAQVVDTPVERLLLQMRDAGLPHTSAEQVVTDSEKQALLTHLKGSHGDRASEPRKITLQRKTTTTLKVGGSKTVSVEVRKKKTYVKRSPDEIEAERQRELEEQRAAEEAERLKAEEAAARQRAEEEARKAEEAARAKAAQEAAATAGAEPAVVADVAAAEPVAKPAAVEERKKEEPRRAPKRDEDDDRRDRKHTQHRPSVKEKEKVPAPRVAPRSTDEESDGYRRGGRGGKSKLKKRNQHGFQNPTGPIVREVNIGETITVAELAAQMSVKGAEVVKFMFKMGSPVTINQVLDQETAQLVAEELGHKVKLVSENALEEQLAESLKFEGEAVTRAPVVTVMGHVDHGKTSLLDYIRRAKVAAGEAGGITQHIGAYHVETERGMVTFLDTPGHAAFTAMRARGAQATDIVILVVAADDGVMPQTQEAVQHAKAAGVPIVVAVNKIDKPEANPDNIKNGLAALDVIPEEWGGDAPFVPVSAKLGTGVDELLEAVLLQAEVLELKATPSAPGRGVVVESRLDKGRGPVATVLVQDGTLRQGDMVLVGINYGRVRAMLDENGKPIKEAGPSIPVEILGLDGTPDAGDEMTVVADEKKAREVALFRQGKFREVKLARAHAGKLENIFENMGQEEKKTLNIVLKADVRGSLEALQGSLSGLGNDEVQVRVVGGGVGGITESDANLALASNAVLFGFNVRADAGARKIVEAEGLDMRYYNVIYDIIEDVKKALTGMLGSDLRENILGIAEVRDVFRSPKFGAIAGCMVTEGMVHRNRPIRVLRDDVVIFEGELESLRRFKDDVAEVRAGMECGIGVKSYNDVKVGDKIEVFEKVEVARSL

SEQ ID NO: 27185 - protein, 130 aa, Pseudomonas aeruginosa
KMAKDYSRTQRIGDQMQRELAQLIQREIKDPRLGLVTITGVEVSRDVAHAKVFITVMGQDDAGKIALNMEILNDAAGYLRMLLGKSMKLRSVPQLHFHYDESIRRGAELSALIERAVAEDGRRHGDETED

SEQ ID NO: 27186 - protein, 191 aa, Pseudomonas aeruginosa
AAGLPEGQRRVSLHCPDRPSGSASLSDAGRQLEARSWKSGVDTRTRGGYRRRASSFALSRNRFGSDSRHSTDFPQGNIEGKDTVNPVTKQFQFGQSTVTLETGRIARQATGAVLVTMDDVSVLVTVVGAKSPAEGRDFFPLSVHYQEKTYAAGRIPGGFFKREGRPSEKGNPDLAPDRPSDPSAVPRRFHE

SEQ ID NO: 27187 - protein, 422 aa, Pseudomonas aeruginosa
RRPPGRHGLQGCRYRQGRHRPADGHQDQRYHRRDHGDRPGPGPGSSPEHPRPDEPGHRQAARRAVRERPDHAADEDRLGQDPRRHRQGRRDHPWYLRRDQGLDRHRGRWQREDLRRNQGSRRGCQAARPGDHRGSRDRQDLRRQGGAHRRLRCLRQHPAGQGRPGAYLADQRQAHRQGHRRAAGRPGSEGPGARRGQPWPHQAVDQGRGCRRSFRRVSRVVIDENRALGPCFRFRDALLGEGGESLHFASPAIANSAFCNRLASDLFFNLLFLKDFILEENWHSACDIYYATDARNGCSFSKSIGETAMKFSKLAIAAATATALSFSMANAFAAQPISLAANDTMQKTEEAVSDTWITSKVKSSLIANKNVSGVDIKVETNKGVVSLSGNVKSDAERDLAIETAKGIKGVKAVSADGLKSVE

SEQ ID NO: 27188 - protein, 1084 aa, Pseudomonas aeruginosa
SRGAARAANRLCKVSLAIQVQLGVDITLVFAFGETDVDQVDAIVRQLAFLHQVILDPGGPGLADLAQQHLALGPGSDHRFAHLRGAFVAVQFLPLGWWLLLQAGPVDAFEQRRLHVLRYLELLGVARDLVAATLEHAVVGVLVFQFETLGADRGTVSRGGGHAFHFQAQRRPLLERIGELVEVGLGFRRQLVAARGEGYRAEILVAAGGEAGDELERRLHGAQDQVAQGLPDDRHDAELRVVQIAGHRQLDIDVALGVLEQGYRQLHRQVYGIRAVDLLAELQAFQQDLVFRLQLAAFDLVVQVQVESPLTDAVAGELAGIGRQGGQLDALEAGGDVEFLQRVEWVQFAGDGHRCVLVDLALDVHLGRLRVARVEGADFAAELLDGGTERRHQGQVGEVRRAVVDPYAADVDAQRLARRRVLAFGGGLAGRTTRLRDDQLADVGAAIFVDDEAGVGLLEGHALDRQAVLVPIGEAVEGQLGPFDEVAVLDGIQGMQLADFGAAVDAEGQRLDALQVDRQLAAKEAAAQFQADERRDVGLGHAQVDVAGTDLEPGADRVEHHLAAGLDLAAVAEAGLELEVEGGLAEAVDVLQVEVQRADFQRDLGGRLAIHQVRLVAAQLGVAQDDVPGLGGRLRGGFRTFRRRRLCSVGELLRRVAGCLVDFRSLGRFLPGCLAGLRSLARLLLGYLVGSAFRDLGGLFVVRCPFRLGDAGVLLRRPVLARFARGYHGCLGGTVGCRFAGGLRRVGRGSGGIGVFRRLGCRRLAWRRSEVGEQFLPVELAVLLARGPGLQALAADFAEHHFLLGQVQGGSGHVEAGELGQRLALGRIDAEVGEFQRGLVEQQLGVLGQVQAIVAGEADHAVLQHQRGIVADIGPPCLELDILDAHVAPGRDRHQGQVAFPVEAAAVRAGGDQGHLRAVVGQGAEVVQLEAQRIEAEVHRLARSQVLEVQAALGQLDAVDAQRERVARLFRLGRFARRDPEQAGQVELALLVEQQFGMRTFQLDVGQVQLAFPQAVQLQVGVQPAEGELGFFSSPRRRPQRVNSRLKGLNSIRSRRAGTVAYCASCWLATRSPMPGMSRKPSRQ

SEQ ID NO: 27189 - protein, 156 aa, Pseudomonas aeruginosa
RTEREVEHRSGPFRQQLGACAQHQRAERPGQGAGRWCVEENPHHFAGAFVATQAWTHRLQVGGDLLAVARYRAGAEAFGDQGDFRVVTVLLAARQVGIEIAQVGLEKAADLGDMHPGQQVRVRWRSRGVPSGNWPMTLSWMRRTRSISRSASASGP

SEQ ID NO: 27190 - protein, 196 aa, Pseudomonas aeruginosa
PVRRRRPSRSSRKLEWSHTPARASGWSICRSSAPMPPIIMLLKSPWTFQQAASGPNRPGSPFGDSKSTPPTASPVRLSTWLSIWRRTLSMGGSLRQGRHELNPGAGETGTVPRRRAAGRLRGSAVEAVVDQPLHHSRIGQGRGIAETVQLVAGDLAQDTPHDLAGAGLRQAGRPLQVIRLGEAADLLADQGQQFLL

SEQ ID NO: 27191 - protein, 142 aa, Pseudomonas aeruginosa
RLAGLTAGHQGDERVDGLALHVMRAADHCRLGHRIVQDQRALDLGGADPVSGDIDHVVDPAGDPVVAVLVAARAVAAEVIPGVGLEVGVDHPLVVAVDAADLTRPTGLDRQYAAARAVDFLAFLVEQHGLHAEERAGSRAWL

SEQ ID NO: 27192 - protein, 186 aa, Pseudomonas aeruginosa
RSGAGQRGDQDAAGLGLPPGIDDGAALLADHLVVPLPSLRVDRLAHRAEQAQAAARGLADRGVAFAHQRADRGRRGVEDIHLVLVDHLPEARGVRVVGHALEHEGGGAVGQRAVDDIAVSGDPADVGGAPVDVAIVVVEHVLVGHRRAEQVAPGGVQHALRLAGAAGGIEDEQRVLGVHRFRRAVG

SEQ ID NO: 27193 - protein, 354 aa, Pseudomonas aeruginosa
GRVERLVVPDVAAFDPGYVALGALDHHHGRDVRAVLQCLFHILLQRDVLAAAHALVGGDHGAAVGIEDAVAQRVRREAAEHHRVHRPDTGAGEHGVGGLGNHRHVDADPVALFHAAALQHVSQAADVVVQLAVGDVRGFAGVVAFPDDRDLFAAAFQVAIDAVVGDVQLAALEPGGLAFPQVAVVDAVPGLEPIEEGLGLLAPELVGVLDGLAVQALVVVVVQVGTLADGVRHRVDADLEHGGFLCFSAPQGVERPHAAPLQVRPRVGQARAMFKCQRRERGRRRGQSPDGMKKPGLEPGFGERRISRDGGRGRSRSGLGSRRPRPGFPRCRPGANRHPCRVPCQAPRPIGRRR

SEQ ID NO: 27194 - protein, 177 aa, Pseudomonas aeruginosa
KSPDETGLYPERARSGDLYRNRLAGMAELVARRHVQHARLVAGQFGFAVVCVGADDHAVADLGLVCRGAVHRDHLRAVLGADRIGGEALAVVDVVDLDLFVLADFGEVQPIAVDGAGAFVVEDGMGDFGAMQLGFEHYGVHGATPIGSAGGGRVWRVRGERSSPREPGARHASIEVD

SEQ ID NO: 27195 - protein, 296 aa, Pseudomonas aeruginosa
EVVDQPRTAQVGGGQDHQLAVAGYPGAQADRLADFQVVGAQPGLFQGLAGVGEQCREVLGAGADAFAELPQGAVDRRGGGALLLVEVTVARGQREAIGGAHRRLAEDLHRQVEVADQLADHRQLLEILFAEQREVRLDHVQQLADHGRHAFEMAGTTGAAKAFGDAGNMDAGLPVHAVGVHFLDGRGEQQVAAGFEQAFLVGCEGPRVFVEVFAGAELQRVDEDADDHEVGAFAGFLYQRGMAGVEVAHGRHEADALAFAAGARHRGAQFTDGLDGVHALNPCSAAGKDTSLTART

SEQ ID NO: 27196 - protein, 179 aa, Pseudomonas aeruginosa
AAMAAGMLSWPCMKSLTNLGERPVSERPSMSCMTSTWPSVAAPAPIPITGIFTAWVISSASTLGTHSSSSMAAPACSRAMASARNWRAWVSWRPWTLKPPNRLTACGVRPRCAQTGTPICARRAIGSASQAPPSSLTMCAPACIRRTASARVWATEWLDSKARSVTIREPLLPRFTQAV

SEQ ID NO: 27197 - protein, 208 aa, Pseudomonas aeruginosa
EEVMARAVRRGTAETKRGALAPRRSGSGAELLLADFREGLAVDAEGRGGARLQATDADLDAAGVAPAVLFVFDQLQGLVDLLDQLALAVAGAQFQAEFFFLAGAVGRIGEVGRFVLHVMHGTVDLFHQLLFPFVQDRGEVRAHALAHVLLALGFLIGFEAAGHLLAALLFCFGGHEWPPLTFANPVRGRVPSPALRPRGRKRANLPER

SEQ ID NO: 27198 - protein, 401 aa, Pseudomonas aeruginosa
NRFFLAKFGISMATSYSARSRAIEPFHVMALLARANELQAAGHDVIHLEIGEPDFTTAEPIVEAGRAALAAGHTRYTAARGLPALREAIAKFYGERYGVDLDPQRVLVTPGGSGALLLASSLLVDPGRHWLLADPGYPCNRHFLRLVEGAAQLVPVGPDSRYQLTPDLIERHWDSDSVGALVATPANPTGTLLDRDELAGLSGALKARGGHLVVDEIYHGLTYGVDAASVLEVDDDAFVLNSFSKYFGMTGWRLGWLVAPAAAVPELEKLAQNLYISAPSMAQQAALACFAPTTIAILEERREEFARRRDFLLPALRELGFGIAVEPEGAFYLYADISAFGGDAYAFCKHFIETEHVAFTPGLDFGRHQAGHHVRFAYTQNLPRLQEAVERIARGLQDWRP

SEQ ID NO: 27199 - protein, 175 aa, Pseudomonas aeruginosa
ALASGRTLRPGFLQYLIMKRSKLALLPLGLALLLAACASDPLPIPQHSFGVYATASTPSAAFRTLADPQGKAMLVALKPSLTQADVLRAEVLYDQNGRPGVEVTFTEPAARRLAALTGEARGRTLAVLVDGRLRLAPRVREPIRNGKVYLDGLASAYEARELADQLNALGSQPGR

SEQ ID NO: 27200 - protein, 346 aa, Pseudomonas aeruginosa
APGWRRGSERLGLEGIATGRRAALEAGLEPAHALRRGAMGEGVRHHHAAALALQAIVADGVGGVQGFLDVARLQPVQPLLCTVGPNPGEAVRLQFLAYRQAVGALHARAALAGCVDLGRDAHQVLHVVADLVGDHIGLGEVAGGGEALFHLAEELQVEVDPAVGRTVERPSGRRGEAAGGIHPIAEQHQLGLLVLCLAAGEDLFPGVLGVAEDRADELALLVIGRRGPTAGLLLGGRRRAVHLAEQRPEDLHRVLAHQQADHHHDGHPTQAEALAADAHAATAACASFAPGINHVVTASSFAPEHGGSPVRFASSVLSSSAASATPTVRPRSAARRGRAVGRGRRP

SEQ ID NO: 27201 - protein, 179 aa, Pseudomonas aeruginosa
SGSRTRGSPGRSSPTGSSGSTGCDRRPGCRAGNGAPGRSARESGCRCPCATGTCRPAACSAGWPACPCRTGRHRRSSGRYRRRSCTSRRPARSGYPRRSSSPACRAGCSCRRLPGWLRCARARCRRGRRWIRSRGPGGSHNAAGRRSRRRGRRRWPRSARSGWPTRSRPSAGRRRPCRP

SEQ ID NO: 27202 - protein, 431 aa, Pseudomonas aeruginosa
ATAGPGRGAGRRAGRAACGTPWVGPVANSQGDVGRTRYCQKNVNANNYQMDSDMRFVAKFTCFARSATEPDMPEEPSMSSTPSLSHSPAELYRAWQDLRAERPQLRARDAAALLQVSEGELVASRVGIDAVRLRPDWAALLPALGELGPIMALTRNEHCVHERKGPYREVTVSANGQMGLVVSPDIDLRLFLGGWNAVFAIAEETARGTQRSIQVFDQQGVAVHKVFLTEASDVRAWEPLVERLRAAEQDAVLALHEPRAPAATLVDAQIDAAALREGWAALKDTHHFHALLKKHGAQRTQALRLAGGEWAERLDNGDLAKLFEAAAESGLPIMVFVGNAHCIQIHTGPVCNLKWLDDWFNVLDPEFNLHLKTTGIAELWRVRKPSTDGIVTSWEAFDADGELIVQLFGARKPGEPERDDWRELAESFKAL

SEQ ID NO: 27203 - protein, 300 aa, Pseudomonas aeruginosa
GEIMRIDRLFNGLALGILLGTGMAQAAELPQRWVSAGGSLSEWVVALGGESKLVGVDTTSQHPQALKQLPSVGYQRQLAAEGVLALRPDILIGTEEMGPPPVLKQLEGAGVRVETLSAKPDLEALESNLKKLGDWLGVPQRAEAAELDYRQRLRRQADWIAAAQKSQPAPGVLLVIGNAGGQLLVAGRNTGGDWVLNRAGARNLATHEGYKPISVEALAALDPVAVVIADRSLEGDAARAALLKQNPGLAATRAARDGRLLVLDPTLLVGGLGPRLPDGLAALSAAFYPSAKPLSTEAAH

SEQ ID NO: 27204 - protein, 197 aa, Pseudomonas aeruginosa
SARRSSFICYCGGGPDAARGEPVHPPWRKDCTGRPRAGAAAWRDARRTRPQRRWQEHLAWRSLWRTGAGRRAGAARRARPRRLAGRRSRAAPGGAAAEFVAGLRLSGGGGGRLRSAAPFQRPRARCADRRRGLGGGRRQASGRAQLPGAVRRRTPARAPGAGAGAAVAGRAGAGAAARRTDLGARPAAPAHYPAGGA

SEQ ID NO: 27205 - protein, 252 aa, Pseudomonas aeruginosa
SGFGEACARRFAEAGWSLVLTGRREERLQALAGELSAKTRVLPLTLDVRDRAAMSAAVDNLPEEFATLRGLINNAGLALGSDPAQSCDLDDWDTMVDTNFKGLLYSTRLLLPRLIAHGAGASIVNLGSVAGKWPYPGSHVYGGTKAFVEQFSLNLRGDLQGTRGARDQPRAGVVRERFLPGPLRRRPGALRQDLGRIPSDPAGRHRRDHLLDQEPARPPEHQQPRDHAGEPVLGRLRHPPRKLTGGGGRGTL

SEQ ID NO: 27206 - protein, 265 aa, Pseudomonas aeruginosa
CPGRPDRISEFHEQTGPTRAGRATQADRFRRTRRRRAHRRDSHRRTPAGLAHAGAHRPAYPRAGRPAVQDRARLQGAGGDPRGYRRRGRGARRSGRPGGTPGGRARAVRRGTGDPGGMPGRGRPIVRQRPGPAGGAGALPAHEHAFPPHHHRGQRQPGDRRGAGAQRPPAVRLGERPGGGSRQSRAGIPPFQLRPHAAPRGGRRAGQRPGGRAPRRSCASTPTRPCATPTTSIRSGRVSPCFTATSPPTRDPAPAVGCANANSRA

SEQ ID NO: 27207 - protein, 79 aa, Pseudomonas aeruginosa
SPPARKGIAGRRADWSPAGREGPRAGCFRRGRSGSARGRRRRTGQGSRRRPRARRNARSSATGSRRHRGPGVRPSPAAA

SEQ ID NO: 27208 - protein, 501 aa, Pseudomonas aeruginosa
PPRPVALRCPATYHAAALGAVFPGDVRLLLHHELDAEAAGRRRPVHRPWHHRRHPAEHRRDLRCRLARRACRALSPGTGAGAVHAAYRRSARAVLAERRAARRGLAAGTADRALRQRLRGRPVCPGAEPLRRFGACHRGRLGDRRRSRRGDPLAAGGRAPARRRLAAAVPLWGVRGGVRRRGRRVAAARCAASRALADAGRRCVRAAGVSALGGDDRLGDGGAEPVQRRRAFAALVPVQGDVERRQGEGQFEHAHAAFGDEAIGDLRRQDGQQLGTGNDLRQHREVRHPQADAALHLHGLEHVLGDAVAGGTGHHDVPLGQVLLQAQAVADPRVAVAEQAHVALVQDPLAARAGHRLAADRRVDLGAAQPGADLVHLQRQHFHFGERRVAGQAFEDQREETHFAEIGEGDAETSLGGRRIEVANALYRALDARQRLAEGAVELLGDEGRLDAVAGAGEQRVVEQFAQALRGEGHAAGFVEGDEGADQVEIDRTHIDQFYFL

SEQ ID NO: 27209 - protein, 364 aa, Pseudomonas aeruginosa
PPGHHRRAAGALDDRGRGDARQRRCRTTAQAAGEMEPRAGLRPGCTARAEPGDPDRQPAAAGAGVPVDSLRRLGATGAGRRRTPGCAPGQRRRAARAGIAGRTRRAPVALAQPGAGARSGRRRGECQRPGRGTGGEAADAGLGRAVGLALSVPHPPCLLPRRAAGGHRRDQPAAGRPRPDPGGRRAGVPLSPVRPRRLPAGRRRAGAGHLRSRRSGTGADGRRVGRRHRADPRGTARTGPPQCAAVARGAAATAGAGRGGRTAASGNRVRRDRCAGAARRHFRQGVDFHRDRLLAARGDARAGQLFLPGRRRPRLRPAGGGRRATGATAAAGDRDHRRRLGQLRHHRALERRAIPRAGGVHHPQ

SEQ ID NO: 27210 - protein, 490 aa, Pseudomonas aeruginosa
SPGFDRGADANHRTLMFHGAAPCQSGRCRPTPACAHNKNKREVGMNRQSAAAVIDAARFNRTHWLILGWGCFIMLFDGYDMVIYGSVVPRLMQEWQLSPVQAGTLGSCALFGMLFGGTLLAPLADRFGRRRLVIATTLLASLAAFLTGHARDPLELGAGRFFTGLALGALVPIAINLISEFAPAGRRSTLVTVMSAFYSVGAVLSALLAIAMIPAWGWQSVFYVAVLPVLAVPLMLRWLPESAAFLELKGRRAELDALLRKVDPDYRPGAERANAVAAEAPSGRVAQLFEGRQAVGTLLLWVAFAMCMLMSYGLNTWLPKLMAGGGYALGSSLAFLVTLNVGATLGALFGGWLADRLGAGRTLVLFFALAAASLAALGLGPGPWLLNGLLVVAGATTIGTLAVIHAYAAQFYPAWVRSTGVGWAAGVGRLGAIAGPMLGGSLLALELPFQQNFLAFAAPGVIGALAIACIHLRPRVPAEASVDATAKKPL

SEQ ID NO: 27211 - protein, 391 aa, Pseudomonas aeruginosa
FSKEEKSDERFPLYRPRSPAPGRRVAPRPGRPPAEGEQPVRRQPVAGDRAGRPRRPRCRLRQGRRGPAGMGRARALGTRGGTVQGGGGVRPPPRGDRRLDHPRVRQHPPEGRDRMGRGARDHPGVGVVPGTGARAHRRVRRAGQGKPGLPQRHRRGRGDQPVELPAAPDPAFHRPGPGAGQRGGGQAGQRHAGLRRTAAGADLRRGRAAGRAVQRGGRPRQRDRRRLRRAPGAGPGDLHRIDPGGPQHRPHRQRRRASQARGAGAWRQQSVRGARRRRPGAGGECRGVRQVPPPGADLHGDQLHHRRGQPLRRFRRALRRAGQGPPGRRSAARRYRGRADRQRAPARRPAGKDPPGPPGRRQAAVRGRRRWAVAGSARIRRGHRDDGDRPR

SEQ ID NO: 27212 - protein, 442 aa, Pseudomonas aeruginosa
PDRRRQVARRGCRGPVVPEKRSTITMKIRRKTAVPRNAGAVLPMLACLAAQAAEGGFLEDAKTDLVLRNYYFNRDFRDHDAGKSLVDEWAQGFILKFSSGYTPGTVGVGLDAIGLFGVKLNSGRGTSNSELLPLHDDGRAADNYGRVGVAAKLRVSASELKIGEMLPDIPLLRYDDGRLLPQTFRGFAVVSRELPGLALQAGRFDAVSLRNSADMQDLSAWSAPTQKSDGFNYAGAEYRFNRERTQLGLWHGQLEDVYRQSYANLLHKQRVGDWTLGANLGLFVDRDDGAARAGEIDSHTVYGLFSAGIGLHTFYLGLQKVGGDSGWQSVYGSSGRSMGNDMFNGNFTNADERSWQVRYDYDFVGLGWPGLIGMVRYGHGSNATTKAGSGGKEWERDVELGYTVQSGPLARLNVRLNHASNRRSFNSDFDQTRLVVSYPLSW

SEQ ID NO: 27213 - protein, 417 aa, Pseudomonas aeruginosa
PLGGYSPYRSGAPPTTPGGGEGGSELRLHPHPQGTPGRGHETLCQRVEVIAVGEVLQRGIQFGVLEQLVLEEQVEQLHRAVLDLRCGGADLPGLVRRGGGAGGIGHASAQGQGLVEEAQAGGQVGRQPRRVLRVGIGAHEAARRAVRRVLGALVAVGAGAQPGGEGGVAGLGLQVVGRRQVGEHPPCVVVRLQFETAGAVAVGVAEGHQAHLARIVIAGDVVLDGVVEVGQLDRRRVAVGQQAVAQRAGTDLPAARTLGLEVLARLDLEGALAGLEQRRQTQAFGIGGVDEGIRGQLEIDPECRRETAAAAAALLAVVVAGDHVGDPRGMDCHVGRAELVEGNAFERIVGVVGDDAVVEAGIGGVGVLAVLVGEPHHRAVVAGPAHRDEAHVAILAPRRGGDAVVLAVEVAVAAAAP

SEQ ID NO: 27214 - protein, 581 aa, Pseudomonas aeruginosa
RQALDRLELELAVEAVFLAGGVPQGAVGVDVVEGGDHAFLRLDVFDLERAAEVELEIAEVGFEARHVVQVAADAPVVLARPVAVGAIGLGARRQHRGQHVALRVGHPQSGAEVHQRIVLGQVTVACGVGVDLHFAQWVLVDAGGAETEDVRRHDLPGAPVVATIAEVQGVLVGDAPGRLEQVGLGLRRRVEHFLSRVVDLGYAAFLATVAVVDAIAVLAFLAGKVVALVALRIGGDQVQMLVAVGEGGAAGLGLGAEQAAAVIVRHAAEILGLRTGAAVLRGDAVVPDVAGEAHAEVLAVDQDVLDADGAHFHAAADRARAGRGTLVDGHAADQVGIDVAALLGAGVAAVDVQRLLRAVDPHRHPALPLDAADVDVQRATVAAVADLYARDALEQVTHGNPAEAVDVFAGEVHRRAWRGIGFLLRIGQLGGRDHHRRQVGRGFSGHARLDQQVGAGGSRRDLQAGVRQDSLQAFQYAVATLERRRRAAAGQLGVEGQQQARLAGEGAQGGAQRTRRNVVAARRGVVQAGSRAVLADALRVGQAAAEQAGAGRRQAEQGPAQGKGERGEARQGARQAGDRAL

SEQ ID NO: 27215 - protein, 342 aa, Pseudomonas aeruginosa
CPMNDRASRRAPQAGDTELSGPPAAEAIAPQVLRETASWLLLMQEGPLAPAQQAELESWRSRSPEHQRAWRRAERLLANIGSLPPALARRALERPSGSGRRAVLRGLALLLGGAPLVWWGCRAQVWRDGFGADYLTAVGERRDLVLEDGSQVEMNTDSALDVRYDAGQRLLRLYRGEIYLRTAADRREPPRPFLVRTEQGLMRALGTAFSVRREGAETVLAVYEGAVQVRPEGAASAADGRVIEAGQRVRFDRQRIGPVESASEAALAWRQGLLVADDMPLRQWAGELMRYGGESIECEPSLDALRVSGTFPVDDLPLALAMLAQTHGLRLVHQGRRVLIRR

SEQ ID NO: 27216 - protein, 289 aa, Pseudomonas aeruginosa
GRRGGSAGQQPDPGARRGQPGETYQGRGRLRQEAHQRVAGGVQRGGGGDETERVQPGAGEVRQLQAVGDPVGQGEQRGGGHRQRQRRAHGEGHAEAEGEHRGGDAGIHERQLQALEAEQPADQHGADEGAGQGETRGSLLLGGPEADGEHRQQVVEAGERMGEAGDQAVFAVAGVGEGQRRSGEQGEGGEQLGQFHWWFLVVAKWRQAAVSRPWRSMKAMISSSPWPVFWLLNTNGLSPRMRRASRSITSREAPTSGARSILLITSRSDLQMPGPPLRGILSPAETSIT

SEQ ID NO: 27217 - protein, 191 aa, Pseudomonas aeruginosa
AGSKFLRGQLAERQGFHQHRQLVFQPAPEPGTQRLLGVQAPGARGHRPGGGEIGRVLARQPGAAGSVELGQGFQQLVQGKAHLPALLGQLAGLAAGPMAFAGRIAGGPVADQRGAQQAGQQRRLEARQVQLQLVDQPGPRALGVAHPAIVEGRLQALGIAVSADRQLRAGQAQARPDAVHRRTPNWCRRGA

SEQ ID NO: 27218 - protein, 305 aa, Pseudomonas aeruginosa
VRWSSSSQRGERAGRRWWMTSMGSFRNATGKGSQQAPARALPGRCGTPVPGKRGHRDVTKYCSAPGWCATTFLPHRKGARASSPRTNAEPEVRRGGAGSAGQAVPVLAADHDETQLVGDLRGRHQVRRQIGGGWVDQLRKGGEDGLHHQVGEHVEGRAVEVRHLVQQRQVGGQIVGDALAQAGDGLADRQRAAVLLAGEEEELRAVGADRVEEDAHRGVDQPAQFELVAAHRAQGGAEGLVDFGDQRQAELVHVAEVPVEAGRDDAGGARHFAQAEAAEAAPAFHQVARGAHQRVAGLLFLFGAG

SEQ ID NO: 27219 - protein, 392 aa, Pseudomonas aeruginosa
PAGRGPMAAWRGISSRATWTAGQPTWRAARPWPAGRRLSSRRWASNWGHASPACRRNPSASRAGAAGRRRAKCACASPGRSGKSPATAPSACWNRPRPTACARPTVAARASAPVAPASCSAAACATCAAARCAASPASLSASASAPPTATWRWTCEPTCEPCDARRPRTDPGTTGGLRRRTRCPAPAYPGRSRRGRRALHPPGPRGGARLLLERQGAADVRLAAADLAARQPASRPGQDPREHGAGPQRHARPVRLDERSGIRRPRLRVGHRRAVRLLAAHPQPYPPHLHQRAGQGRRRRLRGCAPVPGAALEAVLPLATAVGDAAGAAVPVRGGDPASAPGQVRQGAPGQGRTHAAATPPACQAGSPVDQGLPAVPASRPVRRRLRRGVRR

SEQ ID NO: 27220 - protein, 605 aa, Pseudomonas aeruginosa
CRPVRRDVASGRRAASESRRTQDGLRPRSASSVDPSRTYQCSADAGRGARPSRNRHVQPARHLSRALHRHPAHAGRLRPVHHLHRPAPDPGRRRRPVGRRADGVLLFRPGLRWKIRTQADRQLRPYPLLRGLRRDCHRDRAAACPGRSAGSLAAAALHHRCGDDEPVHGDRELAQRAGREPPARQGVRRLHGRRRPWPGARPGPAGAEPDPRLQAVAAGRHLLRLVPDPAGHDPSRAPGQAGRRAAGSAFLLATRAAGAGHHLHRRPDGRRLLRPGAGLCQPQRPGCLAIEFLRRHVHRRRLLCAVAAGLAVRPPRPQLADPRQCGAAVPGLDPDVGAGDAAVLVAAGQRVRYRHAAVHPLSAGGGAGQRPRRAAAPGRVVGDAPDHLWGRRLYRPAGGRRADAPLRSGTVLHAGVRLRGAAGVLGAAQARHRRTPGRRGAAATRGDAGHGQPDGRHPRPACRGSAGGVGGGGAGEYRPLRRRAGRRREARSVLSRERQVEADASRSRGARFGAAAVQAHDRLDDGQAETAGLGVAARGVATVEAVEQARQRLGRQPVAGVLHAQQEFPRAAQAAHFDQAVGAGVADGVGQQVAQRPAEQLRIGA

SEQ ID NO: 27221 - protein, 499 aa, Pseudomonas aeruginosa
PDSPRPFFRYSPVFVSSSITRMRMSRSPSFAAILASARRGLGDIFVMRKSSPGTAGGATIEAQPHRGSTDASTQGFPRAVLRPAPGQCRQLRRATACGHAAAAARHHPAGRRRPPATEGPQRPATDGQTHRQDRDSRRVAGEAGGHPARQLHRHRRRAAARRHPEGPRGACLRPQPARQRRRPPALGERRWQRLDHDQRYGRQPGGQPGPAHDGEIRRWREDRGGAGRRAHRQPGAGRAQPAQAWRQGRAVPAEGRRRQPHRPGHLGRQGRRDPADVRFRRDGASVPAGFPGRKAMNRALHAWPVRLCHWLNAYAMACLVGSGWGIYNASPLLDFRFPAWATLGGWLGGSIAWHLAAMWLLLGNGLCYLAHGLSSGHFRRDFLPLSAAGVWRDLRLALGLRLVHEPGRYNAVQRLLYWLVLALGALLVLSGLAIWKPVQLHGLTALFGGFQGARWVHFLAMAGVVGFVVVHLLLVLLVPRTLLPMIIGREWRRGRRSEG

SEQ ID NO: 27222 - protein, 177 aa, Pseudomonas aeruginosa
RQPRRPAFEDPSGSAGRPARQAGAVRSVGRQGAGHGRCGERPGLCVRLEGQGHLQGPGSGRLGQGRRDAGVAGCEQALPATGRGQCRQHPCRGGRHPDRPAQPRRPRPAPEAVRDQHGQSLSADRHHPAGHSGLLHRRTPAGAAQGGGRRTVPLRELQRQGRRQRPARQPDLRRSPA

SEQ ID NO: 27223 - protein, 342 aa, Pseudomonas aeruginosa
AEAVRQADLRATALRRPRPADRRRQQCRKTEARADQPPAGRQGAAGGGIPYRALARHGRRRGIHRQAYRAQRPVADQRPLYPSGAQRRPAAPGAPALRCGRRQAGVGHPPGRRQAADAEPSEDERAGLQAEAVVPRLRADADQLRRAERRRQSQRQWQFGGEDPRRRRWRIEDADQRRCDQQRPDRNRRPQCRKLPGDQAVRRRRGEDQLRGRRLRPAEGPDDQPAVRLRHRERAGQRRRHGELRQREARPRCHPAQQGPADLLAALAAVRARHLRQARRRGPRRAAGGARRGNDRPRRGGGPGGQPAGAGGAEQERRQPVHRPAATHAPAGQGAGRQALIQ

SEQ ID NO: 27224 - protein, 211 aa, Pseudomonas aeruginosa
VWMVRPLKAPRVVSTKPDSLRVSVWIATWMSWRSATSRQLSIAAGVLPQSSCSFRPMAPASTCSSSGSGRLALPLPVKPMFIGKASAAWSIRAMCQGPEVQVVALVPAAGPVPPPIMVVTPLISASSICCGQMKWMCVSMPPAVRIMPSPAITSVPAPMAMFTPGWMSGLPALPMAWMRPSLRPTSALTTPQWSRISALVITVSTTCAAPS

SEQ ID NO: 27225 - protein, 262 aa, Pseudomonas aeruginosa
CEPTWIGRSPVFATLRARVRRPALSSISPGWMSYSPGIMGAPWGSGRAARRVEVQLHEGQVEPAAELLAHLRHLPADLEAEAPVQADRGGIAAFDGGHHDVQALGPRTFDQRLQQLHAEAFAALVVAHVDGVLDGAAEALEGSPVAVGGVAEHFAGGVARHQDRVALAGAGVEPGLAVGQVHRGFVPDRRGIAHGVVVDGEDAGQVGDAGVADRSAHGRPQAMGWWTVTSLVPSAKVASTWMSGIISGTPSITCSRFSRVVP

SEQ ID NO: 27226 - protein, 337 aa, Pseudomonas aeruginosa
FSLRPRASRRSASRPAVKISSLSFSRGDKSISGTPDAWGNGLAAEQRRPQQAPEFDQPGSRVQRLVGQAARHQQAAGQLAEVAAAGAGERAAALQQVGVDLAAGDQGRQHRMPGEADRRVEQAVAAVDALALVPEQAVVATDVQGRDEVAADEALAAGRAAERDHVPVEQAGVAAQLDTGFQFGLGAGEDDAFLRQPFQGGAGLQVDLQGLPRRAGGAVPLGRAGAGELGPGAFAEAHVEGQAVAAGDAAGRMHEDVLADFRAFGVEVLLHPQRSGVAPRHRAGGVAGAGVGQLQLGVPGGVEAQVGEGGGHRSGQARALRMNTRRNPSSWRRSYSR

SEQ ID NO: 27227 - protein, 415 aa, Pseudomonas aeruginosa
PRAVIRPTRRAPLGRRYPPSGWLASATEVDLDHLFVGLYLRQRAFGQHVALVQHGDMVGDAADETHVVLHHHQRVLARQGLEQLGGEFGLGIGHARHRLVEQQQLRFLHQQHADLEELLLAVGQQTRRTLPRLQQADGGEHLLDAFPLRAVEPRAQAGPHRLVGPLRQFEVLEHAQGLEHRGLLELAADPGLGDLHLAHAGQVEGVAEIRGTALRAGLAGDHVHQGGLAGAVGADDAAQFADADVQGQVAQGLEAVEADVDVFQAEDGAVARVQPAAGGGAQADGVAAAAGGIEAGVEGRFEHQVRGGPHCSFSLRSRPSRPRGRYRVTTMNSAPRKNSQYSGKATVNQLFAPFTTPAPSSGPSRVPRPPRATQTAASMELVGDISLGLMIPTCGTNSAPARPQSTALRVQTKSL

SEQ ID NO: 27228 - protein, 135 aa, Pseudomonas aeruginosa
CSPGRGPGRRCRPATGLPRRAPAMPEPRPKASMSTRPVGTPQQAAMLRFWVTARTFRPSRVRFSSSQVRSSTNRAKPMMTMRFHGSTRFGSTWMPPDSQAGLATSTFCAPNSIRTSWISTRLMPQVASRVSSGRP

SEQ ID NO: 27229 - protein, 231 aa, Pseudomonas aeruginosa
VIARPSAASSRIEPSDRPLKAWPSRSPTSSRRLTWARLVAAAMRTPSSGSTAGSSRFSRRVRASGSPDSPSRRTAERRSAGSGSPSCRLARARPRASFTPASLSIRRRASSSGRCAALAVFCNCCAAACRSGTSLATNWWLARAVLSRPRRRLFRRSGFGSPSGRASPSAAWKRWSAPRMNGCWRLSSAMRLWRSASRKARRPASGVAAQCSSRWARPPLSAAAKSCAGPA

SEQ ID NO: 27230 - protein, 953 aa, Pseudomonas aeruginosa
PRAVIRRGGGRVQRWSTSLPSGGQGVALAAAIAFADPVGDQLAQLRQLHRLGHVPVHADQPRAFLVFAEDVRGERHHRGMRALFVGFPGAELLGGGEAVQNRHLAVHQHQVVLGRLHRAERLLAVAGGVRLEVELVQHAADDLGGDAVVLGDEDPEVARQARRLRFLGRLQVVGDATDAALGEFVGEGRLQRVAGHRLGQDALDPGVAGDDLARRVADPGEHDQQDVVVEVGVFLDLRRQLHAGHAGHVLVEQDHVEVLAQVRLGAQLGQRLLAGRHRADVQAPAAALLHQHLAAGFVVVHHQQPGALQRAVQVGGGVLQLLRVERQGQRQGGALAAAGLDAELPAHQPHQLAGDDQAEVAAELAGGKEVAAVQLGGEQRLALLGVERVAAVLHGDAQAWRLALVVEGHHQQDLAFLGLLERVVQQAQDHLAQARRIAADDPRHLRLGEADQLDALLLGLDPEDIQAVLDQRVEVELHFVQLDLPGLQLGDVEYLVDQREQLVAGAVDGLHVVALLRRQRGAEEQFGHAQHAVHGRADLVADLGQELGLGLQFRGVRRLAGALLQVELLDQPLAFGERDAQDQPGEGGEAEHAEHQPARIELLGAEQYRQEHHEAGVEHDHPGNDQARRLVAAIPVPGRDQRDAERTEDHQQVDQPAEPELLGEGDDRADRQDQQRLALQEAVQAAFRSAAEEAAGEPQQAHRSAEGAEVGGQRLVELESRQPERHQPQVRRGADRQRRVHRRQPQAAGAARVGEADQVVHQQQEHAAEQHAEGVGGLLQADQAGFVDLVEPGHQRMVGGHPHVQGHRLAVDRQREQVGARGQRALLERSRLAGVLVPHQLAVLHQVVVQVLHPRGEDPQPARHLLRGKLDLQPDRLGAGGEDEGALGQRAELLLALEDVGDPQLRALVAQQAPVLVDAGGGGGGLQGNAGNAGVVRDRRRHRTEQKQQEADE

SEQ ID NO: 27231 - protein, 134 aa, Pseudomonas aeruginosa
VRSWGSPGATAGNAPRYPPCVKFVGRAADRIALSRRDTQWRKWRMPVNTIAISASSAAAITSLSRIEPPGWITAVMPALAALSMPSRNGKKASEAITAPFTSRPACSALIAAIRAELTRLIWPAPTPTVWRFLA

SEQ ID NO: 27232 - protein, 79 aa, Pseudomonas aeruginosa
LGGLGLVPLDVVHDGFQQRRFDFAEHHVVNVRDRLPFEVGEVVVQCLLHAVAQGLPFLRRRGEVLFQVGVVAHGRCSTH

SEQ ID NO: 27233 - protein, 212 aa, Pseudomonas aeruginosa
WSISRKIHGLPWAARPISRASTPVCSMTFLAFSGESMSPLANTGIDTACLIAAMVSYSASPVYRSARVRPCTARAWIPACSASFATVTPLRLSRSQPVRIFRVTGTSTALTTASRISATSASSRSRADPAALLHTFFAGQPMLMSMICAPSSTLRCAASASMAGSPPAICTERGSSSPSWIRRRRDLRLFHRRTSLVTISDTTIPAPRRRQS

SEQ ID NO: 27234 - protein, 312 aa, Pseudomonas aeruginosa
STPSFLHEGSGAGSVVAGGAPSIGAAAAADADPAFALGGRVEIEVCGVGRADLRGLLGEDAGQRQQAAGTYQAGQLRGEGNQRAGEDIGDQHVGLSLRQVRRQVDREPRGLDTVARGIVARGFQGLWIDVGADRPFGAEQQRGDGEDSRAAAEVEHLPAGQFLAVEPFQAQRGGRVGAGAEGQARIEQQVDRVRLGGGVPARHDPQAAAETHRLEVVHPAAFPILVGDFLDMVLGQVAAGKQGEVGEQGGLIGVRFEQRQQVGARPQRGGAEVRLEDRLVFGVHEGHGDGADFEQGVFVGFGLFRGDSQANL

SEQ ID NO: 27235 - protein, 434 aa, Pseudomonas aeruginosa
SGPAPVPLSGIRPVRSQTVPLAPCGTSPQGHRRKACTVVRRSPPSCRSCSPCSRLWPISRRFSPPRAWMRSLCERISPTAWLCWVEPSAMRSAITPMVWIAATTSSSAPSAAPACSAVRSACSTWLRMASTDCRAACCRRPMSCWISSVAPAVRWASERTSSATTAKPRPWSPARAASMAALRASRLVCSAIERITVSTLPMVADSSARRSIDWALPCTSSTSSRRPPRLSPITRWPCSTAWPALRLASAVWLASPATCWIAASMSPRASRICPVSPAWRSTPACRPLLTSARVWLLPATCSARRWIAPTSSARKLRRRFSESSRLRRSSVRVRRDMGREKSPSAQAESAGTSCPRTRARRLCRLSMARAMSRIRAIIPPWIRRTWPCRRWRSPRTCGSRVARAWRTASSLAPVSADSCWRRSIRSRVRRNSSG

SEQ ID NO: 27236 - protein, 109 aa, Pseudomonas aeruginosa
PSRAATSPTTSSRRASGWTTCPAGSMACWSRCATSAGRCARISPVRSRSPPRTPNWLAPSRVSTSTTRAGRCRRPSRSTRKASSRWTATWLACPTRTSPTRSSMPVPTT

SEQ ID NO: 27237 - protein, 87 aa, Pseudomonas aeruginosa
TPTSRTPKRYSRARRPRSRKWSRKPPGCRSTTSSTRPGARPGRCRTCCAPSRSTSPTCWRRRTPRSACGRSSANWRPRRSRCGARWC

SEQ ID NO: 27238 - protein, 111 aa, Pseudomonas aeruginosa
ARRSIPGTGTSPPAAWVQAGEPYADSAARELEEELGIRDAVLREHGRFFFDEPGNRLWCAVFSAVSDAPLRLQAEEISEARFIRPELALEEARSLPYCPDSLQALRLYLDA

SEQ ID NO: 27239 - protein, 158 aa, Pseudomonas aeruginosa
SRRPPTSACSPRSACACGCPRWLRRSGQTPVARRPSSAFPPPSCCRWSSASARPVSTRACACCISTWARRSPTWPTTSTASRKPSATTASCARSACRWITSTLAAASASTTTAPIRATPARSTTTSMTMPAWWSACSRSSATPRACRIRTSSRRAAGR

SEQ ID NO: 27240 - protein, 150 aa, Pseudomonas aeruginosa
SPRSPTSSGTTTTCRRSSISTSSRRSSAGWPNCSARPMPRWSPRPTGAPPTTSATPPRSMPTARSAWRRKPSPSSATSLSAGACTTSSRPASAPTGRSSTNSTTSSPTSTSATSRCSRACRIPGPSARCCRSCRCTAWARSRIGARYCRT

SEQ ID NO: 27241 - protein, 301 aa, Pseudomonas aeruginosa
QRSYRTGAGLRRRGLAAEQLRRPDDVRVQRPWLHHFGVLPRRLQRQPRLYERPGQRHHRARGNPQGTGLQPLRARRSRRHGEPGDQEAPGRALRPPACQRRQLGPLPLDPGPEHAAGRRGRPALPDEPGGGGQQGLPRLRRRPAPAGGAIVQLATGPGHLVAGGSRGGAQPPGLRPRHRGAAQPPGQPAALAVLRRTGRRQDRQQQRNPPGHPAPSLQRAVEPAPGQPLQAWPPGRLRLGELQPRRRRLQPAPGVPLPRLRVARQHHPARPARRPPYRLDPPPVADGPRVRALPQRRTDPA

SEQ ID NO: 27242 - protein, 294 aa, Pseudomonas aeruginosa
QRLGRPRRAAQPDHEPDPELLSPLPPPGSHAMQGRTPLLETLRELECEIRLLTVYARECCGCYEILRRKLDRLSGLIGEDCSRAQWQADSDDPALQALGLRLRDAAVQALCELEKHLCQGVLHEPGEMGRYLGSLLESIRGELDSAGIDADARVLFVGSGALPTSALVLAREVGAHLCCLDIDEEALGCAREIARCQGLEARMQFSSLPPAELAFSRDATHFLIASLVQQKSAVLAQIRQVMRADAKVLLRHGSGIKGLFNYPVEPAELDGWRVCAERVSQPLYDTLILEKAGR

SEQ ID NO: 27243 - protein, 288 aa, Pseudomonas aeruginosa
ALSSYYAATKVIDETQPLRALTKAVKRRVYLGSSRPDCPARETWRRVLAGSGVEVVPLATPEAAEGRNVTTYVHSPFFLGEFALARILSEQGPPGFMYKLYPEGPITPGAIGAMRRLWCELSELLRRMGAEPLNLLRFLNDDNYPVHETMLPRAAIDGFAEAGAERQEYLLFVRYAALLVDPFSPADEQGRHFDFSAVPFRRVSRDEDGLWRLPRVPLEDYRKLALIVALAAHFDLAMPQARSLLASYENAVSRFIDCQGASQCHPSLYPIDSRPAADAIYRQWCSTC

SEQ ID NO: 27244 - protein, 284 aa, Pseudomonas aeruginosa
VCNINSRCQRSGFFPARTHMNEQIGNGVALVTGASSGIGATYAEHLARRGHDLLLVARDRQRLEALADRLRQAHGVRVEILRADLSERDDRLRVERRLRDDASIALLVNNAGVAMNGPLADADMDRAERMIALNVVALTRLAAGAAEGFRRRGGGAIVNLGSVVALAPELFNAVYSATKAYVLSLSQSLQHELAGSGVYVQAVLPGITRTEIWERSGTGIAGIPAEMVMEVEDLVEAALVGFDRREAVTIPSLPDAADWQALMTARARLAPNLSRQRPAERYLG

SEQ ID NO: 27245 - protein, 580 aa, Pseudomonas aeruginosa
GGQGSWPLPMRSKNSCGESAATCASSRVPLAPRRARAARSVAIQAFRRSSRPGCSMVVLLSWWERVAGKLRSSYKLCMTSEIQSLSVPLRGVSSICAGVAYAEGAVAGQPRSRMMESYDVIVIGAGPGGYNAAIRAGQLGLKVACVEGRETLGGTCLNVGCMPSKALLHASELYAAASGGEFARLGIRVSPELDLAQMMKQKDESVAALTRGVEFLFRKHKVQWIKGWARLQGEGRVGVALADGGHAQLEARDIVIATGSEPAPLPGVPVDNQRILDSTGALELVEVPRHLVVIGAGVIGLELGSVWRRLGAQVTVLEYLERICPGLDGETARTLQRALTRQGMRFRLGTRVVAARSGEQGVELDLQPAAGGATESLQADYVLVAIGRRPYTEGLGLETVGLASDRRGMLENQGQRSAAPGVWVIGDVTSGPMLAHKAEEEAIVCIERIAGHAAEMNAEVIPSVIYTQPEVASVGLGEEQLQAARREYKVGRFPFSANSRAKINHESEGFIKILSDARSDQVLGVHMIGPGVSEMIGEACVAMEFSASAEDLALTCHPHPTRSEALRQAAMDVYGRAMQN

SEQ ID NO: 27246 - protein, 988 aa, Pseudomonas aeruginosa
ERSPPDARLTLSPAQPFAQGACHGRTTKSACCVPPERPRAVGLTRTSRTFFPPIANIADPARLCLSPDRQPTRVAVAQLATGDRVMSVATQRNTQLDTERRNDRLSMRAAREAQNSLETTLTNVRGRQDGLDQAEAAARLHADGPNEVAHDRPPHVLVQLLQAFNNPFIYVLMTLSAISFFTDFWLPLQDGEETDLTGVIIVLCMVLVSGLMRFWQEYRSGKAAEALKAMVRNTATVLRRDERGMRGELREIPMGELVVGDIVRLSAGDMIPADIRLIESRDLFISQAVLTGEALPVEKYDTLGAVREKSAKRIAADQQDLLELPNICFMGTNVVSGTATAVVVATGARTYFGSLARSIVGSRAQTAFDRGVNSVSWLLIRFMLVMVPIVLLINGFTKGDWTEAFMFALAVAVGLTPEMLPMIVSANLAKGAVAMSRRKVVVKRLNAIQNFGAMDVLCTDKTGTLTQDRIILEHHVDVAGRRCDRVLQMAWLNSFHQSGMKNLMDRAVVAFVEQNPRITPSDAWRKVDELPFDFVRRRLSVILEGKDGEHLLVCKGAVEEMLEIATRVHQDGVDLPLDEERRRALLALAEQYNRDGFRVLLLGTRSLSRTESQAQYGASDERDLVIAGLLTFLDPPKETAGPAIAALRENGVAVKVLTGDNPVVSAKICREVGLDVGEPLLGRDIDLMDDATLQRLAEERTVFAKLTPLQKSRVLKALQGNGHTVGFLGDGINDAPALRDADVGISVDSGTDIAKESADIILLEKSLMVLEEGVIKGRETFGNIMKYLNMTASSNFGNVFSVLVASAFIPFLPMLAIHLLLQNLMYDISQLSLPWDKMDKEFLAKPRKWDSKNIGRFMVWIGPTSSIFDITTYALMWFVFAANSPEMQSLFQSGWFIEGLLSQTLVVHMLRTQKIPFIQSTAALPVMLMTGLVMALGIYVPFSPLGAMVGLQPLPWEYFPWLVGTLLCYCVTAQTMKTLYIRRFGQWF

SEQ ID NO: 27247 - protein, 377 aa, Pseudomonas aeruginosa
AIGRASSRPFPARRQASPRRATHTGPTHGETHHDPARPAPAGAPFPTAAGRAATRPVLAPGLRRRGASLRPAAGAAVRGSRRGRRLPGRRRRDRPRRRMQPGRLAPARTPPRQPLPVGAVPRLHLLRPTIGAARRGAGARGRRRRSAQPPQPRAEHTDDGPRRPRPGVGLRALGGSLPGPPARLRMRRLQPAAELPAVRGPAPERRGRPGACLRRGRAPASLELGRGHGIPGRPTVDPDRRTLRRVGRRQRLAGRTAAAPGRTAGPRSAGRRPPARRARAMAGLGSDLAFLSPRACRAAARSSTEETAMNVVRKCLGASRRALCGLAARLLAKAAHLLMVISVRAYASGRLSQVEVKYLLDCSSALNRASLRLAMGQ

SEQ ID NO: 27248 - protein, 569 aa, Pseudomonas aeruginosa
ARSLHDPFRTGSSAMLGTILLINLAGAVALLLWGTHMVSSGVLRGFGTALRNWLGRHLGNRWLALLAGLGITGLLQSSTATSLMAASFTASGTLGLAPALAVMLGANVGTTLVVQLLSFDTSLLAPLALLSGLLLFRLGDGPRLESLGQCLIGLGLMLLALALLGHSLQQIEASPAFVAVIHGLEGDPLIALLLAALLTWACHSSVAVVLLVASLAQAGLVSLPIALALVLGANLGGALPALGVAGSRVARRLPLGNLLVRLLGCLLVLPWLTALAQPANALGGAAAVWFHSAFNLALALLAIGFTGPLAALLARLLPEEAQSDDPGMPRYLDEAGLEVANIGLANATREVLRLADMASLMLRATSGLLQRPEAKVAAEIRRQDQALDQLSAAIRAYLADLGQDGLGDSDADRAQEILLFAINIEHIGDLVANSLLPLAMRWAGRSRAGSEFELGRMLPLQAAIEESLHLAISAFLREDLDAALRLVARKKLLQRLEADASRERFRRLRDDRGAWVESGDVFQRILRDYRRIHHHVTALAYPLLERSGIDPMAKRPDEPGQGEGSACAS

SEQ ID NO: 27249 - protein, 308 aa, Pseudomonas aeruginosa
PSAAAARTASGAGVATAPARGAGPGRGGSGPGRAGRRSIPPAPRRGPRLARPSRGRGRTRAPGRCCSGWWSTGSPMAPVRSACRGTSRPVRSWPGPPAGRAGGYGRRRGPRRSVPPTVASVAGPSRSGAGPARRAAGPGAAPCPGPGRGSGAARRHRRGRRPGRRSRWCPCAGSRARRPSGCTGCRPRLPRRAGRRAAGGRPPCCPPGAPGERKRSTESSARPAPRPCGGSGRGARHRATGSWGPPDRPGSIATAARPAENPFFISGNRPLPAVYSLSDAASRPAAGNPAKTCQEACAALTAGLCAPS

SEQ ID NO: 27250 - protein, 132 aa, Pseudomonas aeruginosa
NAGVGCFQRKPCMLLGRFVSVGAGATAVHYLVLTLLVEGFAVGAAVAAATGAGCGALAAYLGHRRKTFRHRGPVFRSLPRFFAVSLLCVLGNAVLVLLLGDLAGLDYRLAQLAATGALLLATYHLHRLWTFS

SEQ ID NO: 27251 - protein, 815 aa, Pseudomonas aeruginosa
STATCRRRSAGPIREGAARLAAGLVPARPGLRHPPAEPGQLSADGHHRGPLWRGGAEDGRTGRLDHALVRRRRAVLGQAAAGLLAQRRRPASARRHRVRQPPAALVAGRAGAVAGMGLAGSRRSSAGADRLRPAGQFGAVLRRLRGGNDRHGPGPGAGPGHARLLAGPAWRGGNPAPRGLADVPRPRPRAAGEGAADADPRRTADRPVGLAGVALARALAGPAMDPRKPADAPGGRALVPAGGVEDAGLPRVLPARRALAALRHRRLGRRPLRQCPRLSLRQRLAVPAGRRVSLEPLAAAAALAGLAPARGGGRWRRLAQALLAVLGTGAVPVLHLRRQRPLDLRAARPAGPGVARRRPAARAAGAQRLAAAWRVGLPGTDPIAVRAVPRLPAAGLARRAEVHRRAAGQRRRLARAAAGVLAEAAVLGSVLQRRAGATGGGQRAGRLVASRRPAGDPLAFVRRLARRGAPALALPAAGGTVPAMPGRGAAWLRLPRPVGAVAGTRADARVVAAGVRAAGIDGAQAGLAVEVQAVAVGHAGEGEDLALVVEVLDHAILFQSLGDSLGRLLALELVDQSHADQVVDAHFHRQRAAGRVALAAQAFAVFHPGIQAVGVGGGERDFLHRRAGAGKTGAHDSGCAPVALVRAMSVSAVGPPAIPAGPARPAPSARCRRAGIRRRPSVRGRRGRGGSAARPGPRGPQRSGPAVGVPRAVPAPACAAARRALPAARGAGRGTSGRRDRAAARALRSARAKTWPALGRSPSRTISRVSRSLSDRPSRRAGSSCSCRRSAGPSNGSAGVGAAASCAQRSGAGSR

SEQ ID NO: 27252 - protein, 412 aa, Pseudomonas aeruginosa
ARLDAFGGAVRLGFRPAQHVPCQLPVQSERSLDDEQEQDVPRGGAGNAGRQPSRARCDRLHPHALSHRAVPRSVRLQERRPGGLLARYRAGPGEGRREGLRHLAVAGEQQRGARRTATGAGGGSPGPDRRGESQPDRPQPGRHDRALRRRGGAATGGLGHHHGHAAQGHAGSRRGDRLQRVPRADRHRGDRLGGGGAVLGGRHRRRRRVGQGRRAGCPEQSQHSRHRAVQPALPAGDPGQRLWPGRGDGSRGALLLDERHRLPDQCARPELRRPGGDRAAVRRGQRRSGRPMLQPPGQRGEGQLPDGPSGRSQPVARPGQPVRERPDPGLSAACQSPQERRTLIRSPGRRSPRRPGISLWSNGTWISPPVRAPRGVRTCPDSAHLAGQGLRRRVMTPVKAEKPSVRVGFAAP

SEQ ID NO: 27253 - protein, 300 aa, Pseudomonas aeruginosa
SGHPRPLRDHHADALGAEPGGSGETDRRVQVHRLQGLPGRLLGMERAARRGRPQPRHLRQPHGPDGRLVDGDAFHRARERGRQPRVADPQGWLHALRRAGLPEGLPEPGSDREVRQRHRRLQPGQVHRLRLLHHRLPVRHPTDLAEGPQGLQVQPVFRPRLGGHGAGLREDLPDRRHRLRQQGGHEGTRRRTHRRPEEPRLRERRPVRPRRGGRHPRDVRAAPRRQAVALCRPGRPAERQPAGQPVEGRDQAAGAAGHGRHGARRVLPLCARRSQPRGRRGRPRASRGTGAPGRSVGTHL

SEQ ID NO: 27254 - protein, 240 aa, Pseudomonas aeruginosa
PARASLSLRAGVAAGPPRPGGSGGALGGVGNEKMKFKGKTTPTSAATIGPVAILLFMAGLSGLALFHPALFWLTNLFGGGPWTRILHPFLGLAMFVFFLGLVVRFAHHNRVQKSDIQWLKQWRDVVSNREENLPEVGRYNAGQKLLFWVLLLSMLTLLVTGIVIWRQYFSAWFGIEAIRLSALLHAFAAFVLIASIIVHIYAGIWVKGSMGAMLYGKVSRAWARKHHNGWLKEVGKGEEH

SEQ ID NO: 27255 - protein, 350 aa, Pseudomonas aeruginosa
CRHRPTGGPSDGAFAFIPRPSGRPIVAARPTGPPAQTRGVPVSRTILQPGQIEAAANIPPHLHQPSRDLFARRGERLLQLAEGHPMGDYLRLVAGLCRLQQALLDNPPALAPLDPERLRKSREHGMPPLAYDLLVREGAWLPWLDALLAGYPAPANAAVGAALEQLREADEGQRKAWAIALLSGQFDLLPAALVPFLGAALQVAWSHWLLGLEEGAVVETESRTLCPACGSPPMAGMIRQGGKETGLRYLSCSLCACEWHYVRIKCSHCEESKHLAYLSLEHDGQPAEKAVLRAETCPSCQGYLKQFYLEFDRHADALADDLASLALDMRLAEDGYLRRSPNLLLAPGGE

SEQ ID NO: 27256 - protein, 1112 aa, Pseudomonas aeruginosa
GFSMSSVRLPSVDRLLRSAAAAPLHQRYGREALLATLRDLLDELREPARRGALAEIELSEAVLAGRAGERLAAQHASRVRRVFNLTGTVLHTNLGRALLPDEAIEAITLAARYPLNLEFDLASGKRGDRDDLIAGLIRELTGAEAVTVVNNNAAAVLLALNSLGARKEGIISRGELIEIGGAFRIPDIMARAGVRLHEVGTTNRTHARDYEAAIGPRSGLLMRVHTSNYSVQGFTASVPTAQLAAIAHGHGLPLLEDLGSGTLVDLTRWGLPKEPTVQEALADGADIVTFSGDKLLGGPQAGLILGNRELIGRIKKNPLKRALRVDKLTLAALEAVLGLYRDPDRLAERLTTLRLLSRPAAEIRAQAERLAPALGEALGEGWEVAVVDAPGHDRQRRAAGGAAAQRRAVPASAAAQAPARTRPAQPRGSPARAAAAGDRSARGRRPLARSAPARRRAGVPRPVAATAERAVVIVGTAGHIDHGKTSLLRALTGIEGDRRPAERQRGITIDVGYLYADLGDGSPTGFIDVPGHERFVHNMLAGASGIDCVLLVVAADDGLMPQTREHLAIVELLGIRRALVALTKIDRVEPQRVQQVRTQVEHLLASGPLARSPIFPLSSSTGEGVEALREALGGLAGEVRERSREGYFRLAVDRAFSVAGSGIVVTGTAFSGQVAVGDELLLGNAGRPVRVRGLHAQNRPAQQAWAGQRVALNIAGERLALEQIQRGDWLLQAALHAPTTRVDIDFRLLPDELRDFTHWTPVHLHLGTQDVTGRLALLEGEQLEPGHRAFAQLVLNAPIQALHGDRLVLRDQSAQRTLGGGRVLDGAAPARNRRTPARLAQLQALRQESLEEALPTLLGAAENGLDPQRLVQSFNRPREHWRLPEEVVEVQTRLGPRLFAGERWFALVEQLLAGLRRFHEELPDELGPDRDRLRRYALPQLERPVFIALLDAALAGGDVHSSGPWLHLPGHEVRLSDSEEQLRARLWPLLEAGRYDPPWVRDLARELRQDEAVMRNLLRKLARLGQLQQVVRDLFYPEATLRQLAEIAVQVRDPAGLIRPAEFRDRLGIGRKRSIQILEHFDRIGLTRRIGNDRRLREGSALAEQLLGGVSP

SEQ ID NO: 27257 - protein, 200 aa, Pseudomonas aeruginosa
TSPPATAPISTTPPATATSTRWAACGAPTSAWGARKWLAPWPSRPACWPIPIPSATWPTRAPSNSAASSPSWPPATSTTCSSPPAVPPPWTPRSASCTTTRTAAASAPRSTSSRGSTPTTARPSSACRWAARAPTGRPSSTSSTSASTTLPVPTTTALRKEWARPSSSMAWWRSSNARSSNWAPTGWGRSSPSRCSAPAA

SEQ ID NO: 27258 - protein, 245 aa, Pseudomonas aeruginosa
CHCAVPTVEERPCRNTAYGVNVPLTPLVGNGSQRNTEKVVMSEREHWQRVYESKPSDAVSWFQAEATLSLDLIRRIGAPREAAIIDVGGGASTLVDGLLAEGFGDLTVLDLSDAALRVARNRLGARGEEVRWIAGDITGVDLPEATYDVWHDRAVFHFLTTAEARRAYVRQVMKAVRHGGHVIVATFAADGPTECSGLPVMRYDADELHAEFGSAFQLTEHRDEHHVTPAGRVQHFVYCHCLKRL

SEQ ID NO: 27259 - protein, 284 aa, Pseudomonas aeruginosa
RLRYVWLGRALSSPRSRKITRFMARPTDGCARLPRENRDGRDQSAFNGPATATGGAAGTGARLAWRRRGRDAGADRRRRHRLRARCEGAGAQPRRRGGLRPRRADRRAVRAWPRLALGRRDLGRRPGQRRRRRAQPRRIAVQQPHRLGKPDRRKRRRGAVHAQLQHDPGQPGAAVRAGQRHRSLLSMQADRRYAPAHPARRGRQPERPASGAATRRAAPTGERGAGDRGGTDAASEKPRLRRFPGRQPGTTRLPSPYRAAIPRLSGLRVRDSAGLPGNTSEVFA

SEQ ID NO: 27260 - protein, 163 aa, Pseudomonas aeruginosa
GQHPLGFEDQPCQFAAAGDFVEFLDQFAFVDVHPGLAAHQQARAGLAGLADEVAQRLAAVQRAQLVGDGAAGQLHAFAAEEQGHLGVHAGQQGGGVEGRGAAGRGARAAGDDDEDALGVGVRVQGACPSGSAPRAGRPDRGVRRWRAAGSRAGYRAAARRRWR

SEQ ID NO: 27261 - protein, 423 aa, Pseudomonas aeruginosa
PGGPDPGRRRGRPVEPGRAGALERRLYVQGRGRQLSLPPEAAADSYAAPGAAGDPAAGAGVPRHEVAAGGAAGRCRGRRAGAAEGLVAGAFLFHREGRQRLPDAALRGPRATVRKPRCDAQPPGRPGLRRALRGTAGRRHLDGHRAAPRTDGDRALHPWRVFLQGAGGAVVDAQSDGLRAPRAGEGGDVRHRDRRGLPHRARPGRRRGDEQLAQEDGGDPPPGARRSARRVARQRPFHRFAQGLGLFAGGVAGVELGAVAPHRLAAAGVVQLDADHGDLHGVAAGHRVAGAIAVPGIAPAAVVAVVAAVVVGDLAGAQFAAQERADLQVGRAARPRRAQAALVELLADGVAQLVVVQALGKAADPGGGPAPATVAGVVARRRRIGAGIEAGIGRGGRLRRVGQRAGAVGIVALAGTEGGQAGE

SEQ ID NO: 27262 - protein, 447 aa, Pseudomonas aeruginosa
SDRRCSADAPGDRRPARQRLRSGPGPGPCRAATGWPAGRPFPPFRTEPVLEGRRRRVRRRACRPAPGRAPAGVPRPAPGIPVPLQRYLRRRPAPFPALRTPAVRHPAGATGGGGRARGAVAGRIAGDQPPLPGNARRRGDPPVRRAHRGRVQAAGSATDERNRRADGALPCGLRLPDDPRHAALRAGIRCRGAGQTLAPRRPGTAAHARVAGAPATGRGGAPGPGAPGPRTDRRVAGGRRRHPGAGRRAPRHAGPTSARTPGDGRGALQRPGHRLPLPTGQGTAAEDRRAHRSDRRTHRVFRAEHLLSRVQALGRRDARWSSAGAGIRGAGRACPKGGYRVGVLLPGSQGPPQAPSRLCPHTLSTWPLTAPDDGWANQATVSATSCGRPPWLMEFIRRPASRMVSGMAAVICVSMKPGATALMVMPRLPSAGAQAWARPIRPALLTA

SEQ ID NO: 27263 - protein, 166 aa, Pseudomonas aeruginosa
LLCPRLPAMPLIDASNTTRPLSCSLPPSSRAWVSTCGALRLTLITEFQKSLLIFARVLSRVIPALCTTISTPSGSASTSCCPASAAQMSRATARPPRRAARPSRASLAGGTSSSTTSAPSRARVSAMAAPMPRAAPVTSARWPASGLLQSWTWALLAARRITWPET

SEQ ID NO: 27264 - protein, 258 aa, Pseudomonas aeruginosa
RPERSPRAPDRTCRSRLQRLQYGMTVAARRPRSEGRRGDGEHAGQARAGTRAGGGRHPGQPAADARAARGAVPRAHRRQRPGRAAGGRRRAAPGPDPARREHAGHGRLRGLPTAQGRSADPRHPVDVPHCPRRSRRRATGPGPGRGGLPGQAGEPADRPGAGAYPSAIEGQCRFPARQERIPGTRSAPSHAPAATVAGRRHRSPGDPWRSSRQPAQPPSSAYRALCQAARRAPGGAAGVRRRADSGGCRPAEQVGAVA

SEQ ID NO: 27265 - protein, 206 aa, Pseudomonas aeruginosa
IRPTAGGGLRRRGRRFRRGCPALRRQRRGAGRGDAAAGTGGGGKHRTHRATGLVRRSVRSPAESRRVRLCSARRLPYNVRPFALHIGPEEPRSTDEDTQTPGTVDRRRSDRRGRAPADERQGSLGLCGALRRQPALRQGLQGSQQAQLPPGRRVPGGPQGPQQPPGAGHGQGLEVWPPRTGGSLAECRSGGPVPSRRGRCAGAEAL

SEQ ID NO: 27266 - protein, 303 aa, Pseudomonas aeruginosa
SFPEAAMPVAHILLALLVTLIWGLNFVVIKVGLGDFPPLLFCALRFALAALPLLVLRGPMPAPFGRILLIGVLLGVVKFGLLFVGMAQGMPAGLSSLVLQSQVFFTILIAALWLGERPSPRGLFGLSLAAAGLVLIGLERPLGDSLLAFLLVVAAALAWSFANIATKRSGATDMLRLICWVSLVPPLPLLALSYLFEGPQAIERAVLNMSWGGFGALLYIAFGATTVGFAIWSFLLRHYPASLVTPFALAVPVSGMLAGWLLLGERLDLDSLLACALVFVGLAITLLPASLLRRFAWPVRRLG

SEQ ID NO: 27267 - protein, 189 aa, Pseudomonas aeruginosa
RCGPPRISPASRRSTGGACGRRTGRRAGRCWISVAAARRQVLEDRAVGAVVALAVLDQVLQGVAQGAELLDLAIQLAHVLRRQGLDVGTGTLAILPEGEQLADFVEGETEVPRTADERQGMQVVLVVVAVAAGAASGWAEQLDGLVVTDHLRRQSAFLRRFTDVHPGLLGGCEAASLSLSRPMRRLSDM

SEQ ID NO: 27268 - protein, 82 aa, Pseudomonas aeruginosa
GAAEQHAVGAEGDHPHHVETGADAGVGKDRQFALHRLRRLPGSAAGAGQHAVELAPAVVGDDDAVGAELHRIPWHPPGRGCP

SEQ ID NO: 27269 - protein, 146 aa, Pseudomonas aeruginosa
ADGSTLRCPPKLPPATAAPPPAASASLAPCGCQTLRNRVRETRLTSAEVMSGNSGPMKLDVRYWVMAKLPPATMAAGQVSRMPRQPSIMNTSQNGTRIDRNGSWRPVMAPILKASMPVTWPATMIGMPSAPKATGAVLAIRHRPAA

SEQ ID NO: 27270 - protein, 261 aa, Pseudomonas aeruginosa
GCRDMEFGQVRQRRLSDDIVAQLEAMILEGTLKSGERLPAERVLAEQFGVSRPSLREAIQKLVAKGLLVSRQGGGNYVTESLGATFSDPLLHLLEGNPEAQRDLLEFRHTLEGSCAYYAALRATSLDHQRLTEAFEALQACYARNDQVSAEEGAADARFHLAIAEASHNTVLLHTIKGLFDLLRRNVVTNIGGMYAQRTETRAQLMEQHQRLYDAIISGQAELAREVSNQHIHYVQEVLAEVQEEARRMKRSQRRRSVQED

SEQ ID NO: 27271 - protein, 214 aa, Pseudomonas aeruginosa
RRISDNAHSFPGRWPRFCKKSLQVASGCAERFFCRTLAPVDGRSAPPWRMPPSRRLCLGSRPLDSRSESSMSTHIQRSALLPYPARALFDLVNDVKRYPEFLPWCSASQVLEESESLMRAELTVAKGSLSQRFTTRNVLVPGASIEMNLENGPFTELHGVWQFKALGEKACKITLDLTFDYAGPLVKATLGPLFTQAANTMVDAFCQRAKQLYG

SEQ ID NO: 27272 - protein, 154 aa, Pseudomonas aeruginosa
KPDHTRIPGYCETSRAEKADMVENSELRKAGLKVTLPRVKILQMLDSAEQRHMSAEDVYKALMDAGEDVGLATVYRVLTQFEAAGLVVRHNFDGGHAVFELADSGHHDHMVCVDTGEVIEFMDAEIEKRQKEIVRERGFELVDHNLVLYVRKKK

SEQ ID NO: 27273 - protein, 615 aa, Pseudomonas aeruginosa
SRNGSMRKRRPWGRRFHFPLKERSVLGGQVDQFLRVGQGFLGQVDAAEHAGDLLDPLGLVQGGDRRTGFAAAAFLVHEQVLVALGGDLRQVGHGEDLAAFAEAAQQLSDHFGGGAADADVDFVEDQGGDARGLCRDHLDRQADPRQFAARGDLGQPFQRLPGVGADQELHAFQSVGLRLGAVAGMQDDGEAPPGHAQALHFLLHAGGKRCGRGLAQAAQFVGFFLVMPGVGGQLVAQASDRFVVGVQRLQLVEQALLQVGQFGGLDPVLARQGVNDVQALLDLLLAIGIGIEVVDEAVQFADRLLDLDLRAGQQIDRFAESGGLAAERGQAVEAGIERGKDVAGIALAAHFHDLAAGGEQAFGVAQGLLLLLQAFQFVFAEGQVFQFFQLVAEQLVAGALFVAATRQAFEFLAGLLPALRGELHLARQLLAAGILVEQAPVGLALQQRLVLVLAMDVDQQFAQALQVAQRAGRAVDVGTRATFGSDHPAQDARTVLFQVALGEPVAGLGDGADVEAGENVGLVRSGTYRAAVGAVAEGKAEGVEHDRLARTGFAGDHAHAGSEFEIQMLDDGVVVNGQVNQHGGRLRGFCLVIYTVFFPAGNCRSPLEPWKAVPI

SEQ ID NO: 27274 - protein, 170 aa, Pseudomonas aeruginosa
RQGHRERRGRAYHPLDHRLHQRWRNPGGPAGQAPGGHQPAEHPVCGEAPDRPSLRRERGSERHPDGAVQHRQGRQRRRLGGSEGPEDGASADFRRSAEENEEDRRRLPRRAGHRSGDHRSGLLQRQPAPGHQGRRPHRRPRRQADHQRADRGGAGLRPGQGQGRPHRDRL

SEQ ID NO: 27275 - protein, 174 aa, Pseudomonas aeruginosa
SDPGRRPDPHAAGTEDRCRVLRQGSAQGRQPGRSRGCRCRHPGRGPGRRREGRAAARRDPADPRHRDPGRRDDRSDREEHHHPDQEVAGVLHRRRQPGRGDHPRAAGRAQAGRAEQVAGQVRPGRHSAGSARRAADRGDLRYRCQRHPARLGEGQGHRQAAVHRDQGILRPVRG

SEQ ID NO: 27276 - protein, 166 aa, Pseudomonas aeruginosa
NITRTAILATRKPRTSSRRPTRPTRSSPMPASGRPTTSTAMPASIRIWVGALAPVSAGRASPTSSAMCSAISSVAAVPAVARAAARSAARTCATPWTSTWRRRYVAPPSPSACRPWSVARPATAAAPSPVPHRSPAPLAAVSARCACSRASSRSSRPARAATAPAR

SEQ ID NO: 27277 - protein, 401 aa, Pseudomonas aeruginosa
LFTVSSRFFTPARPVRLDLREVFLTKPAILALADGSIFRGEAIGADGQTVGEVVFNTAMTGYQEILTDPSYAQQIVTLTYPHIGNTGTTPEDAEANRVWAAGLIIRDLPLIASNWRSKQSLPDYLKANGTVAIAGIDTRRLTRILREKGSQNGCILAGADATEERALELARAFPGLKGMDLAKEVTTAERYEWRSSVWNLESDSHPEIPAGELPYHVVAYDYGVKLNILRMLVARGCRLSVVPAQTPASEVLALNPDGIFLSNGPGDPEPCDYAIQAIREFLDTEIPVFGICLGHQLLALASGAKTLKMGHGHHGANHPVQDLDSGVVMITSQNHGFAVDESTLPDNLRATHKSLFDGTLQGIERTDKVAFSFQGHPEASPGPHDVAPLFDRFISAMAERR

SEQ ID NO: 27278 - protein, 1088 aa, Pseudomonas aeruginosa
SWPPQPCPDYCNESPMPKRTDIKSILILGAGPIVIGQACEFDYSGAQACKALREEGYRVILVNSNPATIMTDPAMADATYIEPIKWATVAKIIEKERPDALLPTMGGQTALNCALDLERHGVLEKFGVEMIGANADTIDKAEDRSRFDKAMKDIGLACPRSGIAHSMEEAYGVLEQVGFPCIIRPSFTMGGTGGGIAYNREEFEEICARGLDLSPTNELLIDESLIGWKEYEMEVVRDKKDNCIIVCSIENFDPMGVHTGDSITVAPAQTLTDKEYQIMRNASLAVLREIGVETGGSNVQFGICPNTGRMVVIEMNPRVSRSSALASKATGFPIAKIAAKLAVGYTLDELQNDITGGRTPASFEPAIDYVVTKIPRFAFEKFPKADARLTTQMKSVGEVMAIGRTFQESVQKALRGLEVGATGFDPKLDLNDPEADSILKRELTVPSAERVWYVADAFRAGKSVEEVFELTRIDEWFLVQIEDLVKDEEKVKTLGLSSIDRELMYKLKRKGFSDARLAKLLGVTEKNLRSHRHKLKVLPVYKRVDTCAAEFATDTAYMYSTYEEECEANPSSREKIMILGGGPNRIGQGIEFDYCCVHAALAMREDGYETIMVNCNPETVSTDYDTSDRLYFEPVTLEDVLEIVRVEQPKGVIVQYGGQTPLKLCRALEEAGVPIIGTSPDAIDRAEDRERFQQMVQRLNLRQPANATARSEDEALAASKAIGYPLVVRPSYVLGGRAMEIVYQEEELKRYMREAVQVSNDSPVLLDHFLNCAIEVDIDAVCDGEIVVIGAIMQHIEQAGVHSGDSACSLPPYSLPQHIQDEIREQVKKMALELGVVGLMNVQMAVQGEDIFVIEVNPRASRTVPFVSKCVGESLAKVAARVMAGKTLAEVGFTQEIIPPFFSVKEAVFPFAKFPGVDPILGPEMKSTGEVMGVGDSFAEAFAKAQLGASEILPTAGCAFISVREDDKPFAAQVAGDLVALGFEVVATAGTARVIEAAGLPVRRVNKVTEGRPHVVDMIKNDEVTLIINTTEGRQSIADSYSIRRNALQHKICCTTTIAGGQAICEALKFGPEKTVRRLQDLHAGIKA

SEQ ID NO: 27279 - protein, 156 aa, Pseudomonas aeruginosa
EPRAATSSTRSSRFAISKRAPLRAGAISWLLAQTFWVGGLWLLQFVVLPALAKTGLAPLLVETVAAALTPLLIGFAGFCAALQALVLVSSHGPRSLWRDLRGQLLLAVALLCLVYFLVRGLAPEAVRWLLFNYLAVAMCGLLLVLQPVPGRDEEGV

SEQ ID NO: 27280 - protein, 459 aa, Pseudomonas aeruginosa
SPPLKWRIEHGRQKMSRKYFGTDGIRGRVGEFPITPDFVLKLGWAVGMAFRRQGNCRVLIGKDTRSSGYMFESAFEAGLSASGADTLLLGPMPTPGIAYLTRTFHAEAGVVISASHNPHDDNGIKFFSGQGTKLPDDVELMIEELLDAPMTVVESARLGKVSRINDAAGRYIEFCKSSVPTSTDFNGLKVVLDCANGATYKIAPSVFRELGAEVTVLAASPNGLNINDKCGSTHLDGLQAAVVEHHADLGIAFDGDGDRVMMVDHTGAVVDGDELLFLIARDLQESGRLQGGVVGTLMSNLGLELALQELHIPFVRAKVGDRYVMAELLARNWMLGGENSGHIVCCQNTTTGDAIIAALQVLMALKHRGQTLAEARQGIRKCPQVLINVRFKGENDPLEHPSVKEASVRVTEQMGGRGRVLLRKSGTEPLVRVMVEGDEEASVRAHAEQLAKIVSEVCA

SEQ ID NO: 27281 - protein, 182 aa, Pseudomonas aeruginosa
LDSPCHGSEWQFRDGRFAHFLFLRHTRGDQVSSKLEQLQALLAPVVEALGYECWGVEFISQGRHSVLRVYIDRPEGILIDDCEAVSRQVSGILDVEDPISGEYTLEVSSPGMDRPLFTLEQFAKHAGEQVKIRLRSPYEGRRNYQGILRGVEEQDVVVLVDDHEYLLPIDSIDKANIIPRFD

SEQ ID NO: 27282 - protein, 137 aa, Pseudomonas aeruginosa
SDRRWAYRPASTDSVIRPIRGWLSAGTVIPPFKTREAIPGLFTQRKPIMALSVEEKAQIVNEYKQAEGDTGSPEVQVALLSANINKLQDHFKANGKDHHSRRGLIRMVNQRRKLLDYLKGKDVSRYTALIGRLGLRR

SEQ ID NO: 27283 - protein, 697 aa, Pseudomonas aeruginosa
PSNSSSVSRPSLSRPAVLLARPPAPYWSPWTTSACWSPWSAPSRRPKAATSSRCPCTTRKRPTPQAVSPAVSSSVKDVLPRRETLTSRLIDRPIRPLFPEGFMNEVQVVCTVVSTNKKSDPDIAAMIGTSAALAISGIPFAGPIGAARVGFHPEIGYILNPTYEQLQSSSLDMVVAGTEDAVLMVESEADELTEDQMLGAVLFAHDEFQAVIRAVKELAAEAGKPAWDWKAPAENTVLVNAIKAELGEAISQAYTITIKQDRYNRLGELRDQAVALFAGEEEGKFPASEVKDVFGLLEYRTVRENIVNGKPRIDGRDTRTVRPLRIEVGVLGKTHGSALFTRGETQALVVATLGTARDAQLLDTLEGERKDAFMLHYNFPPFSVGECGRMGSPGRREIGHGRLARRGVAAMLPTQDEFPYTIRVVSEITESNGSSSMASVCGASLALMDAGVPVKAPVAGIAMGLVKEGEKFAVLTDILGDEDHLGDMDFKVAGTDKGVTALQMDIKINGITEEIMEIALGQALEARLNILGQMNQVIAKPRAELSENAPTMLQMKIDSDKIRDVIGKGGATIRGICEETKASIDIEDDGSVKIYGETKEAAEAAKLRVLAITAEAEIGKIYVGKVERIVDFGAFVNILPGKDGLVHISQISDKRIDKVTDVLQEGQEVKVLVLDVDNRGRIKLSIKDVAAAEASGV

SEQ ID NO: 27284 - protein, 86 aa, Pseudomonas aeruginosa
NRSSKRPGRTIPFPSSPGGRPMNSDVIKGKWKQLTGKIKERWGDLTDDDLQAADGHAEYLVGKLQERYGWSKERAEQEVRDFSDRL

SEQ ID NO: 27285 - protein, 236 aa, Pseudomonas aeruginosa
PRSWASRRTMCQGLAGVSAAAFVLSGGGVFAVSASCCGESLAALSISAVLAVSCPVALPVFGALLVSCLATLSAAPSATLADSLSSVALSVSATLASFSAGLSLPASPEAITAALAAPSVAGSRVVFAASVGAAAGSVFSAGLGAGALRGGGVKSANSFCQSSWPSFSRAAQASRPWLRTSPSTTSCLARSRVVAATSRLASLASGLPWGELMLKSASFSAALSSSSWVSLDRSRR

SEQ ID NO: 27286 - protein, 564 aa, Pseudomonas aeruginosa
SRALGRGGSAAMAAAEEVDQALGRGVLGRGFLAADQARIDTLAEFLAKLHAPLVEGVDAPEDALYVDLVLVHGDQRAEAAGADALDHQGVARSVARNHLVRRQALHFGFRQALGAQFGLGLLAALAEHQRLALRQAVGVQPLVMVGHRVVAAHRDDEVRRDQLGALVQQLMVGVLAVAADTTPDHRPGAAGDRRAVLAHALAVGFHVQLLQVVGDIPQIVVVGQDRVAVRAPEVAVPDAEQAEQHRDVAFERRGLEMLVHVVGAGQQFLEVGDADGHGDRQADGRPQRVAAADPVPHGEDVFLADAEGDRGFLVAGDGDEMAVKLFLGAALGQVPGACGLGVLQGFQGPEGLGGNDEQGGLGVQAAGQFMELATVDVRQVVAAHAFLGERQQGFGYQLRAEEGAADADVHHVGDRLFGIAAPQAVVHVAHQLGHLVQDAVDFRHHVDAIDQHLVADRSTQRGMQYRSALGGIDRLAVEHRPDRVAQPCFLGQLHQQVDGVLANQVLRKVEEQPTGAEGKPLEALRIVDERLAHPEVLQFLAMGGQGAPTVELRGIQRSEVVLHG

SEQ ID NO: 27287 - protein, 192 aa, Pseudomonas aeruginosa
PLREDNARPSAARTVGSPKICTGRLRSRTSLRITANCWKSFSPNSARSGWTMFSSLLTTVATPSKWPGRLAPQRPSETPGTWMRVCPSMPSGYISSTVGVNSRWQPASSRRSWSAARVRGYLSRSSLGPNCSGLTKMLTTTKSARSPAFFTSAAWPAWRLPMVGTKPMRLPSLRARATAARSSRTVLTVFMR

SEQ ID NO: 27288 - protein, 532 aa, Pseudomonas aeruginosa
YRAARRRPGGSREAARRHRGQPGSARAVRPGCCPAPRRRAGSFAASAAAFLARPAAPTAAVAAAATLARGAAVFLADQVADHVAPLAVADFLVIGPPLAESFGFLAGTFAQQEEVVAGAEARVFQEQVGALALASRQTFLHIPDLADRQGETLGNGNPLALFADQFVGGFLHRRDGRHAFLLQLRDARRQGRPEQRGEEEGRGYRLALANARIGIGQGLADQLAGVVGVGLQCLGAGREQRREQFVLDQQFESALGPAGEEQLEHLVEQARRRDFPQQRGQPANRRGAVLLDFEVELGGETYRPQHPHRVFQITLLRIADQADQAIADVVNAIGVVQQPLAGDVEVQGIDGEVTALGVVFQAAIDVVAQDAAAFVAGRAAIAIVLAFRMMGAEGGDLDDLAAEVHVYQFEAAADDPRVAEFGADLLRRGAGGDIEVLGSDAEHLVAYAAPDHVGLVAGPLEDLDDLDGVPAELVPAQGVLVVTDDFRGCTDGARTAQGGTNGLDQLFQHGCVIGSTMWVIARLRCSNRTDVG

SEQ ID NO: 27289 - protein, 60 aa, Pseudomonas aeruginosa
CCGIIRTSRARRVLYPLNVWPRDAQGVPGAGTDCAMHPDRNEQGPYILFPRSGRGPGRLR

SEQ ID NO: 27290 - protein, 358 aa, Pseudomonas aeruginosa
FTPRNAQALAAFPQAFAADAQLAGQLGLGHVVLVLEDEVLEVVFQRKVLGGLVVAGRGARRAEAEVGGEVVLEVVQLDVDTQQVGVDFLALAEDHRPLDGVFQFAHVARPWVMADRLFGVVGEAERRAPHPGALASQKGAGDLHHVVATLAQGGQLQRDHMQAVIEVFAELPGLGQGFQVAVGGGDQAHVDLLRLHRADPADLAFLQYAQQAGLGLQRQFADLVEEQGAAVGRFDQPGAPGAGTGEGAFFMAEQLGFDQGFRNRRTVHRDQRRLGALRQVVQGAGDQFLAGAGLALDQYRGVGRRDLANLAVQLLHRRTGADDAYLAVGCRRAGAALAAGLAAVGGGPGPRCGSPGGP

SEQ ID NO: 27291 - protein, 738 aa, Pseudomonas aeruginosa
HQAAVARRQGFLDGRLVQVQPAGVAVVDQALLVQVLVGGVDETFQQALPGFGQGRQARTDDLLRADPGEFLDGAVPHQHFLVLGQGADAHRQVLQGLPVVAAQGVEFGSQASQPGVIVLQAALDEVDVLGDIAFFAGLVGKEGLHDVLGDTGSHQPGKVRLDAVAQATQGIGATFVEGQVEIAQGLLDLLLRGLGAQRLGQLAGELLRRTGEQFAALRTAYVVHRAGLGGAFFLVAGLGEQRHQGEYQHVGRQRGQRRQVPVRIVQHVDHVEQRQVQALYVPHQGQQHGDRPDQHAGDQPGDEATAVGGRPVQHREGAGKELQGGDEGHYAQVGEVLFGAQQQVEGVAGHDDGDDQQAPGPFQPAVDVALRRRLVERQHQVVEDHSRERQGHHDSQPAGGGDAADEGGQGQGRAVHRQAEADGVVLRCGRGAEAQPGPEDRRYRQAHQQQEQRQAPTGGNQRARVEVLGEDHVEHVRHHDGRGEEHQQQRSPWTFGQRRVQGGQRGLVLQQPDFQAFRPAEDAVQGVEADTAEHHQLDQRLEGDGEHQSLVAFAGGDVASAEEDREQGDQGAEDERDPLLGRVAGENADRVGDRLDLQGQHRQHADQHEQRGQGAGPGTAETEGEEVGQRGQLVCACHPEDRIEQHRGEQEGPGNPQVDGEEPVAVLVGQAYRAVERPGTGVDAQRQGVDQRVAYQPARHVAALGDPGDAEEGGEVGDADQDQLGQAKARQHRAGSAG

SEQ ID NO: 27292 - protein, 274 aa, Pseudomonas aeruginosa
RNRRPRGRDAGGLRPARGRRSDIPAPARAGGSPHPRGRARRRGRSPGRSRRIPQAACASKCRRRPGRCAAVARPLRRSPGSVRSAAPPRRPIRSRSAPGFPGSPAGRPGLRGAGRGPPCAPASGRRRHVRPGRRRRPPPGNRSAGSRWASGRSGLHRKRSWRERCGGERRKRNGAPWRPVGPAQEPSCFSRISARVLQSMQRVAVGRASRRRMPISTPQESHQPYSSSSISCRVSSIFLISLRSRSRARSSRLNSSSWLARSAGSGKLAASSCM

SEQ ID NO: 27293 - protein, 424 aa, Pseudomonas aeruginosa
PAGAWAGWWRRQRRCLSWRSWLRTSTSARRAWPSRPRWPVSRRPPSPFSKSVAKSSPAVATSSCRPCASWVSESPWSRKAPSISTPISVRSAAMPTPSASTSSRPSTWPSLRGWISAATRPATTCVSPIPRTCRACRKRWSGSPAACRTGGPDAFRAATGRRPPAASLQAFPRRYRERRRRAPDYPLSEYRFDAQLHERRLPGLVQPLQRPQAQAAGDLGAERDSAGPPGLRQHGAGQPPGRGGAAGRGHRGACRFHRSAPGSGLRRGEQSRRLSPGIPHGRTVHRGEERHPGLRRNRRGGLSRRGDAARRQAPARTGGAGAGGDPRGAAVLREPFRGRGGAPRRRDRSSLWQGVARGGASGRRGAGLWRRGDDGRIAPGAAPPGATLRHGRAVGRGHSLSGVRAGRRFPCGGCRGTGRTARSG

SEQ ID NO: 27294 - protein, 509 aa, Pseudomonas aeruginosa
CGGWRWGNPRSGSACACRPARTSRSDASRCRFPATDEIRRAAGNARAATRRSRARVPRTGPANRRGGTSCLPVVRRRRWGRTVDGSCVEEAQLDHEQDGEDHQRRVQFAPAPGQHLDRGPGNEAEGDAGGDRIGERHGQRGDDHRRGDGDVFPVDFCQARGHQYGDEEQRRGGGEGRYAASQRGEEQREEEQDGDDDGGQAGAAAGADARGGLDVAGGGRGAQQRAAHGGGTVGDQRAAHLRHVAVLAHQSGALGNADQGAGVVEQVDEEEGEDHADQADVQRALDVQLEEGRRQRRRHRDHAAELGHAEQDGDGGDHQDTDQHRAGDATRLQGDDQDEAEGGEDRCRLGQVAHADQGCRVVHHDARVLQGNQCEEQADAGGDRRAQRQGDAVDDPFADAKDRQQEEHGGGNEHCAQRDLPAVAHVQHHGVGEEGVEAHAGGQGDRVVGDQAHDGRADGRCQAGGDEHRALVHAGLAEDARVDEEDVGHGQEGGDPRQDLGAHRGVVRL

SEQ ID NO: 27295 - protein, 300 aa, Pseudomonas aeruginosa
NGPVADEAKPQAEFTPLLNSTSLGCWYCAWPLAKICSQVSSVSPRIERTNSLCSSLAAGARPPACCWVAGAGLSIWPSSDPRICIGSWPISRPTTTTMATPPRLRPLPPMRMPPPPPAPPSPRASITLSLRRPLRQSMAVLLYVSLLQCCRRPPPAPPRPSGRGQQLGAGEQLDVAADPDATVCRDLDVEPARPLEEASLVQDEGFAARGKPVFHQVGGDRTGSAAGSHVFHQPQAVPGAALAPVDVEQIDKRRAEFIQGFLQIVDLTGSTQRLGGYRQEQVGQAGAHHPRWMPGQVVGR

SEQ ID NO: 27296 - protein, 650 aa, Pseudomonas aeruginosa
SGGRLSPVAWKAPGMARRWVWGHFRVRRGNGSDVPDQVDREIAAWLGQSVDVGRGQRRSLADAVVAAHVIPQPVFLVGQVVETGVEGQVLAQPVVGAEVEDAEARGLELAGGAIRGVEGAVVDAILAFDQGPAEQPAVVAVCFVVAQAEHSGEWVDAVDRLAVVLVATVGVGHAALGVESLRRAEGAQLQAALELDALDHRPLDVVGLEGLAVAAGAIGIQGVFVDEVAIFVVEHRHAEAAFVELAAQPGLEALALFRLEVGVRLDVVARLQVLESTVQRLGGGRAEALGVLAVPGVVLGEVVGHAELGRNPVPFLVRLVDRGVLALLHGAQELVGDVRLHARVVVTQAGSEGPVVPADAVLGEQGVGLHRRIGKVAAALQGIARTVRAGVQIGAGAAAHAGDLLVLEIDPVAQQVLGLADGEALVQLAVEDPQAFLVGSVAGAQDLAGDRVVELAGRLVGLRQLVVQAPLDAIGDRAVEQEMVLQAVALASQGVVALAPLVHAARQHARRDGRLALVVRAAIGALLVGIDVALVLLEDQPEAATLGVVPAQLAEQAVAVGVFRVGFAAREPGAAVAAVGFGLVALAVAIMQQAVEVVGAAGDGGRGQPGVAGRLVAGLQPGADVLAVLDDVRRVEGEVAHRAADGVAAV

SEQ ID NO: 27297 - protein, 205 aa, Pseudomonas aeruginosa
RRGRAAKDFHALYDVRIDVVAVGLRVGAAEEVVGQFDPVDLRKDAVPVDAADVVAGDPGTLAGAADRDSRFVAHQFLDVVDVLPVQLFAGPHADGAWHRIHCLLGTGGGDGGRGQRDGVPRQGQGRAEQQQGQAGAQGEGRGERHVGLLGSGRWRIARGTSGAQGTARKTLMQIIIKWIQICVLWQSSPVLRVARPNRICPRNRR

SEQ ID NO: 27298 - protein, 396 aa, Pseudomonas aeruginosa
RHLAYPDLLEPGQPERRQLPTTLAAAAGGAAGGLLATAPGRCAERTAARRVRGPSPGLRRRAIEGRTGALHCPRRRRRSGGGGDDRLHRPGGAAPDPSGCRSGSSDVAAGLDDGRRHSPAACRPAGAPGAGSGGVADRHRHGTDRRAVLPLSAIAGAGLMLRVENLSIRRGGKTVLEGLELELRPGEMLGVLGPNGAGKSTLLGALCGELEPAEGLVLLDERGLDDWPGVARAQRLAVLPQSSSLGFAFPVEAVVGFGRLPHSSGRERDVQIVAEALAAADARHLAGRSYLALSGGERQRVHLARVLAQLWPGEPGQVLLLDEPTSALDPLHQHTTLQAVHDFARRGASVLVILHDLNLAARYCDRLLLLQNGRPHLLGTPEEVLRPEPLRAVFGL

SEQ ID NO: 27299 - protein, 370 aa, Pseudomonas aeruginosa
ANSMSKPGQRVLAELRKLIASGELAAGERIVEIPTAERLQVSRMPVRIALRTLEQEGLLCKTGRGYRVRAVTREDIAGAVEVRGVLEGLAARQAAERGLSAEARATLEECLAEGDRLFANGQVLLEELERYQRMNMRFHRTIIEASGNPAIAVALARNDHLPFASVSALAVDRDNLEQEFRRFNFAHMQHHAVVDALVNGQGGARRGDHARARQRDPALRRLLRSGAAGCHRASRRRRRRLEIQHQPWAARTRTAGREAIVGGLLLFAEVEVAMLRLAVQHAGQAGAADALLAGGRQVHPGFAQGRQHGLPGGDPDQRPVARQLHFEGAVRTGVSWRGGEVLAMQAACFPAQFAGAFFDPLHEARRPAKV

SEQ ID NO: 27300 - protein, 534 aa, Pseudomonas aeruginosa
KTSGINCQIISFQSLSRISLTVGYPLAIRFLVAKMDPIGLRHRRNGARVPALAVPTTTRKRVFPMMDSCIPAPRSRLPSLLSCPLGGGPPMNRDLRRALDDEPMRPFQWLAVAVCIVLNLIDGFDVLVMAFTASSVAAEWNLGGAEIGLLLSAGLFGMAAGSLFVAPWADRWGRRPLILACLALSGLGMLASALSQAAWQLALLRGLTGLGIGGILASSNVIASEYASRRWRGLAVSLQSTGYALGATLGGLLAVWLIGAWGWRSVFVFGAGLTLAVIPLVCLCLPESLDFLLARRPPRALQRVNALARRLGRAALAELPSPPGGGAEHGSRLARLLCVAQRRTTLLLWALFFLVMFGFYFIMSWTPKLLVAAGLSTAHGITGGTLLSIGGIFGAALLGGLAARFRLERVLALFMLLTAALLALFSLSAGLPGAALPLGLLIGLCANACVAGLYALAPSLYDASVRATGVGWGIGVGRGGAILSPLVAGLLLDDGWQPLSLYGAFAAVFVVAAAVLPLLGARRRERSPTLGDAA

SEQ ID NO: 27301 - protein, 560 aa, Pseudomonas aeruginosa
TSSIFYRKSIDLIDYRAAATVAQIQETSLKACMKTVHSASYEILRRHGLTTVFGNPGSNELPFLKDFPEDFRYILGLHEGAVVGMADGFALASGRPAFVNLHAAAGTGNGMGALTNAWYSHSPLVITAGQQVRSMIGVEAMLANVDAGQLPKPLVKWSHEPACAQDVPRALSQAIQTASLPPRAPVYLSIPYDDWAQPAPAGVEHLAARQVSGAALPAPALLAELGERLSRSRNPVLVLGPDVDGANANGLAVELAEKLRMPAWVAPSASRCPFPTRHACFRGVLPAAIAGISRLLDGHDLILVVGAPVFRYHQFAPGDYLPAGAELVQVTCDPGEAARAPMGDALVGDIALTLEALLEQVRPSARPLPEALPRPPALAEEGGPLRPETVFDVIDALAPRDAIFVKESTSTVTAFWQRVEMREPGSYFFPAAGGLGFGLPAAVGAQLAQPRRQVIGIIGDGSANYGITALWSAAQYRVPAVFIILNNGTYGALRWFAGVLEVPDAPGLDVPGLDFCAIARGYGVEALHAATREELESALKHALAADRPVLIEVPTQTIEP

SEQ ID NO: 27302 - protein, 526 aa, Pseudomonas aeruginosa
SARWRSPASTCGRACRRKRPSTRRRRNPCDFRKRRRAMSDSRYTDLGLQPLAGEWRHGRAGRRLKVSNPFDGSLLLEIEQADRDDLDAAYAKAAEVQPAWAALGPSARAAVLYKAVEVFDRRHEEIVDWIIRESGSTRLKAEIEWGAARAITLESASFPARVHGRIVESDVPGKESRVYRSAIGVVGVISPWNFPLHLTQRSIAPALALGNAVVVKPASDTPVCGGLLLARIFEEAGLPAGLFSVVVGPGSEIGDAFVEHPVPGLVTFTGSTPVGRNIGRIASGGAHLKHVALELGGNSPFVVLGDADLEQAVNAAVFGKFLHQGQICMAINCIIVEDSLYDAFAARFVERVKGLRVGDPQRADTAVGPIVNARQLEGLLEKIRLARQEGAKPLYEGGVDGQLLAPHVFGEVTATMEIARDEIFGPLVGLLRARDEAHALELANASEYGLSSAVFSRDLERAVRFARQLRAGMTHVNDIPVNDEANAPFGGEKNSGLGRFNGDWAIEEFTTDHWISVQHAPRQYPF

SEQ ID NO: 27303 - protein, 163 aa, Pseudomonas aeruginosa
ACAIRRTCRTCRPGARRRRNRTVSTTPAPSTASTASAPNWACGTGNWRTSTGRATPTCCTSSVSATGPWAPTSACSSTATTAPRAPERSTAIPSTACFPPASACTPSTLACRRSAATAAGNRSTAAVGGAWATTCSTATSPTPTNAPGRCATTTISSASAGPA

SEQ ID NO: 27304 - protein, 201 aa, Pseudomonas aeruginosa
ERNRRLYWVSWVMLASARPNAALPSTAGRRSASAQARSSSGSRLEASFCAASWPSGRVFISTANWFSSQLQNQALSASSASRRQARAAIAQAAARLGGSWRASQARPGASSSGRASSNWCREKPICRLSWASSRVSRLALWRSLAASQAAQSPISAARSRPASSGASKRARFSCSWSTSQVRALSASRTQPLSRAASRPWE

SEQ ID NO: 27305 - protein, 709 aa, Pseudomonas aeruginosa
GRCRRPAAPRPSAGVVEPPLCAGRGTLLGGRRYARPGPAYRPRLAAGAAGPAHPTAGGARRGAGRAQLQPDPGGRRAPGNRRQASPGRAALALVVRTPGGRPACRVATRARRSALADAGRGGLPAGRRQRPDALARPAPRGAGERLSRSRAVAALRPSSRPARLARRAGGAGGAPPEPGVALEPDPRGAGRWLPGGAFPAAPPGRLGSRPGAQPGPGLRAGGFRRGGGRATGGTLRRLADGILQRPALAQRGGAARSAPALRPVAAGSLRRQRRQPAGTGRGPRPAPGPRLPPGHLRQLHLRPAQRLRARPAQRRAVQRARPAYPPLRQRRPRRPGAGPVNRPASPAMRDDRELTPEQLAAFGAELDALRLRTLADLGADDARYIRRVRAAVRVCCWSGRALLMFGWLPPTWLLGSLLLGLGKILENMELGHNVMHGQYDWMNDPEFAGRAYEWDIAGPSDFWRHTHNHIHHTYTNVLGKDDDVGYGVVRLFPEQRWKPFYRWQPLWVTLQALLFQYAVAIQHLRLDKYAKGRLDKAELMPLLRRLRAKLGRQWTKDYLLFPLLGLFAGGFGAVFVGNLLANVLRNLWTFTVIFCGHFTEKAVVFPPSVLEGETRGHWYLRQLRGSSNLEGGPLFHILTGNLSHQIEHHLYPDLPARRYAALSREVREIARRYGQTYNSGRLGRQFLTVLRRIWVYRLPPREPLPAGRG

SEQ ID NO: 27306 - protein, 511 aa, Pseudomonas aeruginosa
ADGTLAAPVAGPLRSGDNAALCAATWLPAAVRRRSLAERRTACARDRPAASILPEPINARRMPAVGPVRPGTVMFSPLVTFPALYTATLLMLAGSGLFTTYIGLRLTQEGAGDLWVGGLMASYYFGLVCGGKFGHKLIASFGHIRSYVACAGIATVTVLLHALVDQLEVWLLLRFITGAVMMNQYMVIESWLNEQAESHQRGKVFAGYMVAVDLGLVLGQGLLALSPTLDYKPLLLVAICFASCLIPLAMTRRVHPAKLVAAPLEVRFFWQRVPQALGTIFIAGLMVGAFYGLAPVYANRNGLDASQSSFFVGMCIVAGFCAQWPLGWLSDRLDRSWLIRGNAVLLCLASIPMWGLVTLPYWLLLANGFVTGMLLFTLYPLAVALANDHVEQPRRVALSAMLLTTYGVGACIGPLVAGALMRHFGPGLFYMLVSGYAVLLVFWVQPKRVTGEHRVDEAPLQHVAMPDTVSPMAATLDPRVEEVPEELVVEAPANIGRSDGEPDAGEKPAQS

SEQ ID NO: 27307 - protein, 242 aa, Pseudomonas aeruginosa
PARGADSVTFLSCESHLRVPPAGRPSRLNPTEDRPMLRLKASPALFFGLLLASAASFAAQPPAGMLQPLRGTIQQAADDHLQLKARNGQQLTVRLTDKTAIRAVSLAKPEDIQPDSFIGTAAVPQPDGTLKALEVHVFAPSLRGSGEGHRPWENADGSASTMTNGTVGNLVVSQGRRMTVKYGDGEKTVVVPDDVPIVSLEPGERSLLKPGAKVVLFPQKGADGSLTALAISVGKDGVTPPM

SEQ ID NO: 27308 - protein, 442 aa, Pseudomonas aeruginosa
SSDASGGADGGAKDEGAGEEAREDRGRPVQRAADGRFATPPAVARRPVPGRPGDALGVPATGWRFGRQGTLGHVALERPGPGLAVQPYAAGADLRSVAGGLAVPLQRVLPGLQRAGDRPAGIPPAGFRAGPRQAPLEPGATAPAAAGQPGHATDLHRGLERDRPVERSAAAHLSGAGRRRHLGEVRWLQVRRPLLLQPRHAQRAASADAAGAGDVRTGAAGGERLSAAPADSHQARLQERQARGGDLRQQQQSRRLLGGPGLQLVQRSLRRESAACLGPCAQRDRDGKIGKPGIEPGFSRALRRSERSGGAQVETAHAAMQAVHGLFAAVVGQAGFGLGHVLVQAVDGLLAAVVGQAGFGFGHVLVQAVDGLLAAVVGDAQFDAGHILVQPVDGAAGAVGGEGGVGGQGGEGEAEDQGSFHDGDSEWVVDCVGVIFSSDKSI

SEQ ID NO: 27309 - protein, 710 aa, Pseudomonas aeruginosa
RAERGALPRLPDNRRGEKELCMTRGRKILTWSLASLVLLLAALVVFIATFDWNLIKPTLNEKVSAALNRPFAINGNLAVAWRREEGEEGWRAWIPWPRFSAEDITLGNPEWTAGKTKASEFASLERIEFRLAPLPLLWQTIRIPQIKLTQPRAELLRLADGRANWDFDLPASDSDEPSAWQLDIREIGFDKGSVSLDDQRLKTRLEVLVDPLGKPVPFGQLAGKALATGDAANAQDYVFGWKVKGTYKGQALAGSGKVGGMLALQDASKPFPLQAEVSAGSTRAAVVGTLTDPLNLGALDLRLKLSGTSMANLYPLTGITLPDTPAYSTDGHLLARLKEEGGALFRYENFNGKVGASDLHGSLTFVARQPRPKLSGKLTSEQLRFADLGPLIGADSNAEKQKRGQTSRQPGDKVLPVEEFRTERWRDMDADVEFTGKRIVHSDQLPISDLYTHLVLNDGLLRLEPLRFGVAGGKLESDIRLDGGKQPMQSRVKMSARGFKLKQLFPGFAPMQTSFGELNGDASLSGSGNSVAKILGGADGELKMLINDGAISKGLTEIAGLNVGNYLVTKLFGDDEVKINCAAADFGLQKGLMTSRLFVFDTENALVNVDGTVNFANEKLDLDVTPHSKGLRIFSLRSPLYVRGTFAKPDAGVHAGPLVARGAGMIALGVAVGPAASLLALVAPSKSDDNQCTALLQRMRQPAKVPAGKR

SEQ ID NO: 27310 - protein, 185 aa, Pseudomonas aeruginosa
AFPVPAAGYRQTTDCPWGKVKGFVPVRTFSERPPSPPGPNSEPIAKGDIPMPRGDKSKYSDKQQRKAEHIEESYKAKGVSESEAEARAWATVNKQSGGGERKGGSGRAKSETAKRADRKDSAHRAAQARSGRPANRGSASRGKRQGSTSVSEMTREELMQLARKRDIRGRSTMRKAELIEALSRA

SEQ ID NO: 27311 - protein, 154 aa, Pseudomonas aeruginosa
TSAHLHANVQPFKESSMNILRIPMFVLAMAVSAHGFAATAQQEKMTACNAEATTKALKGDERKAFMSGCLKAGAPAGGKATAQQEKMKSCNADASAKSLKGDERKAFMSSCLKAGGSAKAATQQEKMKTCNADATAKALKGDERKAFMSTCLKK

SEQ ID NO: 27312 - protein, 791 aa, Pseudomonas aeruginosa
PYPPIGQGRGQGGSAVALLRLDGQAAADAAEQVALDMTGVGQHRRDAPAQRRNAARTAGEEHRVDPVRVDPGRGQQLRDAVAHALQQSVDGVLEQPTGQLHAEPGLDALQREVQALGFGQADLAVFHLHRQPVPGAFLDEPEEAVDAGAVDDVVAHVLQRQLRLLRVHRVDGVPGGQVQVVAGGHEGVALHPAAVAEQRHHAFQAELLVEVGTADVYAAGGQDVVLALGQVAPLRRQAHQGEVRGAAADVDDQDQFLALDAALVVEGRGDRFVLEGNLLEAELVGHLHQGVLGLAVGLRVVVDEEHRATQHHRVEGLPGGGLAARLELADEQAEQVLERQGAAEHGGLALQQLGAQQALQRAHQPALVALQVLAERLAAVDRAALLDVEEHHRGQGDLAVLQLDQRFDLRPPPADGGVGGAKIDAQGAGGGARVHGAKRSGKKTAAQCMRERRRFHRRRSAGSVLGRPCGPPRPLYTDLPRGLRMVLCWRCFPTPSCRVVLDFAMHRASHHELRAMFRALLDSSRCYHTASVFDPMSARIAADLGFECGILGGSVASLQVLAAPDFALITLSEFVEQATRIGRVARLPVIADADHGYGNALNVMRTVVELERAGIAALTIEDTLLPAQFGRKSTDLICVEEGVGKIRAALEARVDPALTIIARTNAELIDVDAVIQRTLAYQEAGADGICLVGVRDFAHLEAIAEHLHIPLMLVTYGNPQLRDDARLARLGVRVVVNGHAAYFAAIKATYDCLREERGAVASDLTASELSKKYTFPEEYQAWARDYMEVKE

SEQ ID NO: 27313 - protein, 282 aa, Pseudomonas aeruginosa
TAARHRRRRRAPPGPTSRRWPGAAGARWRPAADWRRGPGAGRGWRHGRAGRSATARPPAAAGRRASPAAAKEPPAMPGAARQDPAARHRAAAPGCRAAVRRDRDDGADTGRAVAGRYSGPPAPAGRTDRRRARRRAGGPGRSGGRGGGTVPSCGVPPGLAGDCATPGRWSRRPCKAAGERPYLEVPGFQPEESVMASGWANDGAVQEQIDSTIEDAIARARSQLPRGESLTHCEECDATIPEARRRAIPGVRLCVNCQAEHDREQAKFSGYNRRGSKDSQLR

SEQ ID NO: 27314 - protein, 467 aa, Pseudomonas aeruginosa
RPASVFPIAFLHPLLHRRQGAHSHAQRIVHVMLAGGGPARVDEGPGQARRALVAVGAENVVEAQRLRVAQPLPVEAVAVDGAVRDPATVVVMESHHSPAMLAPVAGVVVDVEGFDEDFLPADVEEGRVIVGMARGQAQSAAVAEVDEAIGGVGRARRKAHQDPGVVVPLRRVGDQCLALRGGQREALAASADHVFQLTLVAWQGAVEAGVQVDRLDEPGDVDVEHFRIAGMGGQRAVLQVVDHRPARPSRTAGVGQVAQAQFVAAVAVVVGDFHLAEAEQLGEGIIGFELLARFPLRVRIEGDQLDLPVFPEAQLDHVLLDIQERGEVEQRGEEAGFGDVEHLHQRQVGPSLVPLQALDDLVVHGEGLADEAPIAVGDQEFLAEAEQVGALDLHLVVRRKAREDGLAQHHVLLADGNLAVLVELVGPVEEVAHHDDGRCLEGLGQIRGGSVAGRLAGGHGRTAGGYG

SEQ ID NO: 27315 - protein, 150 aa, Pseudomonas aeruginosa
RSAACLSRGGTSPSQVLQMRGGTASRPSSAGRSRRQSSISQARACSASSARQRATSRPPGNWLRLPRPAQGSARQRCSRSVSISPLATRVASTGCPARPIGESSRRSPPSMRWRSCQSRRSSRRMSRAATKWPLTKRSPLAGRPSATMSQ

SEQ ID NO: 27316 - protein, 298 aa, Pseudomonas aeruginosa
TSITCSSACTSASEPSASTWPWCSTVTWSAMLPTKPMSCSTTISECLRARDLNSSAVNSVSASVMPATGSSSSSNCGSCTSSMPISRNCFWPWDSKPAGRCRDSSRRMVASTSSMRSLCVPSSRARRLAHTDLSALCASSRFSNTLRASNTVGFWNLRPIPAWAICTSLMRVRSRVSPKYAVPLCGRVLPVITSIRVVLPAPLGPMMQRNSPTPMYRVRSRRALKPSKLTLMSSRLRMVPWRASSRPLVAAPRPMASRPLPAVSRPGWKAGSSIRCGVVLIAPSPCAAGRAGRAAGTG

SEQ ID NO: 27317 - protein, 141 aa, Pseudomonas aeruginosa
VAGSIDDPPFQGEQSLRAFLDEQDDQREDQDLAQHRADLRFEDLVRHAEAEGGEDAAGELADAAEHHHQEGVDDVALAEVRADVADLRQGYPAEPRRCPSRDRRRACPRALWAPRSRPPCCGSGSPRGRSGRAACGSAAAR

SEQ ID NO: 27318 - protein, 556 aa, Pseudomonas aeruginosa
RTRGPLGARPGRSRSVQGNAWSGGQGSSRQNSVALQRMLRLFLVARDERAPGLRAKRLGGLPNHFELAVVLDLADHHRLVQVVVALVHDQRVAGWRLEALPGHRLANLVDLGAAGLFHGLRPHVDADVGGFHGVVGHRGAVVRQVLCLGVGFPVGDELLVDRIAHRLEVVPCREVADQRLGVDAAQFFLAYGEGHHRHLGGFQALVGQFLVEGHVGVAIDGGDHRGLAACGELLDVGDDGLVVAVAERRVDLLDVLVVHALAVQEGAQDLVGGARVDIVGAEQEEAPGAAAVLAHQVLHRRDRLLVRRRAGIEDVRREFLALVLDRVEQQSVEFLEHRQHRFARHRGPATEDHRDLVLGQQLAGLFREQRPVRRGIDHHRLQLPAVDPALGVDLVDGHQGHVLQRGLGDRHGPGQRVEDADLDGFGGLDGPGQAHGSDGRGQREGLEQTATFHWCCSPFTSGRGGSFQEASCLSSGIRPVDGGVRTAAWISSSRLQSKGCASSWRWPVSVGEKAPRVAGEACRAGLAMPGKAAFSTGFRRISTEKAPWAPEGEASR

SEQ ID NO: 27319 - protein, 318 aa, Pseudomonas aeruginosa
PATGLARMRLIPALRAMILLGALLIPVSMISRMSWLRLGSSLIFAASCMPVMPGMSWSSRTTSKYSRRCALVRNWASASLPDDTALTFRPQPLHCCTSTLRQVSLSSTTSSRAPCSGPSRSAVGFSSCCGSSGRVSDRVVPWLLPDWMPNSPPISRTSWRAMIRPRWLPSLLAERKSPLCSSAVSSASRSLASNGWPLSCTAMRRRGVSPWSSRATTSRISPSSVCLNALSSRLRTTWRRRVGSPPMTRGTCGWVKLISSMRCCSALTRKISRQSSINALRSNCTSSSSICPDSSLEMSSISLISVSSSLPALWMVCT

SEQ ID NO: 27320 - protein, 469 aa, Pseudomonas aeruginosa
PSGRGNGICRGSAVRRPRLRARSGLAALAGDGTVADVLAVEAAVPADLLGQAIGLLLGGGHALADGGGTEHAAAGGDLLAILQRGAGVEHLAVQRGGLGQAFDDLALGVVARIAAGGQYHAHGRTRVPGRLDLVQRLGQGGLDQQDQGGLQADHDRLGFRIAEAAVEFDDLGRAALVDHQAGIEEAGIDVAFLGHAAHGRVDHFVQHPLVDLGGDHRGRRVGAHAAGVRPAVAIADALVVLAGGHRQHVLAVDHDDEAGLLAIEELLDHHARAGVAEGIAGEHVAHGGFGFVQVHGDDHALARGQAIGLDDDGRALLAQVGQGRLDLGEVAIGGGGDPVAGEEVLGEGLRAFQLGGAGGRAEDIQAALAEQVDHACHQRRLGTDDGQLDVLRGEVGQLLQGQHVDGDVLALGFGGGAGVARGDEDLRHARVLGDFPGQGMFTTAAADDEYVHGVLLAQRRVTRRVIRPA

SEQ ID NO: 27321 - protein, 521 aa, Pseudomonas aeruginosa
TADSLVLTVGRRAALAPGAPRERVGVAARRRPARSFRSLRGMEAQAVVHRLRTRVEDVQRHVDRYLRWHFRSSGQLAAEVLAGLEAAIGDEVAVEVGEAQFQQRERLREAGAIVDDRVDHQRAAEFGMAADHQVAAPDLLHVDLGGKGAADFRAELGEPGAIGVLARQFVEMVGDVLSGETAQRQQDQQQPAETPRPLAPGLLPGQLQWLVAQLVETLDRRLVRFAGAAQGRDGLFLGAFLVVFIQGAQAVAALAEAGLVVIVVIENEAKFRRILGAAQRHEGYPLFRQRFAEARFLARIAARRLGRFGIGDQRLGPAFVMWIAFVVAARQQAFRRSRGLLDAGEFLVQLEFVELGQFLVEVEAVQVEVVMDPQGFVARARCRGRGRGGGRDAGRRWRSGGRLRFGCRRSVRARRATDLVLQGVEDFQAGAAADRAIGGAQLRVVDAETGAAMGTLGDDAFAHAAIRRENPAASLPQASCTKAVGRDQWWLAARHQSARRRPLMRIQPSRSAVGSRSKCAE

SEQ ID NO: 27322 - protein, 194 aa, Pseudomonas aeruginosa
TGNRAGSIPLREALSREASRACGSMSVPTARSAPSSSAAMARIPEPQPKSSTCRPASSWPSSHSRHSAVVGWVPVPKARPGSSSRLTASGSGAACQLGTIHRRRPKRIGWKLSIQLRSQSWSAISSTWCSGRSPPVSKARWASRAVSSVSASNSASRWVRDHSGVVPRSGSKIGWSSASMKVTETAPTSSRASS

SEQ ID NO: 27323 - protein, 481 aa, Pseudomonas aeruginosa
HRWGGRQAETTRAARRQPLCAATDGSVLVHTQFLLQVMDVHPALAEGGVAHQVLVQFGIGLDTVDDQLVQGIAHPRQRLVAVGTVGDDLADQRVVVRRHAVAAVEVRVDAHAVAAGGVEVLDLARAGHEGLRVFGVDPAFQRMAADDHVLLADRELLAGGDAQHLLDDVDTGDHLRYRVLHLHASVHLDEVEAAVLVEELEGAGAAVANLDAGLDAAGEDFLTGLLVDAGGRRLFDHLLVAALQGAVAVAEVDGVALAVGKHLDFHVARVGQELLQVDHRVAERRAGLGAGQLGRLDQLGFVVDHAHAATTAAAGGLDDHRVADLAGDRQGGFFIFRQRAVGARHGGDAGALHGVLGRDLVAHQADHLGGRADEGEAGAFDLLGEVGVLGEEAVAGVDRGGAGDLGRGDDRRDLQVRLGGRGRTDAHRFVGERQVHQLAVGGGVYRHRLDPQLLACAKDAQGDFAAVGDQHFFQHRRFPAA

SEQ ID NO: 27324 - protein, 361 aa, Pseudomonas aeruginosa
PAIAAEVCQRMSLPGSGPAQSFGEPGGVDLSDDAQVAPFVTARGEEQDRRRTEQVVAVQQAALGRVAFGDVEAQQAVGRQSCLHRGIGENLALDDLATDAPVRIPVQQHRLAGLTCLGQGGVQLRRGGQVLPFAGRARRPGMDRRHRAAQRMDRVRLALQGADPGGHRVGQEHQAKQLQQAACGALRGEFEGAQGQAGAAGEHAPEHQRHRAGHHPLQQPHGDRQQQHAEGVAHAVHPGSALGQQGAAAGAEHHQRRTHAQAEGEQLQAAPPGIAAGADIEQRGGQRGGDAGRDQQAGKHAEGGRAEDRAAARIAGQAVERFADEAGHAQLEEAEHGHGEQREETPRMAPVPRVTAIAPGD

SEQ ID NO: 27325 - protein, 449 aa, Pseudomonas aeruginosa
GAWRVSSDYGTARPQVISVRLPADDKRPLSSVGTIYLDPVAPAVLGPVQRFVGLLGHALDIEVRGQLGDAATEGAAQVGRLRRVMDLGEALANLVEHQARGVQVGVRKDHGELFAAIAADVVGLAQALLEEQRQALDHPVAHGVAETVVDLLEVVDVEHREAQRTAIATCAQTGVLEQLQGMGVVVQAGQAVAHHPRLQAARAAGAGAHGGDQVARADRLGEEVVAAFAHGVQLLVQVVLGGQVDDRHADVAFVLADHLGQLGAQALGHVHVQDDQVGLEVAQLGHHRQRLGERAGDDPGAVEDHLGVQRLGPGVVDDQYPVGFVEAQAAEGLDLFQHAGGVQGAGEEFLAAGAGCGQAGRGVGLAVAEKQHRQLVFEAGLGLAGQSQAHVGAGEVDFHDDRRRVAFAHAGAEGVGGLAAQRLQTEELQLLGQALGAFAVLQCQVDRFA

SEQ ID NO: 27326 - protein, 322 aa, Pseudomonas aeruginosa
LCRRGGRHAQGVLRRPGPAASAHLLGERPGADRAPCGADHPGHRRRAAQRRRAEDRRSRRAAGDRPLAGRTARPDRCRDGHRDLLARHPLHRRRRRAVCRRQDQPGAESPRRAVLLRYLPAPAQPAQGPPALPPAGPRRTQRQARRQVHLQLLGVPEPAGYLGHRPGAADPAAAPPGRGAGSARGTAGPDLRLRRQDHPVRRRAEHRDQPAGARGEGGRGLPDRGIPGRRLPGDPRRHAQPVRRHRLGERLPARRRRHLSRRHRDPRHHRGHAALRAPVAGGTDDPLPRQGRRGQSHRPRAQPVPGCAAPGADPLGVPVLTG

SEQ ID NO: 27327 - protein, 341 aa, Pseudomonas aeruginosa
VEMQQVEEHRRSAERHQGLAATAPVQAFEPGQEQQADSQGEGEEQQRRRILGDVEEAHQGDRRRLAEGPGFLAIAVEQAQQDEAEQQPATARQEVASARGCRRGAAEPVACGIAQGDHTDPRQQGVGGAQAQGVARFDPAAVVEHRPRQVPGRAGSEMQRIEQVVAGHQQHAERREQRARQPEQGGQGEHAQADRPDHLEVDHRRRQLEGPGEVHQGQFQRHQEQPALEQERRDRPASLVLLAVEECRQAGEEDEHRRAQVRQGAAEEQRRLGAGDVHRVADLAVQEKGLADMVEQHEQHHQAAQGVDAVQAGGIGDGVGHGWAGRRKRGMSITAWRRDAR

SEQ ID NO: 27328 - protein, 718 aa, Pseudomonas aeruginosa
YIISFLVRFPMRVSVSLVLGVGLGCSSPALWAETESPAELEVLTVTAEAERAAGPVQGYRANRTASATRTDTRIEDIPQAISVVPRQVLDDLDSARIERALDFAGGVSRQNNFGGLTMFEYNVRGFTTSEFYRDGFSANRGYMNAPDSATIERVEILKGPASSLYGRGDPGGTVNLVTKKPQAERFARLHASAGSWDRYRSTLDLNTPLDEEGDLLYRMNLAVEDSKGFRDYADGQRLLVAPSFSWQLDPDTSLLVEAEVVRNRQVFDRGTVAPHNHLGSLPRSRFFGEPDDGKIDNNNETLQATLRHHFNEQWSLRLASHYKHGHLDGYASENSSLAADGYSLRREYRYRDFEWHDSITQLDLLGDLHTGSIRHQLLMGLEYERYHNDELILRSIPSRNPYAIDIRRPVYGQPKPPFGRDDRNHEEVDAMALNLQDQIEFSEKWRGLLGVRFDRYRQDMNATRLNNGRFRDTSSQQTQRAATPRIGVLYQATPEVGLFANASKSFKPNGGTDMAGKAFDPEEGRGYEAGVKLDLLDGRLGMTLAAFHLKKKNVLTADPSNPGYQQTAGEARSQGFDLQFSGQLTEQLRLIGAYAYIDAEVTKDENIARGSRLLNVPKHSGSLMGVYEFREGWLHGADAGAAVNYVGERAGDSSDSGFELPAYTTVDLLAHYPLASNATLGVNVNNLFDRRYYERSYNNVWVAPGEPRNLTMSLTLNY

SEQ ID NO: 27329 - protein, 564 aa, Pseudomonas aeruginosa
SSRWPPTSTWPCRRRAACWRATRTPCPDSSIAKERASAIQACIRSTAVRRRTPSIANGARPAEERGAAGGAGVLHLQRDERPGQGSQRHPAGCRDRVLPQRHRYPADLPADAPGRCRPVAPGRADAAGARGDGGAVPGLLFLRHRPYPAGGREHPGAHVAVLRHPLLRAVPRRADSPGGLLAVAGGGARRADDRQAVQLFQLLGIRRGRPAQCGVRRRCLGGDPPTERAAPYLRDRLLLPGGGHPGGHPADVERLRGAGDAARVGAAAGHRGGIATRPGVPNPRLQSRERDHRCGDPLYRHRLQRRLGLAVLERGAGRADHRRRRADRGGVHRAVADEEGLSLRRDQLPLLRAGPRLEYVAPDRHEVEEAAGDHEQVPDAMPVAEAVVIGIEDDPYGIEHAAGRQPGEAGAAEGGEQRFHRDQHDPAHHRVDHHRQHSRLGAWLDLLEHAEYRQAPDDAEQRPAPGTAQRDQAERRVAAGDQQVDGQVVELAHHHLRSPAHAVVGGRDAVEQRQGDAVDADPDDLPRTAVEARLDRQPDGAGTGGDRTDQVGPGIESFTVIHDA

SEQ ID NO: 27330 - protein, 73 aa, Pseudomonas aeruginosa
VMNFENSVSPGVSAFVAKMRVRAAQSPGAILPGHGHPASLAWRVDPAGGRLEYRRLETQVEENPESGRRPMRG

SEQ ID NO: 27331 - protein, 303 aa, Pseudomonas aeruginosa
RPSTSAASASGSEPSAGLRPGLSRRVGKPRRAAQRTPDPRMERRIMTLHDRRPRAPLFQPLPAALRRALSWRLGFVAAALACVLLLALLSEARAAGGAYRVDDGEIDPVGECNLDAWHQRERHHGNRYQSVLSPACTFSALPSVQLGAALVREGDAGDRHSRLSPELNTPMMARDDLGLALAFALSADLYLDRRHAFECAGFNLPLSYQPFEALRLNAGVGLGHAYAEGERRHRWNWGVGMEYRVGQPLTLIAERFGESAGDSGWQAGPRLHLGERLDLDLLVGGHLRGERERWLVSGATLRF

SEQ ID NO: 27332 - protein, 329 aa, Pseudomonas aeruginosa
VRRSAPTWQTSARTASATATPIVPRKSFCSPSTSSTSAISSPTACCPWRCAGPGAAAPAASSSWAACCRCRRRSRRACTWRSARSFAKTWTPRCAWWRARSCCSDWRPMPVASASVACATIAVPGWSPVTCSSAFSATTDASTIMSPPWPIRCSNAAASIRWRSGRTSQGKGRDRHAPPDLRRTPFQGRRTPAPGARPVPRPATGGAARPPAACRQRPAGRGRALVPRAWRGFARLRLSGAQWQRQRPARVWRGRPRRCRAGPGAGVSRRAPGQRTDTGRARCRRPADARLSSAVGALSGEPAIAAGQAPAVGGQDQPAQQHEGEERQP

SEQ ID NO: 27333 - protein, 423 aa, Pseudomonas aeruginosa
PVVAQPLQQPAEGQAGGHRDEHRVTHLAGAGGADEQAVEQIAPHPQQRQAGQVRQIGVGDFADVGDVALQVDEQVAEQGEQRGERQACQQRPTTGYHQRAAQGGSVAGADGVAAERLHRVGETVEGVGRQEQAVEQQGVGGYRGVAEAGALYGEQEKHQLQGQAADEDIPVDHQQRQPGQPVAQALPLRPPGAPGQVAAGQGQAEQGAAPFRQHRGAGRALHAPVEAVDEPEHQGDVAQVGGQQDRQWRPCVLRAEEPADQCVAGQGRRQAEQAGMEEGAGLAGQFRRRLHQLQGPAAQGQGQRAEQQGQEQRHAQALGEDQAQRAAIVAAGGLGGEAGGAHAQEAEHADHQGVQAAAHGYRAELVGVRQVADHRAVHQVHQGNGNVRQNHRPGQRPDPVVGRGVAPGIAQQAHGVLRIGRAV

SEQ ID NO: 27334 - protein, 305 aa, Pseudomonas aeruginosa
PSWSRASPSAPPWPPRREQAAGLWLPTWGIAGRLSATVARCSVRCRASSPSACFAYSATPSWCCCSATSPDSTTAWPSSPRPAHCCWRPITFIDSGPSHDDRTFPGVEARGPLPAQCGSAGVQRGGGAAGLPPAPGRRARRPWRRLRGALCRRRQHRPQRDDPRPATGRRPPGGRGPLHPQLRQGTGDERRAQAVARRRGDRHRCRPAGSPGTDPADARRLDRRRRNGQHAPPQPGRRKLAEARLGERLLPFDQPPQRGADPARRRRLPPARPAGGRCPLRAAGRQSLHEGTVRLGRFPPGRYRL

SEQ ID NO: 27335 - protein, 594 aa, Pseudomonas aeruginosa
PRRPRRRPQQVALLAAVELRPGRHHRVFHRAAEGRRLPRPAQPVGGPGDPARRDLRPAGDPRTLAGDRRAVPDRRPATAGHRRVQRIPRADDHGSAAPPALPDRPLPAGAGRRGQSVRALRGWPLAWFLLALAFAIRLLSLGSYPLMDTTEARYGEVARKMAELGDWITPWYDVGVPFWGKPPLAFWLSAGGQLLLGATEFASRLPHWLLGVLVLWLVWDWQAREDRRQARIACVLLGSSALFFVASGAVMTDMALALALVLAMRGFWLGLHGAEGIRRREGWLMFLGLGLGLLAKGPLTLILAGLPIGLWALLEWRWRALWRGLPWIRGSLLMLLVAAPWYLLAELKTPGFLEYFLLGEHWQRFVTAGWDGDRYGNAHAYPYGSVWLFLLAAAFPWSLWLPLLLWLGWRQRGEVVDGVASRRRYWLFWGLAPCLFFTFAGNVLWTYVLPGLPALALLAADLLRAPLARSAWLRRGGLACLALTPLLFALFLGSLLLGSRAEQKSTAALLASDAGWRERPLVFWPKRPYSAVFYSGGRAQRAEDSELAGWLRRDALLAIRSRSFGALPDEVRQRLRCRPPVGQYQLCQGVAPPG

SEQ ID NO: 27336 - protein, 349 aa, Pseudomonas aeruginosa
ASVPWVLPPYRPVLLVQRPVRGAGAQAYAADPAFGGAEVEAVAPPGQDLAARSGQGQRLAFPGQFRRRRAQQRAGLFQQRAEQDAEHQVAEIGQRLAPCGQLGRRPGRRSAARRRGRSPGSAVRSATGRRAGPAVHAVADAAPAPATVAPGSARRPVAPSAVAPDRGRRPRPRGPAPGLRRPAGDAGSIARRAAQAPVGRCRRSARRLARGRSRSVPGAPAASAFLPAPGPGTTGRRHPPRTRAPPASIRRAARARRIPGAGGPGRRPGRGRRRGSGSRCAGRGTRATAGSAPVPWSAGRRTSGSRRESRRASGRGRCRCRSAGAGSRPHRRRPDRGGGWRRRWRRHAP

SEQ ID NO: 27337 - protein, 351 aa, Pseudomonas aeruginosa
WRAPGAQLKHGSTPLAALSGWGSGPPSTCLANCLSNPNGVSTMNKNKTFLAAALVTLAASLPVHAATDYTRTRYPIVLSHGLFGFKSVGPVDYWHAIVPALEKDGAKVFATSQSPVNSNEVRGEQLLAQVEEVLALTGAEKVNLIGHSQGGMTVRYVAGVAPQLVASVTTMGTPHKGTPVADAVTGFSEFLGPIGTEVIASAVEALFSVVDIVDGGEWVKGDALAALNSLNTPGTARFNQRFPQAIPASACGQGAETVAGVRYYSMSGTGSLTNALDPSSAGLAVTGLLFGEANDGLVGQCSSHLGSVVKDNYRMDHLDEVNQLLGLVSLFESDPTQVYRQHANRLRNVGL

SEQ ID NO: 27338 - protein, 570 aa, Pseudomonas aeruginosa
PRPAVQLAAGLPDPGDGRRAGLRRLHRQAHGQAAAPGTAVLLAELRQVPRQPDEGLVRQVGDQGKQLVLRLAAQARHAGRRLRRAALLRHDVPGQGQRLLLPGLQPHRLVPQQGQGRRRAGAPEVDGGDGPAGDRDLGVLAQRRRVQRRRHRQHQDHGVPPAHLLLRRGRRLDRQQRPLVAVALEGRRAAGPGASGHRHHGRAVPPPARDVPQGRRGLPRPDPRPRLVLPQARRTGPGRTGPGVQRQGPERPGRPGQRHDPGQGRRAVAGFRPAARRRQHGERLLDLRRLLDPAGQPDGPPRQQRPLRHGPDPRLGLGLAGEPADSLQPRLGRRQRQAVGPGEEAPGVVERQVLGRHRRARLQGRRTAGSRDEPVHHEPRRGGSPVRRRQDGRRPVPRALRAVRDADRGEPLAPRQPQGDQQPGGTGVQERHGTVRHGRRVPLRGDHLPAHRALPLLDQALPAECDHPARAVRRDRRGAGQGAGHQCRRQGQGLLQPRLHQGGGGGDQAHPPAAGGRQDRAPRRHPDPLGLRRHGAQRLPGQYPDPLRGRREYPDAGVQVVPGQRGKGVR

SEQ ID NO: 27339 - protein, 310 aa, Pseudomonas aeruginosa
NMSSQDIHARSATTTPMPSVRNQEEVAKLIDVSKCIGCKACQVACSEWNELRDEVGHNHGTYDNPMDLTADSWTVMRFTEHENEAGNLEWLIRKDGCMHCAEPGCLKACPSPGAIVKYANGIVDFNQDKCIGCGYCITGCPFDIPRISQKDHKAYKCSLCSDRVSVGMEPACVKTCPTGAIVFGSKEDMKEHAAERIVDLKSRGYENAGLYDPEGVGGTHVMYVLHHADKPSLYAGLADQPSVSPLVSLWKGVTKPLALLAMGATVLAGFFHYVRVGPNRADDEEDHGQAEAPVHQVDPSVHTFDPHERR

SEQ ID NO: 27340 - protein, 121 aa, Pseudomonas aeruginosa
PPCACSAARRRRSAPRPSVWRRRWARRSARAGRSPWSTPLGMIGSGAQPVARLPSAALCLRPRQPRRLRGRALRNLEEALRGLPLPVIGRLEDDALWLDLRQLDDEPGFLAQLPRLRSELS

SEQ ID NO: 27341 - protein, 1073 aa, Pseudomonas aeruginosa
  UNSURE (803): Identity of amino acid at the above locations are unknown.
SRVGAWPLRSRLIMLDSIGTSWWMASTSAARKSGWRRRRIASARCSCQRSSAFGAMACMDGTARSCRCRRRIASRVGRTQRLPQNGVWPAARCSCTLGASIREERQPDERKNARHVPPRRRRPGPCRPGPLHARLPRVRRPPRQRLAEHRRRRRRLYLRHRRQPLPRRGGRHVVHQHRPGARGNGSHRGRADPPAGLFQSLLRHGQPARHRTLPQARRAGPRRPRPRVPHHRRFHRRGHRDPPHALLPELPRQARQEARHHADQRLPRLDLPRHVAGRQERRPAGRVRLPRRAHPPPCLSLLLPRSGRSGRGRVPRWPGGGVRTQDPRTGRRPGGGVHLRAGVRLRRRDRPARGLPPADVGSVPALRRAVHLRRSGDLLRPPRPLLRQPGGVRRTAGHHPHRQGPHLRLPAAGRVHLLPAHLGGDRRAGQGPLLQPWFHLLRPPGGLRGGAEEHRDHRARGLARPRRRGRPLLRGAPAKSPRPAHRRRRARDALHGLCRVRRRQGEQGAVSGKPEHRRVGPPAGAEARPAGSSDRPPERDVAAADPHPRTGRYRGPGAAREHRGNRGGSCPRRSPVSAGAPPAPHPNIQENPNGRQQEQGPAVARCGALHGLGDALHGPDRPGFLPRSVEPVLVALRAGPAVPADGHDDLRAGHRLPRQRRRLPLGAQRLRLPLGGPGVMDVLGQQRTVDAFGLHPVRQHARRLLFPRAEPLGQDRHRHSPGAAHRGVQRGRAAPGQVAAEPRRAAQAARGARPGRRRPALRLEPWLRQRLQPGLHRPVLAGPDGRAGSDGLWHHGDRAGLLXRRGYAQRAPRHPARGGDLRADRRRLQHLRHPRRAGRGTGRGNRRHPDLRPYPLQHLRPRRRRRDARRPGRRLRPVHPLHQHGHLEHGHQPCRGGSGQGRRAAGAVRRGPFAPRHADRLGGAGLGGEHRPAAALRPGGAHCRGTVLDPAVDLRHGFHDALCADVPGLRPPAPRRPASTALPDAAGRPPGQSLGAVRRAACAGRHLPVRRHPRRADGLGLRRQDRRRRGAGPGRGRTADPPGGAKARRDVTARCLRLRSGPVATPPMALMCR

SEQ ID NO: 27342 - protein, 165 aa, Pseudomonas aeruginosa
RASWRARRTGAHACLGRTGMAEINPLSTDLQQQLAELQAQGLALLGVAADETPAQIVAAVTDYVRDAREQGRSLDDEAVFALGALIGAQYVRGLGWHWGDVTWDGDPDSAAVGVLSPDESLFNNPIGWVSQIAESGGGVPFMLSYNMILANQVPLFERGSATGLY

SEQ ID NO: 27343 - protein, 78 aa, Pseudomonas aeruginosa
ACRRIAATRRRIPPGGADNLNGRRQAPRPAEQRQPANEVRVTVVEQTLPLRNRACGAFQEGSLERRDCRAHIGLQFRD

SEQ ID NO: 27344 - protein, 296 aa, Pseudomonas aeruginosa
DPPVPGDARTRVGATVRTAQRLLHRHAPRIPGGHRLRRQRQRYRHRQLLVRPPARRHPRRAARRRPAPESLQGVPALEPRGTLRPLRGRTAGDPDVLHAGRGQGMTCVEAERGAPLRVVVVGTSGAGKTTFSAALAARLGCTHVELDRLYWGPGWQAVPHERFEHAVERATTAPRWVADGNYSAVRELLWGRATHVVWLNFGRWTVFSRVLRRTLARGLLRTRLSHGNRESLRMAFCSRDSILLWSWTTFAGNRRKYTGLREDPRFAHLRWVEVGEPGRVGEVIERLVEAALAQSQ

SEQ ID NO: 27345 - protein, 450 aa, Pseudomonas aeruginosa
NPGVSDVQRLHPWMLRIEPIQAHALGECLPRRVSLEKRAPRRGPVVRLQPYHPALAVAIPVDQRRALDHRRVARQQGPGQRAAGRGGSLGELDHAEAAVAFDVPAVALGGEGEDFAIQRAAVGAQAQGQAAVDFLAQPQVVVRGVEQPVGELQAVQVRAHRVSTRSDSRISRASSPPLEISSSSSISSLSSMFTPGWRHISRRAPASRAWRMKWRSGSPPSSARNWSATGRRANCTPSPLRNRVTSASMQASRVAVWKGAAQRAGVLGPLETMMRTRWAWVSGFKGLVHLDQRHAPAVRIVAFGDGARLVAELGIEQQPGGVGVEAGNLHQARFVLFAGEVFHDPDQVAGHAQAARGGRHHHVAEGAEVAVLPLVEVGEAEHLSVVHGHGAAAAFGDGGGQLGDAERPDRLGVAIEEFVAVLGEAGDRLQVTGLRRAVAELHVSAAGIAT

SEQ ID NO: 27346 - protein, 331 aa, Pseudomonas aeruginosa
SVSTSNVGEHPPYRARRENEMNRSIAILLLGLSLTGCVEARSVVPADGPGPLLVAHRAGTADYPENTLLAIRKALDNGADALWLSVQLSADGHPVLYRPADLAVLTQGAGAVGQSSLAELARLNAGYMFKAEDGSYPYRQKPLRIPTLRQALRAIPPQVPVFLDMKSLPVEPLVDAVAGELERQKAWSRVRFYSTEKAANDYLTQRYADRARQFESRDATRNRLVGLAFGERCEAPPAGGTWMGIELRRELTVTERFTLGESSYKVPAAQLWTRKAMDCVRREPVKVVMFGIETAEDYRTARALGADAVMSNSPRKMEAIRRRVLADQPGG

SEQ ID NO: 27347 - protein, 382 aa, Pseudomonas aeruginosa
DGPAPWITRKNTMRDLTDDVALMRPVIDALRASGCDPDRVLVRVGLPPGGLPAGRFPHSAQNLFWKAAADECGEEHVGLHLAEHLPAFHGLLLEYLFLSSDTFGAGLRHSLRYVRLLSDTLQAQLEVEGERAVLSLGESPAINRHFPEMLAGAVIRLFGALTEGEFKPLEVQLMNETGAPMERYRAVYGCPTILGMPRYALVFDAAVLDKPSRHAAPELLRMHESLARRQLAEVERLDLVRQVRELIGELLVDGGATLEQVAARLGMPARRLRERLAMAGVRFNDLVTDYRCRLAKELLLKTDERIEVIVERTGFSEPNTFYRAFKRWVGETPGGVPPARASGARVGPVRKGATGSASCCRGVRGRLRPPAGSARTPSAPGR

SEQ ID NO: 27348 - protein, 225 aa, Pseudomonas aeruginosa
RVEPRLGVNDSSKEFFHDPAAPGRHCRRQPYSLRPLEHRVRHGEQPGDAHFRPGRPGGALQPARRAPWRGGGRRRAEAFARLQPDPRMRARFAPGPGNPGLRYPAGLRYRPGGGDPGGQQDRPRADRQRHRRRRRYHFRRADRGQRGPAQDSPRGQPRQEQPGQAQEPAEDPPAPRGPGHPAQRRAAHRAVDGGVLRTDGADLADPPRRAGQAGLREPPQAGRGL

SEQ ID NO: 27349 - protein, 407 aa, Pseudomonas aeruginosa
RSPPGGPVAKAGGAMESMLDRPEQELVLVVDDTPDNLLLMRELLEEQYRVRTAGSGPAGLRAAVEEPRPDLILLDVNMPGMDGYEVCRRLKADPLTRDIPLMFLTARADRDDEQQGLALGAVDYLGKPVSPPIVLARVRTHLQLKANADFLRDKSEYLELEVRRRTRQLQQLQDAVIEALATLGDLRDNPRSRHLPRIERYVRLLAEHLAAQRAFADELTPEAVDLLSKSALLHDIGKVAVPDRVLLNPGQLDAADTALLQGHTRAGRDALASAERRLGQPSGFLRFARQIAYSHHERWDGRGFPEGLAGERIPLAARIVALADRYDELTSRHAYRPPLAHAEAVLLIQAGAGSEFDPRLVEAFVAVADAFAEVARRYADSAEALDVEMQRLEQAVAESIELTAPPA

SEQ ID NO: 27350 - protein, 338 aa, Pseudomonas aeruginosa
YADRCAVRRKAGASGCARHGVCRITSDPLPYTLAPRNRVAPMKTPRRLEPLIEDGLIDEVVRPLMSGKEASVYVVRCGDSLRCAKVYKEANKRSFRQAAEYQEGRKVRNSRQARAMAKGSKYGRREQEEAWQNAEVAALFRLAGAGVRVPKPYDFLDGVLLMELVADADGDAAPRLNDVTLEPDEARRHHAFLIRQIVAMLCAGLVHGDLSEFNVLLGPDGPVIIDLPQAVDAAGNNHAFSMLERDVGNMAAYFGRFAPELRQTRYAKEMWALYEAGELTAETPLSGTFVEAEEAADVRAVLREIEAAQREEARRQALRQADDAPRGEREEPPPPWLQ

SEQ ID NO: 27351 - protein, 201 aa, Pseudomonas aeruginosa
RRALPTRLPTIAFSHRSMPITCTVSWCNDSSMSLSMAWRASSESTSSARVARLTGWNCSSRASPSRRARSRICSIKVLIRSTLRLTCSRPRAWALGSSERSATWAWVRRLASGVRISWAASLVSRRSASRAVRRRSSRRLSSSMRPRISSGTASTAIGCRCRAERCWTSACTSRSGARPRATPNQTRPPSNGSASSSGNSE

SEQ ID NO: 27352 - protein, 146 aa, Pseudomonas aeruginosa
AVFRAPAGRCRSRCRGRCGSTGCRACAAGGGRGLRWRCSRRRRSSRRGSAPVGCARAPCRCSPAAGAAVRIRAAPVPPPARTGSPGGSPGPGAARRAPVAAGRDRWCGGSGRAPVPAVRRDRRAWSGSRRHRCRARRPGRPPCPAR

SEQ ID NO: 27353 - protein, 195 aa, Pseudomonas aeruginosa
PSCQAKTARPSSSSRQRSGLPMTSARPGRHSTRSPNEGASRVGWRSSSPAAIQASRRWRQACPVCSPALAKITSSSSSTAVSGSSASSLSSMRCARTASAGCGSRRVASSGRPPPSAAERKRTRCSRQGAPLTASGTLARGAADIFRSSPGPAIVPGRTRSPRYPAVRRRVRRLPVPVPVGRAGSGFPGPSRSRP

SEQ ID NO: 27354 - protein, 293 aa, Pseudomonas aeruginosa
GPWPRAFPFRSVRAGCAPRPRRRRARAYTKARPSSTLSAPRAIIRTTSRPVRMPESARIASSPFTASGDCPAAPRALDSTPSSWRPPWLETTMPSAPNFTASPGILRVEDALDHHRAVPELADPLQVLPGNRRVEVGAQPADVVLQSGRVAAVGGNVAEVVGLAQQADVPGPGRVGHGLQDAARRGVGAAHAGMGVAVAGAGDRHVDGEHQGGDAGGLGPLQGVAHEAAVLQHVELEPHRPVDGRGDLLDRAHRYRRQGEGHALRRRRARRLDLAAAGIHAGETDRGERHRHR

SEQ ID NO: 27355 - protein, 272 aa, Pseudomonas aeruginosa
SARSAVAACRKTSEARAGTRSVVLAVAHGALDLPIGVALLLGVALVEVLLALGQGDLALDQVLLPVHRQGDAGVALLLHGAEQLAQFALVQQQLARAHRVGDHVRAGGGQGRDVAAEQPGLAILEQHVAVDQLGLAGAQAFHFPARQGDARLEALFDEIVVQSLLVLRDGPRRVFLLLSHRRRIIGSRRLHRYGAASRLRDRGEFRTMPTLFLAAGQGFVRKVFKWRQAALSVFSAEPWPRSTGAARRRGGCRRPAGYAWGVARSTAEVRVL

SEQ ID NO: 27356 - protein, 136 aa, Pseudomonas aeruginosa
PSITPGRWSRRPLGRCSPRPPTPWSTRSASAPSNSMAEIAVEVVYALPERQALLRLSVPAGTSAREAVLLSGIGEAFPGLDVQGCPLGIFGKLLARPEERMLEAGERVEIYRPLIADPKEVRKQRAARARSEREGG

SEQ ID NO: 27357 - protein, 193 aa, Pseudomonas aeruginosa
RTADPGSTDPRAAHRRRRGPDRPRAGTGGAAGCRPGPGAAHGRGSAERTPACGAGCREGAQVRAGEIRRRPAGGGRHPRARPGDVRSQRRGDQADARRDGTDPEDVRRHPAPLPGGGAEPGRRAFQPRAAPGDGHAGKRFGRAGQCPQGVPERLPAQRPPAASGDGGSQQGAGGNPAVHRRAGLKFDATTPSG

SEQ ID NO: 27358 - protein, 657 aa, Pseudomonas aeruginosa
STEHETHGRVARNQSFWRVNMGKIIGIDLGTTNSCVAILENGNVKVIENAEGARTTPSIIAYTNDGETLVGQPAKRQAVTNPQNTLYAVKRLIGRRFEENVVQKDIQMVPYSIVKADNGDAWVEVKGQKMAPPQISAEVLKKMKKTAEDYLGEPVTEAVITVPAYFNDSQRQATKDAGRIAGLDVKRIINEPTAAALAYGLDKAKGDHTVIVYDLGGGTFDVSVIEIAEVDGEHQFEVLATNGDTFLGGEDFDIRLIDYLVDEFKKESGINLKGDPLAMQRLKEAAEKAKIELSSTQQTDVNLPYVTADASGPKHLNVKVSRAKLESLVEDLVQRTIEPCRTALKDAGLDVSDIHEVILVGGQTRMPLVQKTVAEFFGKEARKDVNPDEAVAVGAAIQGAVLAGDVKDVLLLDVTPLTLGIETLGGVMTGLIEKNTTIPTKKSQVFSTADDNQGAVTIHVLQGERKQAAQNKSLGKFDLADIPPAPRGVPQIEVTFDIDANGILHVSAKDKATGKQQSIVIKASSGLSEDEIQQMVRDAEANAEEDRKFEELAAARNQGDALVHATRKMITEAGDKATAEDKATIEKALGELEAAVKGDDKAEIEAKMNALSQASTPLAQKMYAEQAQQGEDAPQGEQAKAADDVVDAEFEEVKDNK

SEQ ID NO: 27359 - protein, 372 aa, Pseudomonas aeruginosa
AWRQRGGPEEGLPPPGDEISPGPQSWRQGSRGQVQGGQRGLRGPLRCQQAGGLRPVRPCRRRSEYGWGRWRRFRRGELLRHLRRCVQRFLRWRRCPRWLARRRAARRGPALHPGPRPGGGGTWHHRHHPRADPGRLQDLQRQRRQARYHTGHLHHLRRYRPGAHAAGLLLGPADLPALPRHRQDDFRSLWLLPWPGARGRAEDPVGEGAGRRRHRRPHPPHRRRRGRQHGWSGGRPVRGGQCARAPDLPARRQASVLRSADQFRRRCAGRRAGSADPGWPGQAEDSGKHPDRQAVPPARQGRGPGARRRRRRPDVQGGGGNPGEPGQAPARAARGVPQVVAERHLAFAQGQWLVRRHEAFLRRPINKAMGAA

SEQ ID NO: 27360 - protein, 279 aa, Pseudomonas aeruginosa
QPRPGSAWSGFMRRIAVVGAAGRMGKNLIEAVQQTGGAAGLTAAVDRPDSTLVGADAGELAGLGRIGVPLSGDLGKVCEEFDVLIDFTHPSVTLKNIEQCRKARRAMVIGTTGFSADEKLLLAEAAKDIPIVFAANFSVGVNLCLKLLDTAARVLGDEVDIEIIEAHHRHKVDAPSGTALRMGEVVAQALGRDLQEVAVYGREGQTGARARETIGFATVRAGDVVGDHTVLFAAEGERVEITHKASSRMTFARGAVRAALWLEGKENGLYDMQDVLGLR

SEQ ID NO: 27361 - protein, 217 aa, Pseudomonas aeruginosa
SASPDSVRRCRRWCWCRATGRGASGETFAVSCCSPSRCSAWCISWCVGWRPRRCAGCCSTTWRWRCVACCWCCSRYRGGTRKASEPGREVSRPWLDGASDAGETADVREILVRLRVLPIDQRHLADALHQVAARLRAEFVEQGAAIVALGQRQFHLDQFVIVECALEFGENAFGQAVLGYDQYRFQVVTDRFELFLLLLSERHNQTPGKKSSILPQF

SEQ ID NO: 27362 - protein, 141 aa, Pseudomonas aeruginosa
VRRDLSCRGKLKMLEKVVIVVHLLMALGLVGLILVQHGKGADAGASFGAGASATVFGSQGSATFLSRITGILAAVFFLTSLGLAYFAKEKSDALQHIGLPDPAVLEQKQEKAPAADDVPVLQEQSKPAESAGDVPAAPEQK

SEQ ID NO: 27363 - protein, 177 aa, Pseudomonas aeruginosa
RQLRDFPSLARRRRRGLPGPRHRDHRRGRPGAEAGREGWRGHRRKDRIHRVRPHRCADCQAGHRAKGPRGRARPGGRCLPREGRRDHFRYREEGHPRQRHRRSRQQRRGAAGPRPDHSARDLPRWHPRACPAEGDPDREPRSSTGPVAYRAGNADRAVPHRSAGNRRAVDRRDGSRP

SEQ ID NO: 27364 - protein, 228 aa, Pseudomonas aeruginosa
DHHRSRVGRPDVGQGRRSRQVHVQDGLPGDHQPGPGPGDRPTGRRRAGPQGQAGQRERAGRTTGRVPEVRRRGGHPRAGRHRHGPRRPRQDLAARLHPSRQGRRGRGRWHHPAYRCLPRRNRAWHGDLPGYPRPRRVHRDACPWRPGDRYRDPGGRGRRRRHAADPGSRAARESGGRADRGRGEQDRQARGQPGQHQERPGRSRRDPGRVGRRRSLRPGFGEARYWRR

SEQ ID NO: 27365 - protein, 95 aa, Pseudomonas aeruginosa
TARSGPAAGGSARTESHSVGPGPWRGGRVAPGQGTRPGGHRAGPGRYPAPGRHGAGRHQLRSCPRHARRERQADQGSRPVDPGRDPRPGRYAGCR

SEQ ID NO: 27366 - protein, 231 aa, Pseudomonas aeruginosa
GETGACPCRQAGKHLREHGPGREEDPEHRPQGRCARFARGSARLAQRPGQRRSAGPRGRWRRRWHHRVRRQPGAGFQRGAVRLQRARRRRRAQDRRSRRSGYALLQRDLRHHRGRQEGPDRHARQRSAGEHPGHRRGARRVPLAEVRRDRRLHGHRGHGAPQPSDPRAARRCGHLRRRAGVSPSLQGRRRRSACRHGVRHRREELQRRQGRRQDRSVREGRSRTQPLMASA

SEQ ID NO: 27367 - protein, 464 aa, Pseudomonas aeruginosa
PQRPGRLPAVPGVCRFFFQWPGVAGGRLKNGKRLQPYPAYRRSDATRTGSTDPARDQGPAPGPGHHHRCRGQPRRGARQGVHHRHGPGRCRQDRPEHGNPQRRRRLPAHVAGQVDEAAQRAATAFPLRRKHPPRRRAVRADRTCGGRRRPPPRRRDRGLSVAQVKRIRRSISGILVLDKPRGMSSNQALQKVRWLLNAEKAGHTGSLDPLATGVLPLCFGEATKFSQYLLDADKGYETVMRMGITTTTGDAEGELLAERDVTVGRDDLEQALPRFRGDIEQVPPMYSALKKDGQPLYKLARAGEVVEREARSVTITRLDLLSFEPPCATLAVSCSKGTYVRTLVEDLGQVLGCGAHVAALRRTQAGPFALAQAITLETLERVHAEGGPEALDQFLMPEDSGLLHWPVLQLSEHSAYYWLHGQPVRAPEAPKFGWLRVQDHTGRFIGIGEVTDDGRIAPRRLIRS

SEQ ID NO: 27368 - protein, 154 aa, Pseudomonas aeruginosa
PTSSVIWCRTRWTSGITSTPSTSTLSPIGRRSAVCSTGRRSEALIASPSNIARIASLSRASSASFTSRSMVSWRIRFFEKSRNSPQALKENRLKRSGSSMNAWRILKSCSSWRWAARARQLSSCVASSGVRWCFMADLLVGIRWRTYLNMKKPG

SEQ ID NO: 27369 - protein, 334 aa, Pseudomonas aeruginosa
RCSCVESVFGGGEGHVLDGADIGRDGGRDALLALHEILDELGRAAGQRETEHVVHDQHLAIGRRTGANPDHRDLHRLGDLFGQHAGHALQQQHGGAGLLQGDGIGAQLARLGFLAALDLEAAEQVDRLRGQAEMRADRHAHLCQAGDRLRQPGPTLQLDHVCAGLHQADRVGKGLGHGMAGFEGQVGDDQGTFVTAFHAGRVIGHFLVADRQGAVVTLQYHSERISDQKHVHAGLAGGVGEGGVVAGQHGDLLAALLQPLQGGQGYIRHGKAPRWAGDEPARGKRPLIVRMGWLEVNCRCYRIVTALLPLPNAAPPAVARAVYAHPRRPSSAFR

SEQ ID NO: 27370 - protein, 338 aa, Pseudomonas aeruginosa
RSSRNCPVLARVFRSRWVAAIRRTSTFCDCTEPTRRISPSCNTRSRRAWASSGSSPISSRNRVPPSAASTSPARPALAPVKAPFSWPNSSDSIRVSGIAAQFTEISGALARFDRLCRARATSSLPVPDSPWISTVESVGATLRILLYSSCIGAQEPMMPISPSAAAGLAPRSPPALPPLAEDRGRAAVLLAVLEDARHGLEHFVVVERLGDVVHRAHLHRIHRRTQAGVAGHDQHRNAFGELDQFGAGGARQAQVADHHVEGGDGVALLGFLHRAGFADLVLVALQQASQCRSDNGFVFDDQNMCHVFSSLDVLVYSSAVGPGCRGRVTRKRVPPSRW

SEQ ID NO: 27371 - protein, 236 aa, Pseudomonas aeruginosa
TSARPSPVPLPGSLVVKNGSNNWSMIAFGMPLPSSSTTRSTVCSEASLRTRIAPPGGLASRALESRLISTWARRCESPSTQCAGSQRLKNSTSTLRRFSDSSPMASWATSLRHTGSRACRWLPEWAKLINDWTMRDTRLVWSRICSLISVSSPSPSRSSRRFCARQAMPVIGLPISWATPAARRPMEARRSEWTSLSSNSWVSVRSSTSSTRPLLPGARGSSMAALCRFSQRVWPS

SEQ ID NO: 27372 - protein, 464 aa, Pseudomonas aeruginosa
ATLIRISWVRLKLVSIALALQDESDHDEDQPQQVRAVPGAVGVDPPVHDGGGKEIDAHDQEQDQSVDVHAASLMLGPAGYRLRVGAGKPPGGLQAFLGKGSAARDARGVPVRDAPRQRLAGAGLGQFGRRPLAERAQGAGLRRGGLLGGQWRGAVGLAELVPVRLDDQRHVQVARLAQPQQFLEVKLARGPLEQVGAADDVGDALPGVVQHHRQLVGVEAIAALDDEIADLAAEMLVDFALHAVDEAIFQLRHAQADRRILAGVPGVAAEARVDPGESLKLLARASAGVGQAAAQQLLDHCGVVREAFALPLHRAVPFEAVALQGFQDRLLGARDFAGRVEVLHAHQPAAADGTCVQVGGDGRHQGTEVQVAAGRRGEAAYIGRGHGASGAAGNGGNETGRLGAPSVRLRSRVASRGFPRGSCSRCRGSRWGAPPGDGCRSRRRRSRTSRTLRLRSVAGSRRSS

SEQ ID NO: 27373 - protein, 224 aa, Pseudomonas aeruginosa
RAQSGHRAFPCHGPAGAGQRVAGRRPRCDPPGDRRAGLHHGRADRRGRARRPGRRAYPLHRRPRPAGAARGDREILRRTLRGRPRPTARAGHSGRFRSPAAGQQLAGRPRPPLVARRPGLPVQQAFPAPGGRRRATGAGGAGQPLPTDTGSHRAALGLRQCRRSGGDAGESDRDPARSRRTGRPVGRLEGPRRAPGGGRDLSRADLWRGRRVGAGSRRRRFRPE

SEQ ID NO: 27374 - protein, 371 aa, Pseudomonas aeruginosa
AGEAGSEPLHQRAEHGPAGRAGLFRADHHRHSRRASRRVRPPSRLPPAGPARAGFRNRRGAGRRLLSLRRYQCVRRRCLRLLQALHRDRARGLHSGAGFRPPPGRPPRAFRLYPEPAAPAGSGGADRPRPAGLAALMRFEQPLEEGRLLRRYKRFLADIESAGGERLTIHCPNTGSMLNCMSEGCRVWFSRSNDPKRKLPGTWELSETPQGRLACVNTARANRLVEEALLAGDIAELAGFTALRREVAYGVENSRADFRLEYPTGALFIEVKSVTLGFDETAVAAFPDAVTLRGAKHLRELAALAREGIRAVQLYCVNLSGVEAVRPADEIDPAYGKALREAAQAGVEVLAYGAEVTTEGLHLARRLPVRL

SEQ ID NO: 27375 - protein, 421 aa, Pseudomonas aeruginosa
GMAAPWGAATRSAAFEQDAAFHVVGVGELVEQRAAADPVRVVQLSDVLRQGFRVARNVQDALEAPGQLAGVRIHAGSWRIDEDTAEGVALQVDVGQAAERANLVQRLGQLFGRQAHQADVVHRVVGQVGQRRIDRGLADLGGQHLAYPGGQGQGEVAVAAVQFEQVVVALAERLVGPAEHLLVDLAVGLGESPLGLAVAEAPAGDRQFLLHIVASDDDTLAARTPDQVHAQFRRQLFRCLSPGVVDRPVVAEGDQRVAGQGGEKLHLEQLEAQRRVGPGRLQARHQFVDAAAGDGEILDQDRRVLVALLEHRVVTLLVAGFPPQTKFGAQPVMLARRLEDLGRGCRERGQQTGEAGLLVFQLCGVGAGVELWTAHALKKPSLITNRTERITSAGFSSRQRPDSTLIAVQEMKPKAMPVAIE

SEQ ID NO: 27376 - protein, 81 aa, Pseudomonas aeruginosa
VNGMASAVTTTGAATVMSSQSISARPEAISTATKSSAGAVAKAGTLPASGAKNSARRNRMATTMAVRPVRPPALTPAADSM

SEQ ID NO: 27377 - protein, 215 aa, Pseudomonas aeruginosa
LVVVEVPSSEPPMAAVLSAISARPIFGMWPSLPISPARLATPIRVPELSNRSTKRKAKITLTRPMSSAPLMSSWRKVGASDGGIETTPPNWVTPSRMAMAVTTRIPISTAPVTLRASRATIRMKPRVARIGAGLVRSPMPIRVAGLSTTMPAFCRAISARNRPMPAAIAERSGRGMLLMIHSRMRKIDSRKNMVAEMNTAPSATCQLWPMCSTTV

SEQ ID NO: 27378 - protein, 462 aa, Pseudomonas aeruginosa
NGMKNARGDSTSSLSAFMFADKKAPGWRFPGRRSGRRRSDGSGRLRYSEDSMAESRPARRFARIDRLPPYVFNITAELKMAARRRGEDIIDLSMGNPDGPTPPHIVEKLCTVAQREDTHGYSTSRGIPRLRRAISHWYRDRYDVQIDPESEAIVTIGSKEGLAHLMLATLDHGDTILVPNPSYPIHIYGAVIAGAQVRSVPLVPGIDFFNELERAIRESIPKPRMMILGFPSNPTAQCVELDFFERVVALAKQYDVMVVHDLAYADIVYDGWKAPSIMQVPGAKDIAVEFFTLSKSYNMAGWRIGFMVGNPELVSALARIKSYHDYGTFTPLQVAAIAALEGDQQCVRDIARQYQQRRDVLVKGLREAGWMVENPKASMYVWAKIPEPYAHLGSLEFAKKLLQDAKVSVSPGIGFGDYGDDHVRFALIENRDRLRQAVRGIKAMFRADGLLSPQRKVDSLAE

SEQ ID NO: 27379 - protein, 209 aa, Pseudomonas aeruginosa
AVSTCDEAMRCPPRRVAVGQGRIVAANSSARFGSAVLRVAGAFAAGVELTAGATGPRRKGMLFARLVLLVQALVWGALGVLYWVRPYEMANLSGMLLMEPSAVSDARVFYGGHQFALALFLLFALRRASLVQPALILVVLLQSILTLSRLLIAWIEGGMEADGNLFGLLFRGAMAALGIAALWWLQRRPPRLSAPGESAERREDDFDGL

SEQ ID NO: 27380 - protein, 513 aa, Pseudomonas aeruginosa
RDRTGYARGTVDEQHSQPFPFPCRALPRLAGPARRATAATRARRRRAVAGQRRRAGRQPGRHRCCAPAAGLGRLAAGARRTGADHGADPQRALRPRTQGAVSRSDGLCQWADGPGGLAGYRPAPVPGGLERCLRHCRGDSAGYPAQHPGVRPAGRGGAQGVPYRGQRRPRLGAAGRAPAGCRAGCRAGAARTPRTGCDARRCADRCRRLARRLGRVEGHPSFPRPAEEAWRAAHPGAAPGWRRMGRAPGQWRPGETLRSGGRKRIADHGVRRQRPLHPDPYRASVQPEVAGRLVQRARSGIQPALEDHRHRRTLAGAQAEHRWHRNQLGGLRRRRRTDRATVRRAQARRARARRLARTGRILQGALRRDHAYRSTIQRVGAGHPARHRHGPGRRAAATLGERGRLAERMGGGVGRREQVGRGGHHQPASAGAETVAERRLPAPTGCRGRAGVASGYPHRHRGNGASAGTQAARRRRRASRDPLRQAGSGGTGKQSEEARRLARRAPARRGRRT

SEQ ID NO: 27381 - protein, 388 aa, Pseudomonas aeruginosa
RTTAGAGPDAPGGRPRSAPAGWPGGSLRSLLSFRETAEYGSRPLKSVVRPRALFGALGISLVLVLWLSLALGPVSLPLGDTLRAALRLAGLPLDGTGLAQAEMILGQIRLPRTLLGLAVGAVLALSGVAMQGLFRNPLADPGLVGVSSGAALGAALAIVFGASLGGLPAFLAPYLLSLCAFGGGLGVTWLVYRLGRRDGQTSVATMLLAGIALTALSGAVIGLFTYLADDATLRTLTFWNLGSLNGASYPRLWPLLLVALLVACWLPRRADALNALLLGESEARHLGFDVERLKAELVLCTALGVGAAVAAAGMIGFIGLVVPHLIRLVAGPDHRTLLPASMMAGAILLLLADLLARLALAPAELPIGIVTALIGAPFFLYLLLRGRA

SEQ ID NO: 27382 - protein, 192 aa, Pseudomonas aeruginosa
CCAWRTCPSAVAERLYWKASSWSCGLARCSAYSAPTALARAPCLALSVANWSRPKGWCCSTSAASTTGRASLARSAWRCCRRVRRWASPFRWRRWSASVGCPIPAAASAMCRSSPRPWRRPTPGIWPGAATWRCPAANASACTWRGCWRSCGRASRGRCCCSTNRPRRSTRCTSTLPCRRCMISPAAVPRCW

SEQ ID NO: 27383 - protein, 303 aa, Pseudomonas aeruginosa
SSPVEGVAMRIRLFAFCLLLGGCQSQLPPLPDWQSPEGRDDPQTGRIVELRSGVTLSPQQLVARLAAAPRVIVGEKHDNPDHHAVELWLAQALGEYRAQGSLLLEMLDPGQQPRVDAVRVQLGTGKPVANLEQALDWQKGWDWTQYGPLVSWAVAQPAPLLAANLQRSEIMRIYRERPPLPGTASRRDSVRLPLLAQIRESHCGMLPDDQLPAMLAVQQQRDRRMAERLRDAPLPAMLVAGRFHARRDLGVPVHLRDLGAEKGAQVLMLVEAGQAVTTREADYAWYTPAQPDKDYCAEMKKAR

SEQ ID NO: 27384 - protein, 465 aa, Pseudomonas aeruginosa
KNYSAFSVMRAKAFFPAWNTRVSPSASMKGAVDDLPIHLDAASTQEIASRSRILHQPRLIKDRGNGHILGGRQLDLRQVFRQLALLQTIAGRLVCAHRRLLAMEAGDDLLGQLDLDVTRVGARLDVLAEAIDLIQGTEAEQFEVTPHQRVRNGDQLAVHDTRRFLDTNIVAQRLGHLLHAIQPFQQRHGQDHLGLLAIGTLQLAPHQQVELLVGATQLDVRLQRDGVIALDQRIEELMDSDGLIAGIALAKVIALQHARNGVLRGKTNEVSRGQLVHPGGIEGYFGLGRVEDLEDLGLVRLRILQNLLARQGRTGNTFPTGVTNHPSEVADEEDHLMPQVLELAQLINKHGMAKMQIGSGRVEAGLDPQGLATLQLGHQFRLYQDLVCTALDQRQLLFNRLHLQVLPNCQDRKGTNHTRSQTKNKFCRPSGGRSQARRDFWLDSRRFWLYFRQLFIHNPKTPITP

SEQ ID NO: 27385 - protein, 178 aa, Pseudomonas aeruginosa
CDRCARSQNSGRAVSRLKRKRRAYKRGVFVAAPSTSDRERLSATASRGGVRVLDDEPRTFQAFLVVDFRARQVLEAHRVHHQAHTIALDHGIVIGDIFVEGEAILEARATAAGDEYTQFQARIALFVNQRLHLVGCAWGKEQGRRGEGLDAHVSESPGLRPCVTTLRPLSSCPRKMVN

SEQ ID NO: 27386 - protein, 158 aa, Pseudomonas aeruginosa
RVPAMPLLSGHRDQEDVLMYLWLKAFHIIAVVCWFAGLFYLPRLFVYHAMSEDQTSRERFCVMERKLYRGIMMPSMLATLILGLWMLYLTPGWLSQGWLHAKLTLVVLLIGYHHACGAMLKRFARGEPGRSHVFYRWFNEVPVLFLLLIVLLVVLKPF

SEQ ID NO: 27387 - protein, 198 aa, Pseudomonas aeruginosa
LRRPGIPRRHHPPPRRKGRRGRGRRSDRGGGRRGRARRDLEPFRTGRGNPPVLRQDSAAGRLHQPRPRDSRRTDARRRPGLSRHPLHRHPREQCLRRLQADDPGGTRRRHRAHPGGVRRTGQLHAAKPGGRRLRSEAPDRQGRHELRRETQAGERRGQGLEDRVVRRPGRGQHRRLARRRRVGRPPRPGISRRPAEHG

SEQ ID NO: 27388 - protein, 237 aa, Pseudomonas aeruginosa
SWWRASATRWRASPMSCRSVSAWKCCSATCDLSEPLQLSGLLHELEQGERQIDLLVNNAGIGTSGPFIDQEWAREQELIELNILALARLCHSLGARMAAQGGGQILNIASVAAFQPGAWMSNYYASKAYVLHFSEGLREELKGRGVKVSVLCPGPTRTAFFREAGMRLGRLDRSKLMMTPEEVALLALRGLDKNRALIVPGWRNRLLALSPRLAPRWLVRRLAARINASAVPSAPRG

SEQ ID NO: 27389 - protein, 358 aa, Pseudomonas aeruginosa
LELGAVQLGQVLLGDRSIVADHVARQQSRLGMAEPAQVLHHLLQGPVVGAHAGTTVALAPARRFLADDAEQFVLAGQGQREPRGEALHLGRQLQRMGHQHHGRSMIAFGHGDFLEQAHQGRAVAKERMQVAEHVEIRLLIVLDQAQRRDRVAALLPAQRLAAEAQALHALGHRPGIQAKAAPDRQAGEGFHHLRLVPGLDQDQLDPGIQDQAEVVYVVLHCGSFTLGRSRRAPLHSGKHPRPEESPMDCLFCKIVAGEVPARKFYEDEEVVAFHDIGPQAPVHFLVIPKRHIPTLEHLTEADRPLAGHILFTAQRLAREQGCEEGFRVVMNCNDLGGQTVHHIHMHVLGQRQMHWPPG

SEQ ID NO: 27390 - protein, 226 aa, Pseudomonas aeruginosa
TGAIFRFRRCAMSADRHYSPIDRFLLQADSALRTLLPFSGQPARPSPAIVEPDGELSEEDTRHIAGLMRINHTGEVCAQALYQGQSLTAKLPEVREAMEEAAEEEIDHLAWCEQRIRQLGSRPSVLNPIFYGLSFGVGAAAGLVSDRVSLGFVAATEDQVCKHLDEHLAQIPQEDRKSRAILEQMRIDEEQHSSNALAAGGLRFPAPVKLGMSLLAKVMTKSTYRI

SEQ ID NO: 27391 - protein, 400 aa, Pseudomonas aeruginosa
IARMKKPARSGLFLPRVRSARHVARVEDLQHFVLEPFRDLLTLFRRERPGSVAEQVVLQFEVLEQHLGVEQVLLVHVHVGHLVGLARVVGEIVLDRVDLVVDEMLAPLDVAGEAADPIVDRDDVRVELVDQVVQGLQRGDHSAGGHIDVHAEGRDAVHRMDFRVGMHGDVALVQVRQDGVRQRARGLFDLAVGRSDRLLGDQDGHAGALGVVVLTRDVQDIGADDVDNIGKNLRQTLRVILFVDVLHVGLEVFGRLGVADVVDVEAQGLRQVVEPVELEFAFHRGELSRLLAALPQGWGMPVRCERRTCVGRLTPLRDGDCGLLSCTGAGWRHWSPDRDGSGNVYQSGRIFRTERPPDGIARHEKRGALCRANQASARVCAPFMMTGCRLSRVRRSRSRG

SEQ ID NO: 27392 - protein, 301 aa, Pseudomonas aeruginosa
KRPVATGLFHGVRQRGSVRIGAQHHTTTLLEEQALQLEARIVGPHERLANQEGVDLADFHQLHVGPVENTALGDHQAVAGNFRQQVEGGFQAHLEGVQVAVVDAHQRRVQGLQCTFQLGAVMHFDQYVETDRLGSRRQFGHQHVVQRRDDQQDAVGTDRPRLDDLVRIDHEVLADHRQRTGGPRFLQIGIGALEEVHVGEHRQARRATRLVAAGDLRRDEVFAQHALARRCLLDLGDHCRLLALGPLQQGIGEAARRIGATRQPLDLCQVDARTALGDLLGLAGEDLLQNRRHTHCAFSSL

SEQ ID NO: 27393 - protein, 185 aa, Pseudomonas aeruginosa
MPSCRLVARSAAYSAGPAFITISSAAFCPASVLRRPKASRISSSEACGLSTSSPIRVWLLIPKSSGRTSYSRTSPSFNSAMWVAAARLNSSSPSRECTTSTCSLPRRLSTSASGLHSSWVNTPTTWCLTPAGLVSGPSMLNRVRKPSSRRGPAAYFIALWWTWANMNPTPTVSMQRATCSEVSSR

SEQ ID NO: 27394 - protein, 441 aa, Pseudomonas aeruginosa
MPAASSKSALPLLPETARLPCLATLPPAAATTKDAAEDTLKMFAPSPPVPTTSTTCFSVGNCTPSASSRITATAPTISSMVSLFIRMPIRKAPICASVHCPVMIWRMTACISSVVRSSWLTMRLRAPLISISVALPTHAALLAEEVGQQLVALLGEDGLGMELHALDIQGLVAYAHDLVERSVGMLGPGGDLQALRQALSLHHQRVVARHRQGIGQAGEHAEVLVVDRAGLAMHHLPRPHHFAAEGLADALVAKTDTEQWQLAGEALDHGQRDAGLVGGAGTGGKDDALGRQGLDLFHAQFVVAHHLDLGLELAEVLHQVVGEGVVVIDHQQHAGCNLLISFLCESHHPAFATPGSRRARGGRGSGSSALCLWKTGDAGRRDRPGRRRRSQARQRQRANALMREVMMLLRWITIAVSRSHVGEHSPVGRMGATAGCRKKEA

SEQ ID NO: 27395 - protein, 60 aa, Pseudomonas aeruginosa
EPLTCLDFNISFQQKRKVMKLSIYYSLPQAIPYQDPILTHTLATTYKVPEVWNSDGHQSS

SEQ ID NO: 27396 - protein, 178 aa, Pseudomonas aeruginosa
PSSTRRRRCRYGRSSDRGTPAVRRPVSAIPGGYCLGRRTGPAPVRSPRCRREWRTAGSRCRRCPLRRWPGTPTPGRCARGRPRSAGRPAPAAAWSCPQERSPHCWRRPSRPPSRSRRVPAPDNDRHRCPARRNRAPRFAAPAPSCPSPCAIRPRRPPRSARHPRRPTGWSPPTPGRPW

SEQ ID NO: 27397 - protein, 150 aa, Pseudomonas aeruginosa
PCRWRRSASNARTLACSESPAFSVAPAQLGGRTSGTRQGTARGTSTRTGRGVVGEAAQPAKSRQSPSRRRVIVPAPGRSPHLPPGSPCQSRVLGADARPRHTAPRPAPWPRRVPARRPSRASRRSPAPPPARAAAHRAKPRAGRWRRGWQ

SEQ ID NO: 27398 - protein, 586 aa, Pseudomonas aeruginosa
QRLSSMSPSAVRQVVAIALELQVEGLFAGSAVAQQGALVLADPHQTPEAHLHLAVAAAQDQRLTPLRQPAQRFELLQTDDLFLVTYLSTQREYRTLEQDALLAHADALQRRPPTQAHLPAPVVGTVALQGVEGGSIQVEVERLGIGGQRLQYQQVRQGRCGLARGRRRGCQQPRRQHPRQRRTDVASDLADRLRGTVYLHLQRIHAFVDTKQRPARPVIGGDHAVHLALRLADAAHGTLQPGSHFRRYAGQVLQLRGCAADLADRTVHRSDHLVQTLASGLAGATQVPQAGLQLFQICHGDSLDHRRVVEAAPLPLVGEVDKHALQVGQQLVGQALRLVYVALHRQVDLRREGPVGHSRDGFGLWYGHRRLVVRGRRRIASQTASQTPPQFATAPGADSAANQSTDQRTDHRHHRADARSQSGASQGTSQGGTGLAIGDGLFALRQVAGVDLSNIDQRRGHLQRRVAYGQTRQARQLSCHRPQASSSREAKGWKGAGLQPTALASLPAWCLTALSLCRPPRGLQRRVASRHRPVGNEHALYFATTRYPACTPFDQVADGSGPSPTEPTATQHVDSAAPSLVGEIPG

SEQ ID NO: 27399 - protein, 446 aa, Pseudomonas aeruginosa
ASPAVDSLGSCPELLLQAEVVAHAGQLVDTVDRADTVDRIDLVDLAAIDFQLVVADRNGVLELGFLAGLPVARVDLLEQAAQGSHHWHAGALLALEGAAEHAIESALVGQAEEIQCFSAGTVGGELGLHRLQAHVDGYRRIHAAGTVLLGLHSQLGQGQGWHVTGEAHAVDEQVGIGQGLRNHHGRSLGDIQNFGEPLIGHLDTEIGVLGRRHIGEADVPVHLALGQLAGAVQVRVGIDLEVDHRALVLQIAHEGAQALGDILHVGLGDAAVHRPLVPGEDRIHHQVHGPNAGDESPLAVAGQGAIAPQAIAIVANDRGDIGVVEQVGATGLITVEELHRTAGAGDALDLLVRRRGPEAVLGVGPGEQAGGVGRSRGLACGIGGAVPNLHARVDHEQALAAEVLGVGDGRLVGAIGTIENGDGPQFLGQPVHGGGHRLLGRMTRRN

SEQ ID NO: 27400 - protein, 615 aa, Pseudomonas aeruginosa
PGHVAVEHLRLRHRLRPRSARRRRVRRDLRTTQGQRQASGDRQYPRRPLRQPRQDLHRRALYQQAGQYQLLPRRRLQHAQGIHPYAGGFRPHQLALLPGPPPPDPEQDPRAQGRRLRCPHRHTDQGHRRRQDPRSRTQGGLRQRRGDPARPALSDHLRTHEPLRQGYPRRYQREAGPDHRLRGHDGPGHRPTPALRIPDQWPSRRSAECQAAHGGPARWRRSQALHGADPADDRAHGSGEENPPGPEQAALIVPRYLGLMSGTSLDGMDIVLIEQGDRTTLLASHYLPMPAGLREDILALCVPGPDEIARAAEVEQRWVALAAQGVRELLLQQQMSPDEVRAIGSHGQTIRHEPARHFTVQIGNPALLAELTGIDVVADFRRRDVAAGGQGAPLVPAFHQALFGDDDASRAVLNIGGFSNVSLLSPGKPVRGFDCGPGNVLMDAWIHHQRGEHFDRDGAWAASGQMNHALLASLLADEFFAARGPKSTGRERFNLSWLQEHLARHPALPAADIQATLLELSARSISESLLDAQPDCEEVLVCGGGAFNTALMKRLALLMPEARVASTDEYGIPPAWMEGMAFAWLAHRFLERLPGNCPDVTGALGPRTLGALYPA

SEQ ID NO: 27401 - protein, 434 aa, Pseudomonas aeruginosa
GVLRCATPRFRYAGAPARPSARRSGFPGVANRPRCERRPPRSTSDRRETPAEPPAAAHPPRGGPARPAVDHGTGVPSRTSGEQGRMREAQALVQPEQDVHVLERLTRGALDQVVDHRQHHHQVAALGAMHGDSADIGATHATGLRMAAGRHHVDEGFVGVALLEQRLEVDRAIRDMGIEGCMDTADHWRQVRYERQPDVAAGGPTQALADFREMPMPLDRVGHHAFARLAEQRANLGAPTGAADPGLAIGDQPRGVGQAGLQQRDQAQLGRGRVATRHGDQAGLADLLAVHFRQAVDSLVEQRRSAMRLAVPARPLLGVRQAEVSGQIDDPGPRVQQFASQRVRHAVRRGEEHHVAGAEALHVRHAELQVVIMTSQVRVHVGDLHPRLGTRSDHFHPGLRMLRQQAQQFHARITRTANDADLDHLSITPRAEAS

SEQ ID NO: 27402 - protein, 338 aa, Pseudomonas aeruginosa
SSYWWCSNLSDPGVLSMSLPALLDQRLRLPMVAAPMFLVSNPQLVLACCRSGIVGSFPALNQRESSGFEGWLEEIGAGLQALDNPAPYAVNLIVHNTNPRLQADLRICVEHRVPIVITSLGAVREVVDAVHSYGGLVFHDVTTRRHAEKAAEAGVDGLIAVAAGAGGHAGTWSPFALVAEIRQFFDKTLLLAGCINHGHEILAAQMLGADLAYLGTRFIATRESNASDAYKQMILEARAADIVHTPAVSGVPASFMRQSLEAAGYDLKRLTDKADMNYGEKLKPVNDEAKAWKTVWSAGQGAGNIDDLPGVDELVARLDREYRDALRNMDSLANRWPR

SEQ ID NO: 27403 - protein, 156 aa, Pseudomonas aeruginosa
PDVVSAEFDDLVVVGDLHPAATEHDRRRAVFLRRQLHRALDLGLLETAALDHEVHVDLREHLGLLVGPFGLEEGFAALHRLARLLQDADHIEVGAAAEADQDHLHRAHPEVASAMVRRTVHDHHVAATGLAEEHRLARPLDTRFHRSDSRRQRAPA

SEQ ID NO: 27404 - protein, 133 aa, Pseudomonas aeruginosa
TSLTSISSTSARLRIPLSVTTRRSRGISGNRSRVVSRLTSKVCRLRLLMPTNGVSRVFSARSSSVPSCTSTSTSRPTDLAVAASSAISTSSSAETISRMQSAPIARASTIWYGSIMKSLRITGSAQAARASFR

SEQ ID NO: 27405 - protein, 1021 aa, Pseudomonas aeruginosa
RRASGLGLVFGGPYGFLLGCPGNGLPAAQGIGHGAIAVIRVVTGRRLQYAKARCLGGKAAVEFADFSGMARHLLRQPVGGFQRLADIGPVGRVRRRRLRRHSFQGLVQPLPLSHHVVLRVDLSRVVQQNVGEVADLLLQAPDIHLHPLDIGEELLAQRRLDVLLGDQLVVFAGVAGAGAGDPVRPGADVAATVDQATAERQPFAGRYRRYQVGIAWVGEQAQRPCGLLAAAGSGGLLDLGVGGVRCAAGREPPLQADAPGAGHAAQVGQRRRRRGLALKSGLHTAGVDRADLHHVQGAYPHQITTGIDARHVETERRGSRHPHPVARVLAPFGLVGHRVRRGIPGGRQAGHRQPLVDLGESLDPHVLRRRLHARRNAGDRRQLDARTVVDGVELARVVLQRGDLEKIVLRPGDAHDAEALGGQAVALQRPLPLGPRRLRIGGGHGQHAAYHRLDAARLGLAVRQVDQQAIAGSGLDVAVEGQRAAIHRAQASADLLAGLDRVGYGDDLPRRQPTAIHAGAEGHRVLLQLLGQQRPLATPLRLALGGAADRGDLQLADAVAALRSIIVHRYRLALVAVARIVVVDQGQGVAIALAAAAVVEVAAVVATHGVRRREGVGLVLRHVGYRHHFRAGPVGHAAEDRCQVAQHCPGFGATLQVQVAAEARLLAALAVGHRLVAVLGDAVQRPLVDHARVDPPTEAEALVQHDVVPVPGRVAGPGRLERAVPGAAVATGLRIVVARHPHPPAARFHRYLRNALELAGIELDEQQRGVRVAQLGVDHLGDRLDPHGVGDAVVVLVRRQAAHAHLPAAPRLRQVDTVGALVAAGGLVVQRSLQRFLPGTAVDGDVDRVVDAVADHVTVFLLALDGRPGQAQAHRRELGVAHRADPGRVTLEFDADRQFVFHGGHTGNVFLVHRARTELPGHSGEVHRAVRRQQRRIVQVDRTAVDATVKLAFAQCQENLRPRDRAHRVRHLHRLARLLAATLVARDGLVHDVPSGKKTPAHGGPVTALPATAGPRHRCRR

SEQ ID NO: 27406 - protein, 197 aa, Pseudomonas aeruginosa
GPDSGCHSWTCSSRKEPIPTARLNMSFTAASACAARPGACVRSRVRQTRRGSTAVRTGGAAGTVRRRRAPGPARCPDASHCPGRCPRGSGAAPSRPASPACRRGGFRPAAPAGIQPPHSAARRGSRRFPTNRRGADSPEAPDLPRGGTSRDRGSSSRARRGRTRGRAAAPDSPPALDARHRLPARTGSPRADHAVRN

SEQ ID NO: 27407 - protein, 141 aa, Pseudomonas aeruginosa
SVPDQPFTILHTRPPGRSSCATTLRAASLIIPASCCPVPSSPLAVAAPSRPPPRLTLVEKLKTLPPSPPPSARTPSTPSEPRLSGMMASGPRSPISAGRPPAMLNSAGALWMPSLKAPPLANPGMPPARCLLTQLAMSEPV

SEQ ID NO: 27408 - protein, 169 aa, Pseudomonas aeruginosa
SLILPTLSIPALYPSLRRTRSSVRLPSVFVAMIHVFQKKTPPQRGGLSCPLIHRLVQRKGLESHMRTERVGIGVRSQRMPEQRSDPSQRKLQPVSRMERAALVQIGDPGAVLGVAEPLLGLGNGRPADAVQHQFVPNLVGGGQFFSASSTRLTSPTACSSRKPSAGSRS

SEQ ID NO: 27409 - protein, 142 aa, Pseudomonas aeruginosa
LLRSVSMRATVVRLFLGQLANPQAPGGPAFVETDCDLRAGRGGQAAQRRGEQQRGAASQRQQHHRHAADDRRAGAQRQAPQQGPAAETGLVGTPHLAADAAQRGEQDQYPERHFRQCLRFVAHGSLLGRQRRARPHERFPGQ

SEQ ID NO: 27410 - protein, 492 aa, Pseudomonas aeruginosa
AVIYSQSKNTNHAMTQSDQKAPPYYPKSHLLAASGVAALLSLALLVFPSSEVEAKRTTLNLELESNTDRLLQEKDDLLPQSVTNSSDEGTPFAQVEGASDDNTAEQDSGKPGASVADADTKPVDPEWKTITVASGDTLSTVFTKAGLSTSAMHDMLTSSKDAKRFTHLKVGQEVKLKLDPKGELQALRVKQSELETIGLDKTDKGYSFKREKAQIDLHTAYAHGRITSSLFVAGRNAGLPYNLVTSLSNIFGYDIDFALDLREGDEFDVIYEQHKVNGKQVATGNILAARFVNRGKTYTAVRYTNKQGNTSYYRADGSSMRKAFIRTPVDFARISSRFSLGRRHPILNKIRAHKGVDYAAPIGTPIKATGDGKILEAGRKGGYGNAVVIQHGQRYRTIYGHMSRFAKGIRAGTSVKQGQIIGYVGMTGLATGPHLHYEFQINGRHVDPLSAKLPMADPLGGADRKRFMAQTQPMIARMDQEKKTLLALNKQR

SEQ ID NO: 27411 - protein, 375 aa, Pseudomonas aeruginosa
AVGCISLTPADKDACMTDQRFKIVFSGELMPDASLETVKDNLARLFKSEPGKIDALFGGRPVVLKRELPEAEAERYLTALRQAGANAYKEVDLAASLSLVETPDHNPQVAEETPAQDLPPMTCPKCGHEQPSGAECSACGIIIEKYLARQAQLGENAAPAASAAAGAGASPYTPPSAQVGEALPEFGELNVFTTNGRIGRLRYLGWSMAMTLCFLVIMGLGFLLGETVGVAVTALASIAFIVIAVMIGVQRLHDLGWSGWLWLLNFVPFVGSVFGILMLVLPGSTGANRYGPPPPANSTGVKVLASLIILLPIVGIIAAIALPSYQGYLERANYDGGASAPADPYTTDEQAAAAAAEADEAATAAAEAMEDDDQQ

SEQ ID NO: 27412 - protein, 105 aa, Pseudomonas aeruginosa
PRNPSRRAGSNSPSVSEKSRMPRYALITGASSGIGLALAEALARRGRALILVARQRDALESIAYELPQRFGVEVLFRNLRSFRAAATVRVVARTGTGRTTDRPAG

SEQ ID NO: 27413 - protein, 437 aa, Pseudomonas aeruginosa
PGNPGPGRGRVCRSSLRLLHAWAVATGTATLGKAPEAGGIAHGLSVLQDRGGGSSRAQVLRRRGSCRVSRYRPAGAGALPGHPEKAHSHPRAPDRGRPAAGRPYPLHRPAPGPGAGLRGRLPCGDELQRPWRADRAPHPHARAGSTPDALAAGLSPCWRCDIAARPQHPAISALPVNWCDLSFPEVRHVRRPPLFAHRPFPAAGRLRPAHPAAVQRPAGATVAGHRGTRWRTERGRHPPYRRPDAHQPHRRGLRPGAVPGPVADRQAARGPRGDGGSRRGGDRPPGLVRATHPPVGQPSQRPQSDLLRPVLRRRCRRRAGQRPGQPGLRRRHRRPGVQASGRTPGADSPGGSEIPCHPRADAYRRGTAFEQRPGRRRPALPGTGEAGHEPAGEGDDQEHLPHLNRTHEKARSKRAFSSSCAISAACCARRRSPAFRA

SEQ ID NO: 27414 - protein, 279 aa, Pseudomonas aeruginosa
LRRKITSTFMVRLLSWTRFTGTLPDLPGWGELSAELPGPGRSLHKNSKKHRLVRQAYSLFFRDSGMVAITHTPKLKHLDKLLAHCHRRRYTAKSTIIYAGDRCETLFFIIKGSVTILIEDDDGREMIIGYLNSGDFFGELGLFEKEGSEQERSAWVRAKVECEVAEISYAKFRELSQQDSEILYTLGSQMADRLRKTTRKVGDLAFLDVTGRVARTLLDLCQQPDAMTHPDGMQIKITRQEIGRIVGCSREMVGRVLKSLEEQGLVHVKGKTMVVFGTR

SEQ ID NO: 27415 - protein, 397 aa, Pseudomonas aeruginosa
RAHGARRPPRPCGRGSSAEPSAHSLCVLLSVNGGEGHQFVHLLPCQPGVQGIVGQLNALVQAGRQIGSVQCRAGIHHDQLGGLLPSLGLAPPQSVADQFQRGLRTVDLQPHQGLALDPEVLGTHFVLAYLAVLQLGNVGRRGQTELVQPVARMHHQHMLAAETLEHFSQRLAQFLGEHPDHLVPDSRRVGQWAKHVEQSPQAQLAARTGGVLHRLVVDLGEHEPDADGVDATRHLFGGQFQVDAGGFQQVGAAALAGDRAVTVFGDLAASGGDHEGRRRGYVEDVRAIAAGADHVDHMLQRRQLHAVGQFAHHRHRADDLVDGFALHPHAHQEGADLRVGALPGHDLAHDRLHFLGGQVELVDDAIEGSLDIHLSCPPHARRPAGGGSWPATRGPAR

SEQ ID NO: 27416 - protein, 160 aa, Pseudomonas aeruginosa
MRDIAFRPGQDHPGQTMQFATDPIGHARRGRNVRVAVDDGQDLALVLGGAPVLVIDHEVLAGRSGCVATGHVAALTHTANDQPAAFARMLAGGVCGDGPLQAAAQFHAHILTRPAPAKPPWDSGLSAPKRSLQSLTRPPQRSSAGSSTGLPSASNIAVPV

SEQ ID NO: 27417 - protein, 102 aa, Pseudomonas aeruginosa
TACPSFPRRPAPGRAGSPRRRPSVRPNCPPACQRPKPLQPRPWNRPRSARKQWPPSRRHPSPLPALARHPGPRERPLPLVPQLRGPFPVARYRASGWPVAPR

SEQ ID NO: 27418 - protein, 91 aa, Pseudomonas aeruginosa
RRERNRERNRSIGIGGASDLPPLPNEASVIVPPPSARPKGSSRRNPCSDSATCSRCRIRTDAATCQGENARSKLSDVMVMCGWWKSGRFSR

SEQ ID NO: 27419 - protein, 247 aa, Pseudomonas aeruginosa
DLAFRRRRLVELRLGCASLPRRAAQRHRGSEGRRQRGAGQRRGGQSQGAEDQPGRTGGDRRDTDGQRRHPRRRLDHRHRRQQQPPHPLNIRRGGRRAVRRTFNRPARAGLFVCGVRHGQHSQPFGARRGLSLPEREGRAMIGMDRRSGLPLSGLAHLKQSVEDILTTPLGSRRMRPEYGSKLRRMVDMPVSEGWKSAVQAEVARSLGRWEPRIALSAVRVVAVVDGRVDLLLSGVFEGEHINMEVSA

SEQ ID NO: 27420 - protein, 195 aa, Pseudomonas aeruginosa
MKPRRPIARGTRSPWEASMSSRLLPPNRSSLERSLGDVLPAELPVPLRELNDPARCEAALLPYWAWTRSVDRWDPDWSDEAKRNAVATSFVLHQRKGTLTALRQVVEPIGALSEVTEWWQRSPLGVPGTFEITVDVSDRGIDEGTVLELERLLDDVRPVSRHLTRLDLRITPVIRSRHGLAVTDGDTLEIFPWKQ

SEQ ID NO: 27421 - protein, 225 aa, Pseudomonas aeruginosa
AMGAGHLPRRCRCFDYVPDSFPYAMPRRICESDECFPSGNGCQYRFPWSDYHYRGDSQWLLCSGGSFMGGIWTMKGEYYFSPSQVAFYPASLREVYEYAGCWPVDGEWVSAELHEQLMNEQAAGRAISSDVNGNPVAIERPPLSRQQRSAHERRWRDSQLLATDGLVVRHRDQLETGKETTLLPVQYHELMSYRASLRDWPEEPLFPDSGGRPSVPDWLRRYVTP

SEQ ID NO: 27422 - protein, 400 aa, Pseudomonas aeruginosa
TPPRAGFFINGDLPMSFFHGVTVTNVDIGARTIALPASSVIGLCDVFTPGAQASAKPNVPVLLTSKKDAAAAFGIGSSIYLACEAIYNRAQAVIVAVGVEAAETPEAQASAVIGGVSAAGERTGLQALLDGKSRFNAQPRLLVAPGHSAQQAVATAMDGLAEKLRAIAILDGPNSTDEAAVAYAKNFGSKRLFMVDPGVQVWDSATNAARKAPASAYAAGLFAWTDAEYGFWSSPSNKEIKGITGTSRPVEFLDGDETCRANLLNNANIATIIRDDGYRLWGNRTLSSDSKWAFVTRVRTMDLVMDAILAGHKWAVDRGITKTYVKDVTEGLRAFMRDLKNQGAVINFEVYADPDLNSASQLSQGKVYWNIRFTDVPPAENPNFRVEVTDQWLTEVLDVA

SEQ ID NO: 27423 - protein, 171 aa, Pseudomonas aeruginosa
GAPVMIPQTLTNTNLFIDGVSFAGDVPSLTLPKLAVKTEQYRAGGMDAPVSIDMGLEAMEAKFSTNGARREALNFFGLADQSAFNGVFRGSFKGQKGASVPVVATLRGLLKEVDPGDWKAGEKAEFKYAVAVSYYKLEVDGREVYEIDPVNGVRAINGVDQLAGMRNDLGL

SEQ ID NO: 27424 - protein, 751 aa, Pseudomonas aeruginosa
QTRRTVMSKDMDLVVSIGGIADPSLGKAFETVKARLDSLQERSRQASSLRDVLGDAIRLERELADMRKVGDRGVAEHARQLGERQEQLKRLGIEARAAGDAYARLGEMQRGLDMQVRGLQRLEQASQAMPLASAFSGLVVEASKTAAGYQARLRDLAIRNGLDVGREPALASLIQDSANQSGLGRTATLDMLEHLNATGMGFAAAQMNMGLAGRFGFGQGIASAEVAGLVRALQLAQGSDSPEQLSASLDRLVVLGKGRVGSEALARRLPALLSALGNAGEATAGDVGALGALLEIQAKNTTPDKADVRMKAWLEFVGSGSLKRAYGQDYDRDLEALRKDGASLLEANLELAARYRDKGGKLSAGVASPALEAYRASRGEFQGLLESQQSSVGSSERDAQRRKGMSQELWKASSDSWERAQTALGSALNPYLDNLAKGSAVLGESTAELLEAYPRTTAGLTAAAGAVLSGYLAYKGGRGAIDVLRGGRLGRRGTAAVGDLIERGAGRVSGGSEIQRVFVTNWPVPGGDSTLESARRPAQRKRGQTPRRKRGKGGGLKARSLPSLGFSAGGGLGAMAGKLPRLSRLPIRNAPLQVASSLIDVAEVYSSDLSESEKTIAYGEAGASLAGSLAGAALGASIGSVVPVVGTLIGGLVGGAIGAWGGSELGGRLGRSLAGDPPAASDNKPAVPVPQAEPVAAVPNWTFAPQINLTVQGNVHEPQRLADELLPYLQRMLVDFADERQRRSLYDPAMV

SEQ ID NO: 27425 - protein, 293 aa, Pseudomonas aeruginosa
GVPMAYLEQLQAGLRYLGRAGESGRKSLDKVVAPVNGAISEIRGAAAELENLPGVSPEMAARLQRAMRGIGQAQGKVNRVVSTYDRASRALLGIDERVDALKVQVNSAAQAVGKVAGDISPTLAGVLPSWLLAPSATPPSEAAAPLPHLLVLQPLTANAQPFYFNLNTAAFDALQRNSAYNWSGQVRLGRRPALQSVGMGEESILLKGAVFPLRRQVGNQEKVVGLEQLEALRRLAERREPLILSSGYGEVQMGLWCLVRISENQSALLGNGAPRKQTFDLEFKRYGDDLPNR

SEQ ID NO: 27426 - protein, 355 aa, Pseudomonas aeruginosa
RRQLRRYLRRPQPDENGEDPLPIARQRRGQERRAEEPEGTGYGYGRACRPASLCQPWRGRAGGEGSPGELQPLQCQCAPGAARAWRPVRRAQPAAPRLQGGNRRRVPDRLGGAHLQLQRMDHCRAMQRRPRRQGVTPETHRSAGGSMKLTEQQLLRIFPNARLVAGVFVAALQRAMDEREIDTPARRAAFLAQVGHESSQLTRLVENLNYSAQGLAATWPGRYLGPDGQPNALALRLARNPQAIADNTYATRNGNGDEASGDGWRFRGRGLLQITGRANYRLVGEALGEPLEAEPWRLEQPVPAARSAAWWWAGHGLNELADRGEFAAITRRINGGLNGQAERLALWQRARAVLS

SEQ ID NO: 27427 - protein, 115 aa, Pseudomonas aeruginosa
MNLNELRAAGGFIESALVRKEITWTRVPAGRKKAVSDTFQVFVRRNSFGAVERLFSAEGDQQSRNARYLAECIRLGETGEESLTYEQAYDLDPALGFLLLQAVGEVNRVEDAEKN

SEQ ID NO: 27428 - protein, 612 aa, Pseudomonas aeruginosa
IMATNTDGSLTLDLVLRSEGYRAGMDKVGRINDQKMRAMEARAEKAGKAIGKSLDSSALIASSVLDQALDMLGRTSRQAGQAKKPVQSAQDKVLAEWKTRQKELGEAWKSYREPLQDLSKLNEALLKNSSDKLDKALLNLSETGKLSLANVGKAAYADAARLASRQMTLMLLDGLFGWVASVGTEKPKVDDKAGKGQAKAGDDEKEQPSLQSQVFKQWLLQMNSVWGAYRAPLQDISGMTDELFRNASEKLEKSLFNFATSGKLSLSNFAKTVIDDVARIAARQLSMLALDGLFGWMNGKAGITEAQLASQKPYTSLLEKARAAAGQAAAGAPAAQGAAPMPAAAMDVGAMVATASGQTGDGSKVSAGGASAAGKPVGSWVEQMDASWASLRDQAQDVSGMMDMLFTNAFTNMENALFTFATTGKLSFKDFADSVIQDMARIAARQATLQIIGSIVGAVSGFFGSGATAGSRISDYTGSDMANWVSKQRAGGMPGFARGGAFNDGIQSAPALFSMAGGRPALIGERGPEAIMPLSRGSDGVLGVRALGGGEGGNVFNFSTSVSLGGGREGAATASGDDGTGQQLAGMINDAARNVVAQELRPGGLVWRMVNG

SEQ ID NO: 27429 - protein, 295 aa, Pseudomonas aeruginosa
PGSCPLRRISRASRSRRARSPRCATGASPTSTAGRTATTPVRRCSMPTAIRWTIRRWTAAAAGSAIASCASARTTRCPTAASPAPAWSGCEHGTEPQPAAGHRRTRRPRASARMLRADRSRCASTPLRGLSQRSRIAQRALRDRSPGLVRRRGPGRGPGHRPQPPGRSGHAEHGRSGQLRTAWSALGDPVLAGRRCRASSAGGLSGAAARPRVRPRRARLLEPLSRLVPPRGRSGASGLSAPRRLVGNRREPLRAALCGGWIPAGAAGRNPPRRHAGDAGREGAAPEPRGHLPGQ

SEQ ID NO: 27430 - protein, 208 aa, Pseudomonas aeruginosa
STPSCATRTPRCCSSSSMPASSRAFRRYRWKRAAGGCGCRATTIRRPVATAAPGTARSSRPGPATRPGTGTTSCCTSASASVGGSTRAWSTSGRCTASPSTATSRCPTARAARSRASAATCTCRVAPKPGQCCATWQRSSAACPTGPARKWWRYPTCRRTRPTPSRRRTPCVATTAATSTTAAAASAIATPWPWSTTTIRATATRASR

SEQ ID NO: 27431 - protein, 199 aa, Pseudomonas aeruginosa
KLCRRRRRRRTRPTGPISASRWKPPTGWRSRWRAIPLKSANSTAALPPRHRALAYCRRRPVTTRMTAMAPWPMPCAAGRPLPGQPRRKPYGPPKTRPRPLARRYWRRAPPMPKGVSPRWNGSRPAIARPPRNVWTSSRPRSVAPPPAYRANRPPAPTPTAPSHSGSTPCRRAPTPIAQRSRPPPRRSPRWMATSRRCTA

SEQ ID NO: 27432 - protein, 113 aa, Pseudomonas aeruginosa
RHHYGDGCGEVVLMRIELSPVVVLPEDSTDMDVMVSGDSIAVSGVMYDFSQLPEGGYLPASAIHEGPFSGRVTRAGGEICLTLVFPIRGSYSEAAKFPVPIHIVEDGTVELPK

SEQ ID NO: 27433 - protein, 208 aa, Pseudomonas aeruginosa
NQEVTASMLLMIDNYDSFTYNLVQYFGELKAEVKVVRNDELSVEQIEALAPERIVLSPGPCTPNEAGVSLAVIERFAGKLPLLGVCLGHQSIGQAFGGEVVRARQVMHGKTSPIHHKDLGVFAGLANPLTVTRYHSLVVKRESLPECLEITAWTQHADGSLDEIMGVRHKTLNVEGVQFHPESILTEQGHELLANFLRQQGGVRGEGN

SEQ ID NO: 27434 - protein, 420 aa, Pseudomonas aeruginosa
SAQASRQRACAGGAFARRAGRVQSGRGDPHCRVEGRRGTRVRSASRGLRDQEPDPDGAGGRQSAGLAGTDPRRFGAAQDRGWAEGRRADRDECRPGTVRCRSGDQPARGHSTGPRCPAHRAGTGEDGRTGGLHRRLQRGERTVSVPTVLQKILARKAEEVAERRARVNLAEVERLARSADAPRGFANALLERAKRKEPAVIAEIKKASPSKGVLREHFVPAEIARSYEAGGAACLSVLTDVDFFQGADAYLKEARAACALPVIRKDFMIDPYQIVEARAIGADCILLIVSALDDVLMAELAATAKSVGLDVLVEVHDGTELERALKTLDTPLVGINNRNLHTFEVSLETTLDLLPEIPRDRLVVTESGILNRADVELMEVSEVYAFLVGEAFMRADDPGLELKRLFFQERGGVVLGADPD

SEQ ID NO: 27435 - protein, 293 aa, Pseudomonas aeruginosa
PSYAGASFASDGHAPTLRQSRKQPREFPTVKSKLKLHGFNNLTKTLSFNIYDICYAETPEDLQAYVQYIDEEYDAERLTQILTDVVDIIGANILNIARQDYDPQGASVTILISEQPVTPTDSQIEESPGPLPDTILAHLDKSHITVHTYPEIHPVDGIATFRVDIDVSTCGVISPLKALNYLIHQFDSDIVTVDYRVRGFTRDIEGRKHFIDHEINSIQNYLSDDTREAYQMTDVNVYQENLFHTKMLLKDFELENYLFGDATRTLSAEQREQVTERLKHEMLEIFYARNMPR

SEQ ID NO: 27436 - protein, 506 aa, Pseudomonas aeruginosa
RCPSRPPKREGAAVKNDIHDLGLVLDSRVKLILIESWDEPKVMETLTGLAVRRGLGLYAWSVTEGVQRLGFGGEPLGGEESRDPVAALRLIKHDQQANLYVLCDLHPFLGDSPTLVRLLKEIAMAEGNHRPTVVLVSHALKLPAEVQRFAARFSLSLPSEDELLGIVREEATRWSERNRGARVRTDNRTLQQVVKNLRGLSHAEARLLARNVICNDGAITQEDLPELNRTKFQLLDLEGVLSFEYDTARFAEVGGLAALKRWLGERQSAFLAGTPGDQPKGMMLVGVQGAGKSLAAKAVAGLWGLPLLRLDFACLYNKYFGETERNLREALRLAEQMAPCVLWMDEVEKGISGGDQDNGVSQRVLGTLLTWMAEREAPVFMVATANAIDRLPPELIRKGRFDELFFVDLPTPEVRAEIFRIHLQRRELEPAQFDLLLLAAASEGFSGAEIEQAVVAALYAGQARQQAVDQDLLLRELSRTSPLSVLMAEKLAALRTWAKGRAVPAD

SEQ ID NO: 27437 - protein, 129 aa, Pseudomonas aeruginosa
CCNARPQAGRFGNMSIETFTPTPLLFTPGAANKVKTLIDEEGNPRLKLRVFVTGGGCSGFQYGFTFDEDIADDDTVIERDGVGLVVDPMSFQYLAGSEVDYQEGLEGSRFVIKNPNAATTCGCGQSFSI

SEQ ID NO: 27438 - protein, 379 aa, Pseudomonas aeruginosa
MKSVEEQLALIQRGADEILVEAELVAKLKRGQPLRIKAGFDPTAPDLHLGHTVLINKLRQFQDLGHQVIFLIGDFTGMIGDPSGKSVTRPPLTREQVLENAETYKSQVFKILDPAKTEVAFNSTWMDQLTPADFIRLASQYTVARMLERDDFSKRYASNQPIAIHEFLYPLVQGYDSVALKADVELGGTDQKFNLLMGRELQRAYGQEAQVILTMPLLEGLDGVKKMSKSLGNYIGIQEAPGVMYSKLVSIPDTLMWRYFELLSFRSLDEIDSFRKDVEAGANPRDIKIKLAEEIVARFHGEEAAVSAHKSAGNRLKEGELPEDLPEIELSSPEDMPVASVLNKAGLVKNAAAARDLLGAGSVKVDGQVVDRTFHAGAG

SEQ ID NO: 27439 - protein, 208 aa, Pseudomonas aeruginosa
  UNSURE (5): Identity of amino acid at the above locations are unknown.
DWLRXKRLLRRQPDRHADRQQGRGGPRPPWQPGDPRPCGGGRSPGESPTRGTEERGGGALSQSRQLPRAEVPPLRLQPQHLLSAPACGAPGYPGRPAAAGGLSSWTGYRVPPGIFQPAFEPVFLCLSPMEAASPMHSSGPCTVEAGSGWRSHPFRQSMPGFSISEVGTRLPGCLAKVPRAVYHPHIVVRLPPIAVDCREGIAGLGIGR

SEQ ID NO: 27440 - protein, 195 aa, Pseudomonas aeruginosa
AGLLRSGGAGMSYVSAEHDRMLAAMILPCVVVAVDLAAARVRVRSGDWTSGWLRWHSLAAGKVRHWRAPSIGEQGILLSPSGGVSMGTFIPGLYGDAGTAPDNSASSETWRFDDGASLSYDWAAHRYRVELPSGTVEVRVGASEVRVSDGAVSLKAPKISLEGPVEIAGTLTVSGDILGGGSIIDTVGNSNHHTH

SEQ ID NO: 27441 - protein, 290 aa, Pseudomonas aeruginosa
AACSRASTSIWRSRRDHRSFPVAGARGYRKPRFRDDLPRAVGRLPRSHGWRMGSGGGVRSGSQASATGGLSRTAAAGADQRCGAGGDAGIRQRCRSRPDRCRLQCAAFADQARTARGGTAGGGAVRERQVAAQSHPARVRAAIRRRTAERLYSPCTGRGWKGGGCLCDQSGALRSADQRARGGRQRAGTGSGVAGSAPGAERGGRASCRGSGNGALGRHRSLSGQGAALPVSRPRGRADPCRRRGFAARLHLRPAPPGPRHPAFGPVRHPACRRRAARRTAGACGRRGPE

SEQ ID NO: 27442 - protein, 705 aa, Pseudomonas aeruginosa
PTATPWKSSPGNSDMTTNTPKYGGLLTDIGAAALAAASAAGKKWQPTHMLIGDAGGAPGDTPDPLPSAAQKSLINQRHRAQLNRLFVSDKNANTLVAEVVLPVEVGGFWIREIGLQDADGKFVAVSNCPPSYKAAMESGSARTQTIRVNIALSGLENVQLLIDNGIIYATQDWVKEKVAADFKGRKILAGNGLVGGGDLSADRSIGLAPSGVTAGSYRSVTVNANGVVTQGSNPTTLAGYAIGDAYTKADTDGKLAQKANKATTLAGYGITDALRVDGNAVSSSRLAAPRSLAASGDASWSVTFDGSANVSAPLSLSATGVAAGSYPKVTVDTKGRVTAGMALAATDIPGLDASKLVSGVLAEQRLPVFARGLATAVSNSSDPNTATVPLMLTNHANGPVAGRYFYIQSMFYPDQNGNASQIATSYNATSEMYVRVSYAANPSIREWLPWQRCDIGGSFTKEADGELPGGVNLDSMVTSGWWSQSFTAQAATGANYPIVRAGLLHVYAASSNFIYQTYQAYDGESFYFRCRHSNTWFPWRRMWHGGDFNPSDYLLKSGFYWNALPGKPATFPPSAHNHDVGQLTSGILPLARGGVGSNTAAGARSTIGAGVPATASLGASGWWRDNDTGLIRQWGQVTCPADADASITFPIPFPTLCLGGYANQTSAFHPGTDASTGFRGATTTTAVIRNGYFAQAVLSWEAFGR

SEQ ID NO: 27443 - protein, 74 aa, Pseudomonas aeruginosa
LFAIEINWKPERKRPYSLSNTMNSCRTEPAYGIGRKSLYFPTVADVRPYQIGSDVMSPPEPRLVRGFSLMEIYL

SEQ ID NO: 27444 - protein, 161 aa, Pseudomonas aeruginosa
LRRVIRPSKRWPPPWTGWPRNCGPSPFSMVPIAPTRRPSPTPRTSAASACSWSTRACRFGTAPPMPHARPRLRPTPPACSPGPTPSTASGPRRRTRRSRASPAPAVRWSSSTVMRPVAPTCSTTPISPRSFATMAIACGAIAPCPATASGLSSPAFGPWTW

SEQ ID NO: 27445 - protein, 109 aa, Pseudomonas aeruginosa
AAATARCRWASGVWCGSARTRAPCWATALPANKPSTWSSSAMATTCRTADGDMLDSLCYHVYGHLLGCVEATLDANPGLADEQQPFRAGLLISFPDMPVVNVEQVRLWD

SEQ ID NO: 27446 - protein, 348 aa, Pseudomonas aeruginosa
STAHPQPRLGGVFLFWRNQVQPSFRIVADGTDVTQRLNDRLLKLTLLDKPGMESDSLTLRIDDRDGQVALPRRGAVLEVHLGYAGEPLMRMGRFTVDTLQWAGPPDCLTVTAKAGDMRGSGKTIRSGGWEGTTLAQVCRDVGARNGWRVECPLQVAIARVDQVNESDYHFVTRLARQYDCTAKLAEGMLMVLPRQSGQSATGRRIEPLVLGRADVGSFDVTYDDRSLMRTVKTRYQLPGSGEVKSVELKNPKAPATATGEHVDRHLYASRGEAEQAAKARLASFSRSSASVRLELPGRGDLFAERSLLLQGFKAGIDGEFLIDSVEHTYSSSGWTTVVQCNGGRGGKG

SEQ ID NO: 27447 - protein, 249 aa, Pseudomonas aeruginosa
FRSVVEPGIGRYNVVMLVQVCPPRDVTCNLRARPVCRAFSFASDNGSGRGGSSPTAYRATADRPGGGARRPAWCGSFHVHKGEFSMSILTQGTQIYALVPPVSGTGAATVLEIEGVTSFNPGGNPADQIEDPCLSDTSRKYKKGLRTPGQATLGINADPRLASHVRLFQLSEKDGETSVKWAIGWSDGIDVKPTVSTEGDDFVLPPARTWFTFEGYVSDFPFDFASNTLVATQATIQRSGAGKWTPKSA

SEQ ID NO: 27448 - protein, 113 aa, Pseudomonas aeruginosa
MADLERFTWDISIDSAGQANQLVRQVQYGGGYSQALGDGLNNLSETWQVSRTGDLALIGPIRDFLKRHGGYRSFLWTLPTGEPVRVRAQGWQLRPRGNGVFTLNTTFQQVFNP

SEQ ID NO: 27449 - protein, 416 aa, Pseudomonas aeruginosa
RGQHRRQHQRALPVLRWPGRRAPDRARDLCALPGCGQLRRRQPAGRPLPGAPEHLVPRAEDRREQRPGDLGAVRSAGFPGPADPGAPDHLAVPLVHHQRVPRAGLQLHRYGDVRCRRQSGGRSGAGPLRRPGQRLQAALRRGQPAVPRRLRRRRPGQDVSMELSRSLQRAIAAHAAREHPRECCGLIVRGVRQRRYVACRNAAGSPSEHFVIDHQDWCAAEDQGEVLAIVHSHPDVPATPSMADRVSCELHGLPWVILSWPEGDVAHLAPEGYRAPLLGREFAHGVLDCWSLCRDWYRREAGLELPDYPRRDGWWETGESLYEQHYAAAGFRPVPLAGIRRGDMLVMQVGRALHPNHAGIYLGNDWRLDSEPVQALGGDGPFLLHHLYGRLSTRDVFGGPWIERTRLVLRHTRMPQ

SEQ ID NO: 27450 - protein, 218 aa, Pseudomonas aeruginosa
TTYSSEPSESALYERNRSMNDTLSQGLTTIRLYGVLGKRFGRMHGRLLESGTVREAMSALKHTMEGFETFMREAESKGLTFAVFRGRTNLSGEQLDMRGREDIRIVPLVIGSKQSGLFQTVLGAALIAVGVFATSLTLGTSTFLISAGASMMLGGVMQMLSPQPKGLKGREAPENAPSYAFGGPVNTIAQGHPVGVLYGKRRIGGAVISAGIYAEDRL

SEQ ID NO: 27451 - protein, 286 aa, Pseudomonas aeruginosa
SSAAPLRHQPVGDHRDRLHLRGRGAAAWPVGAADRGAGAGRGDLPHRHGWPWAGAGEDHRRSRPGQVRQADRRTPERGGWPRADPRPRRRGPTRRSPAGQPAERQGRGAQRPVGGRPRADRDRRLFGDASAPGAVGAAEQQPDHPALPHHEHHPAGGQSFRDHRAATQREQVRRHRQRCAHRAAAGHQHSAGRAGAAAERADQGFHQGRPGVGGDQPVGLLGCRAERGGLRGRMAQGLGQLGAGAANLGARFRRAGHLCRSLSGAGTRLERDGGRLGLRQQCGDRS

SEQ ID NO: 27452 - protein, 131 aa, Pseudomonas aeruginosa
HRQRGQRDGRQLCRHGEVELMKLLLKPLLQQGITPDRERLSDVQVRGSVFILDGVEYDFGRMQPGGYLPPEAYHDTPFIDIRFVDGDRLYLHYIHQVTSEVMMQFPREIESIPVDQDGKVEVAFSYEHPMG

SEQ ID NO: 27453 - protein, 366 aa, Pseudomonas aeruginosa
  UNSURE (206): Identity of amino acid at the above locations are unknown.
PYQARRLRVFHYLENVMPWYSTGTVSVVLNSDTVTGSGTAFSANARAGDAFRGPDGRWYEIGNVTSSTVLTIKPAYQGATANGQAYSITPVQGYSKTLADQFRDLSNQWGSLLAAVKPWAIASTGSQAQADMGITEVGRAINGASTVGNALGFLGGVSKTQAPMALDMDTVNESGWFSITPNTYNVPLGNNNISGVNGHVALSMVXDASTRYQLFFVRNTNLPEVWYRSCTNGTWKEWVRFYTTDNIVGTVTRRLVTGKPTGAVMESGTTSNGWYVRFADGTQMAAARSEPGLSFGANVIQLPAAFVTGFNTGVTCNWIPSSGWPATAGQGVRGAYLNGSSSVSFATAQALGANDTITVMAVGRWY

SEQ ID NO: 27454 - protein, 386 aa, Pseudomonas aeruginosa
MSRACSSIPSPSSPSRATSCWPTSSASRAACVGRATEMDIKGALNRIVNQLDLTTEEMQAVMRQIMTGQCTDAQIGAFLMGMRMKSETIDEIVGAVAVMRELADGVQLPTLKHVVDVVGTGGDGANIFNVSSAASFVVAAAGGKVAKHGNRAVSGKSGSADLLEAAGIYLELTSEQVARCIDTVGVGFMFAQVHHKAMKYAAGPRRELGLRTLFNMLGPLTNPAGVRHQVVGVFTQELCKPLAEVLKRLGSEHVLVVHSRDGLDEFSLAAATHIAELKDGEVREYEVRPEDFGIKSQTLMGLEVDSPQASLELIRDALGRRKTEAGQKAAELIVMNAGPALYAADLATSLHEGIQLAHDALHTGLAREKMDELVAFTAVYREENAQ

SEQ ID NO: 27455 - protein, 215 aa, Pseudomonas aeruginosa
KRPVATGLFHGCCSAGAEDHHGLSFHMHQALLLQALQHASDHFPRAADDPADLLAGDLDLHAVRVGHGVRLLAQVQQGAGDASGDVEEGQVAHLAGGLAQAVGHLAAEGVEDLRVLLRQFAELRIADLGDFAFHLGTNPGAAFLFAAFLFEQSQLAEEITAVEVADDHFAAVVVLDEDGDRTLDDEEQRFAAIAGIDDGALCGVAAAVTVCEQLV

SEQ ID NO: 27456 - protein, 434 aa, Pseudomonas aeruginosa
GQADTAGSAGDQGITGHSRLLRNGRGIGPRPSRGVAWLLLVVVFHGLCRRRGGFIGFGRRCGGLLVRGVRVGWSAGAAVIVRALQVTLVGRQGDGGDDTDYRQQDDQTGQDFHPGAVRRRRRTVAVGAGAAGQDQHQDAEHAADEGDEVEQPEPARPAEVMQALHADHHGNDDEGDRGQGGDGHADGFAEQEAQAHDDEETERHRHRPAEIAQASDPAVGGEHVQLAELGEGFADLGAGWCVGRRARARGRGGRRRGVFAELRLARQVLLDDDAASRTFRSAGLFMAAFRAGHGRQVLRWGFLRDLGVVIGRFHQAQAGRQVDFLVGIGAGLAQGGQVTLRLGLWKFAFQHHRAAAEEGVDLARFALEQAGEIVLHGFERCVGHQLAGEDDLEALVGHAGILVSWGERNAADSLIGGLGAHKREMRTPAQAGAP

SEQ ID NO: 27457 - protein, 300 aa, Pseudomonas aeruginosa
RAWRQCLPNRRASPPGRRPGGGAVGDRQPGQGRLGSGAPEHEHPVRAGRAPGPLACGPAPLMSGWELQFRDPRRAWLVRLGVGALLLAVPLAFLGGRWSTGADAARSEADSQRQETLIGEQKAELERLRTEIEVLRSGERLSQQATEQSRQTIKLLEDQVFKQQQDIAFYKGVVAPASKADALEIRAFEVQGTDDPQRFRYKVMLSRLGRDDRKLDGRLKVRISGKLARKDATYDLEQLSPELGKTGLSISLRHFQSIPEGGRFAELELPKNFIPKLIDVRAELNGQSKPLQRRFDWPKQ

SEQ ID NO: 27458 - protein, 140 aa, Pseudomonas aeruginosa
VSIMWSKNKGRADVQRFTGQTSLIASGAELVGDMNLKGAVQIDGTVRGALQAHEGLVRVSAGGRVDGEIRAPHVIIDGQVDGDIHAIERLELGAQARVKGNLHYGLIETAMGAQIEGRLCPMTEASPRPLELPASVETVD

SEQ ID NO: 27459 - protein, 555 aa, Pseudomonas aeruginosa
SGERVHVGWFDRDCRWHGLRRGSSAAGAAVRARPVLQGRPSVARLRRRGRFHRDRGRTGRGCLRAARPAWVGNGKRARWCDHLARSGRCPCRPGWFRTSTPGSAARSALLVQGQEGFLLLIHARDHRLGLRHEALAICATERVRHGQLGTQRIDVTAIDLEFVVQVWAGGQARHAHVTDDLALLHAGTGADTLGEAAHVSVDGPIALAVLDHHGVAVAPLASGFEDLAVSGGLDRCADGGSVVDALVRADLVQDRVAAAQGEARADAGEIHRRTDECLAHAGAVGAVVAGIALLVGIAHGGVGLAAVDEAGGEDIAGRHLLAVDLVLFVDHVELVAFSQIEGEVDVVAEDVRQRRDQVIGQAGVTTGNEQRAGDAAMGIGGMQVDLGFLAFEGVALVGLVQADGLEFALLDSQRLQLSFGVELELDLLADLQMSEALGILAAGQHVVHGRGGKACLGEYGRQRIATGDGDGLPLGIDGLGIGIGYRCARLARVLLGGVVVGGAFYLSERRAFVAGIGDRLRQEVVFLLKEAIGVAFKLQIERGPLGLDFARGEHQ

SEQ ID NO: 27460 - protein, 106 aa, Pseudomonas aeruginosa
  UNSURE (10): Identity of amino acid at the above locations are unknown.
ISCGETGSDXSGYCGGNLIAMLIASKGEVVRGHRGSRVILDRVAEVDRLVNRLPEELKNVVVEHYLNRDSFPEQKYRHCGCSRNTFYLRLHVAHQGIQDGLLRRVA

SEQ ID NO: 27461 - protein, 157 aa, Pseudomonas aeruginosa
RCVPREALVKHRNPALAPGFLLPGKTFVRTCPALPAKEGPMGNEPQTLTEMPLWVLILLAALGGVSGEMWRADKAGLGGWALLRRLALRSGASIVCGVAVMLLALACGAALLFAAALGSLTAAAGAEIAVGLYERWAARRLGVCELPEEQSDDRGPH

SEQ ID NO: 27462 - protein, 176 aa, Pseudomonas aeruginosa
SKESTMPEQAVTLEALYAAIEQVLRERLPEAQLIGFWPGVPENTPAVSLEIAELLPERDPGTGESALLCRLQARIMVPPGADRQAVSIACGIVRTLREQTWNLSLQPARFVRSAVDGSREELKSLRVWLVEWTQSLRLGDPEWAWEDQPPGSLMLGFDPQTGPGHEPDYFAPEALA

SEQ ID NO: 27463 - protein, 384 aa, Pseudomonas aeruginosa
TVRRGHPDHPVGQQAHAPRVRQQAAADGRHAGERRLEKRRAGRGSPFPGALGTAHRIVCRASRRGRRWPRGSAPERRVRGRAHQYGGLGVIIDLSQLPEPEVIENLDFETIYQELLGDFREAMAGEWAAEVESDPVLKLLQLAAYRELLLRARINDAARAVMLAYASGADLDQIGAGFNVQRLLIRPAQPEAVPPVEAQYESDKSLRNRIQLAFEQLSVAGPRNAYIAHALGADGRVADASATSPAPCEVLISVLGVEGNGQAPEAVLQAVRLALNAEDVRPVADRVTVRSAGIVPYQVKAQLYLFPGPEAELIRAAAEASLRDYISAQRRLGRDIRRSALFATLHVEGVQRVELQEPAADVVLNETQAAYCTGYAITLGGVDE

SEQ ID NO: 27464 - protein, 266 aa, Pseudomonas aeruginosa
RAIPDPAQAGCEDRAIPCRRHGCAGIHRHGPGGDGGQVLHQRCPPRSTEFLRPGRPERFQWRVPRLLQGPEGRQRASGGYPARPAQGGRPGRLEGRRESRVQVRRCGQLLQAGSRWPRGLRDRSGQRCPRDQRCRPVGRHAQRPRPVRGAPDMTQENRLPGWLTLDADAALVRLSRPAQCNGVSVDTLTLRAPTVRDIRLAGKVAGDDAEERELQLFASLAQVSRQDLEGLKLSDYQRLQGAYFRLVQDDTDDTFAYASTGEAPGH

SEQ ID NO: 27465 - protein, 105 aa, Pseudomonas aeruginosa
GQPGRGRGKKLTPADEVWHELVLNGVGGSTIAEAKERLSYAEYRAWVAYLNKRGSLHPGHRLELALARIAALLGHALGADADPDAFRPHMALQPLSLHQAMDQWA

SEQ ID NO: 27466 - protein, 274 aa, Pseudomonas aeruginosa
QATPLRRGLFLEDMNHGHEYRRQPDARPGPSQRRVQGRDGQGWQDQRSENARHGGARGKGWQGYRQKPGQFGTDCQQRAGPGAGHAGQDQSPGGSGQEACAERPGQGTGRVEDPAEGAGRSLEELSRTTPGSVQAQRSTTEELFRQARQGAAQSQRDRQAVACQRGQGRLRRCCAPRLAADDPDAAGRAVWLGRQRRYREAQGRRQGGQGTGEGWRRREGTAVAPVAGLQAVAVADEQCLGRLPRAPAGYLRDDRRAVQECVGEAREVAVQFRH

SEQ ID NO: 27467 - protein, 203 aa, Pseudomonas aeruginosa
RKAVLEQLRQDGDRRCRPDRRAAAFNARPGRIVRLDEWQGRHHRGATGQPEALYLATGKGPRSCGTSGSGRSRGPGCRANAGSGDGCRRDGGHCFRADRGRFQGLGWRGFGRWQAGGQLGRTDGRLLGEPARPGAGRLGNDGHAVYQRLHQYGERPVHLCHHGQAVVQGFRRLGDPGYGADRRAAGDAADHRQHRRCGQRVLR

SEQ ID NO: 27468 - protein, 185 aa, Pseudomonas aeruginosa
RRNGGLADFRLYRLGHGQLGQQATRRRHAWVRQGRCLQRWHPERAGAVQHGRRSSGADRRAWAGSHHAAESRFRWRARRARARRRRGGQRLQFLHQRQPGRWPRGRGDGQRRRRYGTAAGGNDQRCRAQRGGAGAAPRRPGMEDGEWLIWNALPGTSRSIPPARRTNWYVRCSTAAATARRSATG

SEQ ID NO: 27469 - protein, 244 aa, Pseudomonas aeruginosa
TPPSSKSSIREVSMTITADDQALEPGALVRLFDLDCTGFGGEMLRFHGHLQQGPIHWQGNAYQAWPLEARGFEQRGDGRASSPTLSVGNIDGSISALCLFFDGLVGARLTVRETYAHYLDAANFAEGNPQADPSQERLNIWFLEQKTAENSVQVTWELSAPPDFQGQQIPARQITSLCHWCITNEYRGQDCNYTGTAMFDADGNPVDDPALDRCGGRVSDCKLRFGADNPLSHGGFAGAGLVRM

SEQ ID NO: 27470 - protein, 1207 aa, Pseudomonas aeruginosa
RNVMNKTITGHKGGSKKPRQPVEMPDSVRSIARAKILLALGEGEFDGGVDGRSIYLDDTPLLAADGSVNFPGVTWEFRPGSVDQEHIAGVPAVENELAVGVELKSDAPWVRAVSNTQLSAVRLRLSWPAIQRQQENGDVVGYRIDYAIDIAVDGGAWQEALKASLDDKSTSRYERSHRVDLPEARSGWQVRVRRLTPNQNNNRIADTMRVEAITEVIDAKLRYPNTALLFVEFDASQFQSIPQISVEARGRRVRVPSNYDPQTRSYSGTWDGSFKSAWTSNPAWHWYDIVLHKRFGLGRRIDASMVDKWSLYRIAQYCDQSVPDGKGGQEPRFSCNLYLQSRAEAWTVLRDLAAIFRGMSYWSGAEMVAVSDMPEDEAYTFSPSNTVRGDDGSHFNYSSSRQRDRHTLALVNYDNPGNGYQSQPVAVNNDRAQRRYGISQLEITAIGCTSEGEAQRRGQWALLTEELEQDAVTFRTGMDGRGLAPGKIIAVADPVKSGKQIGGRLSAVDGRALTLDRDVEARPGDRLLVNLPNGKAEARSVQSVVGRVLTVTAAYSETPRPQGQWALQSNSLTTQRFRIMSITRPEDNLFEITALQHNASKFDAIDNGARIELPPVTSIPPGVQAPPQNVRIKAFTKVDQGLAVTSLSASWDAAPNAVAYEAEWRKDSGNWVRVPRTSALGFDVPGIYAGRYLVRVRALNVMEVGSVYASSVETALEGKTTPPPALAYLRCVAGPWRIGLEWGFPASGAADTAYTEIQQSATPGGSEETARALGLFAYPGNTHLVSPIPAGERLAFRGRLIDRSGNVGAWSNWVTGTSSSDASEYNQLITQEYVESALGQQFFSDIERMQVDIGGLQKQVGDLADVLLYDPAKVYAKNDMVRQGQRLYQALKAVPAKTAPPNAAYWSDIGQSLETANGLAQQVASHTAEISELDGSLTAQASRLGVLQAATRDDADDGNGAMADALRGWKTVARAAQEETVRATENEAQATRTTLLEARTADAEGRIATVERVATSDRQATAQRLDQLSASIGGTAASLQSEQTARANADSALAQRIDTVQASTDTNSAAIQTTSQAVTSLDGNVKAMYSVKLQAHANGQKYAAGWQLGFDSGTSVSTMAFQADRFIWFDSSSGTAVAPVSIVNGQMFIKNALIQDGAIDNAKIGNVIQSNAMSNNGMPIWRLDKAGTYTVRDSAGQVRVEMGLLQS

SEQ ID NO: 27471 - protein, 369 aa, Pseudomonas aeruginosa
FLGDNAMAWHSKGSVSVTLNSEAVLGNATDFIANVRTGDAFRGPDGRWYEITNVTSATVISIKPNYQGATASGQVYAVVPIHGYSKNLADQFRDINNQWGATLAGIKPWAVSSTGQQAQADMGISAVGRALNNASTPANALSYLGGVAPNQMGWAGNAMNTADLDSLTVSGLYAHGTAVPSPVNNAQGYVLHMQHGNPDFAVQQWYQLNSATGQYMRIKAGGNWSRWVLQYSQFNLVGLASFDASNNPSGAIIQRGGTVGFNEYVRYADGTQICWGNTTTNVGATMAYQPAGTLSFYITPVAYSWGFPVSFSRPPSVMVNPMRAAGNNASRPWGSTMSVTETLFSWYGYDTASVASGMAASYVAMGRWN

SEQ ID NO: 27472 - protein, 79 aa, Pseudomonas aeruginosa
RSAMNIQWDKYVSPAKAAADVRDQALASAQAKRLLAYREESDPLKTEAEFDAIKAGVEPDYGAWIAKVEEIKSRYPMPE

SEQ ID NO: 27473 - protein, 84 aa, Pseudomonas aeruginosa
RRNRGVAQVIDWKMMKTPDQVSRERVQQEYDAVLARRAEAYRLESDPIKTEVEFDSIRAGVETDYAAWLAKVEEIKARYPLPRI

SEQ ID NO: 27474 - protein, 141 aa, Pseudomonas aeruginosa
TMKARIQWAGEAMFLGESGSGHVVVMDGPPDHGGRNLGVRPMEMVLIGLGGCTNFDVVSILKKARQPVESCEAFLEAERADEEPKVFTKIHVHFVVKGRGLKEAQVKRAVELSAEKYCSASIMLGRGGVEITHDYEIVELG

SEQ ID NO: 27475 - protein, 335 aa, Pseudomonas aeruginosa
RSRSEERHTRPRPGPGFPGQADPDRVLGRAEGDGNPHRPGGQARPWPVCLVGDRGRAAPGLRRRAAGRGGEPRPGRGVALDQARSAGESLRALRPASFPWRQPDPGAPAQGNRHGRRQSSTDRGAGVPCAEAAGRGAALRRAVLAVPAQRGRTARHRPRGSDALERAQPWCPRAHRQPDPAAGGEEPARAQPCRGATAGAQRDLQRWSDHPGGPARAEPHQVPATRPGGRAELRVRHRALRRGRRACRAQALARRASVGVPRRHAWRPAEGHDAGRRTGRRQEPGGQGGGRPLGLAVAASGFRLSLQQVLRRNRAQPARGAAPGRTDGALRAVDG

SEQ ID NO: 27476 - protein, 186 aa, Pseudomonas aeruginosa
SGEGHFWWRPGQRRQSARAGYPADLDGRARGAGLHGRHRERYRPPAARTDPQGTLRRIVLRRPADAGGSRRDLPHPPATPRAGAGTVRPPSAGGCQRGFQRGGDRAGGGGGTVRRAGATAGGGSGSVAQGAVANLAAVGADGGKARRAADLGQGAGGAGRLSRRLTSLPCEERPINPVGRRVPPRR

SEQ ID NO: 27477 - protein, 385 aa, Pseudomonas aeruginosa
TADRRAEPVAKPDAQRCSCRRSALIIGLFWLACFSARSDGQMIKVGIVGGTGYTGVELLRLLAQHPQARVEVITSRSEAGVKVADMYPNLRGHYDDLQFSVPDVQRLGACDVVFFATPHGVAHALAGELLDAGTRVIDLSADFRLADAEEWARWYGQPHGAPALLDEAVYGLPEVNREKIRQARLIAVPGCYPTATQLGLIPLLEAGLADASRLIADCKSGVSGAGRGAKVGSLFCEAGESMMAYAVKGHRHLPEISQGLRRASGGDVGLTFVPHLTPMIRGIHATLYAHVADRSVDLQALFEKRYADEPFVDVMPAGSHPETRSVRGANVCRIAVHRPQGGDLVVVLSVIDNLVKGASGQALQNMNILFGLDERLGLSHAALLP

SEQ ID NO: 27478 - protein, 297 aa, Pseudomonas aeruginosa
PGECHALHPGRGNAVFVGTGDPSFGHQQGQALHQRRIEGAAAAYQHLFAVRLGVQQRFADAARAQFQQGCLDIRCRQGRVTSQVLLQPGQVEALAPGALGATRGEELIRQQACQQCVVHLAAGGPRTVPVEMFAALVMNPGVHQHVARAAVEAAYRLSGAEQRNVAEATDVQDRPGGVIIAKQRLMEGRYQRGALAAGCDVAAAEVGDDIDAGQLRQQGGVADLHREVASGFMSDGLTVTADGTDFVGAHLLLEQQFAHALCCKGDPALLDFGGAGDFIGTGDAQGEDVFAQPGRHG

SEQ ID NO: 27479 - protein, 466 aa, Pseudomonas aeruginosa
TTCRCWRRSAGRWPSTPIRACAPRRKNAAGRSFPCVDPLTSAPSDGQRHGGPRMPHTAPAPGSLRPVVIVALVTALCLAGDSMLYIALPIYWHEVGLEALWQVGVLLSINRLIRLPFNPLIGRLYKHLALKTGLLLAVVIGVLSTAGYGLASGFLAWVLLRGLWGIGWSFFRIGGLSAVVYCAADHQRGRAMGLYNGLYRLGSLVGMLLGGLLVPVLGLPALALSFAILALLGLPLLAKGFDLPENPAGHARTSAATASTSVARRPPPRGLVILSGFATALLIQGVLAATLSALIARSFGTEVSLLGLALSAAGLSGIIQALRWSWEPWLAGRFGAWSDGPRGRRRFYVAALLVGAMGFGLLSSRLPILAWLAIALLVMLVATALTTLTDALAADVARAGDVVGFMTRYSIVQDLGAALGPALAFLLLERPGGFAWLYWGGSLAFLVLALLWLRRGDSQTGLLTIR

SEQ ID NO: 27480 - protein, 313 aa, Pseudomonas aeruginosa
SPGCSQASARTAPAARAGASGGAAGRRRAHRRAGPRRSPPGSPASRGCRPRRGSAGPNRNPAPGRRPGYPARSAPGPPASAAASAPPGCVPPAASRAGDWPAARNDSRRPHRGVPGRPGCRGAPASASMDSVSASQHAGQARPTHREAPRAAPHSGRAANPGRGAARPAARPGSAPADPPAESPAPAPASGAARPAPRRPGPRHAAVAGARDCPARESAVAATGVPARRCWRRPAPAAGTGAAPAPGCPVPAGGGRPPPCWRGRPRPGAHRRPARKSAGPSPHGLQRGRRVFARRCPGREPCSPRRGSWCRRH

SEQ ID NO: 27481 - protein, 249 aa, Pseudomonas aeruginosa
PTTAISSSTCTTCASTARWNWKRRSTPSSAWSPTACSPPARPTCCCSAPPTASRPSRPEPARPRPMTGAGRHCNKSGYAVSQQTAGPLRSAAPREQGARHGSQIPSEESERRPVPLQPACRQRRDHSHQRTVQGQGLGARRHRVGAQELPARRCLRGQAGQQRQVPLRAQGHQWPGRRPEPALCQPGQRRSRRAVGEARSAGSRSQRRKLRPGGACAEAQAPPIHLCIPFRGYFPSQELNAAPHFQARK

SEQ ID NO: 27482 - protein, 633 aa, Pseudomonas aeruginosa
RCVPGYPRQRILHPPRPFRLRQDHPPPPHRRLRTAQFRQHPPLWRTHGRPAAVPPPGQHGVPELCAVPAHERRRQHRLRPGDAGPPAQRDRRHREPHARPGEAAGGRQAPRRPVVRWPAATHRPGPRAGQPAQGAAARRVAVGAGPEAAQGNADRAEAPAARDRDHLHLRHPRPGGSADHVRPHRGDEQGQGVAGRHAQRHLRGAAEPGGRRLHRRNQLPRGPGRRRRRAPGGRPAAGRDDPGQRRCDLGDPPGAHRTGRRRPVGRRAGKHRLCRHRYRLPPERGRTAGLPRAPAEPRRRTLPAQSGGEGAGADSRRRHPGARRMSTAGRPTAQQSAERRQLRRRLLLSSPAMLMLVLFLVIPLGIMFAVSIQQSGDYGGVKWGQHSLEAYLNFLWERDLDDSLVFNADYLGIFQRSFWLSLLTTLGCLALGFPTALYLALQPERRRNLLLFLVTVPFWTNLLVRVYAWILLLRNGGLVDAGLQGIGLTDTGLGLLYTDNAVIIGLLYTYLPFMVLPIYSSLEKMDWRLVEAAFDLGANRWKALRRVIVPLAMPGIVAGCILVFIPALGSYIIPELLGGGKALMIGNLIQLQFGTAHNWPFGAALSFALLAFVLLAMLIYNLRFRANAGGGQP

SEQ ID NO: 27483 - protein, 987 aa, Pseudomonas aeruginosa
PVHSPGAGKVRPSGRLRDRYGISRGAEHGQRTQQRHPHRRQAPRVRPQRPGHRPAAHPRASRPGLLRAGLHGSADHVHHLRGSHRDHRRSYRQRLPGHPGGDALHRLFLQLHGEEISHRRLGLFLYQPQLRPLRRLPRRLVAAARLPVPADDQLPAHRPVPQHRLPDGAGLGLRARGDRPGHRAQRDRHQLGGRHEQRDRRRPVRLRRGVRRHGGQAPGRHPLAGPEPALRRRRQPAGLRPVDGRRGGAVPVVPRLRRGLDPGRGNPRPATRHPARHRHHHGRRRPAVHRAGGLQPTGVPRQRIPGRRVGGQRSDAGGRRQVPRQLLHRRLRRRRRRLGAGLAGLGVAHPLQHGPRRHPAAARVRQPLGALQDASDRDPGGLGDFPAGGGHRPHHPGLDDQLRRAGGVLRGEPGGDPQLPAARRPPRPARPAALRAGAGHRPGPDPVAVDQPLGADPGDRPDLVRRRPRLPGVAYRRFPPQGADRDLLRTELSPGARHADHLQRRPSPAPRPARTDRRPVHPLLRKTQPRRHGPRPREGRRPRRSPRTARLRPGTDPPGAQRGFRAFPAERLAGLAGHRPQPRHAADRLADPAPAADGAGQHRRSPRLLLLRRRRADHRRDLAGDHQFGQRRPQRPVRTRQRRALGIFALSPAGPPRRGRLHGRLLLLQQCRHRRPGLPRPGRRAGGDPRRRLPPWQRHPGHLLRPRRCAVHLDPRRSALRIPLFPRLRRREGQRRRHRLQLQLPTGGRQRLGDLEPGAAGGDPADPGLCGGHPDRFSGGGYLQGGPDFPVPPGQPRLPAHGRSHRQARPGHAVRDGGRLRGGGNRDQRGERATGFRRGSPVSPPATSPGRNAKRPASRKRGGPFRFRALLDHFDELDVNLAADQVAVDFAGQLDPGLVVDFHRREVFVVDLHLHAAGGIAELVDVALDALDDGALEDHRGVVGGFQRGLHRGGGRGSARAGIAGGQGDGGEQADGSDEGQVTKFHG

SEQ ID NO: 27484 - protein, 290 aa, Pseudomonas aeruginosa
AGTGRGDPAAARHPGKERLLPSRRLDQERGEFLRDPWQEARHRRLRLDRHPALGTRRGPGHAGVLLRHRDQAAAGQRGADRQPARAAGHVRHRLAARSRTALHPVDDRREGNPRDEEGRHPDQRRARHSGRAGPPGRRDQGRAPDRRRHRRVPGRAEIQRRGIRQPAAWPGPGDPDPAHRRLHRRGTGQHRPGSGGEAGQVQRQRHLGVLGQLPRSRPAVAPGQAPPAAHPRQHPRRDERDQQGLRRQRHQRFRPVPANQREGRLRSDRRRCRVLGPGPGETPAGQRYHP

SEQ ID NO: 27485 - protein, 137 aa, Pseudomonas aeruginosa
SCAPTKPASSSRWKTSRASSSASGQGTNYADLAKSVAGVNVRTYPGAPEYLQDLASKRIDAALNDRLLIPFAIREAKLPVKPGAAVGPVANMAIPYRKNNPKFGEALNAALEKIKADGRFAKLSEKWFGLDVSQPPK

SEQ ID NO: 27486 - protein, 194 aa, Pseudomonas aeruginosa
PRRCGAERSAAGVEAGQADRGAVQFILVEYQHAHALEGGGGNALAGDPVAVEAPVVVLQVAAGRTARLEHGHPDVMAADQLHCRLRTQQECFADILAVDGEDPVQPVQHFAALAAGDIRWRAGRRQASGDLRAKGDDPPLRMPAREQVERAMAATVVAHQVAQQATADQNLLHGCSTPLTGTQSSPPLADGHAR

SEQ ID NO: 27487 - protein, 253 aa, Pseudomonas aeruginosa
NCGRPMANLRRPEQTGFPRNREGTARHAPDPLASTVFPGPRVARQRCQPGGHGGPGQRQSQPGHRPGRHQPAPGPARRRGQGRLGGRRRQPLAAQPGDRQRLREGRRLPGRARRQHPPGRRPARHELADIRGRAADPGTGRDHRQRRRAATGDQLAGPRHHQRPVDRQRPAGAAHPPAGGQRPVHRRQLDRPHRTARHHRPARHDQGLGSLRRRRRRGFRRVAGGIRCAGGTSRSATAGRGWRAGLRARCRRT

SEQ ID NO: 27488 - protein, 310 aa, Pseudomonas aeruginosa
CALSIVACRPGVSTSGPPHVDNSAPWTAPPERRGFRRQRSINARFARLRFTAGWSARPGRPLSTPVPGRWLARPARAFQRCPGRGAEALPGQAAARALPDPGGQQQSPLRPGRSRPARPQRPAREPAGQRQPAEFLRVAAGAQGGRRRGARHPPRPVAPAQQRPAAADRQRATPGPGQAPGPGPSGPRGRRGSQPGPGRGRRRQPQPDASGPPRPAWRRTDRPVAGRPAPAPGAADRRGPGEHPAVCLPRSLRCGTHPVRELRRVAGRSQLLPGGPGRAESRPGGGPGGRPLIDAGPGTQAPSASLRKSK

SEQ ID NO: 27489 - protein, 236 aa, Pseudomonas aeruginosa
SGLKASDIGGSGLQSIRGRATGETQGYSAAREHMASLAPVFRVNAMTPRRKTLLVSLVGLLWAGGLLAAYWWFEIRYIRPFSEQTTLFSGDSLRLPAELAGPGAIRLVHFWDPACPCNVGNQQHLGELIERFAGKGVEFHVLQKPGSQGRLPDNLAALRPLAGLPGSEQLPASPAVAIWDRDGRLAYFGPYSEGAVCTSSNSFIEPILEALLQGRPVDATHTLAVGCYCPWTPEKG

SEQ ID NO: 27490 - protein, 161 aa, Pseudomonas aeruginosa
SSVSTTSRRTVWNCATSTSSASPRTSRPSAPCASCRSRSSSTPSPPWRSAVRYRWSSNPLPASPAAPCIAPGARRASGERPGRTATARRTRKPWPPRGWRDRPTASRSPAAGEPHREPAGNSLPQRPAHAARHRCQGPAPPRTGASHSPPRGAARSGSARD

SEQ ID NO: 27491 - protein, 254 aa, Pseudomonas aeruginosa
TGRPAWRLLAIDQRLPGSEHSVNAAGRRHPQNARHYNKEKGSMKRTLTVIAVAVAAAAAGGAWYLHAKQPLRNGSLAVAHLQAPVDVRYDERGVPHLYAQNQTDLYRALGYVHAQDRLFQMEMLRRLARGELAEVLGPKLVDTDRLFRTLRIRDHAAEYSARQDKQSQPWKVLEAYLDGVNQFQENNPAPLEFDLLGIPRRPFTPEDTLSIAGYMAYSFAAAFRTRAGADLHPRRTGQRLPAHLRSRLASAGAC

SEQ ID NO: 27492 - protein, 158 aa, Pseudomonas aeruginosa
TRASSSTAARARRTSPASIRSPTTHRRKTRRAATSSPPTSSRSRPMAGRFPATTTWRTAASGWIPNWPTAAPNGTWTTAARCNSAIAPATRRACSHPCCRSCARWSTTPKASAWSSNWRPGRATTRSTRPPPRCSTSCCSRLPRAPCTTNWAMPSSTA

SEQ ID NO: 27493 - protein, 166 aa, Pseudomonas aeruginosa
PGISRHRRANEKGHPQVAFSFRRRAQAGVGEPFCQSVAVSSIACWIARRRRSSAWRVKYQAKKVNSETLSRIRLATALISGFTPRRTAENTSIGKVVEPGPETKLASTRSSSDRAKDIMPPAASEGAIIGMVISRNTFQGLAPRSIAASSIDRSSSRRRADTTTAT

SEQ ID NO: 27494 - protein, 79 aa, Pseudomonas aeruginosa
DEQKLVWAIQMVTIPRSCGQPISCAMATNNSSSDRPVITSGITSGAVTMPPNSVRPRKRGMRVRTKAARVPRSTEENAV

SEQ ID NO: 27495 - protein, 371 aa, Pseudomonas aeruginosa
LQYHAAVVVPADVHRLVPGRPGDVALGVGHEGLDDHPGGQLDVVHRVAAKVGDVVDGALGPVVPGVFQVVRLLRADHHFLRPQRVGDALVLGAGADAVADVDRVLQLRTGDHRMVLHVLHQHAVEQVDVADELADQAARRGLVDVHRAADLLDAAQVHDGDALGHGHGLFLVVGHHHAGHADALDDLHQFQLHLRAQLLVQRAHRLVEQQQLRPLGQRTGQGHPLALAAGELVRLALGVLGHVHQLEHLGHALVDLGLGQAVLLEAEGDVLRHAHVREQRIGLEHHIDRPLVGRQVGDVLAIEEDPPLGGPLETGEHAQQGGFTRTGAAEQGEDLALVDGQGHGVHRQRLVELLGYPVDLYQHLFRLLVAL

SEQ ID NO: 27496 - protein, 419 aa, Pseudomonas aeruginosa
GFLVGTGGYRHYHNSQVVEPGHATGRNLNLFAGLDPGPGTGLQAQHLGRQHGGNVELVEHGLRRIHLLAVADALVHQRAGPRYRVGVADVVADLGDHLRTQQVVDERVGVIGGLGIGGNRHQVEPQVGAFLGNHVLDVDALAGLFGAGSGLEDVPGIAEGDADVAVGQVGDVLGGVEVADVGANLGQDFLGLLVVLRVVGVGVQPQIVEGGGQHLVAAVHEGHTALGELLHVLRLEEDGPGVDRLVAEDFLDLGHVVTDAVGAPQVGNRVLVARVADLQLLEQRRIEVLPVRQLALVQLLEGTGLDLLAEEVVRRHHDVIAGVAGDQLALEGLVGVEDVVADVDPALLGEVLEGGGSDVIGPVIDVQALLLRLHGARDRRSQSGYQQCLANGMLHVRLLFRAFSRQHPACSTRVLQVPM

SEQ ID NO: 27497 - protein, 448 aa, Pseudomonas aeruginosa
TERVPQGTSRGPVRRPPYCRHEWRGSRQADRTQQSEQSLRKRYQSPRFPVRPRYHRLHRREYRPGSRHRRRRPDLLPDPRHPLHGTLAEAPDRATADDHARTGRRAVLRRPPRSPAPGGGQVHRDGTDHRRRLRAGVLPDRPGERERPAAAASLADLRQASAVGAGVLHRRPRRIRRVPPGHHRRRPRPGHPGRRHRRRIRTGAVRGQPQPRQRRPQGLRPRGAAQAPGQEHRLRPRDGHHLHGQALSGPGRERTARAYLAARQAWQQHLHQRGSRAERRIAPCDRRCARDPAGLHGLPLPERQLLPPLRFAVLRAERAELGPGQPHRGPARAHRQPGRGTPGTPRGRRRRQPLPATGSGAGRRSSRADQQGRAGRADRRQLLRADGAEPAEQPARRPARAGRKRDHGEVHRPEVHRHLRRLQGKRAGGVRALDLRPRVQLVPAYRLR

SEQ ID NO: 27498 - protein, 480 aa, Pseudomonas aeruginosa
QSPRRPLSMGCRRPGHQYPAGRSRLWRAAAQQLEPAVRRQPEPAPEKLRHQPAGRAGRNPGDPPQLPGPQPRSYCAEPGTPRRRGAARTATEPALRRQRALHRRPRRRSPLPGHGLGRRRPARGQGGPAGKFRGTAGRLGAVHRQPGDPGRRPASTRGAPFHRLPDATEDRRTDHRRHPLPQRQRRRRRLPRSRPAPATRPVSGPRHQPPPVRPGNAAGKTPAGGRRDLEGLPRRQPVSGLPRSRELASNSRSRPETRHMQPTSPTRKPRASSQARIAAILDAARDLLADEGIGGLSIYSVAERAEMPPSSVYHFFPSVPALLQGLTGEVHAAFRACLEQPVEHAGLRCWRDLSRIVEERMLAVYARDAAARQLILASHGLAEVTQADRQHDVQLGQAMRALFERHFLLPPLPTDIEIFSLAMELGDRVYALSVQRHGIIDARLAEEGMRVFDAYLGLYLPPILEKRSEPLTGFISDLNR

SEQ ID NO: 27499 - protein, 261 aa, Pseudomonas aeruginosa
KTHKTLLNRFTVRFLSDINPPIPRSGATPRSRPPDPLPAAAKPGSHPSQHTRCSMTRNVTVAATQMACSWDRPANIARAEKLVRQAAARGAQIILIQELFETPYFCQKPNPDYLQLATTVEENAAIAHFQALARELQVVLPISFFERAGRARFNSIAVIDADGGNLGVYRKSHIPDGPGYHEKYYFNPGDTGFKIWQTRLRTDRRRYLLGPVVPRIGAQHGLGSARNSCSTRPPSVANRTTPASARAITGSACSKAMPEPT

SEQ ID NO: 27500 - protein, 406 aa, Pseudomonas aeruginosa
RPWTVRWSPEASGNDPRGDAPRIPRRRPPRIVTISGAAMSNPTSTPRADGFRMPAEWEPHEQTWMVWPERPDNWRNGGKPAQAAFAAVAKAIARFEPVTVCASAGQYENARARLDDGNIRVVEISSDDAWVRDTGPTFVIDDKGDVRGVDWGFNAWGGFEGGLYFPWQRDDQVARKILEIERRARYRTDDFVLEGGSIHVDGEGTLITTEECLLNHNRNPHLSQAEIERTLRDYLAVESIIWLPNGLYNDETDGHVDNFCCYVRPGEVLLAWTDDQDDPNYLRCQAALRVLEESRDAKGRKLVVHKMPIPGPLYATQEECDGVDIVEGSQPRDPSIRLAGSYVNFLIVNGGIIAPSFDDPKDAEARAILQRVFPEHEVVMVPGREILLGGGNIHCITQQQPAPRKA

SEQ ID NO: 27501 - protein, 495 aa, Pseudomonas aeruginosa
SQLPSDAVRIRRSLHAQLFLRLEQRAQEQGQGRSFFVSLTGNAMEFRVVGQLPWPDRPHAPFGDPGGGIVRRQVADVGAAEDQGSDGLHGVGVGPLVEAQVVRAMVFRHVAAADIVGGADLVQCRLVVRPGEEGVRAAAIEVLLLAEQGLVVEPGQPVVKGPHRQLQALFQHRVLEFVGTPRVQLEQHLRGALAKQPDGQRQRQAMLADDAIDAAQVQRLAIAPAEAADLLAETGDVAEQAERGVVELLPLLGQLETAVAAPAQGIAQAHLQVAHQHAQARQAGVQARLGGSEAAGLDDGAEGAQHAQVDVVEVAQHSRPHGVRSAFVIAPKPGRRNAVRRFARPTRQSCISVRTSWSPPPTPWRRRHRTAARLPPRRRRPGPARAGRGPVAGPGGWSCRRSPGCRCHARKPGRTRQRRNSHRSARRPPPAGLRPRSPRRPVRRTLPCGSRRMPHSRAKASSSGEYTEPRMPICTVRTGSSRPSSMALRNGVPWV

SEQ ID NO: 27502 - protein, 441 aa, Pseudomonas aeruginosa
PPTAVILARNRPARVPLPGTPVPPQGPGLRRTARQRAAPEPRPGSGARRTLGLGPGDRPDVRLAGLRRADRPRSGGTRRPHRDLEEAPAPRRVRHRAGGPPQPPAGPDRQSRPHLPPAPQGRRLPLDPLARPGPPRRPGQAAALHWRGPRHHPATAQGRPPAPGRGGIRQHPRGRSGHRCPGGDRARQPFLRAHHRLPLRRRARQDPGDPPLRPPGPGVLPAPVAGPARAGRLERRNLEPAQERRDLPAVAAHPRGAQRPGPADPLRRGVLRPEQHQALGERAGLPRPPRLADRPAQPRAAARAHRAGAGERQGPDGGRGPAADRPRPLQAHQRQPRPYNWRHAPQGGQQAPATPARRALPAVATGRRRIRHPRRERRPGSRRAPLAAHPRRFQRAVRHPLPADLYQRKPRCQPLPGRRQRRRPPDATRRRRAVPGQGQRA

SEQ ID NO: 27503 - protein, 287 aa, Pseudomonas aeruginosa
RLRLLHPRADRPGPRPCPGGIGPAPCAGSRRTARPLPAGARPGQRADRRRRVAGALAASRARPGAARRVRPGGGGMRADRRAGQLGAQACLPADARVATARRRAGVRRGQRLQPAVQPRRPGGKDRQCPGRVRTGAPLPGAGSHRKRGDGGLRAVPQPALPPAYPRREPGHRRLRHRLFLADAPQAAAGAQAEDRPGLRRRPARRGGRRRDRPGDRCPGAKHGAAGGCRGHRASGPGAVPARTWLRLRPRLLVRTAATGGSAALRPAARGAAGRLSLAAKPGRFAVL

SEQ ID NO: 27504 - protein, 269 aa, Pseudomonas aeruginosa
RISPVIPGFGLTLGYTLVYLSLLVLIPLGAMFLKTTQLSWEQFWAIISAPRVLAALKLSFGTALAAAVLNGLIGTLLAWVLVRYEFPGRKIIDAMIDLPFALPTAVAGIALTALYAPAGLVGQFASDLGFKIAYTPLGITLALTFVTLPFVVRTVQPVLADIPKEVEEAAACLGARPLQVFRHILVPALLPAWLTGFALAFARGVGEYGSVIFIAGNMPMKTEILPLLIMVKLDQYDYTGATAIGVLMLVVSFILLLLINLLQRRIETP

SEQ ID NO: 27505 - protein, 444 aa, Pseudomonas aeruginosa
RQQELQRLQGPGQHQPGYPERRTGGPARPLRVRKDHPAADHRRAGNPGRRQHRVPWRGRLAARRARPQRRLRLPALRAVPPHDGVRQRRLRPAHEAQGRAAGRVRDQGQGPRAAQHGAARLARRPLSRATLRRPAAAYRPGPRAGGGAEDPAPRRTLRRPRRQGTQGAAPLAGAPARGDQPDLGVRHPRPGRSDGSGRPHRGDEQGRDRADRLARRGLREPGQRFRLPLPRRLQPPATGQRPAPAVPPPRSVAVAFRGGRAPRRRGPRHPSAGGYHPGNAEGRRPGRTDRSRSGEGPRQPGRPGPRRDPLLQAEGLPAGGQSLIPRRVQPAVRSARPRSPARPFDDTCNAREPSCGRNQPWRRQASSNAAPSAPPRCGLRSLQSGQAQANCRRRRRTSDRSIPNLASPASPVALRRSVLPSCSIQPASSIRANTPTASSPARWS

SEQ ID NO: 27506 - protein, 109 aa, Pseudomonas aeruginosa
KRLRPRASRLSTPPSTSRPRWPLAEDGETPASSASSLAGRALPSISAQIICARPGSASSAASELKPGLNCMLHLRMKHCLSTTRDTGRHRPFAPARDKEEPACPSTSTP

SEQ ID NO: 27507 - protein, 320 aa, Pseudomonas aeruginosa
WRSRRRQDAPMLIANGLRKVDMQDLLVFLQVHQRQNLVEVAEHLNLSPSTVSYCLKKLRQAFDDELFIATRGGMQPTHKSRAMLPHVEEMLARINACHAAQGSFDPRGEPRTFTLCAPEYVELLILPALLRRLAANGPRIGLDIRRLGPELPTEALLDGQVDLVFDFGPEYHRPAPELQALALFSDELLCVQDRAQPRHERLELDEFCRRRFVFPTPLDASNANLVDTWLRRQGRSREVAARANRYVAALQLLSGSDFVLMLPRRIHALLDDGRHHACLAPPGLPPFALHLSWSRAADQDPANLWLREQVLIVCAELGLL

SEQ ID NO: 27508 - protein, 1046 aa, Pseudomonas aeruginosa
SAKCAGRPVRSTGAPGRPWPGPFPGRAWRHRRRGRLWPIRGGWSWRISLADWQPREWKAARHGVTLSLPLASTKSQLPEIPGSQFRHGTATDPRRPPRPGRPALSPAARRDPPWSPGHRRSPASHAIPRRTPGSVAQDRQRSLRAPRQRGLPRRPGRQRHLRRPRARRGSAAAARRRSVAAGRALGTHRTAVRSDGPASTAPLQLRRRHDRQAPLSLRYLAYLRAPGATPATALAGVLQGNRRRPRAAPGDLPLPGDQPRRAVRLERPDGHPGRPAGTRPAGPGDARPRRPGGGRGTRLSAGPRQPAGHRRRGARSAGGRRGAARRPAAGQRQAGLRHPVAPVPAGHADEPGAAPAVAGLGAAPPGADHRGRLRQRVPLRRAFAGVAAQPRPERPGGLPRDLFQDPLPRAAPRLPAAAGKPARSGAGGAQAGRPAQRDLAATRPRAVHPARRLRPPYAPLATRIRPASRAPAGTPARRPEPLARSAAGGGRDPPRGALSRTAGCAAHRPSFAPARPGGRHPAALLRGNPGTGRLPLRLRLHRTGRHRPGVGPVARRAAALGALPPIHGRQLGGAQVGADLPGQRLDCNRAPCPAAHDAPRYPPYGRRRPLQRHGEDGSGLQQFRQSFAVQAEHAGSLALGQLLRVVLGQAGGLGRQAEDQLFAGKHATELVRRSDQPAQLQRQPPTRPQGRAEAGAETPQQLVEPRLVQRAAAIAPILQCPQQRQVAQAMQQPCGIAALDVRAEGVGQFPGDVRATLRKIPEVHGALGQQRLAELDGPLQAETEHQVQAVPESQPPQGLAQGLAGRTDVPGGAVGGGDQASGDLRIAAELILQHAQRMLLGAQATIAGGTHVGQQRRPLRGVARAFEESLQVLARVPLRQRTGDHFVALQQQPSQALHQVLGLERLHQVGGRRQCHGGAHAGLVGAVADQDERLLGDRAAQARFAQQLEAIHLRQVQLGQDQREAPAPAMRQRFSAIAAEDQPGIATHAEDQLAKQVATPGVRVGNQDDGGLFRGTHGVPLRTWRTERDAPGMTGGHDTARGHTRV

SEQ ID NO: 27509 - protein, 289 aa, Pseudomonas aeruginosa
DARPNSVSLDMAMTSASSLKRNTGASGPKVSSLDTRAFFGTSTRMVGSKKVPPRACGLPPETTLAPLETASAMCSSTLATALASISGPVVTPASRPLPMFSLATAAFSLSTKASYTPSCTYRRLAQTQVWPLLRYLEISAPSTAASRSASSNTMNGALPPSSRDTFLMSWAHSAISWRPISVEPVKVSLRTIGLLVSSPPTSPALPVTTLNTPFGIPARSASSARASAEYGVCEAGLSTMVQPAARAGPALRVIIAEGKFHGVMAAVTPIGCLITMMRLSGWWPGMVSP

SEQ ID NO: 27510 - protein, 257 aa, Pseudomonas aeruginosa
SWPATRTPSISSRYSTSRAPSPSGRTAVRPATSMASSATSPKAARVFAGPATNCCWNRSWRAWSCAATGGYSRRRVFRRFSRRCSRSTGCSTTNSVSTTSTCRANTACRPATAITTCTTGWPSRKAWSTTSASTNTATPWSAATGSTSRSVSPAARCCSAPSRRATTRSRCFILSATAKMFVRLDRPSGTTASSARPTTRSIISLARRSSIRTRPTSATTTPVATSGAAPAGLSAKAASEGTGAMRGRHRSAATTRG

SEQ ID NO: 27511 - protein, 384 aa, Pseudomonas aeruginosa
QRRDMMHPRRLLAVLGVVVLTSMTSCTSFSSSRSSSMDKTGWITHCFGRFLIDLPPDAVINAGYYLWGDRIEYLDDKPTELAARVDRLEQEWRTQRHKSKGNMLLRKIDFGNESVGLLSWSSEVASKTYLLDTYVTSKPTWHAYRWKGKVSVDREQHAVEISRALARNLRSRAPKEIPSEPGFCIDHAYIAGDSFQVERFGVGVTFPEHPGARFEFRSSTGAELNSLLERVDGFVQNMLSTFAGMETLRKGKHPVGSLPGEEYLVAGSDKGQRGYTFMWEVQGKEESLTEPNLTAGLAVLERSNENGKPPPPAFKSDKEALELWDTIVDSIRVRPTSSSPRGGNAGPSPAPKPATPGGQTLGDDYVYEEFLSSLKPKDSWLDDL

SEQ ID NO: 27512 - protein, 90 aa, Pseudomonas aeruginosa
ERPAMDIIRLGDTTSHGGTVIEAFGQTDLNGKPMAGVGHQVVCPLCKGTFPITEGSALLDVNGVPVALHGMKTACGASLIASGPLGAAEN

SEQ ID NO: 27513 - protein, 422 aa, Pseudomonas aeruginosa
KRLRCCMSVVTDRRIPDSPVDQRLPLTQLLLVGFQHVLLMYGGAVAVPLIVGQAAGLSREEIAFLINADLLVAGIATLVQSLGIGPMGIRMPVMMGASFAAVGSMVAMAGMPGVGITGIFGATIAAGFFGMLIAPFMSRIVRFFPPLVTGTVITSIGMCLFPVAINWAGGGKGAEDFGSLHFLFLSSLVLCTILLINRFMRGFWVNISVLMGMGLGYAIAGGMGMVDLGGLAERPWFDIVTPLHFGAPTFDLAPILSMCPGGSDHLRRVHRHVPRPGQDHRPRDHPDRTAPRPALRRRRLVLRRFPEHLHPFLVRPEHRPGADDRGAQPLRHGGRRRFPDPPQHAAQGRLPGRLDPAGGTRRRRHRHVRHGRRQRHPDPPRGQHHRPPQPVAGGGKHRHGHGAGGAPGLLCPPAGLDGADHP

SEQ ID NO: 27514 - protein, 627 aa, Pseudomonas aeruginosa
YKNEEQNDGQNESNRSRRTGDAPRRRGYRVRRPRCRDQPHVRRAEEDRRHRPCPGPSRRRRLAHGRGLHPYQGRQHRRLHRHLRPCRHRHDHRPLLRLRRLHPDSLHYRPGTARPPAQGRLPGGRHLQHRRAGGQVGDHRAGTGPGPLCIPEGLPADAQRPARPGTDRPAVRRTDGRDRVRHRRLRAPPGEQAEGHPGPGREGPGHARRSRAPAAGGRRRHLQRRRRRALPRIRRADRHPGDPDPDGLGRNPRRPPADGRHGRPADLAPLRQRHPAGIRPGARHRQPLGQPPHRQRRGLYRRSPLHPCRHRTDPDRPGVHARPGHRLRRRRRPRRIPRSGPRMEGRRQAEVARRLAGKLPAAQTHAAAQDPLRQRAGETAARLRRDERVLRQGCLLRQHHRPVADRRRTVPPCLPTAPLDQLRPGRPAGLDHSRRAGGGQGRPEPPGGGALRRLRLPVHDRGTGGRRAVQAALYPRTGEQLLPGPDPPGAARLRHGLLRAAGLRQHQRPRAGRLRRRPRRGGRGPGLQGDPGVRPERDRRRPGQGPRTDATAPGAGGGRGDPGARHQHLHGYRDQRHQRVRGTGRERRRRADRHLAARLIAGLSRRRGRCVRHPAPGERPPERLTER

SEQ ID NO: 27515 - protein, 263 aa, Pseudomonas aeruginosa
EQDMPRFCANLSMLFTEVDFLERFDAAAKAGFAGVEYLFPYDVEAEAIKARLEANGLEQVLFNLPAGDWAKGERGIACHPDRVQEFREGVDKAIAYARVLGNRQVNCLAGIRPQGHDCASVEKTFVDNLRYAADKLEAAGIRLVMEMINTLDIPGFYLQNTRQALEIRDKVGSANLFLQYDIYHMQIMEGDLARTLENQLAAINHVQLADNPGRHEPGTGEINYRFLFEHLDRIGYQGWIGCEYKPATTTEAGLGWMKTHNVV

SEQ ID NO: 27516 - protein, 477 aa, Pseudomonas aeruginosa
RKRTPGREIHGLCVRAPRFHSPVPAGAGAAEWKRRRRCDRRSDRRHDNKKFGACHEYRSTRLSHRAVQYRGGSRPSLPGAGRPPAGRSQRARHRHRCRQGRRSHGRSGGEALAGRDPGPGSGALPLRRAMQSHRGGGSLPSGARRRRRARRPSRAGTDQRPERERPGDLPSLRRRLRTAFAACRRHWPGGQAGGEQGAAQVRRRHRRDELRAQAPLGDQGRSPGQGLLAGQRLYLRDFRRSRRRGHGDRLRPQRRRPDHLRRRPGDPQALRHRRAAERPRLARRPALGNRQARRPVPGAQPLPVDRHATERPRRSSGEVPRGRLLDADPRRPGGRGAGSRQGPRRHRPADPQARPAAGGALRDPLRRRDHRHRARQRSRRTQRRVPPQPHRRAQGRTEHLGPGRRHRRHRRLGRQRRRADDALLPCPRRKGRAEDPRRARRQQRLRLFPGPRRPAGDRTDPHQRERLPRHSHPRVLT

SEQ ID NO: 27517 - protein, 398 aa, Pseudomonas aeruginosa
GAASIIRSHDERTRQLARTPLYRHLPDRHPRRPALRQRAAAGDPGQPAGSDDRQHRRNPPGLRRPAGLHRMGLHRHLPGGIPAAPVLLAQAAALCLQLLRPGRPAGDPPRLPRPALPRRPVPADRPGDTHAADLPRAQATPVPEPSQFPAHRPARQQAEDHRVLPHRDDPGHRVRRADVRGRRPGARFHQHPPRHLLGDRHPDHGRLRRHHPEDPARPGHRQPGDAHRLLDHRGAHRDLHRRTRHRDAPGPGQPVAAGLPGVPQGDPRSAGGILLPLRQPVVPSRGRQPWEVLTGSAGTPSGSDSAATRRRMPSTRCWRPMAGPTGTTTAIATSSPAWSTSTAGANWRCGRTWWSWGGGPTTWSTTPSARTTRPPAPPAPSTGSTMPGWPRCGRPCAN

SEQ ID NO: 27518 - protein, 258 aa, Pseudomonas aeruginosa
REQGQGVRRQTVQAGTGARHRRPRRHHYLHAEPDRRRTGDLRERSRDDRPRIRPRRLRGGLPERVRRGRASGGGGRQGGREERQPRPGRGLPEVPVVGRRPDHRRQQLPAPAQPGDPRQVRRPLPESRLLLGGEDLWRLAQRAEDPLHRRRRIRPDLQPQLIPRRSTKKPEALALPAFSFGLQFSHCRLSETRAPPRTRGSPAVRRPRRTPSRGGCRRCLASPAGRGRSALPGDPCRRRPPAPTTCRSPRGRDRPGTG

SEQ ID NO: 27519 - protein, 481 aa, Pseudomonas aeruginosa
IPRGRRGRWSPRPRCRHGSAARPPRRRHGCRDRLGISCAWLPRCGKRRRDGSRRSSGDVSGCVQGAFFRLVMLLLLPGIALGGRHRDADGDEYRQQAAEQFAEQDRQDQRRLEVGGECQVIADGGLGADAQGHAKHLVASIHVFEQVVGGDDVRQYHDKGGGARLGQPQVTAEDRHRALAVALEQVADGEGPGQHDADVASDLDGAEQLFLVGEHRVEAPAAEDLGEDSGEVLDDGKRQGHLDERVHHLAEYQEPGDHRRRPVLQAGGQQEAEDEQRRQQPKHVEEVQRQVVQGRRTGRYQFAHRDVVEGNQQQRRQHRERNADQPGHRPQRQVLVVLALEHGQADRDQVDDGRAGGVAHQHGGNPHVAVGGQGIGQLVAAHVHRDDRQRGDGYVGTEGLEERAEGMGNRLRQIGNGYHDAGLGEEHRTDGVDAVDELAAQTAFRAQDGSQRAKYRTQHDQVNHIVSELGHLRRSPLGRLP

SEQ ID NO: 27520 - protein, 185 aa, Pseudomonas aeruginosa
QHLHRHRHHHPAVRPRTGAPEPSDGDHQLAVDRRQRRRLRQPCIHDRRRVPPGIRTERRRPGHRADRPVQRRACGDHRRRAERRWRHGFFHRGSRDRPCHDRPGPPTDGYRRLLEARPARPVPGLPAEPDQPPGGRPQAYRGTLGSPATGAGGSPRSPPAHPAGLTPLAGSPGDRPGLCRWLPVD

SEQ ID NO: 27521 - protein, 130 aa, Pseudomonas aeruginosa
STPPSSGSPACAACRSPPPTQDCDRPAKRRNTASARSTDATGSVSAASVPPVSPRRWASHATSIVSTRASASTKRFASRSGHRYRTSPNTCRATGSVPATTRSSATARWSPAGKSSPPWKARCQPATSAA

SEQ ID NO: 27522 - protein, 426 aa, Pseudomonas aeruginosa
APAASPSPSPPGVAMSITEQVDVAIVGSGPAGLAAAIEIRRQGVARVCVLERDGEAGGIPRHCAHPPFGLREHGRLLTGPAYAQCNVEQAERAGVDIRLRHSVVALAAAGLLQLATPEGPRSLRATRVLLATGARETPRSARLLGGDRPLGVINTGALQAYLYLQGLKPFERPLIVGTELVSLSAVMSCRRAGIRPVAMLERNARATARWPLSLFPRLCGVPMYFSSELLEIEGRGRVEAARVRLGDGRVERIACDGILLSGRFVPESSLVRLSHLELDPASGGPRIDQFGRCSDPAYFAAGNLLRPIETAGWSFREGRRIAGLLAADLRAELPSAAPGIAIDCSGPLKLCVPQRLLADPTPGLAHLQLRVSEAASGRLRILADGRPVWERALSCLPERRLLVPLAALRLPPDTRRLEVAFLTSGH

SEQ ID NO: 27523 - protein, 118 aa, Pseudomonas aeruginosa
PSAASGSSARRRQACSPPSPGRSMANRCTPWTAGSTTPAPRSSGPGVSACSATSRNWPASTGRRPSSAAWPSSRPCRDSHARTGTAAPARCGWEWTPAPAARTSARPCSKAWCCAAPR

SEQ ID NO: 27524 - protein, 474 aa, Pseudomonas aeruginosa
RSPTACPSTAAWRAAPTSPSSSPTACNGASSPSASTNSPPSVAPPLPRVASATSWRSRAIPARSSSRGSTPAPPGAGRCVSAKRWRAPAAGAEPLSASRPAGLAQRRQERLPLQRGHQPAVLGAHVLAGQQHVDDGFFHRLRRRGEQRRDVVVVEHPQRRALRQVLARIVGWRQVLVAGGEGEEHVAAGVLGATAGASDADRGALRQALALVRQQRRVGGQDHHDGAHARGAFLAERRGDVAQPAADRIAIDPQLATLAVVGLDQRAHRPAALLRRQPPRCATDATLELVADHPGAAAHRTFADRSGLGAGQRLADLAGADMLAPDIVEQAVEGLHHHRHAPVQPAVAEFGALLGDQRVAHRADAVGIGDGDRGGQQAGFADPLQARGVAVAVEHMAAGEAGLQARRTGARLDQGDAGANLPAVDPLVQGAVADAHAGNVGDRVERAGSAQAEGDAKLSSAHADSCFKASGTPD

SEQ ID NO: 27525 - protein, 135 aa, Pseudomonas aeruginosa
PGATASRCHGCSTGSRSGRGWRASPGATARRSAARRAGRSRSVLPAPATRAPRDARCDRRPSCPRRAAPRRRNRCRRTARYRPLRSPMPRVRSPAARRRRLPAAAEGRSPVAVHGRNRGRRSPAAPPLPAAGRYP

SEQ ID NO: 27526 - protein, 357 aa, Pseudomonas aeruginosa
WRPRRTRPAWVSAHFRARGKSSCRCPLIVIEVEAVTETRGGPLPGRWLCADSRSAEPAGQSPFGVAPLDAAGGKAANRSLRKPTVERIRMHTLFRDIGMHASLGRAIEQIGGNRFWKQLILLLRQHLPFDNALAIFYPANGVPVALEEYDAEPHAGPASMLAYLNGLYLLDPFYQACREGLASGLYRLEEIAPDHFRQSEYYLSYFHDNVLEDEVQFILQVPGQGALSLSLGMQRMFADEECGMLGLLSSWVLALMQQHWQQRSQRLLPAAPQEEMATQIRDALSHFGASVLSERELEIARLILRGYSSKAMAERLAISPETIKVHRRHLYAKLDISSQPELFSLFIQSLGHDPENP

SEQ ID NO: 27527 - protein, 760 aa, Pseudomonas aeruginosa
PAACSERNHRSGQPCSRRSRRRSCPAATGRRSACAGRRRSVRWSRRCPGSGTSGSAVPGSGCGSVRARRRWRTRRCRWRPGPRRRGRDRAARWRGNASSGLRLVQQLLVQRRQLLAPDFLVDHPDDLVADDALFVDQVGFRRTVHAQVQAQGAVGVADAQQVGIVQLVQPLDGGGVVVLVVDPVDHHALLGQSGQFRVLDPARRAPGAPDVDQRRLALEVGLGQAPGRVLHAGQVEGRERLADQRRGQLAGVQPEAAEEEHRDDQEDPQRQQQNRSFQDSGSLTGEAQGLAHTCFHLHPVAPVERRQGAPEAHQQATEPDPADERLDVHAHRPGTVIQRLAERHVEVAGKAGIDPCLGHHRTLHGVQALLRMQGGDLLAVAADVDAALVRGVVRPFVVLRAVEEEVVAAQFDGVAGRHAQVTLGAVLAAEDDADGAHGDAQVRQLHAPVAAGQAAGAGQHALVPGLVEEVAETGQDHPGGQQEHRQHRPVEIAEVHRTGRRQDRAGHQHRGQHAEQPAARGVLPAHQHADRQRRHQRRHQRQEHGVEVRRADRQLGAAEGIEQQRVEGPEEDHRGRHHQHQVVQQQQGLARPQGEADLALDHRRAQGEQGQRAADHQQQEGEDEHPALRVGGEGVHRGEHAGADQEGAQQAQGESGDRQKHGPALEHAALLGHRQRVDQCSADQPGHEGSVFHRIPEPPAPPAQLVVSPPGAEHDADTEESPCYHCPRPRPARPCGVQAAAEHCGDGERESHRKSDVTHV

SEQ ID NO: 27528 - protein, 353 aa, Pseudomonas aeruginosa
HRRVDDQADVLQQKVEVVAVHPGLRQQAAERVGGDDQEQQEAGADHAHHRQHAGQHDLRQLPGEDRHGEGPATEDQRPEQQRTFVGAPNGAELVVPGQRAVGVAGHVGHREVVAQEGPGQATEGEGEEGELPPGRRARQAHPLAVAAPGADQRQARLHQGQAEGEDQGQVAEFGDHLLALLVVRGLAGGLAVLVVLQLAAVLERLGDFRRHVVLVVLGQHFIGHQHAVAAQLAEGDDALPLAEQVGKDAMVGDGHFLGAVGDHETHVQRILAALQRTLFHQAAGAYAGVGRRFAVGDLGRGVEQVDVLLQGRQRQAHRGADTRHDGEDDDQTFLADRIHCWASRRRRRASSCR

SEQ ID NO: 27529 - protein, 133 aa, Pseudomonas aeruginosa
MSAAGQSLQRSLQRPATENQHRDVQRQDQQRQQQAAALEAHGQGRADGAEQAQHRRTEQQGKQQHRYATGRQAQHQREQRRHQDQGQPGKQPVCQHLGQHQKSQGVRRKDPLLQRTVLEIAAEQPFQREQHGQ

SEQ ID NO: 27530 - protein, 232 aa, Pseudomonas aeruginosa
PAGICCRLWWVVSTTIPPRWQCPARCVSSCATPCLSRAVKGSSRIHKGGASRYRRASATRRCWPAERVWQGTSSKPRRPTSARACQIASRLAGWCSAQSQVRFSSALSRPLIPAAWPIHSRLRASSPRCSASGRPFRRTSPAVGCISPDSRRSRLVLPLPLGPTTCNISPAARRRSRRSNSMRQSRSQASPTVSSKGLAVGTSAGSDIEQHRQASFLVAAPEAFTEQTLKSG

SEQ ID NO: 27531 - protein, 146 aa, Pseudomonas aeruginosa
WNTPPWTTLAPGPARRSLRDSQALVDGEYLNLAIERREDGQLLGSCILFHFEKGSRRAELGYCLARAAQGRGYMGEALRRLLAFAFDEIDLNRLEAEIDPRNRPSAASLERLGFRQEGLLAQRWIVSGEVSDSALYGLLAEHWRNR

SEQ ID NO: 27532 - protein, 155 aa, Pseudomonas aeruginosa
IEPRHTSGTARVSPATSNSRHSKGSAAQAGRPSSSSGRSSSGGSPTLAGALGTRNSMTSWGRGSTGSSRNVVGSSSRAAGAGGTRRASRTCSSSTAASNSSNPWSTGSVSSAGAGVATSATASATGFNGAGAGAGGVSTRGSRSSKVASWSNASR

SEQ ID NO: 27533 - protein, 97 aa, Pseudomonas aeruginosa
FRRSSPGRMRTVPRPSTIICLPPGASSARPGRRMSPSSASLTLIRHSLSRRSAKALVKAAGMCWISTSGAGKLAGNWVSTRCKATGPPVEVPIATSR

SEQ ID NO: 27534 - protein, 80 aa, Pseudomonas aeruginosa
ALRFGAAEVDAGAGDAPALARALAPRLEDDAGAWLDEVAEGSGGRLIERRLLRAMVRTFSQSNWRTLSGLREMSSKFFGR

SEQ ID NO: 27535 - protein, 283 aa, Pseudomonas aeruginosa
RQRCRSLEPGGSETQAGQQIVHVILPGHHILSFFRGDLRPLALGRTLQRGLVAHAHVVVLDSGVTVHLAGHPDQLHEVALDLGDQLGDTLDHLAGQVLVILRQQDVIELRGQLAGVLAAAHEELFDALGQLAEAVSVDFPAHEALPLLVQLPRIVAQLVDQRGALLHQVHGPVGGLLGHFHHVGKTIGGIGDLRHFLRVGGMRVDLEIDDGVVQFAGQLAHFLVEATVPGLAELLDQLHRLLEVPPFETVHQFARMFFQGRFEFVARGIVTKHHDTLLAGFSR

SEQ ID NO: 27536 - protein, 215 aa, Pseudomonas aeruginosa
ASVIEVGSSQTTSSTSCAARTKLTTESPIPAAVSTTRTSRLSLISLNAWISPACCIGERCTMLCVPEAAGTMRTPPGPRRRTSRSSQRPSITSARVRLGVSPSRTSTLARPRSASSSMTRRPRSARASARFTDTLVLPTPPLPPVTAITCTGCMLPICFIPCVVVFPERPFQRSPVLAGTMRHRSRPGGSHLRFRHPRHARFFPRPQPARRAGCW

SEQ ID NO: 27537 - protein, 314 aa, Pseudomonas aeruginosa
TASRRRPGGGRSPRSPATARCARRAGRSRPTPGRCRREWSRKGYAGFSAAGKGSSTGLPGSRFVAQQPERGHHQHDVLADRHVGVVPVVRQDQADRQAVAKHQPELRQQRAPAPAAEQQADAERTVEQGPGDHRQARRPAVDAGLAEDPQAPTVTRPQAGDQGTQPDQHQGRQHQRPHQRRQAACRLRPAEQATGQRRATIAAGRIEECRVGQVVVAHQLQHRWTQCPPASTPAKPAQRIEKRRGRHHIAAARPTLGAAQLVQQLALGQRLRTHQRNHLRPLRPAAQQGQHRADQVLDMQRLQARAIVQQGNQR

SEQ ID NO: 27538 - protein, 322 aa, Pseudomonas aeruginosa
RIVRASEAVRRTSRKPGVYSRPAGRTTGAPQENTATAGHPGQDRRTPGRYNSSLRIAAAQDVPETRRAAPAARTLRLRRRDGRPGNQTGTRDEPGSAQAGSGTGRRRPHSSAPRQQEHRRRRHRLHRQLLHRCPGPPQGRVRRRSGQFGGHRQAPEGTWHPGLRAEHGQRAGVLRRRRRRKQRAPGADQGRRCRADPREDRRRGGQDLHLHRRCQQAGTHPRPVPAAGGGHPDGSQPRRPPTGEARRRSGLPRRRADRQRQYHPRRAQPAHRQPGGTGREDQRHRRRGHQRPVRRPPGRPAAARHRRRRQDPQGLSPLAPGR

SEQ ID NO: 27539 - protein, 143 aa, Pseudomonas aeruginosa
PVRGDTATKAATLCLSRRLVRCDPPHPVNKELDMAAKFHLKKAKDGQFHFNLHAANGEIILTSELYKAKDSALGGIESVRKNSQRDGAFEVKPANNGKFHFVLKATNGQVVGQSQLYASQANAEAGVQSVKRAAPEAGLSDES

SEQ ID NO: 27540 - protein, 718 aa, Pseudomonas aeruginosa
TQRPIFRLASNTPGRCLSLLRRPSRCQLQRSDTSGRPGVNSCSRDMKRSASCFPRREHHSMHHRTDTEESAVFKPLAVAVGLGCAALSLGANAYQYGEYAGETLERLITDYPGRYRGTASFAGASELMQSRLGFGYQTSRQDFTWAGNRSSQNVIASAPGSSGKFLVLGAHYDTYYGRPTLQGLDDNASGAAVLTEIARNLGGIALENGLEVVGFGAEEEGLRGSRAYVESLDASQRANLLGMINLDSLVTGDKMYAHAGSNSVSNPALGAYREQILRIARELDIPLFTNPGLNAEYPAGTGCCSDGESFNGMDIPVLFIEATNWELGDLDGYEQTDNPAIPGGSTWHDPAEDNKEVLTNALGQERIEQRMRDFSRLLTRLVLELTNADLLASTASGGALARQMEDQLQRQHQALTRLHDRRWLTLLGSNRPVGSFDGEVGAEGEVSPDSGFDMPGDPESRRAGVHLLGDYRYSEALTLGGSLAFQRSRDKLDHGGRIEGDTWQLGLFGLYNDGGPEWLAGELNLGHTRYDSKRSVYLQAAGGPVLLDQRLSGDTSAWSWGARLEGGYDFSFGELRSGPLAGLDYMRYRIDDFREDEALRTALGYEKQDYDSLEVSLGWRLRGELALGARMRLQPYASLRWVRELADGRLDDMDLTSRGDGRVRVADMGGVDKDFGRAQLGAQLAITEQLGVFAEANSRFAHSEGNQAGYSLGVNWQF

SEQ ID NO: 27541 - protein, 358 aa, Pseudomonas aeruginosa
QLLDCMEFSMTSAIAIERICMEFGTPGQGLKALDDVSLDIHANEFFTLLGPSGCGKTTLLRLIAGFEQPSSGSIRLYGEHMEGLPPFRRPVNTVFQSYALFPHMSVADNIGFGLEMQGRPRSEIDATVSRMLDLVKLPEVGKRRADQLSGGQQQRIALARALASRPKVLLLDESLSALDLKLRKEMQIELKRLQHETGITFIFVTHDQEEALTMSDRIAVMSKGKVLQVGTPSDIYEAPLNRAVADFIGETNFLEGQADADGVRLADGQRLAATTPGSGAVTLAIRPERTELAADGQLEGVLENIVYVGTDTVYHLNVAGQPGFRVRQQNRDGARCPHSPGAKVRVRIPAAAIRVLAE

SEQ ID NO: 27542 - protein, 640 aa, Pseudomonas aeruginosa
STTCASGPTPAEASHERPQSTLDLQRRAPGRLAVLRLPLHPDPGAGSAQLQQRPVGDALGELQPEMVCGGGQRSGNPPRGEELAARRHPRHPGLDRPGHPRRAGHARSRLPRADPDERRSRPAAAGAGDRHRGGDPDVLLLHRPEAVVVHHPHRPHRVLHPLRLPADPRPPGGPGPAPGGGRRRPLRLAVEGLLENHPAAADARRAVRGDARVHHLDGRFRHHLFRRRRRRNHPAGVHLQLHPHGHIPEDQCDFLDHPHDFHRLRRPVVLPRPTPPLRTCLHEEKTEDRQESIMTYRTPLTLLFAAGLALGGQARAEGTLHFANWSDYYPPELLKKFEKDTGIKATLDAYDSNETLLAKLKAGGGAYDVVVPSDSFIEIFVKEGLLQKLDKSQLPSLGNLKENFRTLGFDPGHDYSIPYLWGTTGYSYDTAKVPGGRLEESWKPFFEPPAELKGKVVALNSIEELFIPATYYLGIDECTEDAREAQKVLDLLLRQKPALAMYNSDGTIERMAAGEVAMHQQWNGAFHRAHAQRASLEYVYPKEGIRLFIDNFAIPRDASNVKEAHVFIDWMMRPENIAAASNFAKYNNAIVGSEKFMEKALFDDPAINTPQDKLDRLKPFKLCSPKALALRSKVWTKLKK

SEQ ID NO: 27543 - protein, 525 aa, Pseudomonas aeruginosa
TLSTPQRPCPHTPRALSSLPFPPTRRKPQRFSTSPSIHPAQERSAQAAACGIDTAFREERNMASERNNGILIGGKRPEYVHSAQGTGLRRILGLPALVFFGLVYMVPLTMFTTYGVVTEITGGRTASAYLVTLAAMLFTAFSYSFMVKKYPIAGSAYSYTSLSFGPCVGFLAGWSLLLDYLFLPMINYLLIGLFLNIAFPMVPAWVFVLAAIGLVTVLNVIGISSVAGMSNVIVGAQFVFAVVFVAMAVKHLAGIPSLDLSLPFVGDGSQPGFAPLMAGAAVLCLSFLGFDAVSTLAEETRDPQRDIPRAIVITTVGAGLLFTVLAVFSQLVFPGSVFQDAESAANEVMLAAGGKFLASFFTAAYVAGAAGSALASQASVSRILYSMGRDGILPRRVFGSLSERFKTPVIAILVVSVISLLAVVIDLTTLASMISFGALVAFSAVNLAVIRSYLLLDGRRAPRDLLRYGLVPAIGLGLTLWLWTSLSALTLVIGLTWFAAGLAYLALHTGGFRRKAPTVTFSEQN

SEQ ID NO: 27544 - protein, 349 aa, Pseudomonas aeruginosa
AREPDMLTIYSDDHRLHHGRHELIGGQFTPCFEKPSRADMVLDRVKAVGLGEVRAPRDFGLEPIRRVHSEGFVRFLQNAWQDWLATGRSHDMLPIAWPTRRLRQTEPDNIDGRLGYYSFDAGAPITAGTWQAITSSANVALSGQSELANGARSVFSLCRPPGHHAAADYMGGYCFFNNAAIAAQAFLDRGAGRVAILDVDYHHGNGTQDIFYDRADVLFTSIHGDPRFEYPYFLGYADEKGNGVGTGYNFNYPLAAGSDWATWSQALQAAIRQIQAYAADILIVSLGVDTFKEDPISQFRLDSPDYLRMGEAIGKLGLATLFVMEGGYAVEEIGINAVNVLQGFEGVHR

SEQ ID NO: 27545 - protein, 443 aa, Pseudomonas aeruginosa
CLWAPSCGCRPAPAGPASRSSLSSHFLRDNRFTQMSKTSLDKSKIKFLLLEGVHQNAVDTLKAAGYTNIEYLKTALSGDELKERIADAHFIGIRSRTQLTEEVFDCAKKLIAVGCFCIGTNQVDLNAARERGIAVFNAPYSNTRSVAELVLAEAILLLRGIPEKNASCHRGGWIKSAANSFEIRGKKLGIVGYGSIGTQLSVLAEALGMQVFFYDTVTKLPLGNAVQIGSLHELLGMSDIVSLHVPELPSTQWMIGEKEIRAMKKGGILINAARGTVVELDHLAAAIKDEHLIGAAIDVFPVEPKSNDEEFASPLRGLDRVILTPHIGGSTAEAQANIGLEVAEKLVKYSDNGTSVSSVNFPEVALPSHPGKHRLLHIHANIPGVMSEINKVFADNGINVSGQYLQTNEKVGYVVIDVDAEYSDLALEKLQQVNGTIRSRVLF

SEQ ID NO: 27546 - protein, 199 aa, Pseudomonas aeruginosa
ARPTFIPTRGVLHAISAPPADAGIPGRSAGPCRAARRRPPARRPAHRPGGHLSAVQLQAGRQAHRLRDRTGRTAGRRTGGQAGIRHHRMERHPRRPAERQVRHRAEPGLGERAAAQGLRLQRAIHHLQRPVDRARRRNPPVQVAGRPQGPQARRRARAPTTPTWRSRWPASTCAPIRAPRNTCRTWPANASTRRSTTAC

SEQ ID NO: 27547 - protein, 334 aa, Pseudomonas aeruginosa
MRRWRRSRPTAASPSSRKSGSAWTSASRRSEFPPERGKRPRPRDAAVVFVDGVLNEFAAEIARMARQPGRAARDGLALPAPGRDVYRAVRRGIDGPGPDPRLQRRGGPGDQGAGGLADRRGLRQRLPRDATAGADLRPVLRAAERRHRVHPGHRGHPGADPECRGLSLGVHARGDPRHRQGTMGSRALGRPDLGPDPVEHHHPAGPAPGGAEPVEQPDQPDQGHLADLRDHRDRTDAGDQGGHRRDLPAAAALSRRRRDLLAAFGTLRACAESPGEPPDRAAAALSVQPPASRPARQTAARSSSSSLNTSTPMRLRAAAVTPSPATRLPLKRPS

SEQ ID NO: 27548 - protein, 100 aa, Pseudomonas aeruginosa
FSRLPQEGLRALSTAIRMSWRRTSSTAASAPSRNASLTSSPSTVKTRFSRSSTSPPWPPGISAGGRGVGRPPATSGQRATIRPCACQRESRSNGPWLPPS

SEQ ID NO: 27549 - protein, 212 aa, Pseudomonas aeruginosa
DRTAGGPWRTSAAPSRLASRATAKEPPVMLPTRSLLPFFLAPALLASAASQAAMEALDNDSLSQVTGQAGISLRLDLRAGAARVAWVDDGGSLSLRNLVIDNGCVKAGDCPDGRGGNIPLGAAQLGMSLPIFGVEQPTLALDVTTGSGGGQQLAISLPDLATINDQLIASGLPAQRIRLRVASDLYIGDNSIGRIELRDITDLRGTIKVWGH

SEQ ID NO: 27550 - protein, 285 aa, Pseudomonas aeruginosa
RAAPVSRQAVRRMSTIAPHGRHHPNDEAFAAKGVSMRALLAFALLLVGLPALADPYQRLYQAAGWPDQRAHFSDALDAAQKRYQDKLPPALYQTLVDNSNRRFAPAEVDQRALNGLRENLPDSASPLNFFESPLGRKVVAAEVLATRRDQLLQHSNGLPRQTASEPRRALVKRLAQVLPAREAGAEVSLALAGVAADSLSQMLPGLPGLLGGGQTGQLLEGQRQRLVQQIDADLENTLLYVYRDLSDAELTQYVNFAESPAGRSYYQAALAALKAGLAVDQAVAP

SEQ ID NO: 27551 - protein, 568 aa, Pseudomonas aeruginosa
RLHCPGRPTRGRCRTKESLHVPTSHPRPARPRQPATDGRPERPSAQQQGTDEGAPGADPERPGRRRLQAQAHRRGQHEPHRPGRREVLADLQHLPHRVGQAQQGNPQAPARLRPGLQQRQRQRRPGEQADRACRRPPGGPSGTARQVRQAHRRERLAQARHALPADRDPARRHRHPGDRPSGTAGRVTLFPLRQPRPVLLRGRGVPAAKGPVERRQLGEPASLGHLADGATGQQHLARPLPANLIANLPETRSPSGQRTLQGTAAKAQLRRALAQAIALPEAQLDQVAHAIEQAVLAEFAGLFFRVAGQHVMHVRIGVARRTPQQGGGKHQGIVRPREQRQPAEQPAVFAQPRRGSVAELDALGDELVVADQRQQLEEQQHQAFDLLAQRGIAQVVDVEDQPCRFPFDLEARGETAGENVLETHEAAQRLLQVARGQQQVADHIEQARLHCLAQVQADVGIAGHRRQLGPEQRGVVMHQAAAQGRRRQRDTPVDAAVDAGGVEPEGVQGFIQQTPQRGGMGQGAGRRVVLHGGSSRLTKDFQGPSIRSMPRADGIRRMLGTTTRRKDR

SEQ ID NO: 27552 - protein, 159 aa, Pseudomonas aeruginosa
SPWRSPPRLPAAPGTSMPSSRSATARSPWPTCRRRSTCATTSAGFRTCMRRTRPTSTAPSATCTPRTACSRWKCCGAWRAASWPKCSDPSWWIPTVCSAPCASATTPPNTAPARTSSRSPGKCWRPTWTGSTSSRKTTRRRSNSICWAYPGVPSPPKIP

SEQ ID NO: 27553 - protein, 653 aa, Pseudomonas aeruginosa
ASPATWPTASPPPSAPEPVLIYIRDELGSDYLRIFDLDWHPQGRADAIRRTGRRRLEGPRRPRPSQPAGPGGRRPAAVRGQQRLGRRRQPHRQRQAPAGRRPAYPLRRAGGMVRGPAERARLRTLWPPPGAQPLRLGGPQPCVRLEPDDVPERRPRPDRREGQPGQPQPGLVPGRMGRPAERGAGNRGQGRCAGEAHPAPLAPRSDRQRRARRQLRQDPDRHVVGFPRDREPGARRLLPAESRRYPGQGPRGGLEDPFAGTQPGLGQCRRRYRLVGLGGPAEAAGGGEPELHPRRQQGRGGQVRLLSVRRQPTGGKPGARLHRLRQLPAGPGQWPADSRLLQPGGPRPVAGYPTGRPRHQMEPGQQPRAATRQSHRLRAAPARTLAAGPARGGRRRRRQAPGRATGGLEGRLPGRLDRRHAVQPVAVPDCRGRLARRTGRCLLRQPDRHPRHRQRAASAGCRRRLALVGRPPHRTPGNPRGYRQDRLERLPRASAQHPRQRPVRLAVGQGAYPDPRARPGPAGAAQAPSQRRSVRRPRHPRGTEQSVGEDRPGPLGGHLRSIDPAPGGLRRPDPQPRHQPGRAERRALRRPLRRPGRGLHRGPLPAAALRGKRGEGEQQGRAGAGAEALSRPAWGRASSRMVVVRRIQRAIGG

SEQ ID NO: 27554 - protein, 354 aa, Pseudomonas aeruginosa
RWRNSSASYLALQFFGLVLVEQDDRDDQDRQHHHRQGGRHRPVAVVEELLPEHLADHQGLGAAEQFRDDELAHRRDEHQHAAGDDAVLRQRHGDLPEAGEVTRAQVGSGLQQARVVLHQVGVERQDHERQVGIDDADVHRDVGIEDGQRLADEPQPHQYAVEQAVVGKDAHPGIDPDQDRRPGRHHDQQQQDGLRGLAGAGDGVGHRVAHQQADQGTDEGHLQRAEVGIDVERVIGQHQVVAEVEEHLQLLVRVGEDLGVGRDGHVRFRQADLQHDGEGQQEEQEEPQERHPDDRMPPGGHALFQAVGEFHDCSTTPLSSYQLMYTDWSQVGRVTWRSALAMKAWTIIPEASLM

SEQ ID NO: 27555 - protein, 137 aa, Pseudomonas aeruginosa
MSIGLPICSMQPRCMMAMRWAMVMASSWSWVTITQVTPTRSMISTSSSCICERSFLSSAPIGSSSSSSFGRLASERARATRWRWPPESWCGLRLAYWVMCTSLSISATRSSISALGRPSCLRPKAMFCATLMCGNSA

SEQ ID NO: 27556 - protein, 83 aa, Pseudomonas aeruginosa
GGRSVMSWPSRKIRPSVGRSKPASMRNRVDLPEPEPPSRAKISPLLMVRDTVSTASVSSNCLVTRSIFTSTSFGCWLPSRAFL

SEQ ID NO: 27557 - protein, 540 aa, Pseudomonas aeruginosa
MCRLFFSACTGPAIAVARAATSSVLPMECCMSDSCSGPFHGSTLPVRPVFFKCRCKPRSLGFHDNPTIPPGNMSELGSLPACWFQVFRALGPGASDTTGPGAADWRSAHGSVFVVDTASGRRAPRRKRLDERAKESNLFAGERDRRKPGRVPVLSCRSAGGFRRRRAPRGSLAGLDLGPAAGHRPLGLGRQVGEGIQLLHDLFARVDARVVADRLGHQRGGRRVAVGELNHVGDLGHDFRLHQEVDEGQGALGVLGVLRNGDHVEEAAGAFLGNVVLDGDLVLRLFGAGLGLVDVAGVADGDADVAVGQVGNVLRRVEVGDVGTDLQEQLFGRLEFLGIVGVRLVAEIMQGRREDLGRRVEEADAALLQLLDVLRLEYQVPGIHRRVVAEGRLDLVRVVADADGAPHVGNRMLVARVADFQGVHQVLVQVLPVRQLGLVEFLVDPGLDLLGEEGVGRHHHVVPGLARQQLGFQHFVAVVDVVDDLDPSFLGELLQGVRRDVVGPVVHVQHLVVRSLRHTGHRARQGQGEQGLTETFHHAG

SEQ ID NO: 27558 - protein, 474 aa, Pseudomonas aeruginosa
FGCSCHTSSIQDCPGAADHAGRPRSGSNGKQEEFPLPGADYPLEILVLRTLHRDVAADELAAEILLEGLAVLHALQRRFDRQRQAQVAAFIAATFDLGARLDAFDHADVAAQQAGSQRQVRVGVGAGETVLDPAVLRAGVRHAQADGTVLFAPLDVHRRRGIGQEAAERVHVGREQRQHFRDELLQAADMVQEQLAHGAVGIGEDVLAGLHVDDALVQVHRAARLAGHRLGHEGRGDVVLERGLAHGALEHQDLVGQVEGVAMTEVDLHLRGAFLVDQRIQVKALGLAPVVHVLEQRVELVGGVDGERLTPGFLASGAAHRGLQRIVGVVAALGQVELHLWRHDRPPALIGIHLQHALEDVARRQLDGIAELVEGVVDHHRGGLDGPGDEEHGILVRAADHIDVGRVEQVVVNVVFHVVAGDGLQQNALRQAHALFRDEFVGRRDLAAGDACQIGNQAFHFGDLAFLQPAGQLV

SEQ ID NO: 27559 - protein, 464 aa, Pseudomonas aeruginosa
QKRCCIMSVPQRAVQLTEPSEFLKEHPEVQFVDLLIADMNGVVRGKRIERNSLNKVFEKGINLPASLFALDITGSTVESTGLGLDIGDADRICYPIPGTLSMEPWQKRPTAQLLMTMHELEGEPFFADPREVLRQVVARFTEMELTIVAAFELEFYLIDQENVNGRPQPPRSPISGKRPQSVQVYSIDDLDEYVECLQDIIDGARAQGIPADAIVAESAPAQFEVNLNHVNDALKACDHAVLLKRLVKNIAYDHEMDTTFMAKPYPGQAGNGLHVHISLLDKHGNNIFTSEDPEQNAALRHAIGGVLETLPASMAFLCPNVNSYRRFGSQFYVPNAPSWGLDNRTVALRVPTGSPDAVRLEHRVAGADANPYLLLAAVLAGVHHGLTNKVEPGAPIEGNSYEQMEPSLPNNLRDALRELDESEIMAKYIDPKYIDIFVACKESELEEFEHSISDLEYNWYLHTV

SEQ ID NO: 27560 - protein, 438 aa, Pseudomonas aeruginosa
GSGIGAPVLGRRRTQRNPGRFRRHSTRGRLCLGNRPGPFLGTGKCAPRHSLPPRLPPDSMLACINASAAWLRHHRPLRSVQREDSMPRLSALLFLALAPWLAQAEETLRVYNWNDYIAPQVLESFQKDTGIRVEYHTFATAEELDKALRSGEAIDVAVPSHDTLPALLKDNLLRPLDFTQLPNRSHLDRQLLSKLAAVDPDNRHAVPYLWGAVGLAINTPQAEAAYGGPLPNSWSLLFDASQSQRLKSCGISLLDAPDETLAILLNYQGRNLGRTAPSQVRRAAEALHGLRPNLRYVDSERYIADLEGGRLCLAMAWVGDALRAAKAGQPVSFEVPQEGSVLFIDNLVIPAGAQHPREAHRFIDYLMQPKIAAQITAATLYPSGNADAAGFLDPALRQQPGLYPDRDTSRRLFALETPPEKLRPVVDEIWKAFRGASQ

SEQ ID NO: 27561 - protein, 140 aa, Pseudomonas aeruginosa
SRNCSRPPTSARSRTRTTCSWPPRSRRTPPSPTSRPSPGSCRWYCRSASSNAPGAPASTASRSSTPMAATSGSTARATSRTARATTRSTTSIRATPASRFGRPAYARIGVGICWDQWFPESARSMALARRGTPVLPDRHR

SEQ ID NO: 27562 - protein, 166 aa, Pseudomonas aeruginosa
ATRPAPHAPTASACPPNGNPTSRPGWSGRNARTTGATAASRPRRPSPRWPRPSRASSRSPSAPAPGSTRTRAHASTTATSASWKSAATMPGSATPARPSSSTTRAMYAASTGASTPGAASKAACTSPGSATTRWHARSSRSNGAPATAPTTSSSRAARSTSTAKAR

SEQ ID NO: 27563 - protein, 254 aa, Pseudomonas aeruginosa
  UNSURE (172): Identity of amino acid at the above locations are unknown.
RQSQAGGTPSGASRGRLGNHAYQFEHHGRPHQRRGAADIERRRDFHHVGADQVQPAQAADQLLGLEAGHAADLRGAGATRESRVEHVNVETHIGRPVAHHPPGFGQGRLDAQFDELFHVDHGGCRTRGRKRRRPANTPSRECRSAPCAPGRADLPRWPCGMACRGCRGCLPXNGRWYRNAHLNAPCPAAARDPGRERSAGSPGGRHRPTAAGYRRHGPGDRSLRCGATNRAGRWDSPAHHRGRRPAPGRRARCG

SEQ ID NO: 27564 - protein, 443 aa, Pseudomonas aeruginosa
TIGELASQAVAGHAGDHRQATGDDAGDRPLRTGPAPQQRADDRHQQAADQQVVGDAQGRDDIVDQARQDQHRHAHQQGDATAQTDVAGGTGAQEARVDVFLQHGGRCQQAPAGGGHDRRQRGRHHQAAQARRQYLAGDLGVGVLRHRQVRQEDPRRRADQRAGGAVEHAVDAGAKPGVAHHRLAARGEHPLPDVLADQRAEEVQEEVGEYGIQADVAEVEEARRQHLLHARQATGAVDRQRQQDQEDTDGLDHELDDVGQRKGPHAADHRIDDDDPATAEDRRDPRDAEYHLGDRADGDGRGDRHHQVVGDHDHPADQARGGLVALLQHLGHGEHPQARDLPREHQAEDDDPQAEHEHQPQAGQAELVAELDRTNGRRAAEHHRGHGSQVEAGAEAASGDEEIALALRLAHSVPAQAQHGQGVDQHDQVIQQHRPRSFSCCSA

SEQ ID NO: 27565 - protein, 461 aa, Pseudomonas aeruginosa
RPAWRLGTPKIGRAPPGLNPGSGKSTCGGREVSAGRRTGDAETQRAGRSRRVAEAADAPARARQASGGTQRVGLQLRGELLQRLDTAGFRLMHPVLDRRQHVVAVGAGLGPDLLQRQALLVDHLQRLAVGEHRVDAHVVAVLQQAGLARQQALGAAEQVAHRLVGLGHFLLDQRRDHQLAVLRHDLEAVVEDRHGGVHVQAVLALDPMGDRRDPGDPGQAQEAEQLDPGPAQVEFPLLHRQLGRVRVGVVVVVQLFAADEDAPGHQVGGGVAAFEVAIADRVAEAVDHAGGPERNPYHLHGPDGQAKGAEQGQVDERHQHHAADREARVEIALDPVVRAVLAVDAQGVLVLRLGLVQLRACAQDGEQALVHRAVRILDGLALGMVLTVDRGPFARVHPCGQPQPETEEVLQRGVQVECTVGGIAMQVDGHADDGDMRQHQGNCHQLPRRQVEKTVEPHRRY

SEQ ID NO: 27566 - protein, 762 aa, Pseudomonas aeruginosa
KSHEPPPECPSPEPGLSRNRHRLGVPEGSFVTKPGPGPGPTGVLDDRQRLLFLPATGRLVYLYLVRQFRRKAQAYDELHGSEQRLNRALEAVRDGLWDWDLVTDRMFVSPGYAALIGLAPEELGDPIETWKKRLLPEEYATVLEAHRNLLQGLTDNLDHIYRLRHKDGDYRWIHSRGRVLRDALGKPLHYTGVARDITLQRLKEDHLRQAAAVFDSTREGVLVTDAQAVIVHVNPSFERITGYRSEDVLGKTPAILRSGRQDQAFYQRLWLALREQDVWSGEIWNRRKSGEIYPQWLHIRVVRNDQGQLTHYVGVFSDLSSIKRSENELDFLAHHDSLTGLPNRVLLRERIEQALENGKDRTVAGALLLIDLDHFKHINDSLGHTTGDMLLKEVSKRLQHQLDERCLLSRLGGDEFAILVENDDPEAVARLSQRILDGFNAPFDIHCQPIYISASLGVSLYPEDASDVDHLMQHADAALFQAKDSGRNAYAFYTRVLTARARAHVQVESALRHALDHDELRVHYQPVHDLASGRIVGVESLVRWQHPERGLVPPGEFVPVAEECGLIAALDNWVLKRACRQMREWQQRGVELEFVAVNVSSRLFNRGGLEERIANALEESGLEPRYLELEVTESAVMEDFEQSLNLLCRLRILGVNLAIDDFGTGYSSLMRLKRLPVHKLKIDQGFVAGLPGAVDDAAIARAIVALAQSMGLRVVAEGIEHQDQALFLREHGCDFGQGYWYGRPQPAEALRFDLPPVALPED

SEQ ID NO: 27567 - protein, 335 aa, Pseudomonas aeruginosa
ELHMSLRRFALAALASALVSGPVAAATQLLNVSYDPTRELYQAYNAAFIKHWKAQGGEDLTVQQSHGGSGKQARAVIDGLKADVVTLALAGDIDELHKLGKLLPADWQARLPDNSTPYTSTIVFLVRKGNPKGIKDWGDLTKEGVEVITPNPKTSGGARWNFLAAWAWAKKQYGSDEKAKDYVQALYKHVPVLDTGARGSTITFVNNQIGDVLLAWENEAFLAKKEQGGENFEIVVPSISILAEPPVAVVDKVVEKKGTRKVAEAYLQYLYSEEGQRIAAQNLYRPRNQKVAAEFATQFPKLNLVTVDSDFGGWKTAQPKFFNDGGIFDQIYQAQ

SEQ ID NO: 27568 - protein, 304 aa, Pseudomonas aeruginosa
STCCSVASKPRKEGAMSSASISAATASASRRGNAGGRLALIVLAWLVFALFLLLPLYVVLSEALKQGFGTFFEAILEPDALAALKLTLIAVAISVPLNLLFGVAAAWCVSKFEFRGKSILVTLIDLPFSVSPVIAGLIYVLLFGAQGYFGEWLSDHDIQIVFAVPGIVLATLFVTVPFVARELIPLMQEQGTQEEEAARLLGANGWQMFWHVTLPNIKWGLIYGVVLCTARAMGEFGAVSVVSGHIRGVTNTLPLHVEILYNEYNHVAAFSVASLLLLMALVILLLKQWSESRMSRLKSNADEE

SEQ ID NO: 27569 - protein, 330 aa, Pseudomonas aeruginosa
TMSIEIRNVSKNFNAFKALDNINLDIQSGELVALLGPSGCGKTTLLRIIAGLETPDAGNIVFHGEDVSQHDVRDRNVGFVFQHYALFRHMTVFDNVAFGLRMKPKGERPGESAIKAKVHELLNMVQLDWLADRYPEQLSGGQRQRIALARALAVEPKILLLDEPFGALDAKVRKELRRWLARLHEEINLTSVFVTHDQEEAMEVADRIVVMNKGVIEQIGSPGEVYENPASDFVYHFLGDSNRLQLGNDQHLLFRPHEVSLSRSEVAEHRAAEVRDIRPLGAITRVTLKVDGQDELIEAEVVKDHDSLAGLARGETLYFKPKAFQPVANL

SEQ ID NO: 27570 - protein, 230 aa, Pseudomonas aeruginosa
SRGGFSPPCAPPGRAVPRGPSTTPATPASRPAAATSPGADRPPATPPPARRRGAACVRSSRGRRRRTADGGGGPPTGRFPTWPARPRRSRSGAASCPPARSSRHPASVRTHRPRVRRPGGRSRSAPRATPTACRGSAAGCAAAAAGPGRRWPALPPPVPLPARPGDRSDCARAPPGSARRPRPAVPGGRWRRTARRPPAAPARWPGGRCHPSVPRSSARGRDRRAAPPAN

SEQ ID NO: 27571 - protein, 359 aa, Pseudomonas aeruginosa
NIACRRREILAAIARSRQPETRKNPHVRRPPRPDPTDRPHLPSRGLRQGRGRPGPADGLGGPARPGHAADAGGGAADRTVDGDQPLAARLRPALPRLDEAPGRPAARGDRGHPAGRRMARRRRPKAGHRRARPGPGGLRAARPGRDPAAPAGAPRALGRPAGRAGDRRADRGHRGFRDSRGALSGSPRIAARRTGPGPRPVVQRLDPGPGGHSRRARRPARTADARRLSADPGPGAGRDAPRPVAAPADQRDAVQALLLRRSPAARRRPRLARFPLTPGTHCAPARAGLRPSRDFRRTAQVAIIRRRAPPTGRAAPGGTRPSGTERHLSQGAHDEDPSFPFRPGPRLRHPGRLPEPAPG

SEQ ID NO: 27572 - protein, 284 aa, Pseudomonas aeruginosa
PHAARHDGGEGCNPERRRGPPGRRPGLRRVRPAKPHRPGQQQVRPAPGQDRQGPGRPDRRRAGELQGLPHRGGQRLGHGQRLHPRLQRADGADERQRDRRRARPRDGPRRPRPHPQGRPDRLRGRRGARRRRRLEERRAGRPVRLPAGRTHRIAGQRAVLPVPGIRRRRFLLRATEEARSEHPGPGHRLREAGQAGRRRQQHVRFAPGLPGPRRSHPPAHRCGSQVTLPPRSPALAGDRLTPPACARECRSGRRAPRPRAARRRAAPAERPVPPARRADRRSTR

SEQ ID NO: 27573 - protein, 405 aa, Pseudomonas aeruginosa
RCCAGRGGRRRIAQGDRLGFSLLWSHARVLASSRRPGFPLCQLDDKHERAYRLPFATPGRPLVPGFAGGLADAPAGTRPTAPVAAGPAPVRPRRRALRTVLRGRGRDPYQRGQRERQGGAADPGGSAALVRRDRPVRRPGAHPRRLRRRPHPATPGAAGGAARTASPRAALLARRGPADEPQAAPGIHRPGRDGPAAGRTTPGAAPADARRGLRQQPQPAGPAPAAGAVGIDAVAVAADHQPDPQGPRSPGHPPAQLRRHRDSRPRRPARGHPRLSANHTFERLQARHGRLPCAGHLPSVRISITTTTGSPHAPSRASRCPLSLLPAAGAAGARRPRRPATRPATTAGPGLSRGGQPVVAARRGFPGTARGATGEGPRQPRPRARRRPRGGAPAARRKDAGGAHP

SEQ ID NO: 27574 - protein, 145 aa, Pseudomonas aeruginosa
LPQPGGTPGATAPARPAPAAMAVAGAGRVPVPAIPGARLPGRAGDCPRAAPGLSRPGRERAGPADRPAHRPAGGAKRQPGGTEETGKPLGVPEPGPARPEQQEQRAGQRFRQALGADHRRPPRACPERKPDALECGVRPRAARGG

SEQ ID NO: 27575 - protein, 468 aa, Pseudomonas aeruginosa
PRDSQRCASVRPDSLASAFFRIRPADFDLPPRPGACAMVLPKGDRHALCQPTRPHPLADGRHRPGRPQPAALHGRRRPTAERHARRDRAQLRRRLAADRPAGDDPRPRHVLRPGHRPPRRRVAFGGPRPAADRRRQRHAPGQPRPARPARQRHARRSRHRPDPGADAGPDQGPFRRAHAALHGALRHRHHGWRGAVRQRRADPGGARRLADRPRCLGGARRARAAGLVAATRHPPAPARRAAGQELPALSADLAAGPVLRPRHGLLHLRAGLARALLPGAGLERPGIRAAARFPDGHGGALRVARAGHGQPLAGSPPGAGRANGADAGRLPRPRMGAGQPAAALGAVSGTGHRRAVPHGLDRLPRPLRRAATRRSTGCPGTRRRLPDRRGLAMDRRAAARQPRQLHRSLARAGHGGGAATGAGPALRPAALCGTVRRAAGARRRRRKLALRKGTGSDGAPDAVRTPRC

SEQ ID NO: 27576 - protein, 493 aa, Pseudomonas aeruginosa
ACLWLPRRANYQKYQVANFAMELQLILDGRHDLVGQLYRQLRDAILHGRLATGDRLPATRYLAERLEVSRKTVSEAYERLASEGFLEGRVGSGTFVARGPAGEAPPQRADGPLRPAARWARIEPQSGLMDQRAPLRYSFAGGTTDKRRFPFDTWRTCVLQALRLQQRSPAFYKETEGDPELRLAISRYLAINRAVQCDWNALMVTQGAQQGLDLLARVMLDPGDLAVVEEPGYPPARASLLATGAEVRGVPVDAEGLRVDLLPDNAKLVYVTPSHQFPLGMPMSLERRLQLLDWAQRHRALIIEDDYDSEYRFDGRSLESLRSLDRNGQVAYLGTFSKTLFPELRLGYLLPPASLREAVLAARKLVDRHSETLQQRALALFIQRGDFARHTRRLQREYAQRRGRLLERLHGDLSPWLEALPAVAGIHLAARCREPLDVLRIARHLRQQGLEVGTLPPFYAETPAQAGFLFGFGCIERDDIDPALDLLRAELRR

SEQ ID NO: 27577 - protein, 159 aa, Pseudomonas aeruginosa
VPISPARGSIATAPHAQRRMTRRVTRPTGGAAPCKGTARTAQGCSSFASRSPSRPSMRAALLSASCSALSSGRLAAWVARLRISSSRESTPPNWYAAAISRRSSSGSRQRARRAEPKLAPKRPSSSSSRASSSAPPPSHQSCNVRSSARSPRRCSSPAV

SEQ ID NO: 27578 - protein, 172 aa, Pseudomonas aeruginosa
QRSTSAPRASASSQAMSAQRCERSQKCMARSASSGSPSWMARCRLKPSTRFRLCPSPSRRRAWPRVWQAGPTCRAALLAAAIRPAVICGSRPNSSSSTRSGCSSALRQRSLAARTSASNGAPSAESRARSRKASRFSPASRSGSGQATTSSPFSNNPRRRCIRFSAWNGFTR

SEQ ID NO: 27579 - protein, 518 aa, Pseudomonas aeruginosa
SLSEFVEALGQDGQALLQLRVGDGDGHEEADDVVVGAAGEQDQALLARTDDDLADQLGGRLVGIAALEQLDGHHRTQATNVADHLVLGLDLAQAGLETLADGLRTFQQLLFLEHLQHGQCRGAGDRAAGIGAAQAAGRDDVHDLGLAGHAGDREAAADRLGEGGQVRNDAQLLGSEEGAGTAGAGLHFVGDQQDAVLVAQGAQALHEGLGVDVEATLALHRLDDDRGDVLGLGIVLEDALDAGDGVVLAHAVQLAGRQGAEDAARHQAHAGGVRDHLAGQAQGHHGAAVVRAGEGDHASAAGGGAGDLDGVLHGFGAGGDQQGLLREVARHALGDFLGQLDVGFVGQHLEAGVGQLAQLLLDRGDHLRMQVAGVQHGDAAGEVDVLAAFHVPDGGVLGALGDDRVDLAHAAGYRGLATLQQGFVGLAHGFLSGRSSGRPGQRMKAGRKLPKAACDDRLPRDLQARQGSEPLRDRRPRLPVRPVPPPATSTPDGAALACRPAPPDAFLAGLRYRPGRGT

SEQ ID NO: 27580 - protein, 134 aa, Pseudomonas aeruginosa
SGTPAPAGRRSRPWTPGRSSARRPGWSARRRCRRGRAACRRKPPWRPWRPRRRCVPRPWPRPWRRSADRWSRRLPGRCRCSAWPRRPSACRRRRRTRRPARTGGWRRRRSGRYCGTWKSARPRRRRPDRRRRTR

SEQ ID NO: 27581 - protein, 190 aa, Pseudomonas aeruginosa
HRCPRHIAWALSTTRNVSMATPAYMSITGTKQGLITAGAFTEDSVGNTYQEGHEDQVMVQGFNHEVIIPRDPQSGQPTGQRVHKPVVITKVFDKASPLLLAALTSGERLTKVEIQWYRTSAAGTQEHYYTTVLEDAIIVDIKDYMHNCQDPGNAHFTHLEDVHFTYRKITWTHEVSGTSGSDDWRSPVAG

SEQ ID NO: 27582 - protein, 438 aa, Pseudomonas aeruginosa
TPSQDFRQRLSKSNVGLASPTDGGGTARQEQGTIHASKGPEIHLRRRRRETRVRCRRVRTGRSALRAFPPEPEAGQRQERHRFQAGTRPAGHLHPLAGRPSGPLRPWHRQPLHPRQLGFSPDPLRTAAGTAVGAPGAVLQLADIPGEECSGDSPGAAQGAPGARLRTAYLPRAPAARILRAGRRQRSLPARPAGLRGRPGLLLPLRRTPPHPGLQRPALRPGAYRRRPGAVQRPAGGRQPAAGASFFPLQRKCSYGSTDPAGLQLQAPDLRPGASSRWRGARASGLVLRALRLPRSLQAERRRPAFQRKPPQRAPARCAGGIGQRRRPAADPGPRLCLGRSSACRLQRLVAAGAGGPSRHPVCRPGGRVRRRPSGGELRPARRTGTRGRRMASRTAASAAYRWSADRDGSRPGRGRDPLRRVGTGESPVPLGSRGTSR

SEQ ID NO: 27583 - protein, 369 aa, Pseudomonas aeruginosa
IQYLLDTGRAELGRCRLGAHGDPADWPGGDRRLPGRRLRPADRHRAHLPGDQPTALRAARPQDPQHHQEQGVQGQSGQRAAHRRHHGADQCGADERPRCQRAAPGLPDPSSARRRQAARRGLRTAHRRTWRGACGQGAAAEHRGAAQGRRRPSRPRRRGAGAGGRAGAGPRAGRLRRGAPGRGARRGAAANPPGSRARPRPRCQRRVRQEQRRQAGDRLERSGRDRRGDAGEPDPGRRRARRQRGPAEPAGDRRAEGGDQRRQRHRPVRPRRRAAPDHPPGADAAAGAEERHPPGGRAERGGQRQPAARAGHREGAHHPDVRRRLPDPQGRQHRAGHARQLRGQGGEAQSCRSRSCIDQLQRLGFDTVR

SEQ ID NO: 27584 - protein, 617 aa, Pseudomonas aeruginosa
SDTRRWWCGETDDRQPGPFTQATTPGHGPGADTHPGQGQSQQRHGVQHMSSEPLEPNQDVIIPRSRDSLGRPVYKAQLTRTDNQSEKVALIRQTAPLPVIFIPGIMGTNLRNKADKSEVWRPPNGLWPMDDLFASIGALWTWAWRGPKARQELLKAEQVEFDDQGTIDVGQSGLSEEAARLRGWGKVMRNAYNPVMGLMDRRLDNIVSRRELQAWWNDEALSPPGDQGEEQGKVGPIDEEELLRASRYQFDVWCAGYNWLQSNRQSALDVRDYIENTVLPFYQKECGLDPEQVRRMKVILVTHSMGGLVARALTQLHGYECVLGVVHGVQPATGSSTIYHHMRCGYEGIAQVVLGRNAGEVTAIVANSAGALELAPSAEYREGRPWLFLCDAQGQVLKDIDGKPRAYPQNQDPYEEIYKNTTWYGLVPEQNSQYLDMSDKKEGLRVGPRDNFEDLIDSIANFHGELSAAGYHSETYAHYGADDSRHSWRDLIWKGDHTPLETPGATLNDDENGTYNSWFRRGLPTIVQGPLETGNPLDASGSGGDETVPTDSGQAPALAGVKASFRHGSKGKGQANTKRGYEHQESYNDARAQWAALYGVIKITQLADWHPNDKGGT

SEQ ID NO: 27585 - protein, 251 aa, Pseudomonas aeruginosa
WAWAWATRSPAAWAWSTSAVWPSAPGSTSSPRCTSARRPSTWRRSCRCALVVVIIFVESTGMFLALGKITGREITPTELRRGLLCDAGASFFAGFLNTFTHSSFAQNIGLVQMTGVRSRYVTVAAAGFLILLSMLPKAAFLVASIPPAVLGGAGIAMFGMVAASGIQILHEANITDRRNQLLVAVSIGMGMVPVVRPDFFARLPVWMEPITHSGIAMTAIWAVVLNLLFNILSRNDRSHLCGSHAPAPKHS

SEQ ID NO: 27586 - protein, 543 aa, Pseudomonas aeruginosa
NEADPAGLVADLVIPRRPAAARQARGQRPAALDDRADFVAGAERQLATVAGDAAQRHFLDETDVQLVGQGVLDQVEDLVVVAALLYHAVQLDPLETGFARRLDAVQHLLQAIATGEGGEAFALQRVEADVEAADAGGLQLGGALAQLRTVGGDRQVFQFRTLPQACQQAGDALAHQRLAAGDTNAPHAEADEGVGHRVKFLQAEDLVAGKELHVFAHAVGAAEVAAIRHRQAQVGDATAEGIDQTGIGHSDSFCSGGSPGARWVSASGRLDTPNEYSKYRKMYRANEPAGQDFPGLRLARTLLEGRSGRVLPSSASCRRCSNEEQGLMTSIRERNKRLILRAASEEFADKGFAATKTSDIAARAGLPKPNVYYYFQSKENLYRCVLESIVEPLLQASAPFRVEDDPLLALPAYIRSKIRISRELPHASKVFASEIMHGAPHLPKEYLDELNAQAQRNVTCLQTWIDRGQLAPVDPHHLLFAIWAATQTYADFDWQISIVTGKEQLSDADYDAAVETITRLVLKGCTPDGQSGKSTGRLRPLPL

SEQ ID NO: 27587 - protein, 622 aa, Pseudomonas aeruginosa
AYTTHLDLALPLCLESFQLLYTISIRTRNKTMARMRAIEAAVLVMRREGVDTAFGVPGAAINPMYAALKKIGGIDHVLARHVEGASHMAEGYTRTKAGNIGVCIGTSGPAGTDMITGLYSASADSIPILCITGQAPRARLHKEDFQAVDISSIAAPVAKWATTVLEPAQVPYVFQKAFQLMRSDRPGPVLIDLPFDVQMAEIEFDIDAYEPLPVSKPKATRVQAEKVLAMLDEAERPLLVAGGGIFNADAAERFREFAELTGIPVIPTLMGWGVIPDDHPQMAGMVGLQTSHRYGNATLLESDLVLGIGNRWANRHTGSVEVYTEGRRFIHVDIEPTQIGRVFMPDLGIVSDAGAALDAFLEVAREWKAAGKLKSRAAWLESCQQRKRTLQRKTHFDNVPVKPQRVYEEMNEFFGKDACYVSTIGLSQIAGAQFLHVYQPRHWINCGQAGPLGWTIPAALGVVKADPSRQVVALSGDYDFQFMIEELAVGAQFKLPYIHVLVNNSYLGLIRQAQRGFDMDYCVQLAFDNINAPELEGYGVDHVAVVEGLGCKAIRVFDPNEIGAALAKARELMQQHQVPVVVEVILERVTNISMGTEINAINEFEELAEKGADAPTAISLLD

SEQ ID NO: 27588 - protein, 109 aa, Pseudomonas aeruginosa
STPSTSPASTCRTPARPWRSATRSAAPTCSCNTTSITCRSWKATWPAPWKTSWRRSTTCNSPTTPAATNRAPARSTTASSSSTWTASATRAGSAASTSRPPPPKPASAG

SEQ ID NO: 27589 - protein, 305 aa, Pseudomonas aeruginosa
RRTTSSDPHPRTRRSRLPARSHSTDRTRRHSHGQDRIHRHRNHGQAHGAEPAEGRPQPVPFHPPRRRSGRPAGGRRHCPGQPEGSGPGSRVHHRHGAGHPAGRGCAVPQGRYRRGRRPEQGGDRHEFDLPHRHQGLRREDQGYRRAVSGRPGLRRRGRRQGGDPEHHGRRLPEQLRTRPAAVPGDGQEHHPRRRQRRRPDRQGGQPDHRRAEHPGGRRGPAVRRPQRRRSGQGARGADGWLRLLADPRGTRRTHGQGHLRPGLPHQPAPEGPKPGPGRRPRAEPEPTQHRQRPAGVQHLRGHRRQ

SEQ ID NO: 27590 - protein, 542 aa, Pseudomonas aeruginosa
LGPLGADQGPGAHGQLLDPRRVIRSPRGPSPRAERRTPFRRARGEERSANSGVRRRPLPSPPTRRGKGSERPAGRFTASASGRLASIPQFPPARVLRNGSVDDAATAGPTGGTTTRNSEPVMSTDPRAFLTELFNTAVAAGHPYQVLADHLPEDRSGRAIVIGAGKAAGAMAEVVEKHWQGEIQGLVVAPYRYGAQCSRIEVVEASHPVPDDAGERVARRVLELISGLNESDRVIFLLSGGGSALLSLPAEGIGLADKQAVNKALLKSGAAIGEMNCVRKHLSAIKGGRLAKACWPASVFTYAISDVPGDEATVIASGPSVGDPTTSADALAILRRYAIDVPQNVLDWLADPRSETVKPDDPCLARSHFQLIATPQNALDAAAVKCRAAGFSTLILGDLEGEAREVAKVHAGIARQIRKHGQPLAAPCVILSGGETTVTVRGNGRGGRNAEFLLSLTAELKGEPNIWALAGDTDGIDGSEDNAGALMTPCSHARGEKAGLKIRDELDDNNGYGYFQALGDLLVTGPTRTNVNDFRAILILES

SEQ ID NO: 27591 - protein, 778 aa, Pseudomonas aeruginosa
HDSRQESQDPCHPRPGHPQPRRYPCPGGGRRQPVPPELQPRRLRRSRAALRLGARGGSGAELPDRRAHGPAGSEAAGRPLRRRCRAIAAWADLHSRPQRRPRRRAAGQPAASGDHPCPGTGHEPAAGRRQDPPGSGQLPQRRHRDPRGGGWRAVRSQGRQRAGSGPATQPADRQGPPRPGLRPGTGGRLGGAVLRATPGGHRRGPWADRRQGLPHGQDREAQRGERHRGDRRARRRDHGGARRPRRRGAGGERARHPETHRPGLPPARQAGGGGHPDARVDALLPRPDPRRGDRRSHRGGRRRRRGDALGGNRFRTIPSRGGRDDGEDRPPGGGRAGLPRPARGQPSAARRYRLRCDQLRDPPGQPDPPGGGAGELHRVGQLDPARRPRAAQGADPQPDPEPAHRAATDRSLGRVFGGQRATGARRRDLLDRPRHRPGPAHGAPRRHRGGHRRRAVRLPRLDQHAAHRDRGAAAGRSLKQRVRSGSRRPPGHAGRATLVSLGWMGPEIRGRVSIHPGKTFLSDHGLPRALPCRPWTFKASGSTPAGGLFFFLERPACMTLAWPSRPGCVASAPDPTMTAPAPRAGLASPCLPSGPCRTDRHAPAISPQCIPNPPARHQPGVPPGRPTPGPGLSAGDRRRRAAAARRRPPWRRPRPAAGAPVALRRQRHRGRAVRLQRRADRHAAGIPLRLVAGAGVTGSARLPGQRGVAAPVPAWAAPTPLASALYPGLRPQRLVAGAPRRLARPGPGDPWRLLQLRLERHGGAGGASAGDRRDHLPR

SEQ ID NO: 27592 - protein, 135 aa, Pseudomonas aeruginosa
TAGRAAGLARPAAGLASLRRLGPRRRRGQPAAGLAAGLRLGERARRVLRPERRPCRAGPGLALPQRLAATARHGPGGDAATAVRPARPAGADRTVHPRLPALHRRRAPVPAPGRQPRRAPRPATLLSGGTLAPAG

SEQ ID NO: 27593 - protein, 295 aa, Pseudomonas aeruginosa
SGKVPHPSSGATMSAPDSWRERLYIVIFQTDTRDGRRFDSALLLVILASLLVVMIDSIDEIHQDYGDLLAYIEWGFTGIFLVEYLLRLYCSPKPLRYAFSFYGLVDLLAILPGFLALLYPDAQYLLIVRVIRMLRIFRVLKLRQYLSQANFLLTALRGSKQKIIVFFLTVMTLVTVFGALMYVVEGPEHGFTSIPRGIYWAIVTLTTVGFGDITPKTPLGQAIASLVMLTGYSIIAVPTGIFTAELATAMRQDPANLLQRDCPVCRKATHEVQAAFCCRCGNPLFPREEGSHGKS

SEQ ID NO: 27594 - protein, 440 aa, Pseudomonas aeruginosa
PRQRARSAEEVPRRHPERQHPARQGSPHARHRRAEKPAATDRRQPRTPARRAAPAGRPRRRTGTAQAAVAGAARHPQRRRQALQARGPAGRPGATGTGRGEARLHPARRLLAADLRRTPARRREYHRTDLPGPGPAEQRRRLDRRRPDPLHRPSGPGRQRTAAESLDRRHRRAQRLLRCRDGHAGRSGAHAASRAHRQDLGEDGHAGPGAEAGRGAARHRGGQQRRRQRLFPHPRAGDPEQRRQRAEGHHRPPGNAGQAALSGGPGPARNRLPGGGDPQRQRLPAAPRHPEYLSRQQLRRQRPSARGDARRELRTGTGRRRGHRHRTQAGQALYRQQRPDRQPHAGQLRIPHRRAQQPQERRTRAVRGPVAGLAQRADPGHLAGTQGAGSQARGRRQAEVGLDPATRRETQRHPEVQRGVSQGPGGQRPRLALAKAPAAA

SEQ ID NO: 27595 - protein, 348 aa, Pseudomonas aeruginosa
PDVIVEPLQHAQRNCPVKRLFSASLLAAGLALGGAAHAAQPLLNVSYDVMRDFYKEYNPAFQKYWKAEKGENITIQMSHGGSSKQARSVIDGLPADVITMNQATDIDALADNGGLVPKDWATRLPNNSAPFTSATVFIVRKGNPKALKDWPDLLKDGVQVVVPNPKTSGNGRYTYLSAWGYVLKNGGDENKAKEFVGKLFKQVPVLDTGGRAATTTFMQNQIGDVLVTFENEAEMIAREFGRGGFEVVYPSVSAEAEPPVAVVDKVVEKKGSRAQAEAYLKYLWSDEGQTIAANNYLRPRNPEILAKFADRFPKVDFFSVEKTFGDWRSVQKTHFIDGGVFDQIYSPN

SEQ ID NO: 27596 - protein, 320 aa, Pseudomonas aeruginosa
IGHPYGQVGGQSKSVPALRTCGIFRRACAKPRPAPFRPAPPGATGRFTVTIAAPGCGPWENTMRPEERRRHILELLRQRERISVDELARTLSTSQETIRRDLAALAEQGLVSKFHGGAALPPSGEHENAFQTRMNEHAQEKRAVARYAAGLFGPGDSIFIDTGTTTLLFARELARQSHLTVITNSLLIAGSVGASGNRAFMIGGEYRPESEQNVGALAIEQIARFNAEHAVITVGALNGDGAMDFSIEEAEIARAMIAQARQLTVIADSSKLGRRALFQVFPLSRINRLVVDRKPTGELWEALQQARVEVHEAPLRTPQA

SEQ ID NO: 27597 - protein, 301 aa, Pseudomonas aeruginosa
ARPPAAACGSWPMVARCGSVPCPACRSAACWCRWPPCACRRTPGAWKSPSSPPATEPAKRTDHANRRPRPGNHQYPRAGRQPGRQRRYSVGAASPATPSAVRLGRARSAGTAGQPATLPGGQRPGRRHRPRQPGRKLHGLGRPQRRAVVAADRLAGQPHHPAHRASTRQRRRGAGPGTQRPAARRLFLGQQAGLDRRAPSGRSQGFEGRPPAPGNQRCLVSRPLVRNLRHRRHHRLAYRIDEPRRGPLGPRPVRPVRRADRVPAGNPRYRRPFRGDRQHPADGLGGRPAGLALRSRLPPAR

SEQ ID NO: 27598 - protein, 680 aa, Pseudomonas aeruginosa
PSTRSSRRWPWLAWTSAPTVQPPCSAGSRRDALPMPPLNSWQIIPVPPPTEPSRTGPDSAQASASPTWRAPTCWPQISLSRPSKVSITTGMHQYSPLSPSSARSSAISASRTAPTLWVLVMAIGVVSRPASRIHSRPVASPLPLSTWQPAKQGCRRAAPARGWTRVTPVRTCLPSIRWFRVLWPTRTPGTSVIALNGPGVPRPRVMPSCRARMRTPVSKLLERRTELAVGAVENHRHRQQSDNDHHVPGRGRQEQVEQQVSRAAHRQQRRQRRQRPQRHPVGMLAVAPQHPAEQRAEGDDQVDHDDQQHGERGQFGQVGAEAQRRRGNGEEQRGQPGRFPARMDTGEGTVQRRHPERVATAAEDHPGALDDDGDDGVEHREEDPGADQARQRLVAMAVQQVADRVGAGEHRRERRRADQQRGERDDLDQYYQRQRPEHRAMHAVTAVLHVLGEQHRAAETVVGEQRGTDRSDHQCPGCDRQQPAVADYLRLQKDARRLLYMAETEADDHQQRRHFQQQAGTRDPGVDADVEDAQQVAEGNDRQGHGLRIEVGAEGSVQVSRRAGGEHRRDEQQHRQHREEGGVAGQAAEHPLGVDILAAGGAVRPAQLGIAPGEHQRQHPGQGEGPESAGAGLLDGEGGDDEDGTGGSDCGNGDGDHVEHAQRGFQRTFGRGGRAHVVVL

SEQ ID NO: 27599 - protein, 372 aa, Pseudomonas aeruginosa
VRRRVRRPALHRRRVPGSCRCDRGSTSPGRNPAEPVPRAPGAQSSLPWSAAPGRIRGPARPCRWRPNAGTGRARPTAPAAPRPAGPPGPGASYALRRCPRCRRAVRGQPRRGHSPVARRSACRRPAGRPARRSAPDKARRSGRYGLPRPGRDGHAAAESAGMPGPPAAAGRQRARNRSFVVLQQVGEARLLLGGQGGLHLGSGAPAAQDDHADHQHAEQQQGARTEPEQPGTLVDRRLVANEITVAGNHVVDDLAVALALLQLAVDLLAQVGGDRCVGVGDVLVLALRAAQFLGQVAEAFALGVAGELVGVDGGPGHAAEGETEQRGGEETLHRASGSSSSCWYSGASCSRQTFWSTTPTILWRMMPCLSIR

SEQ ID NO: 27600 - protein, 139 aa, Pseudomonas aeruginosa
RVPRRIIEAATTSTRLFSSSRVSRDHRAKPTWLLTTGARRANRVSEPPTTSSRKARMNTPRSGSEAKACTEVSTPERTRKVPSRLREKAAIARSTVQLLNTPRFSVTASEWISAVPTSQGMKEAFSTGSQNHQPPQPSS

SEQ ID NO: 27601 - protein, 556 aa, Pseudomonas aeruginosa
CRRPTRRRDRDGPWRGSRRTIRSSSCLLHQGLHLGFRPGGAGLALEHFQAHAHQQHGREEAIEAEDHDQQRQPHLHRHRRFLGDGEGGRLVQGVPPFHRVLDDRDVHHADDGQYGTGLGRAVAVTDRLAEGDDAEIEEKQDQHRRQACVPDPPGAPGRLAPYGPGKQRDEGHPGADGSGALHRHVGDLHLPDQPDGTGHGQHDVAGLGEEGRRHMDIDDAEAIALLVVRRREGQPPDAAGDDQQRRRHGEPGQPAAADLVEPLGRPKLVKPCPIHHQALFTGLFGNTGQTFRCQPGSSVGGTAARYRTPADAFGGRTHSPTLIFRPAAMANGVSVNASAVRLASHNKCPLLGSPCSEACSAPLPRISTGMYSGRISSASNRPPRLRPTVKAAPTAPSRLSTGVPSNRESSSTGMQRAGRPSISANSGDIRTRASPENSQCASTLASTRRARGCGERTHCSREPSSKSLRNSPSSESSTANSAATQTRPGDKVCSNWLSGPTARGNRAMTMAKNTSGLASSAGRRNSRRASRARSRLKTLLMPGRPAPARPSRRWPP

SEQ ID NO: 27602 - protein, 451 aa, Pseudomonas aeruginosa
RRDDPEAGADPGRPAGRRRVGQGRGAGGQGRPGEQFPGPAQADPGEQRAEPGGSAEQSAAGAGQPAQRQRHQQHQRGCNPARQHGRRWPAEQPRPGATAARHPAPGQGPVQHRAAGGQGPAGGLPGPAEPAQHAARRQQAEPRLAPGAAGRQPAHGAGEKQPADRLPAAQRTPRPACAGPATGRAERPPGFPGRPVRRPAGAERPQRPAGQPAPGRGAPLRRPAGGAEDGRFQAARPGPAAERPVPRGAPDAGRHRSSRPGPEGQPVAPVRPAVAAAADRRPGAGHVRRQHGEPGPGAAGLCPQRPGQPGTERQQDPGTELSPAEQGSPTVRRGHGTGVTAAPCRRGDLPPADPSVVEPGADQHPAGWHPTGDLADGGAHAPSALGGTVAGEVPGRTAQDRRRGPRKPLARRTGLRPGAAGTAARPGDPATRQPVQPALGRARRDRAAGRA

SEQ ID NO: 27603 - protein, 153 aa, Pseudomonas aeruginosa
TRPPAPTPARRRPDRWRDHLPTRPPAPGPASDHRTTLGRRNRMNRKQSPAPRQAIALSYDGQAAPTLSAKGDAELAEAILAIARDYEVPIYENAELVRLLARLELGDAIPEALYRTIAEIIAFAWHLKGKCPEGFAPDAADGNQMLLLGGPGD

SEQ ID NO: 27604 - protein, 640 aa, Pseudomonas aeruginosa
LATAQTFIALLFLAWVYPVGAALMASSAPAPVRKPWFARSWRRRRGIDGCRRGRRRTASICSLRASCRACVAERRIRLRLAAADPADAASHLQVARDHQHHPAILRPPLGAGIVRHRLKFTIAHRSHPRRLDPIVAEQADDARRPRRRQFPVGGIARAMDRHVVGEALDMDRVLVGRQDLGDLLDDIEGGIVGQRIAAGKQQAGIKSDLDPQLVTAHAQLVGGDQVAEGIAHAVGDPLQRVGAGRVVAGLLLDAGALRLGGARPLVADGNRLQRAVGLVEHAGEGLREDLVLALVDRGNRIHHHEEGEQQGDEVGIGNQPAFVVLVFLLVATAALHARLRSVHEALQLQLDGTRVLALGDGQQALQEHLAVARLAQHQGFQLVADRQQEQVGEADAIDGGDEGHGDAAAELRRVGQVAHHMDQAHYRADDADGRRIAAHALEHLGGLQVAAFLGEQVDLEDAADDFRLGAVHQQLQALARIGIGLRVGDALQAEQAFLARGHAPGDDPVDSPGKILARREEHPAEHAQAALEHVHRGLQQRRGQGAADHDQRRRTVEQGPRVAALEKVSADDGDERQDDPDQAEHIHQRVLSARRRRAQVVTWVAIEGSLLIPARTLTGTPRPGAGRCRRARTPRPPGWP

SEQ ID NO: 27605 - protein, 262 aa, Pseudomonas aeruginosa
LLLRGRRSCAAGNPYAASDAPCVTLEHARHIEDQGDAPVPGDGGARHAGGALQHLAEWLDHHFFLSHQLVDDETDALGADRQDHHVPLALLLVGRARHQPALEVEQRQGLVADDHHFLAIHDIGARQVKMEDFVDVDQREGERLAAQHHHKGRHDRQGQRHLDDDLRAGPLLREHVDRAVELGNLGLHHVHADAAAGHVGNLGLGRETRGENQVVALQVGQAVRRIALQQALLHRLVAQHLGVHALAVVGDHQEDVVTLLLR

SEQ ID NO: 27606 - protein, 546 aa, Pseudomonas aeruginosa
QHHLADPRLAGGLALLRTLDAVVDGVAHQVHQRIGEGLDQVLVEVGLFAHQLQVDLFLHVPRQVANQAREAAEDLLDRLHAGLHHRHLQVAGDHVEVGHGLGHGLVATVQAQAHQAVTHQHQLADHVHDLVETRRIHPHGGLRLACRGPVGRRRTRGGGLGRSDRFRRGTLRRDVLGYRRGGRHGLGGAVELALAVQFVEQRLELVVADLIAARGGRRLALLRRRSRWSRGSRCGGCAGSFRDIAELALAVQFVEQRLELVVADIVTSGSRGRLDRLGGDLRRLGRDRRRDELALAVQLVEQRLELGVADLVASGSRGRFCNGGGRRFVALQSIQQLLELVVGDIAGGTLRGRFRRRRRLGWRNGRRRRLHRFRGLGALGLGQAGKGRQQLGRRRGRFGLLAHLVEHRVDRIQRLQHHIHQFGADAPLALAQDIEDVFRNVAAFHQRVQLEEAGTALDRMEPTENGIEQVHIVRPALQLDQLLGQLLENLAGLNQEVLEDFFIGVEAHSAAPRDVLLERIGRTAVLPEIPARLSGPTSARPPGSPA

SEQ ID NO: 27607 - protein, 257 aa, Pseudomonas aeruginosa
RPRSLAWLSSWINCTACWKCPRSRQSTSSRACFFRVDSNSSPVESLPSTMTPSWPASAVDPLENLLDLFLQDLSGEGFDHIAVDPGLGSFDDLVAFGLGGDHQHRQVLEALVGANRAQQIDAGHARHVPVGDEKVEIAAVQHRQRRGAVVGLGGIGEAQVPQEVLDDASHRGKVVHDENFHVLVQVNLRTDQSAPQGTRHTFFCVNGYKLRSRPVQADRQSARRARKRAAHWLCNWLTRDSLTPSTSPISLRLSSSS

SEQ ID NO: 27608 - protein, 231 aa, Pseudomonas aeruginosa
GRSARPSSPGWWSCRHLPGRPGPVRRPHRAGPARGSARHATGAPTACARPGAYRPPRRPAPATACSAPPASPCAAGAARDWPAADAGAATGPRRWSPVVPRSARAGRSVRNALPRGSGRPPGAWPAPPSWTRPGTDAPASPRRTIDGPCAGFPPDAPSTRRAPRRSAPGSCAAPLPAPGWACSAPAGPGNPAPRSARCRRRPGGCRESRRPDPVRRGPVSWPGAYRRRRSV

SEQ ID NO: 27609 - protein, 817 aa, Pseudomonas aeruginosa
LALPEPLSSVVLPATSGCPVCRPWSRRSPRSVLSHRRDDGDLLVVRDFLVGQHMHAGHRHPREARHHRADRSGNQQDRRLTKHLLALRALDQRALQLLGHPRLQQHAVLGALSGLLHAVQQNLFQPRLERDHRQLRLKPDNALHDCAGQRDANRGDHRAGILTPWSDVGDGLGDGTDVAHRHLLLEQRLQDLEQGGQGNQPRHQLFRQLRRAAREQLQELLHFFMAQQLVGVLVQHLIQVSGDHGARIHHGVAQRLRLVALAGLDPYRLQAEGRVLAGDAVEAAEYLAGVDRQLAIGIDLRFGHADPHQGQTVGVGQQVEVVADVHRGHQEAQLLGQLLAYALDPRQQLPALVAVDQRDQPVADFQADHVHRGDVVPTQFLDLLGALRRQQLLLALHLLLGDLLGLVLPVPDPVGGSAGQGAEADEGNMRHARHGAHGDQDRRGNRQRLGRGEHLPVDLLAHVLGTGDPRHHDRRRSRQQQRRQLCHQAVTDGQQGVDLAGVAEGHRMLDHADGDAADQVDEENQQAGDGVAADELAGTVHRTVEVGLLGHLAAALLGFLLLDQAGVEVGVDGHLLAGHGIQGEARADFGNPPGALGHHHEVDDHEDREHHHPDHVVAADHHFAEGLDHLACGAMAVVAVEQHHAGRGNVQRQAQQGRHQQDGREHGEVQRPQGVHADQQDDDGQGDVEGEQHVQQEWRDRQGHHRQHGQQQDRHAEAAAPQSRQVAAHIADQLRAIHSRLPCPAYGARRWAPNKLLTPECASGGSLQEPFQLFNSLIEKGFRQSPTTGGATAATRASAAGERVRRRTGRTGRRGTR

SEQ ID NO: 27610 - protein, 420 aa, Pseudomonas aeruginosa
  UNSURE (367): Identity of amino acid at the above locations are unknown.
ASVIAAASTPSPRAAGAEIATDEQRQASGGQDDQRLDAVQRVVHQQQQALQGQGQQQAEQARQVGPAPSSAQPLPGTGQHQQGQSQRKRHGQSVMEHRQAITAVGPEQPLRIEHKNGEEPAGTARILEQRAEADAQDRHHLRQRHHRPCRPVPPQCQRRSERHYRPQGPVPGARTYQQRHPAESAEQECDSQGLPYRAGLQRVARRRRQRLAVDQSYQALRRRFQAAGVVLLTERRGHVFADDPPGIDVGDRSFQAIADFDAHAPVVLRHQHQDAVIDPLAPQLPRLEDPRRIGLNAVRIGAGHHQDRYLGTFPGIQRGQRSFQAGTLGGVEGRGKVGHPPRQRWNLRGLVARIARCFGLGADRRCXHGLLLDIGRCHRDGDRHRRGGNGGNRGGAEQHAEQAKHGEITRDCRHPCLRMK

SEQ ID NO: 27611 - protein, 246 aa, Pseudomonas aeruginosa
ARGFPKARWEPSQKALAALPPPANRWSHPVRLALFDLDNTLLAGDSDHSWGEWLCQRGLVDAAEYQARNDAFYADYVAGKLDVLAYQAFTQAILGRTEMAQLETWHRQFMQEVIEPIVLAKGEALLAEHRAAGDRLVIITATNRFVTGPIAERLGVETLIATECEMRDGRYTGQTFDVPCFQGGKVVRLQRWLDENGLNLEGASFYSDSLNDLPLLEKVSRPVAVDPDPRLRAEAEKRGWPIISLR

SEQ ID NO: 27612 - protein, 479 aa, Pseudomonas aeruginosa
PTDKRAVRRAAPRRTQDAPHCPRSRLAAAGRDRRPGHRAMPGRRFDALYRPADLLARGRPGGALAGRRAAVDQPPDPPALQSADRPPVQAPGTEDRPAPGGRHRRVEHRRLRPGQRFPGLGAAARTVGDRLVVLPHRRALGGGLLRRRPPARPRHGPVQRPLPPGQPGRHAARRAAGAGPRPAGAGAVLRDPGTARPAAAGEGFRPTGESRRTCADLRRNGIHQRRQAPAAARPGDPQRLRHRAPDPGRTRRHPERADRPQLRHRGQPARPGAQRRRPFRDHPGPALVLGAVAGRALRCLVGWPARASALLRGCATGRRNGLRPAFQQAAHSRLAGHRPAGDAGRHRPHHPDRRPRRRRRPRRRRGRLHDPLLHRPGPRRRAGPGPGLPPAGAARRLRLVVLGRLPGVPGPGVALVAPRGLSDRLVDHQVEDDHEGDEGRPAEDEPGVHVAVRQRFDGPRLAQGRLGHVAYADLQPHHR

SEQ ID NO: 27613 - protein, 237 aa, Pseudomonas aeruginosa
RPRGQPWARRSSSSSSPWVSACGPTSGITCARSGQRRSKASTAPTRSSTCSGCRRARLSSKGISGSGDRRSSQALLAPPGPSSRDGRSTSAGMPSSSRWRSAAALLARKATSGCAPAPSAEICRTFAPWAAARSKSVRAPLSWTRAMLASSRLMVPAALISRSTPAGQAKLSGLSASRSRSSASQRTPAGASTGGRRAVRSSSCPAASSAGSRCRPTKPPAPTSRIRMRSYRTGEGR

SEQ ID NO: 27614 - protein, 823 aa, Pseudomonas aeruginosa
  UNSURE (427): Identity of amino acid at the above locations are unknown.
QPVSASRRGSAEEQLVGRVGGLVPVRIADRLQGLRDQVALVFRHLQPGHHPAVGRAMVAVVEHRDVPAPAELGEEVEQRAGPLGEFEAEHHLVADFHRMAADHVANVQLGQFVVGQVEDREALLAQIGHQRLARVVLRVGLHADEDVRLAAAVVAIVELGDLALADRLAEGLEAARPLGNGHRDDRFAALAQFGAFGDMPQAIEVDVGAGVDRHQGLPLGALALDVLLDPGHRQRAGRLGDRAGVVVDVLDRRTDLVGADGDHFVDVVLADVEGVLADLRHRHAVGEQPDLAQHHPLAGGHGRLQAVRLVRLDADHLDLRTQVLDVGGDAGDQSATAHRDEDRIEAAGLLAEDLHGHGALAGDGVRIVVGMDEGVALLVDQLQRVGQSLGEGVAVQHRLGAVGAHRLDLDLGGGLGHHDDRPDPLPXGRQGQALGVIAGRGGDHPAGLLLLGELRDLVVGAADLEGKHRLQVLALEQDLVAEAFGQLAGGLQGRFHRDVVNARGEDLLDVLFEHRRRFGGLHGSPESTPGPPGGLPARRRKTPRLPVIRGKTGGRQAAIIRPFVSQRHRTCRKPAGPPRPRAPSACAAGTAGQATRQAPGMNQDQLKQAVAQAAVDHILPHLDSKSIVGVGTGSTANFFIDALARHKAEFDGAVASSEATAKRLKEHGIPVYELNTVSELEFYVDGADESNERLELIKGGGAALTREKIVAAVAKTFICIADASKLVPILGQFPLPVEVIPMARSHVARQLVKLGGDPVYREGVLTDNGNIILDVHNLRIDSPVELEEKINAIVGVVTNGLFAARPADLLLLGTADGVKTLKA

SEQ ID NO: 27615 - protein, 64 aa, Pseudomonas aeruginosa
TPNTRRVPAAAATAKASTGWTSRCCSSRRPTGNWATWTATSRPTTRRFPAAQPGTTRPRTTRKY

SEQ ID NO: 27616 - protein, 297 aa, Pseudomonas aeruginosa
TWPDSRASACASRTATAHAARTVRGRRCGCGFPPPPSGCSPNEHRRPTYRATVGRTPAAASAPAAEQPGDADAGAVPGDPAGHHVRRVDPAIRRLRRSEMGPAQPGGLPQFPLGTRPGRQPGVQRRLPGHLPALVLALAADHPRLPGARLPHRAVPGVAAGTPAQPAAVPGHRAVLDQPAGAGLRLDPAAAQRRAGGRRPARHRPDRHRAGAALYRQRGDHRPPLYLPAVHGAADLQQPGKDGLAPGGGGIRPRRQPLESAAPGDRAAGDAGDSRRLHPGIHPGPGQLHHSGIARRR

SEQ ID NO: 27617 - protein, 314 aa, Pseudomonas aeruginosa
GADDRQPDPAAIRYRAQLAVRRRPFVRPAGLRPAGDADLQPALPGQRRRRPAMNGRNPLWTFSGVRQAAWLFFAFLYIPILVLVVLSFNSGQSATLWESFSLKWYAVVANDPEILRAAKNSLLVATLATLASTVLATLAALGMRGRAFRGQTLMNGVLGLPLLVPEIVTAVATLMFFSFIGLKLSLFTILIAHIVFCIPFAYLPIRARLEGLDPRLAEAAADLYASPWKAFWKITLPLLMPGVLSGAMLAFIISMDDFVITYFVAGAGATTLPVYIFSSIRMGISPKINAISSIILMISIAFVALSYYLGQRRR

SEQ ID NO: 27618 - protein, 236 aa, Pseudomonas aeruginosa
RPSASAKSAHRATSAWNRSAGCTARVSCVSCRTPGRTGWPPAAATTCCRSPGRPGACGRRSRTTSTVASATTPSTQARRSPPGPGRRSPVRPTSPSAASPNSPTARARYFRSVARRATTPRPTTWAAIASSTMPPSPPRPSSTGAPGGWRSSTSTTTMATAPRTSSTTAPMCCSPRSTAIRASNTPISSATPTRRATASAPATTSTTHWRPAATGRPGARRCRRRSGRSRPMRRTS

SEQ ID NO: 27619 - protein, 502 aa, Pseudomonas aeruginosa
LIYRLLNGWKGIRGARHRREGPDDRPSALRHLLLGEDLAGIHDPVGVEHRLQCLHIGNFGFRAGVGQVVALGHAHAMLGGNRAVVLLDGLEHPLVDGRALGEELVLAEVFRLEDVQVQVAVADVAEPHHLEVRVVGLDDGVDVLEEGGHPGNRDRDVVLVRRPVGDGLGDVLAQLPQVLQLLLALAHHPVQHPALLDAVLEGGQRLVGDFLGGRLELQQGVERAVGFERPRYVATGQDLGQGLVGEELEGGQVELALEGMQHRHDRVEVGRAEDHSGEVLRRALQAHGRLDHEAQGAFGADEQLAHIVAGGVLDQVLVQLEQVALAGDDLHPGHPVTGHAVANDLDPAGIGADIAADLAGTGRSEVNRVVQAVFLGEGLQLLGNHARLADYGAVEGIEVEYPVHVVEGHHDFAVGRHGRGGEPGTTARRDQTDLVLVGPADDRLDLLDALGEHDGQRRRGEMLGPVLAVGVQGGGVVEQLARLDQGLERFDQGFAGHSGTLK

SEQ ID NO: 27620 - protein, 368 aa, Pseudomonas aeruginosa
HPGNTTGRNFPGTLRAFRIRERHRWHSDFHCEARVRAALAHIIRVNARNPWKDRMQPSRFAIVQDAGPAKLNEQHRPDRRSFPPEEYYMRFLPRLLMLVSLAAPLAHAELLDDVHQRGALRIALEGTYPPFNFKQGGKLTGFETELGELLAAELAVKPEFVTTEWSGILAGLQSGKYDIALNQVSVNEQRRKVFDFSEPYTISSAQLIVRADETRQFKSLEDLKGLKLGVGPGHQLRRPGEVGGRRQRAHLSGRPGIPAGPGQQTHRRGAQRPPADPLRHPRGQAAGQARRGGGTGGEHGDSLPEEQSEVRRGAECGAGEDQGRRPLRQALGKVVRPGRQPAAEVSSRPNGGSGRARETRPSCLSMEC

SEQ ID NO: 27621 - protein, 230 aa, Pseudomonas aeruginosa
MNSLQKLLEWLANLVELLGMAWPFLLQGAMYTVLFAAVSMVLGLILGFSVAVVRVTKVPVVSQIAAVYVSAFRGTPLLVQIFVLYYGLPSVGIEFTPVTAGILALTLNVAAYLSESMRGAILGIDKGQWEAGLSVGLTWGQTLWNIITPQALRLAVPSLSNSLISLIKDTSLISVITVTELMLATKEVIAETFQPLPLYLAAAGIYWLLSALFERVQKALENRLTAPLRR

SEQ ID NO: 27622 - protein, 247 aa, Pseudomonas aeruginosa
RGRGMHLQQQLHRTDPRSAAAGTSGGCHPYPRRGLLLPLDPGKRLTWLNTGPSGGGAGRRSGYTARVGPRGAVAEPRSRCMSLRPTLALLALVSLPLMAAQNDPQPSSKELMKEHQAQIQNDLADVDYKRKRIVEANMNLTDQEGEKFWPIYNTYRTESDKLSKETLKLLLDYAQAYNSGNVSDDQASKLIERVDDLQEDRLELRDKYVKRIAENVSPKRAMRFLQIEIQLDAIATLEIGRQVPLVE

SEQ ID NO: 27623 - protein, 217 aa, Pseudomonas aeruginosa
PKTSRVRAFGQCRGPTASAECSALQQGERIDETHPDRDRRGGRRRGCRRRLVPPCQAAAPQRLARRGPPAGAGRRALRRARGSAPVCAEPDRPLPRPRLRARPGPPVPDGNAAAPGARRAGRSARTQAGGYRPSVPHPAHPRPRRRIQRPPGQAVAALESAGGLPGRGQPVPGKQPGAARIRSAGHTQASLHPRRYPEHRRLHGLQLRRRLPHPSRC

SEQ ID NO: 27624 - protein, 608 aa, Pseudomonas aeruginosa
STSATNWAATTCASSISIGIRRGVLTPSGALGAGDWKDLGALARLSQQALEDAGLPQFEGSNAWVVAGSRTASGKPLLAGDPHIRFAAPAVWYEAQLSAPGFELYGHHQALNPFASVGHNRAFGWSLTMFQNDDLDLIAEKVNPDNPNQVWYQGEWVDLQSEEQEIAVKGAAPVKLTLRRSPHGPIVNDALGVSSGRTPIAMWWAFLETENPVLDAFYQLNRADTLAKARAAASKIHSPGLNLVWANAAGDIGWWASAALPKRPEGVNPSFILDGSKGEADKSGFYPFADNPQEENPARGYIVSANFQPVPANGRPIPGYYNLADRGQWLDTQLADRGTKWNLDNSRALQLGNRTGYAPRLLAPLLPVLREVVDDAEGKRLVEQLAAWKGDYPVDSTAATLFNQLLFQIAEGALHDELGDAFFDSLIATRAIDSALPRLAADADSPWWDDRRTERRETRADIVRTAWNASLAHLRSTLGNDPSGWLWGKAHTLTHEHALGQQALLKRLLNVGPFAAPGTHEVPNNLSAKIGPAPWAVTYGPSTRRLVDFADPTHSLGINPVGQSGVPFDGHYDDQAEAYIEGHYLPQHYEENEVKANSKGVLVLEPKR

SEQ ID NO: 27625 - protein, 417 aa, Pseudomonas aeruginosa
KRPPAGGLFFSAEGSGRGRRAFLPVGRGLFHRLLDRPATPLLGLAGEVPGEEGEQRNAQQDQAGHRVDLRLHAQAYRREHFHRQGGRAGSGDEAGQYQVVQRQGEGHHAARRQRGRDHRDGDQQEHLPGLGAQVHRRFLDRQVEFTQARRHHHRHVGRAEAGVGDPDGHDTPFLRPADQLRHGHEQQQQRQAGDHFRHHQRRGDHAAEQRTTAEARDAGEDEGRQGAEEHRGERRIEGDLQGASDRADQLGVVQQADVPLHRPAAPHRHQLGGVERIDHQDQHRQVDEEQADDQHDVGEIPALHTLPSSSLAWFLLNRMIGMIRIASITTARADATGQSRLLKNSCQSTLPIIRVSGPPSSSGMTNSPTAGMNTSMQPAMMPFFDSGTVIFQKLVKLRAPRSEAASSRLGSCFTRLA

SEQ ID NO: 27626 - protein, 582 aa, Pseudomonas aeruginosa
SDQLYTCSTLLSAACAIPATEPAKVRASRVLPKRFIMRGSSIFVEVSGRWRNRSRHHPVSLANALAQSGKSPLRDSSQDGGGGLIEALARQGDQLIDLRRIDHQRRRDNHSVAHRAHDQTVAETMFPAQHPDALVGETLAGLLVLDQLQGGDHADPARFAHQRVVGQLLPAFLQIRCRFRLHLLDDLLFAQDADVLQGHGGRHRVTGIGEAVVELAALVEHFDDLVAHHHPAHGDVAGGEALGDRHQVRGVAVVLAAEPLAGTAEAADHFVGDEQDVVLGEDLADLRPVGVRRDDHAAGALDRLGDEGGDVFLAHFENLLLQLLGGPDAELVRRHVAALAVPVGLGDVDDARDGEITLLMQRLHAAQADAGDGGAVVAVPAADHHFLLRLALGRPIVADHTQHGVVGLGAGAGEEHVVHAFRSDVGDRLGQLDHRRVGGLEEQVVERQLAHLPGGGLDQLLAAVADVDAPEAGHRIEDLVALAVPDIDAFGLGDDPRALLVQLLVVGERRQMVVAAQRLPLTGLGVGDLAVHVTPLLFKTVRERRTTPAAPGQDQTESRRNSRSQELITRLKFSCSARFTAT

SEQ ID NO: 27627 - protein, 142 aa, Pseudomonas aeruginosa
GLASAPARRFSTRRFSGLESGTRRPTVRFSSPHSTFTGAEVSGRKRRNEFTLGANSGSTSGMNFCRPPIWCRNSSLMVPSALEKMFLPVFTSTMLWCRCIALPGSPVIGLAMKVAATLCLSAASRMVRLNTRIWSARSRASP

SEQ ID NO: 27628 - protein, 222 aa, Pseudomonas aeruginosa
TAGRSRLARRSPASVRSRCRCTPSTTSTNTSSASRTSSTAPAPRASRPTPSSPNPHRRSSRSTSTTSTTPSRPATTRCCSSAWSRTSPTTTRWTPPSWPSPIRARPGTDCTCISRCSTSMATTSSPARIPSRTPHCAMRSAVCSRPCRPPWPSSARTSTPTAASVRSSTCRTRRAGAWTTAPWPCACPPAARTRYAWNTAWPAPTPTPTCYWQRCWQAFITG

SEQ ID NO: 27629 - protein, 246 aa, Pseudomonas aeruginosa
PTRSSRARRSKATPTSRWSRACRTTCATPCASWTKARSWRSTSTRSTSTSSSPARKASWRSSSTRSPTSSTTGTCIPSEVAVSARRSWAGAVRSEIRGGFADTQRGGVCVWETAPVLFSEPGNVRHGTACRHASRQTRCWPASMPLPPGSGTIVRSVPSSEKIPCPAFPPCCSSPSHPGWPRPRRPCASTTGTTTSPHRCSSPSRRTPASASSTTPSPPPRNWTRRCAVARRSTSPSPPTTPCRPC

SEQ ID NO: 27630 - protein, 140 aa, Pseudomonas aeruginosa
PLTPGDPPHAAHLAHPQAPRQQPGPDRRDPRRRPRPARRRRHRRPVHLQRGRTRGNATIVGLPLLPQRAGPAPGADRRGPRRLPRVPRTAGGTCRPALLARPVADRRGAHAGGLRPRRGGPPTDSRQPRPGRSHPGRSPA

SEQ ID NO: 27631 - protein, 343 aa, Pseudomonas aeruginosa
NSLKPLHSPIFIGYKSAHPSIGRDTPFPPARPTTGRRQARQPSEPAHEVLHDPQRHRRRHPDGLLLGSSGEHRPRRETGAPGRRQGCADHPDPGTVRDPLLLPEAEPGLPAAGHHGRGERRHRPLPGPRPGVAGGIADQLLRTRRARPLQQHRGHRRRWRQPRGLPQEPHPGRPGLPREVLLQSGRHRLQDLADPPTHGSASVSAGTSGSPNRRAAWPWLGAELLFYPTAIGSEPHDASISSRDHWQRVQQGHAGANLMPLVASNRIGREEQDGYDITFYGSSFIADPFGEKVEELNRTEEGILVHTFDLDVLERTRSAWGVFRDRRPNLYGPLKTLDGSLES

SEQ ID NO: 27632 - protein, 422 aa, Pseudomonas aeruginosa
GLGKRSARGRPAHSAPASAAHSNDFRSSDEQPDQHPTRRRLPHARRMGTPRADLDGLAGTPGQLAQRRQAGPGGLRRGGQGHRALRAGHRLRQRRAVRERARTPRRRQHPRRGNQQRRCLGPRHRPDLRHRRQGRCTRRRLGLQRLGRLRRRPVLPLAARRPGGTQDPRDRTARPLPHRRLRPRGRLDPRRRRRHADHHRGMPAQPQPQPAPEPGGDRADPARLPCGGEHHLAAERPLQRRDRRPRRQLLLLRASRRGAAGLDRRPGRPELPALPGRPPRAGRKPRRQGTQAGGTQDADPRPAVRDPGRVRRRGYRRGQPAARSLHSPGRLLRELPDRQRRHHRAELRRSQGRRGQGDPPARVPRARGGDGPGARDPPRRRQHPLHHPAATGAAQGLTGIPQGGWPAAALFALAGPARRVAP

SEQ ID NO: 27633 - protein, 471 aa, Pseudomonas aeruginosa
MKKARVLQEDAGFFLSGRSLQQRQGVADDQAVLVLVALVVARTGSRQAAAEGGVLPGEAQALEGAVRDHVGQGDIAFPLALVAAGGLDLVAAQVNGIEGQARHADGGEVVAVADLPGALAGTLELADLHVGDQVRGRTFAIATVQEREVTVAVEDLVAGADAVAADGIGEEAAEGAVVDFALGHAAAVVAAADVAVGTAGTAAVLAVGAAVEGAQVGLQDARANLPVVDQAEEVLLVEVVQVAVVVLQGQVLVDLVVATRVVELVAVARTGAAAVGAGDAQAAVVGGVTALGVLQLAGNQGEVLEVGRGDLAALEGDRQQAAVVVGDHGQLRLQGAVAELGVGHLGLGGQAQAGEVVHRLAVAFQREHGARLAVQAALAGTAAAVQAHAEQAQRVDAEADGALGEARLVIQDEALAPLFLLARRGGAIAVVGIDVEVAQGQRCLAVLDETGGDRLLRQGTEGTGSDGQGQS

SEQ ID NO: 27634 - protein, 429 aa, Pseudomonas aeruginosa
ANLSIGLRLRVLSGFLPFSRLTGRRVSAENRLLQLPFWRVTATFQKSLFPALYSARVINSKISAINLKRINYSYLIALRNIVPQPRPAGRLPKEVFRGAVDKTETFAQRSAHDDAVLALALGRVHRGVGPAVEGTESLVIGLEDRQALADGDPEAVLALLEAQALHLALQACADLSRGLLVAAGQQHGELLAADPPEQVATAQRGTAALGDTLEDLVADLVAEAVVDLLEVIDVQQQERQRYPLAATLLEGRLGTVEEIATVAALGQHVGGGQPLQLALHVLLVGDVLGDAHHHQRQSRLALAADEALVVEPADLAVATHDAVFALFHGATFEHLQQAAVGVVEVVRVDAVAPFLVVRQQQRRGTAEDFLVGGTDVDHSPVLPVVGPEHRVDAGQQGAEELLALLQPGHFGTAVQQGQRGLLRVFGNAG

SEQ ID NO: 27635 - protein, 177 aa, Pseudomonas aeruginosa
MHHAQRPLATQGAKDRQGLQVVATDRQRQGTGGMDLAIEAFDAAQRIEQVDGIHRRITEVADPHQVVGRDAADVMHLAHQAGQVAHFARAMAGTGAVGGAAIPGHADQADLQRRRVGERRQAHEGRDAGEAWNIGGVEGLRMVVRHGASPCGGKKAPGAARRGGFIPAGLAGWRQDG

SEQ ID NO: 27636 - protein, 88 aa, Pseudomonas aeruginosa
LPTENPMSPRLSALRLSLAYLAIAIAWACLRDHLLPNQVQDQDQLVFWMTANGCYSCPQPAGSCTSTWYASSAARPRPTTNCTAASSA

SEQ ID NO: 27637 - protein, 68 aa, Pseudomonas aeruginosa
PPGPAPMSRWNRPCAMRWITTNCASTTSRCTTWPAGGSSASSRWCAGSIPSAAWCRQASSSRWRRNAG

SEQ ID NO: 27638 - protein, 89 aa, Pseudomonas aeruginosa
EYCPLLTMRLTPPPLRRATRHLEPQEQRPMSATLRSLDGQDEATILREIQSALRGLRFGAVEITVHNGQVVQIERKEKFRLQQPAVKQA

SEQ ID NO: 27639 - protein, 161 aa, Pseudomonas aeruginosa
PRKAWKSSRRTRRPPAARAGTSSPPGPGRRSSTAATRRPRTTCRRCTSTYRYSTLAPAARPSPSSTTRSATCCWPGRTRRSWRRRNRAGKTSRSSYPPSPSLPNRRSRWSTRWSRRKAPARSPRRTCNTCTARKASASPRRTYTGRATRRSPPSSPRSSRN

SEQ ID NO: 27640 - protein, 547 aa, Pseudomonas aeruginosa
RTTTAWPAWPAARPSTSSRRPSSRWPISDPAAGSARRALRQAAQSRAALRRHLQRPRAVLRPQPALAQTGLQQRRPQRAAEVRLAFAPVGAGAGELPTAAADLRQVDSQPGQPGLAGRAQAQRPALLLDPAGIQHPCEHTDREFAGQVVVAGPRLAQRRRRAVARRQAAPLRLQGQGGAGQRFHRLSHFRPGQAIEAIAPARLQAQHAALDQPSQVAAGGGRRDARQQRQLAGRAGAAIHQCPDHLRAAGIGEQRRQRTEAGIELHASPPDETLPVDDERYWPPSPVRASPRQGRTRMSVDLHALIPLIALTFLLAGFVKGVVGLGLPTVSVGLLGLAMPPMQAAALLIVPSMVTNLWQLACGPRFLGLMKRLAGLLLGVIVGTLLVGAWLGGDAPRQATGVLGLALAAYALLGLAAIPLHLPARHEPWAGPLVGLATGALTAVTGVFVIPAVPYLGALGLQRDELVQALGLSFSASTLALAVTLGVHGDLLEPQMLGASLLTLVPALGGMLLGQWLRQRISATLFRRCFFVGLLLLGADLAWRGFH

SEQ ID NO: 27641 - protein, 309 aa, Pseudomonas aeruginosa
RQGRIAHPPGRACGLRGTSDERHKSLSSAAARPPPGARHRAEHARPARNATYRKEHTMKTRLSLSALALACATLAGCQNLPQGDLMQHGMMAVKAATLSDAEVRQVADQACAESDQQNRIAPANSKYGQRLDKIAKALGDQIDGVPVNYKVYLTEEVNAWAMANGCIRVYSGLMELMSDNEIEGVLGHEMGHVALGHTRKAAQTAYAAAAVRGAAGASKSGALAALSGSQLGELTESLVNAQFSQSQESDADDFSYELLKKRGVNTQGLVTAFEKLAKLGGGDSSMFDSHPGSQARADHIRQRIAADRK

SEQ ID NO: 27642 - protein, 181 aa, Pseudomonas aeruginosa
RSHPGLPRSRETASRRPLVLANAGRAGALLDLALHVAAQPQQKGQFRQHEERTDDQPAEIVDEGRLAPFVVMTDELDDPADHEQADAPAQPGRGSPRRQLRSAPHRQRQQRRHGHAEAQVQAQVEQRRGERQQQRRRQAEPQRRPRQQHGDGEDDHRNADEMAEDVAPVAVVGGVLRKVID

SEQ ID NO: 27643 - protein, 231 aa, Pseudomonas aeruginosa
TTNMNERTDYRSQLQAGRWFQGLPEALQTHLLALAQPRQLPPGQRLFARGDAPCGLYCVVEGAIRISAVSENGKEALLILVEAPHWFGEIALFDGQARTHDAYAEGHTQLLQVPQAALLELLRREPHYWRDVALLMSHKLRLAFIALEEMALLPAAQRLARRLLMLAEGYDNSRSRQVLHLPQEQLALMLSLSRQTTNQILKDLEAQGILQLSYGGIEILDLAGLRAATHG

SEQ ID NO: 27644 - protein, 263 aa, Pseudomonas aeruginosa
RQQQDLPMLRPALPAVLCLYCLLLVLPARAALDDQQRALQQLQVQACRAVGSLLLLRGEGFQEQHAAQLEKDLASLDRALAAAPEGVLLRQDEKTLVARIREGAAYGPREEDLPWRYPQQLSRALRDFLNLVERQVPPPPPGQPLPLWQLPVRVEYLSLQYLARAYLGGLETAREQPRDYLGQDESVLVPLIDRRIALLVAQSANPAGLKKLENRWEYLSQALRDLNSKSSALVSASGRPWAPIIVDRHARALSESLMRLSAE

SEQ ID NO: 27645 - protein, 458 aa, Pseudomonas aeruginosa
GHAPHGADNLATRNVAPASAPTPWPAHFFESALRILICRHALAHAQWCSRKEIAMPSANPPGRTLWLMAAIVLVGLNLRPSMAAVGPLLNAMRGEIALSFGAVSLLTALPVMTLGLGMFFGLGIARRVGEWRSVALALLLIGAASAMRLGSRGLPDLLGSAMLAGLGIALIQALMPALIKARFGARTPLCMGLYVTAIMAGAALSASAAPTLAEHAGWRIGLGAWAALAALALLAWWLQPGTRLRLPDAQPGRSFLRYPRTWLLVLFFGLGTACYTCVLAWLAPYYLEQGWSAQESGLLLGFLTAMEVLSGLLAPAMASRSRDRRPVLVGLTALMLAGFLGLAWAPASLPLLWALCLGLGIGGLFPMGLIVCLDHFDAPQRAGQLAALVQGAGYLIAGVSPWIAGLLRDSLGSFTGAWLGLATVAALLLGLGLRFDPRRYAALFAERQARGVGAESLR

SEQ ID NO: 27646 - protein, 638 aa, Pseudomonas aeruginosa
GKGRVLMALPTPSGRPDADRQRPAQGRHAGPAGLPPGPPTTEPRRGRRTPEPQSVDGQLLPEEAAPGLRRRAVHRHPRRHAADPQESRHAAPRGGNARPHQRLSRRPGQLRPAWRAADLYPLRAGIRRAADPSGTPATARRQRPEDRPGHPPPGSRTAHRSIARRPGRPGLRLRSRVPPTGTGATGARPVQRRAALRTGSCPAAPRAPGTGRVLPAPLRLPDPARRQQRQPGGHVAATPGPQPRGRRARQQVRRRPATAVGQRLRADAATAYPCTARRWPPSRLPRTARAAAVRPAPVMEPRRRPGPGEPLAARAGTDRLRRAGFALACVILHFEARRQGAPEHFGEYLLDAAGQVVEHLLRFPPLAAHQPEIRLEGVPAHLVLQATRRLQPRFDQLLQAQAKPFRLTVARANTDDLAGAHDGRSSGRTSDASVGAALQWLEDRVALLEQLPDQQLGRLHRIGIACQQVRHVRRLVPALAHRVGLHRAAFQLRLHGAFEHVDEHRAGMHMGRGDLAGLERHRQHQPTMAGNLGQGLVVQGFHLLRNMGAGQRRQRGEQQAGDRSIGLHRRPPHSACMPMPTPKRFQALMAETARVSSAISLSSKCSRSSSSRPCGNAPWLRRASCSVQARAARSRGVK

SEQ ID NO: 27647 - protein, 696 aa, Pseudomonas aeruginosa
RREGSSPRQHAMIDCLGTCRPARARSRFAIGDRVSRFVRCHHRQRRHRTAQLLPAVRPLRMRSSPGSDTAQAEVLDLEVVLDPVLGTFAAQARGLDAAERRHFVGDQAGVDADHAVLQLLGDAEHAGQVAGVEVGRQAELGVVGHGDDLGLVLEAEHRRQRAEGLVLGHQGVLRHVDQDGRLEEGAAEGVRLAAGNHLGALGDRVGDVFLDLGHGLGVDQRTGGHAGFQAVADVQLGHGGLQLVDEGVVHAVLHVQAVGADAGLAVIAVLGNQRALDGGVQIGVVEHDERRVAAQLQGHLLDVLGALGHQLAADFGGTGEGQLAHDRVAGQLAADFAGATGDHAEHALRNTGALCQFGQGQRGIRGLRSRLEHHGAAGGQGRARLAGDHRRGEVPRRDGRGHADRLLDHDDALVRLVAGNGVAVDALGFFAEPFEEGGGVGDLALGLGQRLALLDGHQAGQVVLVLDHQVEPAAQLVGALLGGQRTPGRQGLVGSLDGAAGLGGAHLRHAADDLAGGRVVHLDGLAVVGIHPGAIDVGLLTEQLGIFELHDLSPSRNAVSSGSTSTTPRAWLSGSVVTGKCCLLVIRKGQRPGVPFPAPCASGVAVTGRPPCATGGRGRTRPPAGVGEDTKDSCGKGIADETPRRHHGGPAARKAGRATGRSERGHSRGTRPAELMPIPRSPVVVALGAFEISNES

SEQ ID NO: 27648 - protein, 866 aa, Pseudomonas aeruginosa
ARVTWGSLLQRMGEEPPARNKERSMRQRDLKFTFVVGEGKLAFDVVEFELEEALCEPFRLNLKLASDKNAIDFKQVLDQPGTFTLWQDGRPARYVHGIVSHFTQGSSGFRRTRYELLLEPQLARLELCCNWRIFQEKSVPEILQALLKEHRVLDYEQRIYHEHLPREYCVQAGDSDHYLHDRLAFEEGLVYYFRFDEHRHTLVCSDRLYVQERIAGGPVLFSAQPEGDNPQPVLHSFRYSENVRTARQTQRDYSFKRPTYDQEHHLAGEALEHQDSSYERYDYPGRYKRSGAGRPFSESRLRGHRRDAREASVSGDDPRLIPGHAFALEGHPRADFNAWWRPVRVVHRGTQYAGQEEESADAPLGVSYDLRAELVPEDVEWRPAPLPRPRIDGPQIATVVGPAGEEIHCDEWGRVKVQFPWDREGRHDEFSTCWIRVAQNWAGADWGHMAIPRIGQEVIVDYLDGDCDQPIVTGRTYRATNRPPYALPDHKILSTIKSKEYKGSRANELRIDDTTAQISAALMSDHGASALHLGYLTHPRPEGGKPRGEGFELRTDEHGAVRAAKGLLLSTEEQLRAGAGHLDRGVVVQVLEAALELARELGDYAGEHQGVGHDAAPQQTLQEAVRDLGHGANDESGKSNGGKPAIALSGPAGIAAATPASLTLAAGEHVDSVARQNQQVTAGQKVVINAGSDIGLFAQGGELRQITHQGPMLLQAQKNDIRLEAEQSVEVSASQQHVLVTAKEHITLMCGGAYLTLKGGNIELGMPGNFVVKAAKHSHVGPAHASTSFNAWDSTPFDDRYVLRDEATLEPLPNIAVEVIRGDGGVVKLMTDSQGRLPKQQHLAMDPVQIRILGKGSHNSDTESNT

SEQ ID NO: 27649 - protein, 107 aa, Pseudomonas aeruginosa
RGIRPAAAAPHTPRLDAIGGVARARYPGQRPEPGADPDASAGQSRYRSRGHPGAEGEDWPGRLGEPLEIASAALFLASNEPRCRYGTEILVDGGVRHLKKGAKARSW

SEQ ID NO: 27650 - protein, 543 aa, Pseudomonas aeruginosa
RRGRGDQGPPGSQRPGAGAVQPAGRRLGQGRARHRLPPGSGPGVPRGGRQGHRLRQGAGQPPGELPRRDPAAGARLRQRREDLRRQPALRRRQAGSRRHPPGHGDDQHPRHPRLLPAEHPPGPGDPRQGRQRQPVPAIRHLSHADHGRRPGPHPGKPVGGDQPRATRRQPRPPRTGHRRDQLPLPLRAPGPHRLPGLDRLRVQAGHHHRSRPRLDEDAQRRLIRTHEQDAPASLRGATRQTEPGDTLMAKIGFIGTGIMGKPMAQNLQKAGHSLFLSTHHDAAPADLLEAGAIALANPKEVAQEAEFIIVMVPDTPQVEDVLFRKDGIAEGVGPNKVVIDMSSISPTATKGFAEKIKATGAQYLDAPVSGGEVGAKAATLSIMVGGCPNSFERALPLFQAMGKNITRVGGNGDGQTAKVANQIIVALNIQAVAEALLFAARNGADPAKVREALMGGFASSRILEVHGERMVKGTFDPGFRISLHQKDLNLALAGARELNLNLPNTANAQQVFSTCAAIGGSNWDHSALIKGLEHMANFSIRDE

SEQ ID NO: 27651 - protein, 489 aa, Pseudomonas aeruginosa
TTSAPFSSSSPDMTADKKAKILATLGPATRSRDDIRALVEAGANLFRLNFSHGDYADHAQRFAWVREVEAELNYPIGVLMDLQGPKLRVGRFAAGAVQLQRGQTFTLDLSDAPGDERRVNLPHPEIIHALEPGMSLLLDDGKIRLEVVNCHSDAIETRVAVGGELSDRKGVNVPEAVLQLSPLTDKDRRDLAFGLELGVDWVALSFVQRPEDIDEARGLIGDKAFLMAKIEKPSAVSAIEAIAERADAIMVARGDLGVEVPAESVPGIQKRIVQVCRQLGKPVVVATQMLESMRFSPAPTRAEVTDVATAVGAGADAVMLSAETASGQYPREAVEMMAKIVRQVEAEPDYHVQLEVNRPQPDATVSDAISCAIRRVSRILPVAVLVNYTESGNSTLRAARERPKAPILSLTPNLRTARRLTVAWGVYSVVNEQLAHVDEICSTALDIALAQRMARRGDTVVVTAGVPFGCPGSTNMLRIETVAPPLGDL

SEQ ID NO: 27652 - protein, 327 aa, Pseudomonas aeruginosa
PPPPLAQAWHLRACRAALAALTAMPLQSLLNASRILLRGISQVFLQGDPRLGLACLLAIAVGAPPLLAGALLGGALGPLLARLLHCADSDIEAGLYGYNAVLIGMLLAFRFAWSPGLVSLVALGCLASVALQRLFLHGLRRRRWLPPYTLGFVLNGWWLVPLGAWLGLAPATHGGCFSCAWSGTAELAALAQGIGEIIFLGEPLAGLLVWLGLLLVSRPSAAWALAGAAASLPLAWLLGYDWASALAGFYGLNAALAGLALALRYRSAWPPLLGMGLAVTLQPLFGLLGLPALTAPFILACLLCIGGERLYLRLAGSLGARLGRRRS

SEQ ID NO: 27653 - protein, 272 aa, Pseudomonas aeruginosa
CSPATRSSRCPPGSSPPNSPPRCARTRPTCCSGIARCAARRPTKCRRHSAAAAATRCSLARKAAMGSLDRQRWDALWQRLGGNPPADAFDALLAAYGGADRHYHSDRHILACLEHFDRWRQLALRPDLVELGWWTHDLVYDTQRQDNEAASAASTEHWLDHAGLAALRPALRELIMATCHQAPPGDADAALVVDIDLAILPAPAPVYARYEADVRAEYAWVPEPLFRAGRGKLLRQLLEQPALYHCEPLRQRWEAAARANLRGALERLEQPA

SEQ ID NO: 27654 - protein, 592 aa, Pseudomonas aeruginosa
AARENFFAPLNPSFAALASQAAGRDRTHGFLAPPSAQGRDIVNRLAASPLLFAGLFASAPLLAAPQAVDSRISAVTVYADRAVVTRTARLQLPKGQHEIALEQLPFQLDDTSLRASLGASAAATLLDVSSAAQRVERPDDNRVQQLDQQLREIDRQLREIHDRGSVLEAQKKFLADIQSGSTQPGKDRPMPGIDELKSLLQLTEGNLERLLAEQRQLDDRAAELEQRKQQLQEQRGTLNGDGKRFKRAVLRVALEQPAQVEVKLDYTLRDASWQPTYDARLRDGANTIELTYQGLVRQSSGEDWTDVDLTLSTARPALGGNVPRLNPWIVDIDAPNAYYGAEMAMQDVPAPMPQAAPIARTSAKMAMPAPAPKLAEARLATAEVSSGAASASFHIPVPATLNSDGSAQKVTIARLEMPAKLRYLAAPALRETAYLEAETRNDSDYPLLPGTLNTFLGNSFVASGHLRGVMPGESFELALGADEGIGIERKLVKRYTDSSGLIGNRTRVNYEFRIDVRNNHKNAERVQFEDQLPVSRNEQIQVTLLEPKAQEVKREDDGKLKWDWTLQPGEKRSATLKFSVEYPKDLAVSGLD

SEQ ID NO: 27655 - protein, 140 aa, Pseudomonas aeruginosa
STCGRTKARPSPPTTTCARATRRSSPSSPTASRKSTSSRWRRPLATGAACRRPTSSTAAYSTRSTAPTDPSPLDEKAGSARASGFFIRLAVQPLPPQRNSCSTSDQRLTRCPPASKNSISRRMPALSRQPGRSRTISSSR

SEQ ID NO: 27656 - protein, 477 aa, Pseudomonas aeruginosa
YQKKQAETMTEPLATKTAIFDVAVIGAGVVGCAMARRFALEGARVVLLEKSTDILSGASKGNSAILHTGFDAPPGSIELACMQEGYREYRDIHARLNLPLLETGALVAAWSDEDLARLPAIVEQAHGNGVDDVRQVGRDEVLALEPQLAGNVLGAVRVPGEHLVDPWSAPLAYLQQALAHGAEACFDVEVLDGAFDGGEWLLHTRRGDLRARQVINCAGLFGDQLEQRLLGAASFAIHPRKGQFVVFDKAAAALLRHILLPVPNERTKGVVFTRTVFGNLFAGPTAEEQDDREQARVDSDTLQRLIDAAVERIPGLRGMPVTATYAGLRPASEKKEYRIRQVDGRNWISVGGIRSTGLTAALGIARHVYRLYQGERFHEAVREPLWPQVPNLAEHLPRDWQRPGYDEIVCHCEMVTRREILAALEGPLPAGDFGGLKRRTRACMGRCQGFYCNARVAELSAGRLAQPFATGSCHEHH

SEQ ID NO: 27657 - protein, 649 aa, Pseudomonas aeruginosa
RHPPQRTLRSRIEPGPPQPPGTGPGQRRPAHRSVRPLLRPRLFRRRQPAPADRDRRLVVPRGTKDRRPAGRRPAGRTAECRTWHSHRLQWSAQAVRAAAAAGRPDTRPGASAATRKRGRQRPPADPGRWSPGVGACPVLPAGAPPAGAAGRPAPAAGHPAPGSRLPHLRPLNPRREPTMRIAALDQGTTSTRVLVASQDGSADIQLALRHQQHHPQSGWVEHDPLELLANLQRCLEASGRVDAIGLANQGESCMAWDARSGEPLSPLIVWQDNRTTPHIERLRASGAEALVLERSGLPLDAYFSASKLGWIVEHLPAARRALKAGRLRLGTSDAWFLDRLCGTFATDVTTASRTALMNLAEGRWDPDLCALFGVPIECLPEIRDTVGHFGVIGNTPLTASVVDQQASLYGHGCRQPGDAKITFGTGAFALTLSGERIIRSPETGLLATIAWQIDGKPVYAMDGGVYDASAAVEWAGRLGLFSDFSELAGFDRPPAIERGLAFVPALSGLACPHWDRSAGAMWLGMDAGTRREDLCQALLEGVVLRSAEVIQAMDGYLKVTDRLSIDGGLARSPYFAQFLADSLQRRIVTQRFDELTAFGCAALAARGLGYELAEPRNTRTEFQPRVDAGTARRWQVRFSEAVARTRGWR

SEQ ID NO: 27658 - protein, 298 aa, Pseudomonas aeruginosa
RGGWKSRKPEPAKTHRGANTDAHPVPGHRHARQPGPRHRTDRRQPFLEAIDPAAAPAPAVRQRPGDLLPRQRRAGGPGGIRRRTARRAGLDARLPERAVPARPLLPGLPGRPGQRPVPPRGDRPGPFPAERVLPQLLPRQRSGGRGAVHPTGARPGRAVAVPGHAEDVRRRGMRDARLALELGPGADAAALAATQPAPVAGCTAGRDGHADTRRPQPLRRQRAIGTGTGDRPPDPSRLLVEGHGRAPGDLAGDDQGPSAPPVRQAGHFLATGAVLAVHPVARARPGEPLGIMDWRSAG

SEQ ID NO: 27659 - protein, 529 aa, Pseudomonas aeruginosa
CAAGWRRARWTDRAAAGSAAAARPAVRWSAADAPRTRRDRPGESPDPDTSPSPPHLPNRLSLWPGRLGLVRAVDGQRLRRRLGSRQRFAASDPLAGDGVAGAGYPCHQLDLRETAELELRHHGVGIAQADLGRQVGDGQALHCQRHRRAADGAGEDEHAVVGLDLALHRVADIHLHRQGHPGGSGRGRRRRSLPGLGHALAGALDAALDRRACRVLVRQHRHQALPEADGVGVALLFEGGDAEQAKGGHFGRVALQRLVGQGLDLRGHFLATGEIQCLRPLAEHFRLPPAEFGGAFEGPRCIGAAFLGHVGATEEVPALGGIRLSLYRALQARSHLFHGVRRLGEFAGQLDLVAGAPMQVQAERDQRHQQRRDQRDRPAQARATLFAAALGVGEQFAGSLGAAILQLLGGQRAGGLLAGQLGDPLLIKRDVQGGTVFLGLGATATQQRNQQECQGRQQQQAGSEPEIDHLSFFNRLARRACSSADRVVCTLAAVRRRRRTITPITSTPNSSKAPGPNQSSQVRSLTGGL

SEQ ID NO: 27660 - protein, 531 aa, Pseudomonas aeruginosa
DRLLPMPAEIGASPPLPPVSAPRPLPPAQSQGNAQADAEMTLKLVQTLAGLLGEGESGKAEVLAVKEGLANNFQVLLKLTLANSGQSLVEVQSNRPLVPGNLLNVSATSNTSVVATLLDSMAGAGPLSSLDLEQLPPGTLLQGKVLSSTALPADKAQQVVYRVLLNLLNTPLAGSKLSLDSPQALPVGSLLTALVKNSQQIDFLPLSGRLDQLALGQQLAGQSARQASLEGLFAALQGLNGRNDLPDSLRQAVERLFAGLPEAQKMGDSKLLGQALQQSGLFLEARLMQGATDHLGQDLKANLLRLFAQLSPLPPTGAQAPGMFAGNTANLAQALPAFVRNALGNLGQSANKTQALNFPLPSKVLQLFDEDMELESLLRLAAAAISRLQTHQLSSLAQTSTLPDGTQLATWQMEVPMRHQHSVVPLQVKFQEEQRKTGEEARESLWRVELAFDLEPLGPLHAQATLLRGSLSSQLWAERDATARLVEHELGHLRQRLRDAGLTVGEITCQRGRPPQGPRATIEQRWVDETA

SEQ ID NO: 27661 - protein, 208 aa, Pseudomonas aeruginosa
NRPEPPGGGDRSAQPAFGRQPGAPGLPPGGPARTTLDRFRRSLRLGALRIARRALAQPLKEEPPAGPAIRRFPQNLSFAQRSLDGTPHACGGIPQMKKHTLFAVAALGLLFAGSTLLPGELSPVGSAYAKGGNGGGNGGGHSGGKGGSHGGNLGGHSSKGHGSATSGIASSRDSRGLSQASAISATTPGDHNSKGLSNAIGSSTKNDR

SEQ ID NO: 27662 - protein, 439 aa, Pseudomonas aeruginosa
TADNRHDYPGFPDNTDTRSRLARDPGVLLTLLLAQALASAMTGERIAGTVGADGAGFDLRRPDAGGLEQLATEGHQVQPGALLRLPWLGRSEPGWPLGERTTLAPGRHRALPEAAVADLQRLDEPGTHLVAAGFDPGTDGDPDVRAGDAARIEARHRRADDTGDEPLPAAVQGGHHPTVATAHENRQAVRGDHRDRQRPFAENTVGGMPSRFRQRARVDDLGAMHLPAMEYPFGECLAGLLEAMLDAFDRLEDVGLDGHAVSPWKVGKRPYLIFPEAASGDAAQEVGAAAITLDQRSQGDLAQRPVGHRADAQAMASAPLEQQTLLAAIEFAHQQEAPDAAAASQHRQRALAALVQAESVVEAIVVRVTLVQGAPQLPSVQAQAQVEVAAAVEQRSVPEQTAGVGAQHHGAQGYCRHPCGLLETCGLTRTDSRKRQPRN

SEQ ID NO: 27663 - protein, 252 aa, Pseudomonas aeruginosa
PISPLPCVQPGCDAQRALPERRWKMEPVLFYGVPHGCSFGSIVALEWLGRPYRLCRIEMPLETGERTYVRLNPARQTPTLLLEDGRALSESLAILQHLAARDLCRKLGYPQGSAEFDELNFALALLHTECHSAWGALFYLEDADATTTARALTRAARAYGRIDKLLGDRKWLAGEGPSVADAYLAGTARWGRELGYFDLQHDFPRLHRHLEKLEQDPAVRFAHAIEDRLPAQSCGEFRGEVTLVEVASRLLA

SEQ ID NO: 27664 - protein, 518 aa, Pseudomonas aeruginosa
NASDAAQLRPFFLGHHLVQLDQDQQLAVLVADTLDELGRLFVADVRRGLDFRLLQVDHLGDAVDQDADHLLVRLDNDDPRVVADRRRVQAEALAGVDHRDHVTAQVDDAQHVARRARHRGDLGVAQHLLDLHHIDAVALIVQAKGDPLQDRIFGALRGGFAHSPNLSKTAASGGSCLSMVAVQALDGAAGDQFGERRHIQQRTHVFDDRAGQPGPLATLAAPFHLGRVEADRAAHLVHRQPPLVALDRDHVLEAVAIVVAVAFGHHPACGVQHLQVARLRRQDAEEPVGLAEQRGQFLVLQRIDRAEAHQRHRQGQPGDVEQQALEGLRRPGRTTVVEQRQVEQRRLADARRGARHAQLDDFVGPWLDRQLAQRRRFVEQGRRRRRNQARIADLLLEHRGLELVEPVVDRQRFQRRGRCRHFGDRQRDRLQRRGRRRWRRLDERFQVLESGLLEQRIQVGLQGQLRTGGGGGAHVGIPRQGSTTVIGRTPVRLECACRRGDRRAIRPPGWPAAAPADA

SEQ ID NO: 27665 - protein, 527 aa, Pseudomonas aeruginosa
GSGSASAMLSRPSRPSLRAVMLQETIRSIPPERSSRGGKNTQPSMPRPRLSTFTGVCNSAAARVPPITISAAGPLSRAPAWPPSRKFPPTMATNARMIPTRLSTSISASSRLGEGARRSSRGWPSKAVSSFLHARLLARLDQVPADVVEPVHRVRQVGLDHGHRHPVDHATGLVLRPHLAAALLEQARTLASVGAHAGEDHRQDLVVVGLGRRAEGHVDAGLVVQAFVAGEDAHRAAAVDHHLLAARRQQRQAGTQDVAVLCFLDADPAQLVEALGESLGEGRRHVLDQYQRRREVGRQLGQHPLQGNRSTGGGTDRDQPVGLALRRRRGRRRGRRRAGTGTRARAEAGGRRRRMAGRGGRRQRRQADRATIATGDGQDLLAEQLADLVRVARDVLEILRQVVDRSGVQRIQGHPRALVGQRGEHQDRGRATLHDVAYRGDAVHQRHLVIHGDHIGSQGQRLLDGLAAIGGGADHLDLSIGGENLRDTAAEEPRIVHHQDFDCHSYSSEGDAPAPPETHTRRQMRRA

SEQ ID NO: 27666 - protein, 618 aa, Pseudomonas aeruginosa
HSRSVRRSAASRSSRPFSTALLRSTSASMPLPSSVIIRRMWSPSCSADSTTWPTRGLPAASRSSGLSMPWSTALRTRCTSGSARASTRFLSRSVSSPTSSRLISFFMFRARSRTRRGKRPKTFLIGCMRVFITDICRSPVTTSRLATALAMASSPLFRPRRTRRLRTSTSSPTMFMISSRRAVSTRTVVSASLAAGLSGAAGRAAAALAGATGFAAGLFAAMFLATAAAAATASEAPLNLPLPCSSSSSDSNSSSLISSPPAAAGALPCSAGAAAGAAAAGAAGVPAASGTSPNLPLPCSSSSSASNSSSLISSPAAAAAGSTASAGTCAGSAETAGGTNLPLPCNWSSNASNSASLISSPAGAAGASATAEAGASSPCRASSNCSNSSSVISLEALCAGASGGAAGSAGGTAAGGACTGSAGSAPSGSARRARAASSSGVAGVGSDCSRTWSNIALTVSSACSTTSISSELTRRSPLRRISKTFSAMWQHSTSAFSWRKPAPPLTVWNPRKMALSRSISSGRLSSSTSCSDNCSRISPASTRKSWRISSSASKLIRLLPETCYSKGSAGPLSCRKYRPGFPDRLQPARRDHRHDEGCASSPRMPAFNAYLTAAMPQS

SEQ ID NO: 27667 - protein, 690 aa, Pseudomonas aeruginosa
CDVEETVSDLGQFGEQVASFLRAVGHVGQDPEAGHAVVAVEQFDQGVGIGDRGRLVADDQQHLLRGADETDHRIADPGGSVDDQDIEVVADIAERLDQPRMLHRREVHHALRAGGRGNDAHATGTEEEDIAQFAASLDHVGQGALGRESQQDVDVGQAEVGIQQHDATAEIGQSQCQVHRHIGLADAALAASYCDHLYGMHATHLLHTLCCRLPGTPLPALSGIGGNDAPSLPARRKPPSLPSPAPRAVLPTSSAGTPRRLLVEPGEHLGHGVLAGLFRCLQAHRPADQLVTARHLQVVRNPRPIRQIGYRETLGDSQRHRFTEAARLVQLSQDATRQPAVPIGLVGRLEHLALAGGGHHQVILHVQARRRQCLELHAQCRVAGRQAGGIDQHHALARQRRQGLDQRLAGIDQGHRYVEDPTEGLDLLLGADPVAVHAHQRQALGAVLEDVARGHLRQGGGLAGTCRADQGQYAARIERVLLGGLHGTRQVRQQHAPGLARIAHRGDPLQQRLAQLRRQAHALQAPPEIGLLRTLVLQLAPGDGAQLYLDQLAQAVQFETHCLEGLAARLGLGLRRRHGLGQGRTRRLLLGEQLTVLALVFRRTRRQLGARLGDPRLGLAQLHFQRRVGLARRRRGLVIQRRGQLDAAGDPAVAENRGVRTQFVADQFHGLAHIGGEEAFDLHCPNPSVQ

SEQ ID NO: 27668 - protein, 140 aa, Pseudomonas aeruginosa
LPPITTSPKAWITLPAAPWPSWPWSSTTRVEATFSARRNRVATSRMVGNTAKSSGRRAYTQTSRTTMDRAMLKVNSTSSRNGGIGRVIIASMASSRTGTPRLPRPSPARLLRTLLISCVRSTLDSPALRMAPVGGRRTNF

SEQ ID NO: 27669 - protein, 415 aa, Pseudomonas aeruginosa
CRASRGWRCPACMCWPTRKSRTTSKSPSSRRWDRTERGLRRLQGRHTGQPEVAGKTTELRGSGNASQTLLRRRYAPGHETGPRRTGSGRRDSRQPPGRRRHRADRGAGLPGPAGAEQAQPGAGSGAAQDPGADRRGARRVDGASGGKPAQGPSIVRRGEAGASVPGRVHDGGAGQAPGGRPDPRGNAFRTERPARADRGTTGLHRLGPVAAPASAAGQSLAAPAAHGLAGGAEQAVAGAGRRGGRYAPGLAHAVGAPVACRADPRAGPARCGRRTGPGRPGRCRQDHHPGEDGRALRPQVRRPEPGAGEHGQLPDRRPGADQDPRSDPQRTGDPGRSRPVADPGPGAAGAQAHGADRYRRPAGQRPGIAHAARGTGVAEPEREELPGDGHHQPEPGAQVGLPDLSALRAGGLHPD

SEQ ID NO: 27670 - protein, 275 aa, Pseudomonas aeruginosa
LAAAGQPARAPGVLRRTTGPTPRDRFGRMTAASGVRMYSKAQAQNSQEQLIQRYAPLVKRIAYHLLGRLPASVQVEDLMQAGMIGLLEAAKKYDAGKGASFETYAGIRIRGAMLDEVRKGDWAPRSVHRNTRMVTDAIRAIEARTGRDAKDHEVAAELQLSLEDYYGILSDTQGSRLYSFDDLLQDGEHGLPEDTSLSHNEPIHGLLDERFQAALADAIAKLPERERLVLALYYDEELNLKEIGEVLGVSESRVSQLHSQCAARLRARLADWRSA

SEQ ID NO: 27671 - protein, 282 aa, Pseudomonas aeruginosa
RKRSRRFSSGSTAEAGQEGVMVLGNDSTGDEFESTLKKHARELVDCLERGHFQQAVQLIQELSQARDRGLYQEVGKLTRELHNAIVDFQIDPHSPHAQEMSQIADATDRLSYVVEMTEKAANRTMDLVEQSAPLVNQLGDDSRELHQEWQRFMRREIDADGFRELAKRIEQFLVRSGENAGQLSSQLNDILLAQDYQDLTGQVIKRVTKLVTEVESNLVKLVWMAGQVDRYAGIEHDHVSMRHQAALERSAKGEGPQVAAEKREDVVSGQDDVDDLLSSLGF

SEQ ID NO: 27672 - protein, 242 aa, Pseudomonas aeruginosa
WMWCCRRWIRSTRCSTRCASSPNRPRRRPSCWRPLPAWPSPRAPSPRNLCKRRRRPFRQPSLRRRRKRPRRVPPAISPTTSSSSCWMLCRATKRRPPPLQKRPRLPLATRSATPSSRRCSTSCTARASSSRRRSRPSLRKSPPRRSSRPRLPLVTISATTSSRRCSTNCTARASSAMSRKLPAHPPHRLPRLQRLRRRSRARRRPPRAAMRSATTSSSRCSTNCTARASSTAPPRPWRPPRR

SEQ ID NO: 27673 - protein, 266 aa, Pseudomonas aeruginosa
QSSLDQPAAAAFGHLVQPCAGVVLQPRRERACQCRRVAGPGVDLGGAEAQGLPAGRDRYLHRWTGCLAAGADPVAGQLPGAAGTDPAHAGGLHQGFRRAPRQAVPDQRQGSRGRRHPASRPGAAGAGRQADDGRRPRHGAHPPRRRTPELQALRRRDLRLGGQGLQRQGPGGGPHRHGRRRTRGCAPAQAGRQPGVGAGRGQLRDLRDADGRGQGQPGGRGVRARRHRPAPGRGVPVSVRAGMRRLPSMATHVTTCARLRRAERTR

SEQ ID NO: 27674 - protein, 270 aa, Pseudomonas aeruginosa
THARKSRAMKVWAVANQKGGVGKTTSSIALAGLLADAGKRVVVVDLDPHGSMTSYFGYDPDTLEHSAFDLFLHQGNVPEGLPASLLRSTSNERISLLPSSTALATLERQSPGKSGLGLVVSKSLAQLWQDFDHAIIDSPPLLGVLMVNALAASQHLVIPVQTEFLAVKGLERMVNTLAMINRSRKQALPYTIVPTLFDRRTQASLSTLRILNENYPDNLWQAFIPIDTRLRDASRAGVTPSQHDGKSRGVIAYRALLKHLLAQQPATRVA

SEQ ID NO: 27675 - protein, 264 aa, Pseudomonas aeruginosa
TPVAEYPHERRHRHPFATGLAVLPGCVAPGGHFRGPGTSRRDAASACARAVEACRAGGRRSGDTGPGAGNAAGRPRVRRVRGRGARGAGPRCAPGSAGAGGPARRTDDVARAAGRATAPRSHRVARAERPGERRRAAAARPAAARRRSSGLGGGALRVPAVRRRRADPGGAAGVPRLDLSAGEPGTDPVVRPARLVPRHPAVAGGQPEGVGHRTLGDARTLPRRLSRRPQVRDLGPGLRVGAGGAPGEPLDPPRPGRGEMAQPA

SEQ ID NO: 27676 - protein, 288 aa, Pseudomonas aeruginosa
RAGQAPGGGWTDAASLYRRPRGAGHTHLGGARTPWRLPPGGRFQAPAADVQRGGNPGRVPRPAGGAQSRPGRKRAGPGKCAGQAEQGDARCAAAAPRGAPRDRQPGPGPRPGGNQCGGAGDPRRSRPGPCAGRVPLSRPAGRRNPPPTRSLRPGLSQRLLVRQRFLPPAPGVALVPSRSPGRAAHAGGALRATGGFRYPPPPAGELRPDAARLPGGNSDAGGEGAGGRGARRAPRSARRGRWRYAVARQHRRPGLVRPAPVRPAVRLRGQAAAGVARAVEAPGRACPA

SEQ ID NO: 27677 - protein, 394 aa, Pseudomonas aeruginosa
GKVVFQPSMARQHDRPGRHPQGDRRHRAWLPASRPGTLRTDIPLPAGAWRRDRRRALVVGIGTACRRRCFQRRAAGGRGGHRGLPADSHEQSRRSGGGRPARRLAGARRRYRRRGGGALQCARRRQRGHPGRHRSRDQSLLLRGECRVHRGVAGRPRPPLGGRGAALEPASSAPRAATPVRSARAKAGGAGRLAGPGGLLSPVVPGRRRRAGADRSQRRLHLLFRRCVRQSSPTPAPGRGEASAVRLDRAQAVTAYRYCPEILDSHDGCLLFIRQYPASRLSLSMRGCRHAHSRRVPACLTSPKPPSSPAPPAASVAPLPGGWPPTVSRSRSTMPATRPWPTRSWPKSSPPAARPSPYRATWPARRTWTSCSKPPGAPSAASTWWSTAPARCPT

SEQ ID NO: 27678 - protein, 558 aa, Pseudomonas aeruginosa
SPGRCPATVRTSRPSPGSRGWCTCWPTSCAARTSGSTRWRPARWPPSCSSTARAPNRSTRSPGWRRWSVSANRTRSPRRCPSSPGRTGPGSIPRCCGSTAVSPEPCGRGTKKPARRPAFSWSPLAVSGRSWSKSRWRCSSPCCCDRRGWWRRSRWPATARGCRGSWRCRRWLNHGLCWSGRRGCRHGCRPCRRYGRHRCRRHFRPWHRRSRQEKARQAAGCCPRTAGREQLRRTGYVFSFEGCLRRHVVCRLKTVARTTGSVESDGWRALPVVPPSAVAPVLGEQSVERRVGDFSGNDPALCEQALLAEAQALQAGGRRPVARIDLRLQAVQVDFIESERQQPAQRLAHVTPALGCTCQAVAEFGAARAFLEMEEDTTAEQLAVFSTLDGQVQVFAVDERLAVPQGSPRRAWRKGRPRRCVPLTHDFRVGHHGKQRAGVFLSESGYPAGAGCPTGGERRSSSGAPLPRSEAAQLSAQRRGPGADVRADVSPCGLAQSPGPPSSSIWLPSAASGANPSGHLPFRCQAKAMISAMVRYSASGMASPSSRRASRRTSSAFS

SEQ ID NO: 27679 - protein, 300 aa, Pseudomonas aeruginosa
SRQRSGRRRAGVGAGGRVHARPAARSRLARPKAGWTGCRVAGSPGRAAVPAAPGRRPVRRARGFRGPLRRSCAVLPGTSPATVPPSADGAWAPPSARSPVGCHPAGCWSAPGSTTDGSAGGRSPRRQGAAVTPVPCPRRTVGEPCSAGESSVPGSCWRSVPGCPGRCGQRPAAPGPGSPCCRRTCPAPGRRSAAAATAGRTGATGWPSGPGRDDRWRPASGAPRGTGRSAAGPGRAAWNRPSSAPPAGRRRGAPRPGAGCPAGRCGRSAPAGRRTGLPGKPGGRSARPVAGPAQAGRGVR

SEQ ID NO: 27680 - protein, 289 aa, Pseudomonas aeruginosa
TLHRPRQTGGGATGNAPGRALPARRDGGADHPPQPAADARRLPRAGPRCAQGGQRRDGRAGAGRPGMSNVFSLLLAREARLLFRRPAELANPLVFFAIVIALFPLAVGPESQLLQTLSPGLVWVAALLAVLLSLEGLFRSDFEDGSLEQWVLSPHPLALLVLAKVLAHWLFSGLALVLMSPLFALMLGLPARCIPVLLLSLLLGTPVLSLLGAVGAALTVGLKRGGLLLALLILPLYIPVLILGSGALQASLQGLPSSGHLLWLASLTALALTLTPFAIAAGLKISVGE

SEQ ID NO: 27681 - protein, 227 aa, Pseudomonas aeruginosa
RPWWRRHDELRIVRRLPRHGPSRSLRLVGLRHQPAGAGDQCRRAAAGPAPLPARRGASSAPGGPAVNPVRKKRLIIVLAIVAGVGAAVGLALSALQQNINLFYTPTQIANGEAPTDTRIRAGGLVEKGSLQRSEDSLNVRFVVTDGAKEVTIAYHGILPDLFREGQGIVALGKLGGDGVLVADEVLAKHDENYMPPEVTKALKDSGQLKHYENGKAAGETSYNQEGK

SEQ ID NO: 27682 - protein, 657 aa, Pseudomonas aeruginosa
MIPELGHLALILALCLALVQSSLPLVGAWRGDRQWMSLARPAAWGQFAFLAFAFGCLTWAFLRDDFSVAYVAGNSNSALPWYYKFSAVWGAHEGSLLLWALILGGWTFAVSIFSRQLPEVMLARVLAVMGMISTGFLLFLIITSNPFSRLLPQTRMDGDDFNLLLQDVGLIVHPPMLYMGYVGFSVAFAFAIAAVLGGRLDAAWARWSRPWTMVAWAFLGIGIVLGSWWAYYELGWGGWWFWDPVENASFMPWLVGTALIHSLAVTEKRGVFKSWTVLLAIAAFSLSLLGTFLVRSGVLTSVHAFASDPERGVFILAFLLLVVGGSLTLFALRAPVVKSQVGFALWSRETLLLLNNLVLVVAASMILLGTLYPLLLDALSGAKLSVGPPYFNAMFLPLMAALMAALAVGVLVRWKDTPSRWLLGMLTPVLVASAVLAAAGSMYFGDFNWAVLAVFLLSAWVVLAGFRDFLDKTRHKGVLAGARSLTRSYWGMQLAHLGIAVCAIGIVLSSQYSAQRDLRMSPGDTVELGGYHFLFDGAKHHEGPNYTSDKGSIHVSRDGKEIATLHPEKRLYTVQSSMMTEAGIDAGFTRDLYVALGEPLDNGAWAVRVHVKPFVRWIWFGGLLMGLGGALAALDRRYRVKVKTRVREALGLPGQGA

SEQ ID NO: 27683 - protein, 181 aa, Pseudomonas aeruginosa
VLKRAILLLPLGIFLIVAVFLFRGLWLDPSELPSALIGKPFPAFDLPSVQDPARRLTEADLKGKPALVNVWGTWCPSCRVEHPELTRLAEQGVVIYGINYKDDNAAAIKWLNELHNPYLLSISDADGTLGLDLGVYGAPETYLIDKQGIIRHKIVGVVDQKVWREQLAPLYQQLLDEPEAR

SEQ ID NO: 27684 - protein, 468 aa, Pseudomonas aeruginosa
LAPGPGGPAGRGAAGAVGRARPVPALGRQRQGRAGPRIRPGAALHGRDDCAPGARGTGSAGFRPGLVLPRSHLHDPGTRRRCSAGLRTRRRTQRAAAGSARPVGAGTVFLRWQENDRADQGPGRRGAEGRPGRSDHPWPARHRRLRRAALRRRHRLLGAPGVGVAERGPGTLGDPGRHPARPRAHDRGRADSAGAGRARCRRGDPDGEGGYQRRGEGPGQGRRQRVRLRPRRRRPADAVGSEAPDRRRPAGRGQPERCRRHDAAAQAQRFPAGRAGGTGIPRRQRHLRRVDRTRQTVVYCPVVGASADHRRPGPAPGGPAITTIGWGGAAVKAKYLGLAILLGGLGGCVVHPPQTSEPPASLPPQSQPQPGPSSAPGATPPRITPQPQTPAQPSRSRPQFAPPPGGKGVWDGSLGVYVIRGERDLYYRQRTYYRWDGGWFWSTSPQGPWTETDARGIPPGLSRRYANP

SEQ ID NO: 27685 - protein, 387 aa, Pseudomonas aeruginosa
FSTAPTASSVRRSRSFETGVRMRARQLGITLGLGTPGPFNAITDVPGVRVGHSTLNQRIDGRQVRTGVTLVQPRAGAARLQPCFAGCHVLNGNGDATGLEWIREAGLLTTPIAITNTHSVGAVRDALIAEERAELGDSGLYWCMPVVMETFDGLLNDIWGQHVGARQVGEALACAESGPVREGSVGGGTGMICHEFKGGIGSASRRLPAEQGGWTVGALVQANHGQRRELRVDGYPVGRRLGDIPSPFSEEGTPGMGSIVVILATDAPLLPHQCQRLAQRASIGIARTGGGTEDSSGDVFLAFATGNQDLPPADYARKDLPQSTPLRMLNNDHISPLFAAAAEAVEEAIVNVLLAGEDMRTEDGRLVPALKGETLLAALRETGWPGR

SEQ ID NO: 27686 - protein, 463 aa, Pseudomonas aeruginosa
VKRTFKSTRKPNCGTRNASVRFGGATGVAGLPTRQPEERIPLREPAEGRTTQMAEFGNYVIYLIMLGAVLGALASILRPESGLGREFVNGIHAIGPVFLAQAGIMVAIPYLSKAISHALGPFFQTLGSDVSIAALSIIAVDMGGYQLADALTANRDMWITAMLVGYTSGATIVYLIPVGLTMLERKDHKYLALGAMAGLISIPFAVLAALLLITLNHIPVRELVSTGSPALHYLSLDFLDMLRLLAPLFVFCFLLAAGLKYRATAMVTGFLVFGKVMDAFIKMALALSIVQHFTGVFTKVFGGWGFDPMFADEKELFRAIEIAGYIGIMLAGTFPICYLFQRYCKRPMAVLGRYLGLSQPGATAFVMVLANIIATYHLFKYMNARDKVLCVALGVCAQATIGDHLAFTANFQPTLILPILLGKLFGGLLAVFIAIRISVPAAERYARQEQEHDEAEKSALHAA

SEQ ID NO: 27687 - protein, 67 aa, Pseudomonas aeruginosa
TTSKPPRPNSRAIISASFSKVTSTSPIWFCMKVVVAARPPVSSTGTCLNSLPTNSLALFSSPPFFST

SEQ ID NO: 27688 - protein, 170 aa, Pseudomonas aeruginosa
SVRAGPAAARPARHGRASARCWRRWRPRCPGAGCRRPGRGSTTPAPPGPAAAPVGASGRSAPGRRGCGDRCGSAGRPRHRPPAARRRHPPAGCRRVAARGRPSAAGQDFPWLPSSRGNNGLPQRQQNAACTSWVALRHTGQSRCNRLAGSWRIAVASSAVKIPVGTAMIE

SEQ ID NO: 27689 - protein, 402 aa, Pseudomonas aeruginosa
ECLLVLSVEWLRAGRRERLVRGCGSDDVVRLHPAEAGFGGGGRLVLAADPALVADAVQVLEEEAVVDLAGARFVAAGVVGELHVVDRRQLVFQGAGQVAFHDLHVIDVVLQEQVGAADLVADLQGLAGVLQVEAGDVEGVDHLHDQADACGFQLVGGVAQVVDEGLLDAGAVVPLRPDPGEAVHLAVAQHPGVGDGLVDPLAELLDPIRVAGDAALALGPIAGRQVEQHLLQAVGFQAGLDRLGLDVIGEEVLDAGEAGLGGGVEAFEEIHLGEQHGQVGAETGHVLLLSFGQTFGRPFAGGGVPHAPSAPPGKAGDQSSSEMAVGASAPFSASSSNSLMALISVPMEMLVTRSRITSTTTGTWCCCISSRALARAAPISFGSNTRIALQPRPSTTATWSTP

SEQ ID NO: 27690 - protein, 197 aa, Pseudomonas aeruginosa
NQRLKKCIQNYVHIVLECCFRRAGRLLNWVQIFERARIAGGFPISSLNNSRGTTMTTISLETALGITRQALAVGRELSTAPLTIAVLDAGGHLVALQREDGASMLRPQIAIGKAWGAVALGKSSRLLAADAQQRPSFISAVNTLAHGNLVPAPGGVLIRNDKAEVVGAVGISGDTSDIDEQCAIQGVLAVGLVPDAG

SEQ ID NO: 27691 - protein, 199 aa, Pseudomonas aeruginosa
KASAWSAWISRTTTPTCRRNCCICWSARRGLSFGGTEWCGPRAEKRSRTKSGPREGRTGSVAGPPGSQECLGAGAWLPHKWLRSLRLRMLNSRFSTTAQIAVMAMPLWVIGSIQTGRRAKKSGRTTGTMPMPMLTATSNWLRRSVMLASWRIWMPLAATMPNMAMPAPPSTAGGIEATRKAALGSMLRRIRKPAAATVT

SEQ ID NO: 27692 - protein, 385 aa, Pseudomonas aeruginosa
RLRTPVICTRPMFWANEEWVKVFRKPAKNEAPASQSRPRRSSVGVISRPVILPRARNMPVDSTKMITTTRAHRQDRRQVEGRRAEVQRGDDVEPGALGQTAEVDHAHAAGDRVAQAHAHQHRDVDPETAHEAVDQEDGAEHQAGEEQEVQGAEVFRALAAAGPVDRHREQAHADRGDHRAGHQRWEETHDARHEGGDEHAEETGGDGRAEDPGDAHAGHPGHRHHAADGGEAGAHHHRHADAHRADAQRLDQGGDAGDQQVGVDQEGDFLAREAGRLADDQRHGDGATVHQQHMLEAHQQQLRQRQALVYGRVGDAAISYHGHATPQAFLLLSVAGGHRKRQVPAAGYFWPNIHPRLQGDAVGCFISPLCARFNRFFVYKVIFCS

SEQ ID NO: 27693 - protein, 60 aa, Pseudomonas aeruginosa
RSIHSFIHQKVAQWLLDCEAEWSEYFLPLPLSKQRFSTGSLIVQTFTKPSRYKLTFPPYA

SEQ ID NO: 27694 - protein, 223 aa, Pseudomonas aeruginosa
TRCSRHSSKETGHATQRCQAVPSTSLRRWRLGGCRQRPDHQGEQPGHRRDHRQRAEDGRRRDPPRHRGCRQGPAGLACADRQGARQQAAPLVRPDDREPGRPGPPDDHRAGQAAGRGQGRDRLRRLLPRMVRRRSQAHLRRHHSRPPAGQAHHRDQAADRRDRGHHAVELPLGDDHPQGGPGPGRRLHHGAQACFANPVFRAGPGRTGRARRYSEGRVQRGHR

SEQ ID NO: 27695 - protein, 268 aa, Pseudomonas aeruginosa
RPDLRLRQPPVRAGRRVRRLRRQAEGRRGQAEHRQRPGSRRDHRSADRRQGRGQGRGTHRRRGLQGRQGGFRRQAARPRRHLLRADHPGRRAEERPGVQGRDLRPAGAGVPLQGRGRGHRHVQRHRVRPGVLLLRPRPGPRVPRRRATGVRHGRHQHRPDLQRSGAVRRHQGLGPGPRRFQVRDRGLPRDQVPLPGRYLSPARNASGGAGRQARAAPSGVDVAGGGTGRTGRRGRRSRSGSEPWRACKSRGSRSSHAALGSFLPAFIL

SEQ ID NO: 27696 - protein, 548 aa, Pseudomonas aeruginosa
SCSPAAPTTTSSASSCPSPSPTRNWRRAWPSWPSASTNSLKLHRQSDTPEARASARAFLSEASRKRKPLFSARVFRETPDERFSPVTLGRLAHTNPPAFLRSFRSWRLGQVLEAHRVRPSYPCVPAGRVVPACHAWCVPLGSPGSKRNAMSAAKKAPVILIADPDPWSRDLLGQLVLGVRCDARLVLCGDGGEALAHCRRRRFALILAELNLPQVDGFELLREARLRRSVAEQPFILISDRADQASVRAAVALAPTAYLVKPFQAENLMQRLRGLLLKGDEVVACPLPERDAGENLEAFLERARDSAEGAPLLADVRAASDRCLSAEEHPLRVLEDEFGRDPQITAGLIAAANSAARHVGPACQTLGQALRRLGLGHSLNLVLGFSLQRAIQLGEPLLAERAMHFWDLSQRCADIAWELADALGADVERCYTAGLLHRLGDLALLRTLQDWCDGGGALDEARLDELLGRFGASFGSALRARWRLPLELRRLIAAAYQFGGVLSREELILSLATQAASLPEDNAEQLAESKAARMLGLDGERLAKLLQP

SEQ ID NO: 27697 - protein, 70 aa, Pseudomonas aeruginosa
TCMPTTRARPARPSSVCKRSASGRKPPTSPRASALPWPGPSNSPASARGRCRTACSTNCASTSTTRRSPN

SEQ ID NO: 27698 - protein, 264 aa, Pseudomonas aeruginosa
PWRSRPSTPGTASASAWACKRNEVDGDEGQSIDRLPAARRAADAGQRPCCGEGGNPARPGPGRDSRPSWVDADGVVQARPGLRAPCASRLGVRLRARRHRADATGRRPGGDLHGGPELVRAGERAAPAGTQSRSDEAGQVAGLGVAQGGRPDPQATGARRPLRRRSFARRSVRHERQPGHPYSRAQRSVGTAWPAPATTGRTGAGGAGLPGVPGAQGRPRAGSLAGVQPVAGSAADVRLPGRRHPAGIRRSALALPGGEPRSAG

SEQ ID NO: 27699 - protein, 215 aa, Pseudomonas aeruginosa
SCRGCRAAARRSMARPRRSGSRRLVPGQPVDRRVAARRSGRGRRSSPWGTARRCPVPDTAPRAAAGWPAPMRGRGSRPASAPLARPAPGGDPASGWPWPARATRRAPPWPSGNRAAARIPGRSSPAPGNRARARPARRCSRPCRGRRTGPAARSADSAGSSCPAARRAGAGGCRVAATRPAARARRAPPRHRGRSASRRAPPGSARRWRTAPRQP

SEQ ID NO: 27700 - protein, 295 aa, Pseudomonas aeruginosa
GRSVGSGRGGRRTCGFFLVSGWRERAMAASISRRRQAMFHPEVKHAIQSRLQFAGGAARRSRPRADDLGTDGWQRPPGQRAGAAGGRLAVLRQRPPGTAGRGRRAEPGGARAQSLLSPGRAGSGTGGGSAGQRLPGPAAAAAQPAAEPRHAVGVARGADLLRPPGRRTRGRCVRTDAGCRLDRAGGQDAAPERDRRGRAGQVGNRPVGGPPPPSAVRLRLPRLERTQAAPRRRAGGGVAGGLSAPGLVAAAGRLAGVAGVVEGPRGTARPGGAHGGLNPPRDQRLATGWKAFGLK

SEQ ID NO: 27701 - protein, 212 aa, Pseudomonas aeruginosa
SGSRRNRAKTSQARTIRARRPPALPRREALAVAAEMLALDMAPSLRGFDATLQQVDQQQQDEGHHQHQHADGGGAGVVVLVQLDHDQQRQDLGLHRHVAGDEDHRAVFADAPGEGQGETGQPGRQQRRHEDMAEHLQRPGAEAGGGFLDFLGNVGEHRLHRADHERQGHESQRQGDPQGGIGDLEAEVAGELADQAGRRIERGEGDTGDGGG

SEQ ID NO: 27702 - protein, 149 aa, Pseudomonas aeruginosa
IWSKMPPSLKNFGWAVFQPPKSESTVTRFSFGNCVANSAATFWLRGRYKFCAAMRWPSSLYRYCRYASATLRVPFFSTTLSTTATGGSARMEMEGTTISKFSPPCSFFARNASFSQASSTSPIWLLTKVMVEPRAPVSSTGTCLYSACT

SEQ ID NO: 27703 - protein, 347 aa, Pseudomonas aeruginosa
LPSRPREAPDGVPPAWLWRYNEGGPNAMGAGMLGNLNDIDLRMLRTFCAIVEAGGFTAAQARLNTSLSRLSVLVRDLEVRLGYSLCRRGNGGFQLTEEGQELYDAALGLFSDIARFREQVRGLGGRDREALHLGCVDGVIGQHCLPLPLAIRLFRQRAPEVLLKLHTRRPDELEHAVLEERLQLAVGAFHHRLSGLYYQPLFREEQNLYCGSAHPFFARADDEPTLDEICAADYVGRGYMAENHRPHDLRFNQGTDAYTMEAIATLVFSGTYIGYLPTHYAATWVAEGRMRAIRPRQLAYDSEFHCITRQGHEERPTLTLFLRSLFEAQKQLGVQAPANTNGIARQL

SEQ ID NO: 27704 - protein, 138 aa, Pseudomonas aeruginosa
LHRQPQPEHRRRQRQQRQFARQQQVLLRGWRLQGQQGPDPAVLLRQPGRLLQAALPRPDPQLADWPGRPEDRPARLRQQLRRQERQPFRPCRRLRQQRLLRQRRDQGRSRQPRLQRPLHLYRQRPQHRRRLPDPQRRQ

SEQ ID NO: 27705 - protein, 546 aa, Pseudomonas aeruginosa
LPVPEPWRWRRFYRVPDHRRADRQVPACRRAHLAGPLRLRLRHRRRAGPDLQYHLPERRQDQDRPRRPERVGTRYLPGLRDPGRHLQGPGLHLEERLLPQRPAGCRFEQQPARPGREPPDRQLHPAAAVSSGRTGKSPRPPGGRGLFSFMAPLGVPGRPGRTAPRLAIRPAGCPSGLARRRLLLGDAMDVAAAEEDLAPRDHHHLVLGEHALEDRPGLGVLGIVEARRDDAAVDDQEVHVGAGQANGGIARLAALDDIHAVALFLGRVQRAGDRHLVYHQLASLGVAAFFQHAEGGLAAQVVRVVLVVGPGQQHLAGTHVAAEVVDVAVGLVVVEAVRQPDDALHRKVVAQGPLDLRLAQVRVAVVVEQAFLGGDQRAFAVDVDRAALEDEVVGAVAGAPFDLEDLACHLVVALPGEVQAAFEAAPGVEAPVDAAYIALVVDDEGRAGVADPGIVAADFHDADVAVVEACARVLVLPGAGADGDRLEARDGLGHRGEGRLGRLAAVAPVVRAFRPDHPGLLVGFPFGGHAEAVGAWGAGRVAHRCS

SEQ ID NO: 27706 - protein, 260 aa, Pseudomonas aeruginosa
FPHPGHRPHRPALLVRRGRRHVAGRVRRLGRRAAGEEDSRSGRGKRRRLHRRADPGRRRRDRPAGHLLAEDPRDPRQVRHPVHRRRSDLRLRPYRRVVRQPVLRQRPGPDADRQGPHLRLHPHGRGGGARRDRRSAQPGRRVLPRLHLFRSPGGGRRGPGEHPHPARREDHREGEGGNGTVFAETLAGAGRPPVGGRSARGRHGRRPGAGQEQEDPRAFHRQGRRDAVPGTLFPQRFDHARGGRHYDYLAAAGDRSVADR

SEQ ID NO: 27707 - protein, 97 aa, Pseudomonas aeruginosa
PWRALWPVWRRLRTTRCCTCTTGPTTSRRTPWRSSPRKLGSRSSTTSTTATKCWKPSCWRASPGTTWWCRPTPSSPSRSRPGSTRNSTSPSCRTGRT

SEQ ID NO: 27708 - protein, 373 aa, Pseudomonas aeruginosa
KGPEQESDMQHSIGKTLLVAALATAIAGPVQAEKKSLHIYNWTDYIAPTTLKDFTKESGIDVSYDVFDSNETLEGKLVSGHSGYDIVVPSNNFLGKQIQAGAFQKLDKSKLPNWKNLDPALLKQLEVSDPGNQYAVPYLWGTNGIGYNVAKVKEVLGDQPIDSWAILFEPENMKKLAKCGVAFMDSGDEMLPAALNYLGLDPNTHDPKDYKKAEEVLTKVRPYVSYFHSSKYISDLANGNICVAFGYSGDVFQAAARAEEAGKGIDIQYVIPKEGANLWFDLMAIPADAKAADNAYAFIDYLLRPEVIAKVSDYVGYANAIPGARPLMDKSVSDSEEVYPPQAVLDKLYVSAVLPAKVLRLQTRTWTRIKTGK

SEQ ID NO: 27709 - protein, 402 aa, Pseudomonas aeruginosa
VQIPPGSVTGLNDLGVVVMAIASGAYKKALEGNQQPKEVLVKIDRVTKQFDETLAVDTVSLTINKGEIFALLGGSGSGKSTLLRMLAGFERPTEGRIFLDGQDITDLPPYERPINMMFQSYALFPHMSVAQNIAFGLKQDGLPKAEIDERVAEMLKLVHMTQYAKRKPHQLSGGQRQRVALARSLAKRPKLLLLDEPMGALDKKLRSQMQLELVEIIERVGVTCVMVTHDQEEAMTMAQRIAIMHLGCIEQIGSPMDIYETPASRLVCEFIGNVNLFDGVLVEDVQDHAVIACPQLENPIYIGHGISTRAEDKRITYALRPEKVMISAQKPDNLEHAGHNWAQGTVYDIAYLGGHSVYYIKLASGMIVQAFMANAERHVTRPTWDQSVYISWYDDSGVVLQS

SEQ ID NO: 27710 - protein, 223 aa, Pseudomonas aeruginosa
GSARNSPGPRHTGAGALPRGLTPVGWRAGFPGASRLLLPGVTIGERRATLCACQRGGASMQKVLVSRCLLGHLVRYDGGSHGPFDLLSRWHAQGRIVALCPEVAGGLPTPRPPADIPGGQGGEVLDRLNRVFTVDGEDVSEAFLLGAEAAVELVRRHDIRMAVLKARSPSCGNLENYDGRFNGNRVAGEGVTAAALKRMGVLVFNEDELDRAAVCLAGLDAGG

SEQ ID NO: 27711 - protein, 198 aa, Pseudomonas aeruginosa
PTFSLVCRYWPETLMPLSAKTLLISLITPGMLAWMCSRRCLPGCDGRATSGKLTEDTEVPLSLYLTSFSATSRPMLACASAVEPPMCGVRITRSRPRSGLANSSSLDFGSTGNTSMAAPIRCSSLIAAARWSSSTTVPRAALIRMPPFFIARISFSPIIHWVEGSSGTCSETMSDMPSSSCRLPICTALPSGSLVTVS

SEQ ID NO: 27712 - protein, 128 aa, Pseudomonas aeruginosa
PGPIETNYEALPMKLRHLPLIAAIGLFSTVTLAAGYTGPGATPTTTTVKAALEAADDTPVVLQGTIVKRIKGDIYEFRDATGSMKVEIDDEDFPPMEINDKTRVKLTGEVDRDLVGREIDVEFVEVIK

SEQ ID NO: 27713 - protein, 176 aa, Pseudomonas aeruginosa
AAVKKLARNLPPAASITSLAADSASWNTLPGNTSWLKTASTVNSRPAPTVVMTMARGMSRCGSRVSSARVETASKPRNDRHSTAAPAINGAKPGWLPSPTKGRLRSSEGMPARCLTAMATNTTAKTNWAPTITLLMPATELMPITLSTVTRPIAASTKTQAGTIGKAMLRNRPMSR

SEQ ID NO: 27714 - protein, 362 aa, Pseudomonas aeruginosa
RSRVDCGRSWLASAGVGPEAQVVDQHRQQDEGQQGERKGGAERPVVRGTELQLDQVADHQRLTAAEQFRNDVAAQGRDEYQDAAGDYPRHRQRHDHPAQRFPAVGAEVECRLHQAPVHLFQAAVDRQHHERQVGIKEADDHRVVGIEQPQPGVGQADALQAGVHQPAVAQQQDPGVDPHQQVGPERHGDQEQQQVAPAFRLQRQVQRGGEAERQAAEGGQQREPERALEDAQVVGVEHQAVVQVAFPEEIEVGLQAVLAPFHSAVVAGLLDRHGEHDAQRDHQEQHQHQHRRAAQQQAPTQLPAFGRLLRGRSAGGAHSASTRMAAAGIRTRTFAPGLCGQRAPSRFCWRTRKPGCPATFRW

SEQ ID NO: 27715 - protein, 137 aa, Pseudomonas aeruginosa
MSLGVPTCNTLPLLITAMRSDMVSASSWSWVTKMKVIPVSCCRRFSSICISLRSFRSSADSDSSSSSTLGRLASARARAMRCCWPPDNWSARRLPTSGSFTRSSMRLTVASISLRGRPCISRPKPMLSATLMCGNSA

SEQ ID NO: 27716 - protein, 137 aa, Pseudomonas aeruginosa
SPSRCTPARLDSGSPGMSKPLSGETSPSAPTSPSKLPTGRLLPSRVSQRRSCRRVSAWCWRCNWSSICRARAPPEAVEASRSALVSSSTRRVSRREKSRMRCSMRSWPRALVSTSLLSSAGSCQVEPPGIAGLSVCS

SEQ ID NO: 27717 - protein, 539 aa, Pseudomonas aeruginosa
  UNSURE (101): Identity of amino acid at the above locations are unknown.
TPGFREVRRTASDARTIRQEDPHLARLRRRGGNAPATRPPVVRTPRQPGPAQARGPAAGVFLQDPRRLQQGRAAHRGGEGPRGDRRLGRQSRPGPGPGGQXAGDQGGHRDAQDHPRDQGPGGARPRRQGGAARRRLPRGSGPRAEAGRREGLHLRPSLRRSGHHRRPGHRGHGDPPPAARPPRCDLRPGGRWRTGRRHRRLRQVPASGDQGDRRRAGRVELPAGGHGRRRAGGAGPGRAVRRRRGGGADRPAHLRHLQGPRRRSDHRQHRRDLCGDQGHLRRHPLDHRAGRRAGGGRDQEVRRARARRGADPGGDRLRRQRQLRSPAACRRTRRTGRAPRSDHRGDHSRAAGQLQGLLRGGRQAPDHRVQLSLPQRQRGAHLRRRADPPGERPARGAGGLSAREGLPGPRPDRQRTGQAAHSPHGRRPCGESQRRDGVPLRIPRAARRAVQLPHQARRALEHLDVPLPQPWRGRRPGGGRVAGAGRRAPPDPADPGGDRLSVLGRDRQPGLPAVPRLTRGGSPTRAAKLHGQVISFLGN

SEQ ID NO: 27718 - protein, 172 aa, Pseudomonas aeruginosa
ARPRPLKRAGNTDKDALMEHFLQIKILHGVATVLLFGGLLGLAFYAWRSWRTGDAARVARGFKRVRLIGWPLLGLSLLALPVSGWWLVHLAGWPLGQSWLLFGACLYLLGCIFWLVLAGRLARVQHQAGAAETAGAALGEQTLREIKVGLVMALLGAASFIAVAVLMVSKPL

SEQ ID NO: 27719 - protein, 280 aa, Pseudomonas aeruginosa
WWPRSGCWATNLEPGRPVDEPLPAAENPAYPFLDHSLRHRPGVGLLRPARLAQRAVAGDRGDLPPPGRRRLAVHRHHRGVPAAQRPGHGACRRLVAGPGLVAVEPGPLRVRRALLATGGVVADPRTRHGRGGLARGAAHRTAGVPLHERLVHPRLAGLHRLHGHLLPDGQQAGLRVPSAQPEQRQDQERQGAAPVQPGEAAGPLQQEEGQGRAQRGAEVLDDGVAGHEADHVAGAGDVGGEGVGQGGEGGGDQHHQQGDGQPGENGQPAGKQAEAHCADQ

SEQ ID NO: 27720 - protein, 166 aa, Pseudomonas aeruginosa
VETLRQQRQAEQCQDREGQRQRRQAEDRHQQPAEQHADQAAQAVEAVVQAHGAAALVVGGAVDHRREPADAEERPADPPQSAQQHPGQETAGQAVAGGAQHADDDRQEQAGLQCQVLVQAADQRIEGQADQAVDRQQHADLPERLQADLVPVDRQGDIKHRIAGQA

SEQ ID NO: 27721 - protein, 198 aa, Pseudomonas aeruginosa
  UNSURE (107),(122): Identity of amino acid at the above locations are unknown.
PTGFCRPCILPARVAKPRVAAITSFMEQCGHMRFRGCPSVIDSDGFRPNVGIILANEAGQVLWARRINQEAWQFPQGGINDRETPEEALYRELNEEVGLEAGDVRIXACTRGWLRYRLPQRXVRTHSQPLCIGQKQKWFLLRLMSDEARVRMDITSKPEFDGWRWVSYWYPLGQVVTFKREVYRRALKELAPRLLARD

SEQ ID NO: 27722 - protein, 274 aa, Pseudomonas aeruginosa
RRPGAGGEGRPAHAHRSRLWPGRNDHRHRCRADHPRIHDPCVPSARLRRRPGSGGAAPGTTDRRRGVAAAAARPAGARRGTADPGYRIPARRSRRGGAAGTSARLVLDPGGGSGARCGVGTGAALAGRGDGGAGGDGGGPGRRLRRVAQVFARCPLVLRHSCALCAGAVLGLQPLWPAGAPLRIGRAAFAGTDPADAGRCLAGAAQRTALGLPAGPARPAADPGPGVPAVAGGRPAEQHRGADHPARRLPAAAHRLQFQRRRLGGRASTRRRLR

SEQ ID NO: 27723 - protein, 265 aa, Pseudomonas aeruginosa
RPGGTTAVAAAVDCGGDHGDAGLQFRGHGPAGQPADVRLAQGAGDFRGDPDRHGRRAGHAACFLHRPRRPGRRCRLLDLAPAEQGQAGRRAGGAAPAGAAAGAARPGGQGTGLGRRHPGGHGRPGSRLPADPAGRPQPGRATAGADQGRTQEAVPGAGLPDALGAHPRQPRPAAQRLPSDPDGGQRGRSGDLSRSRAGDQPRPGIRQPQRHRRQGPGLRPGGGMDRARPARPGAVAGLHRGGCEHRGRHSPESGAAQARPRAAGP

SEQ ID NO: 27724 - protein, 433 aa, Pseudomonas aeruginosa
GVRAMQVKRFFAADMRQAMKLVRDELGPDAAILGNRRVAGGIELTAALDYQAPPAPSKPNPALEVELRKTQARIAEARAELTARPAENQRKDRQLFAEEKPARPSLAESMTAAQAKPQAGGQTLEAMRFELNGLRELIEVQLGSIAWGQLQHQRPQQANLWRRLQRMGLPAELSKPLLERVAAVGDTRQAWRMLLAHLSRAVQTPEQDPLDAGGVLALVGPAGAGKTTTLAKMAARYVLKYGAQSLALVSMDSYRIGAQEQIKTLGRILNVPVTLVDPGQSLIQALAPLARKRMVLIDTAGLPASDPALRMQLEALASPSLNVKNYLVMATTSQSQVLKSAYQTYRHCGLAGCILTKLDEAGSLGESMALAIAQRLPVAYLADGPRIPDDLQVARSHQLVSRAVSLQAPEEPSEDAMAEMFAGLYQQPARRAG

SEQ ID NO: 27725 - protein, 315 aa, Pseudomonas aeruginosa
RKRRWLPPGRERWRIVPANTGERWKGRSGKTTTQGMKQMGSMHPVQVIAVTGGKGGVGKTNVSVNLALALADLGRRVMLLDADLGLANVDVLLGLTPKRTLADVIEGRCELRDVLLLGPGGVRIVPAASGTQSMVHLSPMQHAGLIQAFSDISDNLDVLVVDTAAGIGDSVVSFVRAAQEVLLVVCDEPTSITDAYALIKLLNRDHGMTRFRVLANMAHSPQEGRNLFAKLTKVTDRFLDVALQYVGVIPYDESVRKAVQKQRAVYEAFPRSKASLAFKAVAQKVDSWPLPANPRGHLEFFVERLVQHPATGSAV

SEQ ID NO: 27726 - protein, 125 aa, Pseudomonas aeruginosa
ASKITTASSATRRAAACTASTTCCRTANMDCRKTPASVTTNRSTACSTNVSRRPWRMPSPSCRSASAWCWRCITTRNSTSRRSARYWASANRGSASCTASAPRVCARAWPIGGRPEPASTAACNR

SEQ ID NO: 27727 - protein, 170 aa, Pseudomonas aeruginosa
RKRMCGASPGARSGLYGGLLGQEHENSHRGRLFHDETHHQEPLAGLGLHQYRRGRRRHHGAADAAQRQFRLSRHRLEHAGHDRHRSAARGSRRRAPQAPAGADGHRRGQTRPDHRSCPGRGQRLCGQTLHRSGPEGKDREDFRAGQRLKPAKRVSWCLVTIPRATNSNRP

SEQ ID NO: 27728 - protein, 226 aa, Pseudomonas aeruginosa
GRRDSRAIVRATGRAGEPAGRYGPAQCHFPWVPYGQGRCRLPPAERAGGMLPHCGKRLRYPAQGRAARQLRTDGCGAAGAGYGQRDVRPGARAVRTDPGDARAAGGPCPPGRARGRRARGTCASAAGGRSASRACGAAGSARAECLQRYHRRRVRAVAGCSAGRRSAGLRRCRSARGSRWRRDQRRRVRGVARPVARQGQVRPAGGLGRACASPRRGGRAGRGCRW

SEQ ID NO: 27729 - protein, 371 aa, Pseudomonas aeruginosa
GVAMAVKVLVVDDSGFFRRRVSEILSADGQIQVVGTATNGREAIEQALALRPDVITMDYEMPLMDGITAVRNIMQRCPTPVLMFSSLTHEGARVTLDALDAGAVDYLPKNFEDISRNPDKVRQLLCEKVLTIARSNRRSISLPPLPSATSSSHAPASSSSLGASARASAGASPAPASTSAAPKRKAYRLVAIGTSTGGPVALQRVLTQLPANFPAPLVLIQHMPAAFTKAFAERLDKLCRISVKEAEDGDILRPGLALLAPGGKQMMVDGRGTVRILPGDERLNYKPCVDVTFGSAAKAYNDKVLAVVLTGMGADGREGARLLKQGGSQVWAQDEASCVIYGMPMAVVKANLADAVYGLDDIGRHLVEACQ

SEQ ID NO: 27730 - protein, 347 aa, Pseudomonas aeruginosa
SPTAPCSSICWRSSRPPGWPDGAPVAAPTGAFKPHRSAADNRCRPLSRNTHMSAATATRSQLALQSYLDALLQEATFEDLEPLVETPPAPAPAPLKPVALAVAEVATPAPALETLPVDHGFDEFEAAVLEEQVRDARLVPPAPAALLDEPTTLRELPVEPRPHEVIELRVPSAPASVGEPPLLDLPLLDDGRPAWAAEPFECLLFDVAGLTLAVPLVCLGSIYPLENQELTPLFGQPDWFLGILPSQAGNLKVLDTARWVMPERYRDDYRDGLKYVISVQGYEWGLAVHQVSRSIRLDPAEVKWRSQRSQRPWLAGTVIEHMCALLDVAALAELIASGAVKRLHGDH

SEQ ID NO: 27731 - protein, 173 aa, Pseudomonas aeruginosa
TASATCGGFREVRGMSKATAQSAEDPILQWVTFRLDNESYGINVMQVQEVLRYTEIAPVPGAPSYVLGIINLRGNVVTVIDTRQRFGLDPAPVSDNTRIVIIEADKQVVGILVDSVAEVVYLKQSEIETAPNVGNEESAKFIQGVCNKNGELLILVELDKMMTEEEWSELGSI

SEQ ID NO: 27732 - protein, 145 aa, Pseudomonas aeruginosa
CVLPTRGPAEMEVVALALALAACLGLAAACLWLRRELRRLQAALAQQAEEGAARERRLKELSKRIESYQQVNVRMGEALQDLGKQLAPLPDRVARLEQRDPTTLSFSQAARLVGLGASAEDLTQACGLSQAEAELVARLHEAKGK

SEQ ID NO: 27733 - protein, 339 aa, Pseudomonas aeruginosa
GGYRLYSVLIFPVDRKMSKPTVRVLALLELLQSHGQLSGSELARRLEVDGRTLRRYIVALEELGIPISAERGRHGGYRLVAGFKLPPLMFSAEETLAVSLGLLAVRSLGLGESELALESAQAKLSRVMPVALRRRLVALRETASLDLARARAGTSVAALATLAEAAQVRARVEFRYRDPQGAETLRQLDPYGLAYRNGCWYVSGFCHLRQALRSFRLDRLDAPRMLAERFERPADFDTLRHLRESFARMPRAYPVEILMRAAREQVVAVLGEPLGLLAEVDGGTLLRASTDDLDWFARRLCGLPFDFEVRQPLELREPLRRQAERVLRNLGQEEASDHR

SEQ ID NO: 27734 - protein, 168 aa, Pseudomonas aeruginosa
AFRGKVLLIARLSLSRIGPGQPARFQEATRMPAIPLRAMVLCANPGRLLRYGALFNRCGYFHLSLCLDRRELRRSLDQGYPYDYCLYDGFRLDQGCKGTLAMLGRSGSIRRFLLVGELDCREKRLLFEWSRGHGLSIGAVSDRPLGQVALAALIKRDRGCPDLLRGIA

SEQ ID NO: 27735 - protein, 259 aa, Pseudomonas aeruginosa
GGFREDEVRSFSNLPWRDSMTVQADILKAIEGIEHGFQQAGQALSERIFHCRQVHGAEIVDARSLSESGRHAADGVFSEGPLAVAVVTADCLPILMSSRDGRVVAALHGGWQGLVAGIVGAAVARFNARGVASADIRVAIGPGIKACCYEVSAGFIEALQVGHGRLWEGAVPPWSQRRPLPERPPRFAPPEPRQAEQGAWLDLVAFCRQLFQAAGVGPAQIEASAVCTYCSGDAFASHRRRQRLGEEKRQQYAWIARKP

SEQ ID NO: 27736 - protein, 311 aa, Pseudomonas aeruginosa
HHPSRHRHRRLPRHRSRHCPAVGRRRFRGRGQLCRQPDHGRRGRGRNRRRRRHGHRRTGRRGQPGGHGQAVRSHQERLRPHRRGGQQRRHDALPEDRRRRPGGLRPGDPHQPARRLHRARPGCPACRARRTDHCPVHQRDRPGAAQLRSVHRVQVRGRGAGARAGQRVARPGHQGQRGGARPGGHRAVLQRQERRTDRPDRQAGAAGASRRTGRDRRGGVLPRRAGRDLGQFPGAAGQRRFRLSRVGGARKSRREGRLFRGRHWRSAVVLGRRADGVAQALAVVIAGGGGGDRAGLRQPAAVAGAGDAGGG

SEQ ID NO: 27737 - protein, 276 aa, Pseudomonas aeruginosa
CRACQTGWPRRHQYSGRVYPDFRVCSVKASGAATRKDAWRCCSMSDPAEVPTASPLLETVGLACERDWRMLFERLDLRLAAGEMLQVVGPNGSGKTSLLRLLSGLMQPTAGEVRLNGRPLAEQRGELARSLLWIGHAAGIKGLLSAEENLTWLCALHQPASREAIWQALADVGLRGFEDVPCHTLSAGQQRRVALARLYLDAPPLWILDEPFTALDKQGVAQLETHLAGHCQRGGMVVLTTHHSLQQMPAGYRELDLGALKAASGATVEPALGDPA

SEQ ID NO: 27738 - protein, 157 aa, Pseudomonas aeruginosa
PRQRGQGLCRTGHRRRGEHPDHQVLGGMVEHPAPAGHLHHHRETGDAGGDVVAVADHGPRLLLLLRGHAAGAHAPGSAQARVPHHLGESRGEGPGGEGTMSFESFGDFLAMGHHGPYVWSAYGISLLVLAINVAEPLLARRRYLQEEARRLRREAQQ

SEQ ID NO: 27739 - protein, 471 aa, Pseudomonas aeruginosa
FRSLQAAGQRAYLAALVRSGRLAAVRRAGDRRDRPAPPAHRCQGANHPVRRGASAPRQPVEERQMIDFWLAAGLLLLAALAFLLIPLLRGRRAQAEEDRTALNVALYQERIAELAGQQAAGTLTAEQLENGRAEAARELLADTEGSGEERSSRLGRAVPLVAALLVPLVALGLYLHWGASDKVELAREFAQAPHSMEEMTARLERAVQAQPDSAQGWYFLGRTYMTQERGADAARAFERAAELSGRQPEVLGQWAQALYFSGGKKMTAQIKALADEALKGDPAEVTTLGLLGIAAFEEQRYADAIGFWERLVSVLPNEDPARSAIQGGIQRARERMTEAGQTPPAPAAPAAAGVTLTVKVDISDAVKGQVKADDSVFVFARAVGGPPMPLAVKRLTVADLPAEVSLSDADAMMPQLKLSGFPQVELVARVSRAGNAISGEWIGRGKPLSTAQSSAQALTIDGPDQPQAARP

SEQ ID NO: 27740 - protein, 610 aa, Pseudomonas aeruginosa
KIARALSNGRCWRSSRINCFQKRLPPICSMARPRLACMPMSRNRVCIRIRSTVGFRRLRFAAFPPAASRGATPKGDWPAGSALLESAHNQRPGKGPPRVSVTASTSITIRGQRHELFPRARKCAETHAGRVRRGRHHRFRSHSRQFRLRHRPLRHPAGRHRRFLGLRPGRGAGADVRLVLCRAGQGAQHRRRRVCLRQAGVRRLGRLRHLPHGAGDAAVHPAGARHRRGDLPERCPRHPLRCADRGPGDRCLQLPAGHPQHPRQRLGHGYLPAAGSGGAAGDRRPRFRPCTATGERPSAAAGSRRRRAAGDRTLGIGDRSGRYRAVLLQRFRRRGAARRGHEGRRSQRASRGALVAGAGSTDRDRPARRAADRRAVAPGDARQPRPDRLPVEQPWQRDAVAPGQRRDLPLGVQRHRRHRHPERPGDLQQRSRRALDAGVEPCLHPYPSALGIALAGHAVPRHSLGGAELQLQPGRTDLVHRVADRHGLPDRRPLRAVQPGAAARPRASLPDAAVAAAGAAGAAGGERRGIPAAQPVPGGLGQGRDDHCRTAGGVGDSLLHLRQAQSGVPEALKQESACALDNLASPSAWALPARSTRSPTFPACASATAP

SEQ ID NO: 27741 - protein, 880 aa, Pseudomonas aeruginosa
RRVICRVNIKNCFAYYPLEPMPRPALWPALVEAADRQVLGILHAELQGGAAFLAGLQGPVPLQLAVVLALDFLRLGFQQGDLDLLVARDRQLVLELHAFGVLVVVAHVDAEFVVDPRAVADQAAAVGIALDQLAFDADALVGAQCQFEALAGHHPAQMAAGDEAVAEKGIQGAGEQRVVAVVAGLRLQVGGFAQGRGRQIAQLGRHFQAGDGDLLRAAVAVQGRRHGDVERGAGGAAADLRGGEPRLGQLRRRGRHGHLRRGPGDGRGLRHGRRNVLHGHLGTVVGVGRVDVDDPGIQPRYVAAQGRTGGGEGQVDVGPVFAAALPDQALVGQFDGIRAVAQACVVGRLPGGVAQGVVELHLDLCRLLQGDPQDRALEALAVAVEGAALLLQLLLALFQFGGAVVQLALLGEQAFEVAFGQLQQAFQLVDAGHGAILAGLGAAALDVGEELLLRFEHAAAVMDFPQLPVYLAQLLVELLHTVVVRALDPLRGAADVEQGGGGAGAEGRAQAGVVELEGQLLQGDLMLALGQLQAGGAGDHGTVGVDGDRADAAVDRLWRGQQRSAGEQAGEQERRGGESIHDISSLGGWRGEEPVRAVPSCCLRRKRGERRVKRREEIFPCGSGRLFQALQGTAQVGAGGGLPALPQRFAVVQRRLLQQLAQQLAAPGAEQRFRHPGVFGADVRLVARVDRRRRGEDGEVDIHHQGCVGVSRRRLVTGGHDQFAQGRPQRGQPGMVEPVLGAGGAGGLVVLALGVVDQVVGPPPQLHQVRPQRQLAPAVEVLQAGEDVAIAVVVPVGPAIGRQQRVEGIRRRVAAESLPEGVPALPVKTSHGCLPREGTTGCRSGSRMPPALRGSPCGTPGNPAATGWPGPGASRWRVRR

SEQ ID NO: 27742 - protein, 173 aa, Pseudomonas aeruginosa
RYRGVRASCRVRSSWLLMMDAAPYQTSPPAPAFPRSGASPAEARAEAAGQAQVQALAADAKQAGEDERCGQRRQAEQAEQRLQRHRQAHAEQWRPGAAVAQGQGQPGKGGVQAVEPGERARPVVAQQPGQRQAGRGAGEGPGGGGTRDQQQAEPDQQPCQRFTEEDDLADPLR

SEQ ID NO: 27743 - protein, 541 aa, Pseudomonas aeruginosa
MSMACMGVREGGHGPTRRSFPDGWRRGPVFPAPSIRERQGWPDPHARGDGASRTELVASEISQRRRHGLDAQHVGRAGATERHAGGDHHGVAAARHALGQGDVEGGRADLVDVRQLLVDHRIHAPGYGQSPRGAQVRGQAEDRRLGPLAGGAQGRVARLGVVHQHRHREDPADPADRAADRIGDGSVGLRTVDLELDVVVRLGLHLADDLRHHLYRLARVLSGSGFRREHHRVGAGAHRGGYVGHLGAGRGGGEAHRLEHLGGHHHRLAELAADLDDAFLDAWHALRRHLYAEVAARHHDRVGALGDRLDGAHRAGLLDLGHEEGLVADQPTGLVDVLRALHEGQRHPVDPQFQAEGQVAAVLVGQRAELQDRFRHVDALAIGQLATHRHAGLDGVAVAVDHFQADLAVVQQQAHARFQGMDDLRMRQVDPPLVAGGVAEVESEGLPTLQLHGTGGEAADPQLRTLQVHEHADRVVQLRFHLAHPGEALRVIGVVAVAEVQAEQVGAGLHQGTDIVAAAGGRAEGGKDLGFLVGCHVRTRG

SEQ ID NO: 27744 - protein, 95 aa, Pseudomonas aeruginosa
ISRPGVRFLYPALWAGKEEGGGEHRSSPTVPLPEPFEKGFVAPRGVTARADCGSLVADREVGHVLQALDQRRVVPVTAADGRAGAEHLLGVGGVG

SEQ ID NO: 27745 - protein, 293 aa, Pseudomonas aeruginosa
VLLVQADAEARVEGALDHAFAVYLEDPRGGEATHQRLAHLGRIGAVAGGEQQGLGDRLDVQRDDDLVGHLGGLAVAVAADAGDVLAHRLEQRQGAFEAVRAAADHDAQGRRLGADLAAGDRGVQILRAGSLDLLGEALGGGGGDRTHVDHHLVRADALGDTVLAEQHILDLRGVRHHDDDELGFLGHFLRVGQGNGAGLQQVGRSGVVVGGKEQAVAGLLQVLRHGLAHDSGADESDLGHESVSWFCLSSGSAQGGGSVLFVGADQTTLCVFIQPRPASVVVAGLYSQPIQPW

SEQ ID NO: 27746 - protein, 286 aa, Pseudomonas aeruginosa
GQAGALPWPRGGARPARTAAQPSRRPRAPERGTGGGAEPEAGAASLRRPGAGPGAAFHEHDRRLTVSSWGDGTNGAIRRFLSHATRATVFRHAPLAAPSREKRRGATPKRGEDVMLPAAPAKESLPCTGSCSSAAATACVVPAPNGSFADWPGLETDSPGLAADAETAHGAGATGVGDAGRRHGAPPPAGADAPARRGDERQAPGLPGYPGRLRLHAGGIAASAGAQGGAFPSAGLSGADRERKKEAGRSPARGKGGPGVSPVRQGVRSAWAPARGCRTSGCGRCG

SEQ ID NO: 27747 - protein, 267 aa, Pseudomonas aeruginosa
PRPMPISTEMLTQKPRMKRLIRRMVQSTRLERNRKCREPKSSAPLPPPAQLIATGNRHMPIEVITVPVTSGGKKRTMRDMKGAMSMPKKPAAMVAPKIPVMPTPGIPAIATMLPTAAKLAPIITGMRMPIGPMPSDWTRVAMPATSRSALIRKAISSRERPAAWPTIRGTATAPPYISSTCWKPTSSSCVSGRRWSTGESGMRRSVTTDMQHLRRFYCCQSQADTGKGRFRRPGISGRTSTPGFRAMRWGVLYPRCVLDSIDFLYTK

SEQ ID NO: 27748 - protein, 869 aa, Pseudomonas aeruginosa
RLQRGFVAQDIPVIERCRIPGVEAGRCMSGTDMTVLRRLDHEVAGHAQLDVAALEGQVGAAAHQGDVLLRGDQHVLLAGADLHALLGLQADVVLLRLQQHRPLVGDLAQLAALGEQADVAAGVDHHLLPGGHLLVLPGHAVDVLAGGQGQARRRRRGDPCRTAQGDRRLASVALAGLVVGTVAEVAHGFLEGLLRRRVVPHALVLPGVVAQLAGQLQRGLQHLHHDASVEMAGAGPELLLGAQQQPLGRTHRAMFVGAQFEALAARLAAFGPRMGQVAQVQRAGTVVAHQRRTDLRRGVVDAQLVGPTALVLLALDGAEDLVVGQRVGRSVGRPVGAPGDDRLVAVAVQVIDDHLLANPRDRHVPPVGTCPVLRDPYPAGTEFIVTSLAIPGELDFHPSPLVAMDLFPCRADYRRDLRTIDTRPRQRCGTPFDVLGYQFGAQVVAHPQRGVGGLFLLAGILGAAMDHPHRPPPGVEVGTRMTFQGKGVARDQPRVVAADRCLPRIAPVPSEAAFAERPAGAAPLVATGVVVALVGRVLMLERLASEMMLLVVGRALEAVVPLGLSSRTNIFAVAERMKHRLRVVALRLGAEQHRAAGDTLLDVEPVAADQGVAVFVEAEVVDQAFLEGQPVVQVVIAVAGLHAVFARQVLVVDTLFVVEHPVLLEQRLENLRNTLLLEYPPVAAQLQARQLRFQQQFVAGPAKTRAALGEVADDAMDVAGRTAVLPEGEGARLVEYLLEIDGVLVAGQLQVQAERLAERFFQFELDDIEREFPFADDEGEFQVPLTHGSFLVPGGRFLPHPLEKRAPRYSCSAAAESLGSVSISRSSGHFRLDGEPIAQVYDRCACQLTLRPASASRRSRRCRRLRGSR

SEQ ID NO: 27749 - protein, 594 aa, Pseudomonas aeruginosa
PARRSSGLSRCRAAVVPAWRFVRNPFPARVFRILPDACRRSRSSASARCARWPAGNGDAAGTGRRKWNTGALALSNNQQATLSGYNRTRQPGTRGSRGRPAAHGIPRRRQVMQLKDAKLFRQQAYVDGAWVDADNGQTIKVNNPATGEIIGSVPKMGAAETRRAIEAADKALPAWRALTAKERANKLRRWFDLMIENQDDLARLMTIEQGKPLAEAKGEIAYAASFLEWFGEEAKRIYGDTIPGHQPDKRIIVIKQPIGVTAAITPWNFPSAMITRKAGPALAAGCTMVLKPASQTPYSALALAELAERAGIPKGVFSVVTGSAGEVGGELTSNPIVRKLTFTGSTEIGRQLMAECAQDIKKVSLELGGNAPFIVFDDADLDAAVEGALISKYRNNGQTCVCANRLYVQDGVYDAFVDKLKAAVAKLNIGNGLEAGVTTGPLIDAKAVAKVEEHIADAVSKGAKVVSGGKPHALGGTFFEPTILVDVPKNALVSKDETFGPLAPVFRFKDEAEVIAMSNDTEFGLASYFYARDLARVFRVAEQLEYGMVGINTGLISNEVAPFGGIKASGLGREGSKYGIEDYLEIKYLCLGGI

SEQ ID NO: 27750 - protein, 264 aa, Pseudomonas aeruginosa
GSHEQDQRIPAEASPGRGTPRRGPDPPGRRRARRELHRLGRGRPRVHRLRRRHRRAEHRPPASEGDRRGPGATGQAVPHLLPGAGLRTLHRAGRGNRQARAGRLPEEDPAGHLRLRSRGERRQDRPRRHRPRWRDRLHRRVPRPHHDDPGPDRQGGPVLRRHGPDAGRHLPRPGALRAARRERGRLHRQHRAHLQERCPAPGHRRDHHRAGAGRGWLLRQLQVLHAAPARPVRPARHPADRRRSADRRRPYRHLLRYRATGHRS

SEQ ID NO: 27751 - protein, 152 aa, Pseudomonas aeruginosa
RGASCAAGHGARLQSSLWPGRSAPTCAPPSCRPWMGGSAPSAAARRATGPTPGRCRPVRCSRSRRGSRPVPGFPRRRAAGCRPPGLAGANDGRCAAHPAVRDSAPRGGSRPPPAALRARGSGRRAGVPAGARDAGRIRVASGAYGGRSRRAG

SEQ ID NO: 27752 - protein, 379 aa, Pseudomonas aeruginosa
RSCATLPGVRRGIAWLAGDRRWPGDHGGSRRAAGDRAGRPGRGGRRGSVAVPWRNWLPGISGNWLFVEAKGRLSVTPCRAAFHSRGCQSAKEIRHDHPPRMGQSLPRRLCRHARPGKGPGQGRPGAPVDRTGLPAHFADQRLRLLREHACQRRAQGRRDRAASASALRLAGNPLLHPARARCPGLDRATRPPQPGGVAARPARRTARALRRQGDRRTDPGGLGHQRLEPLRRRHGHASGMRWTAMKANRSIACLLLAALPTLASAHVAEKVETLHDQALAEIPGHRGLMLTVSFKPGQVSAPHVHPGSVFVYVLEGTVQTQLEGGPVETYTVGQSWYEPANVPHLLARNPDPMKPAKLLVWELLKEGDPILKPLERGAH

SEQ ID NO: 27753 - protein, 105 aa, Pseudomonas aeruginosa
GVARSPGGASVMSASQVIRIRARNGQSERLGLRLQQLVEPGLEAPGCLEYQVRRDALEPDLWLVCSQWREAQQMFDYLAGGIQQVFAEVLWRSLAASLEVQDDAG

SEQ ID NO: 27754 - protein, 177 aa, Pseudomonas aeruginosa
WRPSSSSAWIRRGSISTKSLPDSSCRAATYLLARAATSRLRPWRRSHVSTRLALLASSGVGKTKRRRQNSSSSRRSWRGWARSCTQSSSSLNRASACSSGAGRWYSGPKSKTRSTWPSSNASVGSSGPRRRMSRPILGPLAASRRRSAGRISSSTYSGAQRVKVRGSPRGSKLPWAA

SEQ ID NO: 27755 - protein, 447 aa, Pseudomonas aeruginosa
PDQHRAAIPRAAGHGRREQPGEHLHGRQETEQQPGFLGAPALLQVIGREPGQHAGVAGRAEAEEQDQQPGPRIAQEAPARLRVGQAQAGAGLQPPGQQRERGERRPGTEADPPAGVLRQGRRGAGGQRRASHDGGDVEPHAERRARAETGLDQGRHQRLDQGDAETGEHGAAEQVGQASAAQAHGAGGADQQQGEGHRTPLADAAGDAQAEEHAEAEGHHRQGGQQRDGAEAERDLAAHGVQQWADGGHGGPQVEADQDDGGHQPEGAAGWVGRGHGDLLSGAPLRMRQGVAANQNPQGGFEKMRWPGSRGGRWRNVASREVIRPVRRVASLRTQAHQAFAQGTRVAVDDDRRPGPAGSADQRAALAVQVAQGLAQVLPAVFQFLQSRRVGALRHQQGDAPVDQRDQHALVLAEIVPGLLAGSLQPAQVGARQVLQGQVLDPHRQLP

SEQ ID NO: 27756 - protein, 302 aa, Pseudomonas aeruginosa
LGVAFGVGVVGARLAVEQGDLAEPVRRFHQDQQRLLAVLADRADTDRALDHAVQSAGRVAAGEQALARRQLARLGECQQVRLQGLRQTLEPAAGLELRTVVGTLVHVCRLADRVENRGGAMMREPWRETTTMKTLVDHLAQYAAYHRDRRNIFSHFIGIPMIVLSIAVLLARPALGFGLSPALLLALAAALFYLRLDLRFGVAMTALLALTVWGAAQLAAGTTAAWLGWGVGLFVVGWIIQFVGHYYEGRKPAFVDDLSGLIVGPLFVLAELAFLLGLRGDVQREVEERAGPTCIREHKRAA

SEQ ID NO: 27757 - protein, 230 aa, Pseudomonas aeruginosa
LVGEIVGVGFLGLGELRVDQRFGEFAQLGAGQGGQRAALRGAGGAAHRGGRVGGLGGLAGVAEGDVAHLVAEHAFDLVVAHQLHQPAVDADAAVGHGPGVDLLGEVDLVVHRHAVDLVAQGLGDLVQALAVLAVGRGDAVLLVGLGAGLVGDLADLGVAQGCSLHRHHAVLHEVTLGQVLAAGQGGAGEGQGGKGKTGLHRVLLAIGGVPCRTGVFRPVPRARWGARGGG

SEQ ID NO: 27758 - protein, 233 aa, Pseudomonas aeruginosa
SMQFNPGFSSLAALLADPGRAQMIWALMDGSARPASELALLAGVSPSSASGHLGRLVEGGVLSLEARGRNRFYRLAGPEVGQAVEALASASLALQPQRRSLPPSHGTPSALREARTCYDHLAGELAVGVFARMLDAGWIEQEGRTLRLSATGEAGLARLGIDLSEVRRRRRQFACACPDWSERKPHLGGALGAALLEACLRQGWLRPQDGSRALQVSSKGRAGLRGLAERTAG

SEQ ID NO: 27759 - protein, 165 aa, Pseudomonas aeruginosa
CRGPRQCSAAACPGRRGGPGRASGSSGSRRPCGAGGRCGRDCRSGPAGGCGGPPARWRTLRGAGASSRSRWGRRVPPERGRSARRSPARRTSGRSPGPSPRVRRAPLPGRGSGAARCRAVRRRPGPCGGTGVPGRGTRAGRLRARITAVGGHPKHQLVLVLDLVW

SEQ ID NO: 27760 - protein, 294 aa, Pseudomonas aeruginosa
APCQVRDRRGSAQPGAQGPVHRPARRRGAVQGRGEEPGHPAHLRQELPGRLDRAQSLLALPDRRRGADGAHRPGPVRRPWPDRLGRADGMDSVLGRRRGQRPRPRGRLSQLRMPRRRHQPGALGHPHRRRRAAQQPPHLPELGQAVGEEVGIRPGLGLDQAVQLPAPGQGRPGRADRPSGRGQAQPGHGHRHGDPQQPLPDHGAVPQAGDRAAGQAGSGQGRRVGAPPVPPRQAPAVARDQPAAGPPPRAHRLDARPQPGAEGDLREAPGVAADLGQDQRQRPRHAGGDQGLGA

SEQ ID NO: 27761 - protein, 739 aa, Pseudomonas aeruginosa
  UNSURE (739): Identity of amino acid at the above locations are unknown.
GGSQRYPVAEGVRRATEDLLAASRLTPGAPSRVRQPPLQRAGSCRRVAFRRRQCDAPPILLFLRKSTCLIRDSARAAPGLSSACPGATPGVTQNNKKRSAGDVAGLPDHAGLRPGHAGPGLVRNAQGEEPERFPRRRTPPRPRPLPGNHGRGGARRRVDHWYGQARLPVRPVRLVAGVHARPGDHRPQPGVLAADRAPAGVHRDPGAGAALPGLLAPDRRGGHGRLRPDGGGHRDHRHRLGHRGGIRHPADPGDPLRWRDRHRLFGDRRHVVPYADRHHPVRDQDRRYLPGPAAVVDRRRRWPGAHAGGAAGGLLRPRPHRPGYHTHLLPPVLLRRADRPGHLAAGVHRAQRDGGALRRAWRRRLLHALRRRLRADRRGGAGPPAGPGGAGERLRRDHPRGTGAGPARPGGGGRAVGDHVHRQRVPAGSGHRAAGRHLRALPAPRYHQRHPSEPLHHPADGRGDAGPGVPGQRCHRGPEHRLQPAGRRPAGADRRRAAVAPGQSAGGDRQHRRRLPGGDRLHGPRRPGSPTRRSSTACWPAWRPSSRSAWLPVLPPACEPSRNEPTAPGGARRFLPATRRRPMSNDHPQPLDAADIPRFAGIPTFMRLPAFTDPAALQVGLIGVPWDGGTTNRAGARHGPREVRNLSSLMRKVHHVSRIAPYDLVRVGDLGDAPVNPIDLLDSLRRIEGFYRQVHAAGTLPLSVGGDHLETLPIFRALGRERPLGMVHLDAHSDTNDRX

SEQ ID NO: 27762 - protein, 84 aa, Pseudomonas aeruginosa
LGDNPYTHGTPFRRAIEEGLLDPVRTVQIGIRGSVYSPDDDAFARECGIRRDPHGRVRRTGRRGDLGRSPAGGGRRADLCEFRR

SEQ ID NO: 27763 - protein, 222 aa, Pseudomonas aeruginosa
PRRGRSSTTPRSACSATSPVSASRSAASAGAIARRCTWAASMASSASIACRCRWPSGCFASAPRRCCSSCTRGVPTNSSTRCWKSACNWRWGPFTTGCPGSTTNPCSARSRTSIAAARTPSSPGRTTSRHWTRSAPPTMSAAATWRKTIARTTCASTRGPTPTPWRPSLPWSSAAPTSATCRRTMPPPGSPKGACGRSGHGNWPTTRNSIALPVRDTKNDRP

SEQ ID NO: 27764 - protein, 390 aa, Pseudomonas aeruginosa
PCSCARCSRRRNNWACRLRRIRTASLGNCDQAHWLEPFPAVRRAFLYRRDPCAKLAVEPVPRAERRSMDDLTGIPEDPQEAALALLHSRAEVARLKEREQLFSALLASVNSVLWAYDWQNRRMVYVSPAYEKIFGRSAALLLADYEEWRNSIYPDDLDYADSSLLQVLERGAVEQREYRIVRGDGEVRWLNDKCFVSRQGEAGLPLMVVGIAEDITDKKHMESELQRLATTDVLTQSSNRRYFFDSAEAAFKECRREGIPLAFLLLDVDDFKKINDRFGHQVGDQVLQRIAQSGSAALRRGDLFGRIGGEEFAVLLPGCDEQTARQIGARLQREVQRLRFQEGEHSFGITVSQGLTVLQADDEGLGALYSRADAAMYSAKRQGKDCIVVG

SEQ ID NO: 27765 - protein, 586 aa, Pseudomonas aeruginosa
AVFCRHPSARQPGEGQEAREDAKAEPDGKIGLQIAFTGGGSRHPPHNNKTRVRPCTRFRSLPPCLLACPVVPSSRVAPFPDPSNAEFRARHLPGWYGAQCFNDRSGPRVPLPPTGRQLAIPMGKRPMKSRKINKSRLALAITAGTLGALAQQAVAAGFIEDSKASLTLRNFYINTDNRNGTASPSKQEEWGQGFILNYQSGFTQGTVGFGVDALGLLGVRLDGGGRAGKSGLDRQPGTVFPLESNGEPVHDFASLGLTAKAKVSNTEFRYGTLQPKLPVVTYNDGRLLPVTFEGGQVTSTDLKDFTLVAGQLEHSKGRNSTDNRSLSIAGANGSSASSRDSNKFYYAGGDYKVNKDLTLQYYYGNLDDFYKQHFLGLIHNWQIGPGVLKTDLRAFDSSSDGKNGSRSGRADGYVSSGYYGSGVTKGEVDNRAFSGLFTYTVSGHSIGAGYQILNGDSDFPFLNRGDGEGSTAYLITDVQIGKFQRAGERTWQVRYGYDFATVGVPGLTFNTIYLSGDKIKTARGDQSEWERDISLAYVIPDGTFKGLGFTWKNASFRSGLPAAGSSNNQRDQDENRLIVSYTLPLL

SEQ ID NO: 27766 - protein, 264 aa, Pseudomonas aeruginosa
ARPNPITSTNNGCLMSRLPLIGVTACTKQIGLHPYHIAGDKYLRAVVNGAGGLPLIIPALGESIDQAALLDSVDGLLFTGSPSNVEPRHYSGPASEPGTLHDSDRDATTLPLVRAAIDAGIPVLGICRGFQEMNVAFGGSLHQKVHEVGTFMDHREPANQPLEVQYAPRHAMHVQPGGVLAGIGLPSEFQVNSIHGQGVDRLAPGLRVEALAPDGLVEAISVEGAKAFALGVQWHPEWQVLTNPNYLAIFQAFGKACSKRAGQR

SEQ ID NO: 27767 - protein, 191 aa, Pseudomonas aeruginosa
PGYADPRGRHRADGDQLPSWRRPRPGRPDPGVQAHHARGRAQAQRRRDLHGQADDRRAGQRDAPAPEHRRREDRQEHLLQCRRHHERAVPAPYRRPAEVHPGSAAAVRAQRELVPPLPARYLGAGERRVGRREPYRRPARAGLQPGEPPGREPSRRRRRQPLPGAGCQPAVRLHRHGRRHQAERPGQRSRL

SEQ ID NO: 27768 - protein, 460 aa, Pseudomonas aeruginosa
KRCDMNSQITNAKTREWQALSRDHHLPPFTDYKQLNEKGARIITKAEGVYIWDSEGNKILDAMAGLWCVNVGYGREELVQAATRQMRELPFYNLFFQTAHPPVVELAKAIADVAPEGMNHVFFTGSGSEANDTVLRMVRHYWATKGQPQKKVVIGRWNGYHGSTVAGVSLGGMKALHEQGDFPIPGIVHIAQPYWYGEGGDMSPDEFGVWAAEQLEKKILEVGEENVAAFIAEPIQGAGGVIVPPDTYWPKIREILAKYDILFIADEVICGFGRTGEWFGSQYYGNAPDLMPIAKGLTSGYIPMGGVVVRDEIVEVLNQGGEFYHGFTYSGHPVAAAVALENIRILREEKIIEKVKAETAPYLQKRWQELADHPLVGEARGVGMVAALELVKNKKTRERFTDKGVGMLCREHCFRNGLIMRAVGDTMIISPPLVIDPSQIDELITLARKCLDQTAAAVLA

SEQ ID NO: 27769 - protein, 369 aa, Pseudomonas aeruginosa
DPARPDLGGLCGRYGAGCGQQGAARVQLVRLHRAGHPGEVHQGNWDQGRLRRLRQQRSAGSQVAGGQVRVRRGGAVQLLPRQADQGRGLPETRQVQAAELEEPEQGPDAHPGSQRPGQRACDSLHVGHHRHRLQPGQGQGGLRRQRAGGFLGPGIQAGEHPEAEAVRRQLPRLADRDPPGGPALSRLQAGHRQSQGTQGGRRAVPEDPSLRHLLPLVEVHFRPGQRQHLRRHRLLRRHLPGQVPRRRGEEQGHRQVQHSQGRRRQLLRHGRHSEGRREHRGRPGLRQLPDEAGNHGRDHRRGSVPQRQRGGHPAGVRGDPQRPGHLPERRGHEEAVYLPRPAGQDPAGDDPQLDQDQVRQVIREEPGGA

SEQ ID NO: 27770 - protein, 153 aa, Pseudomonas aeruginosa
PLWLRRSRAPCRRRRRACTSITGPITSLPPPSRTSPRRAGSTSATTSSTPTRPSRASWSPATPAMTSWCRRTTSSASRSRPVPSRSWTRASCRTGRTSIRRCSSNWRSATRATSTRFPTCGAPTASVTTWPRSRKSSATSRSTPGPSSSSRRT

SEQ ID NO: 27771 - protein, 381 aa, Pseudomonas aeruginosa
LHQLLEDHRAAVEERHHRRLHAGVHPGGGRVRHPGTARRPRDPDDRQGALAGVLQQPRLAGGVRPGGGDAGDPDHPDHPVQQEPGQRTGGQGMKRWNFSNVMLIVGLLFIYLPMLILVIYSFNASKLVTVWGGWSVKWYVGLLDNTQLVSSVGRSLEIAFYTAFSSVLLGTLAAFVLTRIPRFRGRTLFGGMVTAPLVMPEVITGLSLLLLFVAMAQLIGWPQERGIVTIWIAHTSFCSSYVAVVVSARLRELDLSIEEAAMDLGAKPWKVFLLITIPMIAPSLAAGGMMSFALSLDDLVLASFVSGPGSTTLPMEVFSAVRLGVKPEINAVASLILLSVSLFTFFAWYFTRQAEERRRRAIQQAMEETATDWQKGSPTPA

SEQ ID NO: 27772 - protein, 642 aa, Pseudomonas aeruginosa
PVVSGGQPPCGYSPDPTPAGSALRLQHQHALAVRLHLVFLVVLRQVVALDVGLGLVVVVAVEGHAALPDRVDAEAVGRVGEVHQAPGRWTVGDRPGGRADLRRQIVRYLVGAGGGERTDVEKALEQRLLAQGVLVGQGMRLAPQPAGRVVAEGAAQMREGGVPSGPDDIRAGFPAFCAAVVPPGRVGVGSQPRQRAVDGAGGDQAVEEGIAQFVVQGALGNLEQQLVEQRGGGRVDRVVALPGRQLLDQALAFGVVDHLAQDRQQGCEQARRVAGAIAELQRAAVVQVPFGAAVGQLGIQPLAAVRQVVVAGNRPAIGRDRLEVGGDDVAARRVFLLWVVGERIEAGLVRLALAAVEDEARVHPLRPLRQGRRGPPADIAGGIGPDQVESRRMDLRGRRAGLGQGIGAIQLVEGVEHRVLGLEESPPHGDRGPAGADAERVVDDRTVGRAAQGELHRRSALDRDFLLLALQVDPFALVPDLVGVVRVDLLGDQVEVVVLEHRQAPAERTVVAHRGEGVERLVVAIEFEAGRAQLGLVPYRRRGEADMRVAGQQGLAAGGAAAGDDPGVAALELRQAGVLQGLLAETGEGAEVLPVAGAQCAGWRQHAPADANRDRRCAGSRCPVRRGCRSAPARVRKAAAKL

SEQ ID NO: 27773 - protein, 374 aa, Pseudomonas aeruginosa
AASRPPAQSRPTRLTRSVLRRGVMAFTRKTGAKLAMCSRAAEYPWVSPVARPRIDCSPEPPMSEAFNPDYLRQHLRPLAAAEADAAVLAYQAYYGLDLRSRHPRLQARLGSMAVDGRRLAVQAWLLPEARGSLLLMHGYYDHMGLYRHVVDWALGMGFSVLACDLPGHGLSEGERASIRDFAEYQAVFKGLLGQAAELDLAAPWHLCGQSTGGAILLDYLLHGGERPELGETILLAPLVRPRAWGWSKLSYRLLSPFVDSIPRRFSENSSDPQFLDFLREHDPLQPRTLPTAWVGALTRWVPRIERAPRRALSPLVVQGESDETVDWRHGLKVLREKFDEPRILLLEEARHHLANESEGLRRRYFDFLSDALGA

SEQ ID NO: 27774 - protein, 394 aa, Pseudomonas aeruginosa
TGSSPSTARMSAKHSCWVRRRQWSWSAAMTSGWPCSRRAVLPAATWRTTTGASTATGSPARALPPPPSSAWACWYSTRMNWTAPRSAWPASTPAAERSAPQRRGQAVLQGFLHTLEECRKQPVDPGGGEIERQRLEGLGDDLLGRQHQFGHGDHGDQRGVLDQADQAVRQARHRQAQGLRGDDVPQGLAPGQADREPGFPLSLVDAEDRPAHGLREIGRDIQGQRQDARGDRGELDAYARQPVVQDEDLHQQWRPAEGADVDRGDLRDHRHLGHPDHRDAEAEDQAQDHRYRGEQHGIHRALEQEGPGHPEQLDQVGEPFEQFLQRIHSTLHRQTRRPRLSGAAASPVRAGTHFGGWLTSRPNHFSESLAKRPSALIFSSAAFSASPNFGLFFR

SEQ ID NO: 27775 - protein, 154 aa, Pseudomonas aeruginosa
LVPWPDAELEALEVFQRLELAGFVGAHDQLGAGDGVWLAEVEDLAPLLVHRDLVQRDVVLAALQAGEDAAPFGGDEFRLDRQFGGQQFAQFGLEAGELAALLEVERRIGALQGDAQGAALVDVVEQLGMGQRSGQGYQHQQAGQKSHVVLLGWE

SEQ ID NO: 27776 - protein, 265 aa, Pseudomonas aeruginosa
TSVGPMLFVQLSRARVLDNREPTGLHAVFPGVAGIDPDYVRERRSNTGFAVEIAVPAMPFPDSEGTKSAGEIPSSGVSRVLTEVKTGDSHESDIALPRSSRPDVRRIRQPDGCRPAPDEGARRGESVFHHAGRWCNRRQDLHREIRPERHGRGAGRRRHAGYRPPSPVGGPEGAAGDEPAAADDRQHPPLRQGPDRNRDHPAAGQAHPATAGGRQEPRAAGADRGVGEDHRYRQVTETKKGGRWASFFLSAGRCLRTARGYGWYR

SEQ ID NO: 27777 - protein, 529 aa, Pseudomonas aeruginosa
TCCPGGSGWKANCAKRVRPALAGTRNSAPRGTKRGGRMLACSPFSLPGCDLSCSQDDHESFESSRMTREALIESLKPLVEPGKLLDDAASLDAYGKDWTKHFAPAPLAIVFPKSVEQVQAIVRWANQHKVGLVPSGGRTGLSAAAVAANGEVVVAFDYMNRILDFNAFDRTVVCQPGVVTKQLQTFAEENGLYYPVDFASSGSSQIGGNIGTNAGGIKVIRYGMTRNWVAGMKVVTGKGDLLELNKDLIKNATGYDMRQLFIGAEGTLGFVVEATMRLERTPKNLTAMVLGTPDFDSIMPVLHAFQSKLDLTAFEFFSDKALAKVLARGDVPRAFETDCPFYALLEFEATTEEVANEALATFEHCVEQGWVLDGVMSQSEQQLQNLWKLREYISETISHWTPYKNDISVTVSRVPAFLKDIDAIVEANYPDFEVVWFGHIGDGNLHLNILKPENLGKDEFFAKCATVNKWVFETVEKYNGSISAEHGVGMTKRDYLTYTRSETEIAYMKALKAVFDPNGIMNPGKIFAE

SEQ ID NO: 27778 - protein, 614 aa, Pseudomonas aeruginosa
QVSQRRGPVIRPFSSVAGATDAFPPVQESVNELPASIYRRHPDPLPPGQAGLRRAQLRRTRQGTEQPGSHRAAAVHQARLLRGAGERRAEPAAGARLGTLRGGNRRADRQAAVAQAEPRGGPRRDLRLCAGAGPDLARGPGETEGKGPALGAGKELRWRRRAVAVRERRPVSRPDRHRHPPDHQRRGAPGRQQPRHAQSDRAADPAHRRAFLATGRRCGADRHAVRGRAAEQRRRVAARIAGRQPFRDPRALNRCGRRVRPASLAPAAETTVGRLADASIDRPGAMPFHGDAQENTWPNSRASPMSLASKLPRFRWLLPAFVVLVGVVLTIVMHWDDRAGLWWKESQASQQQRDESIWLPGYRVVIDAKPLQGLEEEETSDLAYNPATRTLFTVTGKRPLLVELSLTGDVLRTIPLLGLSNPEGVAVLENGNVAVTDERRNTLTIFHVDPQTAELSTKSLAEFPLGNIGKKNKGFEGIAWDPRQQRLLLSKERDPMTLFSWKSDGGPSLSGAMTALPSDDLYMRNVSALSVDPRTGHTLVLSAESHLLLELDEKGEPVSFISLLGGFNGLDSKIPRAEGVAIDDEGTIYMVSEPNLFYVFRKKSGERLATSDAD

SEQ ID NO: 27779 - protein, 291 aa, Pseudomonas aeruginosa
WTPGDLLFFLRGGRFSAAALAEVVRQGDEGDGNHEDDRGNRIDLRGYAHADGAEDVHRQGGCAGAGDEIGDDEIVHRDDEREHRPGQHAGHQQRQGDFPEGLPRRGVEVGGGLRQARVQALQAGADRQVGEGDAEHDVGDEDGEQRQLQADEGEEHQGRHRGDDLRHQQRQAENAVHQGLPAEGATAHAQRGEGGQDGRGQGGEGGDEQRVLRRAEDFRIVGHHRIPFQAEALPERRRLAAVEAEHYQHQDRDVEEGEEQPGGLAHAAEGPEWIAAVHGWPPPALARKRRL

SEQ ID NO: 27780 - protein, 107 aa, Pseudomonas aeruginosa
SRSRAAGASARSAFPCAASGPAPTATRRAAAPWAGWPARGPGRCVAAGHRTTGRRGACRPPAASPGRACGSRWRRSRCAGGPASPGRSRCCRRRSCAGTAHNSGTPC

SEQ ID NO: 27781 - protein, 250 aa, Pseudomonas aeruginosa
SHSRLPAGRPRTRPRCRPTDAGRAAPARRRPGGRPNACCRSGYARGSARRPAIPDRRRCTGRTGRAARCRPRCARHGPACRGCAGRPGCRRGSGPRCSGSRRADARRRAWTPDRQACRNRCPARPRPPRPPRRRSCLPAGCCRAGSASGGRAGGSVPGAGAATGLPSAAPGRRRRRWRPAGRRWSAPAPGASAGGKSRACVARCAPGRGRWSVLPCCPRPGRARLSRRESPGCRSARSRPGRPVPSWSPR

SEQ ID NO: 27782 - protein, 307 aa, Pseudomonas aeruginosa
PLLLQCRPAPVIGLGRAGSGLEGLDAVGGAEQQQVGRAGGEQAVGDHADDGVDLLFQFHRAVDAQVVHVEDDIAVVGQHAFAVDRIAAELHQLAGDVAASHRDDLHRQRELAEDGYQLAGIGDANEGLGHRGDDLLAGQRGTAALDQLQALVAFVGAVDVELQLADRVQLVDRDAMFLQALGGGLRTGHCAVELGLVAGQGIDEEVGGGACADADDALAVEVRKNVVDGGLCHCLLELILVHPGCLSGCLAGRPGGAGGGCARPGRPGGFPARPVPLRYEGTNYSGLASSGLAPDDRQSRCFPAARR

SEQ ID NO: 27783 - protein, 524 aa, Pseudomonas aeruginosa
  UNSURE (108): Identity of amino acid at the above locations are unknown.
SARRAWSRLRASVKSAEPPPMLEQYVKKILTSRVYDVAVETPLQPARQLSERLGNQVLLKREDLQPVFSFKIRGAYNKVAQLTEEEKARGVIAASAGNHAQGLALAAXRQGIRAVIVMPKTTPEIKVQAVRAHGAKAVLHGDAFPEALAHALKLVDEKGYTFVHPYDDPDTIAGQGTVAMEILRQQPGRLDAIFVPVGGGGLVAGIAAYVKYLRPEIKVIGVEPDESNCLQAAMAAGERVVLGQVGLFADGVAVAQIGQHTFDICKDHVDEVITVSTDEICAAIKDIYDDTRSITEPAGALAVAGIKKYVERERAEGQTLVAIDSGANVNFDRLRHVAERAELGERREAIIAVTIPERPGSFKAFCEAVGKRQITEFNYRYHSGSEAHIFVGVQTHPENDPREALVAYLREKGFPVLDLTDNELAKLHIRHMVGGHAVKVSDEMVFRFEFPERPGALFNFLTKLGGRWNISMFHYRNHGAADGRVVAGLQVPEDERHLIPQTLEAIGYPYWDETANPAYQLFLG

SEQ ID NO: 27784 - protein, 601 aa, Pseudomonas aeruginosa
WSASRSETPTKWTSPAFAGSVGTHAYSAGRRGRFRRAAPAPGAARRRTRTAPHRAPPAGRCACRRTLAGARPGAACGKAGQLRLARRGRPADQCRRHHEPRRGEHGSRPGQRRANTLRPRCSPWGEGPADFRAGRRCAPGRGLPRQQGGGRPPPAGTGHPGAGAAPVPAAGAGRRQQRLAGTPVAATADSLAGQSRAPATAACRGPGRRGAGLAAPLAGAGAGDSAGGSAGADPGRAAGRAAPRPGLAARPLCGAARGASRCVGRAWPACWLADTESIDAEAGAPRQPGRPGTPRCGLRLSLRAAGQSPARLAAGGTQPGGADAAADAGGPGADLAGYPGRLPGAGLRLGPADPRRGRHPRLAGEPGGDRRGPARRCARRRPAAPPLAPARAAGAVLADAWLQPGDQPDPAALLVRPLHGGRQEHRADGGHALAAGRRTSSQGGPWMNLYLLLKTLHILSSTILFGTGLGSAYYALRAWRSGQLPVIAVTFRHLVAADWLFIATTAVFQPLSGLAMVHVAGWSLAQGWLLWSLGLYVFAGLCWLPVVWLQIRVRDMAEAALREARPIEPLAYRYMNAWFILGWPAFIAFMVIFYLMVNKPV

SEQ ID NO: 27785 - protein, 333 aa, Pseudomonas aeruginosa
SIESPARHSAVTRATITTGRSEPGAGAVWGILGPPWRCPSDGALVSGSTQGNDRPAAFFRLGAQARIGVDGHRPADLLQQRQVVQRVAIEAGAFQVQAVLVEPALQANHLAALEAGHVEGLPGVAAVAHLALGGDQGLHPESFGDRAGDEAVGGGDDHQPVAGGAVLGEQRLALGQHDRLDHFLHELAVPGFQLGHLGATEDRLGEGLVGKDVELAGHVVGIEGVVARLVFGGVDQAALAQPFAPAMVAVAGEQGVVEIEKGQTHGVTPSVGGWREGRESLLRRLPPGLGKTPSLPAFAGPVSSPHESQSRALPLSQALWNNAGTCDFEDVPA

SEQ ID NO: 27786 - protein, 84 aa, Pseudomonas aeruginosa
RNWPRAFWRGTEHGDKAPSMLNTLRKIVQEVNSAKDLKAALGIIVQRVKEAMGTQVCSVYLLDTETQRFVPMATEGVNAHQRQG

SEQ ID NO: 27787 - protein, 551 aa, Pseudomonas aeruginosa
  UNSURE (152): Identity of amino acid at the above locations are unknown.
PPPTVGVAGGLPAARIAVRWPGRTAGLAGPATVPAHARAAGVRPGTPEWGWWRLVGKLRRRFLLLFLLFLLVVRRLFRGRWFQRRRRCLGQLVMGSRSFHSETRMSAITRYLAMLRLFGMLLCAAAIPSVATATVPVTVAVAASDVEEEAVXASAVGAEAEAARDAGYESAEVPALARRVTDLTATLDAAERARLEASLAALDARKGAQVTILMVPSTYPDSIEAYATRVFEAWKLGRKGIDDGVLVLVAKDDRRMRIEVGYGLEGTITDIDAGRIIREYMTPAFRQQDYAGGLEAAAQRLVRLIDGEALPPPPRDPLEPGAVRQTLAIAFLLGALGGVALLVRPRAWYWTLGAVVALAAALALGRHWPAGAMVALAEMVAVLGVGFGALLKYSRGARWFFAILVLYAQGLFWAYSRYGLPVLHYGLAVPLSLGLTLLMLAGAWQGLRRGRRWAYLPGLLGLLLTLALECLLLLVDDPLNSIEALIILPAACLPLLIGCNFSAGGSGGGRRRGGDYASSSGSSSSSSSSSSSDSFSGGGGSSGGGGASGSW

SEQ ID NO: 27788 - protein, 734 aa, Pseudomonas aeruginosa
PARRAFRRQKFVRRPPTGAIRRAGESRVDRTQLISNVRSNLAGLGRGSLGVPVLLLAMLAMMTLPIPPFLLDVLFTFNIALSIVVLLVCVYALRPLDFAVFPTILLVATLLRLALNVASTRVVLLHGHDGHGAAGKVIQAFGEVVIGGNYVVGVVVFAILMIINFVVVTKGAGRISEVSARFTLDAMPGKQMAIDADLNAGLIEQEEAKKRRSEVAQEADFYGSMDGASKFVRGDAIAGLLILFINLIGGVAIGMIQHSMSFGDAGKVYALLTIGDGLVAQLPSLLLSTAAAIMVTRVSSSEDMGQQVNRQMFASPKALAISAAILIAMGAVPGMPHVSFIGLGALAGAAAYWIWHRQNKAKQVAEQEVQRQQELLPAQRAQEVKELGWDDVTPVDMVGLEVGYRLIPLVDRNQGGQLLARIKGVRKKLSQELGFLMPSVHIRDNLDLLPNAYRLTLMGVSVAEAEIYPDRELAINPGQVFGSLNGIAGKDPAFGLEAVWIEPGQRDQAQSLGYTVVDASTVVATHLNQVLHKHAHELLGHEEVQQLLQLLARSSPKLAEELVPGLISLSTLLKVLQALLQEQVPVRDIRTIAEAIANVAPRSQDPGAMVAAVRVALSRAIVQSIVGLEPELPVITLEPRLEQILLNSMQKAGQGSEDGMLLEPGMAEKLQRSLIESAQRQEMLGKPAILLVAGPIRSMMSRFARMAVPSMHVLAYQEIPDNKQVTIVATVGQN

SEQ ID NO: 27789 - protein, 284 aa, Pseudomonas aeruginosa
RSRSCCRTPIEPRRLLRHPQRHAGQPPVQLRRPVAGRRTWIAGRHQPQSQRTDPRPARRTFPGGPGGCHRQVAGARAPGAGVVLRRGTQPQGDRRGTGRQRIAGQPVAQPVRRAFARAPGRLAVGLNRPRPQLVTVNAKECVARPLGRALVCTEVYLDKNMKILIVDDFSTMRRIIKNLLRDLGFTNTAEADDGTTALPMLHSGNFDFLVTDWNMPGMTGIDLLRAVRADERLKHLPVLMVTAEAKRDQIIEAAQAGVNGYVVKPFTAQVLKEKIEKIFERVNG

SEQ ID NO: 27790 - protein, 760 aa, Pseudomonas aeruginosa
HVSGSSRMSFDADEEILQDFLVEAGEILEQLSEQLVELESRPDDMDLLNAIFRGFHTVKGGAGFLQLNALVECCHIAENVFDILRKGERRVSSELMDVVLQALDTVNAMFDQVREQSEPTPATPELLAALARLAEPEGAEPAEPVQAPPAAVPPAEPAAPPEAPAQSASSDITDDEFEQLLDALQGDEAPASAVAEAPAAPAGDEISDAEFEALLDQLHGKGKFVPPAVSAEPAQVPAEAVEPAAAAAGDDISDDEFEALLDELHGKGKFGDVPEAAGTPAAPAAAAPAAAPAEQGKAPAAAGGDEISDDEFESLLDELHGKGKFNGASEAVAAAAAVAKNIAAKSPAAKPVAPAKAAAARPAAPDRPAASEAETTVRVDTARLDEIMNMVGELVLVRNRLVRLGLNSGDEAMAKAVANLDVVTGDLQMSVMKTRMQPIKKVFGRFPRLVRDLARNMKKEINLELVGEETDLDKNLVEALADPLVHLVRNAVDHGIESPEEREAAGKPRVGQVVLSAEQEGDHILLMITDDGKGMDAEVLRNKAVEKGLLERDAADRLTDLECYNLIFAPGFSTKTEISDVSGRGVGMDVVKTKISQLNGTVNVFSQKGSGSKIVIKVPLTLAIMPTLMVMLGSQAFAFPLVNVNEIFHLDLSRTNVVDGQEVVIVRDKALPLFYLKRWLVPSAAHEEQGEGHVVILSVGTQRIGFVVDQLVGQEEVVIKPLGKMLQGTPGMAGATITGDGRIALILDVPSMLKRYARRI

SEQ ID NO: 27791 - protein, 308 aa, Pseudomonas aeruginosa
STGCRWPWSRPTWRTRCTGSTTSAGTWSRRASKRACRNEETAFDGHPRDDLRAPSPSREDALMDVLSLVGIILAFVAIVGGNFLEGGHAGALLNGPAALIVIGGTLAAALLQTPVNVLKRGLGMLGWVFFPPREDLSGGIDRIVSWSMTARKEGLLGLESIADAEPDPYARKGLQLLVDGAEPEVIRSILEVDLFTQESRDLQAAKVFESMGGYAPTIGIIGAVMGLIHVMGNLANPAQLGSGIAVAFVATIYGVGFANLLLLPIGNKLKTLVLRQSRYREMLLEGLLSIAEGENPRSIELKLQGFMD

SEQ ID NO: 27792 - protein, 300 aa, Pseudomonas aeruginosa
PEPSMQRRRRHQEEHENHERWLVSYADFITLLFAFFVVMYSISSINEGKYKILSETLTGVFNQPDRSLKPIPIGDERPRTTEPERTSVEEQPSDNAASADSLERIADSVRDAFGDLIASDQLSVRGNELWIEITLNSSLLFPSGDALPNDAAFDIVEKVAKILAPYKNPIHVEGFTDDVPIHSPRYPTNWELSAARAASIVRLLGNDGVEPSRMAAVGYGEFQPVADNASAEGRAKNRRVVLVISRNLEVRRSVSGVGSGKAQPDSALRHAGSAAGTQAADTGGTPAPAPATVNSPSPSP

SEQ ID NO: 27793 - protein, 263 aa, Pseudomonas aeruginosa
TFPVDAWLSPRSFQESPSMPDITQAAIVTGASRGIGRAIARRLAADGFAVAVNYAGNQTMADEVVAEIVAAGGTAIAVQGDVASPEDMDKLFEATRSAFGRIDVVVNSAGTMPYLKIADGDLEGFDRVIRTNLRGAFIVLGLAARHVERGGRIIALSTSVIARALPSYGPYIASKSGVEGLVHVLANELRGQDIRVNAVAPGPVATELFFNGKSAEQIDQIARLAPLERLGEPDEIAAAVSFLAGPDGTWVNSQVLRVNGGFA

SEQ ID NO: 27794 - protein, 132 aa, Pseudomonas aeruginosa
SVAPCIRRASRNRPLCCRAWPSSLESPIFCASGRPAKRRSTAWRRLSGRSLRPFSPCRAANRPSREAWRALCPASCWPSASWSRRPLSGRKSICWLFFTSAVSRLPTGSAWGESRLSLLPASGVLSRFSRTR

SEQ ID NO: 27795 - protein, 214 aa, Pseudomonas aeruginosa
PPTTACSRCPPATASWTSVRSRRPAARRSSRRWATRHEQRLQPAPGARGAPAVPPTGGAGQSAGVLRHRHRPVPPGGRAGEPIATNLVARPGLGGGAIGRAALAGRAVPQRFRGRFSGAVGPFAAPPGSSGAGQGAGTLAVFRAGPGPDVAAVRADAGPAGPLHTGAAAFPVARYAGAEPARRRRRGLDRGPQARRPVAGAADPAAVHPGADSR

SEQ ID NO: 27796 - protein, 272 aa, Pseudomonas aeruginosa
PGLAAEGLPGISKEPCKQSLMMNWTWFHKLGSPKWFYEISGRWLPWFAVAAALLIVTGCVWGLAFAPPDYQQGNSFRIIYIHVPAAFLAQSCYVMLAVAGAVGLIWKMKIADVAVQCAAPIGAWMTFVALLTGAVWGKPTWGAWWVWDARLTAMLILLFLYFGIIALGQAISNRDSAAKACAVLAIVGVVNIPIIKYSVEWWNTLHQPATFTITEKPAMPVEMWLPLLIMVLGFYCFFAAMLLVRMRLEVLKRESRTTWAKAEVKALVEKAR

SEQ ID NO: 27797 - protein, 560 aa, Pseudomonas aeruginosa
SAGQARRELHAAGSHQGAQGQRPTEALRERQGRRRDLVQPGGQVDDPRTRPPGPDPRPLPGPGAVEPAAGRRLARRPPVDEPGAPGGLGAVRLPRLRLRLPDLGLPARRLLGGLRGRQLQQRAALVLQVQRRLGRPRRFAAALGADPRWLDLRRVDLLPATAGGHAGPRAGGDGHDQHRLPAVPDHHLQPVQPPAAADPDGRRRLQPSVAGRRPDRPPADAIHGLRRIFGGFRVRHRRSARRPPGRRMGALVAAVDNGSMGFPRYRHRARLLVGLLRAGLGGLVVLGSGGKRFLHALAGRHCTDPLAGGDREARRVQELDRASGDRRFLPEPAGHLPGPLRRAHLGARLRLRPGARGVHPRLPAAGGRRLADPVRPARAGGQEPGRLRPVVARDPAAAEQPGAGGGGLDDPPRDPLPAAARCPQRRQAVGRPAVLQRHVPAADGGADGGAGGRRAGALEGHPEPLAARHADPGAGGQRGPGGGRFDVLRRFQLGGAGGVPAVRLGGPGRFPRLPRQDPAQGRAGRRPQPDPQLLGHATGAPGHRRVRHRHRPQQPVQRPA

SEQ ID NO: 27798 - protein, 392 aa, Pseudomonas aeruginosa
RCLGGARARQAVRPLDLVRWPADGPRGRPGGARPALPGEGENTCARGPGPPRSGSLSLETSDSAAAAGDLPDRRGVPLPRPLAGPQRAALGADRQAVPGLRPAQRAGPGPAPDRGRPQGQAGAGQRLGHLVPVVPGRAPGTDPTGRAGRGDLRDQLQGRQRRRHQVAERAAQSLPAEHQRRRRHPGPGPGRVRCAGNLPDRQTGHHPPQDRRGGRPESLARATGAAVPATAGRAGGPMKRFLATALLGLALCGVARAAIDTYEFASDAERERFRNLTQELRCPKCQNQDIADSNAPIAADLRKQIYGQLQQGKSDGEIVDYMVARYGDFVRYKPPVNERTWLLWFGPGALLLFGVLVIGVIVLRRRRTAAKVQTTLSAEEQARLANLLKNDK

SEQ ID NO: 27799 - protein, 150 aa, Pseudomonas aeruginosa
GSTRSAGNGPGRSPRGGTGRWPGLPGKPGRRGRAGTARSGRRASRPARRAVRRRIPPGPPARRWRGRRSPGRCRTAGAGAAAGSIASRNGCRRSVRWRGPGWRACRCPGTGCASVFAPRWVFAGSGLRLFHPPRQGAQPQRVIGPPVPRS

SEQ ID NO: 27800 - protein, 464 aa, Pseudomonas aeruginosa
QSEDNDMSSSPAPESALKPTLGVFDVVAITVSAVTPASSVFVIAPFAIQQAGTGAFWAFALAGVLALMFAWCYAELGRAHSTAGGEYVYAKRVFGGLAGYATFLTVLAMLLFIPPVLATGAATYLNAALGTHFDAQTVALAIVAFSYLLGILNIRVNAWVTGTCLLLEVAALLVIVGLGFGHVQQPASVLLQPQVVGDGGLLAIAPWALVIGAVGTALFSYNGFGGAVLLAEDMKDGGHSVHRAVLWSLALVVLIEIVPLAALLIGAPSLPAMLASPDPIGYLLNSHGNETLSRLVSAGIFLSVFNAIVAIVIQSARVIFSSGRDALWMPALNRAFTRIHPRWESPWLATLFLAIPSAALSFSSNLAELTSFTVLLIVMVYLIVALCALFSRVLRRDREHPYRMPLWPLPALPALLAVSGAGYLLLNLFLAASARDVMIIVGLLAVSVILYCTYGKLSPAFQKL

SEQ ID NO: 27801 - protein, 184 aa, Pseudomonas aeruginosa
NRSPHARSTTWHHPRPGHSRPVQRDHRRSRRARRPQHPEPADRRQAGSHRRHPGPAARRCGAPATLLRRLPCAQRQRRRHGPGVDPRSRPADHPDRHHQYPQRRRGARRADRRGARRTRRQRAVLVHAGGDGDLRRPAQRYLGPACRRPPGRRGAGLRRVRTGPRRFGGRRHRDDLPRVQGWHR

SEQ ID NO: 27802 - protein, 229 aa, Pseudomonas aeruginosa
RIAAAAGGAGRLDGGRAGPGQPRPASRAAGRWLSGRPPAGRHPLAVQRGRHPGHGLHRGDPGHRRAAAAAPVPAPGAARLDRHRSHRRWHRGLQRRRVPRLRHRQPGPAASRLCAQGPAAEHAAADAQQRPHLAVVRRGGGGGGRSHRQRAAGRRGHAHRGRPAGARAEGGDAPGGAARDRLAGTLKAAQRQPRVRATASLKRTCQRRAVPASTRGWNSVRVLRGSASS

SEQ ID NO: 27803 - protein, 330 aa, Pseudomonas aeruginosa
KRNSQSINRRAATGTAPVCLRGCPRGESGLRGAQGGFVDFHPRLLQGFPEFPGRLAVDHQAVDPAQREDLEQGAPAELRGVGDNRQLAGLGDHGTGDLGFLDGKIHGAIAVQRADGDHRMLGVEPGDLLDGQGADVLFGFRAVLAADHECTVAGGADAAGDQQRVGDHRQMALARQFAGEQQGGGAGVDEDAVTGPEQAGGVAGDCAFFLGVLVHSRLEGVLVLAAGRQGGPSVEFADQALFGQRGEVAANGFLRGGKGPRQFVHRDPLALAQQFENVAAAFLGAHRVLPWAASWCGDCYRESPGSAWRRWAEGGGARLCAGPAENPTGP

SEQ ID NO: 27804 - protein, 470 aa, Pseudomonas aeruginosa
GRYALGLAAYLTVWVTNLGKTNLQINTKTKLWHAKCECSLRRSDRRGRPPDQTTRRTHPATGACRGENDADGRVRKLCDLPDHAGCGTWRAGFHPAPGKRSGPRVRQRHPRHRSGVPRPGRHHGSHSLSVEGDFPCPRPVLPDPRFRRIHRRAVDHRGGHGRLPVGRCPDRQPRHVDYRHAGGLHLRRDHRLPDPGRPDHARAQGPQVPGAGGDGRVDQHSVRGAGGVAADYPQPHPGARTGIDRFAGPALPVAGLPRHASAAGAAVRLLLPAGRRPEVPGDGDGHRVPGIRQGDGRVHQDGPGAFHRPALHRSLHQGLRRLGLRPDVRRRERVVPRHRDRWLHRHHAGRDLPHLLPVPALLQAPDGGPRPLPGAVPAGRHRLCHGTGEHHRHLPPVQIHECSRQGALRGPGRLRPGHHRRSPGIHRQLPADADPADPARQIVRRPAGGIHRHPHLGACRRALCPAGAGA

SEQ ID NO: 27805 - protein, 149 aa, Pseudomonas aeruginosa
RGGKKRPARSLKHPPTSAASHRGVAFRNEVTMRKIFLACPYSHADAEVVEQRFRACNEVAATIVRAGHVVFSQVSMSHPINLCLADLDRAAIGRLWAPVDAFYMDHLEELIVLDLPGWRDSAGIRREMEFFEAGGQRVSLWSEVEHEFR

SEQ ID NO: 27806 - protein, 363 aa, Pseudomonas aeruginosa
TASRMKKPEARALPAFSSSGEGSVGAVDLVEYAAVDEVGLLHAAPVAKGLLHREEVDFREAVGELGEDLRVARAQVVVGGDGLAFVRPQVLQVGLGLGAAAFLLDHLVDHRHRRLGLGGHARVDHLEAASAEFAGDHLGFVLEGHQYVADLVLHEGSGGGAAAGVEHRYLLEQFADELLGLVLVTAVLQHVAPGGEIGIAAVAGGLGVRHHYLDAVLEQVRPVLQGLGVALANDEHGGRGERRAVVRQAGRPVLRHQAAVVGEGVDVGGLVHGDDVGGQTVDHRARLLAGTAMGHLDGDVLAFLRFPVFLEGRVVFLVEVAHHVVGDVEQGLGGVSGAAERQAGGQQGGAEQSFHRAVPLSML

SEQ ID NO: 27807 - protein, 165 aa, Pseudomonas aeruginosa
TGGLECPWPAWECAREAMVRQEGLSRMDGDAAPYFRPHPSERDKGGPTRMPGGTARAGPNSLLQRSPSGGATVSMRSMLVEPGQPNGTPAVTTTVSPRRAMRWARAMSRAVEQISSTCASCSLTTEYTPQATVSRRAVRRFGVRLRIGALGRSRAARRVELPDSV

SEQ ID NO: 27808 - protein, 275 aa, Pseudomonas aeruginosa
SGSASTWRTIFAIISTASRGYCPEAVSAESITASAPAPTAVATSVTSARVGAGEKRIDSSIWVATTTGLPSWRQTWTMRFWMPGTLSAGTSTPRSPRATMIASARSAIASMALTALGFSILAMRKALSPISPRASSMSSGRCTKDSATQSTPSSRPKARSRRSLSVSGLSCRTASGTLTPLRSDSSPPTATRVSMASLWQLTTSRRILPSSSSRLMPGSRAWMISGCGRLTRRSSPGASLRSRVKVCPRCNCTAPAAKRPTRSFGPCRSMSTPIG

SEQ ID NO: 27809 - protein, 555 aa, Pseudomonas aeruginosa
SPWLKFRRNRLAPASTRARISSRLRVAGPRVARILAFLSAVMSGLEDENGAEVVHVGAGRSGHQQVAEGLEIAVAVVVVELVADLQPGLFAAGMGAGRHQRAGVVFRAVDAVGVAGQGPDVRFALELGGEAEEELGVASAATVAAHGDGGLAAGEDHAGRRQRLAVLADLPGDAGVDLGDFPRLALQVAEDQRREAGRAALHRCCVEGVLWRGDQLEVAARQARVVGLDGFRARVGEPVEDVLRHVDGVAPEDRQGVGGGGRVADAGAGGDHRGLVAGNVGNRVGKDAGRPAGLGQATALDRREVLAHAVHLADGGAGLEQRLVHRLLVRQANAFGRQRKQCGAAAGEKEDHPVALVQAADQFQHATGDALAGVVGHRMGGFHHLDATALRAVAVRRHYQALDLALPVLLHHFGHGSGGLAGTDDDGAPAAIFRQVVGQHLVGMAGCHRGIEQLGEKGAWIGTHDRLRISCCRAAGRTGGRSVVDASIPQHPRRRELGNGSEAPGRRGRESPGRAFASFTPPCGRGRKRAAANTGVRRPFLSPSPSKRGSSLRAG

SEQ ID NO: 27810 - protein, 370 aa, Pseudomonas aeruginosa
RPARTADHSSRIEKLAMCSRPLISAEWSQLLPPMAAQVLNTCWALAVLGRFRFSSRAPARARFRSFWCRLMRKPGSKVPLTMRSPCTSRIREEAKPPISASRTLAGSAPLRAANSRASATAWMFSATMIWLATLAVWPSPLPPTRVMFLPIAWNSGRARSKLFGQPPTMMLRVAALAPTSPPETGASRYCAPVALIFSAKPLVAVGEIELMSITTLFGPTPSAIPSLRNSTSSTCGVSGTMTMMNSASWATSFGLARAMAPASSRSAGAASWWVERNRLWPAFCRFCAMGLPMIPVPMNPILAMRVSPGSVCRVAPRREAGASCSWVRIRRRCASSSSRGRLRWWWPACTRSRSSPGSRCGPGARRGSGS

SEQ ID NO: 27811 - protein, 652 aa, Pseudomonas aeruginosa
TAWTGWRRNGACLAPIVRSNVREAFRRGRGAARTVRASGKGRRSVEQRDGGRRVGAFLGQFLELVDGVDLGTHGDVGDALQDHLDHHRHLVLLHQFAGLGQGGADLVRVEHPDRLAAQALDHRDVVDAVAFQLGGVDVVEGQLHAIVHVEAALRLADQAQVGVVHQYVDIGQLELRADRQFLDHELEVVVAGERHHLAARVGLDHPQRGGNGPAQRAGLAAVDPVARLVDMEELCAGDLRQADGADVAGILAEELVHLFVDALRFHRHVVEVGLALQRAFALLAAFQPGGARLQLAGGLPFAGHFEECVEGGAGVGDDAQVGHEHPADLGRFDVDMDEAATFGIDLDAAGVAVGPAVADAEHQVGFQQGGVAVAVRGLQADHAGHLRVVVGDYAPAHQGRDHRDAGQLGEFAEALGGVGVEDAAAGHQQRALGFVEHGQDLLGLDPGGLRLAHREGLVGVDVELDLGHLYVERQVDQYRAGPVAAHQLEGLLEYIGDLGRFQHGGRPLGHRRGDAGDVDRLEVFLVQAGARCLAGNAENRDGVGGGGVEAGDHVGAGRAGGADADADVAGLGTGVALGHVRGAFDVTGQDMVDAADLLQRGVHGVDRGTGDAERGIHAFAAHHQYGGFDCSHSGHRFVPRSYTNCVQKLERF

SEQ ID NO: 27812 - protein, 217 aa, Pseudomonas aeruginosa
QLERNDHDHHQSGNRAGHYPPGAGGGARAVHRAPDHRGARCWRPPGGAAARGRRQHAATADRHRQGLGRRGPGQVVAAAGGGCAAAAFVHFRGEHPGPWQSGSGAGRGADSQRQGRGGRRGRYQRRYLGYRRAMRDPGRAGGRAGARRRLSLRPAHQDRAFAPFFRWRTPPSTRISVPYLQRGSFEARNSAALAISSGSPRRPGQSSPSAPGWPRDR

SEQ ID NO: 27813 - protein, 238 aa, Pseudomonas aeruginosa
ARRGGSERQRPKPAGALAGLPVGRAAFQDQAGDGFHRSVVVGVAELFLAGDDGNLPIEVGIGLGRRPDGEEQVMRVHRGELATVDPGLQAGDVALGLGVQFVEVFLRQVRRAVHDLAGEDLGGMRQLAGDADLRADVGGQGEQRVVFHAERRRRLQQRLDDAFQHAAIEVFLGLEVVVDVGLGQAGAGGDVAGLGRREALVGEFLAGGAEDQALVALADAGHQSLFFIAATAAGSRGW

SEQ ID NO: 27814 - protein, 392 aa, Pseudomonas aeruginosa
HPPGAPLKQGASEAEAREILTRRFICPIHFPVFGVFVRGIESPARTHPPSAGRAPGTERVTMSDSRLVDPFGRRITYLRLSVTDRCDFRCTYCMSEDMQFLPRDQVLSLEELYAVADAFIGLGVRRIRITGGEPLVRKGITGLLARLGQRAELEDLAITTNGSQLRERAAELKAAGVRRLNVSLDSLQRERFAAFTRSDRLEQVLDGIQAAREAGFERIKLNCVVQKGRNDDEILNLVEYALANQLDISFIEEMPLGSITSHRRELTLCTSDEVRAIIERRWPLTPSLARSGGPSRYYQIGDEPSRIGFISPHSNNFCGDCNRVRVTAEGKLVLCLGHEGALDLRELLRSHPGDRERLSAALVAALNLKPERHHFDAQEQVQVLRFMSMTGG

SEQ ID NO: 27815 - protein, 95 aa, Pseudomonas aeruginosa
SQRRTALSPTGRASRPIPPGWRRTPRPPMEREQLEWATLVVVMERRHRQALMRRHAAAMKGKRLVCLDIPDDYAYMQAELLHLLERKAGPFLRRD

SEQ ID NO: 27816 - protein, 252 aa, Pseudomonas aeruginosa
VVRTASGKKKPDEVRPEGRADRECRRSARESGVLGRRRVAAAQVAAVVAAEDVEQQVQHHRPDRGHGDAAMGDRLHPDRQAGKEVRAHHRHHAHADAYRHQQLVAAVGDVGLVEDLDAAGGDHAEHGDAGAAEYRRRDRGDQEGGLGQHAEEDQETGGGHRDVAAAHPGHLHQADVLGERGMGEGVQETGEERGAGVAEQAAAQFGRGDLAAGDLAQGEEHAGGLDEDDHYHQGTSTGSAPGRRSARRSAAG

SEQ ID NO: 27817 - protein, 149 aa, Pseudomonas aeruginosa
APPHIRVMCSFAVTSTCCWLALTSTLCSASRRMSFFCACSSIGPWWVIWRSSPPWANRPMSLPALITTFCPAVTCWFCRATLSTCSPAARVRLAGVAAAIPAGPLKAIAGLPPLLLPDSSLAPWPRSRTASWRVCCGAASCPTPWCSPA

SEQ ID NO: 27818 - protein, 241 aa, Pseudomonas aeruginosa
RMDRSLFLAGGSSPIRWRSEPHVTLAQPLPKVLARCLFREVADIFGSTENRSHRCTTGVPVNSPCDRRAPVVGAGGAGDFVGPGDLAVGEVHVFQVGEVGVARVLAVVHVVLDVDDDRVFQDGGVVVLLGAGGGGAVPLDLDLGQALAGGQGGQQQRRGLVEDLGDDHRLVHALAGRLAGLRVARDDHFVVEALDHHLVLVAFLVGVADRILGEGAGGDQALLGAGDGHIGGGCHGYVPCR

SEQ ID NO: 27819 - protein, 96 aa, Pseudomonas aeruginosa
VTASGINVGATLANGGLTLIALPGRGRISSAPLGATSDGSELSHGLTRRYLTTTNGGSEENPTLPDQSPGDRTYRERRRPPGCPAGTDDRHLSWPA

SEQ ID NO: 27820 - protein, 432 aa, Pseudomonas aeruginosa
AATEEAMSKTNESLLKRRQAAVPRGVGQIHPVVAERAENSTVWDVEGREYIDFAGGIAVLNTGHLHPKVIAAVQEQLGKLSHTCFQVLAYEPYIELAEEIAKRVPGDFPKKTLLVTSGSEAVENAVKIARAATGRAGVIAFTGAYHGRTMMTLGLTGKVVPYSAGMGLMPGGIFRALAPCELHGVSEDDSIASIERIFKNDAQPQDIAAIIIEPVQGEGGFYVNSKSFMQRLRALCDQHGILLIADEVQTGAGRTGTFFATEQLGIVPDLTTFAKSVGGGFPISGVAGKAEIMDVIAPGGLGGTYAGSPIACAAALAVLKVFEEEKLLERSQAVGERLKAGLREIQAKHKVIGDVRGLGSMVAIELFEGGDTHKPAAELVSKIVVRAREKGLILLSCGTYYNVIRFLMPVTIPDAQLEKGLAILAECFDELA

SEQ ID NO: 27821 - protein, 601 aa, Pseudomonas aeruginosa
VRPRSADHRWPDRRRQQRRPARRSGLPDPGPGPAAAGTRAQPEPGARFQPAAGHPARRAAAGRARHALLGSFATLRGHRLGTGRRPRRGRRALLYRRAAASPGRPGAAADIAGLVRWRRRAGRGAARRAAGAFRRQLRLGPAGALAAAAGAAPADRCGVPVRWRAFPRRADPQPGDPGRQPARGQRGATGREQGCPHARPGRRTTGETAAALSRPRRAFARGGASRRAGNAARHAPLGMGRGCNRASGRGDRHLPARRRVAGRGWAEARLAPQLGAQQVQRRVDVVPFDAAEAEEEAGLCRGFRVEGRQGADLQALLAQMTGDAQHIQRFATARREVDPGHRRQRFEPGAQVAVQAFQQAPATLGVFALQAARMAGEVAALDEQREGALLQGLAVPVDQLARRQHRFAQACRRQQVAEAQLGEEGLGKGPEVGHLAVPVEAAQRLQRTPVEAVLAVVVVLDDQRPVALRPVQQLQAPLQAHRHAQRELVRRGDVDQLGVVRQQVDAQPLGVHRHSAHLGAGGQQAGAGRRITGFLDHRQVAGVEHHPGQQVESLLGALGDHQGVPVALHGAVDRQVAGDRQAQLGVAFGFLVERRRALLQA

SEQ ID NO: 27822 - protein, 328 aa, Pseudomonas aeruginosa
RLEHAGTPGIEGKAALVGRAAGEAVAERCSLVHQTGLRFDACPARGRPQRTVGALRRRFPGGPAGDEGAAADPAFEEALAGEALVGFADGLARHFQAFGEVSRGWQAIAGGQATMEDRVAQLAIELADQVVAAVEDQLQFHGEIGYLVFLVIGSSWKPKAGLVLPHAAPLSTLAAANQPRRFAMTTRLEWAKASPDAYAAMLGLEKALAKAGLERPLIELVYLRTSQINGCAYCVNMHANDARKAGETEQRLQALCVWQETPYFTPRERAALAWTEQLARLSQGALPHGLLDELREHFDDKEIAELTLAVSAINAWNRFGVGMGMQAE

SEQ ID NO: 27823 - protein, 229 aa, Pseudomonas aeruginosa
APARSSVFARATVSRNGLACACNNWSNRGWRRRVAWSTRCAGTPSSRISGWCAASGGKRSRCSTTWPAASSRYSPKCSGAPWRRASKCRMTQARANPARRRRSVPARAARGSPGPGRRRGSMTGAGRTAAARAVRGRRDGGHRRAVHGYAVAASARSRCPTAVAGRRRTCWRARRPRGCGPGVAATCPPGWRCWRRAGSGRRSGAGRTRPVPGARGAAGHDPVRRAARR

SEQ ID NO: 27824 - protein, 277 aa, Pseudomonas aeruginosa
SPMQSGVRAPKRALIRAGISAWIRAMPRPASMALPSRSGRPRLPRRMALAAPISSRARATERHSPTRRAMPRPKNMPRPRVITGRAVSSETAPKLSAISPRMAFSSGPTAAMEGRRLRPTRTMAAISQRVRPGGLAEGMAISFREHHCACARAWRQIKIRRADSKKCAGQGVGADAGATLRVARLSAPCGAWPHSALKRIRLSLRARAWRSTMIGAQGLPEALTSALLLLFRSRRAWLRYSQRFSSFFSPAGLALCATSRAMRRSISGTSTLSSWPR

SEQ ID NO: 27825 - protein, 725 aa, Pseudomonas aeruginosa
ARPARPGWPGWESTCRRSAAAVGSSPAPAPTGANASRTSAARWGRRCWRPVCARAGCGRRTARGRCRCRRRAARDCAAWRSARRAEPAAGSEIGHRLEGLRLEVEGLAAGQAGQAVVVLHHFGFDQFVLAVDLQRYPGDSPQRTDVADLGGAVLGHLGTRQRHFVGAEQQVLVVAQLQAVGVAEEVVDEIAGRVLVDLAGRADLLDHALVHHHDAVGHFHRFFLVVGDEHRGQVDLLVQARQPAAQLLAYLGVEGAEGFVEEQDLRLHRQRAGQGDTLPLAAGELLWIAVGEPVELHHVEQLVDLGLDRGLARPLALGLHAQAEGDVVEHRHVAEQRVVLEDEADVAVAHVVLRDVLAMEHDVAGVRGFQPGDDPQQGGLSAPGGAEQGHQFAALDIQVDVVQGLEGVEVLADVTDFDAHGSFLVSIAFQSGHAGFAPLLEQKDDQRHQQQQAGDAEGGDMVVFVVEDLDVQRQGVGDTADMPGNHRHRAELAHRPRGAEHHAVDQAPLDVRQGHVPEHLPAVGAEQAGGFLLLGALLLHQRDQFAGDEGHGDEEGRQDDSGHREDDLDVVVAQPFAEVALGAEQQHVDQAGDHRRDRERQVDQGHQDALAAKLELAHAPGGGDTEQQVERHRDGHRDQGQLQRGQRVGFEDRLEEGAETLLQRLAQDHVERQQEEQGEDQPGQDDQGQAAAGVAAAGGAGGGSGNACTGHGALLTGFRCDAAAG

SEQ ID NO: 27826 - protein, 428 aa, Pseudomonas aeruginosa
VLRGDALAFLAVQVLQVRLGDLAGAFLLDHLVDHRDRRFGKDGDGGYDDLEVFPALFLLRQERLVLPGQQHVADLVVDEGDGRAAGASVEYRYVLVQRLHVVLGLLVAAVLLLRPGPGGEEVPARAAGGLRVRRDDFHAFLGQVAPVLDSLGVALAHQEHDGRGVGGAVVRQACLPVGRQQLAELVQFVDVAGQGQGHHVGLEPVDHRAGLLAGAAVGLLDGQVLAALGLPVLDEGRVVGLVQLAGRVVGNVQQLRGCGNRAGDQGAGECGQGETTKGHVQLLGVCCFDCSNGVLAERREHGASGAHSRPTAAVPVRMGYRTDVHGETPPVVQSGRVLQACLTAGCCRRNFSLRSICTTWPLCTVISTAPKRRPRRALWISRRMVASSWPSRLLRVALMGLCSCGSRCRVARRSGGGVRRIVSSGQYS

SEQ ID NO: 27827 - protein, 736 aa, Pseudomonas aeruginosa
KYCLRIFIGKVVIRRRSGPASPPGSVFRQRHGRQVEAQRFRRLRPSVPVALAEVAAMFAQEQRLVLMLDALGNHPQPHALRQGNDRPGDRGVVHRAGQAGDEALVDLQLVHRQPLEAHQRGIAGAEVVDGQVHAEDTQAAEQVEGLLEVLHHRAFGDFQLQVAGLQSGLFQGIGDPFLQAAAVEQPAGDVDRDELQLDAALLPLAHLPAGTLEHPVVQRGDQPAFLRHRDELAWRHQAALGMLPAHQRLDADDPPAGQVVHRLVVDAQFVVIQRMAQGRFHLDMGAGPGGQHAGVEGVGVTPAVLGLEQRGVGVLHQVVDVAGVFRVEADTEACADIDRLAVDVERRVETVEDALREARDGFRVVVLDEDGEFVAAQSRQQAALVELVLQALADLLEEHVASCMAEAVVDVLEVVEVDQQQGPGHRPVLAVLQRLLDALAQQHAVGQAGQRVVVGEEVQLVLRALDAAQVGEHPDVVGQLALVVAHHADVQPLRVDLAALAPVPDFSAPDVLLAQGQPQALVERLVLAAGAEDRRGLAEHVFGAVAGDALEGRVDVHDHRLGIGDQNALAGAVEYRRGLAQVVFLEPLQGDVAGHASVVQRLAQGVAEDPAARVDPAVVAVLVAQAVDVVEIVGQALQEVAVGLQHGGVLFGEQALLPGLDGVAEFLRSEADQRGVARRDEHPVGHQVPVPESVAHRFQGAVQALLAAVQFVVGLGLAAELAYQVEVHEPAGCGQE

SEQ ID NO: 27828 - protein, 414 aa, Pseudomonas aeruginosa
CPQVLSDKALITPKSPRGSVPPMWFNGFLDLSPWQLVAVTLVLTHITIVSVTVYLHRYSAHRALDLHPALQHFFRFWLWLTTGMNTREWTAIHRKHHAKCETVEDPHSPVHKGLFTVLRAGAELYKAEAKNQDTLRIYGKNCPDDWIERNLYSRFPIGGVVLMALIDLALFGALGLTVWAVQMVWIPFWAAGVVNGLGHAVGYRNFECRDAATNLVPWGILIGGEELHNNHHTYPNSAKLSVKKWEFDLGWAWIKLFSFLRLARVARVAPIAHRVEGKHSLDMDTAMAILNNRFQIMAQYRKLVIAPLVKQEVAKADESVRHLFRRAKRLLSRETSLLQDRHHVRIDSMLAHSQALKVIYEKRLALQQIWAKTSANGHDMLAAIKDWVHEAEASGIQSLKEFAAQLKTYSLRPA

SEQ ID NO: 27829 - protein, 551 aa, Pseudomonas aeruginosa
SGIQPGRRPAYLRRAQAPRRASRRTTRKGARAMLLDYLIMLVYALAMLGLGWYGMRKAKSQSDFLVAGRRLGPGLYLGTMAAVVLGGASTIGTVKLGYQFGLSGLWLVFMLGLGIIVLSLVFSRQIARLRVFTVTQVLEQRYQASSRLIGGVVMVAYDLMVAVTATIAIGSVTEVVFGIPRIPAILCGGGIVIVYSVIGGMWSLTLTDIIQFVIKTVGIFLVLLPLSIDGAGGLARMQEVLPAGFFDLGHIGLDTILTYFLLYFFGALIGQDIWQRVFTARSETVVRYAGLGAGVYCMLYGAACALIGAAARVLLPDLAVPENAYAEITREVLAPGLRGLVVAAALSAIMSTASGCLLAAATVLQEDIYARFLRPGTTSDIRLSRCITLLMGVAMLVLACLVNDVIAALSIAYNLLVGGLLVPIVGALLWRRASPQGAIASIVAGCLAVIACMARDGLARQLADRLRPAGQPGDLRRGQPGYPSCRQPASPAGMNPPRRAAPGAFFPPHGDAPCRTTIRSPSTPPIFHASPASRPSCACRRSPTRRRCRSA

SEQ ID NO: 27830 - protein, 171 aa, Pseudomonas aeruginosa
  UNSURE (10): Identity of amino acid at the above locations are unknown.
MRIPIPTTVXWETTPTPTARHSAGPSRKVCSTRCARCRSAFAARCIRRTTTLSPASAASAVIHMEEFVELGVEATLAEARRVVGDGPTYVSFDVDVFDPAFARGTGTPEIGGMTSLQAQQLVRGLRGLDLVGADVVEVSPPFDVGGATALVGATMMFELICMIAESAARSA

SEQ ID NO: 27831 - protein, 375 aa, Pseudomonas aeruginosa
LRPGRGWRESVGGPPRRGRRPPACAPRRSATGRASSAGLHVPPAVRGTRGRRRGPRRSAPGAGPARWGRSGRPTMVAFPRVRPRCRWTGRRCLRRRAGRGRRRGSRRSGPGCWRGACGWARWAACGGSPGVSGYWTPAHATGASRSLAGAAEGLPDLVDHRPEFFRRRFQGEQAAAGVAVRIQAGLLAQGGIEEAGGVGVAAGVEGGGGDLCGDLRLHQVVDETVRLAWMLGAGRDHQVVDEQHRAFLRYLETYRLARLGRAQGVADPGHGQAEATAFEVGDVALAVDVAQVRSQSVQRLGGAAYLARRSTTEVAALVVEEDRQGFVRRVQQADAAAFQALALAGVEQQAPAVGQRPAIGGFGLRGIDGQAYGTP

SEQ ID NO: 27832 - protein, 394 aa, Pseudomonas aeruginosa
QVGVGVGAGHAVFQAYRVRAAGGHAQGHGAVVQAPARRVRHVELRTEAAVGVDVRAEEGHGGRQGLEHTADRMAQCGVLLGILAGEDVVAMLVEQRDMHVQSVPGLARIGLGHEGGVHLVVVGDVLDQALEQHRVVAGLEGVVDVVEVDLELRRCGFGDDGVGRDALGAGAVDDVLEALDVFVEVVDGVHLHRLRTLAGDRRARRLRPAVHVLLVDQVELQLEGGDDGQFHLGEPGHHLAQDFAGVGEERLAFQFVHGHQQLRGRALLPGFHGEGAGDRVADPVGVADVETQAGTLYGGAGDIEGEQGSGEIDTFFEDFVQTVAFDPLAANHAIHVCNKEVDELDLGMFLEELARFSELNGTLGYRHDATPFLLKISIMRGVGYESIRKPVGCQ

SEQ ID NO: 27833 - protein, 489 aa, Pseudomonas aeruginosa
RTPTISLSSRLSVRPAARGRGNVESGCWGRTLNPEVFMTTKLDQLTSWLKERKITEVECLISDLTGIARGKISPTNKFIAEKGMRLPESVLLQTVTGDYVEDDIYYDLLDPADIDMVCRPDENAVFLVPWAIEPTAMVIHDTFDKLGNPIELSPRNILKRVLKMYADKGWRPIVAPEMEFYLTKRSDDPDYPLQAPVGRSGRQETGRQSFSIDAANEFDPLFEDMYDWCEAQGLDLDTLIHEEGTAQMEINFRHGDALDLADQILVFKRTMREAALKHNVAATFMAKPMTGEPGSAMHLHQSIVDVKTGKNIFSNADGTMSELFLHHIGGLQKFIPEVLPLFAPNVNSFRRFLPDTSAPVNVEWGEENRTVGLRVPDSSPENRRVENRLAGADANPYLALAASLLCGYIGMVEGIKPSAQVKGRGYERRNLRLPLTIEAALERMENCKPLEQYLGSKFISGYVAVKRAEHENFKRVISSWEREFLLLSV

SEQ ID NO: 27834 - protein, 385 aa, Pseudomonas aeruginosa
RDRLRHRPDTSTKMELPRMMKRFGKTLLALTLAGSVAGMAQAADNKVLHVYNWSDYIAPDTLEKFTKETGIKVVYDVYDSNEVLEAKLLAGKSGYDVVVPSNSFLAKQIKAGVYQKLDKSKLPNWKNLNKDLMHTLEVSDPGNEHAIPYMWGTIGIGYNPDKVKAAFGDNAPVDSWDLVFKPENIQKLKQCGVSFLDSPTEILPAALHYLGYKPDTDNPKELKAAEELFLKIRPYVTYFHSSKYISDLANGNICVAIGYSGDIYQAKSRAEEAKNKVTVKYNIPKEGAGSFFDMVAIPKDAENTEGALAFVNFLMKPEIMAEITDVVQFPNGNAAATPLVSEAIRNDPGIYPSEEVMKKLYTFPDLPAKTQRAMTRSWTKIKSGK

SEQ ID NO: 27835 - protein, 626 aa, Pseudomonas aeruginosa
IHPVAHARRFRAAHRGADLPRWPGHHRPAALRAADQYDVPVLCAVPAHERGAEHRLRPQAGRPAQGRDRRARGRDAQAGAHDPVRQAQAAPALRRPAPAGGPGPFAGQAAEAAAARRADGRAGQEAALADATGTGGDHRARRRDLRDGDPRPGRGHDHGPAHRHHAPGLHRADRQPDGHLRDPGEPPGLRVHRQRQPVRRRAGGGRAGPCGDRLSAAGEPDLHRPRHQHPRRGQAHHLRAAAGESDDQRAEAGQPGTRRAQLGPGHRLRHRLPWRPLGVLHQAGLRDDRPGLHGQRRAPRHPADLGPVGVHQLVRRQRRGTAVMKFANSLKKRMPTGRHAVIGVPFLWLFLFFLLPFAIVLKISLAEADVAIPPYTEIFAYADQQLQVLLNLGNYLMLTDDPLYIDAYLGSLKMAFISTLICLLVGYPMAYAIARSSQSSQTVLLLLIMMPTWTAILIRVYAWMGILSNNGLLNSVLMGLGLISEPLTILNTNIAVYIGIVYSYLPFMILPLYANLVKHDPSLLEAASDLGARNFTSFWKITVPLSKNGIIAGCMLVFIPAVGEFVIPELLGGPETLMIGKVLWQEFFNNRDWPVASALAVVMLAILIIPIILFNKNQAKELEGKV

SEQ ID NO: 27836 - protein, 157 aa, Pseudomonas aeruginosa
PRPGRPPALSRAATACPGGRCIRRRGRGCAGCGTDGRYPPAWVRALRPARRAPGAAAFPSGTGGPGRARSRGRGRGRSGSAHTGAEPRARRSARRPAPAGGPRRASRCGAAAWHGGTRRRRQPRRRPPRRSRSGCVSSILSPCCSAEHSADAVGPRH

SEQ ID NO: 27837 - protein, 366 aa, Pseudomonas aeruginosa
PNARTLEVFGQSRGAAMQDDPSTSPLTHSATLRRLLYEALDALGLDPTRVYRSVYRRIPLPPPTLGGRLVHDNAPLFWTELAAVTGDADIGLHLGEAMKPRLLDVVGYLLLSARDLEEALRSFVRFQHILSGGFAARLEVEGETARLILDINYLGYASLRQQIECLMLLFLKLLALISDDEFVAERIEFRHRAPPRLGEHRRLFGRLPLFSRPHDALVFSAALLRRPSRNANPDMHDVLTRHAEEQSRELSENRLLNRVRYLIELRLGEGYGLRQCAAELGLGSGALQRALAAGGASFRQVRDEVRRQRASEMLLAGRAIREVAKACGFAELSPFYRAFRRWHAAPPEQYRARLAKREEGYSTSGT

SEQ ID NO: 27838 - protein, 247 aa, Pseudomonas aeruginosa
YSFGGESLVVRVVPSMGRYCRHAADRLSRHRGGTLQWTMHINVNHPLLHRIVDELVDQGWSHQSIFMPERLTTRLAEECRTRAVAGDLTPAAIGRGDGQVIREGIRGDLTQWLEPGESEACDEYLGVMDSLRQALNASLFLGLEDFECHFALYPPGAYYQKHVDRFRDDDARTVSAVLYLNDAWLPEHGGALRLHLPQRQVDIQPTGGSLVVFMSAGTEHEVLPASRDRLSLTGWFRRRNESLLQLS

SEQ ID NO: 27839 - protein, 150 aa, Pseudomonas aeruginosa
KQETPMRVTLPCLGLAALMFGASASLMAADLPRTKAPEGAKVYFITPADGATVDKTFTVKFGLKGMGVAPAGVDMPDTGHHHLLVDLKEQPAMNLPLPMTDNIRHFGKGQTETEITLPPGKHTLQLLVGDKNHVPLEPTVESEKITVTVK

SEQ ID NO: 27840 - protein, 470 aa, Pseudomonas aeruginosa
RKRKKEAAGPPFSFPPDAALEQHAATDGTVDLLEFLQGQVRVLGIDVDHYVADLLVGLQVLAGNVDAVVGEDLVDLAHHAGDVGVDVQQAVLARVRRQGDFGEVDRGHRGAVVAVLDQLLRHFQADVGLCLGGGAADVRGQDHPVQATQRAGEFLVVGFRLDREHVDGGADQVLVLDRGGQVVQLDHCAARGVDQDAALLHRADFLLADHPLGGGQFGNVQRDDVGHAQQLVQAADLHRVAQRQLGHGVVEEHLHAQGLGEYRELGADRAVADDAELLATDLEGIRRALDPAAAMAGGVLFRDAAQQQDRLGQYQLSHRAGVRVGRVEHGDTAFAGGVEVDLVGADAEAADRDQFLRAVEDLFGQLGAGANADEVRIGDPFLQLVAGKRGLEVLDVGVAGGLQRVHGVLVDTFEKKELDLALVERGLAHLRKPVVPEEVAGKRTARSGSGRRWPAPATRRPEALSAGGVC

SEQ ID NO: 27841 - protein, 221 aa, Pseudomonas aeruginosa
MSYQHQYIDGTPIHFPLGKLVCVGRNYAEHAKELNNPVPTEPLLFIKPGSCVVPVSGGLSLPQERGSVHYEAEIAVLIGKPLSRKPNREEVLDAISGYAPALDLTLREVQAKLKEKGLPWELAKSFDGAGVLSPFVNADQFPDPTDIGIRLTINGEVRQDGNSRDMLNPIVPLIQHIAGHFSLQAGDVVLTGTPSGVGPLNSGDELLLELPGASRFETRVL

SEQ ID NO: 27842 - protein, 848 aa, Pseudomonas aeruginosa
HVHRVDPDFLHRVASLHHEQRGQAELADGFAHAQVVGAVQAELGNRVLLEGIHPQRNDQDVRRIGLDLPDRRLQRLAPGRPVAAGRQWVVEVVAGADAVALLVGVAEEIGVFEARIAVDRGEQHIGAVVEDVLGAVAMVVVDVEDRHPPGAPVEEGLGGDGGIVEEAIAAHVVGRGVVARRATERKYRARAVGEFGLAAEGDVGRTGDRLPGPGGDRRACVEGVVAEATVDVVRLRLPQAPGRPGDRQHVVAAAGGQPVLPGVLQETHETLAVHPADRFQAEVARCADFAEADGLHAVEDHVGAAGFFEAGGELAADQFVPAVVQAMVVAVDGQHVGLPGSVLFGEGHGRRLAAETAGMQRQVGEAGGEPGQADHQGQRREAGPQPQGQAQADGRHQPVAQQVARGAAAVEQQVAADHRQVHRGERHQRAEADHRGQGGEVDDHRQQGNHRDHQDRDHWRLEALREAAEHAPRQDAVAAHAVEDARHRGLRGQRRAGGAGDVGGGEEAGEELAAGRQHHFVGRRLGVLEYAAGEHQLAEDRQHGEQQAGADRGDDDGARDVALRVAGFLGQGRDRVEAEERQAQHRRAGHQRGEARLAAVADEGQAQVQRGDAGQVLDRHGDEHHGEDELGADDHVAHAGHRADADHVEHGDQADRREHEDPGRHHREGDVEEQADEQVVDHRQEQVVEQQRPAGEEADAGAEAEAGIGIGRAGDGIFLHHEAVGKGGEEHRRQGDQVGAGGTTAGDLGDYPVGGEHGQRNHVDQPEEDQGGKPEDAPQAGALGAVDVLGALAADEDAVVAFAGHVPLLAKCRIDPAGGRLGGPFLRRVNGRASGKPLGFPPGRWKWQ

SEQ ID NO: 27843 - protein, 374 aa, Pseudomonas aeruginosa
LAVARFPWALPAPFPRLRATPRGGRGSTLAIRFRRGEPCRRSKRDRNGQAGWPASAGASWPPAPRRSFLKLGPDLAAQRQGFRRAELERLQAVELVLRGVDRRVVEQCFLHEFLRADDGVVVLGEVGGGGDVLRAHHPVDEDVGFLDVAGVARNREVVDEQPDAFLRIDVFEAGALGVGAVEGAVPLLVHGDLAGGHALDGAVAVVHGQRRLLPEQQVEDLLRFPGVLGAFVDAEVVGGGNEQFLDGVQSHHLAFQLGWWFEERLPAFFQPAARHLRRIVAVAGGAPEIGNAVVVAGIEAKGPEVFLQIAQARQLALVELLQQPLLDEYFYETVRRHHHVVGAATGLELGQQRLVAVVGVEGGLDPGVLLELLQ

SEQ ID NO: 27844 - protein, 392 aa, Pseudomonas aeruginosa
VGRRCSFGEHPDGGGGNPHPHLRPRTVRAACAVAVLLAHAEARLSGHVQVVDGIGADIDDVFQHAFQLAVGGQFGALRADRQGHSAAARGRRGQPLAVRQAHAVGVGLALEEVGFADEVGDRPVQRRLVDVAGRADLQHLALAHHRDAVGHGQRFLLVVGDEDEGDPGLVLQALQLDLHFLAQLQVQRRQRLVEQQHLGPAGQRAGQGDALLLATGQLVGAALADLRQLHQVEHAAHGGVDLAARAALHLQAEADVVGDAHVREQRITLEHRVDRAAERRQAFHVFAIEADAAGTGLFEAGDEAEEGGLAAAGRAEEGEEFVGVDIQGHIVKGLQALAGGTEFHADPLDGYRAGHAEFHAVKQLLLLRFCGFWGPLHLLRFDNDRGAAGAER

SEQ ID NO: 27845 - protein, 337 aa, Pseudomonas aeruginosa
ERSGAARFHTAYRLYAMTIHAQTPEPFSMSRAFTPRRLLLAVLLVALSALVLLGQSFRVFDRAWFAVQEWRHADAWKERSIWLPDYRVRIEAQPIEGLNDDVSALTFDPDRRTLFTVTNQPAQIIELSLQGKVLRTIPLTGFGDAEAIEYISRGVYVITDERQQRLVKVRLEDDTRFIDAADAQQLSLGIGLNGNKGFEGLAYDAEGKRLFVAKERDPVRIYEIHGFPHTQADKPFAVHVVDDPGRDKRLFVRDLSSLQFDEGTGHLLALSDESRLVVELDTDGEPVSTLSLLRGMHGLKRSVPQAEGVAMDDRGVLYLVSEPNLFYVFSKDEPAQP

SEQ ID NO: 27846 - protein, 268 aa, Pseudomonas aeruginosa
AAGNRRVVGLLVAVQVAQFPVGRLDEQHRDVHPVEAFAVAAAAGTRRVFGVQAGVGEQRDVQLAGDAQDLFAVGAEGRVGHAVGAGMGVHLVAGDQAVEVDHSQQVGALAGVEGLDVGTRTAQAFLLGAETDHLEAVLQGDAAEVAGDLGEHRRARGVIVQALQGRATVVGVVVRAEYQELPAAAGRRGDDVLRTAVAGPGEVLATGLVAEAQARLHQFAGAGEAGGAAIAARVVGDQALQGLPGVFPVLIGVGTQRQRSTSQAYSDS

SEQ ID NO: 27847 - protein, 199 aa, Pseudomonas aeruginosa
ASRAGDLLPRELSPPPAPQTGREHGQGCADGTFSPDQDSPRSRHRAAVRRPARPGVLRLAQLADGRRGSGRARFQAGPPDRLAAAGAQPAGPAGQRLVAGAPGRLAVGPELAAVRRLPLSARLHLLAGPRRPPGAGPAPGRRRRDGGGRAGRADPARDQGGPGHGPARCGQLHRGGGTDGQQAALKRQRNGLHRPSPVL

SEQ ID NO: 27848 - protein, 425 aa, Pseudomonas aeruginosa
ERMRILLVGAGGFVGRHLLPALLAAGHELLLTARRPPVDAPAGVRWLALDLERLAERPDSFAWPAGVDLLINAAGTMSLDEASMARVQDSGARTLFDLAAAHGAKVLQISALGAGAHPDVAFLASKAAADRHLLELGIPALVLRPSLLLGPGGASSAWLERLSPLPLIPLLDNRARLQPLHVEDLVGAVLALLRRWPERAQVIPLVGPQALTQGELLDELRRAQGWPRGRYVVPPAALLDALGGLGRRAGWRTLSPSMLKLVRHDNLADPALLDAACGYRCAPLASRLLGWPQAARSLAALMRPLMLAALVLIWLGTLVACLGPGYGWGLRILGEAGIHGWPASLAVIAGALLDGALGVGLLLRRWRRRALLAQFWLMLGYSLAISLILPHYWYDPYMAVGKNIVLMVATLWLLGDEPRAREARG

SEQ ID NO: 27849 - protein, 408 aa, Pseudomonas aeruginosa
NGARPGRAPTYASARPGFASRCGSWAATTTCCAWSAESSTRRFFQGLARHREHQSQVVVRQVRGQAQLRIDPGLALGQLQAQARLAETGQQPLGTDPAFGNHAQRHDRLVAQLSFQSGAQWLRRAARLQRRCPLQAQLLLGAQAQLAFHLPGAAVAQQAATEGQAHAIQARVHPQLAIHRVVQLAQGQGVVRQRRQHLLLPVGQPRQRSRRFRRTDQPGADDEGQDRQRQVEQPAGIARHGIPPGRKKPHPCGVRFSRGAAIRRESALSACSWRSFPAAGYARRKRCTFPPGRAAWPSPRTASAAGECRGCARRGLPAPRAGWRWSCRSSRRLPTGAPGRSGGLRGNAPATGRRSRRPRRRPGRTPCPGRSGGFPSRALRGARPPGSRRRDGLPRCSTRPGASSGCAG

SEQ ID NO: 27850 - protein, 501 aa, Pseudomonas aeruginosa
KVDHRTVQPVQRIGQQRPGQDARAQAVQRAHVQEWPAHVTVRPADQLDHLDFVTAIFDVQADGVAHHQQEGQHQQDGQAEDEAFAELEDRAQALDPYQVELRLLHMRQLRELLAQCLQASPVDLLGRDRDHRRQRVLRQLLERFAQAGLFLQFAERLLAADQLGLDHVRQALDLLAQVLALIFAGLQVEEQGYLRRPLPGAAEPFDIVQQQREAHRQAQGDTHHQAGEEAAERVAEQPAQAVHQAGAMAFQVGAERAAPVGLLLARFLAGLAFRCALFGATGKIVGAHQASSSRSAMIRPRCRVSMRWRIRAIRARSWLAISTVVPRRLISSNTPMISEASRGSRLPVGSSASSRAGWWTMARAMPTRCCWPVERSEGNASPFSFRFTRSRAEATRLAISGLGMPRICSGRAMLSATVRSVSSWWFWNTTPICRRRKGICAVVMRPRSWPPSNSLPLVGRSIARMRRSRVLLPAPEWPVTKRISPRCTRKDTSCRPTWPLG

SEQ ID NO: 27851 - protein, 139 aa, Pseudomonas aeruginosa
PSCPRVAASSPACRWWWSCPRRSPQPPGSHRARARRRPATAAPPGAAGWPALPAAPCTARRCRPAPCAPRAWSGSARSGWWPRRRRRRSAGASRCRRAGRRRFPCGRGTGWPCLRRCWRWSWTVPAGGGRRSPAWSPAR

SEQ ID NO: 27852 - protein, 272 aa, Pseudomonas aeruginosa
SWSRTSSATTWPTARPRRNWTTPSANWPAASRCPPRATPTSSASSAPSVSTACRWTTWKASSSRSRDSASNRSGAPWPSTWTPTPSSSSAPARACRRNPCRHPPPSRPSNPAAFRSIDEQTYCESPRPPRRPGTAADHRWRMAQPAFRLSRRARPATDPGPGSARPCSTGWHPMSKAHGCSIPSPAAARCSSRRCRAAPAKGWPWIPTAKRWRPCATTSTRSSAAPPNWSSAMPCATWETRLRAPSTWCSSTRRSIRTCCRTPAACSKPAAG

SEQ ID NO: 27853 - protein, 492 aa, Pseudomonas aeruginosa
PAHDRVPDLPARLVAAQSAPADPVEPVLPPRADPGTAARTPVAGRWRLHRPRLGRPARCRDPAGAGAARPHRVILVALHPRSAARPAGARLGQRGAELARLLGGAEPPAARLPFRGQRQPRRGGRAPARQAPASAAVRGRLFAGRQRAAQVPGRNRWGLPAARRRRGVGAVPPGRVRRPHRPGLFPGLPGALHEGHAGLRAGQAAAVRRAGPGGRPGRPATPRSAGGHAHLLGLRRPGHRAAARLRRRQGLLSARVQPLLPAGHPHAEPDHPFQRRPLRVRPQPARSQRTGTLHRAGAARPRRSRRLRRRLSAPAHLLPGTTHPRLAGGPPAAALSWPASGDGRQNRNRLKEKGGRMELTLRHNPMLDDADCEAILAIHAAVGWDRRMPPAELRTLYQHSGYSLLAERDGRLVGLLRAEEETPIRVWLAEIAVLPGAQSSGVGAALLRRFAEDHRGAYLFTDATLGTEAFFRRHGIHIQQVLEKTLRDQSGT

SEQ ID NO: 27854 - protein, 379 aa, Pseudomonas aeruginosa
SPRAARSACNSSPASAQVVYQPLGVVGVIVPWNYPLFFSIGPLTGAFAAGNRVMIKMSESTPATGRLLKDLLARIFPEDQVAVVLGEVDVGVAFSKLPFDHLLFTGATSVGKHVMRAAAENLTPVTLELGGKSPAIVSDSVPMKDAAERIAFGKSLNAGQTCVAPDYVLVPSRRVEEFVSQYKEVVQGFFPRLSDNPDYTAIINERQLGRLRGYLDDAREKGATLVPLFAEGQQRRLPQTLLLNVSDDMKVMQEEIFGPLLPVIPYERLEDALAYVNQRPRPLALYYFGYDKAQQQRVLHETHSGGVCLNDTLLHVAQDDIPFGGVGPSGMGHYHGHEGFLTFSKAKGVFSKPRFNAARMIYPPYGKSIQKLVYKLFVR

SEQ ID NO: 27855 - protein, 200 aa, Pseudomonas aeruginosa
TGARAAPPHSYAAGDITTMSDTTLESAGLSRRSLMKVGLIGGAFLATAGVTASLTGCSAEKPASGLEKVRESDLPFLRALLPVMLLGAVSAEQMPKAVEGAIQSLDHNLARLSPEMFKLTQQLFDVLALPLTRGPLTGIWGSWENASGDDVRAFLSRWENSFIGLLRMGHSSLMQLAMMAWYARPEAWAHCGYPGPPKIA

SEQ ID NO: 27856 - protein, 248 aa, Pseudomonas aeruginosa
ECIHACTRSVRRGPRPRLENLQRLAPGRRPGAGGRRGRGRHRRRRRHHRGNPQRRRPEGAAGGRRPAEDQQRFQDAGGRRLPRAVPGRHRPDEQGRRHHHPPGPRRGRHHPDQLDQQLPHPGTDPAALGPGLRGQGPQRGGHGALVRENGAAPARGALGAAAECQQRRDPPGLREARLSLEGHPAQRPRLLEPRLLRHGLPGQRQAVDAGHHHPGDPRQGWRAALPSARQPAAAGRRQGDGPRMPGHG

SEQ ID NO: 27857 - protein, 579 aa, Pseudomonas aeruginosa
AAMSFLNLPVRTLVAACGLSLLSLAAHADSFRGNAHAPQQAAVATPHPAATVAGLETLANGGNAFDAAAAIAAALAVAEPYGSGLGGGGFFLLRQAGAQPTYRFLDARERAPKAAYADMYRRNGKVDPRLSVDGPLAAAIPGLPAALVELSSRYGRKPLADNLVPAIRLAVDGVSVDRIYRDRAAMRLEAMRKDPETARIFLDKGGIPDEWNLLRQPQLARTLERLGRYGRIGFYEGETADKLLTGVRAGGGIWSAADLRDYRVIERRPLEVKLANGRELISAPPPSAGGVALAQSLQMLEQLPWQKAEPVQRAHYVLEVLRRAYRDRGLLGDPDFVANPLPSLLAPDYLKRLAAGIDPRRATPSSALPEAPAWREGDHTTHFAVIDAQGNAVAATLSVNLPFGAAFTVPDTGVVLNNEMDDFAADTQGANSYGLAGSQANAVAAGKRPLSSMSPSFLESPTDFAAFGTPGGSRIPSMVLISMLQYFDGRPVGQWVAAPRYHHQYKPDVVEYEPRAFSDAEAAELRRRGYQLKRLERSYGNQQVLYWDKRSGRVDAASDPRGIGYSSLSLEAQAQPRPH

SEQ ID NO: 27858 - protein, 281 aa, Pseudomonas aeruginosa
YRETCHDPIPARQGRRRPGDRRFRTGRTDRSEKSPGRRRRHGKDSFRQGRRGARLEPSPASRGLPRRRHLRRRQPGRLRRPAAARRGDQFRPDPQPGQGPGTGDPRRTGEQAGGGDLPRRLAADLRRTGAGSYPDQLAVAQGRHQQRRRPLGGPGGSGGRQAGEQPQTRRHPGLQPSIHRNPRRLNGPRSRSGESRRCAIIALFCRSLSHDPAQLASQSQRRAPPARRPPVGLQQRGGCRRDAAECLRRRRPGGAGNGQRQAAGHRRAEPEQSHLRPPHFP

SEQ ID NO: 27859 - protein, 288 aa, Pseudomonas aeruginosa
YQARSRQIAAGSSHQHRPQPARAAFRQAVLPAGLRRFRPAARPGGRSLWRRAGGATGVRSHGTAQGRGARRPAAGAQARRRALEERLQRARRRGPGALRGQCLRRSAGVGRPGRERREVRGAGAGRAEDRLVLRPPHEPCAPGALRAGQAGPRPVQLYRWLGHPGRRLRRQRSDVRGRVRLRPRRRRAQRGTERRGGEGRLRRGRRVRGPARAEGRRRTLRRGDRRPAGLHQAQEGPEERRGRLPPSQRTGHAPAEQGRHPGQRLLLNAPARGRPAEHPDRQRPPSRP

SEQ ID NO: 27860 - protein, 644 aa, Pseudomonas aeruginosa
LAAGNRHARLPLENLHPRPQHGRRPRPLARHRDEGRRLQEADHRHRQLLHPVRARPRAPEGPRPTGRPRDREGRRRGQGIQHHRRRRRHRHGPRRHALFAAEPGDHRRLRGIHGQRPLRRRHRLHLQLRQDHPRHADGRAAPEHPGSVRLRRADGSRQDQAGQPRPGPGRCHGGGRRRLLLRREGRRVRAQRLPDLRLLLRHVHRQLDELPDRGARPVAAGQRLDPGHPRRPRATVPARRAPGRGTLPALLRRRRRQRAAAQHRQLQGLRERHDPGHRHGRLDQYHPAPAGRRPGGRGAVRPARHRPPVAQGAATVQGGAEHPEVPHGRRASRRRHLLHPRRTGPRWPAAHRRPHRAQPEHGRRHRPVGHHPDPRRSRAHLLQGRSGGHPDPDRVQPEHPLAEPGRRPRRGLHPQRRACLFQGRRAGRALRQHRSRRLRGEDRRGRRVDPRVRRQREDLRKPGRRGERHPRRRGEGRRHRDHPLRRTEGRAGHAGNALSDQLPEVQGPGQAVRPAHRRTLLRRHLGPVHRSRLPGSRRRRRHRPGAGRRQGADRHSQSLDQPAGQRRRTRRTPRRTGQEGLEAGRAACPPRQHRAQGLRPARHQRRQGRGTQQGAAGRLNRPATKKARSRAGLFHSRVRAPNGG

SEQ ID NO: 27861 - protein, 96 aa, Pseudomonas aeruginosa
SAWAAASRRCPTAPSPTARTCCCPVWCWASSWCSTASRWYGCAVAPSSSPWPSATRWPATSVAWTSPACTRPSCSRYRPRCTSAWTSPGRCSSRCW

SEQ ID NO: 27862 - protein, 184 aa, Pseudomonas aeruginosa
PLCAARPQATRPRPGRRRHRRGGRRTFAQAAEGRARRRALPQPGQRRAAALQLADRDRRAGSGGEEDRGGADHPLTPPGTVSGAPIPRRRRQAHRQPRRVRCSTPGARPHHRSRGKRRRPPAPGQPGSGRDARRAARPRHRAGRRRSASVRRRPPPAPTPRRAPARRPGWRTLPHPPVPGRPGG

SEQ ID NO: 27863 - protein, 173 aa, Pseudomonas aeruginosa
AAPRPPSPGNACPADGRIPPAGRPGSAPSSPSPRARGNRCCRAGTCPRCAAVCRRHPGRNPPARPYAWAAAPAPAGPAGTSPRAAGPVRAAAGRWRFRPEPRWPPTGNSQAVRPTDAGSQPCLQRRRRLHRRHGDLHHAVLAHADHAVLQLPPVVVGGLNSSGCPGLRLVNRA

SEQ ID NO: 27864 - protein, 777 aa, Pseudomonas aeruginosa
LSGARNAGHCRSARESPRASCMPPSARARRLTRKSRRGGGNNPSRSTRMRLPTNSMCRVFSFSTSDISIEAAASDEVTSTPSTKIRRGTRVTSSGPLSSISVSIRSGRQRPLRNNSPRTSWPSLRVFILRLRTAARDAARSWLSRVARVASLTNISPAWIRATIAVGSSSDKGAPGRVGSMRISMRWMKKPMSSCRRKSVSAIHSRELADPEPRAPTLASSVRGGTALIRLSGWRPQSSVAAVGTRASTRAGGATAWPPPWASKASQAPSNRQASCNDRQGNAEAGCAEAITDPLIVMRAPSPYTLPRPSAPFVGLAGKTPTSSRWRRLSRECRETGKEVSPGCVNLLDWNTPEPPTRTRHATSLPAPPPRRRLPDARRWPGQRRPRRHRQRTTRHRLGPGPGLRSPPGRPRTLAAGHRPPWRQRLRTGTHPGRLRPGGDDGRRLRRAGPGDDPRRQAGRPPRQRAGPDHRCRPAPGIRRPQAHAESRRSGTHRLVQRRLHPRRTEDPARHRAHPHDPPGQCAPGRHLRDPHPAGDHRPGEKPADQPATHHRPVPRDQARHPLPAPRPGHGTPTGEDPAPQRLPRSARAGIHPVLRGEQPEGTQAPHRHPPGPALRQRPALRPAGCRRQPDLRRDGHRQGPAPGGALRLRGRSGQELRDSPRCQRQPRPADPLRRRRPRRRAEGASLHLPRGKQLPSGGVPQRRRQPAVARRPGRRDQGLPRRRHRRPVQRPAGRRRAPARAALTQPDRRSYAGAGLMDTRCSRRRAVPCLSPVPAA

SEQ ID NO: 27865 - protein, 167 aa, Pseudomonas aeruginosa
SDAVGRARFTLGREIDTGGDLSHTTHPGLDALWLTEAVRLREEQAGPLEDSEAVRQALAQGGSLPRRILTRAHWLGRREGLLDAQRTWRQGSRLALALLLVLALASGAGLAFAALGDGQRPVNVLWALASLLGLHLLTLLGWGPRPARRRRGRGRARPGPCPTTKGS

SEQ ID NO: 27866 - protein, 303 aa, Pseudomonas aeruginosa
SVSVDQAVQRRRGAGIQLARHASGQVGETTGDDRVLHGLGHHHRVLGMGDGGVHQHRLATQLHGDRCIGSGANAGVDQHRDLGFLEDDAQVVGVADAQAGADQAGQRHHRDAADLGQLAGDDRVVAGVHHHVEAVLHQLLGGLEGLDDVGEQGLLVGEDFQLDQVVPVQQLAGQTAGAHGLDRVIAAGGVRQDGVAIRRDHIQQVRLVGILPDVGAPHRHRDDLRSGGLDGPAGLVQVLVLAGPHQQARAIGTAGDDEGGIGTGCLAHRMTPGWKGLRGRWKGSGARPSRRRWRGRSPRGRHP

SEQ ID NO: 27867 - protein, 326 aa, Pseudomonas aeruginosa
NSQRVLRGMGFLRAEKNRTLAGCGFREARRSGENPPFQLAHGVLFQLPDTLGGNVVLFRQVVQRGLLLGQPALLENVAAALVEAFQRLVQVGAGAVAPVGVFQLARRVVAVVFEVMRRRLVGALVVRVGGRVERHVLAGQAAFHLAHFAGLDPQALGDAMDFLVVQPGQALLLAAQVEEQLALRLGGGDLDDPPVAQDELVDLRLDPVHGEGHQANAHFRVETLHGLHQADVAFLDQVGLGQAVPRITLGDMNNEAQVRQHHLPRRFQVLLIEEAFGQFTLLFRRQQRNAVHRVHVGFQVCAWNQGMYRLQRSGHANPPIHETRAV

SEQ ID NO: 27868 - protein, 521 aa, Pseudomonas aeruginosa
RRGSRHGARGRTPRAGLRGRWDSVCRPARSGSCVLPLCEECLDEGVGLEGTEIVDPLADTDIADRQAELLGQGEDHPALGGAVQFGQGQAGQLHREVELLGLIDGVLPGAGVEHQQDLMGRRLVQLADHPAHLLQLLHQVVLGMQASGGIGDQHVDAAGLGGLHRVEDHRGGVGAGVLGDHRDAVALAPDLQLLHGGGAEGVAGGQHDLLALELQLLRQLADGGGLAHAVHPNHQDHIGLARDVDLQRLLHRAQQAGQLFLQRLVQRAAVGQLLARHALGQVLHDQGGGLDADVGGQQARLDVVEQVVVDFLAAEEQAGHAFADAGAGLGQSLPEAGEEARPGRRLADCRSGGQRRNGLGLGLGLGLGLGLGLGSQDRLGLRDGRLGPGRMLLGRRWLVTGERCFGNRRRLGRLGSGGLLPTWLFCQGLRHVIGRRALLGGRCLGDRLDRLIGRLLAGLRLFPPPAEQTFLFPALRGLLVVVGTKHECLYLKGAARDVAARKTDGYPSISSPDGAKGPAPQ

SEQ ID NO: 27869 - protein, 469 aa, Pseudomonas aeruginosa
PETPVAARKVQITMKTPARRRVGLLLASLCLPLFAQAAETQPTHEFSLDNGLKVIVREDHRAPVVVSQLWYRIGSSYETPGLTGLSHALEHMMFKGSRKLGPGEASRVLRDLGAEENAFTTDDYTAYYQVLARDRLPVALEMEADRMAHLSLPADQFKSEIEVIKEERRLRTDDNPNALAFERFKAAAYPASGYHTPTIGWMADLQRMTIDDLRHWYESWYAPNNATLVVVGDVTADEVKTLAKRYFGEIPWRQLPPARKPLELAEPGERRLKLYVRTQLPNLIMGFNVPSLGSSENPREVNALRLIGALLDGGYSARLASRLERGEELVAGASTYYDAFNRGDSLFVLSATPNVQKGKTLEQVEAGLWKQLDDLKQNPPSAAEIERVRAQMIAGMVYEKDSIAAQASSIGQLESVGLSWKLIDQDLEALKAVTPDDIQKAARTYFTPSRLTLAQVLPVKAEEKEARHE

SEQ ID NO: 27870 - protein, 801 aa, Pseudomonas aeruginosa
TADVRPAPDLRRRQQPGRRHPRPVDADQRHAQRRRAGQGHHCHRRRLRGPRRLVQQRLLPRHGGGRPAQPVRCRQADPGAEAVRTGDRPADLPRGRSGTHQEPGPGRFRVPEAEPRQAGRPGAVQAPLWRASLRALQRRRRKVRSTDQPRTVAGVPQEGLRRRQRGHRAGRRPLAAGGRSDRRGSLQGAAPGPGAGQDRPAGNAQARPDAHRLPLRADPPDARPAWHRPPGSRLRGALPGQPDPRRRRLRHPPDGPGARKARPDLRHLFRLHRHAGTRSVHDQLPDPRRTQRGGAEAGPGHRPRLPGQRPDPEGTGRRQARTGRQLPAVHREQRRHRRPARRHRFLRPAAGLPGKLPQAGRGTQRRTGQERHGQAPGRRRLRHRQRRPERAAETPAATHRQAGPATQRRSGALMSKPTAKAPGRHGGQGQLRIIGGEWRSRRFVFPDGPGLRPTPDRVPRDPVQLAGTLCRRRTGARSLRRQRRAVPRGVVARRPRRAGPGYQRRSGGGPAQPPRRAQVRHRPTGPRRCRALPGKPGSERLRPGVPRPAVPSEPAAGRLPPARNPRLAEPRRLDLYRERERPLVPRPARKLAAAPGKESRQRTLRALAAGSLRMSPASASIRQRLLALGEPCAAQPAADWQGDIALPAELERFYREVGPLDCTLESAGNPFFLPSLARLWQRQAGYRWHGISGERLSGWQDDWLVVADQGADPFILETGSGRILFDLHGGRGWDPAPCFDDLWQMAASLVCFGEVWSGAGEDILLDDCSVAPRYRQQLVDELQPILGSRQRAEDLADEFGW

SEQ ID NO: 27871 - protein, 344 aa, Pseudomonas aeruginosa
AGGHTTTAHDLRMTASPTFQPAWWLPNPHLQTLWSPFFRRGPTLERQRERLWLADGDFIDLDWAGPHDAETPLVLALHGLTGSSSSHYILGLQRALLERGWASVALNWRGCSGEPNRLPRGYHSGVSDNLAEVVAHLRARRPQAPLYAVGYSLGGNVLLKYLGETAGDCPLLGGVAVSVPFRLDECADRIGLGFSRVYQAHFMKAMLAYVQDKQRLFGEQGQAEGLAALQRLGPLEGMRTFWDFDGRVTAPLHGFADARDYYRRASSRYYLPDIRTPSLIIHSSDDPFVFARSLPDRSELAPCTELELHARGGHVGFVDGSPRQPTYYLERRIPDWLEARLRQH

SEQ ID NO: 27872 - protein, 168 aa, Pseudomonas aeruginosa
RCGTTRCSTTPTARRSWRSTRRSAGTGACRLPSYARCTSIPGIPCWPNATAAWSACCAPRKKHRFASGWRKSPCCPAHRAAASAQPCCGASPRITAAPTCSPTPPSVPKPSSAATASTSSRCWRKPCAIRAARRAARKSRPPHPGPAPRCARSPAPAPGRCRDAVAPR

SEQ ID NO: 27873 - protein, 536 aa, Pseudomonas aeruginosa
PESAFMPVPDLFAEGLARGWKTYNGSRLDDDLELEADVVVVGTGAGGGTTAEILSAAGLKVLLVEEGPLKTSSDFKMQEADAYPELYQEGIGRMSKDGAITILQGRAVGGTTLINWTSSFRTPEPTLQHWAQVYGVKGHSAEDMAPWFEKMEQRLHVAPWALPPNANNDVIRLGCEKLGYHWKVIPRNVLGCWNLGYCGMGCPVNAKQSMLVTTIPATLDKGGELLYLARANRLLLDGDKVTGLECLGMDERCVAPNGRRIRVRARHYVLSGGGINTPAILLRSKAPDPSQRVGKRTFLHTVNFSAGLFDRVINPFYGAPQSIYSDHFQWDDGVTGRMSYKLEVPPLQPSLASVLLGGFGSDNALRMEQLPHTNMMLALLRDGFHPDSAEGSVGLRGDDTPVLDYRMTDYTWDGIRRAFHTMAEIQFAAGAREVRPVHSDARSAKNLQEARGIIDGLRLEIYRTRLGSAHVMGGCAMGEDPAVAVADSLGRHHHLRNLSIHDGSLFPTSIGANPQLSVYGLTAQLASALAERLARA

SEQ ID NO: 27874 - protein, 171 aa, Pseudomonas aeruginosa
TGHGHLPGSQPCRTTGRPFPGCRHNGPAGRLPRLKWRNRRLASRPGRTIPDWFRRLRYRWPPRVRTRSRPSPGPGRPLRLSSRERPFHSGRRHPPAPRPSGTSVPPRSCPVARRHHRDRAWPVGSARGPSPQRPPCPTIRARWRSSVAGRSRRRNRTEPAAPPSRRPGGGG

SEQ ID NO: 27875 - protein, 252 aa, Pseudomonas aeruginosa
ADLAQGAAADLAELPATAIDEQFLLEVTGLAVAADEIAQGGAAALDGDRQDPLDLLRQAQVARLGDASGGLARIDAGGEQRFAGVDVADPDHHRVVHDERLDRHAPPARQLEQTLAGESVGQRFRAEVAQQLVFQWRQAPEHGAEAPRIGVAQGHARGQLDVDVLVATGRGTALHQPQAAGHAQVADQRTGLGAQQQVLGAALDADDALSGQAHVQVFGNRPAQAPLAHDHALDALAFEVGGDAPAGGFDFG

SEQ ID NO: 27876 - protein, 232 aa, Pseudomonas aeruginosa
GRRRKLTVRAVYPENPAMGRASTGKAAPGNGHGTFPAAARVGMNTPSDIGRHAMTQSLHGKVVAALVTDGFEQVELTGPKKALEDAGATVRILSDKAGEVRGWNHHQPAEAFRVDGTFEDASLDDYDALLLPGGVINSDQIRSLAKAQELAIRAEQASKPVAVICHGAWLLISAGLVQGRTLTSWPSLKDDINNAGGHWVDQEVAVDGKLVSSRKPEDIPAFNRRFIEILAG

SEQ ID NO: 27877 - protein, 407 aa, Pseudomonas aeruginosa
SRSFAGAFPMTLPSLRLKANAERRLRAGHLWVYSNEVDVAATPLNAFAAGDQAVLEMANGKPLGIVALSPNNLICGRLISRDTKHVLDKSLLVHRINIALSLRERLFDKPFYRLVYGDSDLLPGLVVDRFGDVLVVQLASAAMELRKDEVLAALLQVLKPAAVLWKNDSSARDAEGLERYVANAYGEVPEWVALEENGVKFEAPVLAGQKTGWFYDHRMNRARLAPYVRGKRVLDLFSYIGGWGIQAAAFGASEVMCVDASAFALDGVERNAALNGVAEKVACVEGDVFEALRELKAADERFDVVIADPPAFIKRKKDLKNGEAAYRRLNEQAMRLLSKDGILVSASCSMHLPEDDLQNILIGSARHLDRNIQLLERGGQGPDHPVHLAIAETRYIKSLTCRLLPNG

SEQ ID NO: 27878 - protein, 617 aa, Pseudomonas aeruginosa
PQEIVMPDYRSKTSTHGRNMAGARALWRATGMKDEDFKKPIIAIANSFTQFVPGHVHLKDLGQLVAREIEKAGGVAKEFNTIAVDDGIAMGHDGMLYSLPSREIIADSVEYMVNAHCADAIVCISNCDKITPGMLMAALRLNIPVVFVSGGPMEAGKTKLASHGLDLVDAMVVAADDSCSDEKVAEYERSACPTCGSCSGMFTANSMNCLTEALGLSLPGNGSTLATHADREQLFLRAGRLAVELCQRYYGEGDDSVLPRNIANFKAFENAMTLDIAMGGSTNTILHLLAAAQEAEVPFDLRDIDRLSRKVPQLCKVAPNIQKYHMEDVHRAGGIFSILGELARGGLLHTDVPTVHSPSMADAIAQWDITQTRDEAVHTFFKAGPAGIPTQTAFSQNTRWPSLDDDRAEGCIRSVEHAYSKEGGLAVLYGNIALDGCVVKTAGVDESIHVFEGSAKIFESQDAAVKGILGDEVKAGDIVIIRYEGPKGGPGMQEMLYPTSYLKSKGLGKQCALLTDGRFSGGTSGLSIGHASPEAAAGGAIGLVQDGDKVLIDIPNRSINLLVSDEELAARRAEQDKKGWKPAAPRARRVSTALKAYALLATSADKGAVRNKALLDG

SEQ ID NO: 27879 - protein, 365 aa, Pseudomonas aeruginosa
IVPRRKKPGPAPGFFIHAYARRMADNRKRSFALPLTHAPTAGRIRHRRYPPTCGAARPGRDRVRPVKSRSFSPDRHHEFPAKPVGRQRPQRPGLWPGRPSQRSHRPARRPPAPAGDHRADRYPRPADLPGAGRIAARHQSDRVDVAGDLRHRHLRPVQALRPVRRRTVDRPGHQLQLRRPADRRRGADGQAGHAGGKRDGGDLRRGHRRLLRRDGHLAHTAVRQAADHAAGDRHRRADDRPDPDQGRPDQHGRRLLGDVQRHLRQRREPAAVRCGAGHHRGAQPHPGGMDAQLRHRHRPGRRLRAGRLPRSPGLHRHAPGRAVPGTDPAALRPGLLLAAVHPDAGDLPGHLPGSHRRRHRHQQGV

SEQ ID NO: 27880 - protein, 197 aa, Pseudomonas aeruginosa
ATGGRPAVDAADQGRRAGQRRQLVPRRYLQYLPQLSVRPEQRGDPAHRRGQPLRRPLDRRHAGPARPVPERRRGHPGGAGTGTGRRGDGDVRRGGRFGHQHPRRHPAGPPCPADHRRIPGPRPGRFAGAGVPRAHARGAAQRAGVRGRHRRHLRPAAELVPAGKPGPEGRTLIGAAPPPGGVAVFAEGFSYPANGWV

SEQ ID NO: 27881 - protein, 177 aa, Pseudomonas aeruginosa
STAWPCPSATLFRPATRTRAHAPVPPPVAHRPDRRHPWPAPARGAGTVARLRPVDPCRRHRQAGNPRRAGTPGAALGGARQQRHPGLGGGHPRARAAEDRPADLYVLHDLKRLDLDPAAEGIDVVVAGHSHKPLKEERDGVLYLNPGSAGPRRFSLPIGIGVLEVAGKKIEAELITL

SEQ ID NO: 27882 - protein, 503 aa, Pseudomonas aeruginosa
RPSAHALRHGPAAPRPGRRRGHRRPARRPATGRPVATTGRETRRQVARKPSPILLLLCERRHPIPCPGRPPLSLDWPGKRRRRHAGGDCHGNVAKRAKKYHLAASICWTGTLPNRRRGPVMQPAFLRRHLGAACLMLAAGLASAAHADTGNVQRAIDWAQGQASVRHPAGHERSPLVIAHRGASGYVPEHTLGAYALAVMMGADYVEPDLVMTRDGKLVARHDNELGLTTDVAQHPEFADRKRTQKVDGVELTGWFSEDFTLAELKTLRAIERIPTIRPGNARLDGTFEIPTLQEIIDLVKSLQISQQRTIGLYPEIKHGTHFQRLGLAMERPLVKTLHRNGYLGPRAPVFIQSFEVNNLKELKRLTGIRLVQLYGSGQPYDQQAAGGSLTYAEMATAKGLRQVARYAYGVGPDKSYVIPRDANGNLGQPTRFVGDAHAAGLKVHPYTFRAENSFLPAEFRSADGNPQSRGDLAGEIRAYLDAGIDGLFSDQPDVAVRLREQR

SEQ ID NO: 27883 - protein, 499 aa, Pseudomonas aeruginosa
LLDGKACGADGRVRGPGLAAADGVDDLHAVAILERGAGVLAARHDIQVQLDGHAAAAKLQAGQQVRDALRVGQLEGLAVQLNLHGWTVTKVKGSGILARSTPMTKAPCRQVRRLRQPVSGVAQAPGGQPQAQPAGEEGDAAERGDDAELADATEGQQVEAAGEQQDAQREQATRRAHQAAVQAGGEQRHAEQRQGVDQLVVHAGLEYRQVLGAELLLQAVGGERPEGHAGETEKCRQQQEGTKHGQDSGDSIQPAIMAAPFFQAKPRMLRSLFRRLFKYLLWFMAASVVLVAVLRWVPPPGTMVMVERKVGSWVDGQPIDLQRDWRSWEQLPDSLKVAVIAGEDQHFAEHHGFDLPAIQQALAHNERGGSIRGASTLSQQVAKNVFLWSGRSWLRKGLEAWFTLLIETLWTKQRILEVYLNSAEWGPGVFGAQAAARYHFGLDAERLSRTQASQLAAVLPSPLKWSAARPGPYVRQRAAWIRQQMWQLGGDDYLLRLER

SEQ ID NO: 27884 - protein, 303 aa, Pseudomonas aeruginosa
KLNAAVFPGPGAAPRASVASRRPAGARSGPVADRPRPRPGPVAGAGAAGRDWPAAARHRPCLRESCSAPRSACRPTVLPIRRSMAAARCQAATQMPAAGSVAPRRSGPARLPPARGRRRPAGGHGRPGARHPGAGPPTTRHPPRRAAGAGSRRCPPTAPAPAPASRPATATVAPVPAYGPARRRRRRSGPPATSRTASGYCAAWDSSGQKKTAPLRGAVFARRGDQARIRPFSLLMAFFSSCRIRSAETLYFSARSCSVAFSSDSQRCWRMSRLRSSRPSSASCRLALELSLQSASSNWRAGS

SEQ ID NO: 27885 - protein, 286 aa, Pseudomonas aeruginosa
TSRSSRSAPGSVSRGSCVPVRPLRGHGEDRWRSSGLILTVSDDPATLQGQHAMAHTGDQGQVVAGDQYGGAQAIDILEHTHDFRGESRVEVAGGFVRQQQGRLVDDGAGNADPLLLAGGKVGRQRLALFLQVHPLQGRGHALGDLRLGHAEDLQRQGDVVRHRTIGEQLVVLEHHADLPAQERDLRGSDAPQVLAAEQQLAAGRSLHRQDEAQQGALAGAGVAGDEEDLATVHAEGHLVQAYVAVGIAFADLLEADHAFSRSAKSAWTKASASKVRRSSIPSPTPI

SEQ ID NO: 27886 - protein, 135 aa, Pseudomonas aeruginosa
LMAFCPVPASSTSRTSWGAVSSSLPITRRTFFSSSIRLSLVCRRPAVSAISTSMPRALAACTASKITEAESAPVCWAITGMRLRSPQTCNCSTAAARKVSPAASMTFLPSSCSFFASLPMVVVLPTPFTPTTRIT

SEQ ID NO: 27887 - protein, 212 aa, Pseudomonas aeruginosa
GSRATSTCNGCSTGRSRLASSSCSALYSAPLSASSLRATRLVRFCTIRVVASTPTSAVSRRVSMSSSRSSSISLRPRNRLAMPSPMLALVLDSPCRRRAKKPGLVAGSLTAGAAASGATGSGSGSGSGSGSGSGSAARIGSGCATGASGRGECSSADAGSSLASGASATGAGSAGSAAEGCCRPGCSVRDCATSSAGARCSAAAVSETGSTG

SEQ ID NO: 27888 - protein, 503 aa, Pseudomonas aeruginosa
RPRKRRPVMSERTGLRYGLLGLIVIALLAALAYFVARPPQTPAAAHAAAVEENQLQSLKDIAKQAPVHRKLDIQEWKTAEGAKVLFVEAHELPMFDLRLTFAAGSSQDAGTPGLSMLTNAMLNEGVPGKDTTAIAAGFEDLGASFSNGSYRDMAVAGLRSLSDADKRTQALKLFEQVIGQPTFPEDALARIKNQVLAGFEYQKQNPGKLAGLELFKRLYGEHPYAHSSDGDEKSVPPISREQLQAFHKKAYAAGNVVIALVGDLSRQEAEAIAAEVSKALPQGPALAKTVQPETPKPGLTHIDFPSEQTHLMLAQLGIDRQDPDYAALYLGNQILGGGGFGTRLMDQVREKRGLTYGIYSGFTAMQARGPFMINFQTRAELSEGALKLVQDIVRDYLANGPTQKELDDAKRELAGSFPLSTASNADIVGQLGAIGFYGLPLDYLESFLKQVEGLSVEQVRSAMAKHLDADAFVIVSAGPSVPQKPLPPPTAKPAQQPSGVPEH

SEQ ID NO: 27889 - protein, 197 aa, Pseudomonas aeruginosa
ANLLRKPPAATAARDSCGSSVANGAAGVSSFPTGPACDRPRTGFRETLFNWLAPYVEGARVLDPFAGSGALFLEALSRGAREGLALDTNGEAVAALRNHLDALKCGTAQLVLGDAVRYLGNQAPSAFDLVFLDPPFHQNLLQDACRLLETRGWLNPDAWIYTESESVPSSLGLPGNWRLHREKKAGNVHYALWQRGA

SEQ ID NO: 27890 - protein, 200 aa, Pseudomonas aeruginosa
ARLPRAFANACWRLASLARRNPPPTGRAISPCPPSWSVSTARSAHSTAPWRVPATHFSCRPWPASGSARPAIAGTASAASACPAGRTTGWWWPTRAPTRSSSRPAAGAYSSTCMAAGAGTRPRASTTCGRWRPAWSASARSGAAPARTSCWTTAASRPAIGSSSSTNCNRSSVRASGRRTSPTSSAGKLVATPPPPMTCA

SEQ ID NO: 27891 - protein, 268 aa, Pseudomonas aeruginosa
EQAEGKRGANGTDAAAQPDARRRRLRGDPGDPRGGRLGPAHAACRATHAVPAFRVFPAGRTRRPPGRPAARRGRNTDSRLAGGNRRAARRTEQRRRRSPAAALRRGSPRRLPVHRRHPRYRSLLPPPRHPHPAGAGENPARSERHVEPLGNPVHRILGLRLDVPALQRQHLVDAATQLRLAEVAVEIEGGAEEAHPGGEDDPGVEGQGLQLGLVHPQDAGLGEAPVDRLGVDQATLGEGAVARRQLRVAFQQVLEVAMEEAVAPHRGQ

SEQ ID NO: 27892 - protein, 508 aa, Pseudomonas aeruginosa
RQTRGHAAAHASPRSQPMVADIAYLQQSQQEINQLEALFARQRAAYLAQPMPDATQRVQWLKALRDLLFKEQQALIEAIDRDFSARSADETLLAEIMPSLHGIQYAAKRVKKWMKPARRAVGLQFQPGLGPGGVPAAGRGRGDRALELSAVLLHRPADRGLRRRQPGDDQDERVDPGHRAPAQGPAGADLPRGPGRRGARRGGRRRGLFQAAVRPPAVHRRHQRRQARDARRRREPDPGHPGAGRQVAGDRLRQRADEGRRRADRLRQEPQRRADLRRARLRAGTEPARRGIRQPVQGGGPGLLPASFGQPRLHRDHQRAPARPPPGLSRRRPREGRDPRPAVRRRPATAPAADAAAERQRRHESDAGGNLRPAAAGDPLRAPGRRPGLRQPAPATAGPVLLRLRQGAAAARAARDPLRRCVSERHPAACRPGRHPVRWRRSLRHGPLPWPRRLPHLQQGQGRVQQAALQRRANDLPPLRQVDPEARLQAVRALNRGACGAPSFLRCR

SEQ ID NO: 27893 - protein, 338 aa, Pseudomonas aeruginosa
PTTPGTVSAVPSIPWRRSSSPPAPGKCGRCTATRVARRTCRRRAGSSTACAWRSTARAWAAPTSWAAAPWAKTRPWRWPTASAAITTCGTCRSTTARCSPPASAPTRSSRSTVLPRNWPARWPNAWPGPEPPPGRPRAAAAGPAPSDLWAKGRWPVRLGRTGIPALPSDSLTKPCQDVAMNRVLYPGTFDPITKGHGDLIERASRLFDHVIIAVAASPKKNPLFSLEQRVALAQEVTKHLPNVEVVGFSTLLAHFVKEQKANVFLRGLRAVSDFEYEFQLANMNRQLAPDVESMFLTPSEKYSFISSTLVREIAALGGDISKFVHPAVADALAERFKR

SEQ ID NO: 27894 - protein, 83 aa, Pseudomonas aeruginosa
MSLKITDDCINCDVCEPECPNGAISQGEEIYVIDPNLCTECVGHYDEPQCQQVCPVDCIPLDDANVESKDQLMEKYRKITGKA

SEQ ID NO: 27895 - protein, 414 aa, Pseudomonas aeruginosa
PRRHAPGSDAQGPGNRADLPRQGRNPRRMEPAPPTAAGTYPGTPRALRADRFLRRRDSGQAAHRGPRRRRHLERGRPARLPGDRTPPAGGEAGQRPRTDQRTAALGRRRRPGAEPADAGTAAVAEGRAGTARPLRAGGPAPCLPRSRPARRPGLRRQPAAQFAGAGLPEAPCRRHRPAPRHAQLGAAGGAGLARRRPHHPLRGDRCPGQRGGRHPLGEPAVRRRLHRSRYRRGAEQRDGRFRRRHPGRQQLRPGRQPGERGGGRQAPAVEHEPELPGKPDRLRRLRHPWRQPHPEHGADLHAAVLRRPPGRPMGRRAALPPPVQAGRRRVRTARLQRCRGRRTAPARLSAQTPGAQLRQPAGALLGQAQRPRRRRQRPARDRLLVSVPGGASAASAALNKRETALKKCSTISPR

SEQ ID NO: 27896 - protein, 166 aa, Pseudomonas aeruginosa
PWTSPWAARPIPSCTCWPPPRRPRCRSTCATSTACRARCRNCARWRRTSRSTTWKTCIAPAASSPSSANWPAVACCTPTSPPCTARAWPTPSPSGTSPRPATKPCTPSSRPVRRASRPRPRSARTPAGRAWTTTAPRAASAASSMPIPRKAGWPCSTATSLSTAAW

SEQ ID NO: 27897 - protein, 471 aa, Pseudomonas aeruginosa
NRALFPRTATMSSLQSPSDASARNDLVYGLDDRPSAPIALLAALQHLLAIIVPIVTPGLLICQALGVSPRDTNLIVSMSLVISGIATFVQCKRFGPFGAGLLIVQGTSFNFVGPLIAGGALMVKQGTPVESVMAAIFGVVIAGSFVEMGISRILPFVKRLITPLVTGIVVLMIGLTLIKVGLISMGGGFSAMSNGTFANGENLLLSGVVLGIIVVLNRIPVVWMRSCAIVIALAVGYALAGYLGRLDFTGMHQAELFQVPTPLHFGLDFSWPLFIPMLVIYLVTSLEAIGDVTATSKVSKQPVEGPLWMQRIKGGVLVNGANSFLAGIFNTFPSSVFAQNNGVIQLTGVASRYVGLWIAAMLVLLGLFPSVAGVIQAVPEPVLGGAAMVMFGAVAASGINILAGIQLDRRALLIIAVSLALGLGVSQVPEFLAHMPAALRNVLESGVATGGICALLLNWFLPESPVQKAGH

SEQ ID NO: 27898 - protein, 158 aa, Pseudomonas aeruginosa
ARRHLRVASRFSPKGFRTRPMVGYDRRHGHARRPPSSVPQPGPAPMPQSRRPLRIGLIADTHGLLRPEALERLRGCDQLIHAGDIGKPEILAELERLAPLSVVRGNNDTQDWAADIPERVLLKIGRLTSMCCTTSSDSTSTRPPKASTWWSPDIRTSR

SEQ ID NO: 27899 - protein, 148 aa, Pseudomonas aeruginosa
LESHDASRPRRPLADRGRSPARGAGRSAGRQRGGSPGAGPGRFPAAPYSHPRPLAGPPRGPARRPADLAPGFAAGAGPAVGAGPGQRRRTGIRRARRWPAPGQRVVGAGQPTRPAPADPARLGPSACSPAARPRARSTGSVSHHERLS

SEQ ID NO: 27900 - protein, 168 aa, Pseudomonas aeruginosa
ACSTLRMQPSARSSSRLGQRVFWLNAVWVGMPAGPALKKVCTASSRVWVMSHWAMASAMLGLCTVGTSVCSRPPRASSPRMEKMPPARCTSSMWYFWMFGATLHSCGTLRDRRSMSRRSNGTSASWAAASRCRMVLVEPPMAMSRVMAFSKALKLAMLRGSTLSSPSP

SEQ ID NO: 27901 - protein, 151 aa, Pseudomonas aeruginosa
RWQSSTARRPARRNSCSRSAWVARVEPLPGSDRPSASVRQFIELAVNMPEQEPQVGQALRSYSATFSSEQESSAATTMASTRSRPWLASLVLPASIGPPETNTTGMFRRSAAISMPGVILSQLEMQTMASAQWALTMYSTESAMISRLGSE

SEQ ID NO: 27902 - protein, 631 aa, Pseudomonas aeruginosa
ALSLVCSVRPRLRLRLQGQRRVADPARVAGGVDAAAALVPVEHLLVAVAALQAFELIAAPAQFGGLGIAEGARFVLDDVRLVLVVVARRGDPLADRAAVEVLQHGDQHHARDAAAARGAEGGEVGRAFQEARAHARQRALAGRHRVRLAAGQAVAVGALGVGGEIVHLVVQHHAGIGNGEGGAERQVHREGGGHRVALGIDHREVGGVVAFAPGRRLRQRRAGRGAARVDAGGKALQVVRRQQTGQRVGDEVRVAEQASIAVGTAQDLQHVMGALYRLGLLPRQLFQHLQALRQGDAAGRGRRCADQFAAVGQLHLQRAAFDHPVVAQVGRAPDAAAGADPGEQLVRCLAFVETDPPVAPEAFQGTCQLRLAEQVPFVGDSALVEEDPRGFRVLAHRFQAHGGAVTVDPVDGYAIHRQADRRHQIVGQGLASVAAAQFDQRRRQAGDRRRQRAVDGQPGVDLAIAPVHVGVGGLRRALAGVEEAIGRLRTGLAQKEESTAAESRAVRLGYRQGSGDGRRSVEGVAAIGQGFQAGDGRGRMWRGDGGLLRCVGVAAKAVGMRREAEQGQAAGGDQGTDGQVQEGHGGSLFSGVRGTGPRTPQTGLPRIAKSASDGARTVPEGQAPAGIRPCR

SEQ ID NO: 27903 - protein, 321 aa, Pseudomonas aeruginosa
VGLVQHALLLRLVVAEVVQGQRSRALVDVGQGVFQALVGDHRQQRAEDFLLHHFHVVADVQQQRLRQAPLLAFGEQRDEGRALLAGVVEIAPEAAELALVDDRGVVGVVRKTREEALDHLLVLADEFLDAPARYQHVVGRDAGLPGVEALAEGDPLGGVLHRHAVGDDRRRLAAQLQGDRGQVLGGGAHHVLADAGGAGEQQVVERQLGKGHADVHLAEHHGDLVLGEDPRQQVLEQAPGGRGRLAHLDHHPVAGGEGPGQRADGEEQRIVPRHDHPDHAQRLVHHLGRGRAGIAGRPRGARASSISSRAWRRIGCRAGWA

SEQ ID NO: 27904 - protein, 135 aa, Pseudomonas aeruginosa
KRSSSAGRAISPCQSAAGCAAQGSPSASRRWRMLAEAGLILRLPAARARNVRCRLSFPGAAASFRAGRGTRGRSRSRYRSRRRGSASRGFRAGGRRPAAGSDGTAGRGTPGRRRSEPGFPGSARHRRGPVGRCRT

SEQ ID NO: 27905 - protein, 259 aa, Pseudomonas aeruginosa
SSPWPSSSACRSAISVSARGSTISVPSRPTPSSRHSSQSGRTHDPLRAGRQTLSQRPRRPARGVLPRAPWRDPLRHRPLRRRQEHPAAPHPGDGATDQRQAVARRPGPGAHHYRADPFPAPADRRGVPEPPTAHRSYGGGQHRPAAADPRHAQAGDRQARGLGPGAGEPEGKGRGVAFRPFHRPAAAGRHCPRHRPPAGPAAGGRTHRQPRPATRLGNHGCVRGYQSPGHHRTDRQPRPGPDRPYAPSHADPAAWPDHR

SEQ ID NO: 27906 - protein, 337 aa, Pseudomonas aeruginosa
GLMSANDLPRGPEEGAPERKTREKPSQEQTDWSGSFSAYLESHRASLVDSLRRLFGHPFGSFFTCLVMGITLSLPMGLSLLLNNVERLGGSWQRAAQISLFLDLKTSENQGQDLREQIERLPDVIEAQLISREQALSELQEQSGLGEALKELPENPLPPVISVTPKQIDRAGLEALRQQLAELPHVQQAQLDLVWVERLSAILKLGERFVFGLTILLVLTLLLVVGNTIRLHIENRRNEIEVIKLVGGTDGYVRRPFLYMGALYGLGAGILSWALLAYSLNWLNGSVVNLSGLYGSDFGLQGVPLDDGLSLTVGAVLLGWVGAWLAVARHLRELAPR

SEQ ID NO: 27907 - protein, 229 aa, Pseudomonas aeruginosa
KGGFSPDRRASRKPHPARVRFFSARRNPMPRNTRWLFYLSLAVLTFVVGAWLVRTPEPARPLPWLADWQEQVLAPLADNALTLRQLHDAVDGELWVDPRLDGVRLAFRGRLLGDGGPWQVEGELGLSAEEQLSLQRASALQPGSAPQPLSAGLEGQLGDKPIVALSMIPEGRVGAERLLASLGQPRLRLQLAQGEAWVYPQLGLTAHLPDDDLRLMLAVPRQALEKPPR

SEQ ID NO: 27908 - protein, 350 aa, Pseudomonas aeruginosa
GDGARITIRGSVMASAQPASAFPCLSLQLACLLLGAWLAFDAHGGGQAVAPPARVEARVPTAATDDWGRQPDSLMSAVPPRTLEASVGARGSGSASSRLWIADTDFRLHDDIGFFIQRMLIRMEPTRPGAPLSLDDPTAMVARIQAGEIFVSDATLATLLNQDLAASRAAVRNLSMNTRKDGQEVRGELLRKGRWRPLRMLTEIELSGPLEVTLVPRRIFVDGVEVTSSLAAASIEMSEVLKLKTRHMELVGNRIRVDLDGLFPPPRLDFRVSRLALADGGMQLALGDSLADLQWPALRAPDSYMFIEGGDIKMARTVLVKAYALFTSLSPGQPLLFNPPTTTGGNCRTA

SEQ ID NO: 27909 - protein, 297 aa, Pseudomonas aeruginosa
RRRRRWRHGCEPASVGRTAWLLPVGGQRGSGRKRHRPAAARTGPAARGLVPAGPAGAGAAAHAYGRAGGFRPGWRRHTAAQRGHVPARQHRFPRARGEGLDGAEPGRPAGGIRPSAGHAFPGDGGRGAAQPAATGQPVQRAHPRLRRDHVEGLPHEQCGGTPGGGGAGASARRRALAAAAAGRRRGGGRGQRRAGLSARPVEGDRSAAVRGDEPGRPADVGAGQPRSAGGEPGGQRHAPGLPQGLPAAGHRRPRTGGLARPPGAAPAFLPGARPAVAGVQPAGRGGPHPSSGYTRAT

SEQ ID NO: 27910 - protein, 155 aa, Pseudomonas aeruginosa
PHGTTAGDDRRPWREPRDRHRQPPALAPAGRPQAFQGDDPRQAGDHGAQDLGLAGSAAAGPAKPGGQPPGRPGTGGCGSVRQPGRRAGARRGVGAGGGRRRTDADRRRPALCRGLAARRASLPDPGWPGAGGRRLFPRDRWCGLAPGVEHRTRRG

SEQ ID NO: 27911 - protein, 272 aa, Pseudomonas aeruginosa
GRAAHRGQPADLQQHALGDVRRPVLGVVVAAHHRERRQAFQLGEDFRLADVAGMDQLVAAAQPFQRLGPEQAMGVGDQADAQRAAGLGHGRGSGLRDGRGWPTGMAMPSIIPNHWPGTKTLRRKPRRHPEVAPRLSVSGLLDRAFRQEPVQQQGADAAGGDPGLQHVAQRRGHVREELRHLRNAQAEGQGYGDDQQGTAVQLDAGEDVDARSGHRAEHHHRRAAQYRFRHRLDDPGDAREQAEQDQHGGDPEADVAAGHAGELDHPVVLGEH

SEQ ID NO: 27912 - protein, 365 aa, Pseudomonas aeruginosa
AGEGIEDTGEERVGAVDQHAALDPLHPQRAFHRLLRHLAGGGDVADGFQGGDQVDHQHRDEQRPGEVQAEVQRGRYLEQLGLVHAGEVQATEVAGQRVADGQGDDDGATAHPYHRDAVEHHDDAQHHTGQQQVLAVGEGAVGHRREAAAHADQADLDQGQADHQHDDAGHQRRDQPLDERQYARDAHLDEGAGDDHAEDRRHHAFHRRALLDHQRPAGDQRADEVEAGALDDQQSGAERAEALALDEGGDAGDHQRHRHDQIGVARRYAQRLADQQAGGNDRHDDRQQVLEGGEQGDGSAGTVVQAIDQVVAGAGVRRALQGTHGGGPGKKSAILLGEHGLAQAWLRRMSADNAGGVCALRLERG

SEQ ID NO: 27913 - protein, 314 aa, Pseudomonas aeruginosa
KPAPWRGSPGKLRAPSTFASVLMVQELTAEQIRQALQGISVPPQPQIMVDLQMEQVMPNPDLKNIARLISQDPGLSGALLKLVNSPFFGLANRITSIQRAVNLLGSRSVINLINAQSIKGEMSDDTIVTLNRFWDTAQDVAMSCLSLAKRIGYESVDEAYALGLFHNCGIPLMLKRFPHYMAVLEEAYAAASDERRVVDTENRVLNTNHAVVGYYTARSWRLPEHVCEAIANHHNALSIFGDESARDTQLKNLLAILKMAEHICGSHRVLGNQPEDHEWNSIGALVLDYVGLTDYDFENLKGSILELGVGQGSY

SEQ ID NO: 27914 - protein, 309 aa, Pseudomonas aeruginosa
LAAPRRFLLRCRGQPDCCRHARTTRSRNHPPGHRPLPRRPARRARDRARAAPALADSRRPGRAPVRTTHRQRRAPRQVPAAGRRVRYADQPPGHVRQPEAGGERYPGQSPRARRHRAGLGHGPALHRSAALRRHALEPGATGTRAAAQPRPGTADRRFRRPASVRAVARAEHGGQAVHHGQRGGGRGRQHLRQRSAVRRRHRSAQARRKHLQGALPAPGGGDQADPGDRHRARRHHPARFRRRRRPARLLPAGIVRLWPWRGVLQGLRQHPARDPPRPARQRVLPALPTLKRRAYSTATRRAATVSGLP

SEQ ID NO: 27915 - protein, 196 aa, Pseudomonas aeruginosa
ERCTMSGNYLPRNTLVESLGHAMLKLSGWKIEGQLPALDKFVVIGAHHTSNWDFVAFLAAKFVLRLNARWFGKHTLFNGPLGGLMRRWGGIPIQRHLKLNTVDQAIQAFREHREFMLIIAPEGTRKKVDRWRMGFYHIARGAGVPVVPAALDYENRRIVIGEPFWPTGNEDADLCSLIGLYRPFIPKKPHYAFLGD

SEQ ID NO: 27916 - protein, 354 aa, Pseudomonas aeruginosa
QCPADQQGHKVDQGWPTDSTKIRISRMFSQWVFLSVLALAVPSFAWAEDAVSDLAKEQSKAEQGDKRGDELFAEFTRLRQAAETGEPQALFDFGAYFYQQQNYASAREWWGKAAAAGMVRAQIQLAMLYRDGDGGPQDKTEAARWFRKAAEQGDAAAQNEMGVLYWRGEGVDQDRVKAGTWFERAAASGSEDAETNLGWFYLDDSQGVYSATSDEEAALLDRYAGSREKAFQWFCKAATQGDARAQFKVGEAYWNGSGAGMNKLQARLWLEKAAQQQDADAIAWLESAANAAWYTRLENWIHAALDGELSGVADCSGAADRRHSGRGMEGAPSDPEAVEASAEDAQQAVEAASQ

SEQ ID NO: 27917 - protein, 278 aa, Pseudomonas aeruginosa
PKARRTGREPSLKDRRRRGSGLAGDLPVFLHQLVLALDIGVVKGNAVHRTDLLALRLVVVADALGAEIGIDHIDFFALRDRAVRAFGFADVAIDAIVSDFQGHLTTPTATDSHGIGNGNSGIVPHRRPQCTRDADGRPAERRGSALETFRQGVCHGRMHELADIPAESGDFPDQRRGNEGILLRRGEEHAFHVGGELAVHVGQLELVLEVGNRAQAAEEDIRLLLLDEVRQQGGEAHHLDVRQVLGDLLGQRNPLFQAEQGVLLGAGGDRDDHMVEKP

SEQ ID NO: 27918 - protein, 243 aa, Pseudomonas aeruginosa
PGRPALCTFYAVTAGRAPHCYPNEPVVPMAPRIKTRDRIAQASLELFNAQGERSVTTNHIATHLGISPGNLYYHYPNKQAIIAELFAEYESHVESFLRLPEGRGLTVDDKTFYLEALLAAMWRYRFLHRDLEHLLESDPELAARYRAFAQRCLVNAKAIYRGFTEAGILRMNETQLEALTLNAWIILTSWVRFLCTTLDLDGDLSEAQLRRGIYQVLALESGHIEAQAQDAVDGISERLYVPL

SEQ ID NO: 27919 - protein, 520 aa, Pseudomonas aeruginosa
VCSSMLRNAAGLLGRLGGGWRQGFLRHARAGADDDEGVGVQVLGHGAPDLFDAESLDLLEEAFQVVQRQAVETDGAELADDVGVARGGQREAAGQFALGVVQFLLGRAVGQVVADDVLDQLQRPLAEFGAGLEVDHERTACLHGGEAGIDAVGQAALFSHLVHQAGAEAAAAEDLVAQVERRVVGILAVDAKLGEHQVGLLGGEVDVRQAGLGRFRLDGLGQRRALGQRLGDFRGDRFGLLPREVADQRDDHVAGGVGLLVERLQLFAADRWNGLFVAVAGVRVGMLAIEALEQLQAGQLAGVLLLVLETGQDLVLDACQSVLGEGRLADHLFEQLQRLGPLVGIGQAAQAGHRHVAVGAVAERGAEVLEAGGDGSGVLARHAFVEHGVGQHRQAGGAGVLAAAGGEGQAQVEHRQFMGFDEQHLGTFGGLPFLDVQLAMDRRLLGDVLQRLQLVFLDRRGMGRRRGLGGTRDEIGQRGQQRDDDQAEQAITQPCALTHDGPPFPRPSQAALAPGSGATG

SEQ ID NO: 27920 - protein, 280 aa, Pseudomonas aeruginosa
RASVGRGAFAPARGARRATRAYPGCRARARARARARARARARCAAGRRSGSQRAGDQAGLLRPPPAGTVQDQRQHRRRHGQPVPRPQGNRRRPARRHRDAPADRRRRRRGHHPDRAEPDQARGAQGAGRQRRAVQGAAGRAGQPAAPGGAAVAGRRRARALCDPGGWGERRGQDHHHRQAGEEAATRGQEGHAGRRRHLPRRRRGAVAGLGRAQPHPGDRPAHRRRLRLGDLRRGAGRQGPRHRRADRRYRRTPAYQGQPDGGAEEGAPGDRQAGRDGAP

SEQ ID NO: 27921 - protein, 308 aa, Pseudomonas aeruginosa
GPAGARRRHRAERHQSGQAVQPRGGADRPGPDQTGRHRQGRGDLRPGQAVRPADPLYRCRRGDRRSPYLRGRRLRPGTLRRAGERMIRFEQVGKRYPNGHVGLHEVSFRVHRGEILFVTGHSGAGKSTLLRLILAMERPTSGKLLLGGQDLGRITTAQIPFLRRQIGVVFQNHQLLTDRTVADNIALPLQILGMPKPEIAKRVASALERVNLKEKGEALPSDLSTGQQQRVGIARAIVHQPALLLADEPTGNLDPRLASEIMGVFEDINRLGTTVLIASHDLALIARMRHRMLTLQRGRIIADREDEA

SEQ ID NO: 27922 - protein, 285 aa, Pseudomonas aeruginosa
TGRTPLLSARPGSGAADGVGAPALRCSYRQELFGVRPGPGRPDPGRQRRPDEGREAFQPGNGRSPGVLRRALDQGGDPRVHPAQLADRQGRHHQGAAQAVLQPAQPEEAPGLVEQRGSPSRRREPGGRAPRSARDGKPPDRPGHGVRPGRRRGRRERLPVAGALPRRPPLRPGAPVGRRRLERQLQRQPARGAGRPRRAQPRHSPAALAVRGEGHAARPGGKVQRFRRAYPAAGKERHEQAERADSRLIAAPRENRTPQGCGFFLPGGIPCRAIPAGCSTCRWRS

SEQ ID NO: 27923 - protein, 397 aa, Pseudomonas aeruginosa
CSRCRARPWKNRRVELSALQAQQVVVAAQLPHLLANPGRALAYVGARPGRAPFQRAGQHRGELAGLGAAQALGVEAEVIACRSLRAEDARAPFGAVQVDLENPLLGPERLDQQGEPGLQALAQPTAPGPEEDVLRHLLAERTGAADTAAALVVREGLLDGRQVEAVVLGEVLVLAGDHRDLQAVRQLLPGAPVALQVDGLAVDPGADLAFDHDHGPRWRHPAQDRDQHDAGGHEPEQVLEQAAEQGSQHARLGLEEGGGHYSGLDAITGVLSMLRPFLLLAAFFGFTGVALGAFAAHGLKKQLSAEYLAVFQTGVHYQLIHALALFGVALLATRLDGRLVSAAGGLFTLGILLFSGSLYLLTLSGIGKLGIVTPFGGVSFLAGWLCLGLAAWRLGNA

SEQ ID NO: 27924 - protein, 78 aa, Pseudomonas aeruginosa
NAAPFHFRDRPAMQIQLNGEPFELPDAQSVADLLARLELGGRRVAVELNLDIVPRSQHASTALKDGDRVEIVHAIGGG

SEQ ID NO: 27925 - protein, 209 aa, Pseudomonas aeruginosa
  UNSURE (189),(190),(191),(192): Identity of amino acid at the above locations are unknown.
RGRGRAHLPSGPRAAGRAQPGQAGSPRRPEDPVPQRRRDPQGRRATGEGRLRRDGVHQRRPDHRPPTGRDRLHRGDAAGRPDRLRPGHLQPLQPAHHPRGSQGPGAGRRRRWHRFRCSDRHGAGLRGGADEHRHRPCQGPGDDGRGHEARDRRRSSRLPGRTHAAQAVCQRLVAAGRPDRLIPTTWGGXXXXFLNLSIRISPMFVPVFF

SEQ ID NO: 27926 - protein, 172 aa, Pseudomonas aeruginosa
IVPGQRRLISAKHSKKRPGGSCWLASRLAAGCGVLTGAVAKAFGAGSERNTEMKVVRRYPLALLLGMAGALADELPDGSLLQRYGVQADQLPTLAADPPSRKEEKETPSRFRVEPEQPLVTFGVKDHKGMEPTGNPSIDAMHERDRRICRNIRRQALEKGKAQPFDGYIECP

SEQ ID NO: 27927 - protein, 411 aa, Pseudomonas aeruginosa
GRRPRTSAGRAASALLAQAHGDVRLVAEQAVDAGVEVGPDLAGQVAARLRVAVGAAELRRKEAVFRAEGVGMHLQPGGVGVADEAGRLAEVAVGIAGNHVALVRTDPVGVARHLAQALGGGHLGVGQAAAGSLLVVGLAAAVELDQADAGEALEFLQVVHLEGLDEYRRARTEVAVAVQGLHQWAFHGQAEALEVGAVLDLGVQADGALLADLQAFHQVDDLLQGGDLEGAVQARIARADRGDALDGAQGLQFGEGEVFAEPAGEFHSVDFLRALAVGEFRVLGDIGGQAQLVVVAGDQLAVAGHHQVRLDVVGAHHHRQGVGAQGVFRYVTAGATVGDDQRRAFVAGRVANGGLALGPVDGALYVAGVGVGGAGQASGEHQAGGAEVAAQEGWLHDGSSSAVRECSSPAD

SEQ ID NO: 27928 - protein, 444 aa, Pseudomonas aeruginosa
RPGTWNWSATASASTSTDCSRRRAWTSASVAWPWPTAACNSPSATPWPTCNGRHYGRRTATCSSRAAISRWRAPCWSRPMPCSPASARGSRCCSILLRLPAATAERRDPHARGRHGADRRVAGEGAGAAGGTAVSRRPWGVLLGCCLLAASAAQAESAIDRQQRELALLREGWYRQVPPAPVPLPMRTAGPADSGQDGVGILLRNVDMYLRGNIGFHVPEVKGWMVPNRAGQPVEFDRPQDMHFQVMEGEVLLSPRQLANLFNEHILAYDGTMLKDFRMSSAAGRLEVEGRVRPLGVGPWLPLRLGGGVEVDAASGALVYRPDQLRVIGLPLYGAMSLVGLPMSALVSLDRPGASLVGSAMRLDYRKVFPLLGIDGHVQEAWLDHQGLHLRFSQAPGQPSPVFSPPAAEGPILPLATLGRPEDLRNPHHLRPGAAEDREPRTRC

SEQ ID NO: 27929 - protein, 171 aa, Pseudomonas aeruginosa
GNPMARPLAMIAALGENRAIGIDNRLPWRLPADLKHFKAMTLGKPVIMGRKTWDSLGRPLPGRLNLVVSRQAGLALEGAEVFASLDAALARAEAWAQAEDADELMLIGGAQLYAEALPRAARLYLTRVGLAPEGDAFFPEIDGAAWRLASSIEHAAADDAPAYAFEVWERR

SEQ ID NO: 27930 - protein, 328 aa, Pseudomonas aeruginosa
RFQAGSEGDQLRLDLLPRHFQHADPDRQAEAPRPGAARVEVEHAVALFLQRLVRMSGDHHVDAFGGRVEVESLEVVQHIEVSRPIFSSTRSGMSAAQSWVSLLPRTTESGARRSSSARISGLPMSPAWINWSQPRNRSSASGRSRPWVSAIRPMRNGRRDWGMGAGPGCGTEEGGRRAWPCRRSYPTIGRVRKPFGENRDATRRWRRAYQCPAFWTGLSGRNQFSSRAQMPPVATPDSSTLRSAAGMCARNSGTCETPRPRARDTAMISRARRSSWMPARMLMPEAATAPNITIAAPPSTGSGTAWMTPATLGNRPSRTSMAAIQRPT

SEQ ID NO: 27931 - protein, 208 aa, Pseudomonas aeruginosa
PTARAMTMAQLRIHTTGMRLSTTMMPSTTPDSSRFSPLAKVPLDIAEKPPPMLIRPTLIRVRPIISTTMPVTSGVISRLTNGSMREMPISTKEPAMTTPKIAAITLSTGVPCLTISAPPAISGPTKLKLVPWTINSPAPNGPKRLHWTKVAMPEITSDIDTIRLVSRGDTPSAWQISRPGVTIGTMIASRCWRAASRAMGALGRSSRP

SEQ ID NO: 27932 - protein, 653 aa, Pseudomonas aeruginosa
PLAIIRHSARVRVNEKARRGTGLFSSRDDSAVQQRLVAYRALVGAGGEQGVGLERGADAAGTRRGRLPALLVLFGAACGEFFVADQQVDRAIGNVDQHLVAVLHQADGAAGGGFRGGVTDGQARGAAGEASVGEQGALLAQALGLQVAGRIEHFLHARPALRSFVADDHDVAGLHLVAEDAFHRGVLAFEDLRAAFEHVDRLVDPGGLHHAAVESDVAVEHGQPAFLGIGMLDAADAALGAVVVQARPAGVLAERGLGRDARRTGLEEGVHGFVAGLGDVPLGDGVGHARAVHGGDVGVQQATAGQFAEDGEDAAGAMHVFHVVLLDVRRHLAQLRHLARQAVDVAQVERHLGLLGGGQQVQDGIGRAAHGDVQGHGVLEGLEVGDVARQHAVVAFAVIALAEFHGQAPGAQEQLLAVGVGGQGRAVARQRQAERLGQAVHRVGGEHAGAGAAGRAGAALVLGDLLVGAGVVGGHHHGIDQVQAVAGQLGLAGFHRPAGDEHYRDVQAQRGHQHAGGDLVAVGDADDGVGAVGVDHVFHGVGDDLPARQRIEHAVVAHGDAVVDGDGVEFLGHAAGLLDLAGDQLAEVLQVHVAGHELGEGVGDGDDRLLEVFVLHPGGAPEGAGAGHVAAVGGGFRAVIGHDDFLRLIRFGL

SEQ ID NO: 27933 - protein, 349 aa, Pseudomonas aeruginosa
AGGADQDAVLAQQAHGLFVETAVGGLAVLQVLLALDEGRRVGDHHVEAFVGGLQLAQGLEHVALDAGDLLRHAVQCRVALDAVEGEGGRVHAHHFAGAEGGGLDAPATDIAEQVEDPLAPHVGRQARTVHAVVVEPAGLLPGQHRRLELHAVLFQGDPLRHFAVGIGHVALQALGVARAGVVLPEHGGGLEHLQQGGEHLVLAQFHGCGRQLHHQHVAKAIDHQAGQQVGIAVDQPVERLVEKPLAQAEGDVDAMNQQRFVENVLGITGNEAAADEIVRAQRDDAQRLAVGHFQHRLVAGGEGIQRRRGDIHLVAVDPQVAGAQAALGVGFETQAGQGHGKGSGKRARL

SEQ ID NO: 27934 - protein, 280 aa, Pseudomonas aeruginosa
GAAVNRIAAAMPELPEVETTRRGIAPYLEGQRVERVIVRERRLRWPIPEDLDVRLSGQRIVSVERRAKYLLLGAESGTLISHLGMSGSLRLVESGTPASRHEHVDIELASGMALRYTDPRRFGAMLWSLAPLEHELLRNLGPEPLTDAFAGQRLFELSRGRSMAVKPFIMDNAVVVGVGNIYASEALFAAGIDPRKPAGSISKARYLRLAEEIKRILAIAIERGGTTLRDFVGGDGQPGYFQQELFVYGRGGEFCKVCGSTLREIRLGQRASVYCPRCQR

SEQ ID NO: 27935 - protein, 161 aa, Pseudomonas aeruginosa
SAYTGRSSRKSRTTHSSAIEGGHAGTTRSAVIVRRYLPNQKPERTASMNLFRTTALVLALTTGLSSMPALADAVQENASGDPMYTVEAPPAYAMIGDLLIARPFLIAATAVGAVAFVVSLPFTAASGSVGKAGQALVVDPGKEAFVRCLGCTTSGYNHDES

SEQ ID NO: 27936 - protein, 125 aa, Pseudomonas aeruginosa
RRRRTAGSPRGWRPPRCPGHRSPRSGWCGRLRARPAPPAAPSWAWRGAGRCRRQGASGSPAPANWAAGWRRSPGRRAGLDRGRHGAGPPARNGRAVPARPSATAAVPASAGSAPGRRRRPRAAVR

SEQ ID NO: 27937 - protein, 221 aa, Pseudomonas aeruginosa
AACPLSRLRRNRSARSARGVPGYVPAAVGGAGSIRRGFRPCRGRSARFPGPCASLPGAWRRGHGRSGRRIRHPPPGGSPAPDCRPGACVRSGCSIRPAPPAGRGSPPPAGRRRTAWGRPCHCAGTCRRRRPSARARGRRGSDRSAAHRPGAEGRIHRRRVPSRKARLPPGQRRWPPQRRRRCRHWPGFPGRRRSRPDVAWRRRPAAVRGRCRESCRHAPRG

SEQ ID NO: 27938 - protein, 232 aa, Pseudomonas aeruginosa
PLVMGSKVPGYSTRFIATSWQGFVRESDGSAGMPVRPRRTGHRPLAHRSDGAGPAAAARGRPGGGSGPGQAFGQRAGQLRGKTVDRELRVGADAGGEQRAVVDRQVPQVVMAAEAVGHRHGRVFAHGAAAHDVGAAQARAVDLQAQAVDDPARLLQVLRATRVAVHRPHFPGAGGELDLRHGMEGTADTVPGVVGHPVVEHWGVVAAQADRALRAVRVEAVAEQGEHHVGMR

SEQ ID NO: 27939 - protein, 146 aa, Pseudomonas aeruginosa
ISLRRWISRVNTLKCQTACLPARRLRTQRKAGRSPAATPGADPGGRLCVPSTLSRRGAPRTVTRTSPSSPWHHASRPAIASPRPAWNCSTPRASAASPPTISPPTWVYRLGTSTTTTRTSRRSSPSCSPSTKATSRASCACPKGGV

SEQ ID NO: 27940 - protein, 386 aa, Pseudomonas aeruginosa
TGRRRGDPRRSAAAGLRRRRCSVRRAARRFPPARRESVFLPRRAAGRPGGRRVRPAGNTRNAGTACVARQAACAGPSRPPRGSPGSPRSRRRRASGCAAASVPFAPLFPSACSYSAARRRTPASSVLPQAGLQPVGDASFQVVGGLARRAVDEADVTAAGVQLQLGAGCQFAAIGQAAGEHEGVVAGMDDQARRADVRQVVAAGRAPIVIPGVGEAVQRRGDPAVEVPEGAHALQRTEALQGGQAFRLALLAEQPLLVLHVGQHGLHEVRLVDPGKAQADAVGALVQAERHRHRDAAEQRAVPSGFAQVLEQHVAAQRIADRVQRRLRAPGAQVRDHLGEVVADPGMVAARQAVRLPRATAPVQRHAGPAALQQGALQTEDVVRRG

SEQ ID NO: 27941 - protein, 449 aa, Pseudomonas aeruginosa
RSPVRSLMTGLLFLGLHRQHLRQGQARRGEIGAGGFLDIVRSHCLEGLQVLVDQLPGQADAFQLADAAGLGGDGVLLVDHPGDHLRAHALDLRGAGRVLLEVIELLPQTGLDLLEGLALLHVRRGREDEQAVAAVERVIVGGGAGDQLLAALQARGQAGAVAAIEQRADQAQGVDFARVLAAAQAGHVEAHDQVRQLGAYVQLEPALAGLGQFQRLARRRQLAPGDLAEVALGEGLDLVGGDVADHYQGGVVRRVPGFVPVAQVVDGHALQVGHPADGRGVVAAGRVGGGLEALEGEGVGIVVGAQAALLLDHLDLALELVGRQAQVGHAVGFHLQRHRQTVAGQDLVIGGVVVGGEGVLFRTQVAQHPRGFARAELAAALEHHVFEGVGQAGEPGCLVAGADPVPELGNHHRGAVVFTHYDLQAVVEAELVGGLGFRRLGEKRETKAG

SEQ ID NO: 27942 - protein, 515 aa, Pseudomonas aeruginosa
EQADAAASWGFHGDLDLSCRHRGLRSLRGRTLSPVGRGDARIPIRFPGGHVPCRSLEIQAFMFGSNDDKKAPQGGEKKGLFGWWRKKPQAGEQPADQPVEPVSETAAAEQRAPADDVAQSLTEQPGRQQPSAAEPAEPAPVAEAPLASDEPASAEEHSPRPEAPVAQPEPILAAEPEPEPEPEPEPEPEPVAPLAAAPAVSEPATRPGFFARLRQGLSKTSASIGEGMASLFLGRKEIDDDLLDDIETRLLTADVGVEATTLIVQNLTKRVARKELADSGALYKALQEELASLLRPVEQPLQVDVAREPYVILVVGVNGVGKTTTIGKLAKKLQLEGKKVMLAAGDTFRAAAVEQLQVWGERNRIPVIAQHTGADSASVIFDAVQAAKARGIDVLIADTAGRLHTKDNLMEELKKVRRVIGKLDETAPHEVLLVLDAGTGQNAINQAKQFNLAVELTGLALTKLDGTAKGGVIFALAKQFGLPIRYIGVGEGIDDLRTFEADAFVQALFAERENA

SEQ ID NO: 27943 - protein, 250 aa, Pseudomonas aeruginosa
PCSVAGSSLTVRMRPDERQRSSPWPRRGRTGTQDPRETEPGADRLERLVQRLPGKPSRQPGGQPAPVVRPPVRQLLHLPGDGYHPEPADGPLAAAEQCRTARRLLAAGGADIPVPRPEDQRKSGPGPARADRAPAGRDRGPIDQPRAGAQRIAGTVRPGRSAQGAAGEPAAAGDLGHAQADRPGWPGGTAPAARGAASCAAGAARPGMGRAPERDPQARRTLRLRPDHPAGADPLAGGGQHHPPAHRKSP

SEQ ID NO: 27944 - protein, 309 aa, Pseudomonas aeruginosa
RNLYTRLQSDIRVLHCASFVNRRIRMTTSLQPVHALVPGANLEAYVHSVNSIPLLSPEQERELAERLFYQQDLEAARQMVLAHLRFVVHIAKSYSGYGLAQADLIQEGNVGLMKAVKRFNPEMGVRLVSFAVHWIKAEIHEFILRNWRIVKVATTKAQRKLFFNLRSQKKRLAWLNNEEVHRVAESLGVEPREVREMESRLTGQDMAFDPAADADDESAYQSPAHYLEDHRYDPARQLEDADWSDSSSANLHEALEGLDERSRDILQQRWLSEEKATLHDLAEKYNVSAERIRQLEKNAMSKLKGRILA

SEQ ID NO: 27945 - protein, 315 aa, Pseudomonas aeruginosa
TWISCRAASTPAPRSRMATAWRSSTPSAAARPGPRTLPSAPQAFPSRSHPMSQASSTDTPFVIAGRTYGSRLLVGTGKYKDLDETRRAIEASGAEIVTVAVRRTNIGQNPDEPNLLDVIPPDRYTILPNTAGCYDAVEAVRTCRLARELLDGHNLVKLEVLADQKTLFPNVVETLKAAEQLVKDGFDVMVYTSDDPIIARQLAEIGCIAVMPLAGLIGSGLGICNPYNLRIILEEAKVPVLVDAGVGTASDAAIAMELGCEAVLMNTAIAHAKDPVMMAEAMKHAIVAGRLAYLAGRMPRKLYASASSPLDGLID

SEQ ID NO: 27946 - protein, 67 aa, Pseudomonas aeruginosa
KFQSCGGWSQSQSESQFVVNSPLIALAAGEMAVDRAFQRIAKAAKARPGKVFNLVQQIFYRLRCTKN

SEQ ID NO: 27947 - protein, 345 aa, Pseudomonas aeruginosa
TRLSCANPTTAINRVFHVLPAVPRRQVPRPQDRSASALAPLRFFSPSILRSALKRPSLVRRLPCPSSLYKEGHRPLSPAWITDKKSKIVQASPMRLLACWTDVHHRHAPMTAHDLPRQAFLRGAVAILPLSLAVAPWGLLAGSMAIEANLTPAEGQGLSAIVFAGAAQLVAIGMLKGGAGFFSIIFTTLLLTSQHLLYGMSLRPVLSPLPGRWRIGLGFLLTDEFFALASQHDRRNFNRWYALGVGLTFYIAWNLFTLAGILLGRSIPGLEHLGLDFSIAATFIALVAPLVRNVPTLVCVATSLFCSVLFSHWQWSSALVLAGLAGMAAGFICNKLYREAPWSGQ

SEQ ID NO: 27948 - protein, 310 aa, Pseudomonas aeruginosa
RRPVAMTLQSPSRPDEALKGASSATKNEGSCATGMNSRRKVAWRWRALGRISGQPQRAQRGPHVRLPSPAQRRADPGRGIAAQCRRYRLLHPRGKLPAGARCAARRQRHPHHRHPPRGCRLEHGRCLRQADRPTRHLLRHPRPRCHPCGEWRAHGAAGLDADDPVRRPGGKRLQGPRGVPGSRLRADVLGPGQVGRGNRPYRTHPGDRRPRLQRRHLGPTGPGRGRPARGNPLRFRAGRRCAGAKGASGAAGRHGDGGTARTAGERQAPPAGTWRQRLGQCRQETARRLRRGQWPAGGHLVPSPGPVRQP

SEQ ID NO: 27949 - protein, 185 aa, Pseudomonas aeruginosa
RLGRTKPVSSSSSPRRCSDNGSKSSRKRCSMPSLSSGESPAKRQASACTGRSKASRASIRLASSNGAAGARRSATASRKRRLAWSPRRKCSTSRTSAASQGGAGGSPATSPQCSSIRSSRPSLAQRWRARASMSADRSAATKRQPGRNPASSASSPPAPQPTLSRRARSGRRASNCARLSRCSNS

SEQ ID NO: 27950 - protein, 268 aa, Pseudomonas aeruginosa
PSACFPTKRPISRTPCPGANSPSGSDDACRYRAPAPGSAGSPSPPPTRRRPRRRNCRSRGSPVPRGSPRRYRCPPVPGPHHPPPRVPAAAPGAPPRSSARRCANGYRPGGAAASAGAQRESPAGRGCRLLPALRERPRPPAARFRRPAPREFPPPRARRFRRRSAGYGGRQPAVSIRSRRGHRRIAGWARPVAGGRRSARGSPRPRPGRSRRGGRTPRRPLPARRAAHGWCRYASAAGGPARRCDRPGTTRCRRAGWAAGRWHRGRRS

SEQ ID NO: 27951 - protein, 558 aa, Pseudomonas aeruginosa
QTMRMISICYLRNRRLRRKHDCRSGLARLQQLASALPYSPDRLLDGRGRQRRVVHPQAVPILAGSGKDAAHRDLYAAVAQGLVQAQGVERLVQFDPEQETALGPAGAGALREIARHPVDHQVASALVLGAHAPQVRLVVAVADEFGDRQLRLQGAGAGTDVLHVQHAVGVAPGYHPADPQARRQDLGERPAEQHPAIVVVRLDGARARIGVGQVAIDIVLDDRHVVALGQGQQRPLARLGHDVAERVVAVRGHLDGLDRPLFQRQFEGFQADAVDRIGGDLQGLHAEAFQRLHGAMEARRLHRDDVARFAHRADAHRQGLVAAGGDHHVAGGGSTAGVHQQAGDFLAQQRRAVDPVVGQRTGVGVAVEPGQAAGQRFQRRAGDVRHAAAELDHVRPRYRADQGQHLLPLRDFHRPLGQAGDRRQRRHLSRDRYEIAGLRPRLGQPAIFQQPVCLLHGAQADAVLDAHGPHRGQPVARTVEALFDARTEGLGELQIKGHERDSRVSESGTGTDGGEIHHSGRGALDLYAVNPPFLDLYGTARDGHSISVVQPINMEYAA

SEQ ID NO: 27952 - protein, 163 aa, Pseudomonas aeruginosa
WSARCSRNATPGAATTQRRRWPRPPRAERENERSRPRGRLLRSDAAQRVGVRRVTNSSAAVGWMPMVSSNACLVAPAFIATAIPWRISPASAPTMWQPSTLSSWASTTSFIRVFSWSSVRVSFIGRKRLSKIFTLCPALSASSSVRPTVPMLGRLNTAVGINL

SEQ ID NO: 27953 - protein, 451 aa, Pseudomonas aeruginosa
SGCARLTMPGPWTSYALVDEAQFRHPRRCVEIPTVDQQGSSHGSTDFLEVRLAELFPLGHQHQGIGALDGGVGRVVERQSGAGHSFRIACRDPGVGHRIMGPDPHPVAQQRLQQDQARRLAQVVGTRLEGQPPERHRAPLPASLEQLAEGLEEQLLLPRVARFHRAQYLAVVALLLGAADQRADVLGKARAAVAAAGVDEMGADALVATHAAAHVLDVDAGEGAQPGHLVHEGNLGGEEGIGRVLAELGLATPHQQDPLVIAQERRVELAQGFPGLRLGAADDDPVRAPEIVHRRAFLEELRIARHRYPEALAPARQAQADDLFDPFGGAHRHGRLVDHDAGLAQLRAKLLGDRQHVAEVGRAVLAARRADGDEHHFGVGQAFRQAGGEGQAGGVQLIAQDAFQARFVDRHLAASQPRDPLAVTLHATHLVAHLGETGRRHQSHIARTNHA

SEQ ID NO: 27954 - protein, 94 aa, Pseudomonas aeruginosa
QNPRGCPGSTQGRRKKQEAPMSIDIDSEQGVCSVEIEGSRHRAPVDSLRIGTDAEARLSVLYIDGKRLHISEEDAQRLVVAGAEDQRRHLMADD

SEQ ID NO: 27955 - protein, 341 aa, Pseudomonas aeruginosa
SAGARRRHRHPSPVRGRPGRPRRHRAVPDRPCALEGGPGHQPRRPGPGRGQPRGGGRQAQALRRPDQGPRHQRTRVHRSADRRAPGPGADRLGQGRTGAGPPAPGLRHGHRADRRPRAARAGHRRRAGRRGLADTSDPRRADRSDLRELLPAGRRSRRHAAGDPRRPGEGCRRQGHRRAPGPGRRQRVPAGRRAAVLRPGGRPRHRHHRHACPVPQSASRIAARRLRAGAPAARGEPAGDHRPARRADPYRPVRRGQGGQPTGLGGRRGGPRRHPAGPRLDHQQRAQGRRACDRRERRPACRRLQRPGGGPPAGQRRRPLTAGRLAGGPVTENATNGSFLH

SEQ ID NO: 27956 - protein, 319 aa, Pseudomonas aeruginosa
PAGLRLGDLPADRARRGPGDPLPAGRPVPGHRAAGGQRQRQLSRRLGQGGRGSGDRDHRARDERRARPALHQGHQQHRPGLADPDLPPGRERRPRRGGSAEPPEDRRVAPARIGAARRHLRGEGGGQHPADRYPYLLQRPLRRHGPGRDRLVQRVAGAAPGGGRGQGRDLGRRVRHAHLARPGQADLDEPQRQRPGQRRAPAQRPPHRGRHRQPRGPRLGADQRHGEGRRHPGDARAVRRNSAAHPRRRRRDPPARRGPRRVRPERVRLRLAGQPDDRHRPGGEDGARLQRGGHRQAHPRHPRRAVALLPGGRELQHPL

SEQ ID NO: 27957 - protein, 177 aa, Pseudomonas aeruginosa
HLGVRRDLDQEGGQHPARGDAAGVRRDVPVHAELPRHPDPDTGGAGGPAGHLHGDARPGLLDQRADHVRHGPGDRHPGGRRDHRGGERRAADGRGRPVAARRHGQGDAPDQRGHRRHHRGAGLGVRADGVLQRRGGQHLPPVRGDPGGLHRLLGVPRAVADPGPVRHPAAPDRRRPP

SEQ ID NO: 27958 - protein, 465 aa, Pseudomonas aeruginosa
EARLLRLVQPRLPAPDRTLPQRGGRHPRPADPLDAGLRPGHRRGRPALRAPAAGVPAGRGPGRLHDHGDAARRHADGGDHGQRRRRRALPGGARTGGLRLCGRRLQPVRRRHQLGDDLRHPEGLVGTPGGQPARRRHRRAHQPALRRPAQPYGVCDELAAAAGPGFHQRLRLPPAGPWRGWLRGPGQGPRPVAGARRRGPASGQRDVRRPGRGAADPPGHRPAQGGDPRREHGRDQHHPGGDVRLGLHRRLHARQPGAQGGGPGRRRQAPGHRRHRPASRAQRAGRDGAAGDVRQGRLDPRPAATDPLQRISLVQPRGPGRAGLQQRRSHAGDGAIDAGTARGHRPRVVRPVLRRTPVRRPGAGAVRPLGVDRVPRPGRPLRKLVDPAGGDPGGAVGRTRRTARGEPARSAQRHVLQGRPDHHHRPLGEERHPHHRGGQGPLPGRHEPAAGDPWRPRACACDRSS

SEQ ID NO: 27959 - protein, 140 aa, Pseudomonas aeruginosa
TSRCQRMSITYTISDLARELDITTRAIRFYEEQGLLSPERRGQERIYSPRDKVSLKLILRGKRIGFSLAECRELIELYDPDPSSGNQKQLNTMLEKIAERRAQLEQQLLDIEQMQLELDTAEERCRAALIKSYNKHTVET

SEQ ID NO: 27960 - protein, 403 aa, Pseudomonas aeruginosa
TSFKALNRTSTITGESMTYPSLNFALGETIDMLRDQVRGFVAAELQPRAAQIDQDNQFPMDMWRKFGEMGLLGITVDEEYGGSALGYLAHAVVMEEISRASASVALSYGAHSNLCVNQIKRNGNAEQKARYLPALVSGEHIGALAMSEPNAGSDVVSMKLRADRVGDRFVLNGSKMWITNGPDAHTYVIYAKTDADKGAHGITAFIVERDWKGFSRGPKLDKLGMRGSNTCELIFQDVEVPEENVLGAVNGGVKVLMSGLDYERVVLSGGPVGIMQACMDVVVPYIHDRRQFGQSIGEFQLVQGKVADMYTALNASRAYLYAVAAACDRGETTRKDAAGVILYSAERATQMALDAIQILGGNGYINEFPTGRLLRDAKLYEIGAGTSEIRRMLIGRELFNETR

SEQ ID NO: 27961 - protein, 144 aa, Pseudomonas aeruginosa
SLALPGPFPPGRGHSIASTGASPGRERAPTASAHLDTEPPPWPSCTPRSIHAPPSSRPTPRPCWNRSTPCAPSSAASTKAAVAPPRPGTARAASCWCANASTACSTPARRSSSFPPSPPTKSTAKRSPPPASSPGSAGSKGWNA

SEQ ID NO: 27962 - protein, 302 aa, Pseudomonas aeruginosa
SIRRRPARCSPWRFPPPSTPPSSRPPSACSACDEQTSMSEFQTIQLEIDPRGVATLWLDRAEKNNAFNAVVIDELLQAIDRVGSDPQVRLLVLRGRGRHFCGGADLAWMQQSVDLDYQGNLADAQRIAELMTHLYNLPKPTLAVVQGAVFGGGVGLVSCCDMAIGSDDATFCLSEVRIGLIPATIAPFVVKAIGQRAARRYSLTAERFDGRRASELGLLSESCPAAELESQAEAWIANLLQNSPRALVACKALYHEVEAAELSPALRRYTEAAIARIRISPEGQEGLRAFLEKRTPAWRNDA

SEQ ID NO: 27963 - protein, 269 aa, Pseudomonas aeruginosa
PERRRPGLHRSGQLRLAQVGAADGRLGRGIRRHPPASRRDLRGAGAEPERLRGGAGVGSEGSGGVRRRVGSLLPAQHQLLDQGQPGALRTGAGGGAPAPGAGARLHFLRARLSLRRRCRSAPGRLGRPRTAADGLLRGVPGRHHRRRHRRRHPPADRGGGQRGSPRAPRRALPRHLRASPGEHLRQPAGRHRGIRQLGGRPRRLSLRQGRHRQRRQRRRPLPAERPGDPYRGRHARPGRRRPAYLRGARQEQRVASGESVAGQGLRSGG

SEQ ID NO: 27964 - protein, 148 aa, Pseudomonas aeruginosa
PRAVIRPTRRRAQARRLRHPPWVPSYPIRQLIARVVASSRSAAGPCSSAWKMLAGPTTVSTAATRPRASNTGAESASTPGISSPWIACRPRARMPPGAPRRPPGRPADGRHARPTLPRAARPPRVPAGTRRTPGRWTNRAAAAPSRPG

SEQ ID NO: 27965 - protein, 715 aa, Pseudomonas aeruginosa
APTARTRKAATRPSPPTSSRTGSTRPWPSCSRPARSSGRAVPPSRRRPCRMTTMPAGRRSYPPSTRNGDNPMNQPTPTRSWVASANGHADFPLQNLPLGIFSRAGLSPRCGVAIGDSILDLDAALAAGLFEGAAGEAAEATRGGALNAFFALGKPARVALRQRLLELLGEGAAERPELLHPAAECQMHLPARIGDYTDFYVGIRHAENVGKLFRPDNPLLPNYKHVPIGYHGRASTVRVSGSEVRRPNGQTLPAGASEPVFGPCARLDYELELGIWIGQGNALGEAIPVSRAAEHIAGFCLLNDWSARDIQAWEYQPLGPFLSKSFITSVSPWVVTAEALEPFRRAQPARPEGDPRPLPYLYDDNDQAHGAFDIELEVLLLTEGLREKGLPPQRLTLSNSLSMYWTVAQMVAHHSVNGCQLQPGDLFGSGTLSGAEPGQFGSLLEITAGGKQPVQLPPGETRRFLEDGDEVILRPPLQARGTCFDRFRRMSRQSARGPSGGARMKLYTYYRSTSSYRVRIALALKGLDYQSLPVNLVRDGGEHRQPAYLALNPQGRVPALQVDEGELLIQSPAIIEYLEERYPHPALLSSDPLRRAHERGVAALVGCDIHPLHNASVLNLLRQWGHDEEQVRQWIGHWVGQGLAAVEQLIGDQDWCFGDRPGLADVYLVPQLYAAERFGVALDAWPRIRRVADLAAAHPAFRQAHPANQPDTPAA

SEQ ID NO: 27966 - protein, 468 aa, Pseudomonas aeruginosa
RGASAGRPITNKNLRYLAMHNQIASFRAALDARPVSRYQWLLLLLLALLLVTDGYDAQVLGYVVPTLAQEWGLDKAAFGPVFSANLFGLTVGSLLVTPLADRFGIRRVLLCCVLIYASLTVLMVFAGSLESLMLARFVCGIGMGGAMPSAMALMAEYSPPRLRTLMVTLAACGFSFGGAAGGFVAAAFMDGFGWQAVFLAGGVTPLLLFPFLLLFLPESLPRLLRDAPPYARLRQLSERMAPGWQPPPAQADAEPAASLTVLELFRHGYARPTLLLWATFFVSLILLYFMVSWLPSLLQESGLTRNAANLATSMFLFAGTLGAMLLAWLADRLRSKVRLLAAILAGAALFTLLLGLNHDQPRWLLAFVFAAGFCIIGGQLTLNAFASNFYPAQVRATGTGWALGVGRFGSILGPLFGSLLLGMHISVENIFMLAAIPAGLAALLILQVRSPAAQAQRESAAALAVEES

SEQ ID NO: 27967 - protein, 74 aa, Pseudomonas aeruginosa
TPRRSRKACWRPNCSVPPRGPSPVPSARAGQASCRWPRAARCSSTRSATCRWPCKASCCACYRRKSSKRWVPTK

SEQ ID NO: 27968 - protein, 554 aa, Pseudomonas aeruginosa
RRTEICIATELSLDYVSILRQRYSPRSPSSRRSPRKPRFWGLARLSQCAFPTALPRSRPSRRCPHRSTTRNRPGAPFPMRSAPRSAVEICPMSVIIALAALGLLMLAAYRGYSVILFAPLAALGAVLLTDPSAVAPTFTGVFMEKMVGFIKLYFPVFLLGAVFGKLIELAGFSRSIVAAAIRLLGTRQAMLAIVLVCALLTYGGVSLFVVVFAVYPFAAEMFRQSDIPKRLIPATIALGAFSFTMDALPGTPQIQNIIPSTFFGTHAWAAPWLGTLGALFVFAVGLLYLRRQANKARRNGEGYGSDLRNEPETADDLRLPNPWLALSPLVLVGVANLLFTHWIPQWYGQVHTLQLAGMATPLQTEVGKLTAIWAVQAALLLGILLVLASGFAAIRSRLAEGTRSAVAGSLLAAMNTASEYGFGAVIASLPGFLVLADALKSIPNPLVKEAITVTLLAGITGSASGGMSIALAAMSDTFIAAANAAQIPLEVLHRVAAMASGGMDTLPHNGAVITLLAVTGLTHREAYKDIFGITLIKTLAVFFVIGLFYATGLV

SEQ ID NO: 27969 - protein, 295 aa, Pseudomonas aeruginosa
SALFSSSGRNSMTLKGKTALVTGSTSGIGLGIALSLAEAGADLLLNGFGEVDAALAQVRARGVRAEHHPADLSSPEQIGELMAFAERTFGGVDILVNNAGIQYVAPVQEFPTERWDAIIAINLSPVFHTTRLALPGMLARGWGRIVNIASTHGLVAFAPGRAHTSPPSMACLRPDQECGAGNGAHAGDLQRHLPRLGADPAGAEADRRAHRRGRLARTGGTRPAGGKATLAGLRHPRATRRTDAVPLQRSRRPGARRGLEHGWRLGGAVAGAASLSPDPLPEGRGNHPEFARPIA

SEQ ID NO: 27970 - protein, 579 aa, Pseudomonas aeruginosa
TREERSLGAGALWAEYRGNHNVRSEALMSDSLPQRNGGQILVEALRRNAVDTVYCIPGESYLPVLDALHDANGIRTIVTRHEGAASNMADAYGKLTGRPGICFVTRGPGATHAANGVHTAQQDSTPMILFVGQVESAFKGREAFQEVDYVQMFSGLAKWAVEIDRIERIPEIVGRAFSVATSGRPGPVVVALPEEILFGFAQVADAPEPRVLPGRPGATAMAELRELLANARRPLLVLGGSGWDSAARKRLGAFVEANGLPVATSFRRQDLFDNRDPHYAGQLGFGAAPALLERLRQADLLLVVGARLGETPSAGYSLVRSPAPAQTLIHVHPDSAELNRVYLARLPIQATPCAFAEALADLAPLPSSTWQDWREAAHADYLAYSTPAASDPAVQGVDLASVVAYLSENLPDDAVIANGAGNYAVWVHRFYRYRQARTQLAPTNGAMGYGLPAAIAASLRDPQRSVVCFAGDGCFMMYPQELATAAQFGATPVVIVVNNGMLGTIRMHQEREYPGRVSATRLDNPDFVALARAFGAHAERVECSADFPAAFRRARESGRPALLELLTDPRQITPQARLA

SEQ ID NO: 27971 - protein, 182 aa, Pseudomonas aeruginosa
GILSRRGRRSRPGSPRPGNSGWAGRSRCLPAVRRGAARTTDRNPRASVAACRRCPPGKARPSGRPRPAPDVRRRPGLPSGWPAATAPLAPDARRPPRESAAWPGRRAGNAAPAGPAPHRKAAQAVARRRRRSAARSAPAGRAWRSAGGPGRACRPTGPPRRNASLDATRPAPPVRRRRRSRR

SEQ ID NO: 27972 - protein, 222 aa, Pseudomonas aeruginosa
AKAGPVQMVAKSTIQAGERLICMQSTHLFWTCTEQRAMAILSPSSSRSIWSTQHDATQCEIRAPPTPRWPLPTRRDGQPGAGPASRLSPGPATPADPARAAGPGSGGTEGYRPERRAGPRGSLAGVLAGRKIRREEGMIRCRNCGERPASEGHICMVCKRRSDIDPYKALIAMALLVYCGVSLAAYLKPHMPAPPPTAGSSVQPAEELAQRARQATLEQRGI

SEQ ID NO: 27973 - protein, 350 aa, Pseudomonas aeruginosa
LHPGADRHRPSRHFPALQRPDRRGLRMGDQHRHRPAVLPPRRQAVAPGDHRRHDPLAPAPAGVRLHLRDVPAARPGAETGTVADGHPGAVPRHPVPLRPAGHGAILHRLHLAGARQRAGSGMQRFRVEPARRIPYPAAGQAAARRRRRDRQRAGRHRQDHPATAGTLHRWPGPAALDRHLGGAQQAGAALCRPGLDPAGGLHRLQRRGDPGPVARSTLAGAARPDRRLLRDPRPGPGADHGAGATPGLQQGRRDHHRLLRFEEEPGHRRAHGQGAVRHQCGGADGVASDAVPPDPADGLRGARATLRQAPRRRSGGAGRGPLALSAKMKEAGPGAGFFVQTRLSASACAG

SEQ ID NO: 27974 - protein, 550 aa, Pseudomonas aeruginosa
PIHQRRLPPDRRRNLSKRLSAGPGRRWAMLVRGGKRDVPHPHPPGAARPRPRRLHRLLRNLLRHAGDPPAPRQRLADRLDGRTRPGTTLHLRHHARRPAAQPGQRRLQSFRLRPLQPRRGRRSGAPRRGRRLPGLGAARRALSGRLLLRPARSRGQLCGVQLRPAAGPGFRGAADSLTGHGGAAWPGPGWRGYSPDANNATPADSSGRADTPMAVRPIRKTPRPHRGRGVLHRERRGSVSLAGLVEVFVAEVGRLDVALGAAAVETLALELVGQHAAVLGLLHQGIGDLDLAALARFSLLDQVEDVRGQDVAADDRQVRRRLFRLRLLDHGVHPEDIVADHLAGDHAVLVGLFRRHFLDRHDGAAELVVQLDHLLQHAVAFEVQAQVVGQDHGERLVADQRTTGEDGVAEALHLHLAGVGEGALVDQPTDADQVLFLVGVADLVFQLVADVEVVFQRTLAAAGDDADLGKAGFQRLLHRVLDQRLVHHRQHFLGHGLGGREETSAVTGGREKTFLDHENPSTWTKYADGAQSNQAALALQCPALGRPMPW

SEQ ID NO: 27975 - protein, 414 aa, Pseudomonas aeruginosa
VAVPFPGQAREFTNRGTPMHIQWTGSLRGLLAALVALFLLGCEEAADAGKTAEAPAEVGVIVARPAPIGITSELPGRLEAYRQAEVRARVAGIVTRRLYEEGQDVRAGTVLFQIDPAPLKAALDISRGALARAEASHAAAADKLKRYADLIKDRAISEREYTEAQTDARQALAQIASAKAELEQARLRLGYATVTAPIDGRARRALVTEGALVGEDSPTPLTRVEQIDPIYVNFSQPAGEVAAMQRAIREGQVKGVADKDIAVRLVLADGSEYPLAGELLFSDLAVDPGTDTIAMRALFRNPHRELLPGGYVQVRLQRAVNPQAITVPRDALIRTAQSAVVKVVNPQGLVEDVEVRADTLQGRDWIISSGLKGGERVIVENAAQHAAGSSVQAVVRQPASADAPSPLAASPAGQ

SEQ ID NO: 27976 - protein, 1123 aa, Pseudomonas aeruginosa
RRTLRMARFFIDRPVFAWVISLLIVLAGVLAIRFLPVAQYPDIAPPVVNVSASYPGASAKVVEEAVTAIIEREMNGAPGLLYTKATSSTGQASLTLTFRQGVNADLAAVEVQNRLKIVESRLPESVRRDGIYVEKAADSIQLIVTLTSSSGRYDAMDLGEIASSNVLQALRRVEGVGKVETWGAEYAMRIWPDPAKLTSMNLSASDLVNAVRRHNARLTVGDIGNLGVPDSAPISATVKVDDTLVTPEQFGEIPLRIRADGGAIRLRDVARVEFGQSEYGFVSRVNQMTATGLAVKMAPGSNAVATAKRIRATLDELSRYFPEGVSYNIPYDTSAFVEISIRKVVSTLLEAMLLVFAVMYLFMQNFRATLIPTLVVPVALLGTFTVMLGLGFSINVLTMFGMVLAIGILVDDAIIVVENVERLMAEEGLSPHDATVKAMRQISGAIVGITVVLVSVFVPMAFFSGAVGNIYRQFAVTLAVSIGFSAFLALSLTPALCATLLRPIDADHHEKRGFFGWFNRAFLRLTGRYRNAVAGILARPIRWMLVYALVIGVVALLFVRLPQAFLPEEDQGDFMIMVMQPEGTPMAETMANVGDVERYLAEHEPVAYAYAVGGFSLYGDGTSSAMIFATLKDWSERREASQHVGAIVERINQRFAGLPNRTVYAMNSPPLPDLGSTSGFDFRLQDRGGVGYEALVKARDQLLARAAEDPRLANVMFAGQGEAPQIRLDIDRRKAETLGVSMDEINTTLAVMFGSDYIGDFMHGSQVRKVVVQADGAKRLGIDDIGRLHVRNEQGEMVPLATFAKAAWTLGPPQLTRYNGYPSFNLEGQAAPGYSSGEAMQAMEQLMQGLPEGIAHEWSGQSFEERLSGAQAPALFALSVLIVFLALAALYESWSIPLAVILVVPLGVLGALLGVSLRGLPNDMYFKVGLITIIGLSAKNAILIIEVAKDHYQEGMSLLQATPGGRAPAPATDRHDLAGVRFRRGPAGALQRRRFRRPGRHRHRGARRDRHRHGTRGVPGTAVLPGGRAPVPVAQGAAHRQLAPDPHGASLMPLAKLSLPTLALCVGLLGACSPTPRQPRAAPIVPANGPDLRGKLDDWQQQFTDPLLRQMIGYAPALSGAQA

SEQ ID NO: 27977 - protein, 128 aa, Pseudomonas aeruginosa
PIPASTSPSAKPSTCSATRCAASSPPNCSRAPRRSTRTISSPWTCGASSARWACSASPSTRSTAVRRWATWPTPWSWKRSAGPRPRWRSPMARIPTSASTRSSATATPNRRPATCRPWYPANTSVRWR

SEQ ID NO: 27978 - protein, 210 aa, Pseudomonas aeruginosa
RRPGPAQRARQAAGARTHQPPARPRLAVPRAFRPRRPRSLRRRGRRRRHRRRDRPGRRGGMHDRRQRCHGEGRHLLSADREEAPAGPGHRPGEPPAMHLPGGLWRRQPAAPGRGVPRPRALRPDLLQPGQHECPRHPADRRGHGLLHRRRGLRAGDVRRNRDGARTGHHLPRRAAAGEGRYRRGGQRRGTWRRRRALQGLRGRRPLCRGR

SEQ ID NO: 27979 - protein, 288 aa, Pseudomonas aeruginosa
PCPGHRPPLRRQPQLAQAGPAAMPCTARAAVPRRGAVRGDSRRQQAALRRARSDRTAGGRLRVRRIQGAVRHHPGLRLRPPARLSDRHPGQQRDPLRRGRAERRALHRVGLPAWHPAAVPAEHHRFHGRPEVRGWRHRQARRQAGDRGGLRAGAEVHRADRRQLRRRQLRHVRTRLRPALPVDVAEREDRRDGRRTGRRGARPGQARAGRARRPAARRRRGGEDQGADPRAVRAPGPSLLLQRATVGRRRDRSGADPRGARPGAFRRPQRPHRADRLRRVPHVTSRPA

SEQ ID NO: 27980 - protein, 1002 aa, Pseudomonas aeruginosa
ARRCAATPRRPSPASASARKARKACAPSWRNARPPGETTHEPGLPQHPAPPGRQPRRDRLPGDAQRARPRHRQRRRAQRHRPPRPPRRRSRHRRRPGRRQARRQLPARRQDHRSCPRQRRPGDPPRLRLPLGERRLRPRLRGSRPALPRTAGGGHRRHGQQVGRQGADGRSRRAAGARLSRRSPGPRDFPPGSRAHRLPGAAQGRRWRRRQGHEGGGARGRAGRGPFLRPARGQGRLRRRAYAGGEIPAEAAPRGDPGIRRPPWPLPVPQRTRLFDPAPPPEGRRGSPRPRSRRGTAPGHGRGRGTRGAGDRLRRRRYRRIPPRRTRPVLLHGNEHPPAGGTPGHRGHHRPRPGRLADPRRSRRGATADAGTGTAERPRHRSTALCGRPRGRLPPRQRPPDAIPRSGRRPRPAGRQRGTRRRRGLAVLRPDAGQADRLGRNPRGSPPAPAGDAGGNLGRRPAHQPGVPPPHPRPSGVRRRRTGHRVHRAPPRRPAAGAASAAGAFLASRRRSLAAERTGPPSRRRPAFAVEPQRRLAQRPGAGVRPDAALPRRTPLRPPAPRQPQPVSPRRRRPGQPGGRCHPSLGGVAPRTPIVPRMGGRTAGHRSRRPDRRGRGRPCPPGRFERADERQYRAGPGRARPDGRSRRHPGGAGGDEDGTQHPRAPRRGSEGAVLQRGRTGRGRHAAGGAGREPGLTAKTRNSMNLPKKVRLVEVGPRDGLQNEKQPIEVADKIRLVDDLSAAGLDYIEVGSFVSPKWVPQMAGSAEVFAGIRQRPGVTYAALAPNLKGFEAALESGVKEVAVFAAASEAFSQRNINCSIKDSLERFVPVLEAARQHQVRVRGYISCVLGCPYDGDVDPRQVAWVARELQQMGCYEVSLGDTIGVGTAGATRRLIEAVASEVPRERLAGHFHDTYGQALANIYASLLEGIAVFDSSVAGLGGCPYAKGATGNVASEDVLYLLNGLEIHTGVDMHALVDAGQRICAVLGKSNGSRAAKALLAKA

SEQ ID NO: 27981 - protein, 126 aa, Pseudomonas aeruginosa
TPSSPSASRPAWRCASACWSCSAKAPRSARNCSIRPPSAKCTYRPGSATTPTSTSASAMPRTSASCSARTTRCCPTTSTCPSATTAAPRPCASPAAKCAGPTARPCRPAPASRCSVPVRVWTTNWS

SEQ ID NO: 27982 - protein, 121 aa, Pseudomonas aeruginosa
ASGSARATPSAKPSRFPAPPSTSPASVCSTTGRRATSRPGNTSRSARSCRRASSPAFRPGWSPPKPWSRSAAPSQRAPKATRGRCRIFTTTTTRPTAPSTSSWRSCCSPRACARKACRRSA

SEQ ID NO: 27983 - protein, 165 aa, Pseudomonas aeruginosa
SATRIGASATGQAWPTSTWSRSSTPPSASAWRWTPGHGSAGSPTWPPPIRRSARPIRPTSRTPRPPEGPQSPAPEDKGGRPPDAPSPIRTSGTLRCTTRSPAFARRSTRAPCPATSGCCCCSSPCCWSPMATMPRCSATWCRPWPRNGAWTRPRSARCSAPTCSA

SEQ ID NO: 27984 - protein, 156 aa, Pseudomonas aeruginosa
PLLPTERPADRDPAVAPAPGRPPGALRVDPRQPRPRPSPRTRRRRPGAARPACLAGQRPRTAQRAGTRAAAGRPTVAGRRRPRRGAGPPATAAGAASSGGRQAGRGFPTGPRSLRARPDRTGPGAECRQCGGSGETPGPGSLDPVQEDHGAGHASR

SEQ ID NO: 27985 - protein, 182 aa, Pseudomonas aeruginosa
FRRPSPSARFPSPWTRCPAPRRSRTSSPRPSSAPTPGPRPGSGPSARCSSSPWACSTCDARRTRRGATAKATAATCATSRRPPMTCACRIPGWRSRRWCWSGSPTCCSPTGSRNGTARSIPCNWPAWPRRCRPRSASSPRSGQCRRPCCWASCWCWRAVSRRSAAASPKAPAARWPARCWRR

SEQ ID NO: 27986 - protein, 187 aa, Pseudomonas aeruginosa
WPSPSGPSAASTSSSTTPASSTWRRCRNSPRNAGTRSSRSTCPPCSIPPAWPCRACSRAAGGGSSTSPRPTAWSPSRREERIRRRQAWRASGLTKSVALETARTPVTCNAICPGWVLTPLVQKQIDARIAEGVSPEQAEHDLLAEKQPSLAFVTPEQLGGLTLFLCSEAADQVRGAAWNMDGGWVAQ

SEQ ID NO: 27987 - protein, 675 aa, Pseudomonas aeruginosa
RSSRILSVLLLFGDYGAACVCYGSLGTRPSRGAERYGAGRTVKAVRRSFPGHERAMPPRKDMARSRRERQVDGSVAGQGQGDALPAADAQGGEALLRVATDHLVQQGHQHPAAGRADRVAKGDGAAVDVDPGGIPAQFPAHRQGLRGEGLVGLDQVQLLQAPAGLVERATGGGDRADAHDRRVDPGAGVAGDPRQHRQAQGLGLGRAHQQYRGGAVVEAGGVAGGDAAVLPEGRLELGQGLDGGAGARLLVGIEAQRLALALRDLDRRDLVAEAPALDGGDGLLLRSGGEGVLLLAGQAVLLRQVLGGDAHVVVVEGVPQAVLDHAVDQLRMAHAQAGAGAGHDVGRQAHVLLAAGDDHLGVAAADRLGAQVQGLEAGAADLVQGHGRHADRQAGLDRRLARRVLPGPGGEHLAEDHFVDLAGIETGLFEQAADHRGAQLGGGNAGQRALEAADGGTGSGDDDDVLHGWFSWIRPWPGRIAAGGRRRCDSLLSYALWKGRSARVYWLIPIYPTRMTQRPPLGRIFPRLLGFAAHYCTRYSPLPLRRQASFILALLFSKLPRLPSPCLLFPSFLLGLPFDPRRPLSSFLSPPAYPSPLPRLLPLSPWSFPCLIPLAPGYFPLLLLFPSSTTPLPLSPYGSVSPPPSFLSPSSLSTPGVSRPLLFSPPSLLSRCGIV

SEQ ID NO: 27988 - protein, 483 aa, Pseudomonas aeruginosa
KGQGDRKQALREHGATGEAPVGGQGGRRSYARELRSHKPRKRGRGERKGEGAAPCSHGVQVPVVLEVGDRVLELLQLAFLAGDEDVDVLRIDVLRQDLAVVQFAQGVAQVVRQARLQLLVGVAFDRGTRLDLVGQPVVHPGKHRGQQQVGVGVGAGDAMFQAYRVRAAGGHAQGHGAVVQAPARRVRHVELRTEAAVGVDVRAEEGHGGRQGLEHAADRMAQCGVLLGILAGEDVVAVLVEQRDVYVQSVPCLARIGLGHEGGVHLVVVGDVLDQALEQHRIVAGLHRVGDVMQVDLELRRCGFGDDGVGRDALGAGAVDDVLEALDVFVEVVDGVHLHRLRTLAGDRRARRLRPAVHVLLVDQVELQLEGGDDGQFHLGEPGHHLAQDFAGVGEEGITFQLMHGHQQLRGRPLLPGFHGEGAGDRVADPVGVADVETQAGTLYGGAGDIEGEQGSGKVDTFFEDFGQTVAFDSLAANHAIHV

SEQ ID NO: 27989 - protein, 361 aa, Pseudomonas aeruginosa
EEQDRSSQPDAPAGMLDRRSPPPCPHDCPRPAPPSLSPRRRRHPPIVPGRRALGAAGGIDGHRSQPHPGRGPGPVRHRLRRRRPVGGDRHAQGRCRVLFDHLHHPPPDLAAPALRHELAAGPVTSAGTLADRPGLPAHRRVLRPRQPARPAQLQPLVRPRRRSDLLYRLEPVHPRRHPAWPQHSRSRTPGPGFLHRRHLHRAGRAAGAQRTDTGLRGHLAVLLGAVQPLAMEFGAGPRRSRRDGRRFHLQQAVSGGAMVWAVIFGMGSIVFLNRYLFLEPRLPIRLGSNLRQFLGFAVPGMLTAICGPIVFMPEGRIDLGYDNPYLISGAVTVALVLYTRNTLASMLLGMAFFFLFKWWLI

SEQ ID NO: 27990 - protein, 102 aa, Pseudomonas aeruginosa
PPARWPGSATPRSSSAGSSDTCRKRKRCSPPRLVRRGCARPCPGAGCRTPRPVRPRAGNRPGAGWRGCPPGNSAPPSRSSGRVRAGTGRACAASAARSGRCR

SEQ ID NO: 27991 - protein, 117 aa, Pseudomonas aeruginosa
SVCSQPTFSGPVRNSARWPFYLRRPADQYGVRSMTRLSAKSERRQRLDGPFPLAAMDNLAQALRRGYRLARQRQLTRRALLDLEAAELKDIGLSAEQAHEEASLAFWQAGKSGGRKA

SEQ ID NO: 27992 - protein, 158 aa, Pseudomonas aeruginosa
RKITQKQEKKSGTPLGEFLSSKHCLERHMSTLAPLFLAKHPDGEERQVIRPNVWETSCADTETLSIFHIEGMADPDLLCRVLNLFAVQSFTPERVRADREDHKIRLLLTFPGLSQHRASVIAEKLRSLVTVLAVRLEFSPHAGKVRPSVSEPLLASVV

SEQ ID NO: 27993 - protein, 362 aa, Pseudomonas aeruginosa
PVAQPMATVQVRQAARRLPCVPPILQSVPMSRPRFLPDNFTLALIATVLLATFLPCSGQTAVVFEWVTNIGIGLLFFLHGAKLSRQAIIAGMTHWRLHLLVFACTFVMFPLLGLALKPALSPMVTPELYLGILFLCALPATVQSSIAFTSLARGNVPAAVCSASVSSLLGVFLTPLLVKLLLGAEGETGNALDAIGKITLQLLVPFIAGQVLRRWIGTWVERNKPVLRYVDQGSILLVVYTAFSAAVIQGLWHEVPWLALLGLTVACCVILALALVLTTVLARRLGFSKEDEITIVFCGSKKSLATGVPMAKVLFATSAVGPMVLPLMLFHQIQLMVCAVLAQRYARRRDDAAAALAEAPSR

SEQ ID NO: 27994 - protein, 452 aa, Pseudomonas aeruginosa
KKPAQGPASSFRRGSARRRAQGDELFRRGRVDADGLVERLLGRPGLHRHRDTLEDLAGLGADHVAAQHPVVVGIHDQLHQGLFLVVGKGQLHRPEAALEDLHLVPGAQRLLLGQADGADVGQAEHRGGNQLVVHRAILLRLEQSPCHRHTLGQRHGGQLDATDHVTEGEDRRLAGLVVLVDRDEALVGQLHSCVFQAQVVQHRPPPGGVEHAVRLQHPAVLEGRGQAAIGLFVDTGDVAVELQVQALLAQFVAQMLADAAVEAAQEQVATVEQGGLGAEPVEDRGELDGDVAAADHQHAARQALEEERFVGGDRVFLAGNVRHLRPATGGDENVLGAEALAVHLDAVRIEQTGVTFEQGHPAVHQQVAVDPVEPLDLAVLVADQGRPVELRLAGAPAIGPGLLEVLAEMRAIDQQLLRHAADVDAGATQVATLRHRDTGTEAGGEAGGAYAP

SEQ ID NO: 27995 - protein, 201 aa, Pseudomonas aeruginosa
AGADDEQIEIERHVPTPGSDAFQHNPFTSVGSRRIDAETCRNGSAQGLAGDGLCLSVEVSAMSPTLTHLALHVPDLDACIAFYETFCGMRVIHRRPGKGSQIVWMAEPGQEQRFIFVIMPGGQPRNLASDDYSHFGFALSSRAAVDDLARRAEAAGCLVWAPRDEPYPVGYYCGLRDPAGNYVEFSYGQPLGPGSEALPIP

SEQ ID NO: 27996 - protein, 94 aa, Pseudomonas aeruginosa
ACCRRPLEAARLRLRPIVMTSLAFGFGVVPLALSSGAGSGAQVAIGTGVLGGIVTATVLAVFLVPLFFLVVGRLFRLRKAPRTGNSPQIPTEQA

SEQ ID NO: 27997 - protein, 692 aa, Pseudomonas aeruginosa
PPPVRPEHRRIPAGPGQGGRHVHRPQRQPRLPVRRGRRLRPRRDDPQGRRRGDPLQRRARHPDGPGRDPDPRRQRLHQRVSHRPPVARRQALRDRRRHQRDPPHADRPRAVQRNPLKPRSSRPFSARERAFHCIDRRIARSGAGANRFRPPRHGATAMAILHTQINPRSAEFAANAATMLEQVNALRTLLGRIHEGGGSAAQARHSARGKLLVRERINRLLDPGSPFLELSALAAHEVYGEEVAAAGIVAGIGRVEGVECMIVGNDATVKGGTYYPLTVKKHLRAQAIALENRLPCIYLVDSGGANLPRQDEVFPDREHFGRIFFNQANMSARGIPQIAVVMGSCTAGGAYVPAMSDETVMVREQATIFLAGPPLVKAATGEVVSAEELGGADVHCKVSGVADHYAEDDDHALAIARRCVANLNWRKQGQLQCRAPRAPLYPAEELYGVIPADSKQPYDVREVIARLVDGSEFDEFKALFGTTLVCGFAHLHGYPIAILANNGILFAEAAQKGAHFIELACQRGIPLLFLQNITGFMVGQKYEAGGIAKHGAKLVTAVACARVPKFTVLIGGSFGAGNYGMCGRAYDPRFLWMWPNARIGVMGGEQAAGVLAQVKREQAERAGQQLGVEEEAKIKAPILEQYEHQGHPYYSSARLWDDGVIDPAQTREVLALALSAALNAPIEPTAFGVFRM

SEQ ID NO: 27998 - protein, 208 aa, Pseudomonas aeruginosa
DRPARRSHPVARPGGKEQRLQCRRDRRTVAGHRSRRQRPAGPPAGAARPWPALLRRCRPGLDAAVGGPRLPGQPGRRPAHRRTHDPSLQPAQADPGGGPGRGVRRRGRPGQLLRYGHRQRRRDLLPVRGTHRPDPGDHRPVRGQGHRPARRAALFADRRALRRTPRQRTGPAQRKLSRRRTGKPGRGLDRQPAAKQPARPGRLQGALP

SEQ ID NO: 27999 - protein, 701 aa, Pseudomonas aeruginosa
GRGRRAEPGAAPLHRGGHRPHPHQPGRPGRPARLPGETHARLEKRRMNPDYRSIQRLLVANRGEIACRVMRSARALGIGSVAVHSDIDRHARHVAEADIAVDLGGAKPADSYLRGDRIIAAALASGAQAIHPGYGFLSENADFARACEEAGLLFLGPPAAAIDAMGSKSAAKALMEEAGVPLVPGYHGEAQDLETFRREAGRIGYPVLLKAAAGGGGKGMKVVEREAELAEALSSAQREAKAAFGDARMLVEKYLLKPRHVEIQVFADRHGHCLYLNERDCSIQRRHQKVVEEAPAPGLGAELRRAMGEAAVRAAQAIGYVGAGTVEFLLDERGQFFFMEMNTRLQVEHPVTEAITGLDLVAWQIRVARGEALPLTQEQVPLNGHAIEVRLYAEDPEGDFLPASGRLMLYREAAAGPGRRVDSGVREGDEVSPFYDPMLAKLIAWGETREEARQRLLAMLAETSVGGLRTNLAFLRRILGHPAFAAAELDTGFIARHQDDLLPAPQALPEHFWQAAAEAWLQSEPGHRRDDDPHSPWSRNDGWRSALARESDLMLRCRDERRCVRLRHASPSQYRLDGDDLVSRVDGVTRRSAALRRGRQLFLEWEGELLAIEAVDPIAEAEAAHAHQGGLSAPMNGSIVRVLVEPGQTVEAGATLVVLEAMKMEHSIRAPHAGVVKALYCSEGELVEEGTPLVELDENQA

SEQ ID NO: 28000 - protein, 454 aa, Pseudomonas aeruginosa
RSQRARSPADRRQAAPTPRRPQMNLDSTALAYQSGFGNEFSSEALPGALPVGQNSPQKAPYGLYAELLSGTAFTMARSEARRTWLYRITPSAKHPPFRRLERQIAGAELDAPTPNRLRWDPLALPEQPTDFLDGLLRMAANAPGDKPAGVSIYQYLANRSMERCFYDADGELLLVPQLGRLRLCTELGALQVEPLEIAVIPRGMKFRVELLDGEARGYIAENHGAPLRLPDLGPIGSNGLANPRDFLTPVARYEDSRQPLQLVQKYLGELWACELDHSPLDVVAWHGNNVPYKYDLRRFNTIGTVSFDHPDPSIFTVLTSPTSVPGLANIDFVIFPPRWMVAENTFRPPWFHRNLMNEFMGLIQGAYDAKAGGFVPGGASLHSCMSAHGPDAESCDKAIAADLKPHRIDQTMAFMFETSQVLRPSRAALETPALQNDYDACWASLVSTFNPQRR

SEQ ID NO: 28001 - protein, 657 aa, Pseudomonas aeruginosa
LGRLRQWACRLSPAKPAAGHLQPCRPEPALRRGHRRLDPRPGRGAGRRAVRGCRRRSRRSHPRRRAERLLRPRQAGPRGAAPAPAGAARRRRRGAPGTAPSGRRVPNAPTGQDRRLHRLLRRHPPCRERRQAVPPGQPAAAQLQARAHRLPRPRLDRARLRQRSAPAQRPDPAGRRQRAGVRSLCASGLRTGARHLDRPGQRPRRSHPGFPRRRAHRRLLSAQRLVGARHPGLGIPAARPVPVEELHHQRFALGGHRRSPGAVPPRPASAPRRRPAAAAVSLRRQRPGPRRLRHRAGGPAAHRGPARERPAAAAPDPEQQPEHVLDGGADGRPPQRQWLPVAARRPVRLRHPVRRRARPVRLAAGDHRWRQAAGATASRRDPAFLGGRRRGHPPAPAASARDMFRSVSANVAAKCSRPIRGRADEALYLLPFHLLLPGAHRPGAEGAGLPVAAGQPGPRRRRTPPTRLPGAQPAGPRTGPAGRRGRAADPVAGDHRVPRGALPAPRPALQRSAAPRPRARSRGAGRLRHPPVAQRQRAQPAAPVGTRRRAGPAVDRPLGRPGSRRRRATDRRPGLVLRRPARPGRRLPGPAALRRRALRRGAGRLATDPPGRRPGRRPSGVPPGPSGQPAGHPGRLRDRRVPLLKIKGGVRRTPHHQ

SEQ ID NO: 28002 - protein, 956 aa, Pseudomonas aeruginosa
EPQVPCDAQPDRQLSRGARRAPRVPLPVAVAAAPRPVAGHRWLRCPGARLRGADPGPGMGPGQGRVRPGVQRQPVRPDRRFAAGDAAGGPLRHPPSAALLRADLRQPDRPDGLRRFPGKPDAGALRLRHRNGRGDAQRHGADGRVFATAPAYPDGHPGGLRFLLRRRRRRFRRRRLHGRLRLAGGVPRRRRHPVAAVPLPPPVPAGVAAAPAPRRTALCPPTPAQRAHGAGLAAAAGTSRRRAGGEPDRAGAVPPRLRAADPAALGDLLRQPDPALLHGQLAALAAPGKRPDTQCGEPGDLDVPLRRHPRRDAPGLARRPPAQQGPPAGGDSRRRRAVHPAPRPQPRPAALAAGVRLRRRLLHHRRAVDPERLRQQLLPGPGTRHRHRLGAGRGPLRFDPRPTVRQPAAGHAHIRGEHLHACGDSRRARRATDPPGPLARRPGAAGKRRRAGRRGILSLHRERLPGYSGGPFRRPPQEPPMNDADSLQDYQRVRQQAIRSLFEIVEGSSEGTVIVDREARIVWINQRYAQRFGLADPAQAIGRPCESVIPGSLLREVVGSGKPILLDMMDSAKDPLVVMRLPIHDDAGEVIGAIGFALLDELRSLSPLVTRYLSMQRELASTRSQLQARQAKYSFSHFVGTSPASLEVKRRARRGAASEAPVLLLGETGTGKELLAHAIHSASPRAHKAFVSVNAAAIPESLLEAELFGTAPGAFTGAERKGRPGKLQVAQGGTLFLDEIGDMPLALQGKLLRVLQEKEFEAVGSNEVIRSDIRLVAATSIDLQQAMREGRFRADLYYRLNVLPIEIPPLRQRLDDLPALCESILDSLDHGRLHELGGDALALLARHAWPGNVRELRNVLERALLLADQPLLDAAALGAALGPLQPLPELPRAADDRPVGDFQQAREAFERDLIGRALAQSAGNVVEAAKRLGLGRSTLYKKIMALGMRLDNGTHL

SEQ ID NO: 28003 - protein, 311 aa, Pseudomonas aeruginosa
DLHSHGTFARLRLHFETTLFPTLPFVSPQPAKTAILGPGTVIAMCLSDGPAPFQAVTPVPAPFDNKKQARSALPHAERAPQRRGDMPDERDHRPCRPGPADAGRLPRLQRHPVRPPRRPRRRPAHRSQRGRADLHRGVHGEDGRFHQALLPGFPAWRGVRQADRAGRLLPLHRRGGDPPARHPPGDAGDRTGLRAAHLRRRLAVRGGVRGLPVRRGDVPPERHPQAIDSGDHRPRRVFLHHGRAARHPADPEHHPLDLLRHPRLGRALARDPRRAVRLRRGPALPATPGEQGAAQRRRLRQRPAQRAGDRR

SEQ ID NO: 28004 - protein, 413 aa, Pseudomonas aeruginosa
PAPAESLAGALAAGAGRGRQPAVHPLDPAMVRPGPYPATGRHGHAVADRGRQAHRDLGSAGGPAAGHPAGAGERFRGDPQPPRRRHPQRGGRLAAGGDEHRLGIRLRRGDRLAAGFPGAGRRAQEHSQSAGQGSDHRHPAGRHHRFRVGRHEHRPGGDVRYLHRRRQRRADPPGSPPPGRRHGQRRDGYPAAQRRGDHPPGGHRPDPSGGVQGHFRYYPDQDPGGVLRHRAVLRHRPGLIRPFFIQREKQHDPERQDRPGHRFHQRHRPGHRPEPGRGRRRPAPQRLRRGRRGAGAGPRPRRARRAPPGRPLQPGADRRTDGLRRADLRRRRHPRQQRRHPVRGAGAGIPHGTLGRDHRDQPVPRVPYHPPGPAGHARARLGADRQHRLDPRPGRLRAGKSAYVAAKHGVPPA

SEQ ID NO: 28005 - protein, 271 aa, Pseudomonas aeruginosa
TGHHIAADDHEGHLHGERDQAPETVAEGFRRGGRSGAHGQRGQADDEDGQGGEHPGVGKPALGPVRATHGEARGAAFLDGKDSGHRGFSRFYCYSATTGPPVCATAPWAPGRPEGRNGTGPVGRSRPSAARSLDTSAPCPRERTWRDHAASGRSMDQSRARVRATPCPPPMHRVARPFFASRRIISCSRVTSTRQPDAPIGWPRAMAPPLTLTLAASQPSSRPTARDCAAKASLASIRSSCSRLQPALSSARRVAETGPMPMIAGSTPALA

SEQ ID NO: 28006 - protein, 161 aa, Pseudomonas aeruginosa
GARLMFSWPPATITSASPQRIAWAPRCRALRPEPQTLFRVMAGTPTGRPALIAAWRAGFCPDPAVSTWPRITSSTWPASRPVCSSRRRITAAPSSGAGMPASEPWKLPTAVRVAATMTTSCMDGSPGFARGRAESLRVDVDGATASYPTPSGKDGPRESTG

SEQ ID NO: 28007 - protein, 110 aa, Pseudomonas aeruginosa
PRRAPPAPATPRIAGLKVSFTAPARLAPTRPGEWLEHSPLLIILLVLLAGGWLVHEFSTKPAILAISGLNTYNLLFLMLGALLHWRPRSFLDAVARAVPTTTGVVIQFPL

SEQ ID NO: 28008 - protein, 145 aa, Pseudomonas aeruginosa
GSIAAIMTTVNGSDGETLAHHIWTLFGQIASHDTYALLMGVYSAVMGFFIPSGGGKWIIEAPYVMQVANELQYHLGWAVQIYNAAEALPNLINPFYMLPLLGVLGLKARDLIGFSFVQLLVHIPLVLVLLWALGSTLAYIPPVMP

SEQ ID NO: 28009 - protein, 301 aa, Pseudomonas aeruginosa
RRITPVALSALRNGAGELRMVPSPFRERVWGEAGRPGYCATQPPSMFQAAPRTWSAASLQRNSVSPPSCSGVTKASEGCFSASRSCSACSGETPSAMRASICFCTSGVSTQPGQMALQVTGVRAVSSATLLVRPEARHAWRRRMRSSRREGDQAVGRGDVDDPPPAAREHARQGQAGGMEHGGQVDRDDRVPAFRGEFLHRRHVLDAGVVDEDVDAAEGPLGEGHQFADLLRAGEVGRVVLCAHAAGADLRQRRVDLAEAVEEQVGAGLGQAQGDAQADAAGGTGDQGGLAFQGHAVSPAG

SEQ ID NO: 28010 - protein, 499 aa, Pseudomonas aeruginosa
KKGGSDQAGGVEQPDDEEHRQGLDQGNTENVLVRLPMGQAGDRQEGDHRAVVRQGIHPSAGHGGDPVEDFQGDLRGVGGGDEGIGHRRQGDAHAARRGTGDAGQQGDGDRFLDQRIGNALERVGQHQETRQRGDHRAEAVFRGGVHRRQQRAGHRAAGAFGEAAADRRETARQHQQDAQQQGRLHCPDRGELADLGLQRRGHAGQLQGMDLAVPLRDPVGEQQVGDPDQHQRRERQPGIRQAQVIGGLRLVAQVAAVAFAVAPRLVRLASQVEQAHGEDEQRAEGPEPGRGPGVGAEEGRGDDVLDLRGAGQRVHGEGKRAEGDGRRNQSLGDVALAEHLRGERVDREHHHEQRDAAVGEQRADQYDRQHRLAGAEQADRRRDDGAGEAGQLDQLAEHRAKQENREVELDETDHLLHEHPGEGRRDRAGIGEQDGAEGGEGGEQDDAVAAVGGQHQQAQGGKGDDHAHRAYLHGAAGRAPHGEGRSGPVSCCRTVRAPA

SEQ ID NO: 28011 - protein, 227 aa, Pseudomonas aeruginosa
SSCTGSSDPGPGVSPLPPHCRHSAPGPVRSGRARRLRGPVGNPRPACRPPLEAAPAAVAGGPAPRRGRRRPATVGRPAAARVPARCAVRGRCPARHAGRAAPGRRRRVRGDGRGRGCRGSTRRAPGGRPGAGATAGSRSAGRSVGSRGQRGNGLRASPAAGRWKWRRPGGCRCGSLRWNPPLRTLSPVARATACLARPAACRRSRRGTTCRPGPPATCLAGPCARHR

SEQ ID NO: 28012 - protein, 209 aa, Pseudomonas aeruginosa
RGEPGGNRRKHEDVLHGYVHAQQQAAEQWAEDRTEAAHAQRPAGAGGAYLGRVEVAGEGVQGQLPADDAEAGGEDERQQPARLVVVEAEEQGEQRGAGENRRQQADLAAQAVGEPGQEHRAEGAGEEEHRGRQVRRIACQAAFLEQRGQPADHEVEQDQADEEGRPEQQGRPRVTVAEQLQHGQARRRLGVGLCRRRLPARRHALAELA

SEQ ID NO: 28013 - protein, 685 aa, Pseudomonas aeruginosa
AGIGRCVAEQARQRLRQEQEEEGEQQQRGDAAGEEHRLPAEAVHEGGGDETAGGAAEGETAGRQGDHQGTQARWRILGHQRHGAGHRPAHSDAADEARQHQAFQGTGEDHQDGQAGVDQHAAEQHSADAEAVRQRRHQQRTDGQAEQVGAEHRAERGLVQAPFLGQGRHHVAEHLGIVAIGDQQQGEEQQQQPLVAGHGARVERRAKAGDLVVHRKVPEVLIGDGASGGRPPLSSGAGLCGPSGGRGVRLVGRMGLAERRMGGGQVGDPADPWPGVQRHAEALGGVELRDQVDVGQAWPVAEAPILVADQLLDGGETLADPVADPLPDLLFVVSPLAQQVEHAGVVQRVDVAADQRRDSALVGAAQRIAGEQGGVRVALLEVLDDRRRLDQQLALVDLQGRYAALRVERQVGGLAVFAAVADQVDRQRLVVQPLQRQGDAHPVGGGGTVVGIELHPRAPGWAASTLPRHSPKPIETCPSRLQRGPEDDLVSVLQETPGLAGRQLHRLLAASGDLQQRAELAGLGAGQGAGAEQVAGLQLAAIDAVVGDHLRHRPVHAQAVAQGQALRRQAFLAQALGEQQDLQLDVEGAVGLVVVVVKIRQRPRVAFGARWLGAAERLQGFGGDHPGRNAGDEALRQERAERLVFPGLDVARRPVVEQTEAGDVLGGAGNRDGFAEGVALADPDA

SEQ ID NO: 28014 - protein, 210 aa, Pseudomonas aeruginosa
SGAGRTCRARCCRARRPRPAASGQARRPTARRGISAPVAAAGGCPRSAPPGSGSRADWPGHCCRSGRGRAGAAARRGSRRYSRVPRRRAARRGTSSRAGSPRSPAVRLAARRVRCTGADGPIAGPAAVRHRRRRSNAPSSGWPGTGRCSRRRACRRARWRPCAAGRRGSRWAARAVPAGPSAGGWESAHPVRHRRSVVPGGGTADAWPTA

SEQ ID NO: 28015 - protein, 163 aa, Pseudomonas aeruginosa
SRPAALRSSTRRILSATSIGCFSFCSPSRGPTSTRRTFFGRFMLFLVLAVRPGSRPAPPAACLPRPVRPRCNTAPSLPRRGARGCCVPSSSPPAPPGWRRLRPSGRARPGPARYCRSSARSNRPGGHGRPRPRRSGRRLRWPAVRPPIRGTIGVRGATPPSDG

SEQ ID NO: 28016 - protein, 315 aa, Pseudomonas aeruginosa
SCRRAGSCRRAWRRPGRRRCRLRRRGGRGGRCRCARRRCRCRGRARCASPGRRSRRGWRPGGAGCCGSPGSCVVSPGGRAFLQEGAQAFLAFRADADAGDGRLGVAAQRRAQLGGLDLMVERLAGDQGARAVLQQVGDPGLGLAFQFGGGTAFAEQAQFAGAASVEALGGQRIAPRGALADGLDHERGDGRRDQADAYLGQAEGRVVAADGHIAATDQADPAAEHRALDHRQGRLGQVVEMGHEFGDALGVGQVALVVEVHRLLHPGQVGTAAKVPATAAQHQQADLRVAADAIDGLQQFVDHDGIEGVVLFRPV

SEQ ID NO: 28017 - protein, 446 aa, Pseudomonas aeruginosa
SGCAGWPWRWLRVEVGGSGWRPLPTWRCACRCNGMPSPWRKRAGKSEASAGFVEQLAADQHAADLAGAGADLVELGVAQQAAGGKLVDVAVAAEDLDRVQGHLGGALGAVEDHPGGVLAGRLAAVAGGGHGVQVGAAGVEGGVHVGHLALDQLEFADALAELAAVMDVRHHHVHARLHDSHRAAGKHHALVVEAAHQYLDPAVDRAEDVLLGYLDVLEDQFAGVRAAHAQLVQLRPATEAFPVALDDERGDPVRALVRVGLGVDHIGMGIGTVGDPHLAAVENEAVADPVRAQLHRDHVGAGVGFAHRQRTDVFAGYQGRQVAGLLFGVAVALDLVDAEVGMRAIGERHRGRGPADLFHDHGVGQVAQRRTAVLLVDGDAEQAHLAELAPHVHGELIVLVDLRGARLQFGGDEAAHLVAEHVDGFAEGEVEAGIGHAFTCNCACPV

SEQ ID NO: 28018 - protein, 139 aa, Pseudomonas aeruginosa
MLPTAPLKNAIGTNTETSTTVMPTMAPLIWRIALTVASCGDRPSSAISRSTFSTTMIASSTRMPIARTMPNMVSTLIEKPRPSITVKVPSRATGTTSVGIRVARKFCMNRYITANTSSIASSRVLTTFLIEISTNAEVS

SEQ ID NO: 28019 - protein, 154 aa, Pseudomonas aeruginosa
RLSLSAAAAWLASARARAPRLMSRAAFKGAGSIWNSTVPARTSWPSSYRRRVTMPATRARTSAWRYASRRPGSSLVMPIGAGLATITPTSAGASAVFPASAASSQPSRNRATRAASSPRSEPVHWMCMGVPRFVNSRACPGKGTATHERRDSSI

SEQ ID NO: 28020 - protein, 481 aa, Pseudomonas aeruginosa
LHASVTRLPPRLAAIVRRERARPAEDDAMRLCVIGAGYVGLVTAACFAEMGNQVRCVERDRERVARLRRGEMPIYEPGLESILRDQLDAARLTFTASLAEGLADAEVVFIAVGTPCGEDGSADLSHVLAVAEQLGAQLRQACIVVNKSTVPVGTAERVEEIIRLGLARRRKRFRVAVASNPEFLKEGSAVDDFRRPDRVIIGSAEAQAGETLRQLYAPFLRNHERVLLMGRREAEFSKYAANAFLATKISFMNEMAGLCALTGVDIEDVRRGMGSDKRIGTHFIYAGCGYGGSCFPKDVRALIRSAEQQGYDSQILRAVEARNARQKELLFETLGELFQGRWQGRTVALWGLAFKPGTDDLREAPSLVLLEALLRHGVRVRAHDPVANAGVAARYPEAVACARLTLHDSPYAAVEGADALVLVTEWKQFRQPDFQKIRGSMRTPLLVDGRNLYAPARMAELGFIYQGIGRPRAGHCKASAA

SEQ ID NO: 28021 - protein, 283 aa, Pseudomonas aeruginosa
FCATCAYLIPIFFFVGNIYVHSIGYLRSAYSCVATGGILAFHRRDRRAHRTFPVALLAAHPAPEGGGGDPQAGDPARPQEDRPEYPGIRPDQAQRPWAQEPHRFRRGDAPVSRGAGVPRTDGRGGLHAAYRHPRYRILRTLFLRETVGGAGHPGSELHRRLVGNQIHHYLAPARSLSLPGERLPMTISKTKSSFYRRLYVAYLIDSGTASVPEIMAATGMPRRTAQDTIAALEELDIVCEFEQREGARNHQGGYVIRDWGAVRREWVVEQHRRIAAALEYPAE

SEQ ID NO: 28022 - protein, 494 aa, Pseudomonas aeruginosa
MVDFATICTGPAFAHPGVPLMTLYLQLAETLGSRIEQGLYRPGDRLPSVRAMSIEHGVSLSTVQQAYRLLEDRGLAEPRPKSGYFVPVARQMPPLPAIARLAQRPVEISQWEQVLALVSTVPRPDVVQLGRGMPDISSPSLKPLTRSLARLNRHADARALAYDGIHGSPLLREEVARLLVDSGCRATASDVVITTGCHEALSVSIRAVCEPGDIVAVESPSFHGAMQSLKGLGMKALEIPTDPVNGISLEALELALEQWPIKAIQVTPNCNNPLGYIMPESRKRALLALAQRYDVAIIEDDVYGDLAYTYPRPRTIKSYDDDGRVLLCGSFSKVLAPGLRIGWMVPGRYADRVLHMKYISTGASALQPQLAIAEFIGNGHYEPHLRRMRAQYQRGRDLMIDWVARYFPEGTRASRPQGGFLLWVELDEAFDTLRLDKALRNRGVQVAVGCIFSASGKYRNCLRMNYAALPTPAIEQAVRRVGESACELLEPCEA

SEQ ID NO: 28023 - protein, 310 aa, Pseudomonas aeruginosa
WAIGAWARCSTDGPLRRETGGRLRDADRPPVAGLRVAAPAQSRAVAGPSAGTGAPAQRRLRRRRRTGGAGRVASRLAFRRGGPVGRHARPGPPALRQARPAGADRAALRRRRRATACAALRCGAGPAGAAFPARRPGQAALSRGGRRASGASGAVAAGQPDGSPGRLRTSGAGRGLPLGRAFPGGQRRHAATLARGFRSVVRAAPRRTAGRHRLRPAQPLFPGRGLPGLDRLPRRLRMPQARRACGVIWRGSVSSSSSAGRPLSRARRNAAGKSALHSTRSAWAPKARARATKSGLSRRVADTRPGYSRS

SEQ ID NO: 28024 - protein, 493 aa, Pseudomonas aeruginosa
NIMKGIFMKKSMISCLCFVLLLHFLLVSKVAAEVFCESCLQVRVERPLVVRGGSHEPGLDTKFYVIKLSENLFRGYSSGGGDAYAITGPEAWSMGWPANKVLSKGAAGSYSECGVWINSPVKIGDVYVAAVHQEQKCDYINGGQTHKSMGVSFSYDGLSWVNPITVLTSPEAPKMGTQSGEGDCSLVRAPDEGYLYMYCFRPGRWDNIVARAPEASYMFPSSWRKLYKGNWSEPAVGGMADSLGTIGSSVGYWRAGRKVIALDLDPWFGGIKLSLSSDYKNFFTLKDPLVPFVKNDWDRNLIGKSTDLIAYVGVVNLLGGGNRVDNSGWGITYTYIPHGGTLKEKYLVFQGVNMKVVSEPQQASVGLALTRWEHRSGKYRVTTLPVVRQSEYTERNRIAYLLTRPVVGIETLEVEECVNRQDPDDYLVTDAGGCDGSGHDRIATIGWVYKYPQKNTVPIYRCYSPLGENHFLSSNAGCDDLGSLEWKLGYGLK

SEQ ID NO: 28025 - protein, 453 aa, Pseudomonas aeruginosa
SLLRRPPRSPAPGGGQVHRDGTDHRRRLRAGVLPDRPGERERPAAAAALADLRQASAVGAGVLHRRPRRIRRVPPGHHRRRPRPGHPGRRHRRRIRTGAVRGQPASRRRPDEGLRLCGAAQAPDQEHRLRPRDGHHLHGQALSGPGRERTARTHLAARQARQQHLHQRGSRAERRIAPCDRRRARDPAGLHGLPLPERQLLPPLRFAVLRAERAELGPGQPHRGPARAHRQPGRGTPGTSRRRRRRQPLPAAGLGACRGAPRADQQGRAGCPDRRQLLRAVGAEPAEQPARRPARTGRQRDPGEVHRSEVHRHLRRLQGKRAGGVRVLDLRPRVQLVPAHRVSMGRLLPPSALPSPAFAACGSAALSRSSGVRPGRPPGLPPWPRAPVALASDRPALFSLRGDGLLAVYRLCFASPARATARLACPPLMLRAPPGGLCLGIGVSPRQLVFLSL

SEQ ID NO: 28026 - protein, 507 aa, Pseudomonas aeruginosa
TRLAAGEVGGNNECNSARRIPVTEGRSGRGGDVGSSGWGRWGSASRLARTVLSRGRRIGGCRTVYVHPQRFGPATGESRRTIHARRRHRRRYPYRRRQLPGLAGRHSRPRAGRRGDPPPARTDRSRCRPGRRSDPRPGAHRRVRAEPGAPGGDQGRPAGRRAGHDPEQGLRLRPQGPAPGRPGDPLRRRRGDRRRRPGEHEPGALRHARRPHRPAHGPCEAGRQHDRGRPVGRLQRLPHGHHRREPGGEVRPDPRGAGRLRRRFAAEGHRRHRGRALPRRDHADPGPAAQGRAAELRYRRAAARRHHRRGPGQAQAGLQEGRQRHRRQRLQPQRRRRRGIADERGQGQGPGPAGAGADRQLRQRRGRPGDHGHRPGLRHPSRARQGRLEPGATGPDRGQRGLRRAVPGGGPGTGLGCRQGQRQRRRHRPWPPDRRVRLPGAGDPAARDDPSRREEGPRHPVHRRRAGRRPDPGPRLIHRPAARGVIAPCPFAGAWRARVQGTSGGRP

SEQ ID NO: 28027 - protein, 273 aa, Pseudomonas aeruginosa
PSDRPRTVPPLGTAGCPGSRSTHRRPRSRRITIKPRESAMTAILPIQESRSARFAMRCSNWAERWFPDSWVFAALAILIVSLAALAMGAGPTATAKAFGDGFWSLIPFTMQMAFVVIGGYVVASSGPASRLIDLLARVPKNGRSAVCWVALVSMLASLLNWGLSLVLRRPAGTRPGAPQRPAHGLPRRRRRGIPRAGRGVGAGPVVVGRAVAGQPGQPATVDPGDHRGDPVHRDHLPLAVRGHAAGADPGLAGDRLHDRAERRQRPRRQGLRG

SEQ ID NO: 28028 - protein, 240 aa, Pseudomonas aeruginosa
RRPARVAFPPAGRVPPVRARRPRRCARRSASAPAGSAPSRGRWRCRSPACAPFPAPHSWSGRRHAMLGGDVCALPGAKATRPWVEAMLTIRPQPRASMPGRARRVVWNTGDRLIAMIASQRSVGNSCTGATYWMPALLTRMSTPPKVRSAKAISSPICSGLERSAGWCSARTPRARTCASAASTSPKPLRSRSAPASARLRAMPRPMPLVEPVTRAVLPFRVMLFLPLDEKRADQTRPVA

SEQ ID NO: 28029 - protein, 245 aa, Pseudomonas aeruginosa
NSPMTKNTARVLIRVIPKMSLYASRWVRPVTARRVITAPLCGRVSIPPLAMAATRWRTSRGICAALAAAMKVSDIAARAMLMPPDAEPVMPASRVTVIASLTSGLGMLLSASASTRKPGSEAITAPKPYSEAVFIAASSEPATALRVPSARRLRIAAKPLASTSRMPSSRAACTAQIAVSLPTSVCNGVAMPASCRVWTWPYHCGIQWVNSRLATPTSTSGESASQGFGRRRSSAVSGSLRRSLP

SEQ ID NO: 28030 - protein, 217 aa, Pseudomonas aeruginosa
SSESSVAMQISVRLYLEMGPVIETHAQRHDLLVQGRATQAQAFRRFHHIAGTLRQGPSDQVALEGFAGLLEIPDRPVVRRSRQLRQRLQGAQRRAEGGGVQQRLVGQQQRAFQHVAQFADVARPGMPGEQRQGVAAEFVETAVVEAVEDRLAERREVVQALAQRRDLDRQDVQSVVEVSAETAFAHRLLQVDGSGGDQADVAADHFVGTHRFELFLL

SEQ ID NO: 28031 - protein, 376 aa, Pseudomonas aeruginosa
HAQQLALQGQRHVADLVEEQRAALGHLQLAWPALALGTGEGPRGGTEQFGLQQAFRDRRGVHADEGLVRPRRSAVDGVGEQFLAGAGLAEQQHRRFAGRATTGAALDFQAGRTGTDEVAEAVLGLARLQLRAGRGQFALHAQVAGHQRRQRTQFVEQGEADGADHFAGVVVDRQAHHHQRVLRAIHHVQQDRLAAAYHLAQQATGDHAFAGPADSLRRVGEAETLGVALVDPDDAGLAVDDHRAFAGAFDDLEQRTDRLLAYALVILEAVGVVHRRLLRRTAKRAATVAGKPLAVKAQDSSTASAAALSRCAWAAGERTWRISSAASPAGIAASMKMFSTDMCMPSSRLPNSGPRIEPKRPTPSAQPVPVARTWAG

SEQ ID NO: 28032 - protein, 584 aa, Pseudomonas aeruginosa
SPILAGRCIWHSAAGWSSSGRSAAPSPSSSSRRWRSATRAGLPRAKKAFSAPPRVASAASPAAPSNSPAASAASRSRIESPMATPQRGLRPARLKMPSGRFCRGKSACPLAEATQLRVGVGWFMGLSPLRVEGGYERRPAGIVVILQGRRLEGGTARPEDLAGLEHEGHGLVDPVRLEVGGDGLVAAFRVRAVGAHATVQRGAAGHEAAGLGVIGALDQAHEFVHQVAVEPWRTEGVLGHHPARREDHEVDVGQAGDAGGGGQHGEDRRVWVVEADRADGVEAAQVVLVGHVVAVPGDHVQRRVVKLAGPQLAEVFLHQLQRLAAVLVARHRGQEVARIGQAIAADRAEVGQAQRRAVVLGDIAACLAVEQLDAELHPARDHRDLQRFDLQRAEFGAQAQTAQLRDQQQFAIGVVEATLHRAVGQVLVDAHAGGLVAGRVGGHAQQAVEEVGGLLGQCQRVPAQAVGSRRIQFGTGDLSFQAAERRMLGRRRDAVQPGAPGLAASHGEGGAGEQFGVQAVGRFLRGVLADRQGAGERFAAEFVAEARLIGEGSGVEVHLRPPGSGGSLPPIRRGPGTLAALFLS

SEQ ID NO: 28033 - protein, 288 aa, Pseudomonas aeruginosa
RNLSGRQRQAITSAPPAGTRVHGKEQQSRRNLRQAEGPLRRSRYRYPQGPRRTLPGDLAVAPGGACGDAGEQGPSLSAGIDRQRLRGPGRLHQSLLAGARGAARGPGGAGQHGRAEERRRAAGRAARRAQRDLLPRRLGQPWRHRGTGGTGGARGDGGHPGRLGAAAARFVHRPGVRRVPAGTRGGRAARGRVGRACRPSAGRPGGLRGAPGGIRARGLHAIHGLLMPGVEALSAPVFDARGRVAAVLTVVGPASIFQAEEQGPAAERLLATTRAISWRMGYDGTQGG

SEQ ID NO: 28034 - protein, 412 aa, Pseudomonas aeruginosa
CCAGRRLPTRRRTPPLPSLPTPAPPRSLSGSAPAPRRSRRDAGGCRRIPRPSRPSAAPTWARRSCPLRCSPGRRRSGHRPGGSCRPPRSAVSRSAVRRADRPPPGGPSSAGSCCSSSWLSGLVLVQLHQRRAFLDQFALAAIQRLHYPGVGRADAVFHLHRLQHHQGGAGFDRLAGLDQDPHDTAVHRRAQTALVGMGGLGLGDRVDGFDGQQFALPFEEQLASAAQRRRATGDTVHPADQVVAVEAILAGAGVAQADAAAFVAAAQHQVGLPRQGAAPAVVAAPRRMRVVVATVARFALQPGFGGGLPEMLRQRLRRRQQVVLVARDEPGVQFGGGERRMAEDAAEERQVGAQAADRGFRQHRQQALAGFLAGFAPGDQLGQHRVVERRDLVAFAYPAVDPPAGAGGRFAV

SEQ ID NO: 28035 - protein, 359 aa, Pseudomonas aeruginosa
RLAASDADLPGDQVEAGDGLGDRVFHLQAGVHFHEEELAAFVEEEFDGTGADVADRLRRAYRGLAHGPAQFRAETGGGGFLDDLLVAALDRTVAFVEVQAVAMAVGEYLDLHVARLQQVFLHQHTRVAEGGLGLALGGGKGLGQLGLALHHLHALAAAASGGLEQHRVADAPGFPAESLEVLGFAVIAGHQRHAGFFHQRLGGRLAAHGVDGRRRRSEEEQAGFLAGAGEVGVLREEAVAGVDRLGAAGEGSCDDPVAAQVAVGGLGAAQVDGDVGFGDVAGVAVDVAVHGDAADAEGARAAHHPAGDLAAVGDQEALDAAVVRVHASFLQAGVRFSRKARRPSWPSGLMRMRAMAASV

SEQ ID NO: 28036 - protein, 306 aa, Pseudomonas aeruginosa
DLAVHVGAAKFLGADHLAGSGLHQRRPGEEDGGLFAHHHGFVGHRRHVGPAGGAGAHDHGDLRDAAGTHVGLVEEDPAEVLAVGEHLVLARQVGAARVHQVDAWQAVLQGDGLGPQVLLHGQRIVGAALHRGIVADDHAFHPFDPADPGDDAGGGDLFAVDFVGGEGGKLEERRAGVEQAVDAFAHQQLAARAVPGLGGATAAFVDAAEEGAQGVDLFQHGRGVGRELGGAWIDLGVQDGHGGGSVSRWAEAVGARSRPGDAPVDAMECPLPGGKGPGRARLQRVSLNSSRPISMRRISLVPAPIS

SEQ ID NO: 28037 - protein, 377 aa, Pseudomonas aeruginosa
VMDMRWHLLVYLYVNVRLRRNPVNAWNGGKNDSRERCLSERFNRRLMKGRGWLCSASPNTVFLGGVVTMSRLMTYRTLLACLLAALLALLVAGQQQRAFERIWFKLEQRYGGDVARENALRLADYRVDIEARVLGAESNVSALSFDPSRRSLVSVTNQDPHFLELSLDGELLRRIPLRGFQDPEAIEYIRPGVYVVAEERRQRLVEIHVDADTRVIDIDDPRNARKFSLGSANKRNKGFEGLAYDPLRERLFVAREKAPVGIIEVNGFFNDRGEALDLSVGGDPQRDRGLFLTDLSSLYYDKASDHLLVLSDESRVVIELDRAGDPLGSLTLRGGNHGLTDDVPQAEGLAMDDRGSLYVVSEPNLFYRFSRALPAAD

SEQ ID NO: 28038 - protein, 158 aa, Pseudomonas aeruginosa
TAVASRPACPEGRGRWPERWGPRAAGEASASRRRAARRTVPGWGARVSLGASGLLRGDLGRVAGARRLAQPEQAPDHQEEQRYQEHREYRGGDDPAEHPGADGDLGAGTGAAGERQRDHAETERQRGHDDRSQAQARGLQGSPAAGSCLPGNGPWPPR

SEQ ID NO: 28039 - protein, 213 aa, Pseudomonas aeruginosa
GRSVARKTKEESQKTRDGILDAAERVFLEKGVGTTAMADLADAAGVSRGAVYGHYKNKIEVCLAMCDRAFGQIEVPDENARVPALDILLRAGMGFLRQCCEPGSVQRVLEILYLKCERSDENEPLLRRRELLEKQGQRFGLRQIRRAVERGELPARLDVELASIYLQSLWDGICGTLAWTERLRDDPWNRAERMFRAGLDSLRSSPYLLLADA

SEQ ID NO: 28040 - protein, 234 aa, Pseudomonas aeruginosa
TARHPHTSSMSKDSHDQEMSFPGRRLRHSFPPGHQGHAQGNAAGGEQAADPVRGGGGAGSRPFRDRHRHRPRQAFAGRPLRHQLRAGTPDPQHRQGKVPGRHPSADRRVHLRLHPPGGDEGPRPRHPHRSSADRRRAVRRGPGRRPVPEPRRRQRAEADGQAVQPVPLLHRGDPGSAAGRDQQVRRDRRRDDPRRYLPGEHHGREAEAGRGAVEPGDHRPLHPDPGHLRPDRAD

SEQ ID NO: 28041 - protein, 456 aa, Pseudomonas aeruginosa
SRSRNMSFDFDLFVIGAGSGGVRAARFAAGFGARVAVAESRYLGGTCVNVGCVPKKLLVYGAHFSEDFEQARAYGWSAGEAQFDWATLIGNKNREIQRLNGIYRNLLVNSGVTLLEGHARLLDAHSVEVDGQRFSAKHILVATGGWPQVPDIPGKEHAITSNEAFFLERLPRRMLVVGGGYIAVEFASIFNGLGAETTLLYRRDLFLRGFDRSVREHLRDELGKKGLDLQFNSDIARIDKQADGSLAATLKDGRVLEADCVFYATGRRPMLDDLGLENTAVKLTDKGFIAVDEHYQTSEPSILALGDVIGRVQLTPVALAEGMAVARRLFKPEEYRPVDYKLIPTAVFSLPNIGTVGLTEEEALSAGHKVKIFESRFRPMKLTLTDDQEKTLMKLVVDAHDDRVLGCHMVGAEAGEILQGIAVAMKAGATKQAFDETIGIHPTAAEEFVTLRTPTR

SEQ ID NO: 28042 - protein, 532 aa, Pseudomonas aeruginosa
AASERRSRPLGRLLSFSRSARGGLGQRRRCVVAAPGVALREHRADHQLDLVEQHQRQHHRPHRTGGEQHLGHGHAGGQALLRTAEDDGDLVFLAEAQASRQHRGQHQGQGEDHAAGDGQAEQRQPGYFVPQALDHRGAEGGVDHQQDRALVDIAQHRLVALHPGADPAPQDLASDEGYQQLQGDLADGVQRVAGLAFGAEQQLDQQRGKEYAEQARHGSAAYRCRHVAARQRGEGDGGLHRGRQGAEEQDAEVQLRGDHRRQCRFQRQAEQREHHEGAGEHQQVQAPVGHAGDDRLARQLGAVEEEQQADADVGHPFEDHGGLAAAGQESGEKDGGDQRQGEVIRKETRSGHGHALQDRGNTWQSSGCLANLHCSHGLGDRLTPEGQPMTPNGQGGRRAAPRGSDDAGQQRLADAGTDLAGMGRELQADGEHGDQRAQLLRDHAGAVLAEAGEGQQQADLVVLAVGANPLRGEGLHGEQVEHPAQQVRIGHALDMEDRQGLGICAGGFPDVRADHLAFFAVRVFGQEKGGEG

SEQ ID NO: 28043 - protein, 160 aa, Pseudomonas aeruginosa
GIFMSIPLDIYDQRILALLQEESSLSTAEIAERIGLSQSPCWRRIQRLKEEGVIRKQVTLLDRKKIGLNTQVFAQIKLNAHGRKNLTDFAEAMHQFPEVLECHVLMGAVDFMLRIVTRDIESYERFFFEKLSAVPGIQEVNSIVALSEIKSTTTLPLLAP

SEQ ID NO: 28044 - protein, 89 aa, Pseudomonas aeruginosa
PRTATTRSATSCPSRASGRCWPWPSATTWRSSRTMSMATWPTPIRARAPSSRTTTMAGCCSAGRSPRSWRRACGSAGWYPGATPTACCT

SEQ ID NO: 28045 - protein, 394 aa, Pseudomonas aeruginosa
PRRLRMETAGWRPPYPADRRRNRLARGGGNSRGAGRRNRAAGGRGLSRSAGRSRHPRPAGDSRCAPALAAAPPGRYPFAQRRADDRGGAPGAAAGTRGGGWCGPGTGGHRYRRGDPLGTGEPRERQFLRLGRRRVGGGDGDPALPGAGARYRQASSDPDGLLAPGQGVRLMGRFVGKQADGYETRIGRLLPGYELLHLLSRAQLLARLPERARLLSVGCGAGGELAELAGLRPGWRFVAADLSADMLALARQRCARLGLLERIELHCGDVAGLPPAPPCDAALVLLVLHFLRGDQAKRRFLEAVAERLAPAAPLLLANLMEARDAFERPVQAEACRLAGLSPEDSDGMLQRLREDFDPLSEQRLGELLEDTGFVLPSRYFQAVGYQAWIAFRAG

SEQ ID NO: 28046 - protein, 282 aa, Pseudomonas aeruginosa
VSAFCLLVRWARVPMSREVFRVKFLSGFWERRRANGTPLVCIEERGSGAGEFSSVSRRVETAPDVRSVASADSEQWIHSQEYELSFWKDKWPYRHLSVEELQEARHKDAMWFLGKMGFTYGSSHYRYEGFEGKVLEVGSGPIGFFEKVEGVTVTAQDSLMGLYAENLPFSILGERGSSCYIRDGVADIESAFDFVVCSNVLDHTADWIQFLIDCVGRLRTGGELLLVTDSRGVPAIGHTQIFSHDQLVRVLELLGAKQFKVKAVEREDGVHCDYRHYFRVVF

SEQ ID NO: 28047 - protein, 63 aa, Pseudomonas aeruginosa
LMQEDVTGADMIESPLSAGCINTHKKIRSLFIAVTLRLAKIIFYHRMQGVMIWEAWNGSLDMV

SEQ ID NO: 28048 - protein, 464 aa, Pseudomonas aeruginosa
QKRCCIMSVPLRAVQLTEPSLFLQEHPEVQFVDLLISDMNGVVRGKRIERNSLPKVFEKGINLPASLFALDITGSTVESTGLGLDIGDADRICYPIPGTLSMEPWQKRPTAQLLMTMHELEGDPFFADPREVLRQVVARFTEMELTIVAAFELEFYLIDQENVNGRPQPPRSPISGKRPQSVQVYSIDDLDEYVECLQDIIDGARAQGIPADAIVAESAPAQFEVNLHHVADPMKACDYAVLLKRLIKNIAYDHEMDTTFMAKPYPGQAGNGLHVHISLLDKHGNNIFTSEDPEQNAALRHAIGGVLETLPASMAFLCPNVNSYRRFGSQFYVPNAPSWGLDNRTVALRVPTGSPDAVRLEHRVAGADANPYLLLASVLAGVHHGLTNKVEPGAPIEGNSYEQLEPSLPNNLRDALRELDDSEILAKYIDPKYIDIFVACKESELEEFEYSISDLEYNWYLHTV

SEQ ID NO: 28049 - protein, 417 aa, Pseudomonas aeruginosa
EAVAPSTSTRSDSARPRANPGEPSMQDVVIVAATRTAVGSFQGSLAGIPAPELGAAVIRRLLEQTGLDAGQVDEVILGQVLTAGSGQNPARQAAIKAGLPVGVPAMTLNKVCGSGLKALHLGAQAIRCGDAEVIVAGGQENMSLAPYVMPGARTGLRMGHAKLVDSMIEDGLWDAFNDYHMGITAENLAEKYGLTREEQDAFAAASQQKAIAAIEGGRFRDEITPIQVPQRKGEPLSFDTDEQPRAGTTVEALAKLKPAFRKDGSVTAGNASSLNDGAAAVLLMSAAKAKALGLPVLARIASYASAGVDPAIMGIGPVSATRRALDKAGWSLEQLDLIEANEAFAAQSLAVGRELGWDAARVNVNGGAIALGHPIGASGCRVLVTLLHEMIRRDAKKGLATLCIGGGQGVALTLARD

SEQ ID NO: 28050 - protein, 224 aa, Pseudomonas aeruginosa
SRSPCRWPSWSSAAMWWPVQAPPRVSSTCSRGCRRMAARRSAGWRWCRCSPRCSTGASVWSFGGLLVRALARRSDLRMDYRAAGAAAYLGLGAVWALGLSSSAAQLQANPASLPPSILAITGVIPFTETIFLWQSGVMLLALILVSLVIAYMTAPSAASARDAKDCGVEGELHRSGQAGADPARRVAGAQPVADHPAGTAGRRLAGTRVLDQAGDPGDLRVEHL

SEQ ID NO: 28051 - protein, 175 aa, Pseudomonas aeruginosa
REKVGERVAAPGNEVTADNACGVIRPTQWGGRTPDGSLSLQGEGLGRGWPPRLLRHPAAIHVPGRAAHLVGGFAAKEQRQSAELLGGDEGQRGLLFRQQVVFRLFGRDALGDARVDLLLHQRGQHPAGADGVAGHRRARRFQRHTLGQAGGTPCLAATYALFPARRRPGRGSRRC

SEQ ID NO: 28052 - protein, 158 aa, Pseudomonas aeruginosa
RWVPLSRRMPSAMIFLYRVERPRPRRFAASTTLPALCARARPIRSRSKASRACWKSPTGLSSAARGSSGSGCRGPSAAPRAAASSNGWSASSSARSSTLRSSRTLPGQACRASSARASPPSSWRRPWSRLSRIDSQSAGRSSRRWRNGGISIGRTFSR

SEQ ID NO: 28053 - protein, 184 aa, Pseudomonas aeruginosa
RSARKRPSRIACCRSMEVAATRRMSLRITSLEPTASNSFSCSTRNSLPCKASGMSPISSRNNVPPWATCNLPGRPLRSAPVKAPGAVPNNSASSRLSGIAAAFTLTKALCARGEALWMAWASSSLPVPVSPSNSTGASLAAPRRARRLTSRLAGLVPTKWLKLYLAWRACNCERVEASSRCMLR

SEQ ID NO: 28054 - protein, 200 aa, Pseudomonas aeruginosa
ADRSRRCARRRGKPGWLRRGRCPGRSRCLAPVRSPDAHRDRTPARWRRPAGSGRWAGALRCRRRARSRRGRGSRWARACSWAAAGCPGGTACRRSRHGGCRRRSRCSRRSWPVGAFGTRRPDGAVPGAPRRLRRAAPAGAGAAPRGPACRGRRRRSARRRGWLRRLRRRHPRTARRPAPRPGLGSSRRWPRRNAGSGRHG

SEQ ID NO: 28055 - protein, 214 aa, Pseudomonas aeruginosa
RRPRPQEPASMEKNSSPAETSGKQKVRSAEVGTDILKALAELSPATSLSRLAEHVGMPASKVHRYLQALIASGFAVQDASTNHYSLGREALRVGLAALDSMDVLKSAAAPLAELRDVLNETCFLAVWGNRGATVVQVEQAVRAVTVVTQVGSVLPLLGSSTGLVFAAFLPEREVAELREEELAGRADHPLADPAAYAVLLEASARAACMRSMGC

SEQ ID NO: 28056 - protein, 583 aa, Pseudomonas aeruginosa
PLAVIRRFSGLGQQRFRRSRPVALAEHRADTLAGVDQGVHVDPGMDLQAVQQVEDVFAGDVAGGALGVGTTAEAGHRAVEYRDAFQQAGVDVRQGLPVGVVEVPGEALAGNLAGHRLDQPAGGAGGADADGVAQGHLVAAHLLQFAGDPGDLARIDIAVVGTAEHAGNVAAHPHLVLARRLQHRYEALQAVLDRAVDVALGEGFRRGGEHRHFLHSRLQRRLEAFQVRRQRRVGHAGTLADAGEYLGRAGHLRHPLGRDEAAHFDVVQAGGAQVIDQADLVGHLDRLFLVLQSVARTDLHQADLLRQVHAVPRLGCQAWFSSSSTSGVPSSTSSPSLQYSAFTTPAWGARMLCSIFIASSTTRVAPASTVWPGSTRTRTILPFIGALKPPWWAWAASASAIGSTASMASSSPSHSRNNWRPRRNAAERRVTPSTRLTRSSPSRRYWLGLAWRRRTQRRSSRQRSIRSDSRARALRQPSLRLHGECGSSSRRWPGSLCSQASAAACQKCSGSACGAGSRSSWWRAMNPVSSSAAANAGWPRMRRRNARLVRRPPTEVSASIASRRWRASSRVSPQAISLASIGS

SEQ ID NO: 28057 - protein, 71 aa, Pseudomonas aeruginosa
SRTSMAWPFSGTCSCVSGSASPRATRICQATRSRPVMASVTGCSTCRRVFISMKKNWPRSSRRNSTVPAPT

SEQ ID NO: 28058 - protein, 1049 aa, Pseudomonas aeruginosa
GHQACSVGIWGELPVRGALRNRNRRPTTRKNSGTRNTASTVAVTIPPSTPVPMATWAPEPAPLESASGTTPKPNASEVMTIGRRRRRAASRGRLQQAHAFLVMVLGHLDDEDGVLRREADDGDQADLEVHVVGQTAQAHPEQCAEYAQRHHQDHRQRDRPAFVEGGQGEEHDQHREGEQRRRLGAGQAFFEGLAGPLVGDALGQSLHQLLHRLHGFAAAVARRGLALEVERGISVVAGQLRRAEGPGGLGERRQRHHLALLVAHVKPADVVDAQALGAVGLDHHLAHLAAVHEVADVVRAEHHRQGGVDLVHAHAEGLRLAPVDVQADLRRLALAGEHHVGQTRVLGGARQQLVAGLDQGLVANPATVLQAEVEAAGGTQVRQRRRVHRIHRTVGQAGEALVDALDDGADVLAGLPAFRPVLQGGEDHRRAGAVAVQAEAADRIGVGHRFVLRQVALDVADVGHGLRHRRAFGLHHHDHEVALVLFRQERLRQAHEEQGDHADDQGVDQHPADRPGEDAGHRVAVASGQAQEGAVEPAEEAALLMVVGVDRAQQGGAQGRGQRQREERREADGDRQGHRELAVDVAHRAAEERHRHEHRDQHHGDADDGPADLAHRLDRGVVRRQAFLGHQPLDVLHHDDRVVHQDADRQDHAEHGQHVDREAQAEHHREGAQQGHRHHQCRDQGGAEVLHEQVHHGEHQQHRLEQGADHLPDRDLDERRGVIGDVVAHALREVARQLVEGGADALGGGHRVGAGRHLHRQAGGGHLVDPRDEAVLALAELDAGHVAQADRAAVGADAQRNFAELLGRHQGVVDLHRGADRRRVGDPEVADVAHGEAGVVPAHGVDQVAGAEVHRGQLGRVGPDAHGVLGAPGLDLAHALHPAQRLQHVGRGDLAQVHGVVAAAGGGKGNDQLDAVRRLLHVDAVAPHRFGQARLDDLQAVLHFHRGEVGVHALAEGQGQRGLAGAAGGLGVEQAGRAVHLALDDRGHRFLDHLGRGAGIAGADVDHRRRDVRVLGDRQEADRQDPGEHDQQGDHPGEDRPVNEETSHS

SEQ ID NO: 28059 - protein, 367 aa, Pseudomonas aeruginosa
GGVGAGRLADHRLDAGAGGMLGGVLDDHTLAALEPAADDPVAALQGVGADLHVFHQALWVDHLDHGGLGGTDQRVARDGDRLRVHRALQAHLHVAAGQQFAMRIAEQGTHGDGVGAGVDRQVGEQQLAGQRVLAAVGQDQAHGDVLVGDTLHLAFADRPLHGGDFAGRLGEVHVDRIDLLDAGQRCRRVLADQRAFGDQRAPRAAVDRRGDRGVAQAQAGLLQFGLGRGDLRQGLARVGLRFGVLAFADGAVLDQVGVALELVGRRRVAGLGPGQGAAADVQGRLQGRRVDLEQHGAGADVLAFLVQATGDDAGDARPHFSLAVRFQASGQLAGDADRRRPGDDHADLGGGLRSLPGVRCFFAAQQE

SEQ ID NO: 28060 - protein, 248 aa, Pseudomonas aeruginosa
SAAPFPCEDVQWPGKPKRNPRKPATAYSMPPSGFSWKRAWALLPWPTWRTPPGFLAVRSTATTRTRSRSAWRCATAPSARSRYPTKTPGCRRWISSCAPAWAFSASAASPVRCSGCWRSSTSSANAATRTSRCCAAASCSRSRGNASASGRSAGRWSAANCRRGWTSSWPASICNRSGTASAAPWPGPSACATIPGTAPNACSAPASTACAVLPTCCWRTPEGVNRPPSGACAGPRRRRPPAAGRLPR

SEQ ID NO: 28061 - protein, 214 aa, Pseudomonas aeruginosa
PRAGRAAETRRDADLRTGPGKHPARSAGRRPPDLHRQPGGRPGRRRSGVHRRRHAVRRGRLGRPQPRAGGRRATWRATAPGLHRGQQVDRAGGHRRTGRRDHPPGPGAPAQALPGSGGEQSGVPQGRLGGGRFQAPGPGHHRQRRGAGRGNPAPALRAVPAQSRAGPADGASRGRVQQVRGQCLPRHQDFLHERDGRAVRPHRRRHRGRAPRHG

SEQ ID NO: 28062 - protein, 108 aa, Pseudomonas aeruginosa
RQAHRHPFHLRRLRLRRLVLSQGRPRADPQRRAAGLRQPDTARGGSAQRAAEGAALRDPRRAVPGTLARAHGGALGAGLQAGYRRPARGAEPGPAGGAAAPRGAGQGP

SEQ ID NO: 28063 - protein, 300 aa, Pseudomonas aeruginosa
GERSLIRLRAIRILRPCRRILMIKKCLFPAAGYGTRFLPATKAMPKEMLPVVNKPLIQYAVEEALEAGLSEIGIVTGRGKRSLEDHFDISYELEHQIRNTDKEKYLVGIRRLIDECTFAYTRQVEMKGLGHAILTGRPLIGDEPFAVVLADDLCLNLEGDSVLKQMVKLYNQFRCSIVAIQEVPPEETNKYGVIAGEMIRDDIFRVNTMVEKPKPEEAPSNLAIIGRYILTPDIFDLIEQTEPGKGGEIQITDALMKQAQDGCVLAYKFKGKRFDCGSAEGYIEATNFCYENLYKTGKAH

SEQ ID NO: 28064 - protein, 168 aa, Pseudomonas aeruginosa
PCSKVTPVCSMRTASRWTASASAPSTFSSPPVAGRRCRTFPARNTRSPPTKRSSSSACRAACWWSAAATSPSSSPRSSTGSAPRPPCSTVATCSCAASTAASASICATNWARRAWTCSSTATSPVSTNRPMAAWPRPSRTAGCWRRTACSTPPGGGRCWTTWAWKTQL

SEQ ID NO: 28065 - protein, 522 aa, Pseudomonas aeruginosa
LHTDQALPGLNGGFRHHLYRSRFRSPWSPAHDPLSATRRDPRFAHRTGPLPSGRPAALGAGHEHRARRQPEHRATGIQAAGRSRAGRAAAEVRLFRTGRATDAAAAGDRPPGPAAGGNLAMGAGAGPGQHGTAAGRGPARPRHAGHLQPFAETADPQPGPAQPPRRRPCAGLRRDPRLAVAARGSRPPVGGLRLSSHRQRRGDHHRLPRGPVGEHPRGVRTGRHRRGGVAELPWRHAIAERPRHEGPGDPHRSGQRHQPGSPRTGAGTVADQGHPGDPELQQPARLHHARVAQAGAAGPGPALRRGDHRGRCLWRPGLHLSAPAHHQVVRRRWPGAALRVVLQGPGAGPADRLDGTRALRRPRAAHEVHQYRRQRPATATGDRRIHRQRPLRAALAAHARPVPARTRPDDRLGGALFPGGHPRQPAPGRFPALGRTGRGVRHPAPGQGLAQPRRTSRGGLHLFRFRQVSELPADELRGVADPGHRAGGQASRGERLRAAGALRGLSDSRAFDAVDDCANSKC

SEQ ID NO: 28066 - protein, 319 aa, Pseudomonas aeruginosa
RMHPPAPLDAGHQETIVMSQPAYRLFNVELKRREQLSPALTRFVFGGPEVAEMKTLAADQRIKIFFPDASGQPPSLPGGSEWYQAYRSVEPARRPPMRTYTIRALRAEQEEVDVEFVLHGENGPASAWATHARIGDRLQLAAPNRQYGDDPGGYEWKPPAGVRHILLIADETALPAVAGILEELAGETEPPVVEAFLEVPGEADILDLPAIPAARLHWLPRHQAGIHSRNGERMIEAARQARLPEREVAGGAAQELEDIDIDEEILWELASPESGSFYAWVAGESAAVMAIRRYLVQERGIDKRHLTLMGYWRLGKVFD

SEQ ID NO: 28067 - protein, 367 aa, Pseudomonas aeruginosa
WKPGTPSNVRCRPRPAAWPGFPRRTATACCNACARISIRCPSSASANCWKTPASSCPAAISRPWATRPGSPSAPAEDASGEARLRRDLAWVGQQLQQRRASAFAGAAECGGEVGAAFHSFGVGAEGSRQGDEVGVVQAGGGYPPGIFALLMHADGAEHAVVDHDHHRRRAELRGGRQLLRIHHETAVAGEAHHAALRIAQAGGDRGGQAVAHGAVGRRQLRAGLAIAVEAMHPDGIVAGTVGDHRVVRQVFAEVRDHGRQVDALDGGVARGRGRVGQVIGMGGFAPVLPGARGQRREVGQGLGEGTRGGLDRQSRQVDAVQFRAVRMHVDQRLRGGRTTHQAVASARRFAQARPDHQQQVGLAQPLQ

SEQ ID NO: 28068 - protein, 311 aa, Pseudomonas aeruginosa
PFPGGTVPAAAAKYQQGAPGVRQQFAQFRHRRGARPPRKHPWLRRIGDLRETEEDFLGQGDHDRARSARGGDAEGAADDLRDAFDTVDFHGPLGQAREHLHVVDFLERLAALEGAFHLADEQDHRRRVLLRRVHAIRRMGGTGAAGDEADAWSAGQLAVGIGHVRGGTLVAGDDGADAVGVVQRIEHRQVAFPGDAVDGIDGIAPQCLYQDLPAVALGKGVGHEGLAAHVVVAPIFGPKRASAKRPFFASSFPWRMNPRSSLRRRPLSALHLDEKGTGASSQRVSSRRIGERGFPLVSPSSPQLCLCNYFL

SEQ ID NO: 28069 - protein, 139 aa, Pseudomonas aeruginosa
SRTSPTTTRWTPPSWPSPIRARQGTDCTYTSRCSTSTATTSSPARIPSRTPHCAMRSAACSRPCRPPWPSSARTSTPTAASVRSSTCRTRRAGAWTTAPWPCACPPAARTRYAWNIASPAPTPTPTCCWPRCLPGCTTG

SEQ ID NO: 28070 - protein, 471 aa, Pseudomonas aeruginosa
TRSRREDFPDGELASACTAVSSGPKGEEEEGERACECIEDSGRKRRRTPVAAVVGAGGVRPAVDRHVFAEPAGDRRRSRRQRCPGAAEHQRLPGRLLLRHAVLRPLVRPFRPAPGAAGRYRLVPVQQPGLRAGRQRGATGPAEGAPGPRRRRRVGAGAGHGARPLSVGRGRPDAGIDAHGDHAGTAGRAAARRLPDALGRLARVVRGPGAVRRALPAGGLAGRRKPPAGAPRRQPGPGLSRLWAAARRPSRAGLRAVHGAGVRRDVRLHQRRAIRVHRAFRRARGALRLVLRPEHPRRDARHLVQRAPGAPPRSAAAAAGRQPAGLRVRAVPPRLCGARRAGRVVGAGARPAVLRQRHRPARRQLHRQPAGVVSRTGRGGFGGGGVRAVRPRLPGQPGGRLAGAARRAADGAGDGRLRRRQPARAGLGPARRKPLISFCIPACSLCFFRYSSALSKPVIQARTLCQRQDPP

SEQ ID NO: 28071 - protein, 545 aa, Pseudomonas aeruginosa
PRAVIRPTPGWLSVCGASSRQRLGDPPECLHRLLLPRAPRVPVVEPGAMGEAAGGGEDRPRGEADALGQGQLEQAQRVDRLGQLQPEEVAAAGTADPGLLGEVTRHRREHGVLLGLQGVAQLAQVAVVAAVLEIVGDGRLGRDRRRQAGHQLQSLDLLGVASAGHPADPVARRQALGEGTAVHHQAFLVVGLDRFRRLLAEVQFGVHVVLDHRHLVARQQLGEGAFLLVVHARAHRVLEVAHEPAGLDRQALQAVGEHFQVDAFTRMHGDFHRLQLQPFQHLQGGVERRRLDGHQVAGTGDHLQAEVECLQRAVADDQFFHRQQQAADHVAQGDLPAQAMVARRHVGDHRLRVHVAHRVGHRARQARQGKQLRAGERRAEGHGVRVLDRTEYGEHQLADVDLGGVGLARADLRFRQRPLHVLADEVAGACAGHDQPTAFQQVVGLEHGGSADPVGTTGVPYRGHLLPGGEDAGADQLGNLVGEFLVALHLVLAAVLAGRGHGRWRPLYACRDRVVMPHRGLLSAPAKRRCWCCRPPGSGRRCRAG

SEQ ID NO: 28072 - protein, 409 aa, Pseudomonas aeruginosa
GLCDVPVRRIRPGAGERAGGAVPRPDRPPPRRRTERGGVPPAAPAERPVPAEARLHAARGDSLRHPLVAATARLGARRPALRPRLRAFHHAAEHPVQLDRTGAGRRYPRTPRRRADACDPDLRQLRAQHHHRSLRRGRRGRMDRPPAAGRDPAPVVDGEPGVPVPPAQVQDRPQFGGGRPRRGADARHRPVPLPPPRRRRVAPAGPGRRRPGTHADARPGDPRRPALAAPAVLRRGDPAGLQPPRPARQQVQGADQDPSQGAGHRGFRPRGGGRVAAPARRPGTTDCRGVPAGRRALRIAALPAAGRRRAGLRQRPCGRSDLRPLGLAQRPGAQGAGLRLGGAVDQARRQRAAGRRHRGADGTRRRLGRALRFRRDPCGPRTEPGAPRRAPGEPPRAVARGLRSRPRHA

SEQ ID NO: 28073 - protein, 265 aa, Pseudomonas aeruginosa
PEHLRLHERLRPPPHRQHRHPRRRQERQRVVPGHPRRRPGQGQRAGQGDRAIVQRCRGAGGDRTDRRNLHRPAGRPGTFHRHLQPGRPGAVQGPGLRQDGGTGMNNLIRLRDGVAEVCRDDPWQLLRELPDALPPGPLLLPLAAWLERRGEAGAAAPWLAPDDEVEALLPHFAELPLIAVDFPSFRDGRGYSLAYLLRVRLGWSGELRAVGDVLRDQLSHMRQCGFDAFAVREDKNVEDALKGLAGLSVLYGRSAIEPRPLFRRR

SEQ ID NO: 28074 - protein, 561 aa, Pseudomonas aeruginosa
PLSRSGSGAHPSAVDRGTGGRRRRAALEAPRQLAQRTHQQAGVHAHRDERAAQLQVAPRQCLVGGEDAGGLAGRADAVDGVLYGRLHLGMAWIAAMAHGCAEVGRTDEHAVDALDGGDRVEVGQALQVFHLDQQAHLLVGVVQVLRHAVPARGPGQRTADPAYARRRIAHGAHQPFGLGGAVDHRYQQGLRADVEQLLDQRGVALHRADHRLAGVGRQRLQLAEQAAQVVGRVLAVQQQPVEAGVGGQLRAVGIGQAEPQADLRLAAAQALLEAIDGQVHGNASSDETAGDAAEQVVVDVEGVPRRGRHRAGEGAAEDHLAGLQADAVGRQLVGQPGDALGRVVEHRGGDARLLDHAIAVEDCRYPPQVDIAWPYGPAAHHHAGVGGVVGDGVEDLARDFRLRVDLLDARIDDLQRRDHPLGGLEHVEQGAARSLQRLAEDERQLHLDPRHDEALEGDVAALLEEHVVEQGAVVRLADVRRDLHGARGQADLVALEHAPVGDLALDPGALDGVGVLDGDVRVVEGELPYLLARAFGGVEAVGGFLDQTGIEHGRGLSVQRG

SEQ ID NO: 28075 - protein, 297 aa, Pseudomonas aeruginosa
SFCVLLCAGAEEFGLADDSVDQATDAFHLHHHFVAGDHVGQAFRGAGGDHVARLQGHEAGEVFDQVGNVEDHVRGAAFLAQLAVDPGAQGQPVRLGNLGRIDDPRPHRGGGVAVLHPQVGPVVVLQVVADRVVVAHRVAGQVAEGVLAADVARRLADHRHQFALVVHVVDVVRTPADLAVAGVGARRLDERQRFAGRLERQFGGMVGVVQAEGEHAPGGRRQPLHPVLGEQGAVGQADGVGVFHGDLVNPALVADACVFHGRFLIPRRCCWRGGRGRRSRPRRGRRDARRLALRGCR

SEQ ID NO: 28076 - protein, 374 aa, Pseudomonas aeruginosa
CVNVIFNMLMIVNPGCCAIRPGEVARGAVCGIRKPATACVRSREEQQREDRHARAPADPQHQHRAGLRPALCRRRGALRCAGQPGRILRSQHAGAPARPFLPGALREERRGAGLSRRAPVPGVGADVLPHPADRAARLRHRGGRRWPCADRAPATGVEPHRGRAGPGARPAGGAGLRGAGQPGGRRGRGGGAPGAALRAVAQRVDGQPSRPPADAAGADPAGHDQPAASLGQFGGCAADAPRRPADLPALQRADRGALCRALAAVALRQPDRRHRGAPQRRLPAHRRPAVEAPGVRTAYAGVQAPAAVHRRLGERDLLPARLQGPGLLQSFLRALRGAHPQRLPPATGRRGVPSLSGWAGILALPLEQEAFLHA

SEQ ID NO: 28077 - protein, 267 aa, Pseudomonas aeruginosa
CSHLHAAAGSLHLGRLPCRLPLARAGRRMFRGHCPPPGGCAAADPVRQAGSAVRTCRAARRNRPPALAARCRHRLPAGAERNPERRPAMAADERRAGGHAVRAGAARRAGARAPGAPGGRRPAPAARSRSGRLSLRSSPGTAPGHRAPAGRGRAGGRGGLRRRPSRSQRHGAVPPAARPASGGRRPGGRPWRRLPAKSAGGGAALQRLHRLRAARRRRPAPGPGPGRAGHRGRTRRGLGRGLPRRIRRRYRRRTAGVLQAIGRVLLE

SEQ ID NO: 28078 - protein, 762 aa, Pseudomonas aeruginosa
AAFRSRPARSPPRRGPSAPAPCSCVAANALRPWPVRESRRTRRGRRGRSGGGGGAWNGAILSDGDGCRRYLQALHCARSSSSGRGAGLRLAHRQAQAEGDDVVAAVHVDTPLVGLGDGLGDVQADTEAVAVALVVRRLALERFEQVGQLRFGEAAGFVEHAQAHLVALAGQGYQHRPAGQAVMTGVAQQVGGDLGVAVRVDHGTNLRVDGDLDHQAGIGDVGFADDLPHQLRDVGVDRVHGEADARLQAAHVEDLADQPFHAAAGRGNVLAQFGGAGVAGGQQGRRHGDRLQRVAQVVAEHRDQALAHAVDLGRMVEAQFHQVQAQLFGDRQVGFAPGRGVAADHFLPGLERAARGQPRAGGADGQQLFRLAAPADAVHFLVAEPEDPARFLAVETDRQHTAAVAAVRRVLAGLRPVVGVVDVPFRVALQALQDIPGLALEVAADAQGAAAEHDQGAVAGNQCGDAIVRVGQCAEQVVGVPRAASQGQPALGGHAQQFGDTPLLQALDDGAADLGEDLERHAHRVGNQLGRHVMAGKQSPELAADHDGDAHRGAHAHVGQVFAVDRRNAAQHAVAEIERFVGLRVQRGKHAHRRIGHVGDQPDRVLDVQATRLGRDVRGRVALPQVAFEVFATALGDHLAGVVMTETVGHHPVVAGHPAQFVGDVAEQAGGVVVQLDLGDDALGVEGEGGDRQRVRGADLELQVEHFLVAVADHVEQVFADPRLDAVRPWAVAGQSLFEHAQDLRPHLLLRQVGTRRGDETQ

SEQ ID NO: 28079 - protein, 487 aa, Pseudomonas aeruginosa
MGIPARGAGMPERARSGRLGLHHPVAGDVGRAAGQLHPVLLDEGLQQAVQRQHHRRVAVDLVGPVLLDHADAVVLDVAGDDPGKRAAQVGRQLVGRQAAAELEAGHVLVGRLERALEAFIDLQHPVEVEGVVALAAELLHFLQALGHLLGHLGRVVDDDPVVALRRMAEGRPDEFMELLQVGFGAAGTGEDDREGQVLVVRVHEDAQQVEELLRGPGAAGEDDDPVADADEGFQALLDVRQDHQFVDDRVRRLGGDDPRLGQAQVAAADDALLGVADGGALHRPLHHPRSAAGADIQAAQAEFVADPLGVLVFLAADRVAAPAHDDLRLDAGAQRTGVAQQLEDVVGEALGAVQVDVLAVQPALGIDDVAQGAEQHLASTGDHLAIDEGVGRRVDQLQAHAAVLLVDTHLEVLVGVEDGLGVVAVGAGIEDRQGALAEQLVGLAVGGFAQLLHFALGEGFQRAFRTDRGVDHRAMRHVRFHAGDAAA

SEQ ID NO: 28080 - protein, 151 aa, Pseudomonas aeruginosa
RSPATRRTSSLPTSIRWPRAASCRGSARSASTTAGAWSASPLYGPDADDGHYWLYRLMIDRRYQGKGHGRAALQRIIASVRRTRRRSDRLMVAYAVDNDVARQLYRDAGFVEQGLAPWGETMACLMLPEPSHRSGKVAGAPGGRAAHGVPA

SEQ ID NO: 28081 - protein, 447 aa, Pseudomonas aeruginosa
NRGIRQFPPIPITTIQRTSPPRTLASGAFSVVRGEGRGTCPSAPCSGTERPMDSTSETRSGSWLSVIALALAAFIYNTTEFVPVGLLSDIGHSFEMPTSQVGLMLTIYAWVVSLASLPMMLLTRNIERRKLLVGVFLLFIASHVLSGLAWSFQVLMLSRIGIAFAHAVFWAITASLAVRVAPPGQQAKALGLLATGTTLAMVLGIPLGRVVGEALGWRTTFMAIAGLSVLTLLYLARSLPLLPSQNSGSLRSLPMLFRRPALVCLYVLTVVVISAQFTANSYIEPFPKQVARMSGEATTLLLLLFGGAGIFGSIFFSRYSEAFPRGFMLAAILVLGSSLALLLPLSAQPTWLMALSLLWGMSIMCFGLAQQSRVLRLASDATDVAMALFSGLYNVGIGAGALLGSVVSERMGLASIGNVGAVLALAGLLLALFAALRYAEALKSTSL

SEQ ID NO: 28082 - protein, 314 aa, Pseudomonas aeruginosa
VSRRPRLRLHTPGGGRRRGRVPAPGAGRRPAGVPHPATDSARWRALRHPVHRAGGAQRPGAGPGHRLGSQSPGGRPRRPGDRAGAPDGADHPGPGQRLAPAIVPHPDADLPQRHHSTAGAPARTRRLRLELCAAADRRGAGRVAHRQRGYPPRTQRRHRRRRCRALLRQRRRGAGSTPVRPHAAAGDLRSALADGVQRTAAVRPAPAPAFAAHPVPGRQPGQPVAGGAGQRQRPRPPAPASGGGDPGAAGGDRRQFGGRHHRRRPRRRHQRLESRGRGVVRLPRGAGGRAAGGGPAGAAIQGERGTRHPRPHRP

SEQ ID NO: 28083 - protein, 557 aa, Pseudomonas aeruginosa
RTGGQLRYRAPAPGWPPARRGGDRLADPRSGRRRGRRLEDRTRHLRAEGRRGPHPRAQYRPGAPDRRAYRRTASVERTARQRAAGGVRGVDHHPRPRWHHQRLQSRCRADARLPRRRGGRQGLADPAAQRAGVARPRPGAGRGGFPRAGGAGRTGGRRDPRMDLSAQGRLAAQRDAFGYRPARRGWGDQRLPGHRRRCHRMAQRRARDGRGARPVANGRRRGAPGHLALEPGRRQPAVERAHVRAVWPAAGVARRRPGLRALAQPPASGRPRAHRGQPARGGGGARQLRCDLPRGAARRRHPLHPGRRAGRARRRRQPAAGHRDQYRYHQRPATAGAPARGQGAGGRRQRGEVVVPGEHEPRDPHADECRAGHAATGPADRSQRTPARLPGQGQLGGNLVARPAQRHPRLLEDRGRQTGPGNAPLRAGAADAGPGRGALRQPGRQGRRGDLRHRSRAAQRGGRRPPAPAADPHQPGRQRTEVHRPRARPGELAASGARRPPGAPAGAGGGHRHRHQRGTAAAHLRRFHPGRGVHLATLRRHRPRPVHMQTPGRPDGR

SEQ ID NO: 28084 - protein, 474 aa, Pseudomonas aeruginosa
PVLVRPGPRRRPRPTAACGLPRGRRTAAAAGGGRQPGGRRAARTHGRRPRLARRLRRQRQRGGGAGPGGDGRGPSLRRGADGLAHARSRRPQRGATDPPVAGRPAAAHGDHDHRLWPRGAGRCARPQRAALRRFSHQAGHAQATGRLGAACVARRTGRPGQPAAAPGGAHPAVAGRASAGSGGQRAEPPGRRRAVEQRGRPGGPRRRRAGGRSAGAGGERAVRRGADGHADAGYRWSRGDPENPRRRALRRAADPGHDRQRLAGRPRSLPGGGHERPCGEADRQGAPGALPARSSRQERRQGRAGNGSGRGRTGRGAGRYRRAFRRQPGADRPGVAALRSGHAGPLRPARTPARRGRCPGQRRDPAYHQGQRFHRWRQRPGRPCQRAGAGPAPRRSAARHGNPRRHPPRRTAHPVRCLPAPPAGDVRRRAGGVGELNPGAVASPAKDSGGPGARPASDAACRADNAMGVIRRYS

SEQ ID NO: 28085 - protein, 102 aa, Pseudomonas aeruginosa
PTRARACCRYCVTPSTASPACWNVSRVATTGTCSPSARSEPSRSVGCCRGWRTSRRAIPSSICACPPTTTASTSPPRGSTTRSASAAAPGTAPRRWRCSRRR

SEQ ID NO: 28086 - protein, 379 aa, Pseudomonas aeruginosa
PRWAGGSERCPALRRHARARLRIALYPCAVSIPPAYKSKCRAIHPRYISQAKWPHPNRGARDDPRRSRRPVRTGAHQRRACGPAAFTVEKKHVRFRFASKDFRQPARCRTGGGNAARPFGVRRPAVGAWAATGGGDRPRMPMRRKASVVAAAPRRPRPRPAPRASAGRASAATPPLPEPTPITMARSRAPSSSRWPRTVPVSSTASIATMTASFPKPRPTNTCARPTRPTASRCPPGCSASWSKAGTEPFHTLAAPSLSPGKAGASPFPELSHDPDRQRRRPRPEARPASATAGDGARRGGLPRMRAGQLDRRRRCLRCRPGAPGGALSTDLPRSLAVPRRLHTAGCRLHRADPTLPRPPPGRVVQRAPQLLFRRWPSL

SEQ ID NO: 28087 - protein, 339 aa, Pseudomonas aeruginosa
SVAAAVHRGRGASRRGAHPRGAGAPGAAHRGGEHFLLCSAVPGDERDRVRQRGTRRGRLRPVAGRQQPVRQRLQPRLRRPRLPRPAAARAGRRLPCGGALRRGAGPEDRHPRRRREARRLGLARSRLSSFRRAPDPARAGLQLSAAGRTAAGSGADPPMATRRGTPSWMSACANSSSASPGTCATRLAMRRRRTSKNVACGSTASCSTTPSKASLPAASRACAGCLASSSGMAWCASSIARREAIPPCSPVSPGSSSTTCGSGASIGRRGKPSWPTSNGAKRASTWPSPTIRRIGVKATCSTGCRCCRAWRCRWAIAGRCIGSKRTSRSPKRLRNRPCC

SEQ ID NO: 28088 - protein, 329 aa, Pseudomonas aeruginosa
ASWMGLDQSHRQREHIALAAHGLDVLRFAGVVAEALAQAADQQVDGTVEDVRLAALGQVEQLVAAEYPLRMIEEHPQQAVLGAAEGDHGAGVVEQVAGAGVQLPLAEADQPAALAHGEVRRQHPRTPQHGVDPGKQFAGGEGLGQVVVGAHLQADDAVGLVVARGEHQHRRGLVLADAQLAAEQQAVVAGHHDVEDDQVHRVGFEERAHLPAIGDDGGAQAVLLQVVAYQLANLAVIVDDQDVIDMLHCLAPVAVGVLASSVSAPAALACRGLYCTVSGAGANTGACKKARLSLSRTGETTDGAGRDSSGGSGAANVRPCIGRQRRYSG

SEQ ID NO: 28089 - protein, 185 aa, Pseudomonas aeruginosa
PSLASVRYISTMSWWSCRFSPTPGNSWRWTMPWRASSAAGPMPESNRSCGELIEPALRITSRRACNCTTSPAWLISTPVARVPSSSTRRVSAELSTVRLGRARAGCRKARAALQRSPLTWVTWNGPMPSWRSPLKSALYGQPISSAAWKNTWLIGPGLRCAATFNSPPRPCQGDSPGSKCSERRK

SEQ ID NO: 28090 - protein, 773 aa, Pseudomonas aeruginosa
PRLPGGALQPQQRAHVDHQLQADDETVSAQFASAGVVVVVRVEDVLHRRLQRDVRGQCDVRIGFQGVHVALAEFRIAASGDPRLALELQLVIVQAQVAGLEVELVPRAVEGRMVGQAQLGEMTERLLVVGRYRQRAEQPQRPRRIEAAAVGAPEQLLELEEAAGAAVVAGAGERVDLVGGVQVGVEFIVRAVGIEAFLALVADPQQQAGAAGVVGAEIEAMALLQVIHRVGLEGPGVQVQGRGRPVLQVAAPGAVGRRQDAGGGVDDRVVAGDHGLAVVDQEIAPRIGPSEMAVEASAQPLLLPGEQAQLVGADVVVQRRAAEVAAHRALPARPGGLTGAAVEDEQGFLDVQRGAVQAGEGGEVEVGAEEQVAAVAEAVLARAGVEVLQRQAPELRVGLHAVALESFAEPGQRAAAAVFGGLRGETEETGAEQRRQGAEGFHGKALVLLLFCRANRCPPQADRCIRSEGGSGAEIAAVHRQHGAGDEAGAGTAEEGRGAGHLGRLAPARQRRALHDPAGGLDVGLEPGAQRRVDPAGGDGVDPDALGGILAGQGTGELDDGALAGAVGRAVGGTEGAVHRGDVEDAAAALRQQRPGQLAGEHGGAQVEAQHPFEGSQVVFLAVAADAGVVHQHIQARQRFEQPLQALAVGDVQFFPANPRMTRCVHAVGVQAEGDDFGAEFGELHGDGRADAGAAASDQHLLAGVDIVLENHRRSFLQASARAGLGLTSTLTCDLSRSRASKPCSTACSRGTLRVTARARSRRPSASRAISSG

SEQ ID NO: 28091 - protein, 155 aa, Pseudomonas aeruginosa
PTLPSRRSSRLTRSKASSRTSPIRLTSTSSPPLRRLARAASRLAWLPAASKAQSSAPPSRRRAAVSPSRASSARLAPNSPARARRSGLTSIATMSSIPRRWASITSSRPIGPSPNTAQRWPGARLLRRSACRATAAGSSTAAWRKPTASGRRCSM

SEQ ID NO: 28092 - protein, 664 aa, Pseudomonas aeruginosa
RETGRTAPGGRRRRSRRSGTARRAGRFRNWRNCCYAPCRSPGRAGRPAGEARVRQGGARPGSAEQGVDVGGADADLVVVLTAHRDVVVDVEDAVRVALLVEPDQRSLDDEECTHRLLVLVGHQGVALAGRLVDEVAGGGGPVVLQVAPLAADGVGEHLVRVVVAVDQAGARCHQDVAPAVFAWRDPQRTRLHGLGEGHVEALVLGRRVAQVDLGLGVRLEAVGNRLQVFPEFTGGEFGHGAASVVVIVEPTLAMGGPPGLTLAARKLALFGHGLARPATRRQAGLPSVGAGWRAIDGGKDSDVNDGVPGASPTDRDRSAERPGAWPRRPCLRSGRSTQRSTRRIKMPAHALLETRRASTQDIPLEQRLAFWEDYNASILVGLKCSSYSQAGFAATQDNLCLERLRLARIGGNEHVVERDRSMIRAVPKESIFVSLVQGSQSFFYQDNGCNLLQPGELVIYRTDKPYLFGFSGPMRQFIFDIPQDDFAERCLRDFKGPLKIGAESPVQRLLVRTLGERTRDFLDSPHGEDAERYQEEAYDLLASIISDHAGEHRASALGASYLLAGKQYIQQHLDEPALSCERVAAATGVSSRHLARLFAQEGSSPGRYLQERRLERARQLLASPQGRRLDVAEVAYRHGFSSQAHFARAFKARYGMTPSEARGR

SEQ ID NO: 28093 - protein, 246 aa, Pseudomonas aeruginosa
KPTATAPLPAWTSIFAASFSPWCRAEEGRTPPVGRLRREGSGGSAGSLQAMEAAAEVDQAVALFEDLDVLQLQQQHRMGADLLDLGDASLQVGQGAVQHRQPGEALAPVVEGEAAFHRDLGHAGEVAGHLFMFAAEDVHAESTVGLEHRVHLAVAVDAEHQRRRAVGDRADRGGGDPAASGRAVAGDHVDRRRKMRHGVAEGLLPGFELGHGNNLRTRRGRHWRMRSSTLMSSGLCRCGTVQPFSS

SEQ ID NO: 28094 - protein, 255 aa, Pseudomonas aeruginosa
YLGLRLSGRNLRLSRNGRRRSRRPSRLRAKAWLPWPVRTASALQGAARMFHNSKGNQMNKFKRAILAPLVASGTLLALMSPVAHAVDGIVNFSGNITDVACDINGQAPGAGNVTNVDLGIVAPTHFTAVGTNSTFQEFDLVLSGAGCTNDKKVSIAFDTVTNVDRISGNLMLMGPSKAKGVQIQIFNNSAANTTKIPLGLVDAAPQKGNHRQEHGDPEVQGLLCVHREDRDRGYRPVPYPLPPGVRVSGGRRTKR

SEQ ID NO: 28095 - protein, 367 aa, Pseudomonas aeruginosa
  UNSURE (203),(255): Identity of amino acid at the above locations are unknown.
SIQISGGTSMKRFIQGEHRGQSSLLPESLDDYVADTNPVRVVDVFVDELDLGQLGFDGVVPAETGRPAYHPADLLKIYIYGYLNRIQSSRRLEREAQRNVELMWLTGRLMPDFKTIANFRKDNGKAIRGVCRQFVVLCQQLGLFSEALVAIDGSKFKAVNNRDRNFTSAKLQRRMEEIESSINRYLSAMDTVIVQELAVAQVXAERLQDKIATLKAKLQELKEIEVQLNEIPDKQISLTDPDARSMKTRGTGMVXYYVQAAVDAKHHLIVTHEVTNDGVDRDQLSAMAKQAREAMGVEELSAVADRGYFKGEEILACHEAGITVFVPKTLTSGATAAGRFGKGDFIYDAAKNEYRCPAGQSLIWRFY

SEQ ID NO: 28096 - protein, 339 aa, Pseudomonas aeruginosa
RRSLADIASLAGMASVDVVQQADGDDLRATEQMAQAVAGIELHGGLGTGGQQAFGKFVEHHVQALALGVANPAVGGDRRGEVAVGVQLALLDPGVDGRHPRAEHFAGTRVEHHRRTVARAHVAQRFLAEVGDDVDTVVHQRRHRRSGRNVGARGQLQVAQGPGAVGPDAAVLQLQTSLGQGIARLAQAQVVLAGRAASRGQLADPRLGRGDPGTGGLGLGADLLVHLLRHMVALHQLGGAARLAVQLAGAAARGQEVGLGRGDGGIQLAVGALGFLQCQFGLAHGQSERLGIEAEQYFAGLHVAVVGHQHLGDLTADTRRDAHHRPGQLGLRGGSATRK

SEQ ID NO: 28097 - protein, 126 aa, Pseudomonas aeruginosa
KGRPGIQWRYTMATQGVFTLPANTRFGVTAFANSSGTQTVNVLVNNETAATFSGQSTNNAVIGTQVLNSGSSGKVQVQVSVNGRPSDLVSAQVILTNELNFALVGSEDGTDNDYNDAVVVINWPLG

SEQ ID NO: 28098 - protein, 156 aa, Pseudomonas aeruginosa
MLSEPMNTTRFPLLANQVRRQRRTVLVRRRTAVNDVRRILEALVGGRVAEQRVGALDHRHHRLARVRHVAAHEEPYPPVANEVLGAQPIAVRVAAGVLGQRFDRATADAALAVQLLDRKQCAIALRALDIGGDAGFGEQQADQRPLLVRSHPFPLL

SEQ ID NO: 28099 - protein, 227 aa, Pseudomonas aeruginosa
RPAHRCADRRRARSGRGRCSCSSRRARPPARAGPGRKPGRGRRDGGSMGGCAWVSSLSAGGDGLAGLASLGVVLVAGDPAGLADLHREEQGRVPIGCDGARLRSAGGLGARGLQATGVVLVGGQVAVVVAFAGEQALVIVGEGGIAAGAVGRGFAFDGDDASAAIDYLEIIDGLLAVFVGDGGGGVIVVGEGDLFGAVGVFAGDGAALVVVGPGGEAAIIVILDACK

SEQ ID NO: 28100 - protein, 106 aa, Pseudomonas aeruginosa
FYVPRVVIEVLCFRVVLPICSCYRSESLFLVVCVLNGYTPYLSAKELMVGSLRENEFVATFVANRKISASLYTILSTLLGLEPGEFSIRVKLYSFVELRGIEKSSC

SEQ ID NO: 28101 - protein, 82 aa, Pseudomonas aeruginosa
QRTGPGEAMCGKCPIYLASRRGVEPPTFPLGGGCSIQLSYRDTPDMASGAPRPGGMLTAEKAFVMPLPPRLRIIFRNPGGAA

SEQ ID NO: 28102 - protein, 406 aa, Pseudomonas aeruginosa
NHVTIRRHSSVRSDRQRDPGAEPAARGHPPRLVRLGSAGHFRRMAAVCTGGRSANPLRSKPGLISPAALCRALQRRSQRQAHAVARQFHPFGQRSGVVQQPGVQRMPDVSQHGPPGTQRFDALQCPREVVVVARRLLLRRHRAVQHQQVQRRREQSRGAVRRQPDGIGEVGQAPYRSLLGSPLQQVAEGWLRVDQRQRGRRQRAPLAPLEGAEGLAEIEDARMLVEVGEALRVGRAVHRDHQTLAPAQVQQALGVVGVVMGLEDAIEAMGREALAEIDQAAVDQPTLAGALQQRATGTATQAGVGAGVATGRAIATVDRHLAGVAGAEQGQAHARSLPRRARRVRSVSSRSPELSSWNSGPSRPAANSALRARRASISSGLSRPRASRRWRSTSGFTPSRTASRSG

SEQ ID NO: 28103 - protein, 138 aa, Pseudomonas aeruginosa
PSPPRAAGRSGSHHTRCARRRAARPHAAGWPDSSRWKGYPARRFPPVAPPPRCPSGNRRGPRWARPSAPAGRARGWPWRPPRWSGTRRWPCRSRPTRGHARGSRRHGWPPTGRVPGRHRRWPHGRRRCSARSWLPARR

SEQ ID NO: 28104 - protein, 360 aa, Pseudomonas aeruginosa
SVRSRVLLPAPERPWSTRHSPPATLKLSPRSTLSTTPCCWCRVKVLLRSRTSIRLFIATSPGARRADRRRRFGSGLQDRRHQQLRVRMLRVVENLVGETGFHHPRTAHDHQAVGEQARHRQVVGDDHHRQVQLAHQAAQQVEQARLHRHVEAAGGFVHEHQAWRRDQVAGDLQTLLHAAGKGSRQVVDAQRIDLHLFQPVQPGLAQPTVVAHALGHQPFADVGAGGHAHAQAVARVLLDEAPLGAQQGAPLGFAGGVEVQPAVAVVAVGDRAGVRRTAPGEQREQGRLARAGLTDDAQHLAGVEIEVDLLAALFRPVQAGQATHREQRPVARVEVRIDGFADRVHCASSPSSWQARRCVQ

SEQ ID NO: 28105 - protein, 375 aa, Pseudomonas aeruginosa
PVCWLMSLRKGSQMLLRFCDDSVEMIPKLITGWSACAIPAREPASRAEAASTRLKRFNMERTPGQGLAGFYAVRMTSGAREGQFRLALRPAPGTVGKQQRGVPFGAVEFVEEAFGKVLAAAVEEDPAALQGHRARAIAQRVVDLMQGHHHGLAVVAVDIGEDVHHLARRLRVERGDRFVGENHLGLLGQGAGDGHALLLAAGKGRGALPGEIGQADPCQRFQGLALLLGAEQPQRTAPARHATEEAEQDVVQHAEAVDQVELLEDVADVGAQATHFAAQAAGRLEAATQHVDAAAVVAVAAGKPGDVTQERGFAGAGCTDQRHHLARLDLQPQVEKRLLAGKGLVQAVDTDHRAHRSPSNRLHEDASGAIWCRPR

SEQ ID NO: 28106 - protein, 123 aa, Pseudomonas aeruginosa
TLPRHRFSLTLQVQCMRPLKQATPTYSSRTADKFVVRLPEGMREQIAEVARSHHRSMNSEIIARLEQSLLQEGALQDNLGVRLDSPELSLHERELLQRFRQLTHRQQNALVALIAHDAELAQA

SEQ ID NO: 28107 - protein, 134 aa, Pseudomonas aeruginosa
RWRYPSNATRESRMSYRLAADALVWLHLGFILFVLFGGLLPLRWPRLAWLHLPAVAWGCAVEFLGLPCPLTPLENCLRRAAGDAGYSGGFVEHYLLPLIYPAGLTPAVQWILGAIVLLVNLIAYLYLWHRRSSR

SEQ ID NO: 28108 - protein, 150 aa, Pseudomonas aeruginosa
IYKIIVYKKGSKPMSDRPARPSRLNGLRHLALLVPNLEECERFYVDVLGMEVLNRANEDLVYLTCGNDNLSLGRAHAASNGLQTMDHYGFVVDSVEELEAWYRYLKALGVTLLDQPFDHGDGARSFHLLDPAGNKVQPLYHPAVSGQRLA

SEQ ID NO: 28109 - protein, 169 aa, Pseudomonas aeruginosa
SQANTPSSCSATASIPSRVPATCAVASSIGSNCASSATSSASATSTTSACRTSTPKACRSSARWRSSSPAPASVSIRARPGPWSCSCGARPARWRGYSPASSWPARRPRNTWSGRSQRPRNWPPWKRLPGRCGCGSGTRRVSRSGSSVPPSSCSWRSSSSRTAWCDGRA

SEQ ID NO: 28110 - protein, 202 aa, Pseudomonas aeruginosa
PSSTRCSKASAGSCSSATRCCSSSGHSPQPACCSGAAACSAAGCARSVRYRNCSTNSRASSACRSSRCRSPCTSGSGRSSTSSCWCSSVSPWNPWRWPSRPRRWSRSRPPSPSASTASGGSSPTPSRCWWSTCSPARSIAATSARWARPWRSRPRRACSTGSSAARNAAGPASSVPANARSRRSIPTAASRPTNATTASTAR

SEQ ID NO: 28111 - protein, 475 aa, Pseudomonas aeruginosa
NATASSPFPTSRRSTACACKRCRIPATCSGNAEFIIPHPNDGSTFDLSGDNAFTLYNAIDAETMEVAWQVIVDGNLDNTDMDYSGRFAASTCYNSEKAVDLGGMMRNERDWVVVFDIPRIEAEIKARRFVTLGDSKVPVVDGRRKDGKDSPVTRYIPVPKNPHGLNTSPDGKYFIANGKLSPTCTMIAIERLGDLFAGKLADPRDVVVGEPELGLGPLHTTFDGRGNAYTTLFIDSQLVKWNLADAVRAYKGVKVDYIRQKLDVQYQPGHNHATLCETSEADGKWIVVLSKFSKDRFLPTGPLHPENDQLIDISGEEMKLVHDGPTFAEPHDCILARRDQIKTRKIWDRKDPFFAETVKRAEKDGIDLMKDNKVIREGNKVRVYMVSMAPSFGLTEFKVKQGDEVTVTITNLDEIEDVTHGFVMVNHGVCMEISPQQTSSITFVADKPGVHWYYCSWFCHALHMEMCGRMLVEKA

SEQ ID NO: 28112 - protein, 240 aa, Pseudomonas aeruginosa
CGCPPRSRGREPGRDRRRDPALRRPHRPERARPAPGARRGARPARPQRRRQDHHHQAGPRPAGPQRRPRAGPRPRCEEPGGAPPARLPAGERDLLPAAQRRGNPAPLRPPQGRGAGRSRAPAGTGRPRPCSQAAPENLLEGHAPAPRPGPGAARRTAPAAARRTDGGPRPAGHRRALPIARPPARPGHRDRPLLPCAARRRDAHRPRRDSRRRPPASGRQPRRIAPQGGSADPRAPGQPA

SEQ ID NO: 28113 - protein, 345 aa, Pseudomonas aeruginosa
PAVARTLAPGRPGGAETGRPAHRGTAGRCRARRRAGSAAGRVRVRPGNPAAVAGGPLSPPHVPRPRRSHAMPVVWTIARKELADGLRNRWLLAISLLFALLSVGIAWFGAAAAGQVGFTSVPATVASLTSLATFLMPLIALLLAYDAIVGEEEGGTLLLLLTYPLGRGQLLLGKFLGHGLILALATLIGFGSAALAILALVPEVEAAILLGAFGRFMGSSLLLGCVFLALAYALSSRASEKSSAAGQALGLWFFFVLLFDLALLAILVLSQGHLSPRLLPWLLLLNPTDLYRLINLSGFDAAAAGGVVPLASDLPVSASALWLALALWAGAALALAHGLFRRRPI

SEQ ID NO: 28114 - protein, 468 aa, Pseudomonas aeruginosa
LSDGSGDLRASFAGTEIGSQHRQVAVFQHPRQLAQAQPGVEVGVARFRQVAAGAVELLFGVQHVAIDPLPAGDAAPRRCHLFARRRHRHLVGTHLGQAAGGQVELAVQVIDHTGHLGIQLGLGLGVLVAGLAGRCRHPPALEQRQAETQADTVGVVFLLVGAFRSRVRLAAAGVEAEPGQVAGTIALHLVGCRLQRMALGAQLGAALQGHLAPAFEGRRLQAQRREALDGRGQFAILQCLPEHRLQRTPRRRRAIAGGDLLGAGQAQPGAGLQQVGAGALAFLEGTLVERQLGFQGAPLGLGQDHLLAGEQGFAVGGEQAHRQFLAAPAELFVGEQRLGLALAVARVGLVVEQRLLQAEGRGVAAIVALDAGVALADGGVVARLVVVVAQARQQAGTADGAVFAASAALVERRLEGRVVAHRQLVGVQQAQRLGRRGRKQRGGQQAGSQAIHSSPSARWVRSASGLNR

SEQ ID NO: 28115 - protein, 283 aa, Pseudomonas aeruginosa
PSLASWRRPRNCSSRAARCCSLLRSAACRPSSCAWLPATVSARPSSSRRSARRRLSCNCRCCSSRVGRRGSSSASSSAGNSIRAFSSRSALSRARLASAARYWANRPSAWARAWVASISSSTCPASTRSPSCTRMCLTRPPVGCCTALRLPATITVPETPTPLSSGANPAHRRKPTKPSSTSPQPSREKRFSSSSSAAPPAPTSRNRACPLIAPLLPAHRRPASPVPAGSRNRTPASAVSAPGPQRPAARRWQAPRRSRRNAAGARHAATTACRSAPAPPACG

SEQ ID NO: 28116 - protein, 237 aa, Pseudomonas aeruginosa
PAPGCCRAGASPRWPRPGPPHPPRRGWHWVRRARSAPVARTARGPGRCAGAGRRRVRRRRRQGACRSPAAGAAPGRARRPGAPPPPPSRHPPRRSARCSRRCCRRTVARPGPGSRCAAPVPPRSSAAGRRRPGAPRRTAAARRPPASAPGSTCRNRTARSRRALRQVPGRNRGPATMPARVPARPRRAARRATRRAAPVAACPGRPADSPRAAAPVAGRPAARRSTGARPRSTGRWG

SEQ ID NO: 28117 - protein, 169 aa, Pseudomonas aeruginosa
TARRCAAPGGSGRGWRGFHCAARPAGASSESGPVGVRAASGPGGHCGSLHLPGTAGGGTIRGPPSPRVRGAATAVRAPERSANSSPAFSASSPRTLSWTVAQAARARSCGSSCTPTTPTSAAAAAGVAWATPAAANWSKVELIDRLGSTAFSSASICPCRALLSPLIRP

SEQ ID NO: 28118 - protein, 879 aa, Pseudomonas aeruginosa
MPERTNARSGFALHWAKRGSELVFEGALQGPPATEGEGQHVAQRHQVGAVGDVLHGQAQGQFVAHPVAAVQVVDGVFLPVRRVHAGLRHRGAASHRVAFAVAGTGADVQPAVEEAHAQGQRAAVHRHVFGGAEHRAAMGGGVGLLVRPHVDHRRAATAALHRLGDAAEPGGLRTEVVAADHVRVGELPVGQPGIVVELVLDATEARAVEVVDVGAVADPGHAVARRLHAHAHEDEVVDPGVEVGDLQAQAVVAEPEVLLQHVETDFPGLRALRTEERVGVHVFRAAAVGAAGDQALGHRRRAPALAVGGEQLQPVDAGLDRQAEGRREAPLLAVDGVLQRHVGLPGGAKDEGARVEAGVAAQAVAVVTQPGVEVEPVVVVVVETGEQATEGAVALGGHAFGRREADRRGARPRLAGVRPHLVVEELQAIVGAQRGEIVESEGRGVLRLRAVGVGLVGDRVAGGDTALQGLLAVAVVDVVELGLEVHQRVVRRVAVVDGEVLRTHVAAAELFPERLVLGVEHVGVVVGHLGGQVAELQALVLRQGDAKLGQSRAHHVAGVGHRRMLDPLPGLGIEPGAGAQLANAALGPRVVVAQVALAGGDQHVPDLGADGEGRAADEVGAIGVAAQAAGEAHPATDLLARPDQVAGLHGAEVGDPADHPGAAHGRAGALVDDHLAEQLGIDVERPVALLVAALLVVLAHAVDRHVDPPVVLDATDVHRQAGVLLAHRGVHPGGFLEHVGGMPRRVALDLLAADHADRMRRLVDPVVRTRGGNHRGRHLHQVVLADADQAQLVLAGEAVFHRAALEHLAQAVGQHVFAVHRRAAETGETLAVEEHLDPGLLGESQQGAVHRLCRDVQPDPAQRGLLLARRVRPVLRMQR

SEQ ID NO: 28119 - protein, 88 aa, Pseudomonas aeruginosa
MAVEVVYRSSRDQERLFMDKAEADRYDKMLELAETLAEVLQKAVPSLKEEQVEELGIFMAKNRDAFARAFKNQPDALNELFEENAADE

SEQ ID NO: 28120 - protein, 216 aa, Pseudomonas aeruginosa
SLATPRVITSPTACSKATRWARTRANGSTFRDRFACSSEPCRWTACPTPSASVSRRSARPSACATGAPASAATAWPAPRSIACAAARPASPTTRSTCSTVPRCTTSTAPAATPSSNNCSPACDAAESARRLSDPRPACRKLALAVQRPAAPSTRKVPCPLSPPPPSAPDAGAWTGAACCWHCCCSACWSCSPPWAGIGAGYAASAATCWRWSGSTT

SEQ ID NO: 28121 - protein, 143 aa, Pseudomonas aeruginosa
GAGMSTSALAVSTETRRWSARTLSPALTCHSTISASCRPSPRSGSLKCFMVVSPWLRRSRARCRRPPGCPPRRACTALPGGTAAAGYRPRRPAGSAPAGRTGHARRGSRRFPRRGRHSSAPHGRSRSDRSCAPRLRGCRGRAA

SEQ ID NO: 28122 - protein, 329 aa, Pseudomonas aeruginosa
AGVGETPARPTTRRRRSPSRVLDEASADGYNLGVRPLETGPGVLRTARPQRSRRTRRKAMDPRQACLDCLAQEPPALFEAALWIAAEHLPAYSPAHTLRELDELVRQIGASLDDRASASERAQGLLRRMSEQGFCEDDDFPLQPRSALLPLVLQRRQGQPLSLALVAMELARRLDIPLVGVNFPGRFLLRVPQADHLLDPATGRRLYPTDCRELLLRLQGPKSELQAAYLKQASPGEILQRLSRNLRQLHSAAGEPLAALKDAQRVIELGPVGAADHEARAGLYRQLDCPQAERYDLERALLLSDDPTEQLRLGQRLGELAPPTGRALH

SEQ ID NO: 28123 - protein, 142 aa, Pseudomonas aeruginosa
APPLLPPAGRRTVAAGDPAVAAAAVAGLAAPPAPGRCAGSAGPGAIVRRGTGTRRYPCALRKAASAAPAPREWRAARAAALRRRLPRRCRVRPVPIGALPALPAPVRRAATGAPVPAGSRRGPAAGSPAPAPAVPAAGSGRS

SEQ ID NO: 28124 - protein, 251 aa, Pseudomonas aeruginosa
TPRPGRPARPPARPVPGSRRAPRDRDSPVPAPAPADTSARPRPRGPAAGTGARGAGRSGRASGCPAGRGPPGSAGRDRGRLPRAAVRRAAPATAPAPVRSAPRRSGCRARAPGARHRGRSTAPGPSAPRLSPVASAPSGRSVPATRRPPAVAPAPRAGSRRRRARRGSAGGSRTSPAIAPAAPAGGTPRASAGSAPTGRCSPRLRPGVRRRAASRHSGSPGAACWPAAPPAVRRAGPGPCRCCGRAAIAPR

SEQ ID NO: 28125 - protein, 361 aa, Pseudomonas aeruginosa
ASATIRRRFPVRRRPAPGRPPRGSRRVRRTIRRLPGGSPAAGAAALRARPRGSPVAGCSAGSHRPAGGSPAPTGRPARGAAPRTAGGTAPDRLAAARPGHARRRPAAAAARRATRAGGIPATTVRPSLRRPAGASATRRTNRRCVPAAPRSQRHRRCDRAGGAVRRPRRHRTPAGRRRPPATPLPAATAPGCTAAAAGSPATSPPVARPRSTSNRGRRQRRGRGAVGNRRAAATARMRCATAGTAALRRFPRASRGRRPGGGGRSRGPALPRPAPARPPARQAAPAARILRGGRSCRCQRARRAVAGGIRRAAAAGANGAAAGAAAAAAARRRAARSARSWQCSCSVEAPCREPRPRLPRC

SEQ ID NO: 28126 - protein, 511 aa, Pseudomonas aeruginosa
RTSASAQADALVATGRDSAYPGVAQGGRRVVGGRGLEAELVAALLLVVHAQRQVATGDHVVERLQGVAGDLLVVVVLRVALADPPELAATVVVVDQGDLPAVLVDVHVALGVDVPLARLHRADHFPHPVQLVAGQVLVDVPGLDDVAVLQGRVVELVGVVGDVHLELADQLPVVAVRGAGEHVEVIRGAQAVGGGARAIVGHLRGAPHAALAGVVDPGQARLLDLVEGLVDQQHVARQARRRGHLLLEEGEDVGRLALVEVGHVLRECHRLLEADRREAAVGLRGGLDDGALEVAAAVAGDVVPEHFDTVLRDREGVVAALLEIRQAVAVVDRLHVQRALPDRLVDLGRQGHRAMGLVHRDPVGFRVALEHRQLAVGELVLVLLDVLRGDGEQRLLVGKGIGKEALAIDLAGAGREAAGPGRDAAVGVAFLLRADGGQAAAELGGLVGRNRRRHRTGQQAEGQRPGGQESCCFHASLSLFVSAKAAAPRGGGPQKFTPKLTARKSRSLIGL

SEQ ID NO: 28127 - protein, 515 aa, Pseudomonas aeruginosa
QGRGGYTLPSGPNGGKRTKEVFRLSPERVNRGPGKRLGERHMQDGYAVIQCMDDSAALFRRRRRWHPSLHAARTDHSRRPRSRRRHPRDGHALSPQLEAPRHRRGDGALSSRGRIQRLLPEPPDAPGRSPRVRRGDHAQGPRRVAGAHRPYPLRRRYRLHPVPPAGDPQRPPGFVPRQRGDHRARRPDLAHQRIRLAGPRKRRRSPGRRRRPAAGQPPGAFGQAAEPAGTRPGALLPAGPALSRSGPGPDPGGQCHRLYAQPDFLPAQPGARPELLPVRQPDPPATPARPAFRRAARTGRRTGLRRRLQFAVGLLPLLPPAHRPVSARIPEAPVVAPLRFPSGPARTTGARHLPTLAAFPLPSRYGALYVGLAPPQPVDESTGRSARSAPVPGRIPRGRRGHRRRRLHRPLDRLLPEAPGAAVARRHRRGRNRRLRRLGAQRRLADGQPARRGRPARRLAAGAAPGRLRPAARDSRRSRAGAARGRHRLRLPQGRRALLRGALPGTGTPPARLSA

SEQ ID NO: 28128 - protein, 374 aa, Pseudomonas aeruginosa
SSTASPGGATASLEAPVAPLAVLEALRALQGLAALDHRQPALEFVGQGHVEGQFPLRIYAGAVGEHAGLREGGEFRRQLLGLGSRRTARHHPVGQADLQRFVGLHRTPGEDQVERPALPDDPRQAHAAAIDQRHPETPAEHSADGVLGHHPQVGEQRQLQPAGHRIAFDGGDQRLAELHAARPHRSVALRLQAIAPLAILGHRRQVGAGAEIAAAAGEYRDPRRIVRFELAQGVGQGLGGRPVHRIAPLRASDDQGGDRAVAFDDDTHDRLPAEKAKKDTGRMAEDRRQPVFTLVLLPRPRRIRRASQSACFCRLAIISRSASTLSAGCAAFSKSQICCQCAATSSASKPAFGSKPKPRLRSQRTLPIQPPPTS

SEQ ID NO: 28129 - protein, 125 aa, Pseudomonas aeruginosa
TRSQSASSILWKVLSRRMPALLTTTSTRPKASSAFSTILPPSVTESWLATAVPPAARISATTLSAAEALAPSPWVLPPRSLTTTRAPCFANSRAWARPRPPPAPVTITTWSSKRRASLMFGTPGQ

SEQ ID NO: 28130 - protein, 328 aa, Pseudomonas aeruginosa
RSGRPNRAGRPAGSRQRDRRGSAIRRRRPGLAHRRAGSERRSRRHPLLSLSDARSLAPPSSGDCRRAYTRAPAEWRRIQPAYARRLQAVGDQGRDQQVEQPGENHQQTGRRTFLAAELVGPTGAGAVRADAEQRAAGQRRAQAQDAQQGAADHRAEHPGDHHEGGGQFRHATQVVGHLHGERRGDRARQQRQRDLAVQRQGLGQRPGAADGHRGAGEHPGQQRRPVAHQQLALLPDRDGEGHRRRTEQRHQPIGVAGVVGVAGMGGNRQGVEQHRDEHDGRQPVPLHPAVQLAAQEVAADGRRQPEQGLLIETHGAPSSGTSTPPTPR

SEQ ID NO: 28131 - protein, 347 aa, Pseudomonas aeruginosa
VPPVRRQGGTDGGRAGATWERPWLGNRGWRKDKARPIIPKANCPHESHSRMEFRQLRSFVEVVRQGSFTQAAQVRHASQSTISKQVAQLEQSLGVQVLERNGPHVRLTDAGAVVFRRAEEMLRLRRDLLSELDDLSQLNRGELRLGLPLLGADALFAQRFAEYRRRYPNIAVHLVEGGSKTMEQAVLAGELELAGSLTPADDGFDYQPFCNEPLDVLLPAGHPKAAAASVALGELADSPFLLYQQSFTLNDRLLRACLEAGFSPREGGRSGQADFLGALVAANQGVVLLPRVIAREIERPGVVRVLLREPDLRWDIAFIWRRGGYLSRAAQAWLELLREQPLEESPA

SEQ ID NO: 28132 - protein, 333 aa, Pseudomonas aeruginosa
APPAPRPAARRPGCAGRRGRRSRPGRRGRRCSAGSRPGWRWPPAATAGRCAGRRCGGRSRTAPSSIGGWRHAGGDGRRRRGRGHRDNPCRCSRDWRRDGRPGAAGRRTCRSRPGPPWHWPRRGGSVGRGRGSARWLPPGSARSVAARRGRANRCRRGRRPPGRRPGRRCRTRPARRRRRREPGRAGRTTGRRGHASGLLPRRGGLAFGQARGAFVEAYLALAEDYHAVRRGDGLGPMGDHDAGDAQRANGGVDPLFTVYVEVAGGFVEEQDARLLVQRPGQHHPLLLAAGEHRAHVADQGVVAHRHGLDVIVDGSHLRALAPARACPVAGQKN

SEQ ID NO: 28133 - protein, 577 aa, Pseudomonas aeruginosa
RLRHQLVDHRRLVPGGGGAVAPALAPLHPQRGVVAAEVVEQPGLELVVEGIGLRGTGQAEDVQPDRRVPLRLVGARTDRRQAGHLGAGNDRLAGLVEPADANLHRAVHGVVAVGAVGGDHRLVLQVELVDHPLHVATPGQHRVAVGGDAQGAGLDVQQQVLAPAPQVVAQGQRHAAHYQVVLQLAEQRGEFRVAGVDRRQQVGQRLGNVVGEGVVERAVDRAGAERAARGRRPDLQPGLVGEGEPDGLGASAFLQEAVEGPSAAAGRGEHLARRDVHVALAAHALVDPGLEGRLDDEGASEVDEERRAGRIVAAEGLQHVLSGGAVPDHRGQRHDAVAQGAVALPRQAAFALRRDAGAVAVDGEHPAEGQVTRRRRGDEAELDPLQLFQQGFHGDAGLRAEQAELALGVDPYAGQVTAGFHQHDAALAVLAAFQQQRGPVVTHAARAHLEAVLPGPVDHRENLFVGARGAAPEVVGGDFPRPIAERPPIKFEAGRKACRRRTTAGGGFGGLDDEGRGPAGHQADRAERGTLAEEAAARQAAGFLVGIADEGVGVLDEVVHGGSPDRGAGRPFPVAGS

SEQ ID NO: 28134 - protein, 450 aa, Pseudomonas aeruginosa
RCRPAKGARPARCQGERGRGARISRTANLHPRARRCRLDRKAKKRRASVPASASRIQVGSGEGRLLLLLSALVAFGPLSIDMYLPSLPAIAADLGASDAQVQRSISGFLVGFCFGMLFYGPLSDRFGRRPVLLAGIALYLFSSLACVLADSAGQLVLLRVLQALGGGAASVLARAMVRDLYPLGEAARMLALMHMVTMLAPLAAPLLGGYLMLWAGWRALFVVLALFAGLCLLAVWRVAESHPPERRGGSLAQAFLAYGRLLGDRRALGYVLCMGLAFAGMFAYISAAPFVFIEHFGVRAERFGWFFGLNILGVMLATWCSARLVRRHGPRPLLRAGSLLACVSGLFLLGYAALGERGGLWALVPGLLCFVSVTGLLGANCIASLLALYPGQAGAASAVAVSGQFGLGCLASLAVGWLALPGVLPMALVMAVCGVGSLLALGLALHGGNR

SEQ ID NO: 28135 - protein, 615 aa, Pseudomonas aeruginosa
FSSSAVEPCPQRGGRGSGREGTRCRGSGHAGRREDSFRARLAYRAPGVVAHQQHAGEEEPATDQAHDEARMAGHQRLDEGVGQRAVLVDRAPHQALGNAVDPQRGDVQHGADGGQPEVRIDQADAVHLLDPVDLGNQVVERADGDHRDPAEGAGVDVADGPVGVVGEGVDGLDRHHRAFEGGHAVERQGHHQEAQDRVVAQLMPGPGEGHHAVDHAAPARRQEDQRHHHAQRLRPVRQRGVVQVVRAGPDVQGDQRPEVDDGQPVGVDRAPGLLGHEVVHHAEEAGGQEEAYGVVPVPPLDHGIGGAGVHRVGLEPAHRQRHVVDDVQHRGGQDERAEEPVADIDVLDLALDQGAEEHHRVGDPDDRQPDRAGELDLGVFLGGGVAQRQADQQDHRHRLPAPEGEGGQGVGEQSHLAGTLHRVVAGGEQRAAAEGEDHQVGMQRPQAAEAGPGQVEVHLGPDQLRGDQYAQPHADHAPYHGHDGELANHLVVVGRFRRCFVHLYSPERNEQPATAVEGGDGAPAGACNLRAGAGVKQLQVDMEFGYQMGRGKAFVQGGGAYRDGGREPIMADDRARLSALRRGGFPSAGRHPASDWAIRPSVSIAFSCRALHGCP

SEQ ID NO: 28136 - protein, 514 aa, Pseudomonas aeruginosa
RFILSWPLSWLAVGTAAGAHSMRAGTVLSCLIAASSARRRNEGAGAADRQARVVDAAQAERQRLRAGPGAFGGRGHRHREVEDLAGLQAQGVLALQAELRRVVELQAIALRLLGLVDDLEGVDVLDLPGGVLAEQPTVAGHVQRGQRAGIQGDDEGADHRQHHRRVADQAWTQEAGLATFQGAFRGVAHQAAFIAHLVHDRVAGVDAGGAADAGDLQAVADVDAGGADLHALLAVDAVAEPLGARIAAFLAGAAGLAAGGVVGHDQGVLVEHHALEARVGAHVDAHLLAQPAGVDIGGGGEEQHPEQAFQVQLEAEQVGHQRPHRSEVADEGDRRDQAHTQPQRVLGRFAQELGGARRTLVELDPRIAVALGDLLAPHEHPGPHALRAGIAAPDAAGEHGDEEQAEGGDDQQRREQDEVLRPEGRAENVELAFGQVPEHRLAAVPVQPQGAEEQQEQQAAAEAAEVAEQTGEAAGVDRAVHRRRQLAGRGRLFRRSGRCGGLDLDRGNSFAHFS

SEQ ID NO: 28137 - protein, 616 aa, Pseudomonas aeruginosa
CVFFGGICRCFAVCTRAIVGASEHRPILSPETGAQPVPGFFATHPARHRWRNPVDEGFAMYQYDEYDQALVSERVAQFRDQIARRLDGELSEEEFLPLRLQNGLYLQKHAYMLRVAIPYGTLSSPQLRALAHVARHYDRGYGHFTTRQNIQFNWIELEQVGDILEHLAGAQMHAIQTSGNCVRNITTEAFAGVAADEWTDPRPLAEILRQWSTVNPEFLFLPRKFKIALSSAVEDRAAVQMHDIGLYLYRHPDAGELRLRVLVGGGLGRTPMLGQVIRDDLPWQHLLSYVEAILRVYNRHGRRDNKYKARIKILVKALGIEAFAREVEEEWQHLRDGPAQLTAEECQRVAERFVLPRYLPPADGELAYGSARAADPTFARWASRNVQAHKVPGYASVVLSTKPGASAPPGDVTAEQMERVADWAERYGFGEIRVAHEQNLVLPDVRLENLHALWHEACAAGLGTPNQGLLSDIIACPGGDYCALANAKSIPIAQGIQQRFEDLDHLHDIGELSLNISGCMNACGHHHIGNIGILGVDKNGSEWYQVTLGGAQGKDSALGKVIGPSFSAAEVPAVIERIVETFTDLRVGPERFIDTFNRVGLEPFKARVYARMEEPA

SEQ ID NO: 28138 - protein, 190 aa, Pseudomonas aeruginosa
SCTFCERPDVPATCRWPGGELGECSVMAGRSVRRVVQEFMHVVALVVQLRVQFGEFEGQRQQASRLELGEVRGDHLEKCLGDLPASLQVATGADFQGHVDEGVVVLAVGHAPGVQAHAAAADAAERENAAGAKAGVDLLEQAGQVGFGFDVVGVFGDEVRHGGVLRGGWRNWRRPGCRPGRRGSPSRPGR

SEQ ID NO: 28139 - protein, 594 aa, Pseudomonas aeruginosa
RFSWWPVGPGSGRGRWRLARILLIVSARRRCWRPRGAALHERALHAPAGDVMAAHGYTHVLDLGEYLEAVFPAFASGARGLHPAERLAQVAHVLAVDEDHPGLDAACQAMGLADVLGPDVGGQAVFHVVGQAQRLGFVLERDQADHRAEDLLLGDAHAVVHVGEHRGLDELPLAQVRRQAGRTLQAAGHQGGAFLEADADVAGDLVVVGLGDHRADLGLRVLRIADDQAPGACGELGDELRVDAFLDEDATAGGAALAVQREDGEQSGVQRPLEVGVFEDQHRRLAAQFHRVFLDPGRLHDPSPGGGAAGEGHRAHVAVANQRVAGAGAVALDHVEHPRRNARLVHQAAQLVGGQRRQLGHLQHRRVAQRQARRGLPGGGHERYVPRRDQAADAHRLVQGVVEHLVVDRIAVPVHPRADFGEELEVVRGARDQHVLRLVDRQAGVEGLKFRQVRHVPVDQLAEPAHQARALLGRGIGPFREGFPGRRHRRVDFRRAAAGNLADQLAGGRVVVLEDVLAFDLAAIDPVFDHSACSCARARKNSASLTIRLTRRPTPSTSTTTSSPGTTSDRPSGVPVAIMSPGCRVMKLEKYSIR

SEQ ID NO: 28140 - protein, 260 aa, Pseudomonas aeruginosa
RMRACFMVGSSFRDDAVGEAAEAVDLDLDAVAGMHVDSPFGGAGDQHVAGVQGHELADLGDQPRDVAHQVGGVVALAQFAVDVQLQLQRMGIGDLLRRHQLRTERAEAVAALGFHRRAVVAVFRQAELVDDHVAGDMRHGLFLLHPAGVASDHHAQRRARLQALDAAREEHRGVVLVAGIRCLDEQHRLHWRLLVGRLLELRQAAVEQALVVQRDAEQGAGGDVIQCAAHCGGVSWRDKRTARGPSWRKLVNVLTLYLTC

SEQ ID NO: 28141 - protein, 344 aa, Pseudomonas aeruginosa
SSTPVAAPFVPGRWQEAPSAVYGSPRRLACAAGKNNKEKIAMPERQPIPNINIGQVYDQRYADAEVHYDALGNLAGFFGRNMPVHRHDRFFQVHYVKNGAVRVYLDERQYLESGPMFFLTPPTVPHAFVTEADADGHVLTVRQQLVWSLTEAEPGLAPGPQVAPACVALGNLEGGAAEEAARLALLFEQLRSESMASRPGRQQMLLALTRLVMISLLRLSANSVAARPMRHEDLQIFQRFNALIEERYAEHWPLSLYASRIGVTEARLNDVCRRIADLPSKRLVYERLMQESKRLLLFTGGSVNEICYQLGFKDPAYFSRFFVRYAGLTPSAYRQRQADGESRR

SEQ ID NO: 28142 - protein, 285 aa, Pseudomonas aeruginosa
AGGRVYSRSHSNRKRFSMHDAATSMPPQAPSTWADYLAGYRWRGQGEGCSAATVHRLEVARRPTLFVKQEVLSAHAELPAEIARLRWLHGAGIDCPQVLNETQSDGRQWLLMSAVPGDTLSALAQRGELEPERLVRLVAAALRRLHDLDPAACPFDHRLERRLDTVRQRVEAGLVDEADFDDDHRGRSATELYRLLLDRRPAVEDLVVAHGDACLPNLLAEGRRFSGFIDCGRLGVADRHQDLALAARDIEAELGAAWAEAFLVEYGGDIDGERLAYFRLLDEFF

SEQ ID NO: 28143 - protein, 1441 aa, Pseudomonas aeruginosa
SSGTKRRRECGIAPRRGGAGTEYRVNVQQSKFRLSRWAGATLALGLLLSGLGAWGLALVNEQQARMALEREAELLAEAVTRRVELYQYGLRGVRGALLTAGEAHIDRELFRRYSLTRDIDREFPGARGFGFIRRVAAADEAGFLRQARADGQPEFRIQQLTPHDGERYVIQYIEPVARNGQALGLDIASEANRREAARAALETGQVRLTGPITLVQASGLRQQSFLILMPIYRSGITPPPGPQRELEGFGWSYAPLLTGEVLAGLPIDNAAIHLELSDVTGDGAAVPFFVNGAAAPAQRLFGHMLRREIYGRHWQMAFSALPLFVQRLHQPSPRILFLAGSLVSLLLAALVNASALGRLRRRREAATQARLAAIVGNSADGIIGVGLDGVISDWNRGAEALFGYREEQAVGRRVVDLLVPPSKENEELDILARIARKEQVVSFDTVRRHQDGHLLDVAVTVSPILGPDGGVVGASKTVRDISAQKAAEARIRELNTGLEHQIAERTAELRRLNVLLGSVLQAASEVSIITLDRDGIISGFNLGAERMLGYRADEVVGKASPTLLHSERELLARGQELGEEGFRVLVARAEQEGAETREWTYLRKDGSPLSVTLSVTVLRDEAGAINGYLGIAVDVTEWRNAEREMAAARDQLQMAADVARLGIWRWNLADDSLQWNERMCELYGQPLALRDGGLVYEHWRSRLHPEDLERTEASLRAAVEGRGNYDVIFRVVLPDGGIRFIQAGAQVERDADGNPLQVTGINIDITSDQQLQARLREAKEQADAASAAKSSFLANMSHEIRTPMNAVLGMLQLARQTDLNERQRDYLDKASSAATSLLGLLNDILDYSKIEAGKLVLEMLPFELEPLMQDLAVVLSGNQGDKDVEVIFDIDPELPSAVVGDRLRLQQILINLAGNALKFTARGHVLVSLRRLAHDAHLVRLRVLVADTGIGISAEQQQRIFEGFTQAEASTSRRFGGTGLGLFICKRLVDLMGGELRVESAPGSGSRFWFDLDLDVAHDQPLRAACPGAGEPLRLLVADDNLVAGELLERTVGALGWRADCVGSGSEAVARVQAAMAEGRRYDVVLMDWRMPDLDGLSAAQLIRQLQGDLPPPMVIMITAYGREVLADARDHSAPPFVDFLTKPVTPKQLADSVLHALHGEQGAPANPPPRPVERTQRLRGVRLLVVEDNALNRQVAAELLSSEGARVALADGGLAGVQQVLEASVPFDAVLMDMQMPDIDGLEATRRIRADGRFAGLPILAMTANASLADREACLAAGMNDHVAKPIDKERLVLCLLGHLGRSGARGAPATAADAGELVEARGDIVGRFGGSLELIVQVLRRFVPDMQDLFAQLERQLGEGDVQGSAATLHTIKGSASTVGASALAGRASELEQALRRADPLRGMEILAGIRLDELRTLCDACLLRLQAMFGDVQAESAS

SEQ ID NO: 28144 - protein, 338 aa, Pseudomonas aeruginosa
RLHFRSRGLRTPAQDLRGQRQADARRAVQQAGARPALSLSTPWRRPLFPLGKRGRRRFRSYPMTLIDNAAGLGLRRGLLPQLLAMAPGAVDFLECAPDNWIGVGGAFGADLERLVERFPLTCHGLSLSLGGSTPLDAAFIEQTRRFLVRHRVALYSEHLSYCSDDGHLYDLLPLPFTEAAVRHVAARIREAQERLERRIAVENISYYAAPYREMSEIEFVNAVLDEADCDLLLDVNNLFVNACNHGYDALDFLVRLPPGRVAAYHVAGHYDEAPDLKIDTHGAAVKPGVWALLGAAYRRFGVRPTLLERDFNYPPLGELLLEVEQIRQWQRDEGRRHG

SEQ ID NO: 28145 - protein, 834 aa, Pseudomonas aeruginosa
PRASSARLDHSAGQCTAAVATRVTTISTRAVRRVPRPSRRSSAPSSSAHSDSSQLKAAGRRSKGKGKADWISPNQFSPFHFSQPDSKNSQARNSRRDRSALQPPQRSSRAKGRRQARRSDACMIDVSLRAVDGSGRLYVATTQAHGELGGELEDDGGEDRGERQYVPAAHGDAFEERQAEDARQHPGAGRVQGFPGAWAEQSGRGAEGGEGEQQDEQVADRAGDVRRDRAAAPECLGEQLPVGQDQQGVYCVGEGEGQAQVAPFTEQRAGPRAGHQGRQRGREESGEEQREGTARGGADGAAQALHRLRLESQDEGGHAQHGDGEDGEQSPAVPGGLRGWDGHGGAPGCRERLGDVPPLPVARSVASGFIRSVSAEGGYVSLCTGASGVQLDARAKPAAGAVGQGQAAAEGQAQLLRDGQAEAGATGVAIARVFHPVEGLEHLVEFLGGNPRAIVQHLDSRAAIGTAFHFQARGAGELQRIVDQVHQHPAQGVRTGVDHRAGTAVELYLLAAVLVVEDQAVEEGVEVHPATGFGAAVHAAGIGHAFADQVLHLFEIVPQLVPVAGGVHELDAQLHPRDRRLQVVGNRREQLHALLEVVGDARLHGIEGRRRMRHFAWAGFRERLCRTIRIEMFHGLHQPGQRADGGAHREAGAEQQQEQLHQQYQRQPAGQRHRGRRDVDGQRAAVAQAQEDLEVRTAVGHRAQGQRVLTVEGAFDGVRGNRRVGQRQRLAGLAGVEAIAVGASFQARQPGLALGGRQAVEHGYRDRHVLFEAVEHHVLRGLVALVELRGEGQPVGQHQPGEEDQRQARGEAARARHGELHGWASTSRTGSENT

SEQ ID NO: 28146 - protein, 123 aa, Pseudomonas aeruginosa
PRGRRGPGAAAGSSARGRRSDPAPGSLPAGRGGGSHRTRRCSRSAPRAGRTGTARASAAAAASPSARSPGRSRAWPRCGTSARCPGGPAGSRRPQATHGAGRCRGAPVPPPGRCRRATGAAAS

SEQ ID NO: 28147 - protein, 91 aa, Pseudomonas aeruginosa
PPSTASTAPVTKLAPGPQRKAAALATSGASPQRASGVRCMIRRVASTSALSPAPSGVSIQPGAMALTRMRSAAYSQARERVSWTMAPLLAL

SEQ ID NO: 28148 - protein, 394 aa, Pseudomonas aeruginosa
SPSTRRGCSGLPGSSGIRRSGIPAPPRRGRRCAVPPRQGRARRPRRRTHGRGSAARGNRTAGAPRPGESSAGRSGIRAGRCRRCRSRRLPVRLRRAAAPGVPVRSGGGRGQRASAVLSWLVSLQDGGRRAALARQHGGRGFAQEQREERGEQGAAAGHPHDDGQAEAVGGEAGHGRREETADQFAEAHDQAEGGGDDAARDGLRRDGRHEQGEAAEPGVGQQQQQAEAGRVRRIEQRQRATRGEQGERHQGRSTADAIGYRRYGEAPDHPGDAQAAHQPAHGRRAEAAGVDQEGRGKGNQHDEPGDEYATDQGAEQDVAALQQCQALAFRFFCARRRALRAGRVGTHMAPDQPGDQQTRQQRDDEGVTPAEGFGQGHQQRRADHRAEQAGRRAL

SEQ ID NO: 28149 - protein, 173 aa, Pseudomonas aeruginosa
QTHVEAAAMWRGGLDHQRLRERQDRPLGQAHDAAEQQQAEEAADQPGQRRAQREQDHRHDQQRLALPAAVGPGADQRAGYRPGQGQHRGEHAQVAVAQLQLLFHEGKQEGQRQAVEEDEAEGQEQHAEQDVFVTGGIVVMRHVGLQAGRAGRRGRRASARAARARGQRNRESM

SEQ ID NO: 28150 - protein, 203 aa, Pseudomonas aeruginosa
PAVPAHAAPAPRPGAAAGPPAGRGHRVRCLPRGDLSGQWPERAAVEPALGRGRPAAAVQSLPAPRGRLFQRARDRRLRAVGAGPAATAEGAPGLAPGTQRDRRVAAGAVAPGDGPDTPGAGGLPAPAARVEPCRYRRRAGAQGKHGENLPQPRLCPPGHPFSQPAFRPGAGLRRAGRRLWGGSGERGQAARQARCRRWKLRLK

SEQ ID NO: 28151 - protein, 172 aa, Pseudomonas aeruginosa
TRPSPCSRTWMSSSSSNSTEWVPISWTSAMRPCRLARAPCSTGNPARPSRQSWRAKRRSIGTSVMPAKWRATSSCSPLRTFTQSRPLALNTVFISLLRLMQSISVGGLSVTEQTAVAVIPQRPAGPLLVITLTAAERCAMALRKACCLGSSWDMGITSGRDAGVIGGCGRAR

SEQ ID NO: 28152 - protein, 218 aa, Pseudomonas aeruginosa
TALRRGPGRGRRWCPWASSQIVAGLVEHLGQGADREVNRGGEVVVLVAEDLAVGAPGFQVDQQHAEGRHDLLAPDEQVQAFGQSVAVAAVGIGQPSLGAAQALPGVEVGIEVDVFVGLAGAVDVAVAQADQLVAGDVRAGVGLPRAVEAAMQELGLHAGQFPAGQGPGEQTLFAGRAVGQMAEHRGERLVVEVQHQADRDRPAVFLLEEIHQVKVFPQ

SEQ ID NO: 28153 - protein, 74 aa, Pseudomonas aeruginosa
WGRRKPRACRSRSSTIRRPTPRRSRWAWSMPPRRKATIDKNTATLKYKASYVSTEKTVIAGTGLSHIRYLLAYE

SEQ ID NO: 28154 - protein, 258 aa, Pseudomonas aeruginosa
AAVDGRRGEAMAPLMHRFHSFVAASAVAIALCVGTAHAGLIAQGTRVVFPASEREVTLRISNTSGTPVLAQAWIDDGRQDVPPEELQVPFSVTPAVTRVDPNGGAVLRIAYLKAPLPTDRESLFWLNILEVPPRDEDENNALQFSFRSRFKLFFRPSQLKSVDSAAGKLQWKFLESGGAGKKTVVQVNNPTPYYVSFASVELIVDGRVMSVGKGMVAPFSTKEFDWQGNPKNMEAASVRYEVINDYGGRNTHDRALGK

SEQ ID NO: 28155 - protein, 410 aa, Pseudomonas aeruginosa
VAILKSLQGLHMPKVSLHRCLSAPAYGGQVALLRMAMQGGIAVRSLRFACLLALFPSLSSCQSWSSVGAAGVAGAKEARTGAPAKQPQAPAVAVASPAGGLDAPSRRIVFDAQMLALGPGGRSIDTSRFERGDVIEPGRYRLDLLLNSRWRGVEEVELRRQPGRESAVFCYDRGLLERAGIDLEKSARGQDRSSARDPLPEGLHCDPLERYVPGARVKLDIAEQSVYVSVPSYYLSLDSSKTYVDPASWDSGISAALLNYNSNLHVRENHGRSATSGYAGMNAGFNFGRARLRHNGTATWSRRMGSHYQRSATYVQTDLPAWRAQLLLGENSTSSEFFDAVSFRGVQLSSDDRMLPDSLRYYAPVVRGTASTNARVSVYQRGYLIYETTVAPGAFALDADCVKTLASTLL

SEQ ID NO: 28156 - protein, 107 aa, Pseudomonas aeruginosa
WSSHCQGCALKEHCTPSSERRVSRWEHEAVLEAMQSRLDQAPEMMRIRRQTVEHPFGTLKSWMGATHFLTRTLDRVSTEMSLHVLAYNLKRVLTMLGSGALMAAMKA

SEQ ID NO: 28157 - protein, 215 aa, Pseudomonas aeruginosa
SPSLAAFLHGLGRGRSPGWSARRNRSPVRRSPACGCARRTSPRSTATGRRRAGCRSDRRAAPASPPPAHSRAAYRGRGCARRSARPSSAWETTPGSRRSAPTASPSGRRSGRPRRTRSPPWPRAASRGAGWGRPWPAPGAAAAVRRRGTGRTSARRWPPSARWRPCCWRACRTDRRPDSWQSAAASRGTPNSVRRRRTAGRAPSGRSGRRRGRRR

SEQ ID NO: 28158 - protein, 123 aa, Pseudomonas aeruginosa
HAAIIRTEASPMKFGLFASTALFLLSVCALPALAANSPCSGKKGGIAGCDGDIFLCNDGSISASKRSCAAYFGNAGGRTGQPAVQRLQGTTQGCACGSGSFCTGPRGGVYCLTPGGKKSYRRK

SEQ ID NO: 28159 - protein, 560 aa, Pseudomonas aeruginosa
GGVVAALGAVADRVVGVAAPALDAAFLGQAVQRVVLVVQGAPEAVAVLLDIAIGIVLVVALPGADLLPQQLVVLVVLAAESDAVAPGQALQRAEGQVGDLPNQGARRLVAHCQGHAGDLAAGVARVADGEAGGVADLQQLVGRVVAVGHAVEQGLLVEADAAYLLDQVAALVVAVHQAVAGTFDGAQAADALVAVGGEVVAVLYVEARVARRAALDQPIEGVVAILGDRTASVGAADDVAGGVVLEGGGAAVRADQSGQVAEAVVFVAGGDAARVLDLGEVVLGVVGESGLAAEGIALADQPVEGVEGLAVGELARVGFADRIVVEVVGEAACLAAGADRTEQPAKLVVGPLLLAHQAAAGVLDALGGAIALGVDVVFEAFAEVVADRHQAPCVVVFVAQPTAVATGDAGDLADCVIVEAGGAAGGADGGQPAVDAGVGEAAGDAVGIGDAAGLAALVIVAEAGDLAEGVGHLGQVAATVVGIEGDVLHIGARTVGALDQAEGVVAVAPGALGRLRGQGQGASQGEGAETGEVWGDAHGCRPCQRVVTVSPVLRPSASYW

SEQ ID NO: 28160 - protein, 78 aa, Pseudomonas aeruginosa
AGTRNSEPDGEGSGSETMSRSAVILLFVVIASAILALSLPPEATLLAWCAWGLLGISGAWLLFALVVGRRIRFDPSLD

SEQ ID NO: 28161 - protein, 159 aa, Pseudomonas aeruginosa
TGTWRASPVPSRVRRMRGRCRDGPGGCVACRRDHRSCPVGTAGPPGRRRTRRYAPGAPRFPRGFPGRAPAGAGAAPRVSPRAGPRADPDSAGGPAPGSRASRSPARRSPAPATRRSAPECHSKGRWRASSWRTPRPARGCRTAPESPPGRPPPPLPRSA

SEQ ID NO: 28162 - protein, 494 aa, Pseudomonas aeruginosa
SPAARYGSRAAPGARARPATGCPCPSRKAPSDKSVCLSSEHSLPAAPDLTHHRLVVAERPRMQQIGAQADADFATIGQPGGQRRGTADHRHRARQVVADRIILAVLAGEQQGRMQQAGRIVVAGKDIQHADSRQLRRRHVARVGTAADHVGRAHQHLQAVLVAGPGGLHGGRELGDGHAVAGRLADMREGRVVMAGHRQAASLADIDDGRTGGVAVALGVGYLLDDEGVHLGIAQVVLALVVLAVLLQPGELALAGGVVHHRDQLHQRMLDQFAEHLQRLRMADLATQVQAMVGARVAAGGGLADGLEHLRQLLHALALGVDVADGQRVEHRGDSRGDDLRVVRQHRRGRWPVDAGTRGHVLLQVVGVQLDQTGQQVVAPQVLGPGQVAAAFVDRGDQAVAQQHAADEDPLGADYPGIAENAFRRHGLAPGGKAPGSCPGSGWPPPRGRRGRGRCRSTRRQRPWLRRSAPALPGGWLRRGTRSARRAAGSATRP

SEQ ID NO: 28163 - protein, 161 aa, Pseudomonas aeruginosa
GRGPRSGCSSLLLRAPVARTGADASAQGCRTDDTSNCVYGCCGSSRIWSVRPASTTRERRMTIRRSASRRATARSWVTITTARSSSRTRPRSRSSRRACTDTSRPPVGSSMNTRRGAETRLRAICRRCCMPPEKVRGRSSMRSGSISTCSSQSSPAWRSRP

SEQ ID NO: 28164 - protein, 481 aa, Pseudomonas aeruginosa
AGRGGSCAWSARRGRRSCSPAPARRWLAGKGSCALLLDSGLRGFGDAGTTQLANQLQLGLEIDVVRQLQVRDEATGLDVVAVHQDELFLLRRRHHLLAVFLGAQGAVDQGHAHRLAFGVAEGQAVATGELRQLLAGTDELVDHLALGDLDLAHRHREAEFLGLQPDLAGADADLPGERMVAAVAALGRIAQGEKEALVAAGQGLQALGAAGGEVERLAGDIRHRAGQFVLRRHQAFPVEQAEHARTRLQGRAPLHFGAGVVALGEQAEVEQAMGIVEGRTEQLPARQVLVGRRDPPLQAHPGGIQRQAGGEARQRGAVGAEEEDRFHQVAGRLLDRQCRQLLVVQRTLGHHPRHGQRHLLADLLHRQLRQRGIAAALARQQAMGVVDGLLATLDGYVHQATSSTGSLTRVLRGRPRMRSPAAKKASRPLGNSVRAARCAQNPALTGNATWRTSAMPGPRHSSEAPPSRPASWISRVQDWSG

SEQ ID NO: 28165 - protein, 197 aa, Pseudomonas aeruginosa
ATAHGGASAGAPPPRGWAGAHRSGCRCGSAAGLCRPGSDAANRPGSRRAARCGKRRSNGGSGSLAGRRGNAGWSVPAPARPRRSPGGWHRRRRPGAGAPPAAGPRPGGPGPRATRCRRWRRPSGRSSAPPGPGCPCPGAAARGLRAPVRRAPCAGYGGSPRSAGPAGSRRAGSRRGGRPAVPGAAVRPVRGTAVRFV

SEQ ID NO: 28166 - protein, 325 aa, Pseudomonas aeruginosa
QNVDQAHHHDDHDQHGAGLAELEAADGLPEDHADAAGADHPDHCGGTHVGLEAVQRIGDPQRQDLRDDPEDDLLQGAGTGGADAFDRTGVDRLDRLGEELGEHPGGTDEQRQHAGERAQADGDHEEHGEDHLVDRTAGIHHPPHRLVDPPGHDVLGSQDRQRDGADDRQHRAPEGDLHGDQHLAEVELPVAEVRREEVGGEGRHVAGVAEQHGRVHFRALPGPGEDGEEQAPADQASPGWLAGGGRRGSGAQSAHIGNLDSGIGESGGARRRPRPGWISRRWRRFSARARPCVSPAWPAPRRGPSAWRPSPRRRGWRCSPRRCAA

SEQ ID NO: 28167 - protein, 277 aa, Pseudomonas aeruginosa
CCAGSEANRRLISPAQPGVFPMHPYFSLAGRVALVTGGSRGIGQMIAQGLLEAGARVFICARDAEACADTATHLSAYGDCQAIPADLSSEAGARRLAQALGELSARLDILVNNAGTSWGAALESYPVSGWEKVMQLNVTSVFSCIQQLLPLLRRSASAENPARVINIGSVAGISAMGEQAYGYGPSKAALHQLSRMLAKELVGEHINVNVIAPGRFPSRMTRHIANDPQALEADSASIPMGRWGRPEEMAALAISLAGTAGAYMTGNVIPIDGGFHL

SEQ ID NO: 28168 - protein, 177 aa, Pseudomonas aeruginosa
RPRPLASSRHDPQRFSHRLHPLLLHGEVRHPAPAAARAGGAGDPGTAAAVRPGGSAGRPGAGQPCLAAVPLPPGPGRQAATEGAPAAPGRQPLAGSLRHPRHPSAERHRPVGGAPGGLRSGAPVAFRNRPARRHPGTRYQALRTLRRRRGRRPQRHRRRAAAGHRRGVERAGAAPGP

SEQ ID NO: 28169 - protein, 728 aa, Pseudomonas aeruginosa
PVVDGTYARPSFFRRIVAVCLRLDAPAGRPRRPGCRTQRVGAPAHRPGIPRGRADRRPRRRLRRTPPEQGRGNPRLRLPDPQRHRHPGLLRQADQPAGDPRSAGGYPRRLRPRTPRTDPADRHPGREAARLQRQVRRRARRPAGGGRPLQRPAGGYRRRGERRHGDGDGGQRDRHARRTYGGGFPRPDRGPRQCAAQAGAGAPATGSDGELERIARQRCDPPPAVESRADRRRLQGQRGRRHRRSRRGAPRRAVHRSLQRPAQPSRGGPQPARRQPVPRTDGVAEARRIRLRRARRRRVFLQGFRLRARWHLRSGPTAPVRRHHQLPRPRLPAPVGRLRRRHAGVPRDGDLRRPRQPAFRSGLALDPGVARAAPDRPGGGGIHQLRAGLPDARGIPGAAAANGRGTGRPGRGCPAAVAAGLVPEEFPGRGPLYRPRPAPGDPLPPGPPGATAAPDAATAHRLPGVHPGLPGLVQPRPAIGGQRADLRPRAVRRLPLGAVPQRPAAVHPLDIHRSQPAALGPRRVLRLAVPVRCATGTAQRTRAQAPRAAVPGAVRRARAALGDQVHHPAGALRSLPGIPGAGRAGRGGGAVQDHHHPRLRPPVVVRRLRRRAAGGQPVHPQGLLPLPLPAGRGPGDPGQGAPVRLAQAPRGMRQALPALCPRMRDPGDPSRRPHRGQRMPLLPRLPDDLPRPGQVPAAGEQAQEAREERAGGQRADTRGEPLTWLPFP

SEQ ID NO: 28170 - protein, 164 aa, Pseudomonas aeruginosa
VLRVLERRTFRRSTRARRAVDARADAHTGVQRRLGHRLGPDQREQAGPRGQRALPQRRLPPSAHLDDRRQVRRQVPVHQRQGQQPGRAHPPGRHEMRPHRHHSQRPGDPRPAPAKGAAYPLRVLATPSSSSPIPTTARPSTCPATTPSPCTTPSTPRPWKWPGR

SEQ ID NO: 28171 - protein, 788 aa, Pseudomonas aeruginosa
PTASSWSTTASAWRSARNRPRRSPSSPISPGCTGTTAAGSATPCTWKCAGGCWWKRLDPRSAVAGRAPGGAAPRPAPARPRHGPRGAGRRPAAAGRRRWPLEPGGGPLRRQLRHRPAAAPTLRGRRRTGRRRPRQSADPDQPRDHRRGLPAAQLGAQPDRTRRRDLRRQGRQRRRDPRQRPARRGIRRLARRHGGRAGARQPHRGRRKRALPGSRQRYPPLCGEGRSGPRQPGQPHPRRGLHRHFQRQQHRSQPLRGAALRRALHVHPQQPGDRQPDPAHPHRLRADAEPQADRDRQPLHRRRELRHPDELHHLLDPGRQPRRGRAQRQHRRRDDFRRRGQGAVHLQLAVQPHRRQQLRRQRPGHPPHRRLGGQSHRRQRLHRQPPAGQVRRQPRAGVVRRRPRQLLERLPGLGPRRRRSRRRRLRAQRQRRPADLAVPAGTPAVEQPEHRAAALGPARLPGGALARRARQPSADADARRGAEAVSLVEIDGATLRYGALTALSGLDLRLEPGEVLGLLGHNGAGKTTTIKLVLGLLAPSEGRVRVLGHDARSLEARRQLGYLPENVTFYPQLSGAETLRHFARLKGVAPAEAARLLEQVGLGHAARRRLKTYSKGMRQRLGLAQALLGEPRLLLLDEPTVGLDPLATVELYQLLDRLRGQGTGIVLCSHVLPGVETHIDRAAILAGGRLQVAGSLAELRRKAALPTRVRLASPHNPQWLERWHRAGLAARRLDDQRIEVLLDDAERDGVLEALLAACEFDLEILPPSLEDLYRHHMSPAPAGATPCP

SEQ ID NO: 28172 - protein, 236 aa, Pseudomonas aeruginosa
STCPASTQPPPAGWFPWPATCRCPPAPSGWPWPSGPALPWRWPTACSAAAPSDSRGSAMQRHTLPLRPLLGTLLLGLLLAGCDASRDDATALGPVPIASGDECHVCGMLIEEMPGPKGESVLPGAVRKFCSTAELFGWWLQPENRQGQARLYVHDMSQADWRHPDDARLIDATRAYYVVGIQRPGGMGATLASFADEEAATRLAAEEGGRVLRFDEIDQAVLQGVGGDHPHRHPAH

SEQ ID NO: 28173 - protein, 130 aa, Pseudomonas aeruginosa
AWAGKQKAPAADTAGAFFAWRDEARRRPTSRRRRARSGSRPARPCAARSSGRSCRARRWSLPACSGCRRSSHGRPADSSAAGRCPRTACRCASGRSGGPGCGTARGSPAGSRSASLSPGRRSTRVPAGPW

SEQ ID NO: 28174 - protein, 426 aa, Pseudomonas aeruginosa
ERARCTDCSSKTPRKTRAHTNSSRRDAVARHFIGCQNIRKMNCLDNAYPEYGYGITRYRSAAGRRGLPSLPRTGRKDNRANPADGTAKCRGAFRSRRGSLDEIHPPPARGVRRRGPAGERLPRRRGAVAVAVGDQHLARRAGAAVRLQAVRPRRQAPDPQCPRPPTAAAGGGAARPRRGNREPAQRQDRLRLPRPRRHPDHRQLPGHAADRRLHAAPAGLPGAPARAQHRPGGAAGRPLRAGPGPDRGRLPASGHRGATLDGGRTGGVLRPPASAGAAGRRRPGTADAGGLDPPRAGLRHPPDLRPGHASSPAAAEHPPGAGAHRGDQACRGVRPGHRLHFPPGPARRFPPRQPGAGGNARPGPAPAVLLHLAQAEVPDCDHARVPRPVPQRDRRDQPQRRDRAAADSLTQLARDRLPSRYWRYEV

SEQ ID NO: 28175 - protein, 340 aa, Pseudomonas aeruginosa
GAARPCGYRPPSPCRRPRHPCPAGPTRPTGESRRSRAAPAPSRAGKNASRPVPAPRRRRRLRATAPARSSRRSSRHTADRHPRSRPVAETERRRRPCRRRGRSGRRRGAGKHLGGRAETLQAPAMQQQQLVGQRQHRRLVGDQHQAAAVPAHRRDGLGQGRLTRLVEAGIGFVEHDQRRSPVQRAGQADALALAAGESGAAVAKARVVALRQAQHQVVHAGQARRRHHLLGIHLGEARDVLGDAAGEQLHVLGQVADVRPQCRRAPVPQVGAVQAHRAGQRLPGAHQQARQGRLAGTGRPDHAERFARFQGETEVLQQCLLASRRGRAEPLDAQRAARRR

SEQ ID NO: 28176 - protein, 437 aa, Pseudomonas aeruginosa
RHAQGGRRILLEQPRQSLVGLPRAAPLAPDRDQLVDGAEHAAHQDRAGDHHPRGDQAFHRQPGAEAEHQRLQGQAHALGGRADRRAALAAEVLPGKEGLVLGEPARAHGRQHAHCRQGFRLAQVGRGLLGGEDRQLPGLGQRFARAAFVDPGKQHQQQRPNQGEQAEPGTEEEDHQQVEREPGRVEEGEQGVAGEELAQAGQVVQRLPDGLLAVLQAGAERGVVDALVELHVELAAEADHHQAAHPLQGAEQQVEAEHHEGQHQQGHVVAGAEHPVVDLQHVQRRRQHQQVDHRGEQRDAAQRRAEAAEGGEDFIARRGRPELHRSRVLWVSGPRAGPEDIAAVSTCRARPAEEQSGGRRRHGCEAQRRRFVRRRGAPTPLRPLAQAVHERYRGQLLRPPGPGRAAVPARRPRRPPPLPQPGWHGRRRPRPTGRRWS

SEQ ID NO: 28177 - protein, 135 aa, Pseudomonas aeruginosa
SGRPARSRRRRVRSRRCPGPAAPPPPRPSRATPCAAPRRGAARWQPASEPSSAVRPAIPAVSRSVAPAPARPGAGGQPPASRPALRAGTGRGRRRPGGSPIRRPAGGSAVVPGGCSRAALVGRYRGSDARTGKTR

SEQ ID NO: 28178 - protein, 386 aa, Pseudomonas aeruginosa
RRNRWKNSASSWRRTATPSPAPSRTSRTPSTNCSRKTPRTNEPPLQAKRKEPKHAATTCRPAVRPPRPRRRPCPRLPIPGHGRRDTGSLCRRRAGPGPGRHRQTATRPATGPRHPAAQRRPADRSLRRGSLPRPPPARRQRDGRGRGRTARPSATGSPALRSPAAGRPARRRARASPGAAPGPRPVRPARQRQPLPRGRHRGLSPARQPGRQALPRALPARRSPGALPRQLRQRRLRRTTARQPATPLSPRGACPTRARLAGNWRLPYNARQPHRPGRSHARSPRLPRPLPTLAPGPAQPAAGTAAVRPAGPARHPGPALGLDTQLRRRPAGVGLALLPDGQRAQGAGRLAGIRRLCRRRAAGTGPVPGGATALAIFQSRAAHRSR

SEQ ID NO: 28179 - protein, 437 aa, Pseudomonas aeruginosa
SASWSSPLGSGVAEHGVAGRQDVLHGGHVQRFQAVQRRRDIGRGDPLDRRPQVEQDTLVEARGDFPAEAATLRRLMDDHAATGLAHRGFEGVEVERLEAGDVDHFGLDAALRQALGGLLGLVDAGAPADQGQVAAFAKGEATVQRQAPGVVRQRLRVHPVEPGRLEEDHRIGIVDRRQEQAVGPRRRRRHQHADAGDVREHRLGRLAVVLRRADPRAHRRAQHQRAGQAAAGAIAQAAGMGHQLLHGGVDEAHELDLHHRLQALGGHADGQPGDHVLRQRRIQHPLEAEALAQAEGGAKHPAVDPDVFAQHHHRLVLGHGPVQRQVDRLQNGQACRFAVALIHVRPLPAAARGAPRIARAAPPGPPGSARRHARTMPAAPAPANVSKRSTDSCTRAWHSPTSACSRSSSHWPRPARKARRRLIGSSRQAWLTSSGER

SEQ ID NO: 28180 - protein, 757 aa, Pseudomonas aeruginosa
PLRQLQAAAQGLLGLGQLSGEELALGDTHAHFAKQRLPPLRLENGEQPAQPRFGGGCLAAVEFGQCQLVLYPRFQLRFGGRRQARPSRLEVGADPQQDLPRLRRPSLLQGQGGADQQQRAAIQRIGDMALLHQPFDLQQAVERRVQVALPGLQQGQSQVAVERPGIEILPCLLQPQPIPVPGLDLAALLQAQARAAQGDPAEHRAALLAEVLQVALGAIEDAFRAQQFAALLQPLRPLQFDQRLEDQAVVLARQAQGIAADQPRLVHPPLDYRQLHQRRAADQSLRPGVLRQLLQRLAQVVGGAALAAAVQEDPEQALPLRQQHPLAGRRGHRQEARQLADAVLGFGQASGVEQRPGIQDHQARRAGQQRRRQFVAQGQDHADVVAVQQLLLGELLQQSGGGFRFVGGQRLVDRLAGLAVFGEPFAGFPVEVPLRALRRFAPGLADRRWQAVALVRIGQQGEAPRQQVVQPVGQLLEQPAEQLRTDLRQPGQGTRGVGQRRRQLVEQLVLEVFLQQRSGRLFADQQAQAQRGAPTAAAFQQRPGRSGIGAATVQAEQFGDLVGIERQQAAVDLQQLPFQQQPRQVALRPPPARQPPAHPWRGRAQQAIEAGVKGGVGVPWVIVEQQPQRGCVAQPPAQLRFVAFLGQAEGAGQAAAEGRGVQRFPAQRQPDHLHARRRPPRAFSEEDGLAAASGRAEQSQAAFAAQQRLVQTGPRQVLRRQPRQGGGQLGRLGHGSALVLSKRLAGSLDRACPAAER

SEQ ID NO: 28181 - protein, 308 aa, Pseudomonas aeruginosa
TGALESASANAICRMDTPSSSAWMTARHCSAGGGDGILRCMQPEQTIPADRDLADATRETVMRYHLSWKHRDIDAVMALYHPEVEYNDFFQNRRMRLADLREYVEATMPKGPDESLEHTDRIRFDGDTAFIQYRLRVTLSGRLASFRASEAITVRDGLIWRINEYASLVHESGGGAQAGGDGRPPASRLGLSAKQLSLLARDLEHYFQQAQPYLDPDLDLTQVANATGYTRNQISYLLNQVLGLSFYQYVNQTRLQHLLGQLSGELPGRVDELAFAAGFNSLSAFYRCFRQHTGQSPREYLKRLSSRR

SEQ ID NO: 28182 - protein, 498 aa, Pseudomonas aeruginosa
DFPADPRARQAHGIFLLSPHSPFPLAMEPSMSAWRHLSLWMNQLDDPLEARPSLEESLEVDVAIVGAGYTGLWTAYYLKRRAPQLRVAIVEAETAGFGASGRNGGWLMGNLLGEDGLLAGLPPERRRAGYDLLHGIPDEVARVLQEEGIDCDYRKGGVLYCAARYPEQERRLRAYLHDLYAEGLDESDYRWLRPQELDQQLRIPGSYGAIHSPHCATIQPARLARGLARAVERLGVRLFEKSRVLHWQRGLLRTERGELRAEWIVPAVEGYAASLPPLGHYQLPVQSLLVATEPLPSSVWAEIGLERGQAFSEFSRQVTYGQRTADDRLAFGARGGYRFGGKLRSDFSLDDEEVGLRRYLFGELFPLLKDARISHTWGGNLGMARRFRPHMLLDRASGIALSGGYGGEGVGASNLGGRTLAALILGEDSELLRQPWVLGERPLDSLARWEPEPCRWLGYNAIIRSFVHEDRVLADPHSAPWRRSLAQTLAAGMESLMR

SEQ ID NO: 28183 - protein, 287 aa, Pseudomonas aeruginosa
ESPPPPTEEKPHGPDPSEKYRRRRSWRRQPGRGAPWRAGRADPRLRRGAHRPGGNRHLGMHPRTLAAADRRAGVLPLPARPLHLHPGRRRDHPHRGRRCLAAAGEQSRRVGCAGNRAQELRDHPPLARAARRRHSKRPWRPSPSLKRCAPSRVSPLSITASPPWNSLARATSKDSSHCAYTLARSASMQVCGKAASSAASSSASARAEPLGTTRLARPICNASSAFTGRPVRIRSSARPCPTIRGRRTLPPSISGTPKRRQNTPQMASSAITRRSASSASSSPPATA

SEQ ID NO: 28184 - protein, 293 aa, Pseudomonas aeruginosa
NPECGRASARPPGECRAAPRSLAVARVLLVELAQQRRPGELAAHAGLAAHHPGDHVARAGEDLPRDVDQLGAAALRHHLYLAGALQGEHHEEGIGDGTAAGEQAVVGQDQEVAGPQVGLQAGLFLMVQGDALVGVVGQAGEHEQRLLRQRQQALLLAGHRDPRGGMGVQHALDVVADLVHRAMDGVAGRVDLVGAVHQLLAAGIHLHQAGGGDLVEHQAERVDQEVLGARHLGRDVGEDQVVPTVQGDQPVAGSEIDAGLPFGGGDLGLHIGGQGVNGGHGGILFCRYRMPAV

SEQ ID NO: 28185 - protein, 138 aa, Pseudomonas aeruginosa
ARLVPAPCAPTPNSAPRASGVRKRRTRSRVPPITAPNTPVIITKAAVSSGTPPRSWDISMANGVVIERGSNDSVTWPSSARAWASAQELPMATAVPANIPASSAGQWRISSSRCCQIGMAKATVAGPSSATSQLVSRA

SEQ ID NO: 28186 - protein, 177 aa, Pseudomonas aeruginosa
QRAVVEQAHQRRDEEQQHLRQQQAGAGLQPGRTQQAAGEQQQQCRQADHPARQRQADGLRQPAAGPPEGDEYRQFGGKAGQTADERGQHGKGLGWEIGDGERIRPGLSSPKRIVRMRAIPEWNSVNSAASSKWSARAASPRRLRSATPASRPSASRSPNWSRALACRYWNATGRTCA

SEQ ID NO: 28187 - protein, 184 aa, Pseudomonas aeruginosa
PTPAPWCFAAPRRCCGCAATCSANWTTSASSTAANCAWACRCSVPTRCSPNASPNTGGAIRTSPCTWWRAAARPWSRRCWPASWNWPAASPRQTTASTTSRSATNRWTCCCRPGIPRPLPPASPSANWRTARSCSTSRASPSTTACCAPAWRPASARAKAAAAARPTSSARWWRPTREWCCYHE

SEQ ID NO: 28188 - protein, 301 aa, Pseudomonas aeruginosa
RRQLRDLPRGGQAALGGEGVVVGLGGEGEGVLQGRVLAGVGRQQQLLGVAQGGAAAAEVEQHPAQLEAGATPVAMAVAGEVGGIAIIHVAVAATGVETAVQARQVGGLADPDLGRLGIGPGEAGLWVVAEDPLDGFLQAQLGRWRPAAAGQTAAAEVVDRLAGDLADGAEHVRLVGGGAGNQAEQAAQQAGEGTHQACSRAAAAWRSARRAVLSSRLTLPWPRTITRSAEAMVSGRWATMTRVMRSARMAALTRCSQCTSRWLVASSRNRMRGFLYSARASITRCFWPPESTVPMSPTRVL

SEQ ID NO: 28189 - protein, 1059 aa, Pseudomonas aeruginosa
PIGMAWMSSWMAAICAHWRQPGHVRLRVKKTDVVRLSEPANSTSSCSTVPTSSRSPSRPNCARSRPAMADLFPPWREDAQQDVEQGALAAARGADDGHRLAAGDAQVEAVEDPGLLFRVAVAQALDLDARLALAKVLREDVAVADLRGLEHDVGQALALQLEHAQLEELVDQAADAAVELRLVGVEGHQDADAELAVHHHGRAEPDHQQVLHAEQQAVELLVEQLQLLRTQAGVDLFHQQAEPYRAALVLALEQLQRADAAHRLEEMALLARGVDDLLLGGVAQRPVPDPAAEGVEAHGGDGDGRQWRTVEQHHAEGGDGHQAVQHRREEGRGEGLLDAVHRAEARHHVAQVALLEILRGQPQQVAEDVGLPLHAEQGAHVHHHPGAHPADRLLHQQQQAEADGQGAEQVTVFADDDVVDGPLQEERTDQREHFQRAGEQQHLGQRAVQPGDLAEHAQQLDPRRRLLFLEAALRPEFQGYPGEAPRDFLQAQPALAVGGVVEHRAAPVDRLEHDEVVEVPVQHAGQLELAEVAEVELHRAGTQAEAVGGLDQLLEGDALERYGEAPAQFHQAGMVAVVAGDHRQAGQAAFGGFGLQHQRQAAAQAQGESVEKGHGSFLEFAGQAVERFQHPFVEAPGVLEDVGVQQHAALQRTRLAVGGHRLVVEGYPQPVQLLAILAEPRYAADHAGKLGIGDAGAGDRLHLAVVLAELLVRIGLVADQHRVARPDETDGLARRVEFGLQRGVGGNDAQQRTRAVDGLPGFGEHGGGDAALRRGDQQGALGFAFGQVLLHRAELAAGFRELVGLARGKPGEFVAALGQLLPQRRAFALQALQRLALAEQLGLALLQLVHGDVALVHQPLVARGGVAGQRQQALLAVGLGGEGGEFALQAGDLAGQAVALVVLQAAKLFQFVAQGVAALFQAPADAGLHRPGIAAVAFAGKHHQALAASYRLAFLDELAQHDAGLRRVHLDLAAGGHQLAADGAALGVAAEQEEAHHQQRHRRGQQGEKSEGDRADQHDLAQAAGMLGVEGFLAKHGGWILDSNNTCMTLRHPCESSNA

SEQ ID NO: 28190 - protein, 447 aa, Pseudomonas aeruginosa
GGRCVAAFPNRPRRRSGELPPNLSPRASTVPKEIPVSVPTHQQDLIALLEERGFVHQCTDRDGLAAHLAAGPATAYLGFDATADSLHVGHLQGLMLMRWLQKAGHRPLLLIGGATTRIGDPSFRDSSRPILTEAQIQANIDGIARVFSRYVELHDDSLVNNAEWLDGVGYLEFLDRVGRHFSINRLLTFDAIRQRLDREHSLSFLEFGYTLLQAYDFVELSRRRGCTLQLGGADQWANIINGVELSRRQGGAQLFGLTMPLLATSDGRKMGKSAQGAVWLNAERLAPFDFWQFWRNCDDRDVGRFLALFSELPMDEVRRLGALQGAELNEAKVVLANAATALAHGEHAARSAADAARGVFADGTRDSGLPVMKLSRARLAQGLSLTDLLLEHAIQPSRSAVRRLAAGGGLRLDGTPVSDPDAPLAGEVDGLRLSLGKKQHLHLRLED

SEQ ID NO: 28191 - protein, 97 aa, Pseudomonas aeruginosa
CSGPAGARCSWSWRCSPGSACWRSGGSPKATRRSAAAAAWPRPFSPMGGCSATVARWATCCAWGWRSPGCSPTSAPRHSCSSSISACARSASAGSSA

SEQ ID NO: 28192 - protein, 190 aa, Pseudomonas aeruginosa
WPSAASAACSRWAWPCTAETVDFLLHTRMQPVFFPLLFCTFETSHPSSDPMSTPRPSLTLTLLQAREAAMSFFRPSLNQHGLTEQQWRVIRILRQQGEMESYQLANQACILRPSMTGVLARLERDGIVRRWKAPKDQRRVYVNLTEKGQQCFVSMSGDMEKNYQRIQERFGEEKLAQLLELLNELKKIKP

SEQ ID NO: 28193 - protein, 172 aa, Pseudomonas aeruginosa
LPRSASGSPSASYCRATCRRPTASWPTAAPVRPIRPSPAGPRATSRRTRCRATPRWCCRPSPAPARRRATSPRSRWNASPIGPSATVSARSVWPTNRTWCSPTCAWRTSTRCGTRPAQPASARLTKACSATSSPVPAATTARWPTPSRSPSPRVSSSASRTSTTCTTSASLA

SEQ ID NO: 28194 - protein, 324 aa, Pseudomonas aeruginosa
ARARRRSCARPRRAGWRRRPRWRCPGSRGRTALPAGASVRRRRGGWRLPGSDGDRAWSGSLGSAWVDHGGGGPQDQAGAEGDEDGQQVQGQAGALGGVAHPADQVGREEGGDAAEGTDQGDSGGQGGAGKEGRRQLPEHRQGGAGAHPGDHQTAHHQPGAGRCQGRQAEPGGGHQQRNAQVPAALAQAVGGTADEDHEGAAGEIGHRAEHADAAVLGDAGAMDQARHPERDGVHRQHHREIDRHQQPHLRIAEDAGEGGDGLALLLAGQFLAQQVLLFVAEPRHPFEAFRQRAPDHHAEQHNRQAFDQEHPLPAAQSEGVMEAF

SEQ ID NO: 28195 - protein, 186 aa, Pseudomonas aeruginosa
SCLPSAMRQVSRRTPRLRMPPSGKTPLAPRQAWTFSNRPGRSASASMLSVYSAMKCGMVASSEAAGATGAGRVAGLGGGDRRAVLGGDREYRVDLPGAGGAEVGRHHLRLAVVGRPAEGAEEHRGVVHEAFAMALGGVLREHPAEFRPAAFLPHLHDFMVEDLEERAPDAVGEVRRLAVLGEAVGQ

SEQ ID NO: 28196 - protein, 205 aa, Pseudomonas aeruginosa
AAGEERHRAVVVLFHRLAHGPAQARAVVQVMHGAQGGDRDHLEVAVLVHVAHRYQGAVLRAEGGGVVGQGLHAERVAALGEDAAQLRVAGEAVLHVGDEVRQLVAGVEPLEVRRAVDVVAGVDQPVGVEHHDGVDPQFAAAPADLAVPVDRRLAAAVARAGQLGQVQRGYVGDLGSQSDFAHDDSPGGPLGLAAGAAVGGWPGFF

SEQ ID NO: 28197 - protein, 80 aa, Pseudomonas aeruginosa
EARPYSTSLARRSASASSLNGIRQTTGPKISSWAMRMRLSTSANTVGWMNCPLLRCAGRPAGRSRPPATRVAPSSRPMRM

SEQ ID NO: 28198 - protein, 140 aa, Pseudomonas aeruginosa
TRSATSSASRTRPTSVVSSCVTRGSPPALTASDRPTGSPVAERVGGYTRAPTRTGSVSPCMMQPPPCRRRLPPPGPTTLPATAGEGRAKDVPRPLSTAWRLRGGRPCSSSRKCCPHMPSCPPKSPACAGCTVPASIARRC

SEQ ID NO: 28199 - protein, 711 aa, Pseudomonas aeruginosa
QGKSRIYLSPAWHRGNPATSRGRKDPASAGIIDSSPDIVAFPPDARPVEGRNEACRMNSPAAYLATFFPPFSKSLSSMIELRTITRDDWETCIDLKVARHQAHFVASNLYSLAQSRFLPGFRAVGIHHGGRMVGFAPLRPRRRRRPLLALPPDDRPPLPGQGAWPRRPATDHRQRAPDEAAQRSPDGRLRRRQRCGPPALSGCRFRRTGPRALGRDDGLPDAAGAVPSLREGRRSAGRACSARRPGVESRDSAVPSNTYNDHPTHIAAPDPCVRGVFRRAWRGSRDLPVRPLLRNRTPHGQHLRNPQRQLAERDRPGPGRLHLQHHGVRPGRPAQRHRPQLRDAHLAGRPDVDHLCLGGVAGLVADDAADPQYRAAQAAGRGIPAVHRQPRAVRAGLELPGADAQPDRHCLRPRGVLGHHRFAGGARGAAGTAGQGARAAGHRHHPGDGPGHPAGAGGRRGPGLAYHLHGHRRTLGADPALPGALPAAAAKPELRFPAQPADAVPTPGAGLPVRADRGGDQRPVHREQLHRAVPQAGGADERRGDHPAAAVVRRRRDLRFDLLQPIQRGFPARLHAGRDPSLGQQPGAAVAAVRAADLADGAQPALGHVDHVLRPGPAVPRPAPRLGRHRRGHGAVLRPVQRRHRRRRAARQRGQRTHGPGLDRQRRRRAGAGRPAARPVRRTALRGGAEKHVVVSGHTWGRMIRRRNPPA

SEQ ID NO: 28200 - protein, 201 aa, Pseudomonas aeruginosa
PARCWPGCPSTTRLSTSNSATSPATALPCPSSSTAPRRRLNACSATCCGGRSTVGTGRWRSAHCRCSSSACTSLRRASCSWPAAWSACCWRRWSTPAPSAACAGVGRRRPRRGWRRSSAIRRTASSASASTASSATGIAGPRRCSATARSRRSGGGWWTCWCRHPRRTRNSTSSPASPVKNRWSASIPCAGTRMATCSTWR

SEQ ID NO: 28201 - protein, 161 aa, Pseudomonas aeruginosa
AGRRRLPGASPGRGGWRRGSPGGSCGRAPAAPRSACGCRACCAPRRRPGRSAGGCPVVPPCAAAGVPGLPGCAGLPGERPGAALPGGSGGGCDGPRRAPPGARVRRRRRRAGRAGGGAGKRSWHHHSQDRRPAPLRSVALASALQRFSGTLPCCSRPLRMA

SEQ ID NO: 28202 - protein, 302 aa, Pseudomonas aeruginosa
KNLEQRLVRPHLPLNALRAFEASARHLSFTRAAIELCVTQAAVSHQVKSLEERLGVALFKRLPRGLMLTHEGESLLPVLCDSFDRIAGLLERFEGGHYRDVLTVGAVGTFTVGWLLPRLEDFQARHPFIDLRLSTHNNRVDIAAEGLDYAIRFGGGAWHGTEALALFEAPLTVLCCPEVAAQLHSPADLLQHTLLRSYRADEWPLWFQAAGLPAHAPLTRSIVFDTSLAMLEAARQGVGVALAPAAMFAWQLASESIRRPFATEVSTGSYWLTRLQSREETSAMLAFRGWLLEMAAVEARGR

SEQ ID NO: 28203 - protein, 565 aa, Pseudomonas aeruginosa
ASLPGWRHRPGVPQRSRSRACLLSLLRQRRQVRIGGQPSSGKPSGRRLRTTGQATLWMEHSHFCCALRLSPGADTYGLLKTVGGLPAVSTMVRLKQRGAGGDCGEAADNASRYAPYGSGARLAGGRRLRISGSRVEIRARGLGQSRPHLVEIAEVPGFRRLEADDSVGLSGPTQVYHLLRDRHLRAGREEYLDPWRQQRAAVLFEDHAEAPAFQPDQRADRVDAHRLDEGAEHLRVEVPVPFGHASDRLGGVPALLVGTVGGDRVVDVAHRAHSRQQADLLLRQAEGVAGAVDALVVVQADIHHQGADLAAIEQHPRAVLRMPANQAELLVGELAGLVQDRIGHRHLADVVQQSGQPRLAYQRVGQFELAGEGDHQRTDRHRMHVGVFIRGLQPYQAEQRVGMAQHRGGDFVHQVRCMRGIDGLAHARVAEHADHGGLGTAAEQGGVADFLLQGDPRRRRAGRHGDRQDRSGRDRRFLREVEALAGIDPDFLHGAFAQALQVGLAVEQEATSFPERVVQPRAAKALDEHTEAKLGYRNAFQHDGLDLETGPGGCLLTVAEMGRRE

SEQ ID NO: 28204 - protein, 239 aa, Pseudomonas aeruginosa
EMPGTSSACPRSIAYRFVSMRGFDTSGVQIQVSGDTPPIHLPGEMATSEPRRPGRPQKVPPPGSYRRPPAPRLRPGRVYCGEEACPFSIRVKRLPPACSVPYWWGECCSAVRRSPSSRWGMGCNWRRRSPANAHAEKGKCGSGGSAKTPAKAGAEGKCGEGKCGDASFARTDTDHDGKVSRAEFLAVAKDRAGEFDSIDSDHDGFISEAEAYEHLRKTYEANGKPMPAGLFSKLEQGRH

SEQ ID NO: 28205 - protein, 302 aa, Pseudomonas aeruginosa
SPASGPCSEPPIVVSACARPCSSGTSTIRRWANCCWKWSRSANGNATRDAVMDERLRQQQFSLARHLRDPLGNAPPPDIEERRLRVYRELFYNAIEGLLASGFPRLRGLLGEQQWHGLVREFYREERSHTPLFTRIAGVFVDYLRQRGEYRPAWQAELAHFEWSETRLYLAEPDDPPYRREGDLLDGVPLLSSLALPLGYRWPVHRLEEDVALAEAPAEPTLLLMHRDSSHRVHTARLTPLAYRLLESLARRRLSGREHLAALALEARSAPGALDAAGLELLAALRTQGVVLGTLERDWAGG

SEQ ID NO: 28206 - protein, 646 aa, Pseudomonas aeruginosa
SGAGQSLHGRLSRGRCMGRRLAEDQVGGLLADHDRRGVGIAGDQRRHDRRIGHPQALQAVHAQLVVDHRELVVAHLAGAHRMEHGAQVGADPGLDLAAAGNLRARYQLALEVTGEAAAGGQFADQLETLDQGIEVGRVAEEVGFDQRPVVRVRRVQADPPAALRVHHRDVQADPVAEGDQALRLVLQRGGDDQTQLRGLCLRVEAEEATGLDGVRGQRPAPAEQVLPGRAQQRQPALRREAQAVAELGLGAVHQHDVLVVLQVLADPRQLMALDDAVARQFRRRADAGEQQELRRVDRAGAEDHFAACLQLHDLASLADLHAGGAGTFQQHAQGQRRAEHGEVGPRQGRVQEGARRATAFAVDLGDVERADAFLALAVEVGVVRPAHFLGGLEEHLVDRARAALRGDVQFAAAPVPGRFARLEMFRAAKVGQQLVVAPATVAEGCPAVVVVAVAADVDHPVDRAGAAPDLAARAGDRLVGGAGLGGEAMHPVPLRVGDQADDPGRRADVGGGERRAVAGAGLDQADRDGGIGGKTVGQDATGGAGADHDVVERTAGSGSHVGTFLGVLPGLARRSFSPRAHGRDATPLDGEARPAACPSLPAGLTEAARRRATAPAASPCRPSVAGRRRNRLRSVRERRGCSSCPG

SEQ ID NO: 28207 - protein, 472 aa, Pseudomonas aeruginosa
PAPAGRRRYRVGKPSAIVPSGVGQGRVGIDQHLDLRLVAQQGLETVLDGLLQGHAAGHCAGQVEAAVGEQGDQLRVGVAVADAAEQAQFAVDQVEGVQPDLAHQAHQHQLATLAQAGQGGVEAGLAAGGLEGAVERAALAQARRRVAVAGVERPAGAELPGQGEALGTDVDRDDVLDSAQVGEHHQQQADRAEPEHRAALARRQAAAAQRVQGHGGRFEHGGLAEAHRVRQAVQHVGRHPRALGEAAVAHQADEAHRLAEVVAAFPAVAAFAAAVFRLHRDAVADAQSLHARAERGDHAAELMAEGQRRAATGQRVRLGLGNRVRAALVFVQVAAADAAVGDFQFDFAGPRRLVFQFAQAEVAGSVPAQCFHGWFPCRTEVGALRWRASTAGAVSRRNSERNAASRAPPQDIHMTMDRPKRSAAKPATVGARKPPTSSPRPMIRPRAVAMTPRETVSAGMVAMNRVKQPSPV

SEQ ID NO: 28208 - protein, 514 aa, Pseudomonas aeruginosa
RGARRLADRPRQVGGAARRLAPEALPEVREVHAAFDEKNKNARTCLARNPAGQHPGHSPGAAAGVLGGLQRFHPGWPEMFVVFPGRLRRDPGQPLPRTPAAGPHRRQRARGGARPLDDPRSAQGVDLRLSGAGQPVVLLPGQRLQPPATGRAGYLPDRQALPVRFFRTDAAVHLRHSPGRFRRALPARLQGTAEDRRGKPGAAPAGADPRRAYPGFPRQPPWRGCRALPGGSLRPAGEHHQRPCRRAPCQRPGRVLPAGGQAVHPAAPRRTRPELRAGGRRHWRLQPAPGAAVRPGRQLARALPAGAALGAGPPVARFAPGPAPGCRRGRLSPRLLQPGAFRPGLQGALRDDAERGAWPLDPTTVPFLLLLPRTRSVTDKKEQIARFIQREFPQTRVVVEAVGERSATVWQAVDASDLRPGGTVSGPTLMAIADVALYVAVLGEIGIVPLAVTTSLTINFLRRPAADRRVVAECRLMKVGKTLAMGEVSLFSEGDAEPVAHVVGTYSIPPAHRR

SEQ ID NO: 28209 - protein, 219 aa, Pseudomonas aeruginosa
TGDEIGVGQAHEASPWLFFGVRDRVPGSCRGSVIRRSARFPRWPARCRKAHGRSAPARRRRRVSRRSCISRRGRRREAPGPVPRGLRGCSGGFRRAGSGRCGATPGGRRRCRRTRTPALLERRSVRSAGVPRSRSRRRGWPASTRRVRSSRVLRRHLGRRSARYCRVGRLRRCNAAASVRHRASSVRRGRLRAGVRGPHTVGASPCPAPGTSEPSRESG

SEQ ID NO: 28210 - protein, 308 aa, Pseudomonas aeruginosa
RSSSAGLSPQRWTAGLPASVAVANVSVEAWTGPALPHPLQQEQRCVPATMISFWNAPPGSPSADLRPFVELACALGGEGFPAALLETLGHWVAARHFNVLRIGAPRPELLLAGTRHRDAQLVWRCWQAYSRYYHSHDPLFLRMQRQRRGPVPLLGHLLAEDIEFDAYREAIYRDNGLSERLSSLHWDEEGRPLLFNLYRHREDGYFSEREIAAFEQWVPALLQLLRGHLALRRGRSATDEWRLALLHRATDLTPQELAVCLHLLRGLSHAGIAAELGLKESTVKTYRNRAFARLDIHFRSQLFALVQG

SEQ ID NO: 28211 - protein, 159 aa, Pseudomonas aeruginosa
PPDATRASLADAVEHVDVVRVVQVRHGPAVLVVVAHALLDHAEHALHRPAADRLAQGLHADLVLAAGVVDLVQLVAAAELAADGVPEQLEDLDPLPVAHAAGAAAIGGEVLVELRIVQVANAGGQVDQAAGDHLLDGLLDLRVGLRRQHAVGLQGLGAG

SEQ ID NO: 28212 - protein, 399 aa, Pseudomonas aeruginosa
EGAAVPFAGVAVHGVGQRPEQVAPGHHFADLRLHAAELQGAGALQGLVEGAGDEVELDRQAGAALHREQPAEATLGEPLLAALEVAVDQYVLPGDEHLVHHQDRVVLVETAGQRVVERRSGDTRHQFVGGAADQLHAGGVHRRDEHQGEVGVVAEQLRRTLADEVVVGQRGIRGNHLGAADDDAAVDFLVHRDEHVLDLVHRLVAVDRRVDDGMVEVQAGFLDALVPGFRVVLETPVEARVGAEGAAEGGLVFRGAAHPAVGQPRPLGDGVALLAQFVGAARVAEELVGIAAVAGIGLPAELFLALRIVQGVVEPGHGGGRVAEGGVAGDVLDAVAVHVDLTVVAQAGEVLLAGERTGGRGTEIFGFHHRLQSLLLSARERLEGMMGRGRSELNGFSGE

SEQ ID NO: 28213 - protein, 151 aa, Pseudomonas aeruginosa
PRPCSPHSARAQGSPCAGRSPRRSPGRARPRCGAGREGRPGSAGSSFSGSPPGSVPGCLRPVPRGRTGERQRRCAGGCPTGRSAPGSRSPLVSRRRARSGRRPAVRPCLRPGGSPPGRPGRGWRYASPAEPWRLRRRSIRRWPGRCPGRRR

SEQ ID NO: 28214 - protein, 429 aa, Pseudomonas aeruginosa
PVRRGSPSASRWALQQFAQAIAEQAVVQFDVLCAGRRAGQRHVVEWRQEHAAVEQVEVQAGLDQAVACVVGLAAVARGVGHEQVLDARADARHVPGQAQFLERRADARLELRGELEHVPIGVLRHHFGEGRAHRRQLQRVAGQGAAKAEMVDRLPRSEVRQYRPDPLRLRLAASPDGAGNAAGDAFAEDEEVRLEAMRAAIAGGTAGDGVGLVDDQRHVVAAGQFAQAGVEAFGRRDHADVGHEGFGEHRGDVAMGEGGLQRVEVVELHQAGGGVVAYAIGVNARARNHAPGGVEFHLRFVDAAVVVAVEHHHLVTSAEHPAQAQDETVGVGGRGGHLPIGQAEAPRQFGADPQAVLGRQHQGRAAPRLAGDGVGHRRLGVAEHGAAIAEGEVDVLLAVDVGDARALGLLHQQRAVARPLLHPVQRCAV

SEQ ID NO: 28215 - protein, 162 aa, Pseudomonas aeruginosa
PGRRRPGREHRRNSRRRPRWPLRHRPAGWTHRRGGSSSTRRCWPWGRADARSIRRVSSAATSSSQAAIASTCCSTADGVASRKSSCAASRGGKARSSATTGACWSGRASTWRRARVARTVPRLAILCPKVCTATRSSAMCRGPGSSSISPSSRSMSRCPAIT

SEQ ID NO: 28216 - protein, 320 aa, Pseudomonas aeruginosa
ENHSAVDRHRLLRFYTVWAEDDRQGGQRAETDPRYAVLQHVDARAEHRRDPQQQGDEGQDVVVIVEQHLQAHRQRTAEQRTEGADAPGEVHALPVHGKQHQDRGDLRRQRVLQVEGLEDHEGQGRHRGPEQRLVAPAGGVLGRRLARRPRFDVGEQVEHQHGDGHRQPGGDHVAGEHVEQIDVRIAGKVQQHREEHRTQCAEEEQRAARHQGEAVDEEAEDDRRHQQRPVAEQPVQHQYLDADHHRVGEELADDVQVDHRRQAEQQHRVDAEERAVVPVHQLADEEPQGAAAGDAQALTQVVGGHRELGRHGVSRRSAAG

SEQ ID NO: 28217 - protein, 94 aa, Pseudomonas aeruginosa
CSWDRVFMSTRQNPSASPCRALARARTISVLPTPVGPRNSALNSGRRGSAMSARTTLSMSSTACSAGSWPSTSARRQSITAAGSKRKRLCRALR

SEQ ID NO: 28218 - protein, 242 aa, Pseudomonas aeruginosa
VPDIFGVPERGRTSNLPLRRGMLYPIELPGHAGHGERCAASGRHVNGRESVCHATATKAAHNFPQPWRCSMNQTVAIPAAQDLPDAPRQPRIPDSPFASFDVRIASEHDAPRLSLLLQQLGSADSRPDPALLAIQLQRPRGDRVTLVAERGERLLGTCTLHLIEHLAHDFARSAILEDMVVDRHARGQGVGRELIGRAVERARSWGCYKLALSSHQDRETAQRFYAALGFTSHGVSLALHLG

SEQ ID NO: 28219 - protein, 130 aa, Pseudomonas aeruginosa
FIDLKGFFIEKSWHNRCYKTLRIKPWPSAWQSYEMEVNMSSSRNLVGTGLLSLLALVVFQNSALGDEDRTQERNGERPVVLDSNATPQWAPAAQQLVIQAPDESPRIVTVGEDERGTALVTAADEQAWTF

SEQ ID NO: 28220 - protein, 180 aa, Pseudomonas aeruginosa
RVVEITGVVQLEQRALQAGGELGVTRQARLDFLGAFPAARQQALAQHLGFHPEQDREQIRIAPAGLRQVAARAVHQHVVALRQPLVDLHRNAIAKAVGAPAHGERRGPLEGVELRRSHRLGVLPHRFRGARDHPPHDTAAAQRQGLARGLQQAVLARAGRPHQINQSACHQNTLCPPRQT

SEQ ID NO: 28221 - protein, 135 aa, Pseudomonas aeruginosa
YSRYFSSLANWRWPGAWSITETSCTSGCSTSSRNTSSVCGWLTSQRRCRRWSARASPLAAASPMASSIFGNCCMRLPLGLTSPMDSASNTVVIPAATICASCASTAEADGQSTPGRGVMCFSRLSVCSSTRPGSR

SEQ ID NO: 28222 - protein, 324 aa, Pseudomonas aeruginosa
SPPRSSAPARWLRPSSTAAIRPSRSSTLPTKTRSALTTRALLRTRSDDMGLLLAGKLLAHVQVAAGHRLAGGAVVEDADQRGASGLGFADQLQHYLAVGFVEGRGRLVEQQDRPLDHEAAGNVDALLLAAGKGTRRQLPEAFRDVQPGQQAARPQFGAVAAPATGQGRLHDHVEGRHPRDHPQELADVAEGLATHGEHLARLGADQFQPVAGVAQADAAAGRQVVAVERAQQGALAGAGASVEHQAFAAGDIEVEPAQHIEHYALLLVQGEGLAEVADLDQVVHRYFSGRPSRGPAPTLRLRVAGPTTPAIACTDAAGRRESGR

SEQ ID NO: 28223 - protein, 511 aa, Pseudomonas aeruginosa
TPGVAPRPGCGRSADAAACRRKRFAAGRRCAADRSPPVPASPARPGAADRSGARPGPSAVRRCWRRRTRPCAGRRAGSARRSPTRCAAGCAARLRWRRRGPASGRRRRGRRPCRRPADSARRATRAGSTCPSRTHRRCPAPRRGRDRSRPPGSPFPARTGGSGHAPRAAAGRARRGSHRWIRRPRSLRVLPFFLAGTPLRAVIGVGTDEALAATVVDDQFVQVGLVAAAEGAAFFPALDFEGVVLEVQARHPGERRHRVQALLATGAEQHQRRVHVQLGVVELGNRRGIHHVALVHRHRVGIAGGDVAEGGDVLVELHVHHPIVVERMHGPGLRLGRLDEAQRLGDRHLVDHDLLAAQGGFRYPVAGLDHRRLRGPFGGGDPGGAGEETPDGYRVGGVVGALVDHLEHVVGTEDGRGHLHAAGAPAVGQRHLAAAEGHLVAGDRHRLEQAAADHALGLLVEVGEVVALLRRGAGLRGKAHARFSWTVGCADSATPGRRSLRISSSSDWKST

SEQ ID NO: 28224 - protein, 504 aa, Pseudomonas aeruginosa
APRGNSAGHPGPGPGTPVAIARRYPPGWEAKRWSSIFSSDQGEELHLGSGDFRILGGAALGMGAGQRFDQARLPGRRVGALQVRVGQGGQFGVALVAPGDIAVAGASVTEPHHAAGHGHLAEVERAAGAAHASAHQGHAGLGGAQQVIVGIAQGVRMGVQLLATGAGEHAHPALSCGDGGIGMQGGHGLLLGGDLVLEAIGAADRLGQFHRLAGTVAGQGEDGEQRRMAGHQQARRLLAVGQARTDQAVGAGQRQAFVGQVATQRTALVVGEQLAAGNGEAMADQAHWLAVEVTQGGQFQHPPALADPQVGGIGGAGRALARLQQPGLDPVALGRERLGVGVGGAHRVDRRRLQDLGALALAPQHAAFEHQFVERPAQGMAVHREALGQLDLAGQVVAGAVGQQFLAQPFGQFAVQRFALSRQVHGLERAHQAPSSRRQMNSLRRRCDRTSIRLTTTMITISTAQVWPNWKPRMASQRITPMPPAPTIPTTVAERTLDSKRYSE

SEQ ID NO: 28225 - protein, 477 aa, Pseudomonas aeruginosa
SFQLPKSGGKKSAAKVAMLPASRNSTAGFISAPFQDQARMARNRPQPTRRPQDGLPVAAAAAVVLRVLISGISTAVLANRVGRGAGRARGGSAGVGGGFLLALGHAFLQLGQLLVEGLQLGGLLLGAEVGVVRHVGALLEQLELADRQQLVVVGGLELRPLQVGEDLLLLGVGAVLEEEVAQLVLLLVAQVVAPHQRVARDQRRLPDHLELPGLLRLGQFQALHALGIEGGDVDLLVGHRQGVDLMAGVEGALESLDRVDVVLGEHVVAGHQVAGRGVRIAVAEGQALGVRQHVLEAVDLAVLVGDQQAPVARRATGGDGLGEDLAVGAIHRFHGGLVAVPGDVDLVETHALDDPGVVGGEEGLHLVAGLLAHVLEEGFPDALEVLRRLGGDDPEIDHRLVGVRHPGKGAGEQGGSREHTTEAFQHGENSWAGFGGFLCGSNDVRRARGSVPAGSPPRAGNGRKTAAGCPLRRRRVR

SEQ ID NO: 28226 - protein, 65 aa, Pseudomonas aeruginosa
SPRVFSKPAPASSSAHVTQRPAPTPPHTSRPTAIARRSLPTFPAKPVPGAWRRRSANSARGWISW

SEQ ID NO: 28227 - protein, 242 aa, Pseudomonas aeruginosa
HDAPDRSPRPAMTHSVSPIGYIRSCFMEKFAIPRQPLLAPAARGTLELLPPFDQVEALEGLEQVSHVWLLFLFHQALEDKPRLKVRPPRLGGNRSLGVFATRATHRPNGIGQSVVRLEGFEAGRLWLSGIDLLDGTPVLDIKPYVPYADAVADARNGIADAPPPGIAVEWSEQARRQAHEHGQRLRQPVAELIEQCLAQDPRPAYQKPEPGRRYGVRLWDLDVHWHYPRPDLIRVLDVASGD

SEQ ID NO: 28228 - protein, 219 aa, Pseudomonas aeruginosa
NYCIQKRKQTHVRPPCPPLPPQRPASPRPAGAQPGRMRALLCRRTGHGSAEPRQRRPGVSHLRQRQPFPWPRPRCQQRPADHGSLRLRRRQRGGTGGLVPLPESAGRDPARPTLRPRRRRAQLPPARPGGQQGAAAVPSSGIRATPGLSLGQPSPLSLKGEGRLGTLSASNLACSSSPLLDFHQARSAPAPPSIRQRKRFHRQAQTPPQRGVPFFAGSQ

SEQ ID NO: 28229 - protein, 718 aa, Pseudomonas aeruginosa
MEPMRALRFSAGSWRCVFAWMLLLVGLAAQGAELSELERLRIAQVFPAVERIGDPEGDYGVRRLSKGEETLGYAFQTLSVTDIPAYSGKPINLQVILDPQAVIRDAYVLEHHEPILLIGIPEEKLHAFSARYDGVRADQRVVVGRSSDPQAVTVDAVSGATVTVMVVNEIVMRAAHTVAVSLGLIEDRGNVRPKPAQVRQQPAATASWSELLGNGAIRRLQLSRGQIDDAFKGSEAEGIGEADAAHRDEPFIDLYSALLNPPAVGRSLLGDNQYRELMASLKPGEYAFVVLGDGEYSFKGSGYVRGGIFDRVQLRQFGDIISFRDLDYQRLSDVYAEGMPEFREMAIFVARASQRFDPGSPWTLELLVRRQTGPVAGVFTSFELACQTPEEYLERPQPTAEELAALEEAARPLWLRVWYQKSFQVGVLCTALVLLLAILFLQDRLVRRPRLMQRLRTGYLAFTLVYLGWYSLGQLSVVNVLTFVHALFEGFRWELFLSDPLLFILWTFTAASLLLWGRGVFCGWLCPFGALQELLNELARKLRVPQFQVPFAVHERLWAIKYIILLVLFGLSLESLALAEQAAEVEPFKTTITLGFDRQWWFVAYAVALLVVNLFTRKVYCRYLCPLGAALAIPAKARLFDWLKRRAECGRPCQLCARECEIQAIHPDGRIEANECHYCLDCQMTYHDQDKCPPLVNKRKKRAKSAPADNARIPAENL

SEQ ID NO: 28230 - protein, 611 aa, Pseudomonas aeruginosa
GRHEMSDDTKSPHEETHGLNRRGFLGASALTGAAALVGASALGSAVVGREARAAGKGERSKAEVAPGELDEYYGFWSGGHSGEVRVLGVPSMRELMRIPVFNVDSATGWGLTNESKRVLGDSARFLNGDCHHPHISMTDGKYDGKYLFINDKANSRVARIRLDVMKCDRIVTIPNVQAIHGLRLQKVPHTRYVFWQRRVHHPPSQRRLDLRPVRRQRLHPVQRHRRRDHGSGLAGDRRRQPRQHRHGLQRQVRRLHLLQLGEGRRPRRHDAQRARLGGGVRHPAHRGRDQGQALRHPRRLEGAGGRRPAQGRQGQPGDPLHPGTEEPPRAEHLAGRQVLHRQRQALADLHHDRHRAPRRPVRRQAGRPARRGGGRAGTGPRPAAHHLRWPRQRLYHAVHRQPVGEVEPGRRGARLQGREGRLHPPETRRAVPAGAQPRHPVRDQRSRRQVDRGAQQVLQGPLPAHRSAAPGERPVDRHFRRGNEAGPRRPDLRRTARLHPRPPRPDQDPQDLGPQGPVLRRDGQARGKGRHRPDEGQQGHPRGQQGPRLHGLDGALLRPHRVQGEAGRRSHRDHHQPRRDRGRDPRLRHGQPRRLHGDQPATDLVDHLRRR

SEQ ID NO: 28231 - protein, 456 aa, Pseudomonas aeruginosa
ARGALVLLQLVLPRPAHGNVRADAGGKGLIHAARSLAGRRAGPLLALLLLGLATARAEPVDGLPLRADGDGRWSLAAGRYAGNFVIDRPLHLRCEAGAELDGGGHGSLLTLTSPGITVEGCRLRNWGRNLTELDAAIFVGKAASGAVIRGNDLRGAGFGVWLDATVGAQVLDNRIEGDESVRSQDRGNGIHLYAVKDALVRGNRVSHTRDGVYIDTSNDSSIEANRFEELRYGVHYMFTHNSRVTDNLTRRTRTGYALMQSRKLTVTGNRSIDDENYGILMNYITYSTLAGNRVEGVRSGSTGDAMISGAEGKALFIYNSLFNRIEGNSFADSALGIHLTAGSEDNRIAGNAFIGNRQQVKYVASREQEWSADGRGNYWSDYLGWDRDDDGLGDVAYEPNDNVDRLIWLYPQVRLLLNSPSIELLRWVQRAFPVVRSPGVRDSHPLMRMPAAEPRP

SEQ ID NO: 28232 - protein, 554 aa, Pseudomonas aeruginosa
KPTRRACASASAWPRRCSANRACCCSTNRRWASTRWPPSSSTNCSTACAARAPGSSFAPMCCPASRRTSTAPRFSPAAACKWPAASPNCAARRLCRPACAWPARITRSGSNAGTGPAWRRGDWTTSASRYCWTMPSATACWKRCWPRASSTWKSCRRRWRTSIATTCPPPPPEPRHARSLDHRPQGTGRRPAQSLAAGDQPAVRPALGGHRLVRRRRGRPGRLHLGAGDGRQPDQPGHLPDAADRPAAGLRRHRRRGGRRHPAAAPDLPAGARPVAARQVPRSRPDPRPGHPDRLRQRGAGDPRAGAGGRGGHPAGRLRPLHGFLAAARLRVPRPGLRPEQPRQREIQRRRAGARPVVLLRPAVRPGPAGDPGPQPGSPEPAAAALAVAAQPDRPLPADQPVRLRRSRRRRGGSPGQRPAGVRQRPLAGPGPLGRRCPGAGPRPVPPPPHLTHEVPPCNVIPSPCALCSARSCSACCWPAAMRRGTTPRHSARCRSPAATNATSAACSSRKCPVPRASRCFPARCASSAPPPNCSAGGCNRKTARARRACMSTT

SEQ ID NO: 28233 - protein, 385 aa, Pseudomonas aeruginosa
STPPAPTTWSASSGRAAWAPPSPRSPTKRPRRAWRPRKAAGYCASTRSTRRCCKAWAATTRTGTRRTERGPESRKPLPRIRQGLSSPGATRRGGGLLLDEGALDQVVARLAHARRDLQAEAVEHGAGLFQHARAAADHRTVVLRIHRRQADVLEQLAAAHQVGLAALVAERLAGHQRVVDQLLFHLVAEVLVFRQDLGDEVGVGQFADPAHAVDQDHLLVALVGFRVLDHAEEGRHAGAGAEQVEVLAGQQVVVHQGAGRLAADHQLVAFLQVLQARGQRAVRDLDAEELQVLFVVRAGNAVGAHQRTTVDFQADHHELASLEAQTRVAGGLEAEQGVVPVVHAENALGVQIAHQRLLGKRGRTPTAADVTQLRGILSVAKISAK

SEQ ID NO: 28234 - protein, 353 aa, Pseudomonas aeruginosa
HDIGRPPAAEGSHRSRGRGARITEPTPPTERQNVAGPFALDEEAWMKFTLRQLEVFVAVAQQESVSRAAEGLSLSQSATSTSLGELERQFDCKLFDRAGKRLTLNALGRQLLPQAVALLDRGEEIENLLNGKTAFGSLDLGATLTIGNYLATLLIGAFMQRQPDCRVRLHVHNTAQVVQQVAHYELDLGLIEGDCRHPDIEVQPWMEDELVVFCAPQHPLARRGGADLERLTREAWILREQGSGTRLTFDQAMRHHPRPLNIRLELEHTEAIKRAVESGLGIGCISRLALRDAFRRGSLVPVETPGLDLRRQFYFIWHKQKYQTATMREFLDLCRSETAGISRSDEIVLPLIP

SEQ ID NO: 28235 - protein, 128 aa, Pseudomonas aeruginosa
TSARRRRVQPGGDKELSGRHPVPTSTTAFRWSAMTDSSPFQLLTEAFQAEYRVNLSLERPDGSIVLTLSNERGVAAKRLIRPAQLHDLEQLQRMIESIRFGIAIENGTSAPQLLQAMTQGKARWPIAI

SEQ ID NO: 28236 - protein, 535 aa, Pseudomonas aeruginosa
RWSRCAPCCSRSAGSAAGRHGRWRGFRCQRGARGAPPGRSGRGAPPVGRRPAGPAPGPKRPKAARRTAGRLAGDSFFPQRQVGTVGQRLEQVVQQRALAAANEGLHRHPRADLQAGQATYALLAYADAHPVVRRLAALVQQAVGRDQGHFALHPRRSALVEGAEHQLHRQADADLVDHLHRQPSVHQQRLALREDFHQLLAGRDHAALGEHFLADHQAGDRRPYLAVGQVEARAGQAIAQLLGAHLGVGQAGAHLFLELLPPLGHAQAQFEDLPAGTAEAAEVAGDLAVDLGQQALAVEQAVARHVALAGQLAQAAQLFLEGGALLLLAAQRGLQAVQLRLAAGDRLGETIEFQAQRPPTAVVQLPLLFQQGRQARVVQRQQLGGKLDPRLFIALGAQPRQTRQRRQVLGEQAIGLGPGLGSVHLQQHLSCLHPLAFVHADVPDQAAGRVLHGLAATGHHHRAGDPDTLVQRGQPGPQEKADEAEQHQPPAEPGKTLLVQFQRRAAGADFAQPRLPAHRAAPPGTPPTGIPGPGR

SEQ ID NO: 28237 - protein, 104 aa, Pseudomonas aeruginosa
PMCGPSAAALQCRRSAPSRRTAPDSGCQAPTSKRARVDLPEPDGPITPSASPGSRAKPRSCNNACSRPGAAAQSRSTRNAPRGAGSGMPRAAGGFSSSSRASRW

SEQ ID NO: 28238 - protein, 158 aa, Pseudomonas aeruginosa
ACRAPLHWRQTAINWSMGLSTRPIRIEPAIIIPGVIRPSTASQAPRPSTSDCRARRTPLEVAPIAALRSLPRFCRARKAWCWANQRARMAGNMPIAARVSAWRRLAEACWVARIDSCPASASGSRERLSLTQASSTSSSAPTRASRPSQGLKRKITSR

SEQ ID NO: 28239 - protein, 273 aa, Pseudomonas aeruginosa
SRSLRQDAGAGGNAGRGAAEGGAVAEGGTGGRTRHLHGEEPRRLRPRLQEPAGRPQRTVRGKRRGRMSRRCKQSARSRNMPRQLAGLLCVLLGLAGAPALACPFRATDAETPAASAGAAQVLALGGTGRLQLDLQRAPATLLHSGDLLIARYAEGHYLAHRLLEGNEMGADEGERLDLPRQVRLLFGALPLDGLPDAERERLQAQRQALGLCDRRASVSRYRVAGTEVYRLRGSQAGKPYHALYLLDGPQVHYLDSSGSDAFVEQLLASLRRR

SEQ ID NO: 28240 - protein, 163 aa, Pseudomonas aeruginosa
VRAALVRPAPGLPETGACRTTPGSPIDQEGPMPALPASPVRSRRWRLDRRSLLLALLLFGLLVLLATLGRHWGWIRSFGGDLLALVWLYYLMGSALRAPAAWLASAAFAVGALLELGQYLAAQLHWQFSSPVLRIVLGSTADGFDLLAYALGALLAWWLERRR

SEQ ID NO: 28241 - protein, 172 aa, Pseudomonas aeruginosa
MKPMNWISITGFRPWAAMPMDSPAIMFSASGVSSTRLKPKRSRRPRVARNTPPLTPTSSPSTTTVSSSAMARCNARLTASRTARRVASPLRSFMFGPSPPPRGALPELLALLLQDRRAARVDMLEQCLRRLPRLTSRNAPPTPAPAPGTPPPARARAPRPTGRGRRGRRAGA

SEQ ID NO: 28242 - protein, 504 aa, Pseudomonas aeruginosa
LLLVVRAGLLPPGTFSIGRRRRNARKADDQAAALAEPGTGRSFGGRLQPWGPPARNRPRRAPNGPSAAIQAHQEESHGPASSLPRLSRPGTASAVRGGPVDRRGAPPGVFARPHPARTRRTRPADRRQPGRPRLGQRARPGVAAANERTGFLRGRRLPPATALGPAPAGVAAAPGTAVVAGAGGHGTGAAAGHSAGRSELPGTLPAARAAGRPSARPGHRTAPLSHRLPRTAAAPAGAEERTAGRLPEAGLSRGNPPASVAQPATTAQRRRRAAGRAEGCPAGDRTRPGGRRRPRGPRRPLSATGLPAGGTLRPGTRALAQRRSHRATAPRPAPGRTRPADRPRPALRPLRGSRPRALARATAWVRRATPSLPLIRRAWVFTVCREMNSCSPISWLEQPWAIRPSTASSRQLSGLSPSSSSPGRAANSCGWRSRSRRCGSCRPSRSASSRPLRRVCWAWGNCPERNWHSAIPMRTSQSSVCRPCASRMASSPRSRASAAAASPL

SEQ ID NO: 28243 - protein, 168 aa, Pseudomonas aeruginosa
RWFASASRGKPRANRSSSPWGSSSNSRRNSSGPTCGSQARARAASASGGGSSSSNSCWRYSCNNGPAVSSPTSRRKRNAAHQPPLRSSSAPVAAASALRPCRRSSSATSSASNASRPPSTSSNSPSSSNRARLHCGRRRLASHQPTRGEAALNKQSRQASKAGSGCRG

SEQ ID NO: 28244 - protein, 230 aa, Pseudomonas aeruginosa
GRRNSTSSCASPAATGRSIRRTAPPSSRPGSRAAWPARWSAWACGCSRRAGCCTGNAACCAPSAANYAPNGSCRRWKAMPPACRRWATTSCRCRVCWWPPSRCRRRSGRRSAWSAARPSANSAARSPMASAPPTTAWPSARGAATASAASCAATSASTTRKSACVATCSANSSRCSRTPGSATPGAATSAWPGASARTCCSTAPVASPSPAATAAKGSAPATSAAAPWPR

SEQ ID NO: 28245 - protein, 128 aa, Pseudomonas aeruginosa
CAENPLHLPQRKNRMALTLLKNTAGADLGAASPVAVPLGEPVAQTRAYAVERTDQVETGIWECTPGRWRRQIVEQEFCHFLQGRCTFTPDGGETIRIEAGDALLLPENSLGVWDVQETVRKSYVIIHR

SEQ ID NO: 28246 - protein, 160 aa, Pseudomonas aeruginosa
PGRPAPGPGPAPRSCRWPPRCRRTSRPAAPASGASAARAAARSGWRRPPSPDRAAPPANWCRGRSRRSGYGWESPGRRAAPGRTRWATASTTSPGGTAGGSGGSRRRSPPTRTGLAYRDSWRALQRHIHSTDTAVTSITSRVLSMITRRMRQPSLRSSAP

SEQ ID NO: 28247 - protein, 367 aa, Pseudomonas aeruginosa
EPFQNGIPSTPQLRRSGPPGQLHPGGSGPPRQPVDHQQAGRPTGAEPWRAGIGTQRAARAPDRRRRRGVSPRRGDAAAAPRPAQRIGRPQPAQPRRTAPGPAVARCRRAVRPTLRRIPAALSEHRRAPGGGRQQDHGAGGAGRRAGIGRQPHPGRRRLRLPAVLQRTAGRAAAGRASQGRCRQRRPRRTGGQPVPALPAELHPQRPPAARLPGGRLQPARRRPQRPGRLPRRAGGGQPGSGAATTSDRSRDRTPGSGAGPAQGAGPALGHRLHLAPWRLPVAGGAGLAGAAARAAAGGKPGVGRITASSAEATADNAWGRYSPYRLLPPRVGRITATRLSATSAGVSADDAWGVIRPTACSLPVQGE

SEQ ID NO: 28248 - protein, 349 aa, Pseudomonas aeruginosa
QHHSLVGRHQRAEEVGLAAAAAFARAEAGLQAGAQQAVVEGEALLVEQERAVRQFAEGDAGGSGLGMPGRQQHVQRFVAERLVVEAVVCRGEAAGQFQLAGQHRLLHGLAAALHQVHGDVRIAPPVFGEALGEQRVGTEQRQAQAQFAAVELAEVVQFAEQVAAQPQHLLGAAKHHGAGVGQAHVRPVAFQYLHAKALLQLGDLLADGRLAGVADLSRLGEAALADHFDEAAELTEFHSGMALMRTIRFGDDRPGLILSPSPISQPRPFPCCPRSSAVCPALPPNWRYSSPSGGPAAGWRRPSACRCRAGWSAWRHCCCCSPAACCVRPGCRPAPACCWRRCCCSSSRR

SEQ ID NO: 28249 - protein, 245 aa, Pseudomonas aeruginosa
CWSPRCRWSGCAAGGRAMSLDKQALFWLAATVGGYLLSRQLYRRVKWYWLSPIVFVPVLLYALAIPTHTRYADYARDTNWLVALLGPATVAFAIPIWQQRELLMRHWPALLAGMFAGTAVAIGSSWALAQALALDGQVTLSLLPRSITTPFAMEMSHDLGGVPELTAAFVMITGVFGAVIGGTLLRVLRLRTPLARGALFGVGAHGAGTSRAYEFGGEEGSAAGLLMVLTGLFNLLVAPLVAHCL

SEQ ID NO: 28250 - protein, 249 aa, Pseudomonas aeruginosa
CAARPAWAASSPGRRCCASSTSRTRATASDRGAARHSPGGLAEARPHSGFQGLPDPLLGSRAGSAVAADPRFSQRRLGLALPLGAAGAALPRAGLRPARLRRFGQAARPSLQPAGAGRPATGAARPPGNRRAAARAGPRLRRQRRPGTARPPSRRPAAARLLRVPQWWAVPGNAPPGAQPEAVAEPVGRAVRPAVRPPRPGAQLRQGFRPAQPARRDRAGCLLEPDRKQPGAAGDASPDPLHRRPPRAA

SEQ ID NO: 28251 - protein, 135 aa, Pseudomonas aeruginosa
FRVFLSEFEIAASAIAQGSGLGCWRLAGRGVSSPMEVSMHDPVSPLRVFDEGSWLFRQLVQAQPFIRQSGMVLAELGLLLALGLGYLCWQEGSRWYAVGAGLALLGSLLLVVVRHNYDWWLFKLGPRGRLYIPFD

SEQ ID NO: 28252 - protein, 281 aa, Pseudomonas aeruginosa
GEDRLTPVFCHPAGVFFRFFRRESVMSVIVERNGPVTTLVIARPERRNAVDRPTAQALADALREFEADDTARVAVLTGSGGNFCAGADLAAVAEDGERRNRLEAEGDGPMGPSRMQLGKPLIAAIEGYAVAGGLELALLADLRVMAEDAICGVFCRRFGVPLIDGGSVRLPRIVGQGRALDLILTGRPVKADEALQIGLANRVVPSGSARAEAEELAAELAAFPQTCMLADRASVYAQWELSFDVALANEFQGGLAVIESGETLEGAQRFKDGEGRHGRFE

SEQ ID NO: 28253 - protein, 613 aa, Pseudomonas aeruginosa
GVPTSTLSGEPHDNNKKARNLPSARTRCGHSPGLRHPGLGRVIQHRGDRRAIRLVAVGGGQLVHAFRRQGLHRHPQRRPRLVADLRRRPAELQEGRNLLEDLQGHPRSRTQVRRHRRVLPWQVLVRLRAEGRTPPALRHRRPQSQGGRQVLRGAAARCLPLPQLQHRRPARQRAGRQAGGELGREHVHPELDQQYQPDGRRRVPPARRGDQGRPDPGEHALPVPGHQRRADRRRLLPVGVGPDGDRQLRHLLLYHRRGRRWLRADGLRRQRLRPEPGQRLPLPAARRRSRCPRQRPVGPGPALVRGGAERHRVRPVRDELPQSQPVLQRDRRQRPGHLRPGHRALHRLLLHRLSRGHPPLRPELPDQHRQHLGGRRAELPAEHAATNQQHRHVDRRDLPDHPVRQPDLRQRLRHPARRRGDQRLRAQAGDPGTGDRHPVLRPGTGGRPPDRGRRSRLQPPQRGRRRRPALRSRRHLWHRRTAEQRLVHRRAQRGQPAGVQQPRLLHPQLVGLSPARDPRISQRVRRGQPEAEPGLVARRRGIRAELQRGRQGRQRRPRCRIPEHVYRQHQLHRLLRRQLQPDQRPRLPRGELRGELLRSAAPRGGRFRGYEQG

SEQ ID NO: 28254 - protein, 458 aa, Pseudomonas aeruginosa
RRMKTARLLSSGALALSLLAGSVTAAVSPDEAAKLGSSLTPIGAQKEGNADGSIPAWTGGLAASAGKVDGKGFLSDPFADEKPLFTITAQNVEQYKDKLSDGQLAMFKRYPETYRIPVYKTHRTVALPAEIDEAVRQSALNVQPINDGNGLSNFEKSRYYAFPIPKNGVEVLWNHITRYRGGNLKRTIVQATPQTNGSFTPIRFEESVAFPQNMPDLDQSKAANILTFFKQQVTAPARLAGNVLLVHETLDQVKEPRLAWVYNAGQRRVRRAPQVAYDGPGTAADGLRTSDNFDMFSGAPDRYDWKLVGKLEMYIPYNAYKLNDPTLKYGDIIKAGHINQDLTRYELHRVWEVVGTVKPGERHIYAKRHMYIDEDSWQIALVDHYDGRGQLWRVGEGHAQYHYDQKVAGYTLEALYDVIAGRYLALGMNNEEKRGYEFGFKASSADYTPAALRNAGVR

SEQ ID NO: 28255 - protein, 337 aa, Pseudomonas aeruginosa
WTRPGSTVSTSPKTRPRDSRPLSPSTARDSARRWVVVATCLTPTTKPPSATPIRLAQGMSYKAALAGLEQGGGKAVIIRPPHLDNRGALFEAFGRFIESLGGGYITAVDSGTSSADMDCIAQQTRHVTSTTQAGDPSPHTALGVFAGIRASAQARLGSDDLEGLRVAVQGLGHVGYALAEQLAAVGAELLVCDLDPGRVQLAVEQLGAHPLAPEALLSTPCDILAPCGLGGVLTSQSVSQLRCAAVAGAANNQLERPEVADELEARGILYAPDYVINSGGLIYVALKHRGADPHSITAHLARIPARLTEIYAHAQADHQSPARIADRLAERILYGPQ

SEQ ID NO: 28256 - protein, 376 aa, Pseudomonas aeruginosa
AARLPGVRRRFAMVHNRIDPPFTRYLDSDGRPLGELPAWAGDSDALVGLYRQMLLTRLFDQKAVALQRTGRIGTYAPTLGQEAIGVAIGSQMRAEDVLVPYYRDTAVQLMRGVRMEDILLYWGGDERGSDYAEPLAAQDFPICVPIATQALHACGVASAFRIRGEHRVAVTTCGDGATSKGDFLEALNVAGAWQLPVLFVVNNNQWAISVPRRIQCGAPTLAENAVGAGFPGEQVDGNDVLAVAERVRAALERARHGKGPTLLECISYRLCDHTTADNASRYRSPEEVNQAWREEPIKRLRAFLAGRGQWDEEREHALVGECQARVQESVERFETLAGAGAAGIVRACLRALPGGPGGAARAILGAPRAAAGRGRT

SEQ ID NO: 28257 - protein, 313 aa, Pseudomonas aeruginosa
SSMRRRRVAASAGKSPRASTSVSCSTCGRRSSGSPRPISRRRCTAWKRCTCPPWRTSWRPATPCSATPEPRGDDHEALQAARPGRGPAGSGNRRMARQGRRQRARRPAPGFGGNRQGAGGHPCALRWGGGQAVAAPEGDILATSAEPLVGFEAEEADRRYLGWGAWRAGGNPLGDRLFIGAAPSTRRTPGHRPADPGRCAQFARPAGRRTGRHERLRPGWRDHHLGRGGRRLGRPRMLWRRALARGTAEHGAEHGALACRGGAGDDLRRRRPASLEDRTRPVDPPGPGAGRGLSRRADPQRLVRWRLVVAETA

SEQ ID NO: 28258 - protein, 151 aa, Pseudomonas aeruginosa
ARCPSGSRARPTPAGRRRSCVSSPNAGPGWRAGPAGRTAAVPAAGCAGPGASVGSGRGRRGERAWDLPGRWGCRALYGKRQFPASRARVGQAPRGLSGVAGWRAVVRRRRRCRSCRGSAPGDRRAGRARGRACRPGCRAGDRPRCRPRGSG

SEQ ID NO: 28259 - protein, 182 aa, Pseudomonas aeruginosa
KICCCPSERTWVDAPLAEQDLKALFLRHARQLQSYLLRKTRDPHLAADLAQESFLRLAEQRHKEPIEHVDAYLYRTAHNLTIDHYRQERRRRTETRPNDDLAGFVADQPGPEESAVDADALARLREIVAELPPRTREIFRLNRLEGLTHAEVARRLEISDSSVQKHLARALALVMLALYDSR

SEQ ID NO: 28260 - protein, 187 aa, Pseudomonas aeruginosa
PPAPGRAGAGATDLETAGIAGRTADDGSDAGCQRAAPRRGAAQGVARLGRGGGGAAGPGQRLERTRRRRDLAGRPLYRQGRGTHPAAGGWQRGRAGRTECHRCRLRQPRATGAPARRQRDLPRRPPRGAGDTALRGGKRRRQHSRAGYSVPGQPQRRRQRPGRGARTPRRGGPGASAHGDRRAPRAG

SEQ ID NO: 28261 - protein, 977 aa, Pseudomonas aeruginosa
AGSAQPGPGGGDAAVLIGPIASENLDHGPGSRPARLFRQGPGSVFSSRGSRRRKILSISVTDFPCLHRSLNETDSYYTKRWSVGAVMKHRGWSAVRGGRKGAQLALGLGLVLLGTAALPLHAQDGADSASQQQTALRRVRLDIPAQPVNRALLRFAEQAGVQVFFDSQRFAGLGSAAVHGEYVLADGLSQMLQGSPVEYRFSGKDQLSLIRVSQDDLVQMSPSVISAARPDDWVYQTPHSVSVIGREQIERNPPRHAADMLEETPGVYSSVSQQDPGLSVNIRGIQDYGRVNMSVDGMRQNYQQSGHQQRNGTLYVDPELLSEVVIDKGASSAMGGAGVIGGIANFRTVEARDLVRPGKQVGGRVRLTSGLGGDANGTHFIGSAAFAIGTEVWDMLVAASERHLGDYDPGTKGSIGELRTGAWFNPEAGQRVKHSPVAYSGYVMRSRLAKLGVALPQDQRLQFSYLTTQVSYDDANMLNTENQALWEKLGSSDVRAQNFAIDYGYAPDNPLVDFKAKLYYVDNRNRQQTLQRGITPGYSITYQTDTYGAQAQNTSTFALDDLSTLRANYGLEFFYDKVRPDSSQPRASTSAVGFPAAEGMTPKGDRALGSLFARLDYDYDDWLNLNAGLRYDRYRLRGDTGFNARTFILGTTRQTDMPLQYAVDREEGRFSPTFGLSVKPGVDWLQLFATYGKGWRPPAVTESLITGRPHGGGAENMYPNPFLSPERSKAWEVGFNVLKENLWFSDDRLGLKVAYFDTRVDDFIFMGMGMQPPGYGMAGIGNSAYVNNLDSTRFRGVEYQLDYDAGLAYGQLSYTHMIGSNDFCSKTAWLGGVTQTVKGSGRRPPVIDMRPDEQANAATHCSAVLGSAEHMPMDRGSLTLGMRFFDRRLDVGARARYSEGYSVAGGATVSQAGVYPADWKEYTVYDLYGSYRVSDELTLRLAMENVTDRAYLVPLGDVLAFTLGRGRTLQGTLEYQF

SEQ ID NO: 28262 - protein, 767 aa, Pseudomonas aeruginosa
KGADRVSRRAAGAGRPAPADPAGTAAAVARQPSAGAAPGTRWSRRDGRRQPGATGRPASRAAQQGAAARRPRGTVARPAPTGQRGLRAAQPPARQRAPAGPGQRRDRRRPRQPRQYPPADPRTAPAHGPAAGEVPGRGARQPGRRPGARRGVAQSPGQRALRPGQQRGTGAGRRPGGRPGSVHRGRRDRARPATDGNPPGAPAAAGGRSAAGGDGRQGPRRPAGGADVQRLQPEHYAAGGGRSDPGLGRPPAGRAQRGAVLPGAHPRRRGGRTSPGRPGDPPGDAGGGLRSQRRALAVELPVQAAGRPYPPGAGGRMNRLRACLLSSALLSASSAQALGLLDAYQLAVRHDPTFQAALHERRAGSENRAIGRAGLLPSLRYDYNKARNDSTVSQGDARVERDYRSYASTLSLEQPLFDYEAYARYRQGEAQALFADEQFRGRSQELAVRLFAAYSETLFAREQVVLAEAQRRALETQLAFNQRAFEEGEGTRTDLLETRARLSLTRAEEIAASDRAAAARRTLEAMLGQALEDRELAAPIERFPALRLQPATFEGWRQVALQRSAELGAQRHALEAAAYEVERNRAGHLPRLSLYASSSKTHSASESTYEQKYDTDSVGLRLSLPLFEGGRVSAATRQAGDKYAQAQAELDAQVASVINDLHSQFDLTASSLAKVRAYEMAVAAAREQVTATRRSVAGGERVNRDVLDAEQQFNGARRDLAEARYAYLNAWLRLRQLAGVLEDRDLAVLAAYFGAGEGRAQVAAAIR

SEQ ID NO: 28263 - protein, 152 aa, Pseudomonas aeruginosa
SASTAPSWKPSSMPCTRRATRPRRSSTSRSTVPARRASARSRPAWHRPRPSCATPSRISSATSRWSSAASSRGPSSTSRGVSAMSPATASPRRGPISTKASRATARSAARRCRPRCAGPTRRSPSYRRRSTTCRCARRSTARSGRSPPNRAN

SEQ ID NO: 28264 - protein, 511 aa, Pseudomonas aeruginosa
ARYEELPANPPGNPEGHAVQADVADGRGLGVHHLAAVHEPHRPRPAGGGGRRGSQRRVARAGPAARFGAESRRGRLRQPAAGQARPGLARAVRDHRDPAELREAPAARRGAGDPVLRRCHQPHGQRPDPAGHLGGLQRADQPLQRRSAGTRRLHRDPGAGGAEPAGRAIDRPVQPRHQLRRDRPSGAAVADPATQPAARLHPRQHHAARRHPALHAPAAVDPLRPLQRATADLVRAGDALLRDLAAPAGLSPVGLVLHAAGDRPAVPNRGDRPQRVHRRAAAHRGIGVPDHDLHHPAAVLHGRLQLAGTGHAGLGTLAGRRDPLDLGDPRHRRDEPDGPAAARSQRPCPGAAGHGRHLCVAGYAAVPVPQLALGQRQGLVKRRKAGHTRLAFAQGDEGMFRSGLSLLVLLGLATLGGCGSVNTLVRDDASAAHDLRLKATACTSLPRVYSGVSYTFCRLNVKTGSPVAPAQADGILEVLALDFALSGVIDTLALPYTSYRQYRDGNLSLAN

SEQ ID NO: 28265 - protein, 297 aa, Pseudomonas aeruginosa
RCMAEPRESDGAAAEQAVGQRQGSAGPEGQGQPEGAGGHRQVAGQGNHPAGGGCVEAGQVDQPVEVGRVEQQQPGQQPRAQVTLAEDQDRQQGQVEQQDEEEPQAERLPGGAGFLAGAAAQGVGQGEEHAAEQQRGTHEAAEGAQQDGRLDLRHQREDRQRRAAEADQGGQGEDQAVTEELAEQQLAAPQRVGQEQQQGAAFLLADDGVVGQQQGDQRHQEGGQAGQAGDRRRHRGEADLAGRGGAEPGDAHREQGEQQADRQQPAIAQAVGQFLAGDGPNYGHGVAPAGAGDMWWR

SEQ ID NO: 28266 - protein, 525 aa, Pseudomonas aeruginosa
RSCRRSGPPPGSSGHRRRPAAAGRRPAPRGPWRGRAGAGRGAAPPGARPATALRGSSLFHQHPPAHFHVQGVAEPAAVVPVHPGLIGDEGDRRGLLRADLHADAVVDHDEAVGHVLDLVEVGDGHGDFVALLHLELGEAEGGRHRDHVDADLVALADDLVVLHQVDAVLFRALDRLGEERVLAVPDLAGLDLVAAGEDAIVRFGEGRAVVDQLHFLAGNVDQLVVLRVQRTGGQEAVLGELAEHHDPLAVGFAGLAQGGVVVPRLVLHVEFLADVVDLHALVGAHRVGQVPLHQLAVDEQRGIGVASAIEGGVQRAEAQFRLAHHHVARVGQLAGEQVAEALDGDHGAGRRELAVGDEVLAVRRGVQPVGVLRYRDVAGHRAVLAVLAPAVDHRHLRVAEGDEAPGLDLGLDARDVEHHHPVALVAHHAAEVDGLLRVVAGGGGEPAAVVHVGVVEVAVDDHLPGHFHGLGVDGVVQGEGVVAGQVEGRAVVGMGDDELGVARTRSGYAAPFAGAGRGSPGRWEW

SEQ ID NO: 28267 - protein, 186 aa, Pseudomonas aeruginosa
TPVCASARASTARRARVLRRNVRRSRTRSTHPVRRGRPRPCCARPCPRPGPRGRPPRCPGRWRQPGRRLRSAPRRRGSRGGSGRGFLRGGFSCRRSSRVVLKGSQGKGSQVRGSPRVSARCPPARSSRASCACSPAAGTCPGRGRSSGSRGSSGIRWPRCGRRDGSPGSRIRGHRAGRACRIPRGA

SEQ ID NO: 28268 - protein, 406 aa, Pseudomonas aeruginosa
EERGRNALDESQEVEMRNKRGCWHSVYRVAPLPSGRGERAARGSGQALPGYRWMVQRLHLVARRVEQVEAARAVAVVEGLVEQGHAQRFQVTVPGLQFLHAVDDEAVVIHGLQAVAGSVGAAKGKVVVAAGEIHQVFVGAVQHFHAQYVDIEALAFFQVGHQQGEVTQAVEAGGAGRAVGHGFASFFVYNNFINLKQKEVSVYCIFIKTRLRPGCAEAFIDAIQVNAAASVSTEPGCLVFDVSRDRQDPDLVYLYEVYRDDAGLRGAHPHRAFPRQPTVGRAADPRTGSLRKRRAGAQSAALRRLNRRWRRPARGSGPGAGSANARRGPTGAPRSGARALASGRPGVGPAPGIARSARLPAAATAGRAHGPGAAPARSTPRRCPAAARRRCRCGRRPRRRRRVRRA

SEQ ID NO: 28269 - protein, 303 aa, Pseudomonas aeruginosa
HSLLLSWSTPDGAAGVFVQPIGGRTMSAVIRVDSLNKTFARKQALFNLRLEIQAGEMVALIGASGSGKSTLLRHVAGLARCDRDNGGSIDVLGRRLQASGRLSGEVRRLRADIGYIFQQFNLVNRLSVLDNVLLGFLGRMPRWRGSLGLFSAEQKRQALEALARVGLADFAGQRASTLSGGQQQRVAIARALTQKAEVILADEPIASLDPESARKVMDILADINRHDGKTVVVTLHQVDYALRYCPRAVALKGGRILFDGSSEHLSEGFLNELYGAEGDTPLLFSDRSRRGAESQPELTLARA

SEQ ID NO: 28270 - protein, 74 aa, Pseudomonas aeruginosa
TRPCCSATPATWRPSPPTSSRRTSATGSSTSARCWSPCRSPSGARCWRSSAPSRCRSWLPRTSCPGGSTSRCGG

SEQ ID NO: 28271 - protein, 312 aa, Pseudomonas aeruginosa
TKRTAVPRTGRTAAPGTAGLPPRRLPARRDPAGPALRGEPPYPAQGARRTGARRPRAAAPGQGHPGPGGADDLPDGRRQRLHRVALGPGPPGRGPAAGGAPAPGRRRRCHPPGDRRGRAGAGTDHPALPRRPASEPDPPLLRRFPQRAARRLPGRFAASLPGRQRPAADPHLQPDRCAPAQPRGGGAPADAPPCAVAHRPHPVPRPYRPTGGTGPVDQPRRSLPVPGRPLGEAHDRLAFRSHHRRTTALDGRARPRPSRGAGRPCGRPARCRLSPAARRRDRHDPGARTHGRHRQPVQPRRDDRDPLRGAAR

SEQ ID NO: 28272 - protein, 282 aa, Pseudomonas aeruginosa
RTHRLQLCRRARQAPRRTGRPGRRAPAGRRRGGLAGAPDRTAGPHPCRAPRRPGCGNRHYQGGVLHPGPRRRLMTSASLPSPADTAALLQPAFQDPVLDAQRSFRAALKALAEPGLVRNLERAPALAALHPASYALCLSFLDSDAPLWLAPGLDSPTLRANLAFHCGCPIVAEREQALFALLDEGELDDLSGFDSGSDRYPDQSCTLLIQLAGLDGGASLEWRGPGIAEVRQVALPVSAGFWAQRAARTEFPRGLDAFFAAGERILGLPRSTRVSEPVEEVA

SEQ ID NO: 28273 - protein, 93 aa, Pseudomonas aeruginosa
WKRSSSSAPTAPRCRASPPACRWIPPGCACNGGSRRPTRTCRAGNCSVRPSTIPIACSTSACSPRATTPAPKWSGARPWSLVRACSACSTGKA

SEQ ID NO: 28274 - protein, 148 aa, Pseudomonas aeruginosa
RRSTNCPARCRISPASRSTSPPAAPSACRPWPAATRASFSPWAIRPSAATAATIRSPGRSASAPARSGWSPRNSASRCRWARSRSPSARWSTSSSVPARSCRNSPVATAWPSATPNARRWAWPWSTAPCAPRNTARRWCRRRSRKSSS

SEQ ID NO: 28275 - protein, 586 aa, Pseudomonas aeruginosa
FASCVVPASPNPRNPLSRRSAHEPFPASQRRAGAGLQLRLPRRADQAHDPPRPAQGGGDPRLPGALRRPRDAAALRLGHRRHAGDRGHPRCRRRAQGDRPGRRRHHQRGIHPAFLRPHRRGRHHRTDPGGDGDPDPPPDTGNRPERRADHGLPGADPRAAALHRAFRGGDPDHACAQRLWGDAREALRGHRHLRPHRHQLCLPGDGGRALRDGSLADSQVRQPQAGHEPGADAVRRRSREAPVRGAAVHPGGEPGLRGPPLRSPALGRKLRLLRQPRVLPGRTDRRRPWRQALRLFRHRLLHAAACLPGRRGGRAMNAVCESIDANLDARDRPLLSVRGLTRLYGPEKGCQEVDFDLYPGEVLGIVGESGSGKSTLLSLLSGRCPPDAGTVAYRDDGDRWLDLYAASEAERRTLLRTEWGFVEQNPRDGLRMGVSAGANIGERLMAQGVRHYGRLRQAGLDWLEQVEIDPLRIDDLPRTFSGGMQQRLQIARNLVSAPRLVFMDEPTGGLDVSVQARLLDLLRGLVRELDLAVVIVTHDLAVARLLADRLMVMRRSRVVEAGLTDQILDDPQHPYTQLLVSSVLQP

SEQ ID NO: 28276 - protein, 263 aa, Pseudomonas aeruginosa
AEASAPVRATGARRSSDEQPDRGPRPQQDLHPAPATGRSAQCAARAQLQCRRRRMPGAPRTLRRRQEHPAAHALRQLPAGRRQHPPAPRRRLVGTGRRRASRGARRASPDPRLRQPVPAGDPAGGDPRRGHGAGPGPWLEPRQRRTAGAQPAGPAEHPGTPLATGAGYLFRRRAATRQHCPRLHGRVADPAARRADRVPRRSQPPGSAGADRRSQGRWRRVDRHLPRPRRPRGGGQPLPGHEPGAFPPGASPCRLNAFSAMPG

SEQ ID NO: 28277 - protein, 184 aa, Pseudomonas aeruginosa
PIVAKSASACAPICCMRGRSATTSRWCVRSGAAGRECSDDRQTDLSDGAFRLGQGQPVAGRARAPGAARLPYRAAGDHALRGSGGGGRPGGDSGAVRHPRAGLGVRHELARQRPLLWHSGADRRVAGAGLRRAGERLARLPGAGPPALSGSARGPARGETRGAAPAPAGARPGKPRGNRGAPGA

SEQ ID NO: 28278 - protein, 273 aa, Pseudomonas aeruginosa
SRRHATHPPGPSRQRPRMRLTLLGTGDARQVPVYGCDCPACRNARADAGLRRRPCSALLECAGQRWLIDSGLVDLCERFPPHSLDGILQTHYHADHAQGLLHLRWGQGLVIPVHGPADPEGLADLYKHPGILDFSQPFGAFERRQWGALAATALPLVHSKPTFGYLLEGASEEGTIRRLAYLTDTVGLPADSASRLLAAPLDLLVLDCSMPPQEQPPRNHNDLTRALECIESLRPRRAVLTHVGHTLDAWLLDHPAALPEGVELARDGVCLPL

SEQ ID NO: 28279 - protein, 504 aa, Pseudomonas aeruginosa
MRTKASLLAQGRLRSVTRLMFTLFFAQSANAELYQWKISIPGEPTAFFPSYAAACQYYFDNTSKNWLKKIEKMNPKWVQCNVSGTGGITWQTSGATLIGNSCPLGAELNNETGSCDCRPGYEMNDAGCKLPDKNGPDKGAPPPEGCAGNPVNITNGNKYQVEHDLITPIPLARHYNGLDGLWRHSFSARITRKDDSYLLYREDGKVSEFSGAGRDLTSLTDLGKLSRLAGRFFYTSELNETIEFDPYGKLARLKTKEGRKYRVERGANLTISDERGNKLVLSEGANHQLLRAQIGGISIEYTYDKEQRLTSVTRTDGQYNTKTQYLYDDPRNIKLLTGIQDNNNRRFATWAYDNQGRAISSEHANGAEKVSLAYNDDASTTVTNEYGKQAIYYFQIVNGSRRIVAIEGEPSPNCPSSNSTFTYDDQGLLTSKRDNNGNLTTYQYNARGLETSRTEAAGTAQARTITTDWHPTLFLPVQVSEPGRITRYQYDAEGRKTGETVTTR

SEQ ID NO: 28280 - protein, 140 aa, Pseudomonas aeruginosa
ATNTTTHGAWWRSATTSANASNTTSTPRAIAPPSASRTPAAAWCASSNGPTTSLAGCSVRSAPAARHAASPTTSTTIRSAKPTRASSPTARPSTPSTGWSARAIPSAARPDSPTTPRTTSPRSRTRAASPPATNTTASAT

SEQ ID NO: 28281 - protein, 145 aa, Pseudomonas aeruginosa
PATPPATSPRTAPRANWPTTPRAACKASASTASRSPNTATTPSASASSSSPPRASPPTSTVPTASCSAKPNTTAAAGNCEPSTTCGWTACRWPPSTPTTTPRARSATRPCSTSMATTSTPRAWLPTPAARSPGSGSPTPSAAAKR

SEQ ID NO: 28282 - protein, 262 aa, Pseudomonas aeruginosa
RLSRRSSSIVSIAWSPSTGSNATSSRAWSSWRCSGSTGAWRSIAAAWRRPPRCWRRSPAPASTGSSAPVRCAAASVIISRYRWPSICSTTTSRATGTARPTWRAWSTSGFASCGAERQSQERKRMGSHQERSLIGLLFSETGVTADIERSQRYGALLAVEQLNREGGVGGRPIETLSQDPGGDPDRYRLCAEDFIRNRGVRFLVGCYMSHTRKAVMPVVERADALLCYPTPYEGFEYSPNIVYGGPAPNQNSAPLAAYLIRQ

SEQ ID NO: 28283 - protein, 449 aa, Pseudomonas aeruginosa
SSQEGYRGVLALAMHGPVPDCRQRPAVPARSIVTLSVTIYWPMPAGQGRLSRNILRHLVAAAATATHWPSSGSPVPSRPRQPPHSGPAAATAFPLDSRLVPYDSRSTICPLGSSRYRGIRVAVRLLPGRRPTPQAQLTRPVVRVAPRVSGQVAEVLVSNNGHVQPGEVLFRLDPEPFRLAVRQAELALEEAERTNRELDAAIASAKADLLAARSSAGELDSEARRTAQLVQRHHVSQQMHEQVSAQAQAARARVAAAQARIGELTARRGTAGEDNLRLRQARNALAQARLQLQYSSVRADRAGTLSNLQLTPGTYVPAGTPVAALVDDRIDIVADFREKSLRYVRPGDRAAVVFDARPGEVFGARVAAIDAGVKEGQLDANGDLAAPVTSDRWVRDAQRQRLHVVLDELPEGLLPTGAKATVQLYPGDGLSHLLGRAQIVAISLLHYVY

SEQ ID NO: 28284 - protein, 172 aa, Pseudomonas aeruginosa
LSLRRSVLFPWHIDLSTIRSISGYSKTGQHGFPTTRRTLCPPTRIPDGSPSAPWPTASPRTTTSFPPAAISPGSNGSCTSPTAGSSNMPSTRSACAGAWPTAVPAASRTTAPVHCGKTFTWWISSSRKTAGRSRSAWCWTSTTRRSPRCSAICPTARPANRVCSPGPWPAGN

SEQ ID NO: 28285 - protein, 94 aa, Pseudomonas aeruginosa
RPSSCMAASTARGSPTPARTSPATSWSACATATSTAPARPTNTSTSIPTSTPGNACAAPSEGWPIPTAATATDWPNACTCSSGARRSCRPSACC

SEQ ID NO: 28286 - protein, 469 aa, Pseudomonas aeruginosa
  UNSURE (421): Identity of amino acid at the above locations are unknown.
RRAWPRAGLLRPRQMHRRRHSQRRLGMQPGAGGADLGGTAALPTGAGDQPFRLWRHPGRQRAATGGDARDLRRSDDGGRLSAHVPARRAARGGRPRDARGTAPALARDAHRRARRVPVHDPRPAQRRRGPPRTQRPDRGLPAPLPAQPRRALDAIPQHGADLPGDPRRGRRTARPPAPRLPGRTAGAPIVRRLENRVALVTGAGQGIGRAIAECFAAEGARVLLATRTASRGQAVLEAIRLGGGTAELLAVDLSEHDAARRAVSATLERFGQLDILLHNAAAFPQCALAELDEGTLERTLAVNLKSCFRLTQAALPALRRSVAGRVLVTSSVTGPRTAIPGLSHYAASKAGVNGFIRAAALELAGDGITVNGVEPGLVATPALGSLRRRRRAGRAHPPRACRPAAGHRPRHALPPPPTRRXTSPGRPWLWMAARCCRKTAGWPEAAGVRPLPPERAPSDVSGKHFRRLR

SEQ ID NO: 28287 - protein, 673 aa, Pseudomonas aeruginosa
DLHVRRPRQGRHQPPRLPQRGRLHGPALRRPARSAEQGKALLGDRYRQRRLYPQVLPLRAQRRRTAPAARRHRRVVAADLRLDGPHPGIQGRLRQRPRRQPGLLRAFRGQRENLVQAHPGSLPVPQPCHRQPADRPRQAGGPGQGRVHLGGRGSRRRHRRQRRQGGCHEFRADPLQLRRPGFGATARRQHRLRPDVHRADEHPRHEADLPPLLRTGGGYRRIAVRLPAVQPFRRERRDPGDGQGVHPLGERTDLPRLRALQAVVPPGWLRPAVPDAGLHPPGGQARLHHRRPLQGPAMHRLPGVPRRAGAGRRSGGLAQPVLVADRRHVRQRQRMAQRRLPTQRRGPAGLPRAGAAGLPGDQEDHRAGGRQRPDLPALRRSRPAQSATRQVPLHLLPRLRRHGPPGADQDPQAALGRHRQRVRRPPRAVRDQLRRQPGRDPHAGPAPGGRQRGDEGHARHGRAVHGRLRRERLDRAAPAQPGRHQRARPHPPMTPASRPEVIPMSQLEPRQQAFRNAMAHLSAAVNVITSNGPAGRCGITATAVCSVTDSPPTLMLCINRNSEMNTVFKANGRLCVNVLSGEHEEVARHFAGMTEVPMERRFALHDWREGLAGLPVLHGALANLQGRIAEVQEIGTHSVLLLELEDIQVLEQGDGLVYFSRSFHRLQRACRAA

SEQ ID NO: 28288 - protein, 356 aa, Pseudomonas aeruginosa
QPRRTPVNPLSTSGGTGRHWRSASLAACLPKEPPTMSASPSSRLHLQVTDFRAVARDVVLVELAAVDGTELPAFTPGAHLELHLGNGLIRHYSLLNDCRERQRYQLAIGLGDDSRGGARFIHRQLRTGDRLHAAAPRNHFMLREDAARYCFVAGGIGITPILSMVRWCQAQGKDWRLLYAVRERQRAAFLAELMTLGGERTRLHCSDEGDPLDSTALIAGLGADEELYCCGPDGLMQAIRDAGSGCAERLHFERFDAPVAPASSSGGTDAFRLELRRSALSLRVESHQSILEVLEEQGLEPPYACRAGICRTCETRVCAGEPEHFDHVLSDTERASGETLLICVSRCRGNYLELDL

SEQ ID NO: 28289 - protein, 189 aa, Pseudomonas aeruginosa
SRLDDNNDRGRPMPELATREFWKDLQPIPDCFKPDAKPEVYLRNAPTEDERLYVPFTETVKSRPLWISPSENRWCDILMATSAGLVNRHYHPHEVFAYTISGKWGYLEHDWTATAGDFVYETPGEGHTLVAYEHEQPMRAFFIVKGPLVWLDEKGNADGIFDVHDYIAMCREHYDKIGVGAAYIDSLFR

SEQ ID NO: 28290 - protein, 140 aa, Pseudomonas aeruginosa
SWASANWSAVSSRRPWPASPPTASACPSSCGCPAAAPCSPRSSRCSCAKPRPPCWRASAARLPPSCKETNHESTALARCPRPPPERTGTPGAAARRSRTGSRLLRHLRQRPARIPERPALDSPGRGAPAVRLPRAADPRP

SEQ ID NO: 28291 - protein, 528 aa, Pseudomonas aeruginosa
VLRRGRRARPWRGGTAHRRPRRGGAGIPLRRMPLLPGRPLQPLRVDGLHRPDGRRRLRRARAGAGLHAAPPAGRGGLPPGRRARTGRRGPARAAPQQPGAGPALRGVRARPDRPAAGDARPPARNRGHRRDRRQSRAPRPGRGVRRQPGARRPRRRHGGAPARGRRARLRLRGRRQPGQPRRRPGQPAQGWRAGAGEPDGRGPAGRLRPGQPRTAPARQRRLPRRLPGADRPARRRPPRPGPRSDPQRAPGAGRRARFRGPAARQVAGQGAGQSQPGPGRRLKERSPMVFQHDIYAGQQVLVTGGSSGIGAAIAMQFAELGAEVVALGLDADGVHAPRHPRIRREELDITDSQRLQRLFEALPRLDVLVNNAGISRDREEYDLATFERVLRLNLSAAMLASQLARPLLAQRGGSILNIASMYSTFGSADRPAYSASKGAIVQLTRSLACEYAAERIRVNAIAPGWIDTPLGAGLKADVEATRRIMQRTPLARWGEAPEVASAAAFLCGPGASFVTGAVLAVDGGYLCA

SEQ ID NO: 28292 - protein, 462 aa, Pseudomonas aeruginosa
AAFAPDAPVRLGRTAIRTTEQQQDECLAMKTLRTLPALLCAGFLGLSAQAAEDSRSGPLAGFGERLQRHGVKTHAQFWSLSLKNLDTGPRQHSFGNSGDLFLGADLDLATLAGLDGASLHIEETLFILDRGTGQPTGPSWQGAVGSYFGGAPLHNDIGANQLSLLTWQQQWLGGRLDSHLGRTNARRYFLIYNCETVVTCNDPIIDASTGILPPPYGAWGGYLKYRATPTLYLHAGAFESNPVDYLKKRHGLDFGTDDASGTSLLLGIGDKREESLDPYRSHYELNAYLNTANQVDPLTGASDHGSAGGFFKFQQLFWRADGGRLDSPRALGLFGSLSVSADDKQPFRHFAELGLTYHAPFDRTRDKLNLKASYLRLNDHQLEFQRQARIAAGGDAKLGQRDVYALETNAHIALTPHIALEPSVQYIFNPDNYYNPGARELSGDGFVVGLQLMVDMGSLLGL

SEQ ID NO: 28293 - protein, 721 aa, Pseudomonas aeruginosa
VAWGRREPAGPPGHRADVPHRGQARLRPGLLAEGLAAAAALALAVPVRPARGADLEHRRVRWLPPPRPAGRDPGAGSDRRPRAEEPAAAPGPLRPRGQPARRGDAPAEPRAGPPELAGPARPAADRSQLPQPPCRPRYPGPGFPTGPQTGRQPQLRPSPQGRAGTGPAGFQPRPDRGLDPRQPGHRVPSGGHLQDGPRPARGGRRPVARARPARPAGGRCVDHADADHRQYQRPGDHDRREGRRPDPRQAGAPCTARATTGRAGSGRRLTSRPGCRRWRTCGRPANAACRRSLGSPSVHRRSRRWSTPVPGSPPPCAHPAACRSGSFRSVPVRRPGRRTREAQARRAGWWRAGCESWGISWRQDRVGGRRHAFVEAYSRPRSCPGCVAGMPDSSAAVSPLPADTWPYIRRPAPAGRIAPGAIRRLPRSRQRQPGFFARPGIRPGSGYSAIQTPAGKRRGRGYTACKHTNRHGSQAMEHVDHILIVDDDREIRELVGNYLKKNGLRTTIVADGRQMRAFLEANTVDLIVLDIMMPGDDGLLLCRELRVGKHKATPVLMLTARNDETDRIIGLEMGADDYLTKPFSARELLARINAVLRRTRMLPPNLTVSESSRLIGFGQWQLDTSARHLLDDAGTVVALSGAEYRLLRVFLDHPQRVLSRDQLLNLTQGREADIFDRSIDLLVSRLRQRLGDDAREPEYIKTVRSEGYVFSLPVRLVEAHP

SEQ ID NO: 28294 - protein, 291 aa, Pseudomonas aeruginosa
SWPTGSCSPRHSGAAARSRRTSPARSATCSSCCSPSPPSAPRPDCSAHAPGKPCTRPAPGCWRASSACRSSNASPWAAGTYWRSPRSSPPSSSSSPPSSPCACVVATYSRPDPSTALNETSIMQASDLRAWRRPFALLDRCGGWSADLSLRLFLAWEFFESGWEKWNGENWFGDIQSAFPFPFDRLPAAFNWELSLWAELLGALLLLLGLGTRLTALVLIVVTLVATAAVHWPAEWSSLAELARGYSITDHGFGNFKLPAIYLAALLPLLLAGAGKLSLDHWLGRRLGLSR

SEQ ID NO: 28295 - protein, 186 aa, Pseudomonas aeruginosa
RQRRYPPMHRLHKGCVVIRPPNRVPGFRARHPGSATLPATPAPPRRALRAHSAPQAPAPPGARARSGAVSPATPAGGRPAESGARYARDAKNRDASTAGSVPQALRRARRPLRADAPASDSPAAAPGSTAAAPRRAGRLHADTADRRARPGRGAFRSIRSGPTRLATPADTRPAAAGSRRRPRRYG

SEQ ID NO: 28296 - protein, 268 aa, Pseudomonas aeruginosa
RESKTDMLLLHSKRGRAAGAALVGAGTNRAAGPSGVVPGAAVRMWPFRLGDVSGVYRPTLGFVRRRYRNRAWIQSDTQSSAGMPTKCRASLTPAGPSRLPLGDSHLAQSRGRAHRAETHSGNPASPRYVRPEPLRLVAGPPVLEKRWLPARQPGRPAAPARKRREGSLDRCQQGPRPPGGSGGLGRCGPAGHHAGRPFAGAGRPGGGNPPRRPALQPCQGRRGQHVPRRAHGPGHRYRACIGPGGRNLRLGAAPSQRAAQPGTAEDLG

SEQ ID NO: 28297 - protein, 180 aa, Pseudomonas aeruginosa
IACITVISPAPQRQPSPATTPGTPASRWSPPATASASASSCRYSLRWRTDAGCSRWPVARQTSPPAPGPRRHPGGPPRAWPARCRRRCSGSVARAPAVRPPGTTAATRRRGRSAAGCAAAGRRDCATGRRPPGSRAPSAAPRTTPAPRCRARRRRRSGSRSRAPRRRCRRGCCGWTGADR

SEQ ID NO: 28298 - protein, 159 aa, Pseudomonas aeruginosa
ARPSPPPSPAMPWPRTRCASTTAPASTGRHCRAAASTASACSTSRPIPPAACRCSSPTRCRRTRHRSATTTASGSRPMRRAASASIPTRASACSAISPRAAWASRSNDSWSSKCARHWASNRPTSTCPRRRWRSTPRATARTTARYGSVPARWMPKGTG

SEQ ID NO: 28299 - protein, 156 aa, Pseudomonas aeruginosa
SAEARSRGRRSVAARDAGPGYDGAMSASPPLRQPCPPGACVCERERLEAPGADRRILLLTRQEEQRLAARLEALRSLEDLEHLLRRMEEQLGIRLRIAPAFGEVRSMRGIRMRFEEQPGLCRKTRQAIPAAIRRGLEKRPEVAYALLNAHDLLRDA

SEQ ID NO: 28300 - protein, 234 aa, Pseudomonas aeruginosa
RRPSAIAAWTRATASLPLPTQSARQPRAPTVRSSSSPATRLSSATSSRSGSPAPGQAARSGWSWATSRSRSNQNRLPLPGALSTRNSPPIRSTRRLHMNRPRPVPPKRREVDASAWVKPSKMRCCCSALMPMPVSATSTRRRTRWASCARRRKLTRTCPRAVNFSALPARLMRICCRRRRSPTTALGSSGSMSKITSTSLSPWLPESTTARSCISGSSSKGSISRTSLPASIFE

SEQ ID NO: 28301 - protein, 132 aa, Pseudomonas aeruginosa
IKRADSSAESSDPRYDRSQRRAFQRLRVAQCGEQGEQQAGQRQHGADVADRGQAHAFADHAAEQRAGADADVVQAGEQRHGHVGGVRGEAQDAGLLGQAEAHDRHAPEQAERHQPGRLRGQRQQQRQAAAQD

SEQ ID NO: 28302 - protein, 142 aa, Pseudomonas aeruginosa
DRGQHEASRESLAVSAEEDRTEDPGAAEQQQQQGGRLAAHPRHLLGERLDVAVRGELGADHHHGQHVQADQRRASEQHRQAAQGTGVLAWQQRQGARQVEQGQHRESGDGHEGGTPAQGLADHPPQRDAQDHRQGGAGGQQP

SEQ ID NO: 28303 - protein, 352 aa, Pseudomonas aeruginosa
RLGLLSRRRHAHRQRSGDGPEHRVGEGNADPAEHQHLEAPGQPGQHVAGDEQQEYPDQQLAPLDIAGQQHHRQRGQRHHPGIDGQHQADLRGGHLEAVADVAEQADRDELRGVVDEGGQGQGDHAQPAAAAGFGGAVHGAFGSGAGGGRAGPATLATHDGKRPGRKGPGRRCALDGRYRYWRELPNPAILRRDAVRCTPARRSGDLPGAMGRLRQHQAGHRLAPGREALFDETGIPIKLAGHIVVDGVGDHQAIAAPPRPAHAGDDPLQGGAAMPLALVAAVDHQAVEPVVAVVGVGAVEGRSRPCARRGGCRPRGTPAGSGSGPANRGWKRRSAPGGGRPSGQCRFPNRRG

SEQ ID NO: 28304 - protein, 542 aa, Pseudomonas aeruginosa
WQDFPGARPATDKFEIFLVRSVRFSLLHLTKTLEPSPSARLPRRPTPTADRPLPRHATCPALPYPDAAALLRRRIPCMESHMSHRPVINASVSPKGTLETLSQREVQQLSETANGKTYQLFRQCALAILNTGAHSDNAKTILDAYKDFEVRIHQQDRGVRLELINAPADAFVDGEMIASTREMLFSALRDIVYTQSGLDSQHVDLDSSQGLTDYVFQLLRNARTLRPGVEPKIVVCWGGHSISSEEYKYTKRVGHELGLRSLDVCTGCGPGVMKGPMKGATISHAKQRIVGGRYLGLTEPGIIAAEAPNPIVNELVILPDIEKRLEAFVRVGHGVIIFPGGAGTAEEFLYLLGILMHPDNQDLPFPVILTGPRSAEAYLQQLHEFVGATLGHAAQRHYRIVIDDPAEVAKQMAQGLKEVKQFRRERNDAFHFNWMLKIDESFQRPFEPTHENMASLQLSRSLPPHELAANLRRAFSGIVAGNVKDNGIRMIEQYGPYEIHGDPAVMLPLDRLLQAFVKQHRMKLPGGAAYVPCYRVVQTEAA

SEQ ID NO: 28305 - protein, 234 aa, Pseudomonas aeruginosa
ARPLRHPCAARGDAHLFRAGRTASCYSFPFMPRIAGPDLMSPSPSPALAALRDATRDLHAELDRRSPLGDDDLDDRAYLDHAGRILGWLEPLERALRDNRSGWPAALRADARLVKSAWLESDLLAGGMSRAQVEALPRCADLPNATRAAEVFGVAYVMEGATLGGAYLYKRLAPRLPGLPLQWLQGYGQATGVRWQEFLEQLARQIDSPEAIGLAQDAAQATFLSFRRWVLDEA

SEQ ID NO: 28306 - protein, 728 aa, Pseudomonas aeruginosa
MTSITPVTLANCEDEPIHVPGAIQPHGALVTLRADGMVLAASENIQALLGFVASPGSYLTQEQVGPEVLRMLEEGLTGNGPWSNSVETRIGEHLFDVIGHSYKEVFYLEFEIRTADTLSITSFTLNAQRIIAQVQLHNDTASLLSNVTDELRRMTGYDRVMAYRFRHDDSGEVVAESRREDLESYLGQRYPASDIPAQARRLYIQNPIRLIADVAYTPMRVFPALNPETNESFDLSYSVLRSVSPIHCEYLTNMGVRASMSISIVVGGKLWGLFSCHHMSPKLIPYPVRMSFQIFSQVCSAIVERLEQGRIAELLRVSTERRLALARRARDADDLFGALAHPDDGIAALIPCDGALVMLGGRTLSIRGDFERQAGNVLQRLQRDPERDIYHTDNWPQPSEDSPDGGDCCGVLAIRFHRQESGWIFWFRHEEVHRIRWGGKPEKLLTIGPSGPRLTPRGSFEAWEEVVRGHSTPWSETDLAIAEKLRLDLMELCLNHAAEVDRMRQRLIAVLGHDLRNPLQSISMAAALLSSSDTRTTELRQHISASSSRMERLVSQILDMSRLQSGIGLTVNPVDTDVSQLVRQIVCETDVAYPGLVIEIAIDPQVRAVVDPDRYAQVAANLLSNARHHGLPGRPVLVTLTRQGDEVCLSVLNETSGLSEAQLANLFEPFKRESADNQRNRNGLGIGLYISQAIAQAHQGRIDVDCRDDVITFCLRLPVRQAETGSSS

SEQ ID NO: 28307 - protein, 297 aa, Pseudomonas aeruginosa
SPAPPKGESTCIPATASRSRSTASAASPTASSRNEEPTMKHARIRYQGRVHQVTVEDANAVRLADGTLLAEDRVEWLPPATGSMFALGLNYADHAAELSFKAPSEPLAFIKSPGTYTGHRQVSWRPDNVDYMHYECELVAVIGKPARNVRREDALGYLAGYTVCNDYAIRDYLENYYRPNLRVKNRDATTPVGPWIVDAAEVPEPNRLTLRTWVNGELRQEGSTADMIFDIPYLIEYFSSFMTLQPGDMIATGTPEGLSDVVPGDEVVVEVEGVGRLVNRIVSEAEFFRARAQEHAE

SEQ ID NO: 28308 - protein, 292 aa, Pseudomonas aeruginosa
RPRAPDAKAGNTASRYSPRSRTCVYPWAAITSPAGACRARSCRAAPRGRQQRRRADTIRRIRASRQRPRPLPGPTGHQENRHGQSRSGCQDHPRTLAVPVRAARPAPRLPPAGDRRAPRDRPALPRTGGRHHRGVRHPLAGQRRLPHQLRAALRGALHQQRVAALHRQHGVRLPRQPGAGPHPRRGLQRARRGDPGPRRHHPRPGVRHPGTDALHEPGPPLQGGLGLRPVHRALPERQRAPGLGHAQGGGRALRRHGGVPRQRLTVPPLRPERPGAGLLRPHLEPVPRGPRP

SEQ ID NO: 28309 - protein, 163 aa, Pseudomonas aeruginosa
SRADVAGRPLGGILRDAPGVRLQGPWRRLHARHRDAPRRPRLVGLRRQGGGGDALLRLLRHRADQRGIPGHRPGRLGDPRRPGRQPGRRQLRQPPLRTPPCRTSSPNTPTTSKPKPTCPACSRRSTPALAPAAFSRSAASAAAACAWTPGAWPTASTTTPSST

SEQ ID NO: 28310 - protein, 213 aa, Pseudomonas aeruginosa
TTRRTDRPAITLHSPSSPPGHRQVAGTSGRSQKVQDHEHSQHPEQHHPASQRQHPRPRHLAADAAAAGVLRLRPSGPHQHRFRQIADERRPALQRHRLRSRRRAILHRLCAVRPAQQPDAGTDRPAPLDRLPDAGLGLSLHRHAAGGDRARLLPAALSPGGRRGRLLPRYPGLPEPLVPGAPTRADHRPVRHRRAHGRGDRRTAFGLDPRRLP

SEQ ID NO: 28311 - protein, 530 aa, Pseudomonas aeruginosa
RPRTARLAVDVPDRRPAGCVARRGGLVLAAGKLRTGDVAQRRTEAPAARGTGRRGAAQDHHLLLRHLQQSAGVAAGGDLFRGDAGGEHHRVLDAEPDPWRRHRPGQPHRHAQRGALSRRLRLHDLHRPFLRPPARAPLAPGHSVADGRRRAQPGGPGTDQRLAGDGRSGDRRDGRQRRPADVLATAAGLPFQRHPGRRNRPDQFLRQHRRLPRALPDRLDARHHPERQPGPVPAGHPHRPRRRPGPADPRRRGLPTLNRETPTMLDPRLIQEAANRLDAAERSRQQVRQFSLDYPDIAIEDAYAIQRAWVERKIADGRVLKGHKIGLTSRAMQVSSNISEPDYGALLDDMFFEEGSDIPFQRFIVPRVEVELAFILGKPLKGPGCTLFDVLEATEWVIPALEIIDARIQQVDPQTKVTRKVFDTISDNAANAGVVMGGRAVRPGDIDLRRVPAILYRNGVIEESGVSAAVLNHPAKGVAWLANKLAPYGVCLEAGQVILGGSFTRPVAAAPGDTFHVDYDLLGSISCRFV

SEQ ID NO: 28312 - protein, 272 aa, Pseudomonas aeruginosa
GGISMDLPVNRFKQRLRSGEAQIGLWLGLADPYCAELAANAGFDWLLLDGEHAPNDLRSLLGQLQALAPYPGQPVIRPVQGDTALIKQLLDIGAQTLLVPMVDSAAQAEGLVRAVRYPPAGVRGVGSALARASRWNSVAEYLNHADEQMCLLVQVENLEGLANLDAIAAVEGVDGVFIGPADLSAAMGHRGNPGHPEVQAAIEDAIHRIRTAGKAAGILSADETLARRYLELGCAFVAVGVDTSLLMRSLRELAGRFKGGAPAPSASSSVYG

SEQ ID NO: 28313 - protein, 555 aa, Pseudomonas aeruginosa
SPARSSTSRCRWPLPPNAPGPARNRWRSACAASTTRAWRSAAPAPSFRRRAEEAAMRHDNTVPARIEWAPAAVPTASQDSGQDKMKRYEKFADEIAELIRTGVLAPGQKVPSVRHASRTYGVSASTVFQAYYLLESRGLIMARARSGYFVCQHVQRPLPEPEISPRQADATEVDVSELVFSVLSSIKDPDTVPFGSAFPSPQLFPLPRLARSMAHAVRDMDPQSVVADMTPGNHGLRRQIALRYMVGGLLLPVEELVISNGALEALNLCLQVVTRPGDLVAIEAPAFYATLQVLERLKLKAVEIPVHPREGIDLEVLADSLERLPIKACWFMSNFQNPMGASMDDEKKRALAELLARHQVPMIEDDVYAELYFGQQAPKPVKAYDQEGLVMHCSSFSKSLAPGYRVGWVAGGRYAEQIERLKLMTSLSASIPAQAAIADYLQHGGYDRHLRKLRYALETQQNAMLAAVARYFPEQTRVSRPSGGYFLWLELPEAVDSLRLFQLALAQGISLAPGPIFSATRRFAHCARLNYGHPWSARQEKAMETLGRIAQSLAG

SEQ ID NO: 28314 - protein, 146 aa, Pseudomonas aeruginosa
ATTPGARYARRARKESSRRPAWPEPRQRVPSLPEPRPPRCGQGSTADEENHHGIQLERDPAGAAGDRRAVLRRALEPAPRQDPGPGEHAAVRRRRGGGPPGRAGNRQEPHRLRLSRSLPGRLPALGQELAGMTPASRFRALSSSAR

SEQ ID NO: 28315 - protein, 99 aa, Pseudomonas aeruginosa
AVPATARAFPRRTAPGCAGSSSPCRRSWRRSTAGPFPSGSRRPAAGPWAPSSAGRCRRAPGAPARRSCSGAGCRPGWPTGSSPSRPAGAGCGSPATAAR

SEQ ID NO: 28316 - protein, 438 aa, Pseudomonas aeruginosa
NSPCNRRHPYLQEQQPREESMITACPRPCAWRSYALGLGLLPLAAQAEFLADSSAHLDLRNFYQLRDYRQHDAPQSQAGNWSQGFVLRLQSGFTGGPLGFGLDATGLLGVKLDSGRGRSNDGTLPFGANSKEPVDDYSHLGLTAKLRYSQTQLQVGILMPQLPVAFRDDVRLLPQTFDGALLTSSEIEGLTLTAGQLWKSRTRESAGSDDMYIMGRDKAHASDEFNLAGATYAFTPRLSASYYYGQLKDIYRQHYLGLLHTLPLGEGLSLRSDLRYFDSGEDGAAISGPVDNRNLNAMLTLRAGAHAFGIGVQKMIGNDAFPVLNGYTTPYVANLMAYQTFTRPQEKSWQLRYDYDFAGLGLPGLNLMTRYVQGRDIDRGAGRADDSEWERNTDLSYVIQSGPLKSVALKWRNITYRSRYGADLDENRFIVNYTLKLW

SEQ ID NO: 28317 - protein, 103 aa, Pseudomonas aeruginosa
RNSAMQLATLQELSFDEIDQVSGAGLFSFVGDAIVDVVKVSNDLLNTSVISSVGKVFNAVGLTPIHQLADTLGYGVFKGVAAVGGLLGGDTSRIDYHYDTEWT

SEQ ID NO: 28318 - protein, 143 aa, Pseudomonas aeruginosa
DPATGKGRPAPRSGEPPCTTSSSTPTPSSAIPTRNPAACRAAASSARVPRSARSAWWPAGPRPSSSSPPKPPPAVVRRRQAFRPASNFIGGRSAIGRGKSPPTTSGAAPRAPTKRFSRWSTGPGRTASRCARAAWVTTGPRCC

SEQ ID NO: 28319 - protein, 665 aa, Pseudomonas aeruginosa
CRPHHHLIRKVALRHFMRLNFRKGVGVSCKYYSNPGSSHHVSPGSPRRPACRRPGRDRADPPGLLHFSHPAGRGDGAAGGGLLPVRQLHQAQHRQRPIGARQRPGQGARAAGRHRAAQVRPGRPGGTTRRAPDGAFQRTLRQRCRAGAGRHQQAPGTTPRLPARRTGKASPPARRRARQPDQQGRQPAARTHHPRRPDRQPATPAGAGQRRRRALPGADGQGLHLHGPVAAAPGRAARPAPDAARPGARTHVAAAAVDRAPQRTRRAFRAPGQPARGNPPPAQRGGAGPGRKRSQAHLAGHRAGERHRHRRARRSRADRRQLASAAEHRSRRHPVAGRTLRAEQVHRFHPAGRRGADPLPGLSVPEVRPVPRQGAVDLPRQRLLCRAFQHGRRRTGARPGWRAAVPAAGNPRRPGGDRLRPAASAAERHAAGRRHPPGHPAPLRMGAGTALQPDRQTLGTTHGLSRRSRPAPGPPPAAGAADRSHRMRPGLPGDDRRLPRPPYRPDGTAPALLRIAQGHLPQATDPDRPPPRPGYPRGEARPRRPRQAQAALRAALELQPLRRAQGGRRARRGAPRPRPRPAPAGPGGSLAELHRGSPGTLAGERLRETGGAAADQAAGHARQGHRAVPLAGPGAAARRRAGSVLADQSVLPAMDHRQRHRQRRP

SEQ ID NO: 28320 - protein, 381 aa, Pseudomonas aeruginosa
PAQHPGHRLRPVAADAAGGQRGARLGDDAHEHPARRAVAGQRLQPPAAAARAVFREAPPGRRGVALRRGEQHPADPHRGLPLGGAGRPDDRRHPRHDAALQSATGGHRHRRHEPLRPRPLDLVPAVAQRHRGADRPRRAPAEPFPRDGARHPPAEAVPAPGRAPLGMARPAGGTDQRRPAYAEAATVLPAAQRPAVRRGEPAGDLARRDHGDGRPVQRRHPDGLQRLQVAVRQPRRQPDRQVLRAAHAPVAGRAPGRHRAPGPGGQPRRHPPEEPSRARGEHRDPGPALPLRGTGALGPRRPRPAHRRRRVGGHRRPLGLRQEHPVQRPAGHPPARGGTDPPWPAWTLRNWAWKGCANWSARCCRTTCCSPVRSTEQHQFF

SEQ ID NO: 28321 - protein, 217 aa, Pseudomonas aeruginosa
ASTKAPRAWPNARPPRRGSRPDACPRRPVVRPARPGSRRRRLRAGRVRHRRPGRRPGGLRPRRQRFALPRRAATDRAEPGGSHRADPLPRPTDPPRLGQCQGGPGRDRQVRLPAAPGRPSRRQSRLQRHGLSRCPLPLRRRPSPPAWRQPPIELGAVRLRPPQRRPAQRPAVAAGGQRQPGRDPAEHLRPRRPGLLRRPRRPAQPGRLAAGRGAGGA

SEQ ID NO: 28322 - protein, 401 aa, Pseudomonas aeruginosa
GKGPPAGRPGDQQLPDPAQPRPAHLRRFHRRYLPHDVHPATRLRGTGDGAERRRRADPHPGADPRRRARHDRRGDAQQDRHGRPARLAGAAAQARPAEPGLPPVTAALPGIPLEAWRRRGRTLDFKGFPIRYWEAGQGRPLLLIHGFPSAAWDWHYLWEPLAQRYRVLVCDLLGFGDSAKPRAHRYSLLEQADLQQALLGRLGIDEPLHVLAHDYGDSVAQELLARHHEGRLRLASCVFLNGGLFPETHRPVLSQKLLLSPLGGLFGRLFDRRALARNFAKVFGPRSQPGETELDAFWSLIESNQGQRVMHRLIRYIVDRREQRERWVAALQHGGVPLRVIDGAVDPISGAHMVERYRQLVADADCVLLDGIGHYPQIEAPAAVLEHYLAFRARLDDSEFS

SEQ ID NO: 28323 - protein, 456 aa, Pseudomonas aeruginosa
GAGASLDEAFRHPWRSPCTIPFLPCACSTRAPGCSASWCRRNRSSASPGWSSPNSACCWRSGSATCAGRKAVAGTPSAPASRCSAACCWWWSGTTTTGGCSSSARVAGCTFRSTEAEHPAALSGAIHGGAKPCPRRRAGRHSGNPSYCPGVPNMSDALRFDDQVVIVTGAGGGLGRAHALLFAKHGARVVVNDLGGSTHGEGASASAADKVVAEIRAAGGTAVANHDSVTDGGRIVENALDAFGRVDVVVNNAGILRDKTFHKMEDADWDLVYQVHVEGAYKVTRAAWPHLREQAYGRVVFTSSTSGIYGNFGQSNYGMAKLGLYGLTRTLALEGRKNNILVNAIAPTGGTRMTEGLIPPQVFEQLKPELVSPLVVYLGSSACEDTSGLYEVGGGWIGKVRWERSLGFGFDPKAGFDAEDVAAHWQQICDFENAAHPADNVEALREMMANLQKHAL

SEQ ID NO: 28324 - protein, 273 aa, Pseudomonas aeruginosa
RPGRAPGRSPPRPTTAAARWPPADSAPATGSGPAAAGWRHSLPPPARSIRRVVRRARCAAGRVASAAPGSSRTAARPGAPPRGPGRARAWPAGWWRSAANGSPRSCRGCATAGRVPAASASGSRFRPGLRHRDHADRRAGGVPVPGSAPRSRARRPCGSRSRCLPLAAPARLRRESRAAGRSRPGAAPAASRRAGRPRRAGCPSASRRCAPRRRSRRFLPRRWRRATAAPGASGNRRSRGRCSRRRRWPRRPRGILPGTGALRADRPVDSSTG

SEQ ID NO: 28325 - protein, 679 aa, Pseudomonas aeruginosa
PSRGWRRRDRGRREWSVRAACSEGCHRRRRRNSAALSSMHWMTAYPSCIWRSPRRFPGPLFTLSGDSRNTSLVRLPPFGPLGRVYPPRPCQESRMTTTKRRGIFPLHALAAATALGCATQASAVSFNIGEIEGQFDSSLSVGASWSMRSADKDYIGTRNGGHASSQTSDDGRLNFKKGETFSKIFKGIHDLELKYGDTGAFFRGKYWYDFELKDEHRLLYDIDDHNRKEGAKSSGAQLLDAFLYHNYSIGDLPGSVRVGKQVVSWGESTFIQNSINSINPMDVAAFRRPGAEIKEGLIPVNMLYLSQGISDALTVEGFYQLEWDQTVIDNCGTFFSTTDVVADGCERMVYAGSDFDPNPANGYRYLPRAGDRDARDSGQWGLALRWYAAELNDTEFGLYAMNYHSRNPYYSVIAGNGLATSDPVTGRSTGYYFIDYPEDIRLYGLSFQTNIGSTSVAGELSYRPNMPLQINSTDMSIAAIYPTTLFGNPIYDSGFATPRAGEVINGYVRKPVTQAQVTVTQFFDRVLAADRLTVVGEVGYNHLSGVDGDDLRYGRDAIYGIGELPNNALCTGALNVANPQECNSHGFYTRNSWGYRLRGILEYPNVFAGVNLKPNLAWSHDVEGYGPNFSEGAKAVSVGLDAEYQNTYTASISYTDFFGGNYNPINDRDFLAVSFGVNF

SEQ ID NO: 28326 - protein, 202 aa, Pseudomonas aeruginosa
TTRRSAATSSASRPRPPTTRRPPCATPGYAESRPVATSASACADALVRYDGPSPGAIIVQQRGRRGLGSRQGASTEQEHCHDRADRAARRLAAAAAAAPAAAPFAPAAAARRMPPATALRARWQRQDRPPRRMRAAGAAWRAGGLAGAGRGSAGPRDLPPPPGRRPRLARGKRRSAAVPAVAQRIRAVAAARRLPTAPRPRL

SEQ ID NO: 28327 - protein, 743 aa, Pseudomonas aeruginosa
RLPRLLVERGLATGGLVAGEPAAAAVQPGAVAAGRGVAGGRRRPAGVRCRRGRRTAPPARSQRRCRCDRGAAGTQRRLVRRVALAPAGRRRDGRTVVAGIPPARVARRAAAAAGRRRACPGLAAASRSGAVPPAVRGAAPRAGRPVGAGLPPAGRCEPALQPATGDPRGLARSAAAPAAGLPPGSLRMVRRTRRDPRGGRPGAGRRRTGNRRRIVAEAHRGAIAARPQHRHGPGPARRTAGGAAGQHAAPGDPECLDAALRRTPGRSRGLHRPVGALPADALGVPPAGAAGAMAGLVRDPPALPRRARRRRLPARGAGATAGGRLVAGTDLPLGADATGDNRGADGPGAVDRPRCLAPGARARQPDLRGADRTGAGAVAGAARRTAARGRRPRSRPALPGGPRPAGQPDARPDRPAPRAPVPAAGPRGRGRALVSAGAGAGTGESRSLGALRLPGTGLAGGRAGRPGRGVQPPAGGRTADAAAPCPRSAVSRRAAAGQLRPDPAAGTAGAGAGDPAAGPRLLPAGTGAPVAALRTGAGSAGRAPIGTGRTLQRRGSRRRSAAARAARHSRGAGAADAALRSAHGYRRVPVPLRTIAPGPADPAQRPGAGGAARPATAAAATAGSPAATVRRPAGGRRGGAQSAQLSGAGGARPDRPGLLQPGDRRATVHFPAHGEDPRPADQRQARGGPSDPGGGAGQGPRPAPPERPQCRARPVGGASSPRRWPRRSCSVGSSLSKSARSRS

SEQ ID NO: 28328 - protein, 198 aa, Pseudomonas aeruginosa
SSARRTWTIAARCSRPSGASSKASAEATSLRWTAVPPAPTWTASPSRPATSPAPPRPATPRRIPPSACSPGFAPAPRRASAATTWKACGSRCRGSATSATHWPSNWRRSAPSCWSATSIPAGCNWPSSSSVPIRWRRRHCSPPLATSSRPAAWAACSPARASASCAARRWPGRRTTSWSGRRSPTSWRRAASSMRRTT

SEQ ID NO: 28329 - protein, 148 aa, Pseudomonas aeruginosa
TWRAPGSCRCSSWSTTTSGRSRCRGASSAARRPWRRMRWVPASPANRWTATTCWRSPNASARPWSARATARGRPCWSASAIASATTPRPTTPAATVPPRRSTRPGARNRSSACAPSSPAAASGTRSASTRWWGSARRGCRSRWSVSRR

SEQ ID NO: 28330 - protein, 265 aa, Pseudomonas aeruginosa
AQRRSDTPGRSGGGQPGVAPGHGRGRDGGGAGRRRRGQRRGVSRHPRPARALRLQAGAGYAAGGEHDRRAVHRHGRPGPEAGDGDPVHGLHLRRHGATGVPCQPPAQSHPRPPGLPVGAAHADGRGDPRAGAPQRGDRGDVRAHPRRPRAGAVVAGAGLRPAPGGDRRSRSGDLPRADPALPDEPAAAGGRRPAPAAGQLLHPSRRRRPDPGQLGRQRPRDPAGRRAPGAARHRGRSDRRRLPQAARPRHPRSLGAQDRSLRDRP

SEQ ID NO: 28331 - protein, 228 aa, Pseudomonas aeruginosa
GAEEWRPRRGNRREPLRACPVRPAGADPAGRRGRYPAAAVPPGSAVHARRGGHPGGLRHRARLRLSQGETTMKHFKLPDLGEGLQEAEIVEWHVKAGDSVRADQRLVSVETAKALVDIPAPYDGVVGKLLRRRRATSLPRRRNRWWASRPRRRTAGTLGGAPGGQAVTPWGTVCSSGPHRPPGEHLGTAPPTPGGAPSSPAQQGVELAGMSGSALDGVITISDVEAAA

SEQ ID NO: 28332 - protein, 217 aa, Pseudomonas aeruginosa
GARECFGGERLRGVRRSMALNMARSHAEVVPVTIYGDADLHRWKTARDPLIRLAQALAEACRAEPTLNAWFDGASLSLKLHERLDLGIAVDTPDGLFVPVLRDVGARSAEDLRAGMRRLREDVQARSIPPAEMLGATLTLSNFGTLFGRYANPVVVPPQVAILGAGGIRDEVVAWRGEMAIHPILPLSLSFDHRAATGGEAARFLKVLVNALEQPDG

SEQ ID NO: 28333 - protein, 434 aa, Pseudomonas aeruginosa
SAPALQPPCQQRAEGIGEQVEAVGGATENDAQHGTGKLPMQLRRQVLAQFQQRADGKGGGCQPGGRRPERAAHQVVEPDQRQQVAAEAAYPAPMPAQGGEQDQQAEQQQCQQQAAPVQAPASGADGGGGESGHGTFLVDGAAGRCTASASFRQAGRGSDKRRADSAASQAGEQLFDEGVAAGAVEVVHLGTVEQVERVVGLAGLAAAQAIDLGAGHAVAADAGAPVAQAEGLALRLETLALGVGQAVQRQGSEEQANLSRKVEPFALVRAHLVAFEQAVGEVMTLGVASDQQVAAVQQGGGGPLQVELQSAGAAQGQDLRGAGRGCRCLGVRGPEWAGEGRGAGEAEEDAQQAGKLSRHVSAPCALLAAAAHSSAAFSSNSSLRASGWFLKARAKASRFFAMKMPSSSTCSSFSDGTAFCSTSASVSASSSILS

SEQ ID NO: 28334 - protein, 92 aa, Pseudomonas aeruginosa
GCAPAARCAAHTFRPARMPGMQDFGFALLLIGYVWSVASGGRRSIPCALLCLLLFPLAQLAFAINDAPMRPPLALAALGAGLACLGGGSVFG

SEQ ID NO: 28335 - protein, 141 aa, Pseudomonas aeruginosa
APASHKNTIENHYHKKYAAALLKGRGWMRRWRSRISRHCFSGMPGSCSRICCARPVIHTWRRTWRRKASCAWPSSGTRSRSSMSTPISTAPRTTSPSTITGRNGGAAPRPGPTTTSPGSSPTSPAPRSPRWMPMRLPACAR

SEQ ID NO: 28336 - protein, 359 aa, Pseudomonas aeruginosa
CSHSTILAEWITESCRFARLNLYNDQREPHVNSPQEQQQIRQQAAEWAIRLDGGDLDRSRREALDGWLAADPRHPAALALAQRTWKQLGSLAEPRTMVQTPVASAPRRAGGRRKGWRGWAAAAAVLLALGSAWSERDAGVTWLADHSTGKGEVRILRLVDGSEVELDAQSAIDVAYDSRERRVRLLEGSAIFRAAPRAGRETRPFVVESAGGSTRALGTRFLVSRNDDGSVQVGVLEHRVAVALAHPRTGTVGRRELGEGESLRYSAEGGVEAPLGGRLHDLTSWRRGLLVFDEHAMGEVVALLNRYRPGAFAGGSRCVGAPAGHRGIPGRRPGRPRCTLSAHELGVRSPGLAGGTLLY

SEQ ID NO: 28337 - protein, 133 aa, Pseudomonas aeruginosa
PPRCPTTTPTCSTPRTRRSGKSSAAATCVRRTSPSTTATRRTTRWWTSRPSSTTSTTATASRPCNAVSPPATRSPTRPTPTARRRRTPRPSLSTISPRCAPTMAWSSSTTRCGRTPASRGRAPRRSASLRPKA

SEQ ID NO: 28338 - protein, 227 aa, Pseudomonas aeruginosa
RAKPERAFVRSGIHHSLNWSFGMSISISYSTTYSGWTVADYLADWSAYFGDVNHRPGQVVDGSNTGGFNPGPFDGSQYALKSTASDAAFIAGGDLHYTLFSNPSHTLWGKLDSIALGDTLTGGASSGGYALDSQEVSFSNLGLDSPIAQGRDGTVHKVVYGLMSGDSSALQGQIDALLKAVDPSLSINSTFDQLAAAGVAHATPAAAAAEVGVVGVQELPHDLALAA

SEQ ID NO: 28339 - protein, 492 aa, Pseudomonas aeruginosa
NPRHPRPLPPGAAQRRAVHRGDQPADAGAVAVHAAGLRPGARLRQPHDPADADPHGARPLPAARRPGVGAQPGGDPPRRPARHATQPAHLRRLVPRQPGARRAGRRAGAERPDQPAPVPHRQRPVRLLRRALVPALPAGDLPLQSLARPARPGWGAAAGAACLGQRKPLARTAGRGRATVDPRHPAGLGQPAPGGNPGGNGHVAGHARALVRPAPGLPCPAEPRQRAQRGDRRDLQGRAPGPAVAGARPRRLAGGGRPDHPGDDDRRLDPDGPRAQPHRPVDRGLAPVERRAAGLPATGAAARGESAGRPGHAATGAARRVARRAALRGRAGTRAGIVAGPRFRPGTWRSARRDRAVRFRQVDPGALAGGRLAAAVRRGAPGRRRPAALERGGTGAAHRLPGPGRATVRRQHRREHRALRRGGCREGGGGGAPGRRARPGAAPAAGLRHAPWRRRRRTLRRPAPAHRPGPRAVRATGADRARRTQCQPRRGG

SEQ ID NO: 28340 - protein, 535 aa, Pseudomonas aeruginosa
GGPGRGHRGDAPARQQPGAGHPQAGGAGADRQAVVAAWRAPAAFRRDRRGACQRLAAGRCGPGADTADAGVRFRLPAGTGDAGRRCAGRSGAMSGQARLREVGAGGAALELDEKRFSRLGWGLVLLGFVGFLLWAGLAPLDKGVGVSGTVMVAGSRKAVQHPTGGLVRHIRVHEGERVEAGQVLLEMDATQARAQADGLFAQYLAALASLARLSAERDEKARIEFPAELLALDDPRLPTLLEQQRQLHDSRRRALRLELDGLAETVAGSQAQLDGLQAALRSKEQQRAALEEQLRGLRQLASEGYVPRNRLLDSERLLAQVNGEIAGDLGSLGSTRRQILELRLRMAQRREKFQEEVRASLADAQVRAEELRNRLASARFDLANSEVRAPVAGLVVGQEVFTEGGVIAPGQQLMEILPERQPLLVDARLPVEMVDKVRVGLPVELMFSAFNQSTTPRVEGEVTLVSADRLLDERSEAPYYRVRIRVGEEGVRRLAGLEIRPGMPVEAFVRSGERSLLNYLFKPLADRTHLALGEE

SEQ ID NO: 28341 - protein, 184 aa, Pseudomonas aeruginosa
IACEPACCPPRCFRPLRPRRWACWTPTNWRCATTRPSRRRSTSAALAAKTAPSAVPACCRACATTTTRRATTPPSARATPASSATIAATPRPSAWSSRCSTTRPTRATARARPRRCSPTNSSAGAARNWRCACSPPTAKPCSPASRWSWPRPSGAPWKPSWRSTSVPSRKARAPAPTCWRPAPG

SEQ ID NO: 28342 - protein, 391 aa, Pseudomonas aeruginosa
QRRGAASPAGSGSIATCWTPNSSSTAPAATWRKRATPTSTPGCACASWRGCWKTATWRCWLPISVPAKDARRSPLPSDSYRPACLALGHRLQQLRRAGAVFDGDAEADALDHPLQLLQVMQLRRSDQALGGDPAFVGEGEDDAAVRPLQAEVDPVLGLEGLGEELERAAVGHGGPPECCRAGWDWVSPGKFFVTAGLYPAPTCGRLSAHVPWPGPCTLRARWPSSLSGEAMKQNWAERLRASMHHQAESLGNLLVEAFHYLALFAIGATVFWAAGAAFLGMVNKGHASIDDILLLFIYLELGAMVGIYFKTNHMPVRFLIYVAMTALTRLMIADIQHNHTPDDGIILVSVALLLLALAILVVRFASARFPSAKSDGAAARRVASEDAEGEA

SEQ ID NO: 28343 - protein, 242 aa, Pseudomonas aeruginosa
ARCRPRPRRRGAGQSRRRPQGRPRGAPPGVAGRGAPGRRADRRATGADRRPAGARAGQRRGRADPRRTGRTDQRLQSAADAGAAGRQLLRLQPARGHPGQGAQGRPHRHAGARPGRRRGRDRAALHRPAGRFLDQARDPRHRRFRPEDLRDPLLPVAADTRPAPGHERAVALDELSDGVGRAEAQRQPFRPGVQHRDADRLPQLDHPLARLVLAAAAVRRDQRRLPGRYPAGHAAGGDRQGP

SEQ ID NO: 28344 - protein, 700 aa, Pseudomonas aeruginosa
PTVAQVDPRTRRDLPRPGDHRSRRRPGGARRDPSGRCLRLALHPAGLRGRRARRARAEGRAVLQRAAVFGRLRRHPGLLGAGRQPQRRIASAPGRRDAGGAAAPGEHQRVLRQPVQCQRQLHLLPAVRRHRAPATAVRDRHHGPCAGPRGAGTARLLAAHPAGQGPRRTPGGQAGALHAAVHRAADAGNLPAGGVLRRAHQRQPAGDADDHAVLRDRRAERRAGAVRLHRQPLHRLFAGGHADRRRPDLLGSADPGTGDADPGAGDRRGRAADPHPARPVRPVPAPGAAQFGALHLRQAGAVPADRLHDRQDAPAQPPGPEPDMKNYLQILRETLKAMLSKPMWLMVVASVCITSLPYMNHTALDLPVAVVDEDHSDVSRELVRLLDSAPKVAVVGYDSLPQAKRDLAWRELYAIIVIPLNFEKRLLRGEALVIPYFGDATNRMANGQIQQDISAVYSALTNRYNAALLEREGFTATQAQVVLSPLVGQLTDLFNPGISFAAIVLPGLLSLILQHSLLLGCTRGNIMLRGGTPRYMRQPLSTRFGRYSAQLLIWSVLAMLFYVIWPHLLGYRQSASFFMLLGIVLPFLIAVIALSEFIAELLPTEESVYLTMTFITLPLFYMAGYSWPEQAMPDWVRWLADAIPSTWAIRAIAEMNQMDLPLREVSDHALVLLGMAATYALLGTLLYQYRNWRWDNVKGW

SEQ ID NO: 28345 - protein, 338 aa, Pseudomonas aeruginosa
STPSRCPIPRTASTATATCPWPTESGNQRQHDLVAAADPGGLAAAQVEELAHGRSLVLLLVPDEVELPAQVQAGRFHRHQAAAAESVAQGQAGNAADAQAGLHGTLDRLGVLQLQADVQRPRVMTHGLVEGQAGAGALLAEDPGLPRQPFQVGAAPPRQRMLGGAEHHQFVLHPGLHLDVRMPAVALDQAQVQLVVGDLLHHLGGVVHVQAHPAVRLALHEGADQQRGQVVADGQGGAEVEGAEGGLAVEQVLDFLAAVEQRHRLRQQLAAEGIEGQALAGAVEQLAVELPLQLAERGAGRRLRQRQPLGGAGDALLLGHGDEHLELAEGEFHPGFLV

SEQ ID NO: 28346 - protein, 261 aa, Pseudomonas aeruginosa
ESLMSNLYTERVLSVHHWNDTLFSFKTTRNPGLRFKTGQFVMIGLEVDGRPLMRAYSIASPNYEEHLEFFSIKVPDGPLTSRLQHLKEGDELMVSRKPTGTLVHDDLLPGKHLYLLSTGTGMAPFLSVIQDPETYERYEKVILVHGVRWVSELAYADFITKVLPEHEYFGDQVKEKLIYYPLVTREPFRNQGRQTDLMRSGKLFEDIGLPPMNPQDDRAMICGSPSMLEETSAVLDSFGLKISPRMGEPGDYLIERAFVEK

SEQ ID NO: 28347 - protein, 274 aa, Pseudomonas aeruginosa
ASSRAISGIRKVARLVRLATVAGTEVKPTWPAAAAPNQAMPTESRANSRLIASSQRLRRPSASSLRAMVQTTGMAWLRRGRGTCGGDRGPPATAAGFPGRTRTRPAALPARRRARHRPAVPRCAGRPVSAPPGRPGASVRATAGYAGWPGARGSAEPPCGAIRRGCRPLAGGRRRESRRGRCASRRRAAHGSKGRSRCPGRAGGRAIGRARRWPAGRGPPSVRRAAAGAVRRAAPGPGRGAGACPSSRFSGAAWLHGRGRPVPAGARLRPAPRP

SEQ ID NO: 28348 - protein, 445 aa, Pseudomonas aeruginosa
SMSVLSRLPSTITCQATSMVSASMALYRVKALSPDRSKVEPSLGWGMMNSALPEHVAGMRHLLQAQAVDRLDVGNGDDAVAFHDVQADARDPAVGLVVDEQVLAVVLAVGHRDVRMVAVAVEEARAVPEDPLALVGQAPAGGRVDVEHRYAHQLAHRRHAEHAYFAGMSAAPEPVVLIQFAGGDLGLAALALARGPGLAADHRAAQGAGANQGGGSGQRRGAEEAAAVQAVGFFVGAFRVVAHLVSSSRAVRGKGARSEVLRGYPRVVRRRALRALLALVHQRRALVLVVVGHLAVEAVVAFVGLDAAVGMDRLDLAFAGTELAGPAAFRAALEPVEQARLGRDRQGRAQRAEVAAIDLAGEQVDHQQRDGVGDEPPLAVEAEGDGGLERLHLRGLLGQRQGFQGETEEHQQDDVLDRPEPLVHGERHLELRHAELAREFVEQFL

SEQ ID NO: 28349 - protein, 519 aa, Pseudomonas aeruginosa
LAEAVPAQVDQGERQVAGAQSLHQARPSHQAVLEEEDRQEQDEGGTEDPDLETLLVPDPQPQRPGSLFQGGQFLGRWLRPLQVFLGRLAGQLEAGEYPRHRAGLAPHEQLQGPGRARIETLAGAGDEDRHLAELRHAFGVDVRQALVVEVAEADDVAELAQLDPIEDATAHVAGTLEGILAVAEHDEGVFAWLQRRHQFAVLVVAEQAAAHRGRVEQGAVEIDERLVAVRRVGFADAFGLAALEGVVDLPATQLQAADRTVAEQFAPARRRCRLLAHLRRLGPHIAAVLDQAEGNRHRMCGAHDDLVDHHHRHRGAAHRVDGNRLRVAGAADHHPLVGAHAVVPGAEGVQLLFRDADQQDRFVVFEDVGVADNRLRIEDHLQVDRLAGVGRDVGDAEGLEGVAEGFLALAQAAYAVVAFGVADPLDRGEYLGDAQALQLAEFGTLGGEADQQEHPGEDTPPRSGGKTKGAHRFHLLLATGEKRDAALRWGLRLAVESLPLPDARRSGGGTRLMKVKKWR

SEQ ID NO: 28350 - protein, 345 aa, Pseudomonas aeruginosa
KPAKPCPGVLSMLKRFSRVLAASALLAGSLAGMAHADQPVINFGIISTESSQNLKSIWEPFLKDMSQQTGYQVKAFFAPDYAGIIQGMRFDKVDIAWYGNKAAMEAVDRAHGEIFAQTVAASGAPGYWSLLIANKDSKIDSLEDMLANAKSLTFGNGDPNSTSGYLVPGYYVFAKNNVDPVKAFKRTLNSSHEVNALAVANKQVDVATFNTEGMERLELTQPEKARQLKVIWKSPLIPGDPLVWRNNLSDEQKNKLRDFFFKYGANAEQKKVLADLQWSKFQPSDDDQLLPIRQLELFKQRTDVANNANLGAEEKAAKLKALDEELAKLEKRMAEREQKTAANAG

SEQ ID NO: 28351 - protein, 534 aa, Pseudomonas aeruginosa
STPGAAGAAPHPIRQYRCRDSRYEHSEHHCRGGRHRQAILGTPGRLGPVPRHPRLVLEGRGNEPGRAVPRRRQHGDLRRRLLPAGLRQLEALPQRDAGHRADRPLGHGAGDRLRHPAVDPGFREHRALVGLPAGAAGDGCLPFDQRDGLRHALRGRRRPGPVRRRAGAVHQYHRGARQALRRGGRGDRPRSGRRRPRHRCQRPAGGHLRGHPAGPAAVDLLFAVPLRVQRAFRHSGRDGRRRRHRRDPLGGHPRLPVRPDLRRADRDHRGGEPDRRSVTTPAQAVHLTTRGGRLVRPFQTMHLSRQSEPLYRELAERLRQELLAYRPGDYLPGEIQLAQRFAVNRHTLRRALDELVLEGRVLRRQGKGTQVLEAPTIYPMGAANAYTESLSAQGHRVEARLLEARQRPAGAADATHLGIGEGGRVLELTTLRYLDGQPVSLIRHCFAVSRSELLADYQGGSLRRYLADKGLPLTRTYSLIGARLPNREEAARLLMPRHAPLLTVLTLSRDRTGQPVELAQSISRADRFQYQVAP

SEQ ID NO: 28352 - protein, 155 aa, Pseudomonas aeruginosa
EKPMTALHSDPTIAARQRWMGVLARARREELDAHADALRDADYHLLRAAETGMTLVRGRMGGTGSPFNLGEMTVTRCVVRLGDGRTGYSYVAGRDKRHAELAALADAHLQGADAAAWQARLIEPLARTHAERRAAQDAEIATTKVEFFTLVRGED

SEQ ID NO: 28353 - protein, 705 aa, Pseudomonas aeruginosa
APGSGHSAPHAPNSPGAWMPSSPPASASSACHAVPGSANPSRRWPDVRSRQGWREGHRQRPSPAGAQAPRRYRAAGAVGGADPPADAAGRVAGDDRGFAVRRATGGTGDQAGGRRPDGSDLPPPRLPHHAAALRRQPAAGYRRDAPATADLGDLQGPAGRATARSDLRLYPSPARLQPARRGRLPRPRSGAGRVPGALSARARPARPGRPDDAGVRTARRGAGYHPRAARLPHRPRPAPAGPGPRRRGLPSRPGLFDPARLRPQPSVRRGDPHRRLRGLAGARGTRLRGAGGRDRGHRVRDGQPVRRFPRGAAAIHPWLRPGLRLRRTQGDGHGPGRPRPARRGIRRGGGVAGAAGRVRPDALRQRRGRWLRLAPEAAALRRFPVRAGADSQAASSRRRRIRATHCPGEARMSLSPQASAAPEQGYNFAYLDEQTKRMIRRGLLKAVAIPGYQVPFGGREMPLPYGWGTGGMQVTAAILGADDVLKVIDQGADDTTNAVSIRRFFARTAGVATTERTPEATVIQTRHRIPETALSGEQIMVYQVPIPEPLRFIEPSEAETRTMHALNDYGVMHVKLYEDIATFGHIATSYAYPVTVDERYVMDPSPIPKFDNPKLDMNPALMLFGAGREKRLYAVPPFTRVASLDFEDHPFEVQRWEESCAFCGSHESYLDELIVDDRGGKRFVCSDTDYCTQRRACQEEGEDAQ

SEQ ID NO: 28354 - protein, 291 aa, Pseudomonas aeruginosa
WSCAVRGWWKPVSPTRFSTTRSIRTRNCWCRRSCNPEPKRRRRSARRAPGEVAMNNLIEVRDLSKTFTLHQQQGVVLNVLRGLNFNVAGGECLVLHGRSGAGKSTLLRTLYGNYLPAGGSIRLRHAGDWLELVGAEPREVLAVRRQTLGYVSQFLRVIPRVATLDVVMEPALARGWSRDSAELRARSLLARLNIPERLWQLAPGTFSGGEQQRVNIARGFMVEWPILLLDEPTASLDEANRQVVLELIGEAKAAGAALIGIFHDRAAREAVASRYLDMSQELSRQEQAHVV

SEQ ID NO: 28355 - protein, 229 aa, Pseudomonas aeruginosa
TRSQQCPGSQRRAGLRRQRAAARRPDRRGRRRPQPPGRGRGPGGRLPAARSGRAAHRQPGEAHDPASRRRLAIGLGGAGARRADRRRGNHHGVRRAVHRRRQPQGQAHAAVAEDARGHRRGRRQRRRARRPSPAPALRGQPSADAGGVPRTGRASAGATGLGDGPRPRPAPVRQAGEVPRVLPGQVPPERCRDGRLHRRAGSQLRALQRRRPCGHRRCLPGTRPVGGQP

SEQ ID NO: 28356 - protein, 247 aa, Pseudomonas aeruginosa
CDPLRPAARGGDGQPYPGAGRRADRSWRNPRRPARRSAACAGARQQPAGGASGLARRAESVLMTGRLIYLMGPSGSGKDSLLQAAREPLALRGCRIVRRVITRSAEAVGEDAQAVTPAQFDTLERASAFAMSWRANGLCYGIPVQIDEWLAQGYDVLVNGSRGYLAQARRRYPDLLAVLLGVKPEVLRQRLLARGRESPEEIEARLARNAEFAAGLEGPLFQLDNSGDLDDTLRTLLARLGSDRACA

SEQ ID NO: 28357 - protein, 150 aa, Pseudomonas aeruginosa
PPTSTTPVAWRPRAPRPPALRRRAPSQPIGTRPCSSRCRSASPAGSPATSTTPRDARPARPSPPADKDDTHAHPPILPPSRRPRPGLRPGPARAGGRARLELQLQRPRPDRARRRSAHRCAGRHPLCLRQSRQPDPGDQRPRPGHPPRRL

SEQ ID NO: 28358 - protein, 618 aa, Pseudomonas aeruginosa
RSRPDHPRHPWRRQLAELRIRRRTAPGGDRQQPRRTPRIRRRHQGQSHRPAHQGRQRQPGAPAAMGLRRAWPAAPCGRRRRPDTQLRLRPQRQSGRRNQPAPVRPQPGLRRPRPAGRPERSPRRQDPTRLRRPGQPHRGQGPARRHHPLRIRRPRQPDPTGQPGQRHHHLRARRRRQRHPPHRRSRCGHRVSLRRPQSAGRAPLAERPEPRRTVPLRPHRRRQPGHRPPGRHRRCPRQPGVPLRRARQPGRAGTQHPPRPADPARPRDLPLRRGQPTAGDRLPLRPRHRLPAQRRRPGRQRDPGSGRQGAEHPGWADRLPALRPAAAPDLGQRHHSQPRVRPGLPTAAAEGRPLAERLPARCQWQYPAAPPQPLGHPGLPVRPAGPPDRGTRRPGRAQLRLRRGRQPHPTQRQPRLRRHRQQPGLPVRARQQPIDRHRRASGDQRRRRQPHPGPRRAQTGLRRPGPPAKRQPRRPAGRRIPLQRPRPAHRQAHPREHHHLPLRSRRPVARRSRTRRQRPETASPVLPVAGQPAAGHHRRRLRRPGQGRQPDPALPPWRPPRHPAPGYRRQRPDRLAVAVRRLRPRRSAEPGQHPGQPALPRAVLRCGERAALQLLPRL

SEQ ID NO: 28359 - protein, 74 aa, Pseudomonas aeruginosa
WLHAISGARRALSRARRLHGLTRALTGLFNGAYKWRHQVMRISVDVAGPNLTHTYRANGLSRGYPGGPFFVPKK

SEQ ID NO: 28360 - protein, 352 aa, Pseudomonas aeruginosa
QQEVISMRHGDISSSNDTVGVAVVNYKMPRLHTAAEVLDNARKIADMIVGMKQGLPGMDLVVFPEYSLQGIMYDPAEMMETAVAIPGEETEIFSRACRKANVWGVFSLTGERHEEHPRKAPYNTLVLIDNNGEIVQKYRKIIPWCPIEGWYPGGQTYVSEGPKGMKISLIICDDGNYPEIWRDCAMKGAELIVRCQGYMYPAKDQQVMMAKAMAWANNCYVAVANAAGFDGVYSYFGHSAIIGFDGRTLGECGEEEMGIQYAQLSLSQIRDARANDQSQNHLFKILHRGYSGLQASGDGDRGLAECPFEFYRTWVTDAEKARENVERLTRSTTGVAQCPVGRLPYEGLEKEA

SEQ ID NO: 28361 - protein, 242 aa, Pseudomonas aeruginosa
RHRRAVVRHAVSAISPCGRRSFIHAFSERHARPVPPAAGRGTGPGAGESCRGKSAPGPPESPQRPAQPFPFRPGGGDGLPARRGARPGTGATGRRGHAQGGSRGHRRPAPSAVQRAVPRPHRGRQDRDRARPGQGPARRRRGVLPGGHEHPVPGALCRRPHRCAAGLRRGEGGHHPVGAGQAGRQSRAPRHRSLRRTGKGQPGSGPCVAQRTRQRPAAGRFRRTHLPFPQYPGVHDQQSLRP

SEQ ID NO: 28362 - protein, 210 aa, Pseudomonas aeruginosa
PRRLVRQHGRGSAPMSANSLLGSLRELQVLVLNPPGEVSDALVLQLIRIGCSVRQCWPPPEAFDVPVDVVFTSIFQNRHHDEIAALLAAGTPRTTLVALVEYESPAVLSQIIELECHGVITQPLDAHRVLPVLVSARRISEEMAKLKQKTEQLQERIAGQARINQAKALLMQRHGWDEREAHQYLSREAMKRREPILKIAQELLGNEPSA

SEQ ID NO: 28363 - protein, 205 aa, Pseudomonas aeruginosa
AIRADQNNNKRGIVMMLGLVLLYVGAVLFLNAVWLMGKISGREVAVINFLVGVLSACVAFYLIFSAAAGQGSLKAGALTLLFAFTYLWVAANQFLEVDGKGLGWFCLFVSLTACTVAIESFAGASGPFGLWNAVNWTVWALLWFCFFLLLGLSRSIQKPVAYLTLASAIFTAWLPGLLLLGQVLKALQEVGKGWRLAAIPSLPNS

SEQ ID NO: 28364 - protein, 126 aa, Pseudomonas aeruginosa
PGRWCASRRVSAVRSPRCWCPTTATCSPAKYCSASIPSLSDWPCARPNWHWRKPSAPTASWMPPSPRPRPTSWPRAAAPASWTARRAAPPNWCSATMCRSRCTSRSAPRPRPPVPGSPRPRRGSAS

SEQ ID NO: 28365 - protein, 328 aa, Pseudomonas aeruginosa
AICSVARRSSPSACCTTSTDAMPAKLAMSANDLRQCLRIAGGGTLGFFVCKLMNWDYGSFFGVYPMLLLGLTPVINLHIVRQFLANSVVISVEVLVLYGLFGDRPLLMTPIVFGLFVYRFALMARGPLFFFGALSSVFLSMLLHFASYPDVDLFDMLASNMVATWLTVAIAVLMFYLFPDVEPRPPRQAPAKDAPSRRHETLLGATVATLSFVVFQTFDLKDSLSAQIASILVLFPMHWKGVHFAGRIRALGTLLGCALAVGLQVLLYDHYDILPFVALLLWISAMFCARIHMLENGVPGIGFGALTTLAIVLGPDRVKTQQAMAINC

SEQ ID NO: 28366 - protein, 163 aa, Pseudomonas aeruginosa
RRRARNATYRSSVRPAPGPASARRRRSAATVRPTRRPVTQRPPRAPAAVSPVLPSWPPSPRLRRRRRRRTRTGRRTAKETVPADRRIAGNERRSLPASPFATGRPAHRKRERTSTYEEKLWAYVIPAAILKSPLICRAVSKKRGNGGVICRVPYRGYCGHRNR

SEQ ID NO: 28367 - protein, 300 aa, Pseudomonas aeruginosa
DFIFDNFPFAAPYYFRGISTYQPSGRYRDTRRQASMGFPRRGEPYVRPLAFRMDHRRRPGRRLRPGQPRPSRLRRSRRARTGPALRQRLGHRTCLRLAAPALAPGRRQCQRRVGLPRQFTAGKPLPGGFPQAGKRPAGLGQPGAGLRQPGVHRGARPSARPHGLRTGSVLPGPGRPGTDRREGRVPAWQPRPPVAARRLPARPQRRVGRLAQPLRLQRQRGLRTRLPQSRLLRLAMPARRRARAGRYRPLPLLPTGRTPVPVRLAREDRADPRRAADRPGSRAHRRQDLRLPGRRLRHPG

SEQ ID NO: 28368 - protein, 482 aa, Pseudomonas aeruginosa
LPGRRPGPGAQPDPPRSVRTPMDTTFGLDLARVEALFKRELRRFDELHPRSAQAYRENRRHWLYGAPLHWMQQWPGNCPLLVKEAQGARVTDIDGQQYVDFALGDSGAMFGHAQPAVADAIARQARRGSTLMLPTEDSLWVGAELARRFGLPYWQVTTSATDANRFVLRLCRMLSGRDKVVVFNCNYHGSVDESQVEFDAAGRMVPRAGVHPNGVRHDATTRLVEFNDLDALEAALAHGDVAAVLTEPFMTNVGMVPPAEGFHAGLRELTRRHDVALIIDETHTISCGPAGYSGAHGLEPDFFVLGKCIAGGIPSAVWGCSQAQAERIWAVLPHFRPGQAINHFGFGGTLAGNALQLAAMRATFAEVMTEDAYRHMFQLAAQLEAGVRATLEELRLPWHVTRIGARVEYLFMTHAPRNGGEAHHARNGLIEACLHLYLLNRGVLLTPFHNMALTCPATRAEDVELHDRLLRDCLGELLERPS

SEQ ID NO: 28369 - protein, 107 aa, Pseudomonas aeruginosa
YRKSPTERIRFMFRSTSHVRTESAARYVNRLCKHWGHKFEVELTPERGFIDFGDSNCELLAHPDHVLMILNSPDEDSLAHMQNVVADHLQRMANSESLEIAWQPAES

SEQ ID NO: 28370 - protein, 524 aa, Pseudomonas aeruginosa
LETMMKPEDFRASATRPFTGEEYLASLRDDREIYMYGDRVKDVTSHPAFRNAAASMARLYDALHDPQSKEKLCWETDTGNGGYTHKFFRYARSADELRQQRDAIAEWSRLTYGWMGRTPEYKAAFGSALGANPGFYGRFEDNAKTWYKRIQEACLYLNHAIVNPPIDRDKPVDQVKDVFISVDEEVDGGIVVSGAKVVATNSALTHYNFVGQGSAQLLGDNTDFALMFIAPMNTPGMKLICRPSYELVAGIAGSPFDYPLSSRFDENDAILVMDKVFIPWENVLIYRDFERCKQWFPQGGFGRLFPMQGCTRLAVKLDFITGALYKALQCTGSLEFRGVQAQVGEVVAWRNLFWSLTDAMYGNASEWHSGAFLPSAEALQAYRVLAPQAYPEIKKTIEQVVASGLIYLPSGVRDLHNPQLDKYLSTYCRGSGGMGHRERIKILKLLWDAIGSEFGGRHELYEINYAGSQDEIRMQALRQAVGSGAMKGMLGMVEQCMGDYDENGWTVPHLHNPDDINVLDRIRQ

SEQ ID NO: 28371 - protein, 395 aa, Pseudomonas aeruginosa
SAYHAAAATTWNSISDPEEQPRRRLMSLPNANLIASSRKAAAQMATRDTSFIFNEWYVAAFAEEVGRELLARTLLGKRVVLYRTLAGQAVALEDRCAHRSFPLSRSRLEGDGIVCGYHGFRYDSQGELIETPSQKACPRGVGIRHYPLLERGPLVWIWLGDPRLADPKRLPQRPWLEDPGWACSKGYFLHPGNYVSMHENLMDLTHLTYLHANTIGTPDYAGAPYELDLKEGHYRLVRHVLPTTLSPVWGRTTGLDGCPTAARITTSEFLSPGLHQVSATFYDTALPAERRPEFHIRTAHILTPETHGSMHYFIVHGRDFAQDDETVGAFMHEQLFAAFVEDVEGLGALEKVLAEADEDSYEISVASDAPAVATRTYLKRRADEEARQRAAHRVA

SEQ ID NO: 28372 - protein, 138 aa, Pseudomonas aeruginosa
WQRAPAWSTATTTRTRCSPTPSAASGATWSTTGPPPPATSSTRRPARATPWWPTSTSSRCVHSSSSRDRWSGSTRRATRTASSTSTTTSRCAVSTTTRSASAPPTSTPCSADPGRAPPWRTRASPAGRPARPGDRHGA

SEQ ID NO: 28373 - protein, 767 aa, Pseudomonas aeruginosa
QQFRQLRKRPALRAVPDLRLRLLRPPGAVLPVSLHGTGAATEQQPPGHALLGAGPGLGGIRRAGRRLVRPPRAAQAAADRGGDPVLAVLGAVRAGRRLPQPAAVPRHHGPGRGADPAALAIADGRGLLATSPRPQHGSATGLGGRPARRGDRPAAAGGPGRSPRLASRLHRLVAAGSADRLVDLAPCASRPAPRAAPGAARRRSERQAPGTAEEPQHPALHPDQLRIRHLVHRADFLYPDLPGQRPRLQPGDHGQADELPGRRLGGLGLRRTGDIRSHRPSTDPGGVLPARRVLPAGAALCAERDQPRPAVAADLHRARLLHPVHGDHPGGDRLARRHRHRPRPDHGPRRTGRRFPRADRGRLRRRPLRPVHRHVDVLRRRPARRVPLAVPARNRARRAGAPAQRAYLRPARKPTMKALRWHAARDLRLSELEHQAPRPGEVELEVAYCGICGSDLHEYQSGPHSIPQAEAHPLSGCRAPLTLGHEFCGVVAALGPGVEGLRIGDRVAVEPEYRCGECRYCREGRYNLCESMGFIGLMGDGGFAERARVPAYMLHRLPDAVGFRQAAVLEPAAVALHALRRSSLAPGQRCAVFGLGPIGLLLVMLAHLRGIEDIVAIDVSPERLALAGEFGASRALDARDGDTAARLREGGALDCAFEAAGSQASLDAALASLRKGGELVLVSLMGEVRLDAFDLVNRELRLLGSVGYRDAYPELIALLADGRLDLARAVTRSVPLEQAVEHGFEALLRDKSQVKVLVNPNPALADA

SEQ ID NO: 28374 - protein, 163 aa, Pseudomonas aeruginosa
APPCSPANWPGRCWRSAAAASSTSPRCTAPSVPPTARPTAPARAPSSSSPVPWPASMPPSASGSTPSPPAGSTRRWAPGSRPTSRPPAGSCSARRWRAGARRPRWPAPRPSSAVPAPASSPAPCWRWTAAISAPEPPSLRMHLSAWGGQRFARQNNNKTSALP

SEQ ID NO: 28375 - protein, 621 aa, Pseudomonas aeruginosa
WSTWARCWGCSAPPGSLGQPRRQAGTSGRARFPVQWSSVAPMGAGRKRTPGEARQHTQKGADMTSTARRSFDYIVVGAGSAGCVLANRLSADPAVSVCLVEAGPSDRTPLPAAYIRTPAGIIRLIANPKWNWMHRFAAQPGTANQPIACPRGKVWGGSSAINGMIYIRGDRHDYDRWASLGNRGWSYDELLPYFRRSEHFEPGESPWHGRGGELNVAAQRSPGPINQVFFQAAEEMGWPYNADFNGERQEGIGPFHVTQVNGERCSAARAFLHPALARPNLTVLSSALTLRVLLEGTRATGVEISQAGEVVQLQARREVILSAGSINSPQLLLLSGIGPAAELARHGIVQRHELPGVGENLQDHQDIVLMYRTEAKLGYGLGFSPKGWLPLLRSPWQYLFGRRGALTSNTVESGGFLRLDPQAETPELGLIVAPALKNQPQRLVPFGHGVSLHVAVMHPQSRGRVRLNSPDPHDRPLIEANFLSHPADLDTLVQGFQLVRKLAASRSFARHLKGELVPGPQVSSRGQIEAWIRANLGTVFHPVGTCKMGHDQLAVVDDQLRVHGLQGLRVADASIMPTLITGNTNAPAIMIGEKAADLILGKPAPHAPPARQPAVQALAGA

SEQ ID NO: 28376 - protein, 506 aa, Pseudomonas aeruginosa
PRAARRTSSTVPSTCWSAACANASATTPANRSTSRPCAARAMCSRCRCDWSRPIHEAHRAAPAQPRRAPGADPLRRAGAGLRAVLRLAVLRALPDREAHDARQPRTGRGDLGSHARPPDARRARGLAAAPGTTHLPLSPRRRRARPAAGAGRRAGCRALHRTRPRRSIPADPAHGGRQPSALPGPPAPARRQPADHRRHAGPGAAVRLAAAGTAGAVAPAAALHRPRGAHRHRPADPAGEGRGTSRSESSGTASRGNRPTRSGACGGGLQCHAGAHRRLPQGAHAVARGDFPRPADADHADEAARRVHGRLQRQGQAVERSRRDAAPGPRRRGLCPQHARQHRNQLPGGPRRLPRQPGLRLPGQRQAGTTRRPYRRGDRHPSARPAPGAGEPGRQCAEVRRRRAPGSGTPYRWRHANPGAGQWPGDSRRGTRRGAQALLPGGKLAQSRHRWHRPRPGHRAAAEPGPRRPPDPGQPRRRRALRAHRAGPLRRPYRAIHNRPRRTHCG

SEQ ID NO: 28377 - protein, 351 aa, Pseudomonas aeruginosa
RRHPAVWSRRGTARDRGRSVESAPPGAPGRHRRHRRRRSSCPARIRGSPPRRAPSPAVAEAGRASGRGRRRCRSGSWDSSGNGDAPAFPGEREGAARVWKGSVPALLQLAEQPGGHRLAVGLVGLAQVFVGLGFGNEAVMVAIDAVELTGTVLGHREELGARDLAIVIGVGSGKGGVAALALPALALGAGLGRGLRGAAATTLAFLRMGIRGRSPPPVAAHAPTAGRRTPNGRAAFPPPVRHRAGWRKSFDANRKRTCFFSTVNAAGPQARRWWAPVRTGRRDLLGSSRAPRFGCGHFAWEMYRGCIARHLDLYAGGIETAHGYKAIRNRARACRRSAGHLSLPPAHLGYR

SEQ ID NO: 28378 - protein, 427 aa, Pseudomonas aeruginosa
ETATWPSLEVEPIVLKRIPVTQLRLGMFVQSLCGSWLDHPFWKRGGFLLDSQADLQRLRESAVKEVWIDASKGLDLPEEAAVSAAAVLPVTMPAGPSPARVALEEEIRHAALLCSRAKAAVVSMFRDARMGQAIDTAHASDLVDEISASVLRHPNALLSLVRLKTSDEYTYMHSVAVCALMIALARQLELPDPLVREAGLAGLLHDIGKMAVPDPILNKPGKLTDQEFGLVRRHPQNGARMLLDCRQVSALVVDVCLHHHERIDGTGYPFGLAQEQISLLARMGAVCDVYDAITSDRPYKKGWNAAEAIRRMAEWNGHFDPQVFRAFVKAVGIYPVGALVRLESGRLGVVLEQHGRSLLTPRVKVFFSARSKVPIPQQVVDLGRAGQTDRIVGFEPAETWNFRNLDEMWTGLAKSTGSYFDAGTGNP

SEQ ID NO: 28379 - protein, 396 aa, Pseudomonas aeruginosa
PLSPPRLNGSHLQQPPPERQHRAGLLPRLQARQPVAAGTHFGGERTPDALAGQLPGKHRRRRQGHADTLAGRLEHGQRGVEDDAPGQWRVRRQSGRLEPQRPLVGAVGAQQGVLQQVGGTVQLGGDLRAAEHRQRRLEQRQRLGAVPGAAAEADRVVEPLGGDVDAVVVGGQAQIDEGMARLEVLQPRQQPTDREGSDRADGEHVPVVATLETFQQAGDAVEGVTQYRQQALALVGQHEAARQTLEQGHAETLLEALHLVADRRLGHAQLDGRAGEAQVPGRSFEGAQGVQRQMGSNQSLLQIFLMAAASIRRLPQILRKPRFSPPADQGALPGRFLMQPTTKDANPHARYQIPLPVRHRRFHTAVRHHPGHCRRGPGGSPEGTGRRRRTTGDEGQ

SEQ ID NO: 28380 - protein, 357 aa, Pseudomonas aeruginosa
HSGPGRSHQPERRTALLQLWAGLERGRPPGDAGDPVRDRLGEQDLHRHPRRLCPGPGQDAPRRPRQPALAGTAGQPLRRHQPARPRDLYRRRLAAAVPRLGAEGPGTDPRLLPPVAADLCAGQPAPLFQPEHRPVRLSRRAQPGPAVRTTHGAASVPGTGPRTDPPRRARGGAGAVRPGLRQGRPPATGRSRPAGCRRVRGEDQRGRPAALRRCQPASGAPGQALGAGARCHPSRLLQGRRHDPGPGLGSLRLADLPEAPAGRQLDADGAATAQDRQAARATGAGGPAPAEQDRFHQRLRRLRGVRPGPRPGTGDPGQPQLSQCRAGEDRLRHPQRPGAAGQGAAEALKRAREGDGA

SEQ ID NO: 28381 - protein, 228 aa, Pseudomonas aeruginosa
WYAGSRRCPGHRPRRAGVRAGRRGPACPERSAATPGRSAPGCRRNARRYRPAPRPVRPRPLPLPARPWRRSCRDDRAGKAPGAPCRSASPHGRSCPPPGRLRGRPARRWRSWPGSAARRSARRRGFSGSPRDHRYPASACPSAPRRTARSPPAPAERPPARRRRGPPGRPRCSTARRRPGGSARCPPLPADARPATAGCAPPGAAAGWPGRPVRRATHAAPSRPVAWA

SEQ ID NO: 28382 - protein, 155 aa, Pseudomonas aeruginosa
RSAANRASSRPASASTAPTLPIEARPMRSLTTLPSSAPAPMPTLYRPENSAMATSVASEARRRTRDCWARPKHMIDMPQSRLSAISQVGCADSGNSSARLLPKTRIAASMKPRGKASLYRLKKIEPKIPAPPNNSSSRVVASPLIRATCLGNGSM

SEQ ID NO: 28383 - protein, 311 aa, Pseudomonas aeruginosa
ACSTKPAASPKRSWPTCSNRSSASRRTTSATATASVSACTSPRPSPRPTRGVSTWTAATTSSPSACACRCARRRPAPRPDDEDRAQCNACRYLRQPSPSDRIAPFHAPPPPPDRPRLPRRVLRDSRTGQGRSAFAATQEHGAGADGPRLGGDRAGRLRNAAQGFAQQSGNLLAQAAPAEQHRRQRAGGDPHGPPAARIRLRRAGAVEQRLPGHLRLPAGGRQAQDRTRLRRPAPSLLRPRRLAALALGQRHALRLRRLLPRNGYPQHLGTGHAKHRSQTDARAFGEGTGAVPAELNRRLRGTSEGARWRWR

SEQ ID NO: 28384 - protein, 157 aa, Pseudomonas aeruginosa
SAAPPPADLAGRRRHGRPPGLRPPDAGRAAGGTAPWRCDRDGRRRSPPRPPARPRPAGARCPGAVPGDDRRDRRPDRDRAAGAGRRPPGAPGARAPARRAAPARTACPPARRSSAAIAGRRSGFRSAPAGNRCRHRAASAGGRFRRAARHVRTALPA

SEQ ID NO: 28385 - protein, 217 aa, Pseudomonas aeruginosa
RRRRHPVRRRAELQGPARQPPAGVPAAALPEAASEAGVVHQDTEYPQRARRPGALPARRRAPATGPGAGRGDRSRRQPGEGGRGHGACRRLRDRQRVQPAGRQLLPPGGESQVPRRLLPVRSATGADAGDRRSPCAGAEAVRQRRTAPTQQHRQPGARHPAADRRDQRVHDPARRRRADHRHPRRASRRASRRPRRGRDRRPRPPRQQHRRGMRNRP

SEQ ID NO: 28386 - protein, 755 aa, Pseudomonas aeruginosa
DPRHRPADPPDEERADPARLAQLRVLRRSLHADERAQLSGRRPDAQLHPVPAGGRLRPGLAVERTVHDRHLEDRAVPGAGQHGGAEDVRAVAADRQRAGPPGARGGHSAGGVQRGPGLRRQRRRRAGSPPRRARGVLHRRHRHRATDHGGGRDQEILDGTGRQVAGAGLRRRRPRAGAGRRSVHHLLAERRALHRRQSHLRPGKRLPAVRRRVRRTRQAPDRRRSAGPEDPGRLDDHPGPLRQGHRLHPHRPRGRRHPGGRRPGASGRPAGAPEQGAVHPAHGVRRRGQPHAHRPGGDLRPGGLPDPVQGRSRGAAPGQRRGIRPGLLHLDPGHRQGPSPGTRHRGRDGLHQQPERARPAPAVRRGEGLGHRTRRRGIQLRGIRRDQERVYIHGQPSHPPLGRVGRARAERPPEAASSAGVQTQSEESGPAANGRARCQAQRATRRIVMGKVALAAKITHVPSLYLSELPGPRHGCRQPAIDGHREIGRRCRELGVDTIVVFDTHWLVNAGYHINCAPHFEGLYTSNELPHFIANMEYGFPGNPELGRILAEGCNALGVETLAHDATTLGPEYGTLVPMRYMNQDRHFKVVSVSALCTVHYLNDSARLGWAMRKAVEEHYDGTVAFLASGSLSHRFAQNGQAPDFSDRIWSPFLEVLDHEVVQMWQEGRWAEFCGMLPEYASKGHGEGFMHDTAMLLGALGWSAYDGKAEVVTPYFGSSGTGQINAVFPVTAQDGSAIPAAQAGNPAGASCASRL

SEQ ID NO: 28387 - protein, 460 aa, Pseudomonas aeruginosa
RCTHPARLPATDRSPGRPGAHKKYKIMSTASTLNSTTLPLSDSTHDRVTWRLMPLLLVCYVFAHLDRINIGFAKLQMSADLHFSDTVYGLGAGLFFIAYALFGLPSNLMLERIGPRRWIACLMLVWGCLSTAMLLVETARGFYLLRFLLGVAEAGFFPGILVYLNRWFPARRRGQITALFAIAVPMAGVIGGPLSGWILEGFHDALGLRGWQWMFLIEGLPVVLLGVVVWCSLPESFERVTWLSDEQKHLLREELAGEEQRKTITSFSGIFSNPQVWLLVAIYFAVMLAVNTIAFWMPSLIHGAGIAQDSRIGMLSAVPYLAGCAFMIFIGRSSDRLRERRWHLGIPLLMAAAGLSLAALAPTSAWLVMGGLVIAGMGASAALPMFWQLPPAFLSSATLAAGIALISSFGSIAAFLAPYLIGWMRDTTQSASLALYLLAILIALGAGLVLRTPAAVVYPR

SEQ ID NO: 28388 - protein, 108 aa, Pseudomonas aeruginosa
SSAAPSPARWRPRRGTPSTSTTTCSAASPAVSSEEAFPWTCPSIASSNACAAARRRSACGSAWPIPTARSWPPTPASTGCCWTASTRPTTCAACSASCRRWRPTPASR

SEQ ID NO: 28389 - protein, 331 aa, Pseudomonas aeruginosa
SQPPLQPDGPTKNERKNSRDPGRARRTGRSVETAARARQAAVGGERPDLHPQLHRSVPQLPPPRRRPAVPAVLRHPVAELERPPGGALGPARTQVLHFRRDLLAAGLHPALGAADHRRLRPVLHHRVRRPRLVRLYLPAERVDLGVHVVREGHRGRPQCADQARPGSGERRQALAQNGQARAVAGCEPGHGDHLHRLLHSGAAAGGRPVQLPAGPGKPVLGAVLHRRHLCQRRLAARAGVHPHVPLLALPERDVRQGHPDRVLRRRPRRVPRRPQERQRSARPRARRLHRLPAVRAGLPHRHRHPRRPADRLHRLRRLRRRLRLDHGQDGL

SEQ ID NO: 28390 - protein, 67 aa, Pseudomonas aeruginosa
RRATMACAGRSPCATWSAACCCRWKNWSSATARWRHSTSACRWSPVPATWWPSRRRRSTPPCRCWNG

SEQ ID NO: 28391 - protein, 152 aa, Pseudomonas aeruginosa
PACRRRSRPRRPSPTISSTAATTATCASCATPWRPSRTPCSRRWRVTSPSRPGSAVPAAATSSGWSCPRRSTRCACSNWPWPRASASPRGRSSPPPAASPIAPGSTTGTRGARGRRRRWRHSGGSPSRWRDDAPQTESHPGVGRITARGHPP

SEQ ID NO: 28392 - protein, 143 aa, Pseudomonas aeruginosa
CRRTSRRTPAPCTARSPARDGRRAAAHRRERPGPGCRRGAPAGGFRRPARPPAGRARRTAPGPRTTRASRPRASGSRRAAARPAVPAWSPCASMPASGRPRPTDRGRAPWPAPAPTRRRRRGPGAPSAGPVAPRCRPARRPGC

SEQ ID NO: 28393 - protein, 120 aa, Pseudomonas aeruginosa
SRHAPARAPGAAMRLASASCPSPRKRNSSRTAAPTSTSATSTSCATTASTMRPNRRPATGRRASSCACNPVSPAARSASAWMLPGCSASSSTRDAGVATMARCRSERIRRSRWTTTVTSA

SEQ ID NO: 28394 - protein, 273 aa, Pseudomonas aeruginosa
LHHRQAAVPRTVGEHPARGIGGGSRGVLAVRQGGGGIGQDHLRFVQLGALQGAQAAHLIHRQFAEQGEEATDVAIIAVAPELPEVERRQALGVEPYRTLRRLAHLAPVTGGQQRHGQAEQLGAALASRQLHAVDDVRPLVGAAELQGAAAPARQFDEIVGLQQGVAELEERQRMLAVQALPDGVEGQQAVDREVPADPVEELQVADAVQPFGVVHQAVVVQFDVARENPGDAVDIGLDLRLGEDRPARIAEARIADPGGRATDQQQRAVPGLL

SEQ ID NO: 28395 - protein, 274 aa, Pseudomonas aeruginosa
PPSINWPTPSATACSRASPRSAACSAATPAASITTTTPSGPDPRTSARSRRGAGLHRRRRPGRPRRRPRTRQPGRGDQRPDQENRHARPHPARRRLRRRSRPGIRRPVAPQLPRQECHARRGRPGGRLDPGLRHPARRSRRQQLSGAGRLSGRPRTLSAGVPQLVGGNRRRRPLELRPAHQRRGSRGGQLGLAERLQGAPARHGSQLVPAAAERRRELREPHRAGGNQPLPDPRTDRRPGRVRPVQRADRRHHGSPAETTGAGQARLRRHAGAG

SEQ ID NO: 28396 - protein, 416 aa, Pseudomonas aeruginosa
PDPRRGARHRRPRHRHPGAGRKPPAGAELRLPEQQHRGADRGGLGRRRRTIRAEDLPPRRSGLRAVPRPPRTRLHRRGDPPGRGQQAHALPELREHPGERDVRRGRQRRKDLRQLPAEKRTRRGHLVPLHRQALAEGLDADPALPVRRPRGQRPVQLPLLRQHSQGAVRPAGGDQHRPPGTHPAARQAAVRPGSGRHGADPGLRPVGLEQGPAAVHQAQHPARHRQRLRGADPASRRAAGDQRVLPAVPDDGRRLPRQRPLPHERPGGDSRQRARPARRVDRSRRPGAQPVGDPSAPRPTGVGHGDLAGHPQPARYPAGQCLLPRVRGLAVRPLQRRLRLAAGGVEQGLGLQPRRRLGRADGGRPVGGAVATPGPGRRQRLGQRRAPVERSRSASAVQLAAARPADAMKCRYARPY

SEQ ID NO: 28397 - protein, 127 aa, Pseudomonas aeruginosa
SWQFIPLFRISTIEWLSRLMGSLKEIYEMKELNDIEVTCVSGGTLSGMIVGAVDGAATGMAIGGKWGGAGGFGFGALSQLVGLIVPTAMGAIAGGTVGLFTNAETAVGYLGQYRENFGPGDVGRTTI

SEQ ID NO: 28398 - protein, 438 aa, Pseudomonas aeruginosa
TFARVSECHASIIRIQDPATMFRQEALDAQHAGGLGEIVLIRPVSFTFLTLLAAAMALLVVGFFLFGSYTKRSTVSGQLVPASGQVKVHAPQAGIVLRKFVQEGQAVRRGERLMVLSSERYGSDAGPVQAGISRRLEQRRDSLRDELEKLRRLQDDERDSLTSKVASLQRELTTLAAQTDSQQRLLALASDAAARYQGLMDKGYISMDQLQQRQAELLGQRQTLQGLERERTSLRQQLTERRNELAGLSARQANQLAETRRQLSAVEQDLAESEAKRTLLVTAPESGIATAVLAEAGQTVDSSRPLLSIVPADTPLQAELYAPSKSIGFIRPGDAVLIRYQAYPYQKFGQYHGKVQSISRASVSYAELSSMVGGVPGLGQDGEQLYRLRVTLDDQAVTAYGQPRPLQSGMLLDADILQDTRRLYEWVLEPLYSLTGKL

SEQ ID NO: 28399 - protein, 609 aa, Pseudomonas aeruginosa
ERPMAFLDALALRLGRRLPLVLQTEATECGLACLAMIAGYHGHHTGLMELRRRFSVSLKGISLKQLIQTAHRLGLGTRAVKLDLGDLGKLKLPCVLHWNFNHFVVLKAVDGRGAVLHDPAHGQRRLGLEEVSRSFTGVALELWPESGFEKQEAPPRIKLLGMLGKVTGLYRSLAQVLLLAGALEVFSLISPFFLQWTIDNVIVSEDRDLLSTLAIGFGLLLLMQQAVSGVRAWVMMHMSTLLGVQWQANVFSHLLRLPAQYFEKRHLGDVVSRFGAVNSIQQTLTAAFLSAVLDGLMTVATLGMMLLYSPPLAAIAIAAMSLYALGRWIWYRPLRNATEEQIVHAARQQSHFLETVRGIRPLKLFQRQDERRSVWLGLLVEQINAGLRTQKLQLFYQQLNGLLFGVENLLVIWLGATMVMDGQFSVGILMAFNAYKSQFDSRVGSLIDKFFELRMLQLQGERLADIVLQAPEVSHGDILPKNLREREASIEIQGLRYRYAEQEPWVLDGLDLRIAGGESVAIVGPSGCGKSTLFNVLLGILPPGGEQIRHGRPGPCAIGPGRAARTGRHGAAGRRAVRRFAQPNNISFFDPQPDMPWLAPVRADGCHPR

SEQ ID NO: 28400 - protein, 255 aa, Pseudomonas aeruginosa
TAGQRRHSRAAHHPRHGRPSARDHRLGGPRDSPRPGQGKPRRKHRAPGRTPGRRGAGAGLMRALAGLLCGLLGLVPGAAAYEPDVFGTVGQVAGQAVYDLGGSGLPCRGGPPPTELSLEEAIERILCHDPQTRLAWANAKAAQVGIGKSAYLPRLDGRLDASRGYSDMDYRDAPYLSGDGHRHRRGASLQLSWVLFDFGRRSAALRNAQQLLLAANASQDATLQNTFALAAQAYYDALAAQRSLAASRQVAELAA

SEQ ID NO: 28401 - protein, 146 aa, Pseudomonas aeruginosa
AGPYPFSIPDFPAKAFPMLPPLVRRLSRLAAELAVLIAFWWAGGWLAKAIGLPLPGGVVGLAALLLLFASGLLRPAWLQAGAGLLLAEMLLFFIPALMSLLDYGALLRSEGWRILLVIMLSTLLVMLVTAVSVEWMCRWRARHESR

SEQ ID NO: 28402 - protein, 526 aa, Pseudomonas aeruginosa
ASPVLVGGDRRRLPPEPPAVPPGEVVLAVAHRVRPGAALRPGDSHPYPLRRLRPRHQLAGGAARSGDGGLRHPDLAAARAADAPLAGAAGRDVRRHRGGHRQLLGAGPGPGAGRPGHAVVAAALDHHAVRHGDVPRPGWRAGTDRRLRDDHRGVRRGDRRHPAARPALAHAAGPRRAVRRRRARRRHQSGLRVRRRGRFGGRSADGSHRAVQPAGRAPGRPLPVACAHRPAESSAIQPARECKPGDSRRRRAGLDCGHPITTKEDAAVTAVHSLPADVQAQVSAAEWQTRVDLAACYRLVALHGWDDLIFTHISAKVPGTEDFLINPFGLMFHEITASSLVKVDASGKKLMDSPYEINPAGYTIHSAVHEVRHDVECVLHTHTAAGIAVSCQKQGLLPLSQQSLFVLSSLSYHAYEGVALNHEEKARLQADLGTSNFLILPNHGLLTCGGSIADTFLMMFTLQRACEVQVMAQSGGAELIHIPGQILAGARDMIAGVMRSKTGMGGQLAWPALLRKLDQQNPGYRQ

SEQ ID NO: 28403 - protein, 115 aa, Pseudomonas aeruginosa
STVFPAPPGTGTTSGSRWRSATACWSATCSASAIRPSRAPIATACWSRPTCNRRCSAAWESTSRCTCWPTTTATASPRNCSPAITKAGCGSPPACSSMVGCSRKRTARCSARSCC

SEQ ID NO: 28404 - protein, 115 aa, Pseudomonas aeruginosa
WRRSVPPAAPRWPTTTRSRTAAGSWRTRWTPSVASTWWSTMPASCVTRPSTRWRTPTGTWSTRCMSKAPTRSLAPPGRTCASRPTGGWCSPPRPRASTATSARATTAWPSSASTA

SEQ ID NO: 28405 - protein, 244 aa, Pseudomonas aeruginosa
AAQCGGPADRPGPGRRPARVRSGRYGAGRGTHRQRRQFLRRRRPGGGGRGWRAAQSPGGGGRRTDGAEPHAARQAADRRHRRLCGGRRAGAGAARRPAGDGRGRHLRSVLPAFRGAADRWRQRAPAADRRAGPGARPDPHRASGEGRRSVADRPGQPGGAERFGASRGRGAGGGTRRLPADLHARRPRQRICAVGTVLRRGPGQRIPGRAGGDRERRDPGGRAALQGRRGAPRALRVTPSRRPG

SEQ ID NO: 28406 - protein, 284 aa, Pseudomonas aeruginosa
ARVCATGSPRGTATGLAAPRSAPAVFFRRVRAMRFFLCGRWRGFSAHQAFHAGREGLRQAAAPGRAVRVGKDPVLMDETADDRVVAEPAAGFRFPAGQAVQRTLAQHPGLPQQLAVLTEDQRGQGAAAEVAGADPFAAVAAGEGDATGAVEQHVRAEAPGHAEVAAPGVADPGVLEQREEFAEQVATQADFLVVEAEVAAQLAAEAVAAPRAEGQAVVGGALAIGDLAAEFAEGLAALQADLRPDRRRQRLGGHQQTLHRQLVVAQRRQAGGIAFHRRHDPFGA

SEQ ID NO: 28407 - protein, 870 aa, Pseudomonas aeruginosa
APGKALRQNKSTAMTEPTELPAALPRLPPQHLPRPRLHQPLLRGECRLRLLCAPAGSGKTVLLGECARRAPPGVQVVWLALGGEALDPATFRRRLAGALGLPEESDEAQLCRRLRNASALWLLLDDYPRHPDPAFDACLDCLLSAASPRVGWWLASRRRPQCNLARLLLEGELLEVDGGLLAFDADEVAELLRLHGRSADAAATGALLERSGGWCAALRLRLLVGEETAGPLLQEYLQHELLDELPPPLADAARALAWLPQVGPELFRRLFEELPHGLDDLLARGFPLLADANQRYSLPPAIREAWREAPQRPQRDFHREACEWFAEHGETREAVDQALAADEPETAAGLLQKLTEEQLLHGHNIGMVLALRDELPAALLASTPRLVILNAWTLLYAGRLAEAEDCIGQLARFLPMPSASRQRVLLAQWQGLFGILLHCRGERGAADYLREALEQLPEDAWSQGLICRSALMQLAIIEGRMDQARLIGRDALRLAREHDSLIFEALIELERAQWLEQRGELLRAEGVLDRAQRYLEDLGQQGSPMLGRIALRRARLCLQQGREVEAGHWYRLGLEQARENLDPWALYGYLGLALLEAGQGDLDAAFNRLLEVERLMQQRHVPDPLYRGALLLVSSALTLQQGRPAQAREILLRVRAYFQPGRARLSPPSEPELEARVEHQLALAELYSGEAAAAEARLRGLLAILEAQGRQTLLCEVRMGIAECQFLSGQLPQAQQTLRSGLELAERLGLQLPQRRLRDRQPQLFAALPGEEEEGLSPLSCRELAVLGLIAQGCSNQEIGEQLFISLHTVKTHARRINGKLGVARRTQAVARAKALGLLPLSGLSAGRGRSAGRVRPGAGRGAVARWDRR

SEQ ID NO: 28408 - protein, 1411 aa, Pseudomonas aeruginosa
ARARVPGRSVPPAGNPVADRGRRGPRGRRRPPGRVRSPAGHPSARPAARRRRCAVVAGCATDAGGFPRERPASGRRPAVRSSAPAGAAAVRGSRWDRGAVRWPGRADGRPAARAAGSVPGSSLRPAECPAAAPVPWPPAPATTAVPGAAATPAGAGPSAVAGGSRRPRRNPVRSFAAATPGRARWPRRGRPGWRRSAGRVRRVRAGCGRANTPGGAPRRSTGPPRTALAVPGRDNRGRLDAGPWLSSWCAWIAADGPFGARRGRFRAGGPQGCNRPPKLRPVPGSASAAAWSSALRAFRRRLPILKVPGGNSPARTTSSNQGSPTMFDMMDAARLDGLHLAQDPATGLKAIIAIHSTRLGPALGGCRYLPYPNDEAAIGDAHPPGPGHELQGGPGRAGAGRRQGGDHPPAAPGQSRRAVRGLRALHRKPRRRLHHCGGQRYLQRRHGLHRPADPPRHQHHPGRRPLAAYRPRRVRRDSRQRPGAPRQRRPGRPAGRGAGARPRRLRIGRATGGGRRRAAGLRPRSRPGATGRRAARCPSAGAGGIALHPLRHPRALRPGRRAHQPERQPVALRGGGRGGEQPVGAAGGRRRAGGARHPLCAGLRDQLRRPDLRRPQAPRRRPAQHHRAPGADSRAAHRDLCPCPGRPPVAGADRRPSGGTDSLRPAVTGRRFRRGRQRASPAAVRATPAAPRVHAATRGATLSGTPTRRAEEVCDGSQPDRPAFHPLPRQRRSAPRRVARLGRRQRCAGRPLPADAPDPPVRPEGGGPPAYRADRHLCANPRPGSHRSGHRQPDARRGRAGAVLPRYRRAIDARRAHGGHPPLLGRRRARQRLRRTAGGAGLSHLRADRHPGPACLRGRLGVPHPRRTPGGGDHLRRRRHQQGRFPRGAERGGRLAVAGALRGQQQPVGDLGAAAHPVRRADPGGECGGCRLPRRTGGRQRRAGGRRTRPRGPGARAPRQGADPAGVHQLSPLRPHHGRQRQPLPFPRGGQPGLARGTDQAPARLPRRPRPVGRGARARAGGGVPGAGAGVGGAFRDVSRGRRRRHCSSMSTRAARRSWRSSASNSGSAPRGGGEGPNMNERNGEATRLAVLEAVNLALHRAMAEDETVVVLGEDVGVNGGVFRATLGLRERFGFKRVLDTPLAENMIAGLSIGMAAQGLKPVMEIQFMGFIYAAMEQLVSHASRLRNRTRGRLACPLVLRTPMGAGIRAPEHHSEATEAMFAHIPGVRVLVPSSPARAYGLLLAAIDDPDPVIFLEPTRLYRMNPQPLADDARRLPLDSCFTLREGGDLTLVSWGASVHETQQAAERLAQRGIEAEVIDVACLKPLDLDTLEASVRKTGRCVIVHEAPKSGGLGGEIAASLYERVLFDLRAPIQRVAAADIPPPLYRLEALYMPAVEDILAACDTVLGYA

SEQ ID NO: 28409 - protein, 97 aa, Pseudomonas aeruginosa
TFYQGDILMRVIPLALVALLGLAPLAQAQQQPYGPNPDSKSLRQHYVEGRLDIARVIYKTDLWSACGIVPARLVYEDSQGERHTVEYKAWGSGCSGN

SEQ ID NO: 28410 - protein, 535 aa, Pseudomonas aeruginosa
FLLHKTMECRRCHETSWMECRARRSQGGATGPGAGPGPAGNGRATAACARRGGLGEPAADRAAPGPAGHPGTTGEPRPAAIRRAGRGPGVLRQPAFRRSRQRGGARRIRAGRRPEPDAPGQPGGIPLLRQGPIEPDPRQPGRPGADVALGDFRRASGRLGLPDAAFGQRDRPRADRAQPAAACRRHARGNPRGVLLGEPAGPRPVGEHPWHPGLRAGQHVGRRHAPELPAERPPAAQRDALRRSRAAQRGGHRQGRQLGHGRRRGDRRDRQLPHRGGPRPGQAGQAGRWPGAPHQRPGRRRQWHPLHRQRGLRHRHRGLGHAGRRQRAPPGRLRPGDQGQHWRAAHRRLVQSRGRAAGQAFAGGLLRLRDALATGQAWRRPAAGPAPAVQLPDHPGVLRRRQHAQHREPGALGKARQQRRACAELRHRLRLRAGQPVGGLQGQALLRRQPQPPADPATRYHPRLLDHLPDRHLRRAGAEHLDLRSRRSLHAARQLWPGVLLRQGAAGLQPAAGEHLGGRLPCGRRHDPQGRPRPR

SEQ ID NO: 28411 - protein, 655 aa, Pseudomonas aeruginosa
RPERSWRSSPAHEPPSLRLAPVATAAPGLFLRRPCPASGDCRNVLRARSRPGHPQDPTPMKLRPASPRNEILATLGRFRPALRSVALFTAVINLLMLAPSLYMLQVYDRVLGSGNHMTLLMLTLMVLGLYLLLGALEWVRSLVVIRLGGQLDMQLNQRIYDASFRASLEHGEQAVGQALNDLTSLRQFLTGNALFAFFDAPWFPLYLLVIFLFSPWLGLLALVGALLLVLLAWVNESRSREPLAEAGQLSILATQQASANLRQAETLAAMGMLPAMRARWFAQHQAFLARQNLGSERSAAIGATSKGVRLALQSLVLGLGAWLAVEGLITPGMMIAGSILMGRVLSPIDQLIAVWRQWSGARQAYQRLARLLEENPPAALGMPLPAPRGALRVERLCAAAPGREQALLQDLGFALEPGEALGVIGPSGSGKSTLARLLVGAWQPLSGAVRLDGADLRHWSAAALGPHIGYLAQDVQLFAGSIAENIARFAEVDAEKVVAAARLAGVHDLVLRLPQGYDTRLGDGGAGLSGGQRQRIGLARALYGRPALIVLDEPNASLDEAGEAALAEAIAAMRRHGSSLVLVTHKPAVLALTDKLLLLHGGRLQRFGATAEVLASASPPAAAAPAPTRPTPAFGFGYRPGPGMPVGGVPGGAAR

SEQ ID NO: 28412 - protein, 360 aa, Pseudomonas aeruginosa
TTCSSRWPTVPTWRWGKNESPASLPAVLRAAFGLFGPGAGPAGRLPTGGAPRPDLPGGAPRAPRWQRKPRHRPCRPAAEPALRLQQGAQRLHRQPGRRPRRARLSQLRLDPQPGAAAVRLRGLRALPPGRGPGAVRRRTVPRAQPGTGGAPVRRLQRNPVRPRAGGPGRGPAARPGNPAGVQPACLRGRRGHPHRPAGDPRPAEPDPRRGDRRQRSRGGGAAYAGGDARAGTGGSRTGRAHRALPGAAPATGDLRRLAPGGPATQRRAGRPAPCAGGGSLRGGAQSCRPLAQAQPLRQQQQDALGFGKHLRAEIRHRQCRPASQPAAVRGRAGVGSDPPGRRQVRPGPGRAGCPGGQCDQ

SEQ ID NO: 28413 - protein, 417 aa, Pseudomonas aeruginosa
SPTSSTTIRRTMASSWSRWRCSCWRWRSWWCASPRRASLRRSPTAPPRGGWRARTPKGKPDSSPRRSRSPARFRPAQRPGNVLPSPGRVQEACPMKGWKLFTPLLILAIVAITLYLRLHNPPLLLQGEADATNVIVSSKAKGRVQVLHVRRGDEVKQGDLLISLDSPELEAQLDALHAARNQAQAQLDESLHGTREESIRALKASLAQAEAELRNAESDFQRNQQMVERGFLSRTQFDLSRRERDVARDRVAEARANLDEGLKGDREERRQALQAAVRRADAQIAELQAQIDDLQVRAPVNGEVGPIPAEQGELINAYSPLLTLVRLDDSYFVFNLREDILAKVRKGDRIVMQVPGLGGAEVETELRYIAPLGDFSTRRATRATGDFDLKTFETRFYPLQPTPGLRPGMSALWRWTN

SEQ ID NO: 28414 - protein, 391 aa, Pseudomonas aeruginosa
AMAWAALKRNASRFVQAFNTETRIACRSWTIHWLGWCWPLLLFGVISGVYQAGTLLDMPLAVIDKDHSQLSRKLIRELDATSHAQVITVPAGVQEGLDAIRRADAYALLYIPPDFEADVLGGRAPKAELYYNALLYSAGYAATQDFSALVASLNGELRPRLAAGMPAALPHLASISVSYDSLFNASGNYIYYQQFAAIVHLLQLFVIVTMVHVLAREAPELRASSPHILRAKALGVRLVGKLAPYTLLFTALLMLEIFLLVAFSGARINGSPLAMLMITLFYVIAAQSVGLVLFVFTANRFTAYSLVGMLIGVAQTYSGVLIPELAMPTLARVIAEAEPLTHTLHGLFDQFLRQAPPSSALYTCAKLALYPLIAYMIAKMRLRSRLDLSPI

SEQ ID NO: 28415 - protein, 193 aa, Pseudomonas aeruginosa
LPMVRVAPRSREPKAVLPLSRFSISSPRSSSATACGSSWRPRALRVRRLPARSNSLQSNCRSSSPSEVLVADCDSDSPSAARETLSCWATATNTSSWRRVNFIQASSSRAKGPATFCRSVGGVGSVILAPRPRERWEPSAAGGRPISCYPISIFWISIIQTIHFADILATDKMPRNCVTSAAVGVRPRFPRSL

SEQ ID NO: 28416 - protein, 384 aa, Pseudomonas aeruginosa
SPAASDCAGRRPVPCGRWSKLRAWRGSGGGGGHVVAIEVLQRRRQDFQVELARGQQRFQHAVALGIVQQYLDALVVQSPRRQAGPVPAFEPLRVMRAGQAHAGRQSRLAAQFGEAAGHLQAAAGENRGAVDVRLDAGQHMGAKDDPGALAAQAVEQLVELDGGQRVEAHRRFVEQQQARFAEQRLGQAEALAHALRVGFQAPPGCMAEADLFQQARGFGRRHALEAGEVAQGFRAAELRVEGHVLRQVAELAARLQAPRIVAEDPHAAFAGGQQAEDQLDGGGLAGAVVAEQAEHLAGLQAQVEPAQGGEGAVAQGRAVDLDQAHGLGSAAGIRISGWLSRTPGERTTGKARWTQRSSSMLGLFNSRRTCGYSQISRSTLSLGS

SEQ ID NO: 28417 - protein, 345 aa, Pseudomonas aeruginosa
WPSDHRSFKGLSLDCHRHFTGLTQSPSILVYTRWRRWRLRATDWRENDERGDPCRQPEQDLCPQAGAFQPEAGDPGGRDGGVDRCIRLRQIHAPASRRRACPLRPRQRRQHRRAGSPPPGVRPPERRSASPARRHRLHLPAVQPGQPPQRAGQRPARLPRSHAALARFAGAVQRRAEAPGPGSAGTGRPGRFRRAARLDPFRRPAAARGHRPRPDPEGRGDSRRRTDRLARPGVGAQGDGHPRRYQPPRRQDRGGDPASGRLRVALLPARGGPEGRPDPLRRQQRAPFRRLPQRTLRRRRGHPAAVFRPFPARGGEPAGTDPRARLTSFEPHKNPPNPAQEFSPC

SEQ ID NO: 28418 - protein, 313 aa, Pseudomonas aeruginosa
RPSTRSWPSWRNAWPSASRKPPPTPADPPRARPAPRPTRFANTAVEIPDMSTLSTTAAAAATGKPSWGRLVGWGLFLAILAWSWKGAEMNPAVLFRDAGNMATFAADFFPPDFGNWKLYLSEMLVTVQIALWGTVLAIVCAIPLSILASENIVPWWVYQPVRRVMDACRSINEMVFAMLFVVAVGLGPFAGVLALFISTTGVLAKLFAEAVEAIDPGPVEGVRATGASALQEVIFGVIPQVLPLWISYSLYRFESNVRSATVVGMVGAGGIGVILWEAIRGFQFGQTCAVLIVIIVVVSLIDVLSQRLRKLFI

SEQ ID NO: 28419 - protein, 474 aa, Pseudomonas aeruginosa
AGAVRFARRRRAGRPERLRQRQRPLSGPVLHPADPACRPRWRRLAGVARTGHRRSAPGGVAGERRVLGTARRTHRIPQGPGCLLRRRRAHPRPATQYPGQRTRRGGGLMYVAVKGGEKAIDNAHRLLARKRRGDTALPELSVEQIRQQMPLAVSRVMTEGSLYDEQLAALAIKQAAGDLMEAIFLLRAYRTTLPRFAASLPLDTAGMRLQRRISATYKDLPGGQLLGPTFDYTHRLLDFSLLAEGDYPGPEVERGASLEPCPRVLGLLDREGLMTPEYELPGAVPDITREPLDFPTGRAQRLQALARGDEGFLLALGYSTQRGYGRNHPFAGEIRIGACEVWLEPEELGFAVPVGEIEVTECEMVNQFVGSREELPQFTRGYGLAFGYAERKAMGMALVDRALRAEEYGEEVVSPAQQEEFVLMHCDNVEAGGFVSHLKLPHYVDFQSELELIRKLRRPGVAESAQPTVQEKRA

SEQ ID NO: 28420 - protein, 234 aa, Pseudomonas aeruginosa
VRLGQVDPALVALRALSAGRRHGRLPRRRRPLAGPLRRQRSRAAHPAAHRVGLRRAEPARRPAHGRVRRRQHRRTADGPGRAPLRSAAPGRAGLAGTGGDRSAAHRRPAANLFRRHAAASADRPQPGLGATPGVHGRTHRRPRRVGAGAPARPAARPGARAGPGGGDRHPRPGGGAPARRPPDGHAPFAGGGSRSHRPDSRRPAASVHAIAGVVGPATLSRSVGAGPRDGRPEK

SEQ ID NO: 28421 - protein, 81 aa, Pseudomonas aeruginosa
CSMCCAGSTSMSPAANAWCSTDAPAPARAPCCARSTATTCRPAAASACATPATGWNWSAPSLARCSPCVARPSATSASSCG

SEQ ID NO: 28422 - protein, 397 aa, Pseudomonas aeruginosa
ARSFPARSKPMSSERVLSNARVVSAERVFVGSVLLRDGLIAAVDEGRSHLAGAEDLGGDYLLPGLVELHTDNLEKHMTPRPGVDWPSASAVLAHDAQIVAAGITTVFDALSIGDVNPKGKRMQQLPKMLEAIGEAAASGDARADHRLHLRCEVSHPQTLEVFRELVEHPLVQLVSVMDHAPGQRQFARLEKYREYYQGKYHLSDAEMDAFIVEQVANSERYSDAARAAIVDVCQGRGLSVASHDDATLAHVRESAGYGMAIAEFPTTVEAARASHEHGLQVLMGAPNVVRGGSHSGNVAAAQLAGIGVLDILSSDYYPASLLHAALLLAGEHSEYDAIRYDLPRAVAMVSRTPALAAGLTDRGEIRVGLRADLLHARALGNNQPVVRQVWRGGQRVF

SEQ ID NO: 28423 - protein, 264 aa, Pseudomonas aeruginosa
PRWHPPDPLPRRPRPGPAAPALGPGSGDPGARPGRPGGPRRPLQASGHPRFQPALRRLRAAPVGRAGGDRVAAGPLEANLRLLAGGGFRGGNDTAPGLPHRYRRAAGGQRLAIARGAAGPAGAGLLDAAAGAAAAQPQRPHAGIGVHRIAASPAGRVDSRRAYAGRLAAGPPRCVARRGGTGARRRVPAAVSDAVAPGKALRAKSVQAWIEADSPTYHQCKQQPCAGNAQQTPGAPGEEGGLGRQAQRQDRAGDHYEQKNDGGS

SEQ ID NO: 28424 - protein, 998 aa, Pseudomonas aeruginosa
PGPAHQQTRQQRQPDHLPVQRPWPGDLAHRGRRHCAGAHHHNRLAPDPVPPGAGQRARPDHPLPVRRRGTQDRRDRHHPLTRTTPMRIPPYFPRLGALALACALALPAQAAERAWSYSYNALGLIERADGPRTDVQDVTLYAYDSRGNLTQVTNALGQVTRLGDYDERGKPGSITDANGVTSSLAYTGVDGWLASVSTAGSTTRFDYDAVGQITRVTRGDGSWLSYEYDDARRLVAIGNNLGERLEYDVDTKGNRTAQRIKDASGSLVRQQQWAYDELGRLLRAVGAGGQTRSFAYDLNDNPVGETNPRQFAHSQAFDALDRLVGQSDPLGGKTRLAYDAQDNLTEVKDPRGVTTRYEYDGLGNLTRLVSPDSGTTTFEHDAAGNVIRRTDARGAVTEYRYDALNRLVERRSPSDPSLDVQYRYDLTADGNQGIGRLGAIEGARDSLVYRYDERGNLVEQVRSIRLDQQTLLDRVTYRYDAANQLLEIGYPSGLAIGYPRNAGGQVASVTLAVGDKAPSTLVGQIAYLPFGPLQRLTWGNGITLSREYDQDYQLLRQKVGPWQSDYQHDANGNIQQHRHSLWGTLDYQYDPLDRLTEERGVQGGRSYAYDAVGNRTQRSDNPASGGTASSQDYQYAPDSNRLTAIGAQAVTSDAAGNLTQDRAARKLAYDAQGRLQSVSLDGQQVAEYRYNALGQRIVKLTPESITTYLYGPDGQLLGEAEHDGSGRKLRAQYYLWLDSLPLATIDADYDAQGKVGNPTLLYLHGDHLDTPRLATDASGQIAWQWQSDAFGRGEALSQGSTQVNLRFPGQYYDAESGLHYNYFRDYDPETGRYVESDPIGLSGGVNTYGYVQGAPLNRIDPLGLAAIEIDIPKSAYDWIPGNIRLPAGRLLGGVLLVASISGATPQADSDTKEQNCPKDCPPCKTISGRIIPVGTLGYRPLDIIPDDEMQHGVYGSHHNMFVANQNPNNCRCFWQKKNYVLKPEQLPKNAVPVEPFIN

SEQ ID NO: 28425 - protein, 119 aa, Pseudomonas aeruginosa
WPRPWPGPTTAMWRWPTPPASTACIPTSATRRSSASTVVPSVSAARRKWVSSTPSCRFRRSAMRAPTISRRTTCSRSSTAATAACRRPAMATGAWRSVRSSSTAPGSPTPRRRARMSSD

SEQ ID NO: 28426 - protein, 419 aa, Pseudomonas aeruginosa
PARLPVWRNVRSAGCPTRDWRRRPDGTGVPSCGTPSPPFPPVAEGVSSMPFLSDMLDQSRRQQDEEQALARENLAEASLLQAHLSHRSALHSRFRFDPAAVMDCLRAEVLGQEPALQAVEDMLKVVRADIADPRRPLFSALFLGPTGVGKTEIVRALARALHGDAEGFCRVDMNTLSQEHYAAALTGAPPGYVGAKEGTTLLEQDKLDGSPGRPGIVLFDELEKASPEVVHALLNVLDNGLLRVASGERTYHFRNTLVFMTSNLCAHEIQRYDERRQRLPWRLLPVGGERRRRDIDGMVRARLLKTFSPEFVNRLDSVVTFNWIERDVVARLVELEVQRLNRRLEKHRCRLEATPEVLAKIARAGFDRQFGARALRRSVRHHLEVPLAEHLLDHHQPGDGNCTTYLASLEHERVRFVRR

SEQ ID NO: 28427 - protein, 394 aa, Pseudomonas aeruginosa
ATVTGEETDGIAPGAVADRPAVLRNRRHRRYRALAALWRIACGRATEPRGRRRRSPDRNAVPGPRRRPGPLSAVRRGLHSQPGGTVPRGLLHVAHAQGGDAGGRARRRAALLPDPLRGLRVFAEHRLRRSGAEPEQCAAGGVPDSPITGSGWCSSARTTSIRGESNHVMPHLFRQHGGTVLEEIYIPLYPPDDDVQRAVERIYQARADVVFSTVVGTGTAELYRAIARRYGDGRRPPIASLTTSEAEVAKMESDVAEGQVVVAPYFSSIDTPASRAFVQACHGFFPENATITAWAEAAYWQTLLLGRAAQAAGSWRVEDVQRHLYDIDIDAPQGPVRVERQNNHSRLSSRIAEIDARGVFQVRWQSPEPIRPDPYVVVHNLDDWSASMGGGALP

SEQ ID NO: 28428 - protein, 379 aa, Pseudomonas aeruginosa
LPINDLPVGFKSLSRYSCCCSSTSWSPTHPAGPVDPAGGARRAACQRSGRRGAGVQQRPRAARRSIVPPRSRAFPTGRAPGRTGTGGSRAHQPRAGCRHRLGQGRPPGRAQQRRRAGQRGAPHRPTGAAPPCVAADARAGQRPGPGRPCPGRRGPGADRRADRATRHGRRGQPAPAPGAQCPGPGSSATAIQQRPGRPRRDPEQPATDPGHLRSGRNAGGGAGGRPYRHRRRLPREIAALRAPWRPCGGGVRRASRRSVRRAGGGHRRRGQGGPAGRQRRPRRAGHLRPLGSRRPAPAPARGARRTSRRPAAHRCQGHRAALSRRRPEPSARSRADRRHQPAALRLLTPCRPSSRCPPTTCVSACASPAAAPWGSSSAS

SEQ ID NO: 28429 - protein, 161 aa, Pseudomonas aeruginosa
LQKLPLKFPGSRIDTLQLAGSKEEFEARTKGKLQCIVFVFVPGRNFQDIQPEQRFAIRRQRGLQVGDAQYGAAIGVHSRHGRRDTEGNLQFLGGNVLPAIVDPGLRQHGSAGGIADPQGDLALAGRKDDASALCDQPGVSRSDAQGDGHGACRHERMKTMH

SEQ ID NO: 28430 - protein, 331 aa, Pseudomonas aeruginosa
LKNQKRRNKNSSKTSSSITFPSPLRTISVAYRPINHPVDIGILEDRPAWVSHDEENPMSAHSHSGWITVGALADGFAPDNHVLPACGDLAGLERVLHFANGWVIEHAFDSQRLRWRLADGSASGESDYRASSLRENLYLVDFLKQENGRPVSVSLVLDFDNQAFTAVLGHLPDRTACEQGLFSRALAGRELTGVKAEFLHGSLDRPWQPDACPHVPSDELVGLRNRYVYSASEAYEHVYLNPDFYAWQCLRGAERGLADTDRCHCYRLAERLYLFVWREKIVPTLGVLLIDLEAGRTDGKIFGYQDDDFATPVNFPVGALAQVLNQTRHDL

SEQ ID NO: 28431 - protein, 282 aa, Pseudomonas aeruginosa
  UNSURE (260): Identity of amino acid at the above locations are unknown.
PARRPAQRTSNCTTACSAIAWANCWSAHREALGEPRRTGHRRRPGHRPGHRRMLRRRRRQGSAGDAYRQPRPGRPGGDPPGRRHGRTAGRRPERARRRETSGERDPGALRPVGHPPAQRRCLSPVRPRGTGRRHPGTDPGGEPEKLLPADPGRPSRPAPQRGRARPGDLLGDRPAHGDPWALALCGEQGRGQRFHPRRRAGAGRRRHHRQRRRARPGRDSGAGQPPATPPRWPRTSPSGVSASRWTSPTPCSSSASDEAXYITGQTLVVDGGALLPENGGLA

SEQ ID NO: 28432 - protein, 126 aa, Pseudomonas aeruginosa
SRWRSPSPSRESAFRRIRQTLPPAPVGRSPCPTDKGRPFAGRLSKAPAKWMNKNDSQQVSIGNPQPRGFASCSAPPPMSVPNRRHATSIACASTGATSSKSNSLPSAASSTSATPTASCSPTPTMS

SEQ ID NO: 28433 - protein, 179 aa, Pseudomonas aeruginosa
RKATTGWYGTCCRPPCRRSGAAPPASTAVPRRRASPPRSFSRQACTRSARPSTTQPCPPSDDRNSTSARRTSSPRRPTAACTTSSSTDAISPRTTRPSALSCTSNCSPPSSRTWKASARWKRYSRRPMRIATRSPSPATRRRWPPAPTSSAAPMRKRASARRTGWPERRPQRRCAGGIE

SEQ ID NO: 28434 - protein, 461 aa, Pseudomonas aeruginosa
ALRQDRRRRRLHRLPVPLTPGARRPGGRAPPPPAGPPGLETDMAHNNNSASYENVLLCVLFLTFGFVFFDRLALSFLFPFMEQELQLSNSHLGMLSSVLALAWAVSGALVGAWSDRRGQRKPLLIVAVILFSLCSALSGLVGGFLSLLLFRGIMGLAEGPILPLSQSLMVEASSPHRRGLNMGLLQGSAAGLLGAVIGPPLLVALAEALGWRHAFIVSLLPGLLIAWLIWRHVRPDPPRAQRPAPRAEEAKGKRLALLKSRNILLCTLISCVFVTWFIVLISFTPTFLVNARGFSPATMGRLMSCLGVAWVVWGFAVPAISDRIGRRPTLVAFSLLAACCPLALLYAPNATSLGLLLLLTYTGLGCFTLFMATIPAETVSRGVIATALGLIMGLGELVGGFLAPTVAGFAADRFGLSIVMWMSCGGALLAAFLSLFLRETAPAVLARQRSAPTSVLQGNQP

SEQ ID NO: 28435 - protein, 567 aa, Pseudomonas aeruginosa
PAACPWSRPSSTVSRPCCATSRRSRCWSIPTRPWPTPEGTIADGFPTRYLRRPAGAGHWRQLRHRRGHRHAVRRTRRRSRRPRPGRRRRARTASSADSPGRTGHHRQPAPATAVRSAAAPGCAGEQRRHQPRPRGIRPGYLRTGAAPQPERRHARQPTGPAAAGAARRQHPQHRLDVQHLRFRRPPGLQRQQGRHRPAHPFPGLRVCRRAHPGQRHRPRLDRHAAGRRAQGRRRGHPPDHAAHAAGALGRGARGGQRRGLPLRSRRQLRHRRRAGGGRRLSLRLSRLRSGCTCPLGADSDSHDRTTTRRVPCHENPPHLAGAALRRFPRSLRAGRRRQPQRPAGRVRRTTPAPRREDPRAVLEPVAEEPRHRPAPAQLRQQRRPVPRRRPRPRHPRRPGRRLAAHRGNPVHPRPRHRSAHRAELAGRGGQLLRRRAAAQRHRRQPAEPAHLAAAVAGRTPRQPSRTDQCAALFPDLQLRDRGHLQRPDHRRLHRHPAAALRRLGRLLEVPGDPDPVPARRGLRVQPGGLPEEAPWPRFRHRRRQRHQPAAGDRRQARGKPRSLPLAL

SEQ ID NO: 28436 - protein, 667 aa, Pseudomonas aeruginosa
PRDSRAGRQLPEEERPAHHHRRRWPADARVPRSQHGGPDRPRHHDARRRRPAALPRAARRQAQGHAGADAHRAQRRDRPHHRPGDGRRRLPDQALLRPRTACPDQRRAAAYADAAAEPHREREQPADRLRPVATGHQRPPPARRRRHRGRPQRRRVPPAAGVPRSSATGTQPRPVAQPDPGPRGGHLRPFHRPAGQPPAPTPRRRRPRTGVHQDRAQRGLCVLAAGATGRGPSMKLTVPRPRSLAARLALILFAGLVLAYGLSFASQFYERYQTAKHMMLDSLEQDVAISVAMLDRLTPAEREAWLPRLERRTYRYRLDAGEPGQPLALADAPVAAHSIERALDGQYPLTLRTVADSRPHFQVLLRLRDGSPLTIDVTPAPVPLSGWLPLVLLVQLLLLLLCTGLAVRTAIGPLTRLVKAVEHLDPNRPAQPLAETGPREVAHAAAAFNAMQARIADYLKERMQLLAAISHDLQTPITRMKLRVEFMDASSDRDKLWNDLEEMQHLVREGVAYARSMHGSTETSCRVDLDAFLDSLVFDYQDSGKQVQLDGRTGAVIDTRPHALRRVLVNLVDNALKFAGAARLEVERRTDGGTRIQVLDNGPGIPAEELDEVLKPFYRVENSRNRDTGGTGLGLAIAQQLSLALGGRLTLANRAGGGLCARIELDP

SEQ ID NO: 28437 - protein, 252 aa, Pseudomonas aeruginosa
GARTERYITALGGHTADKPACNTPGHGKRRHIAEPLPATRSPTMTVPTSQSAWHGWRLFAVLAVAVLCMTALVLALQAQPVEGLRSAIRATARSSFALFLAAFLASSLATLVPGPGTRALLRERRYLGLAFAFSHAVHALLILAYWKLFPETFWSGRSVAANIPGSIGYLFILLLTLTSFRTPARLLGPRAWKALHSTGTWVLAGIFCLSFFKRIPMGGWYVLAFATIFSAIVLKLTAKLAVRLRRRDVQPA

SEQ ID NO: 28438 - protein, 141 aa, Pseudomonas aeruginosa
TSPASSPTRSSAWFAGIRRTARGCCSIAARSAPWWWMSACTTTSASTAPATPSAWRRSRSACWREWARCATSTTRSPPTVPTRRAGTPPRRSDAWPNGTGTSTRRCSAPSSRRWASTRSARWSGWKAGASAWSSNNTAARC

SEQ ID NO: 28439 - protein, 97 aa, Pseudomonas aeruginosa
WPPSKRSSRPAMRSKESHSTGSRLSPSWVSMRPRGRRLNRATPRRSSRLFTWWLTAAWVTHSSMAARVKLRCRAEASKARRAFSGKWGRTNLCSKFF

SEQ ID NO: 28440 - protein, 439 aa, Pseudomonas aeruginosa
WLPRVFVVCRKSCASLDFPRPPIKERSRGGFSCSQRQRTPILMRDTRFPCLCGIAASTLLFATTPAIAGEAPADRLKALVDAAVQPVMKANDIPGLAVAISLKGEPHYFSYGLASKEDGRQVTPETLFEIGSVSKTFTATLAGYALAQDKMRLDDRASQHWPALQGSRFDGISLLDLATYTAGGLPLQFPDSVQKDQAQIRDYYRQWQPTYAPGSQRLYSNPSIGLFGYLAARSLGQPFERLMEQQVCPALGLEQTHLDVPEAALAQYAQGYGKDDRPLRVGPGPLDAEGYGVKTSAADLLRFVDANLHPERLDRPWAQALDATHRGYYKVGDMTQGLGWEAYDWPISLKRLQAGNSTPMALQPHRIARLPAPQALEGQRLLNKTGSTNGFGAYVAFVPGRDLGLVILANRNYPNAERVKIAYAILSGLEQQGKVPLKR

SEQ ID NO: 28441 - protein, 157 aa, Pseudomonas aeruginosa
WCHERFPAPPPALPARRLRLRTRAPGGARRGPSHPPPDPPGRAAPGRSPGSPAQPGRPGTPAAAHGGTTGHPPADRPGLRRGAQHARHPHALRGAAGALPQDPPGDPRRHPPRPGEAPGSRLRPAQRPRPAARRLKALNDRKRMSLKTWAGFRSIGG

SEQ ID NO: 28442 - protein, 1490 aa, Pseudomonas aeruginosa
RPWRYPPYRPHRMQGEPRVRLNPWRDWPPRRGSARRLRLHVAEHRLQAEQAGIAQGAQFVEADAGEDFHAAQRIGAAQGLLQLAGTAGQGAGANGGSAALDGMQGRGAALDIALAELAFELGEEVLHVRNEAPQHLDDQLQAAAETPDDIAPRLDQFARVRCRCRRAPGAAPAEMTEQAKHQALLVDRLRHMVVHARRQAGFAVGQRGVGGHGQDRQPGEAPVGADSPGRLETIDIRHLHVHQHRVERHARLQHLLNARQPAVGEGHPGALAAQQLGGDLAVQRVVLHYQQTHAPQPLGALHRARRRVGRGALFAVQRMQHRVGQLLGRDRLGEKIDEGRRAVVARIGQHLAAIGGDHDHHGRRQVALQLADQLRRAEAVEIGHAPIHQHHVVATALGHRRLDPRHRLAAAADAVGAPAEGADRAFEQLAGHQVVVRHQQPQRFAGPGAGRTQRLVVGDVEVQVEPEPATAARRALDPQFTAHQVDQAFAYEQAEAGAAEASRGGRLGLGETFEDALLLFRADADAGVRHQHPQAHQVGVVRQTPQAHQDVPAGGELQCVAGQVDEDLLQAQAVADHRAGQLGIDVEDHLDVLVALVAGEHHGQVLHQRLQLEGEHFQDQFAGLDLRVVEDVVEQAEQRGCRRAGLVQVVALAFVEIGLPGQLQHAQHGIHRRADLVAHVRQERRLRRAGGVRLLLGLAQARLQLLVAGDIDIDPGDLQRVAVGVALDLRAGLDEADAAVGQHHAEDHIVVAAPLHRRAQAGLGALEVFRMQAAAPMLVDQAAVAQRQRLAIQLAHALVPLQAVVGQVPAPDAQARHVGGHLQLVARRGHLALGVAPFGDIDGDAQVAVDRPSLVAQDGNRKRHAERRAVLAQIGPFAGLGALLFGPRHQHAETLLAQLLAAGEQLPLAVQQGRRGLADHLVGAVAEHPLGTEIEAADDAIAVEGDDRHLGRRLQHAAEQYVQPTQFGGTLGDLVLQAGIELADAGLGGLLRGDVAYGLRGADHAAVRTEDRRDGHRHVEQVAILVPAHGIEADHLFFTGDAGEDVEFLVLLGWRHQQVHHPPPDRLLLAVAEQRLGPAIPVADDAVEADADDAVRRIADDRRQPRLGRRLPTPAQAAEGAGVDQRRQQQADQAAGQEQDARRRLVQALDEQRQCAERHLPVPTVDLPPQHVAEQALSRRRGAVDEEGHGSAVAGDVAEFEVDSRVVDGQPGQHLAGQQRRIAPAEAFEFALGPRRWSDAAAVDRHQDEERLLAQAAGLDQGDRPRQAHLPGLQGGAGGLPAIGFRGDVQAQRLAVARHRLDVLDDVALAIVRSQLLDAELRLAVGPRLAQEPGLVGGRHPAYEAEAAGAGKLTVDVAGQAVAAEQFAVDVRLARRQQGTAHPAQAILVEFHAAGHRLGQQFRLAFQRHPRLLLVDQRQPPGAQPGQQQSECQCRARPAAQPELALLYVHPIFRPCAAPARGNPALPAPFRPRRLDQAGGFLRRIIRPQV

SEQ ID NO: 28443 - protein, 333 aa, Pseudomonas aeruginosa
SPSPPARNLPGAPLSGCRGSSTPPHPLHGIAHVSSPCDQRLGQSERHAGNPLPTRSATTERNRQRQDLPTVPPVRPGDPQYRRPQRQRQDHPRRLQGLRGAYPPAGPRRAPGADQRAGRRLRRWRDDRQYSRDAVQRPARHRLYPERAGQPARRPGQLPGPHRLRLPAAAQRPYAAPRRRAEDRRVLGRPLDQQRGIQVHQEGRPRTRPAQPGCLHRLRTGGDEGADEGRHHQPRQAAHRRRPLPGPDRAGDHRRRGAEPDRQRTGDPAGHREAPGSLRPRRPRGHHLPRRRRDRGGVPLPAGHPHAPGQPGPALPGHPHRSPQRRSLPAAAP

SEQ ID NO: 28444 - protein, 140 aa, Pseudomonas aeruginosa
KLPAPVRADPREHGQPPAQPQPAAPRVGGQPAPRVFRDRRRQRQGQRHPHDRAIRALRDPRRPGGDAAAGPPAAGLRQAAPDEAARRRGLRPLLPGGADRGGLSAPAPASLRRARGCPFIPSRAYGFLLLFSVHASNRWP

SEQ ID NO: 28445 - protein, 354 aa, Pseudomonas aeruginosa
PARRTGPPFAVGRRRSRRPRLPRPCRTHPWLAGASGARAARQPQRLAGGAAGRRAAGQERLAGKRPAGRRHEPRAGGGATALRRPAECDTGRGGLRGGLRDGRRDAGRRVSLQTTSSTPARSAATVVAGLRPGNRGALAGVSRTARPADRQPRSHRPCAGCGTGYIPFVSSMGSRRSLTAWRPGWTIDDEHHPGYPGELRGRTHPRAWRDPAARGAGHPARGRHGPRGKREHPGATGFRRLAGFLPDAGAGGAGGPAHARRGTDRQRPMVEQRRDADRRTPVRRDRPQLQGSVLPGVRDPHRGHAVDHLLHPQRPAHHRPGPVAQRHRQPAQQRHRRTAPDDRLRPGDGLPFPS

SEQ ID NO: 28446 - protein, 776 aa, Pseudomonas aeruginosa
RLRRGGRREPSRRPRKLPGATLPGLGHPGPGASPVHPEPDQADRRRGLYADARVSRAEPGDQRIVRSQLQRAAQRFADPLRIPDQHGRARLDEHLHRGRRQALGTVFLPSHVAQADSLPGAHVVPDLLPGLQRHRRAPGAGAYRRTAARVHRAQAGPGSPRAGRRRPVRRTGPPGRWHRRTDSLRRRPGHARRPHPEHPRRLRAPGRECPATPAARPGTGHLPHRQLAAAQRGLSGRRRLLRCAGDPFPPPGIGLDLLVPPRGSAPHPLGRQAGKAVDHRPLRPAADPARLVRGLGGSGPRPLHALERNRPGDRRKAAPGPDGTVPQPCGRGRPHAPAPDRGARPRPAQPVAVDLHGGGPAVLQRHPHHRTAPTHFRVQQPHGTAGQPDPRHEPPAIGHRPHREPGRHRRLATGAADRLRNRRRLSRPGDRDRHRPAGSCRGRPGPLRPGRRQPAEQRPSSRPARPAGAGNPDPPGRRGVPERAQRNQRPLRSAAGQPVRTVQARVGGQPAQPQRPRYRPVHLPGHRPGPPGAYRRGLPRRRHHLLPAPAGAPGGDRLLVLTTRTVHNATLAGIFGSHRRLTGSPRSMPRLRLRTVLACLAVFCATPALARVEVHSLQHKSMGRVLTVRVSEEIAPGDYETLLKGLRNNPGTYSRKLLLLNSIGGSVPEAIRMGRLLRESGFDALVPSSSVCQGTCVYLLAAGKRKTVRGYVGLHRPYYAHGDSLHSRSANGMRYDSAAYFREMDIPSTLVQAMQSTDPKRMRVLSAKELAQYRLN

SEQ ID NO: 28447 - protein, 622 aa, Pseudomonas aeruginosa
PEVRQPFAVDIAAVFDEEGLGPGRAEFGLDVPRGQGQVLVPVGDAEPPAIDEAAEAPPLRQQIWQAGVAMGDHQVFDRRTPVEQQAVQLRGAATAMVVVEVRLVHQPGLDPLAHGVQAPFQAMIEGTGGRIEIVQPAQGGGHQAHQALGLQLAALRQRGQRVPRHGAHQQPLPAVALGFVQHLRAIDAGTVQPAQAGDFGGQLGMCGQHFLLDEQGRPPRNLQAVDSGRGTSFALPSPAVAGKVVGPGGGSLRRHGGGCIMHGETLPVRVGARVYPPTRSATGLPVGLSLAVSAGGEPRVTHEETTEVGRVLEAELVADLVHRAAGEQQQALGLLHKPFVHQALRRQVGDAPADVVEARLGDADPAGVERQRPVLGIALLDQRVEALEDLQVFVAHRPRSHRIGRETQQADHDQPGQRQQHLLAAGTAGHRLAAQLLEEQRQARRLLGRAALQVAQRHAGRRHLRAGRQARLGLGEAPHQLLAHGQHMAIGVRLGDEGVRHGRRGEEEHRPRLQVLALVEIDPHRAVLHVVHLEETVVPVHRHVATEESGQVAQRIVVHLGVGIALVVDLPDVDVGDRLALWHGDLLFVVLPGCARKPSRASVYRRRRLLPPPRDEWRSNRG

SEQ ID NO: 28448 - protein, 242 aa, Pseudomonas aeruginosa
HINEFSPGRPPRRSLIAPGDTTTMSRALNDVAAGTLFGVALNYKGLLDSRLPEFQQPPYQKPPVKPVLFIKTPNTRNEHDAPVLFPRGVERLQPGPALGVVIARDASRVKEEEAMAHVAGYVIVNEFSLPEDSYYRPAVKAKCRDGFCPFGPQLVPTQEIADPHALELKLYVNGELRQRNNTANLVRDIPRLIAEISEFMTLHAGDVLITGTPEGRVDVHPGDRVEVEIDGLGRLANSIVAE

SEQ ID NO: 28449 - protein, 748 aa, Pseudomonas aeruginosa
GTDHETRTHPLPGPGSPGHRGRRQRRPPGRRHPARRGPGGVAAAGHREHVRPRPELRRPCRRTVVQGAQRTAGVHQVAGHLHRPPPGQLASGQRRLHALRVRTGGGDRQAGAQRPPRGRPRLPGRLHGVQRLRDPRLPGELLPAQPAGEEPRRHHPGGAVDRRCGRGSRAEPADPAHLGQRRAAPGRQHRGHDLRHSLPDRILLQLHDPAAGRHDRHRHPGRPVRRGPRRRSGGGGGRRRSPGQPNRQRGRILPRPRTGARRMIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPAGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 28450 - protein, 177 aa, Pseudomonas aeruginosa
GALVQSGPPRPPAAPACRHNQKNPGQPPTAAPAARPNGPPGESSWAKSLWLPRSPTYPRCTCPSCPARATAAASRRSTGTARSAGAAANWGSTPSWCSTPTGWSTPATTSTARRTSRGSTPATSCRTSSPTWSTASPATRSWAASSPRAATRSAWRPWPTTPPPSARSTAPWYRCAT

SEQ ID NO: 28451 - protein, 109 aa, Pseudomonas aeruginosa
TTARAWAGPCARRWKSTTTARWRSSPAAHCPTASPRTARRRTSPTASGARSSRSSTMKSCRCGRKAAGRNSAGCSRSTPPRAMAKASCTTPRCSSAPSAGRPTTARRRW

SEQ ID NO: 28452 - protein, 177 aa, Pseudomonas aeruginosa
RPTSAPPAPGRSTRYSRSPPRTARRSPPPRPATRPAPVAPAASEDATMPHFIAEYTDNIEAEADLPGLFEKVHACLGASGVFPLGGIRSRGVRLDTWRMADGKHDYAFVHMTLKVGAGRDLETRRQVAEALFEVITAHFAELQARRLLALSFELTELDAELNYKRNNVHEFLNNPAD

SEQ ID NO: 28453 - protein, 639 aa, Pseudomonas aeruginosa
SAGCATPPRAPAWPCTCWPSSSPSAPAWSCGPPPPWSTHAEPRDPDHARSPSDPGSRQPPRRRRTLAPAGKAVLPRLPGHRHRGRLRHPARLGRAQDRRRARAQGPQDRPDLARHAGLVEHQRAGLRRLARRHVLRGGQRHPLPALHRAAGRGGAGVHPRQAAEGTGLHPVRRARGHRVGDPGAGDHRCAHPAGRPANESHAQGLRHHLRQRRQRRRGDGRPGRTARRYRPAAGTGNPLPQWRDRGVWRLRRGAQPPGQGRRLAGQQAGALRRLPGGRPGDPRRLLHPPGGGRAGGHLPRRLRPARQHLLPFRLRRHFHGPARQSLQATPAQRRGADRPVARPGRSLLRGAGRQRRLRLAAAGRRARAQRPAQPARPVAGAGALPRPAGDPPGAGRHRADQAIARHRRADPAGTDGRQRRPGRRAGARRALSAGGRTRGRQCAGPGLALEQRGGVPEPRRRADVPAGPGGKPGGPGQPRRDRRRRGRRRRVHRSGRPQRSHGPSRQSRPSRGAGGHRGRHPPHPHGRQGRRHPLRRRDTGAALPGAGLRVRRGGRGHQPADAFAARAGGALQGRRAGAVRQFLGLRLRGAPRSRCGRGVRSALRQVSASVRGRMPSVGGTTVAARSPSGRRARSNPPAP

SEQ ID NO: 28454 - protein, 416 aa, Pseudomonas aeruginosa
AGRATRRPLRATRRSTPGARAAGRPGCSHDRRGSWGSRRRSAAARRSAAARPPPHRPAPARARRLRPRRGAPARPPEAAATAPAAARRATRAGVARDRRGRPRRRHRANGSGCSCRFLHPGVDPGLERLQADPVEGVDETFRADPQVGEGFDDPFDHRRHLGSAERWPDHLAQRAVLALGAAEGDLVPLAAVLVDAEDADVADVVVAAGVHAAGDVQAKLADVVQVVEVLEALLDTLGDGDRLGVGQRAVVAAGTGDDVAEQALVRRAEAGCAGLVPQRVEVLQAHVGEHQVLFVGHTDLAETVALGPIGDAFHLLRGDVARRRAGAGLGRQHHRGVARHLVRLDVARGPAGEGRIGRTGAAVGQLAVGRRQVARQYEALGDPLALLGSQLCRAVAQVLPLFLHLAGESLDAQRLD

SEQ ID NO: 28455 - protein, 862 aa, Pseudomonas aeruginosa
DLDPRLVLVVAPAVAVVDPQDRLDVGQQVLPGQVVADHLAEHRRASQAAADQDPQAQLAGVGVAVKVQADVVHLHRGAVFHRRTEGDLELAREEQELRVHRRPLAQDLGQRPGVGPFVRGDPGEGFGGDVAHAVAGGLDRMHLRAGEVFEDIADLLQFDPVELDVLPRGEMPVAAVVVPGDVRQGAQLRRREGAVGNRHAQHVGVLLQVQAVLQAQREELLLAQFAVEAAGDLVAELRHPLAHQRLVVFVVLVHRKALIDRVSPPMTGRVRGEETGDRLRPCFWRQDGPVFTGTHYRPRTDSETAADSAEKNTSDGRRRRIRAACDRLPRGAYLYCPRSPGNPRQCWAAAFRRHLIRFFPLDLPLFRPSAGSYSRNRLSSLMGLRKMSERIPAIQVEPAAPAAPSKQPPAPGKLPSAVNGPIYTRSFTGLFRNFRRLGGGLLFLLFFGTLWLNWNGRQAVLWDLPERKFYIFGATFWPQDFILLSALLIIAAFGLFFITVFAGRVWCGYTCPQSVWTWVFMWCEKVTEGDRNARIKLDQGPASAAKLLRKTAKHALWLGVSLVTAITFIGYFTPVRPLVADLFSFQLDLESLFWVLFFTAATYVNAGWLREQVCIHMCPYSRFQSVMFDKDTLIVSYDAARGESRGARKKGSDPRAQGLGDCIDCQQCVQVCPTGIDIRDGLQIACIGCAACVDACDSIMDKMGYERGLVRYTSERALEGGQTRFLRPRLVGYAAVMLAMIGAFVVALNARPLASLDVTRDRGLFRENAAGQIENIYTLKVINKTQQPQRYRLQLDDAPEFRLQGEHTLSLKPGEILDFPVSVASTAERARAGSQPLAFSLRGIDDPSLAVGSTSTFVSPAR

SEQ ID NO: 28456 - protein, 501 aa, Pseudomonas aeruginosa
IAGSGRRPVSPLDGGRRLFISFGTVQMNKATTEPAYNYKVVRQFAIMTVVWGVIGMGLGVLIASQLVWPQMNFDLPWTSFGRLRPLHTNLVIFAFGGCALFATSYYTVQRTCQVRLFSDTLAAFTFWGWQAVAVILLVSLPLGNTTTKEYAEIEFTGAIWLAIVWVAYAVVFFGTLIKRKVKHIYVGNWFFGSFILTTAMLHIVNHMSLPVSWFKSYSMYSGATDAMVQWWYGHNAVGFFLTTGFLGMMYYFVPKQAGRPVYSYRLSIVHFWALITLYIWAGPHHLHYTALPDWAQSLGMVMSLILLAPSWGGMINGMMTLSGAWHKLRDDPILRFLVVSLAFYGMSTFEGPMMAIKTVNALSHYTDWTIGHVHAGALGWVAMITIGSLYHLIPKVYGVEKMHSVGLINAHFWLATIGTVLYIASLWVNGITQGLMWRAVNEDGTLTYSFVESLVASHPGFIVRLVGGGFFLTGMLLMSYNTWRTVRQARPEGILAAARMA

SEQ ID NO: 28457 - protein, 476 aa, Pseudomonas aeruginosa
LVSKVQKSSGKNTGCMRVCRRKSTVSAVQGQAQREQAADAADGHHQRHRQHAGQRQPADRQAGQAAEAELPGHRHRRSRPGLSGIQRQQAGDAVGAEQAGDADEAQQAGHQRPQPAPLAERRIAEEEQPGHAGQQAAGPQQRPRTVAAHQARAAPGGEHHAEDVQAEEPAEALRAHAEMLDEHEWRGADVGEHPGERQPHAQHVAQRATVAEQPPIGEKGLGQAAAAALRRVAFGDPPDRQQAEPGEQRQDHEQRAPAGPEHQVAAEQRRGQRCQHGHHVHQCQHPGGLAQRIEVAHHGPRQHRRGAAAEGLEHPQQDQLPRAVGQHAGQAAEQVQGDTGQQHRAPAETVGQGAVEQHAEAEADQEAADAPLHLGIAGAEIGGDRRQARQIHVDRQRAERHQRRQQQQQASFAASDLNPRCTRRHARPPLLRLSVQTTPPCTRMQVRRPGNPRAATSFTLAARGPGSFRGPTTLTD

SEQ ID NO: 28458 - protein, 563 aa, Pseudomonas aeruginosa
QRWHAAVRSEFEGAGGRLQSPRPDRQAALFADPATGRHPHAATAGGVPRRRAPVAADLRRRAADLQRDRGSHPHRGAIVEVAHPRVGRQRRHVHHGPRQGPRQRRVQSRRRDLRLHPSAQRQLLLRPAQGHLPAALSRPAAHPAAGRRAVAAQRPALLRQRRRRRGDLRAGGQSQPQRHAHPARRRPRLRHRCPEDDRQRRLSGAQRLHHALRGQPHGLPDLHPTAGEILATALRLRLRRPRPARPEPHDPLCTGPRHRPRRRPRRRQRMGAQHRPVLRDPERTAEERRLEMAQHHLPQPLRCGPGREPLHRQLHAKALVKRGPLGPQAPQSSSRRCKCCFLPRLRRSPSTSPASGASGSLTGVPSRRRPPPAARRRTALREGWIACSSSRSVSDSPCARRARDSFITGRPLSRVPSANTPRAASAADRAACSPCARAVAALARTTFASFSSAPCKAPRRRTSSIGSSLNRARKRPTSRSSQLRQNCQKSNGARRSALSHTAPCADLPILRPSLVASSGMVRPNSWAPPWRRDSSTPLMMFAHWSAPPSCRVQPRRRDSSTKS

SEQ ID NO: 28459 - protein, 728 aa, Pseudomonas aeruginosa
NRPGIGRRTLQLRRRCHRRCGQGVQRPAQHVGHLFGRQGVQRRRPDPHPSTGRHPRLRRVQGRRRGRRPARRRHQPHRLPLRHRVDLIPGPRPAPVAERASTVAGDPDAPGGDLGPGNREGATSAPIRRTAMHDLIQHADAFVGDPDQESGGLSRRSFLGKSATLGAVGLVAGWTPAFVIQPAEAAASSCPAPAGFPAGLELYRRAFRNWSGEIAADDLWSCAPRTNEEVLAVVNWAWQNGFKVRPRGMGHNWSPLLLKGGENCESRIVLVETSRYLTRVRIDAQGEFGLFSAQTGVTMEALLKQLERVKLGFVATPAPGDLTLGGVLAIDGHGTGIPAQGESRLPGQSYGSLSNSIVALTAVVWDGAAGQYVLKTFRRDDPACAPFLVHLGRAFIVEATLQAGVNKRMRCQSYVNIPASEMFAAAGSGGRTFDSFLQKSGRAEAIWFPFTDKPWLKVWTPTPRCPFGARAVNGPFNYPFSDNIPKALSDLLAAINTGHPELTPLLGKLQYDLVVGGMALTLGYDLWGWSKDLLLYIKPSTLRVTANGYAVLTRRRDVQRVINEFYLQYQTMVAAYRANGHYPMNGPVEIRVSGLDQPGESIVPGAQVPSLSAIRPRPDQPEWDTAIWLDILSLPGTPQANAFYHEFEAWLFDHFSGDYASLRVEWSKGWGYSPAAAWDEPTVVDQLVAQSLRQGLVADNDWDSAVRQLNEADPHRLFSSPLLDRLMP

SEQ ID NO: 28460 - protein, 277 aa, Pseudomonas aeruginosa
STSSSSCACSSCRASAWPTSCSRPRRSATATSSRRTFASARRASRSRACATATRNRSPGSSTASTCASPAASRWPSSAPRAAARAPCSTSCWASSRQGGNRSAMAGLDLAQLGLEGLRELVGTVLQDDVLFAGSLNRTTSVFLTRNRTCPGWRQCAQMAAIHDDIQAMPMGYNTLVGDMGTVLSGGQKQRVMLARALYKKPRILFLDEATSHLDVHCEQRVNAAIRALRITRVMVAHRPETIASADRVIVLGQGKVSLDESTARLAERQAAAAREQA

SEQ ID NO: 28461 - protein, 775 aa, Pseudomonas aeruginosa
AGRPRRLEARIREVSQRYGMPLEPRRLVHGLSIGERQRVEIVRCLMQDIRLLILDEPTSVLTPREAEDLFVTLRRLAEEGCSVLFISHKLAEVRALCQRATVLRGGRVAGQCVPAQCSDLELARLMVGDAEGLAAEYPKVTGGAPFLQVRDLHWRNPDPFGVSFAGLDLEVRSGEILGIAGVAGNGQDELLALLSGEVRLPRAQAERIRLGACAGAHLAPDARRRAGQAFVPAERLGHGAVAGDEPGGQCAAHRLPAGTGEARVGPAAQGAGAGRGDHPPFRREGPGCRGAGTHPFRRQPAEVHPRPRDPPGPAPAGGGASHLGRGRRRGGADPPRADRLARCRYGDPGGLRGPRRAVPAQRPHRRAVFGSAVPGGRHRERFAAAGRRLDGRSIRGAGGSRRRRCPREPVMLLSLEPRGRQSRWMLLASPLLAGLLTLVCGALLFACLGHDPWQTLHTVLVQPLSDLYGLGELLVKAMPILLCALGLALAYQARVWNIGAEGQLLVGALAGSAVAIQLLDWQSRWALAWVLLAGTAAGALWAGFAAWLRTRFNANEILTTIMLNYIALNLLLYGVHGPLKDPDGFNFPQSALFGEASRLPALFEDSRVHLGALFGLLALAAVWVLAQRNFLGFQVRVLGLDRRAAGFVGFREKRLVWFVLLFSGALAGLAGVCEVAGPIGQLVPQVSPGYGYAAITVAFLGRLNPFGILCASLLMALLYLGGEAAQMSLNLPLALSGLFQGMMLFFLLACDVLILYRPRLHGRWRKRPALRDALA

SEQ ID NO: 28462 - protein, 215 aa, Pseudomonas aeruginosa
INGAFLPNPVKILPVDLKHPIQLREERLMSLINTQVQPFKVNAFHNGKFIEVTEQSLKGKWSVLIFMPAAFTFNCPTEIEDAANNYGEFQKAGAEVYIVTTDTHFSHKVWHETSPAVGKAQFPLIGDPTHQLTNAFGVHIPEEGLALRGTFVINPEGVIKTVEIHSNEIARDVGETVRKLKAAQYTAAHPGEVCPAKWKEGEKTLAPSLDLVGKI

SEQ ID NO: 28463 - protein, 522 aa, Pseudomonas aeruginosa
TMLDANLKTQLKAYLEKVSQPFEIVASLDDSDKSRELLGLLQDIVGLTDKITLKTDGSDARKPSFSLNRPGADIGLRFAGIPMGHEFTSLVLALLQVGGHPSKLDADVIEQVKGIEGTFEFETYFSLSCQNCPDVVQALNLMAVLNPNIRHVAIDGALFQDEVEARQIMSVPSIYLNGEVFGQGRMGVEEILAKIDTGAAARDAEKLTARDAFDVLVVGGGPAGAAAAIYAARKGIRTGVAAERFGGQVLDTMAIENFISVQETEGPKLARALEEHVRHYEVDIMNLQRASKLVPAKNTGELHEVQFESGGSLKAKTLILATGARWREMGVPGEQEYKAKGVCFCPHCDGPLFKGKRVAVIGGGNSGVEAAIDLAGIVAHVTLLEFDSKLRADAVLQRKLYSLPNVEVITSALTSEVKGDGQKVTGLVYKDRNSEEFKSIELEGIFVQIGLLPNTEWLKGSVELSPRGEIIVDARGETSLPGIFAAGDVTTVPYKQIVIAVGEGAKASLSAFDHLIRTSAPE

SEQ ID NO: 28464 - protein, 257 aa, Pseudomonas aeruginosa
AEAAAGRRQRGGLPDPYPARGAGEERDPGHARPGDQPRAGPDPGPGHRQGHPRDRDHGRRPLQRRQHHPGRRIQYLRRPPRGGNRAQERGADHHAAARRDPQDPHQPRAHRQAAQPRQPGRQDRRRHPRRLRPVRHQVLRPEGRPGARRHGGRLPAQALAVQGQADQRAGRQPRGHHLRPDRGRLVRRPQAAGQRRVDQRGRCPGVLRPAHRAYRPPALSLSPYGRRRVSRGAGWRVGAGPARRRRRRSCRAPTASG

SEQ ID NO: 28465 - protein, 118 aa, Pseudomonas aeruginosa
AAGRTLPGSCRRGRGSDPRRSAPGRAGGFARRSCRRRRRSHRPACRGRWHSRPRRRCRCPARRRGRSSGWPAPRRRVRSGRCWRGRSRPPVRAARRAVSAARCPAGRGPRNRSVRTVP

SEQ ID NO: 28466 - protein, 267 aa, Pseudomonas aeruginosa
RGAQKRELERSCPGGQVIASAGGLNAKPRPMANPALTGARLSMKHRRTQSRMSVLRRLAAVLGLGACALAAEAAEPLKIGFVYVGPVGDHGWTYQHELGRRELVEHFGDKVKTSFVENVAEGADAERVIRNLAKDGYGLVFTTSFGYMNPTAKVARQFPKVTFEHATGYKRDRNLGTYLSRSYEGRYVGGFLAAKMTRSHKIGYIASFPIPEVIRDINAIQLALDKYDPQAELKVMWVSTWFDPGKEADGAQRADRPGRRRGVPAHR

SEQ ID NO: 28467 - protein, 321 aa, Pseudomonas aeruginosa
SRTHPMYEWLNALPKAELHLHLEGTLEPELLFALAERNRIALPWNDVETLRKAYAFNNLQEFLDLYYAGADVLRTEQDFYDLTWAYLQKCKAQNVVHVEPFFDPQTHTDRGIPFEVVLAGIRAALQDGEKLLGIRHGLILSFLRHLSEEQAQKTLDQALPFRDAFIAVGLDSSEVGHPPSKFQRVFDRARSEGFLTVAHAGEEGPPEYIWEALDLLKVERIDHGVRAFEDERLMRRLIDEQIPLTVCPLSNTKLCVFDDMSQHTILDMLERGVKVTVNSDDPAYFGGYVTENFHALQQSLGMTEEQARRLAQNSLDARLVK

SEQ ID NO: 28468 - protein, 577 aa, Pseudomonas aeruginosa
  UNSURE (297): Identity of amino acid at the above locations are unknown.
GAACRVARRATRKAFRRRRLLGIDDKHYHLRACSAFPWRRPGAGFRAAVLTDARPRPTSRPAPGCLAGRRRCGAPRGSPQGLPGPAPAHGKPGQPLGLLPGDRRRPGPGAVPALLAAPGRPGGGAWQLPPAQRAQPGHRPLAWRRIAATATGRLAAGAAPGRAGQSRAGARGRRPVAPGRGRLARPARADPADFPAQSHPRPHLRGDRPGHAAFPKRRGKTYDARPRRLQGEPGRPGRRAGKERPAMTRPDSDAAPYEPVLEQTAQAWLVRLRGTPDAATRRAFEDWLAQRPAHAEXYARAEALWRLTEIPASRLAIEEADALEAYLRPRRASRNPRRWAYPLASVACLLAMLWLGGWWQPGDWLQDWRADYVAAPGQVAEWKLADGSYLSLDAGSAVRVRIDGGQRRVELLRGAAALRVKRDALPFVVEAGEGRARVLGTEFEVRRGAGATRVTVLQGRVAVSAGTGAGAAEEVLGAGQQVGFADGKLGRPVAIDAAAALAWRQGWLSFYRRPLAEVLDELARYYPGRILLLDDALGRQLVSGSFRSDDPEAALKSLQAVLGYRQQILFGRLVVIR

SEQ ID NO: 28469 - protein, 803 aa, Pseudomonas aeruginosa
KSDRHEQPMTPFPRFALRTLPALFLSLGCLAATVQAAEAVRYRFSQAAAPLAQALNAFSRASGQTLLYTAELPPQATAPALHGSLDAEEALQRLLQGSGLRARRIDERTLTLEPIPASGALDLDATTVSAAAPAQGYRPAANASISRGDAPVLEIPQAISVVPAQALQDQRPRNLDDALGNISGITQANTLGGTQDAVMKRGFGDNRDGSIMRDGMPSVQGRNFTATADHVEVLKGPASLLYGIQDPGGVVNVVSKKPQLQQANALTLRGSAYAHGRNGSGGQLDSTGPLGDSGLAYRMILDHEDEDYWRDFGKSRETLVAPSLAWYGEDTTVNLSYEHREFTTPFDRGTAIDPRTNRPLDIPRSRRLDEPFNITEGRSELTRLDLERQLDDTWKAHFGYGYSRETYDDNQARVMAVNADGTLTRRMDGTHGAVSSDSFATLGLSGTLQLAGMQHDLQFGMDHEKRKIFRADLLRDSKTSRFDYLDPVYGQVVPSTRVVAGDSDQTDKLRSDSLYFQDSIHLDERWILVGGARYQIYDQLAGRGRPFNANTDINGQKWVPRGGLVYRLSDEVSLYGSYTRSFKPNSTIAPLSTGETIDSAILPEQATSWELGAKLDVPGRLSGTLALFDIRKKNVLVNELDGAGNSSVRAAGRVRSRGLELDLTGQLSERWSLIGSYAWLAAEVTEDPTLEGKRLQNVARNTASLSAVYELGQLFGGDRLRLGGGARHVGKRPGDPANSFDLPSYTVADAFASYDTRFGGHGVKFQLNVKNLFDRTYYPSSANRLYVAMGEPRQFQVSTTVEF

SEQ ID NO: 28470 - protein, 202 aa, Pseudomonas aeruginosa
VVPPSSAFSLWGKEGGEPPGTTSPHATPRSQPARWVPCPHHSPPRPPHEPRQPHQVPPPRLLPRSRPPAQLRQGGGCRGGVAAGDLQDPQGTGGNPRRAPVRTEQGRRRADRGGRDLPALCRPLRAGPARRGEHPARPRGAGRDGAGRRAVDGGEPGGARGDPAPAPAPRCAGGQRRHRTQRLPAGATEGRRAGPGGRADDR

SEQ ID NO: 28471 - protein, 243 aa, Pseudomonas aeruginosa
QEPDMHDAESRRFVIRDRNWHPKALTPDYKTSVPRSPSQALVSIPQSLSETSGPDFSHLRLGRHDNDLLLNFDHGGLPQGERIIMFGRVFDQYGKPVPHTLVEMWQANAGGRYRHKNDRYLAPLDPNFGGVGRTLTDSEGHYYFRTIKPGPYPWRNGPNDWRPAHIHVSVSGPAIAARLVTQMYFEGDPLIPKCPIIRTLADPEAAQSLIGRLDMSMANPMDCLAYRFDIVLRGQRKTFFENV

SEQ ID NO: 28472 - protein, 291 aa, Pseudomonas aeruginosa
SASLSVTRARTSMSELPEHPATLAPPTVLSPAKRIEAFTGDPNFMTSLARGLAVIHAFQERKRHLTIAQISHRTEIPRAAVRRCLHTLMQLGYATTDGRTYSLLPKVLTLGHAYLSSTPLAITAQPILDRLSEQLHEACSMATLEGDDVLYIARSATPQRLISVDLNVGSRLPAYCTSMGRILLAALDDDALHAYFGGVEMQAKTSRTLYTPETLLPCLVEIRRQGWCIVDQELEVGLRSLAVPVRDSAGHVLAALNVGTHAGRVSRAELESRFLPLLLEASRELSARLFT

SEQ ID NO: 28473 - protein, 102 aa, Pseudomonas aeruginosa
RPPRRSWPTPATCFPIPSCVPPTPGSSLPARPRSARWCRPPCRSSPWPATASATRCSTSTSRCSATMSTASGSPSACSASRKSPPAARSARSPRRWTSAAVR

SEQ ID NO: 28474 - protein, 155 aa, Pseudomonas aeruginosa
ASAAWSTPASPRRPSTAWCCPGRRCPRSASSRRSGCSTSKARRVCNRCGWHATPARRWSSTVAWRRARRWSRWAANCSIRARWSRWPSRRSRPRAPPAATPWAEASHEAVFPRRPVRLRPAPLRLRRRAAAGTAAAGADGDREDPEERRPRSLRR

SEQ ID NO: 28475 - protein, 202 aa, Pseudomonas aeruginosa
LRRQGRAAGDPRPHRPAEPVARQPGRPGQRRGTVDRRPGQCPAPGRTVRPQRYCPGAPGRCADPPEDQPGQLRPGQSGGAAGQGPAFLHAPGDRFRRRHHHLARRGRASGQRRPGGGHPGPARSARGSLRPAHRGRREPAGRRALPGQRPARPAGQDHRQHPRAGSAGRRLDPHPSRAPEPGADAGGVSPRFDHPGPAEQRR

SEQ ID NO: 28476 - protein, 1092 aa, Pseudomonas aeruginosa
RAQRAAGQRAAGARRQDPGLGRRWETVQRGPARGTGAQPRRTPGGDRTGPGRRRPGGPRRSLQPQARPEDQTRRGCAMKGGFNLSDWALRHQSLVWYLMAVSLVMGVFSYLNLGREEDPSFAIKTMVIQTRWPGATVDDTLEQVTDRIEKKLEDLDSLDYVKSYTRPGESTVFVYLKDTTKAGDIPDIWYQVRKKISDIQGEFPQGIQGPGFNDEFGDVFGSVYAFTADGLDFRQLRDYVEKVRLDIRSVKDLGKVQMIGAQNEVIYLNFSTRKLAALGLDQRQVVQSLQAQNAVTPSGVVEAGPERISVRTSGNFRSEKDLQAVNLRVNDRFYRLSDLASISRDFVDPPTSLFRYKGEPAIGLAVAMKEGGNILEFGEALNARMQEITGELPVGVGVHQVSNQAQVVKKAVGGFTRALFEAVVIVLIVSFVSLGLRAGLVVACSIPLVLAMVFVFMEYTDITMQRVSLGALIIALGLLVDDAMITVEMMITRLELGDSLHDSATYAYTSTAFPMLTGTLVTVAGFVPIGLNASSAGEYTFTLFAVIAVALLLSWIVAVLFAPVIAVHILPKTLKHKSEQKKGRIAERFDSLLHLAMRRRWTTIFLTALLFGVSLFLMKFVQHQFFPSSDRPELLVDLNLPQNSSIHETRAVMDRLETTLKDDEDIDHWSAYVGEGAIRFYLPLDQQLQNNFYGQLVIVTKDLEARERVAARLRDRLRKDYVGISTYVQPLEMGPPVGRPIQYRVSGPQIDKVREYAMGLAGVLDGNPNIGDIVYDWNEPGKMLKIDIAQDKARQLGLSSEDVAQIMNSVVTGSAVTQVRDDIYLVNVIGRAEDSERGSLETLESLQIVTPSGTSIPLKAFAKVSYELEQPLVWRRDRKPTITVKASLRGEIQPTDLVARLAPEVKRFADGLPANYRIEVGGTVEESGKAEGPIAKVVPLMLFLMATFLMIQLQSVQKLFLVASVAPLGLIGVVAALLPTGTPMGFVAILGILALIGIIIRNSVILVTQIDAFEKDGKTPWEAVLEATHHRTRPILLTAAAASLGMIPIAREVFWGPMAYAMIGGIVAATLLTLIFLPALYVAWYRIPEPGR

SEQ ID NO: 28477 - protein, 367 aa, Pseudomonas aeruginosa
QSLCGGKESGRRVGHPPRRRAGYARRCYGDGGQYRQPGVRENPTNLRICFATEVIVDTLQGMRVFARVVDSGSFTSAAQALDLSTAQVSRLISDLEAHLQTRLLHRTTRRLALTEAGERYLERCRGILEDIEVAEAEAAGAHIRPCGRLRVQSLMGMGQHHLVPMIARYGALFPDVVIELTLSQRNPDMLEEGQDVLITGERQLPDSEFVAQRLGSIHSVLCASPGYLQQRGVPRSVDDLERHVCLRLQDPAYPEGWIFADEQGERTVSPQNTFMVNVAEVMAQAAKADLGIALLPSYVAAAALRNGELLRVLPGHAMHQRTIYALYPSRRYLDAKIRTWVDLLQQELPQAFARDETTMQSSSYWAQ

SEQ ID NO: 28478 - protein, 499 aa, Pseudomonas aeruginosa
RPCSTRRSPAAASPPSCSTCCCPRSALPKRRRPARRAAPWRAGASRWVDTGVCKFFRAWLVSRGRAGVSTRGSRRWKPAHDPDSARPRPGRPRQAGRAHPPEERGGDPRRGRGGVRPPRLQGHQHEHHRAERRPAQGQPALLLRQQAGPLHGGAEQHPRTLGQYLQHPRRRRRSGRGAGPLHPRQDGVLPPLPAGLADLRHGDHQRRRVPHRAFQPGLPQLVPRSRRGIRGLDRRRPDGPGGSRAPDLPALGQHPALRRLRQPDRPGHRPQAHVQAGLRRRRRQPGADHPQGLRTDPAGGLNAMPSTLQGLAEYREEIRKSRFHTIAAPVADEDEAQAFIAAHRDASAGHNCWAWKCGAQYRFSDDGEPGGSAGRPILAAIEGQDMDCVAVLVSRWFGGIKLGTGGLARAYGGGAAKCLQQAPRSELVERCRVRFACAFADHALLKARSLALGASVAAEDYGADGVVLTLELPVARFEALQALLVDLSRGQVRLQRLDA

SEQ ID NO: 28479 - protein, 330 aa, Pseudomonas aeruginosa
ACMPSAMPSRGLAMKSTAPSSSARRVASEPRSVSEEIISTGVGRAFISLSRKVRPSIRGISTSRLITSGACCLIRSRATKASGAQPTRRSSGSAWMISLSRLRIRAESSTTRTLMGMAGSPGESEQVDGAAVRVAVDTAAVVAFTLQHGVVLQLHQGLHQDPAIAREEVDLAREGLQHVAGEQRDTLGGQVVEGELDVALADGGADLAQYRAAAEDLGLQALAAGAEGQHAVDQQFHGVAAVARRRRGRVAAEAALGEHEVVHPGDAVERVAQAHRDAGAEHGDDHQVFAAGEVFAGQKLHRIAGEVRIVVAVQRRAFPGLEIHRDQAGL

SEQ ID NO: 28480 - protein, 357 aa, Pseudomonas aeruginosa
WNSWLPNTGEGVEVGIGVGFPWSTLRACRPPPGGGAAWSQNSSQPSSLRALLARAMPLRASGAGALGRGADGRALASWTTLGGVSSLNTATDWLSRPACSCMASAAAAASSTSAAFCWVMSSICETALFTSSMPVLCSAEAAAISDMMSVTRRIATTMSLMVCPAWATRVLPFSTLSTESEISVLISLAAAAERWARVRTSPATTAKPRPCSPARAASTAALRARMLVWKAMPSITPMMSAILRADSLIEDMVLTTFCTTVPPWVATSEALAASELAWRAFSALSFTVLVSSSMLEAVSSRLDACCSVRADSSALPLAISLAAVLMVSAASRICPSIRDRLCAVSLEKSLSWPKVPW

SEQ ID NO: 28481 - protein, 567 aa, Pseudomonas aeruginosa
LTASTATIRPSRIARVSGRRMPMRVPMPGAESMSMRPPMAPMLRFTTSMPTPRPDSSVTVSAVEKPGMNTSCQTSASLIPSCTGRLRSRALARMRGRDRPRPSSETSTTTLPPWWLAASFTVPLAGLPAARRSAGVSMPWSMLLRTMWVSGSLSFSITLLSSSVCSPCRCSSTCLPRRVAVSRTSLGKRLKMKLIGSMRIDITDSCRSRVLCSSWARACCRRSWRLGSSCSPSWPSMAWVITSSPTRLIRLSIFSTLTRIEPDSPSPRTGATAPLAVAATACAGALGAAGLPGAPSNRPKARSSAGGEPGASSKRPNASLAAGAPGASSKSPNAPGAAARSGAPGPSSKKPKASSSAVSLAGLAGASSNRPKPSSAASCSGTRSQPRRRSTVSSNGTPGSGRPLRWASSRRCNTSRASRKELIMSGRRCIWPQRMRSSRVSSSWVTAVMSSKPNIPLEPLIECAARKIPCSVSLSGRSRSRPIRRSSRVARCSSVSSKNTWRNWLISWGMGPPPRGNGNQGRTLRVTSSSFGGSNGFTSQPVAPALRPCCFIASLDSVVSMRIGTLR

SEQ ID NO: 28482 - protein, 292 aa, Pseudomonas aeruginosa
GFPWERARINHWYRLNIAITRYQVCNGRRKLGACLSTPMEISMSVSSASLAGKVAFVQGGSRGIGAAIVRRLAAEGASVAFTYVSSADKSRALAAELEGAGASILALHADSADAAALVAAVDEAAARFGRIDILVNNAAVLALGSVEELPLADFERTLAINVRSVFVATQAAVKHMGDGGRVISIGSTNAERMPFAGGATYAMSKSALVGLTKGLARDLGPRGITVNNVQPGPVDTDMNPDDGDFAEALKGLMALPRYARSEEIASFVAYLAGPEAAYITGASLTIDGGFSA

SEQ ID NO: 28483 - protein, 176 aa, Pseudomonas aeruginosa
PGSPRSTRRSSPSPRPSGQTLPPEGRGRGERFRLSHQERRSPLYDTGLADVSLPMLDQLRQLARLAVSEVVDLARVAGQVVELPGGRAHRGRQVHRLPVALADRTHAEQLPAGHGVLVVGRLGLAGKPTQPRPAARLGDLAAAPALAWVADTGEVEDGRGDVHHRGEGMADRTLPA

SEQ ID NO: 28484 - protein, 767 aa, Pseudomonas aeruginosa
PRVAHQRWHANPALGCERLVQARWCGGRLGPARAIPDVGIGAADVFQAVVVVPVEKAQQVRAEFRERLQQGAFGAVVGHEQDEGVVQLALPAQVVHDPADVPVHALDHRRIDLHRPRRLSPFLVLQGLPLAGQGEHRMGFDVRFHQAQLLEPGQAFLAQRFWTGVVATAVLLDDLPRRLQRPVRRGERQVGEERPALVALLEVLQQLVAEGVGGIEALRQRVEVALVFHVERWRTLEDARSAFVVGRLETIVVGGARQQREGTLETACMGRLFRLQTEVPLAGHEGLVAGLAEQLRQRHHALVEMPFVTRLAFQFRGQRLGHGADPGDVVVGAGEQHRAGRRAGRGGVEVGQAQAGDGQGVEVRRGDLAAEGADIGEAQVVGDDHQEVGAFAHARVSSGWEEKVGPSPPPFPQGERARARGFSASEEFEGQVFHPSRRRRDVLAVGGQFVQQRFALAQEVEATALARMRQAHLDHPPDPPRTRLHHHHPVGQVERLLDVVGDQQGGDTGAPADRQQLFLQLLAGQCVEGAERLVEQQQARAGHQATGDRHALGHAAGQLVRVGTLEAVQADQADVFVDPRRLVGFAKGFVDQAEGDVLLHRQPGEQAVLLEHDAAFAADAGDWPAVDADLAVVVAVQADQQAQQGRLAAATGADDGDELALADLQVELLDRFQSPAVHGEVLAHLAEADQRGARGGRGECVHACLQRVARASMRWPRALSRAPVRPTRSMPAPIRSMRNNCWAPIIRLPMPPSEGMKYSAPMVPSQA

SEQ ID NO: 28485 - protein, 240 aa, Pseudomonas aeruginosa
ISARRRPANTDGAAPGRTSRSSRRQGPRRSTRAASPRLGGRLAMPRWVASSSGKKAAIATNVSLAGSPRPNQAVSSGTQAKIATCRSAAKVGPKKRSAGRHRPSSRPPRKPRPPPSRSPPSVRFRLSNRAPGRLPSSAPLQVARATSRGLARIAGSTHSALLADCHRSSSASGGSHTCRRCQPRPGGRRRNSPVAACGQCSRRRSSHWMARSMPTPTRPMMRMQTNTMSSMNSCRPCTIR

SEQ ID NO: 28486 - protein, 233 aa, Pseudomonas aeruginosa
PIPSLEASNSTASSEVQPCARARRSPVRKAGSAAGRISRQTSRRGGRRSTAAASRSLGWASRTPTRVWMVTGTTTAFTSTTSLSSSPMPKNSMNSGIQASVGICARALKVGKTRRSARGLKPSQAPSAAPLATPASRPQARRRRLIANSLQSSPASNSRALCQTSSGVGSTWADIQWRWLATHHSSASPSGSNQGSRPSPRRRAKAAEGGGARRGRGRLQAGERVLSIFFMGI

SEQ ID NO: 28487 - protein, 419 aa, Pseudomonas aeruginosa
PHTRSRRESLSSRSKEPPHESAYVFPARSVRRACARRPARCLRAAGERRSAEGNPHRGAGRQRRQFALGRRRGRRALHPPVAGEGVRQRRHRGEMELLQGRRPGGQRSVRQRPGGLRLPRRPGGDHRQVRRPGQPPAGRYRARGQPLSRRAAGLRDQDPGGSQGQARRHLSWHRQPVVVRQCPGQRRSQREGPEGDQPRFQRRPVRPRSQADRCHLGPGRTVRPARPRARGNSAEHPRPERRRHPAGAAGRLRSLRRCPSGHHRAAAQGAVAGPGLAGPRGEPRRLHRTGVEAGQLPGGDPAERVPWPQAGRRPVAAPGHRFPWPAGCFDPGGQAFRPDPSRIQRRAVGRAGTAGGGRQAGEGQGRGAGGGVTPSRGRPRRRRFVAICNMFRDSCTDPTNDWIERSIQPLVGDSAYIAS

SEQ ID NO: 28488 - protein, 559 aa, Pseudomonas aeruginosa
QIVRRDTRSRTRESFGENAGEVIPPGTIGDHPDPQRVWFPAVAQRTGRRQAGTSRAQGVVRPRRPPPARRRRRHRADQQCAVCQRLPRLHAAGAQAAHRRRFPRHPGAIVQPAMRAQRPGGRGDPAGQRRTGLRAPAPAHADQASRPAARRRPDHRAQAPEQHPAGVPPERRGAGHQVPAERRGGRGGRASCGGGGLRRTGGGARGSGLPTADQARAGGNPGARQHCGVARAHCLLRQRTARDAPAQLRRPRPPAGGAGTGLQGGVVIAQFVAVVLPILICTGIGFAWSRSAGPVDTRALVFLVANVGFPCLLLSSLDRPGLSIGMVAGVFLATALAVLAFALLGLVALRLLRMPVRRYLPSIMLPNSGNMGIPIAYLAFGEEALVYAVAFSTLIQVGHATLGVWFASGDITPASILRNPMIYALAVALGLIALGWSLPPPLRDVTRLLGGITVPLMLVMLGLSLAGLRLHETWRPLLLSLVRVWGGFAVGYGIAAGLGMEAVAAGTFAIQCGMPTAVLTYLLAKRYDGPVNEVAGMVLITTLLVLLSTPLFIQLLPRA

SEQ ID NO: 28489 - protein, 180 aa, Pseudomonas aeruginosa
STTTACRSAERRPAAPTTPWPCCSPSAVRCRPVPPMLPRPPRKRRRWPAASRTRPIRPWARSLSPRVAARRIRRRYRRRSPCSAARLSRPSASPGCRTCSRCCPASMSPTSMRGSRASPCAASATTPPATAWKAAPGSTSTTSTWDVREWPCSTCWTSSNWSCCAVRRAPCSARTPPPGC

SEQ ID NO: 28490 - protein, 158 aa, Pseudomonas aeruginosa
TSAPARRPSLPSVPSRSPAGRMATSRAAARFPGRSAKPSPDASRPIAPATTATSRTSTTTTISTAASARARAGNCCSSRTRTSACAGSPTTTRRIRATAAWWSTAPPSVSGSAPRWSALRRCAIRSAGRSTSTAASTSACTRAAARWRPTGTSPAATA

SEQ ID NO: 28491 - protein, 142 aa, Pseudomonas aeruginosa
TTPTRRPTARSRPTASRCSPRAPGTSPNAWTSPPACAVPTRRRTPRSSASLRWAARRSAGSARRCATASSAPTIPAISASTTSPLRRCSASATSSATTCSATPACPTARSPAGSTWRWAAHRAPAPIRCWSDRSAPTTPSWA

SEQ ID NO: 28492 - protein, 212 aa, Pseudomonas aeruginosa
APSPASTAPTPHRWGSRARSAYRCATTSEPSPTQYPTHEEHDMSNAAQALATPVRLDVRPVAGRIGAEIRGVTLSGELDAATVEAIQAALVRHKVIFFRDQSHLDDQTQEAFAHLLGEPVAHPTVPSREGTRFLLELDGAEGRRANSWHTDVTFVEAYPKASILRSVVAPESGGDTVWANTASAYADLPAELRELADRLWAVHSNEYDYAGV

SEQ ID NO: 28493 - protein, 129 aa, Pseudomonas aeruginosa
PSASVEQLENYRKVFTSTVYETEHPVVRVHPQSGERTLLLGHFVKRLKGLSQHDSAHLFAVLQGHVTRLENTVRWRWQAGDVAIWDNRATQHYAIDDYGDQPRVVRRVTLGGDVPVGIDGQRSRTIRKA

SEQ ID NO: 28494 - protein, 263 aa, Pseudomonas aeruginosa
AVLALRHPVRLGVPAAGGHPGAVLGWRRQGAGHRQGGQHRRRRTGQLRPAGTHRPPMDAGAVLRLVPLRTGGAVQWRRDALHQPGARLREPRRGDPARDRWPAPDQLQPLHPPARGRLRRRFRHLPHAGHRTDPGQRAPAGTHPPGKRPARTVPQRPHRGGDSRLRPRAGPGADRSPARTSGAPGTELQPRLVGGRHRLVGQPGRAACAQRLPGQRAAAPEAHQPSGQPSVLSRHPPACAGSSVADRRRSLRAALASPFRSGE

SEQ ID NO: 28495 - protein, 70 aa, Pseudomonas aeruginosa
RLFGSIAQCRAKVRSRIAVCELDLRSRCAIRSAPDYSTITQEIRECRSVSPSRPMPVRRGFPPPRKPSRS

SEQ ID NO: 28496 - protein, 478 aa, Pseudomonas aeruginosa
PRWARPWAPSPWPWPRSMCSVASWSPGACWKCSRRKRRRRGATDEHEPGHPPVPHRLGLLHPGPERPVAPDHLAPRQPLRHGRHGHRRGHHRRPGVQAGRGDRHHRRRLHRRRPAGRRYRRLDHGQARRDDQDARAGRLHAQHDRPGRGVHRHRSGGRAAVAGDRRAPGRHHSHRQPPGAVPRRGHRRHHLLRFGDRLRQALRQVQVPPVPGHPGAVLRAAPAEPGARPGNPRPGPGVHVHRQPHRLRRDAGAGLRPRRADHHPHRRRRHAGGGVDAQLLFRLGRGGYRLLAEQLDADHRRLAGRLLGRDPLLHHVQGDEPLVLQRHPRRLRRRSRRRRPGGLQGAASGEVRFGRQCLVPADQRRQRDHRPRLRPGGGPRPARADGTGGEADPSRGHREVRHPPGRRAHAGAHERGCWPRPKCPTSRCSRWRTSTPSSARPTWSWCSVPTTWSTRRRRTIRSRPSPACRSSRPTRPRP

SEQ ID NO: 28497 - protein, 199 aa, Pseudomonas aeruginosa
APAPARTWRRMRGAAPARPSCPPSGWGTARWPEMSLADNALLTAFQQGLVKRGLVRRRKVLALAEEIIRRFAVKAPGAGAPARILSGGNLQKFILGREILQAPRLLVAAHPTWGVDVGAAALIHRALIALRDAGTAILVVSEDLDELFLLSDRIAALCSGRLCPAVATASASPQQVGGWMAGQFEAPAAVAGAVAQGSL

SEQ ID NO: 28498 - protein, 338 aa, Pseudomonas aeruginosa
SSTAHVCTDAGASARRCATPWPEPNRRGTTMDIDLLDNLLFAMVRTGTPLLLVALGELVCERSGVLNLGQEGMMLFGAVIGFMVAFSSGSLWLGVLLAVLAGMLLAALFAGVALYLNANQVACGLALTIFGVGLSSFVGAAWVGKPLQGFAPLALPVLGELPLLGRMLFAQDALVYLSLALFAAVAWMLLRSRAGLVLQAVGENPDAASAMGLPVLRVRTLAVLFGGAMAGLAGAYLSLAYTPMWAENMTAGRGWIALALVVFASWRVFRVLLGAWLFGLASILHLVAQGIGLSIPANLLAMLPYAATILVLVLLSRDALRTRLYAPVSLGQPWKAGH

SEQ ID NO: 28499 - protein, 416 aa, Pseudomonas aeruginosa
  UNSURE (337): Identity of amino acid at the above locations are unknown.
SGPPRRSDPASDRRTRDARSAKAPRAFSLARPPASGRDIQVRVARRGGRLGVDLLVVLDHPRGRPHQQRVGLMGDAPVLVRVVQRVQEVADAVESRALLVVGLDDRPRRVGGVGMEEHRLLGGGVVVPLVQRLDVDGRQLPVLERIVAARDEAPQLFLAAHREPVLEQQDAAVGEHALQLRRLAHELQVLQRRTEAHDPLDAGAVVPGAVEEDHLAGGGQMLDVALEIPLALLLGGRFLQGYDPRAARVQVFHEALDGAALAGGVAAFEQDHHALAGLLHPALHLEQFDLQVVLGLLVLVAAHPRVIGIVRRQARRGAVLAVAVGRTGDLQGHRLLXDCLDLLAGLLRRAGHSRAAGRRLARGAAGGWPGRLGRLRGGLLGGGGTDSGFFAHAGLLPFYVFSYAVPHSMPLPGGVR

SEQ ID NO: 28500 - protein, 278 aa, Pseudomonas aeruginosa
  UNSURE (251): Identity of amino acid at the above locations are unknown.
AGSHQPRAGSVRAGPPIRRRSAHVPHLDSQSPRHLHRQRSRRRRRPGRRRRPHRQAARRRPTARAALRQPVRRQPARGVAGAGQHPSPLLPDPHPRLGAGGQPAAVPLAEDPLPGLGAADPGETRTGHQGGAGRAAVVRVYHCRRPPLPVSRRPRTGHRRAGRGGRGTGHARHAHPRLDEPRREGRRLAAAADGAGGRDHPRRQRATDRPLPPARRRCPGADRPGALLAVLGDSGDHARQRRTGGAPRGTXAHPPGGDPRRGRLLPAALRPAHRGLPG

SEQ ID NO: 28501 - protein, 360 aa, Pseudomonas aeruginosa
TVAFPTRSRPMLRAARPCNRFCSLLLGLALLMPASLPLSAAETVAPPSPRTLIIDTDPGADDVIALLFAMASPKELKIQALTTVAGNVPLEKTARNARLAREWGKRPDIPVYAGAPRPLLRTPIYAADVHGSEGISGVEVHEPKQPLAEGNAVDYLIRTLRAAPEKSVTLAMLGPETNLALALTQAPDIVKGIREIVIMGGAHFNGGNITPAAEFNIFADPHAAEIVLKSGAPITMLPLDVTHKILTSPERIAKLRNLGNQAGKTVADILDAYVQYDIKYYGLKGGPVHDATVVAYLLKPSLFKGKRINVQVDSREGITFGQTVADWYGGLKQPANVEWINEGDAQGFFDLLTERIARLP

SEQ ID NO: 28502 - protein, 169 aa, Pseudomonas aeruginosa
APGSIRARRLTAPNALIDQGVDVVFQHTDSPAPIQAAERRGVYAVGYASDMQHFGPKTVLTSIVNDWGPHYIRSAQAVMDGTWKSEDFWGGLAESTVVLPLNQEVLPAPVREEAGRLIESIRSGAFHPFTGPIRDQSGKERFAAGVSATNADLASMNYYVEGIKADLPK

SEQ ID NO: 28503 - protein, 344 aa, Pseudomonas aeruginosa
ALALYGKSRRAQALSVQDPSRRARLDRLPIIDIAPLYGADRGAWNDVARRIDQACREWGFFYIAGHPLPAARFEALLAAAREFFALPVEEKLKIDITRSRNHRGYGAIATEQLDPALPSDFKETFDMALHLPAEHPDVRAGKSFYGPNRHPDLPGWEALLEGHYADMLALARTVLRALAIALGIEEDFFDRRFEQPVSVFRLIHYPPASARQSADQPGAGAHTDYGCVTLLYQDAAGGLQVQNRQGEWIDAPPIDGTFVVNIGDMMARWSNDRYRSTPHRVISPRGVHRYSMPFFAEPHMDTEIRCLPGCFDADNPPKYPPTTCGDWLTSRFAQTYAYRRGETA

SEQ ID NO: 28504 - protein, 95 aa, Pseudomonas aeruginosa
LPGQVKLAGQDQPDREPTPCTNGSTPCPRPNCTCTWKVPWSRSCCSPSPSATASPCPGTTSRPCARPTPSTTCRNSSTFTTPAPTCCAPSRTSTT

SEQ ID NO: 28505 - protein, 240 aa, Pseudomonas aeruginosa
PGARPARRFVVAGFSVLMISIIICGPAQHSHGAAPAPAFVQPSSPMPDRDLPPGPRPDALPADGDAARRADLLKAFLAQRQRMESLVSRWVCCRATAADLVQELFLRFWRRPAAPVEELGSYLLRSARNLAIDHLRGEGSRQRQLDDWLPEQRQGEPVSPEQALEAGDQWRRVEAALRGLPERTRRIFLLNRIHGRTYAEIAQAMQLSQSAVEKHMMRALDACKASLAGPAGEQARSAQP

SEQ ID NO: 28506 - protein, 123 aa, Pseudomonas aeruginosa
AERCNWPGCNMTCNSAWTTRSARSSAPTCCATARPAASTTSTRSMARWCRRPGWSPATATRPTSCAATRCTSRTRSTWTNAGSWSAARATRSTTSSPGAAGRSTPTPISTGRNGCRAAAWSTA

SEQ ID NO: 28507 - protein, 435 aa, Pseudomonas aeruginosa
RTCSTAPTTRPVPIDCTWRWASPGSSRCRRRWSSESALAPGGVPRRPPGRGGPPEGRRVGAMLPDHAPSGSFFPQGRDCPARESFRHPVPSPFGERKAENRLARPRRTPHLVPNPPVGYHARTTRRHGRPMNLDNRIKFRHLACFLEVARQRSFAKAADAVAVSQPAISKTLKELEEILGARLFERSKAGAELTEAGVTFLRYAGPCVQALRDGVNTLRGHEAQVETVRVGVLSTVESLVVPEVIRRLHRRHGALVVSVATGPSAYLLAQLKVGELDLVVGRMTDSPDIQGLTFEHLYSESMMLVVRPGHPLLAAPLGDLQRLAEFPLVLPLAGTTIRRHADSLFVQWGIALAGQRLETLSPTLSRSYVLRSEAIWVAPRDAVRLDVGNGELAELDLGIREPGGSVGLCHNAALPLPLGAQWFSAVLREVAAELH

SEQ ID NO: 28508 - protein, 147 aa, Pseudomonas aeruginosa
ASRNRSRKPAGRTSPTSGSAATTTTCCSTSTTAACPRASASSCSAGSSTSTASRSRTPWWRCGRPTPAGATGTRTTATWRRSTRTSAASAGPSPTARATITSAPSSPGPIPGATAPTTGARRTSTCLSAARRSPRGWSPRCTSRATR

SEQ ID NO: 28509 - protein, 233 aa, Pseudomonas aeruginosa
AWPTRWIAWPTASTSSCAGSARPSSRTSEEPTMSHELLRETPSQTAGPYVHIGLALAAAGNPTRDLEIWNRMAREDAPGQHILLLGHVYDGNGHLVRDSFLEFWQADSEGRYQERYDPERPFNSFGRTATTFDAGEWTLHTVKPGVVRNAQGVPMAPHINVSLFARGINIHLQTRLYFDDETEANAACPVLNLIEQAPRRDTLLAQRCEVDGQLAYRFDIRIQGDNETVFFDF

SEQ ID NO: 28510 - protein, 770 aa, Pseudomonas aeruginosa
SQSLGTRLESLPILGVSGRIGRYLYGSRRGRHVRRQRRFSFQRSLVADGAARHPVRRPACRLRRRAARRGTRPCAGADGEDGRVRLGHLDHRRHPGTGTGRPVVPCRRQDRRAPGRCRRPRRGWPGAGAARPAGPAQQRGERPGGGRRAAGAVEARRPQLPAAEGAAAQGLHQPERVRPGAGLCAQRAEFAEGRPGAVGQRPRPAFLYRAACLRRRGHHCPPGRGRPGGAGHRADLHPGPRRRARRGVQRLRVVVQPRCRRPADHRQPARQAGSHRQRQGPRDHPDGGRAQRYAEGQGRPRLGAGGNEPRQRGQRQRRRAGRAQRGAALVGAVQGRRAAGGLVARPARQGASATGAGGTLRQREGGHRRWPGGGPDGGHGGRPTAPSGPGGRGGPAAAADPEHRQPRRRGRRPAMKPFSLAGLFGFALLLSGCGDEPPPAPPRPVLTVTVKTLKNDDLGRFAGSIQARYESVLGFRTNGRIASRLFDVGDFVGKGALLATLDPTDQQNQLRASQGDLASAEAQLIDAQANARRQEELFARSVTAQARLDDARTRLKTSQASFDQAKAAVQQARDQLSYTRLVTDFDGVITTWHAEAGQVVSAGQAVVTLARPEVREAVFDLPTEVAESLPADARFLVSAQLDPQARTTGSIRELGPQADASTRTRRVRLSLAQTPEAFRLGSTIQVQLSSAGSVRSVLPASVLLERDGKTQVWVVDGKQSSVALREVQVLSRDERQVVIGQGLADGDRVVRAGVYSLKPGQKIKLDEDAR

SEQ ID NO: 28511 - protein, 177 aa, Pseudomonas aeruginosa
SPASASCPTRSSSPSAWAASTACSAPVPATCSSAACHARWTTWSATSACACRTRPTRRAGSSPTSRASAPSARRTPSWSMSPRSWPRRPRPTSASPCCPATWRPRRCATASCYGCCPAMPCTSGPSMRCIPRGVTWTRRSAPGSICCNRNFPRHSPATKLPCKVQVTGHSEGLLLLR

SEQ ID NO: 28512 - protein, 69 aa, Pseudomonas aeruginosa
TGCHRRRAMNRQILAAAILSLFSLAFSQAGFAEESSLMTNRMVDANQQAIEHQQELSASAAQAGARSDS

SEQ ID NO: 28513 - protein, 71 aa, Pseudomonas aeruginosa
LSLAVDDIRSVFIDLAMQERDVESLKPDESKRLSIEESDCVPAGFQCPEIHWQDFPTPNFDCSYSTSSQGR

SEQ ID NO: 28514 - protein, 310 aa, Pseudomonas aeruginosa
TGRGRRARVGIGRCSSAGCPFIVMTWRRVASRQSLAGLTCRLKFPGAHADARLLRPRASLRLATFAGPCPPRHGRHLAAAGGAGRAGDIAPWRQCHRRGDRHRRRADGGRADRLRDWRRCLRPGLDPRTPARPGRQRARAGPARSRAGARRRPRADAAVRLDAGHRAGLSGGLGRTVAALRQIAVRTTAAAGDRAGSRWLSGLAGDRPPVAERPGQVPRGVAAAARAAGLVRRVPHRRPGAARRRGVPPAGPGRHPGRAGAQPVRKLLSRRAGQGHRRPRRAQRRLPARGGPGRLPGEVGRTDLTELPWL

SEQ ID NO: 28515 - protein, 291 aa, Pseudomonas aeruginosa
RLGDSAERPGPDRPDDPEHPQGLRIRRARLRADLASPTGGDEAGVRRRAALHQPAAVDAGLGRGTAARGLRRQPPCADRRARARSQPRPAEAGRHGVPGLWRRGGQPGLVHPEQLPRLRLRRGGARHRHRLAEPRRRVQPRSGPRELPGAGQADLPHHHSRFPQQGRRAARPVRRDGRLYAAAGPRADGDEPGGLRPQPPGCPRRAALAVAGRAARRHRTCRAARAGGGAGAAWAPGGDRLRLDQLRARPDRPARPGQRRALWRHRAAHRFADRGVVRGPMWVRRGDLSGG

SEQ ID NO: 28516 - protein, 326 aa, Pseudomonas aeruginosa
KNRRSLRRRKPGEAPAPSWLRSCYPWRGLTARTGSPTRRKAIHSRSVSMSRTLATVMLAGGLLAAGQAVAEDHDMTPTHETDSGPLLWHNESLTYLYGKNFKINPPIQQTFTLEHASGWTWGDLFIFFDQINYNGKEDASNGKNTYYGEITPRLSFGKLTGADLSFGPVKDVLLAGTYEFGEGDTEAYLLGPGFDLAIPGFDYFQLNFYYRKPDGNRVRAGAWQITPVWSYTIPVGNSDILIDGYMDWVINNKSASTSRRNQSDYHANLHFNPQVKYDLGKALGYEAKHLYVGLEYDYWSDKYGVKDSQYFTTDQNTASFLVKYHF

SEQ ID NO: 28517 - protein, 724 aa, Pseudomonas aeruginosa
DGPDAQRRPTPQRPHLRPRRPAAPASRLPCRATARAGQLRRHRHSAAGDRLAARPRRAPAIPDQHGADGFRRRHPDPGAPAVRHRRRDDLPARHQLRLPRRRAGRRDAGEAARRRSRGDPRDDLRRVLLRRLRADRPQSFPRPSSPGDHAAGHRHRHHPDRRQPDQGRHHRPRRRSRGHGLRRTGQSRAGRAGAAEHRPAEPLAPALAAPGRHRHRPGAGYPGGLGDRPVRSAGVARAAAGQPAAAVPLRLRLRLDGLPAGGADLPDQQHRDGRRSDRQLHALAAAPGGTGVPAAVARRGARRRRQLPAGSHLQRLPEHHLRAEQRGDPAHRGGQPARRDLYRRRVAGARPVPLGRRDPPADPQAGTRRRHPGDVRQRRRRRHPHSRPDRDGPPQRADHRRLVRRRPRRGRAADPARPDAGGGEDPVRLGDHQRRHHRHPAQPAAARGARCRSGAGQREGRRPGALAQAAGLIRAFANFSAPGLCPAAGLGYQRGDHADGNLRMTLTVPAHDPAARDKPAGRIRQKNEEAILAAAEEEFARHGFKGTSMNTIAQNVGLPKANLHYYFGNKLGLYTAVLSNILELWDSTFNTLGVDDDPAEALARYIRAKMEFSRRYPLASRIFAMEIISGGECLTAHFNQDYRSWFRGRAAVFEAWIAAGRMDPVDPVHLIFLLWGSTQHYADFASQIGLVTGRKRMSRQDFAAAADNLVRIILKGCGLTPPAA

SEQ ID NO: 28518 - protein, 166 aa, Pseudomonas aeruginosa
TRCRAPCKASPNTARKSARAASTPSPRRWPTRTRRRRSSPPTATLPPDTTAGPGSAARSTASATTANPAAAPGGRSWRPSRDRTWTAWRCWSAAGSVASSSAPAASPAPMAAARPSACSRRRAASWSSAVGCASPVPSPTTRCSRRAAWRWAPAWRPKTTAPTASS

SEQ ID NO: 28519 - protein, 726 aa, Pseudomonas aeruginosa
SRAGCVGECSFHAWPAGLAFPWVPLVESEGQDGDVVALRVLALVLGERRHEGLGLLGERLPRVVAEHVGEAPAAEAEAVFAAGLVEETVGAQVEGPARRQRYLDVAVVATALVAYRPARALEFLDLLAVAGVQRDLRPGEGQLAAPAVDPDQPGIHVGGQRLGDLLLAEHAAHRLVGLAEDRRRVAAAHRLDGVVDGGAGEHGHQRAGHAVTGAVDHADQVAVGLLAVHVEVAADHVARFPQDEVMLAEGGAELAVGEDRALDQAGIVEAVADLLLRGGHLAVGFLQRLGALLDLVFQLGGVPADLVGHAGEGLRQRADLVLARQRQRRVVAPGGDRLGRALEAAQGAQQQALDGIGEAQQQGHQQQQERARQRPKPAVVEDLGGVQVDGGEHVPAQLGNVGHGEELLAAVEAGPQAVHRAGLGAGQAHGLAQGVALFRLVEQVEHPVAFAGAAGGGAVGDQAAVRVGLDGAVVADDHRRHARLAGDDEVVEEAAQVQAAAGQADGPALVADHQVEPDLGQVQLAVDIDVDVVGGAVAQGIEVPGVFRVAGLQGVARPFAVGLAAVVEVVVVGAAGDDEVGVVAEVAAVALGLAEEQRAARRVVFLQQPVAGHHRFGETARQRQFAGDRGEDLLPVQQGEVLRVGQAEVRTDVVHRAPAQQHRRDQCQGTGQQQRHHRFAAQPPVRRHGYPYQFLARPAAEIMDRKRVSNFWRKGQLCRCALFQAT

SEQ ID NO: 28520 - protein, 88 aa, Pseudomonas aeruginosa
RFSGAPSRAWRFIAIRPGCRRSGRRSAPGGWRGRSSPNARRRTGPPAAAGPPCVPAGGSGSACRSRSSRCGRRSRRVPRRSTSLPPAG

SEQ ID NO: 28521 - protein, 404 aa, Pseudomonas aeruginosa
WPFASSSKDNVRWISIIGAGFSSDSYPVRRIGYRYPSEQFHFAHVDAVLAHRAGQGPAQFLDLPRDPFGPFLARPRLQRAEAEGEGAKTRMVLAHLAEQLAAHVLELQGGDRRVDALADFQREPVQFVDDLQGVPVHGLQVIEHALDLVLGIEGEGHVLVGQLRDRALGVLDLVVDHVDVLADGGGKLRGAGRQRAHFIGDHGEAAAALAGSGGLDGSVEGEQVGLLGDGVHVLGRLQDLGDLQAHLVHAFHQLLRGPAGFQGSLDEQAEGLLGGPDEVLEVDAFVDLAAPVVALDQRMGQAALGIDAFGEAVEAVAELADRRMQQFVDLPGVTVQLRGFVGERPLRRAPGRRSGIRLRVGIRYRLPRGAQEEDEHGQAGEPTERQDQPDAEADGMQPGAQRPG

SEQ ID NO: 28522 - protein, 284 aa, Pseudomonas aeruginosa
QLVRRVVEAGVAGVDVPVPQDPHQGAGLQVGIGVLHAYQGDAQAHGGDLAGGFRVAHGHAFAQLDRRLLAVAPAQRPGAHAAGLRRADADPVEAAQVAWMADWRLVAEVGGRGEEDQVARRQVARHHPGRQFETTADGGVEAFADEVDLAIVEMPVGHDVGIAFEELAEQRQDVVAAEGQPHADLQRAAGLVADAGDVGESGLDALQAAADLLQETLPGFGQGQAPGAALEQAHAEVAFQAGDVLAHPGRRQAQAPGGLGEATGLGAADEALDVAEGFHGKGPA

SEQ ID NO: 28523 - protein, 164 aa, Pseudomonas aeruginosa
RLPATRSAMDDGNSGPVYPLRWRFPCPYPLHPSPAKSPSSRAVPAASAPPSFAGWPPKAPASPSPTSARRTSPGPWRPNSKAPEPASWPCMPIAPTRRRSSPPSTKRRLASDASTSWSTTPPSSPSVRWKSCRWPTSSGPWRSTCAASSSPPRRRSSTWATAGG

SEQ ID NO: 28524 - protein, 184 aa, Pseudomonas aeruginosa
PGLPSSSGVSASAMVPIPAMWWSVPVSSIERVGEQVEAVWKSVRRRPAMARASRFGVAISPPKAPISEKPRSSATITRKLGRLLMRGSRLDGRRRWGPRPRPSRRGKGPGQGAFQQARNSKGRFSTRRGGGATYSPSAVSSCSSASRWRRKSKPPRSRGCARPTSTTRLIRPGRGSITTTRSAR

SEQ ID NO: 28525 - protein, 388 aa, Pseudomonas aeruginosa
KNEFLLFIFEAPLCIASRTPAPGGNPSLPVPRSRPMKALTSSLLGLFAAPVLAGLLGAYVPLASAAPPKEIRIAVPDVSAGSSHSGGGVVDVLYTRQLLEKEFANDGIAVKWSFFKGAGPVVNEAFANGQVDFAYLGDLAAIIGKSGGLDSRLLAATARGVNHYLGVQPGSGIKTLEDLKGKRVGIFRGTASQLSFDNALASVGLSEKDLKVINLDFSAALSALAARQIDATWGLAGLFALRDRGLAEIPLSTRDLNGAGTLQALLVGSGAFVDAHPDITERLLKVQLQAQDWLAREENRDAYIELVSKQASYPVVILQSEYRGRKLGDALSPRLDTDFLGRLDASIQAAKRFGLIRREFSAEQWAAPELLEAAGKLAKAKAVAQAAE

SEQ ID NO: 28526 - protein, 302 aa, Pseudomonas aeruginosa
PAHHYDSAAPAPGLALRVGGIPDFLPEESGHMNLDSKLFDATLDLERVKVSVRTLVKLSRQEQSAIIRTLNEFGFLLLRSEQGEDRQELLALKELFGRAAPHPRADADGIVPISNARYVSGYLGSTPLEHKLHTDGAFLDTPEQLCSLQCVRNAREGGETLLASAGLAFERLRRRMPTKHLGLLRGDALTIVRKHQSSTQPVFRLNGEALGIKFRQNDGAAEVVEHPVAVEAFAELVAALEDPACQLRIKLEPGEILVLDNTAVLHGRTAFCANELREMRRLNFDGHGRLRAELELGFKVGL

SEQ ID NO: 28527 - protein, 374 aa, Pseudomonas aeruginosa
VPGGRSLGSRSAGRLCFPASAFAGACHWQGLACATAGRVKHFGSHRRRVWRRPSSATAVGGSLGSRCNLASGNTLHEQQDPMPFALALPFAARTAVLSRGDRRRALSAGPPTAPGRLPPAAAGGGLGCGRRRSRRGAGSATPAHARTGTPGTRPRPVGGQRLPLRRRPAGRLVRQGTPAADPEFLQPRPGKPGRGADAGEEALRPPASLRSDTEGEAGAAAAGGGVLSQRPHHGQLLQGLAAEHAGAGASRCVLRPRRGACAEPCAGRRALPQRPGRRADRRRGAGGEPAGRSGGGRRLRRGARGAARRAGVAETPVEEGKARGGSGRRVLRLVQFHQRLDHRLGRCRKPVAAAADDAAAGAEAIQVLRQVAPL

SEQ ID NO: 28528 - protein, 289 aa, Pseudomonas aeruginosa
RLQFAALQVGAQGLVAGDADGVGLADDTDQRVHVLAADVGGEVDLAAEVRQQLADARGNQGRGQRVVEQVVGGQAVLAQQRMLRTAEELAAARGQRARLEVRVGLEVADVGDEEFDLFAEQGAAELFPVVHVQADLHPRVAVDEVGHRVRHQLLGRRRPAAEAQLAGIQLVQLGDLVDQVGRPLHQAQRVLQHHLAFRRRAQVLAATVHQLTAKLLLQALDAAAEGRLGDAHGVRRADETAVFGEGDEVTQLAQIHDALPALEILDKGICRSGCAGFKCKLLFRQQRTN

SEQ ID NO: 28529 - protein, 677 aa, Pseudomonas aeruginosa
AVRRPPSNLSPDRCLARHGRLLPASGCAGTEDIHDEAPLPLAAPPNAARRLRLRPGPAARPRRCVAGQCRRCSRARRGSAAAGQQRPGQGRYGPGQGHCHRASPRGGFAEGTDADHRARRRDSRGPAHLPGAGPAAGAAQRQCRLHPCAAVERRRARHRQQPRQRRPGRQRRDLPRQRLPGTSGNGRVRPAGHRATGAAARSAGHPVRQEHHRRGAEHQHPRADLHCRAYRRGLRRAGWLLPGPRHGFRAARRNPRRTPLGLSHPRRRLHQEHPRRQLSQRRRAPGRARAIAVRAERGLQPALDRRLQRGGFEQRQHGGLRRRRAFLAARRAGRRFAVARSAAQEGQHQRPPARQRAPGRQLAGGQLEPRRRLPPDLHQRLPLLALHPGQRRATERLGDQRHRGGSARPAVLPGDPPGLAHRRCLRIRGGRLRVQAEPRQQDLHLLRTVGRPVPARRQSRRAERHLLEGQRQDRDRQLRAVRPGHLAPHRTPGLHRRPARYLRGEERQGRALRSAGRRGGRRGRRGGAQRPARRLRFRRSQPVQLRPFGVAQPQLPVQRRPARLRQPVPRREVRRGQPGGGQRTERRRRFAAGRTGARQRRRAGPEEHALRPAPVAQRQPVLDRHPRVPGHHPVPGAGLDPVGAGAGQRRQRALAWSGVRGHRAAVARPDPELQRLL

SEQ ID NO: 28530 - protein, 335 aa, Pseudomonas aeruginosa
ASTGNAAGRSGRHDGPGPLLAGEGDHRQNEPARTPYMSQSATARQPEPEVAEAFRITPLEAPLGAEVRGLDARRPLAPEQVLALKQALREHHILVFRQQHLDDEQYLRFATLFGSVFQPPADIPVLSSGGDGKVPDIVKVANTGDGELGNFALPAHIDHQWTPVPSSGSFLYALEVPSSGGETRFTNLARAYESLDEATRREIDGLRLINYNPFIRLREGGYGGGFATYRTPDIEPIQGSEHPLVRTHPESGRRVLFLSAHTEVEIPGYDPARGQALIGRLREHLARPELSYSHAWSVGDIVWWDNQAVLHARNAFPASERRRLKRISLAGSRPF

SEQ ID NO: 28531 - protein, 330 aa, Pseudomonas aeruginosa
SRRRDDRQRRRGLRRRPGAEGGRAQRRRAGPDEKRRRAGRHAQPLRQREHRPHGRARHHRLRPRGRAAYLAGAEPGRALLAGQHRRLQGGDARRQPLPALHADADDRRRHREGRPRADPRRRRRRPAGDRHGQAPGRGDRGFRRASGGEGADRVARRQVRRRALRDRRRARVRRRRRRLRAADAGLVDGAPGQGRARARQAVGHRHHHRADPRPQGADAAARGDRGGDEAGLGGHRPGRRPGRQLPADRGRPGRGPARRDHRRPQQPGRAGTGGRLGAIRAQHPRFPQAHPERRRLQREPRGRHRRRLPDVPRRPGGAQERLSRCVGKLR

SEQ ID NO: 28532 - protein, 629 aa, Pseudomonas aeruginosa
RDLQPDHLRAGRVRRLPRGMERHPCLAHPADGGDQRDFRDRHRRRHARRRPDRDPAGQGHGHPRRGPGRGQCVRWLPGHPAHAGNVQEESAEGGGPLMSMNLVTLLYLIASVCFIQALKGLSHPTTSRRGNLFGMVGMAIAVATTVGLVFKLGAEIATTGVGYIVVGLLVGGTAGSIMAKRVEMTKMPELVAFMHSMIGLAAVFIAIAAVVEPQSLGIVAHLGDTIPTGNRLELFLGAAIGAITFSGSVIAFGKLSGKYKFRLFQGTPVQFSGQHLLNLVLGLATLGLGLVFMFTGNLTAFAVMLALAFVLGVLIIIPIGGADMPVVVSMLNSYSGWAAAGIGFSLNNSMLIIAGSLVGSSGAILSYIMCKAMNRSFFNVILGGFGAEADAGGPAGSKEQRPVKSGSADNASFLLTNADSVIIVPGYGLAVARAQHALMELAEKLTHRGVTVKFAIHPVAGRMPGHMNVAAGRGRSALQAGVRDGGHQLRVRPDRRGPGARCQRRGQPGGEERSEVAHRRHADPRGLQGQDRDRQQAIHGQRIRRPGQRAVVPGQDYDGVRRRQESHRRHGQGGGVIPRWVHQNPGPGRGFSFSRVARAAFSADSNGENTSLSGIFFMPARHGFLVGSV

SEQ ID NO: 28533 - protein, 201 aa, Pseudomonas aeruginosa
ASLPIMQLLAPLGLQHGLERPWSSSVQGVFHGNTPACRCPHAALARDARRRPGGARSAGSPGVAPGSPQPGTGSGAQPARDDPAGPVRPDPARSGDPLAEPAENPGAARGAATGAADDHRVHRPGAAGGGTAAARAVAAGGRGTATTGGRRERGEAAAAEAGAKAETQAQAATPAQAGAEGRRAGSARAAATRRATRPAGA

SEQ ID NO: 28534 - protein, 243 aa, Pseudomonas aeruginosa
GQAPPVGGAYSRGVAALRHAAGASPAGPWAVHRRAPAGGDRALPDAGHPPADPRRADFGADPTRGRGSLRHPAPSCGRGLQCPLHQPQAGRGPCALPARHGAARRTGGRTVRAGAMFRSRAGAADGGRRRGPGGGISEGYRRRAFPPGARPALAQPGPLRRVLRRPRSGGAQRRDPRYRRGRRQRPGRVARSAQRRSAPAARPGRAHPPRRLRRRAPGAGCAAPRRPGLRARRAAGARRGGRR

SEQ ID NO: 28535 - protein, 488 aa, Pseudomonas aeruginosa
SPCAMPVRRSWWSPRTSTSCSCSATASPRCVRVGCARRSPPRALRRSRSAAGWPVNSRRRRQSPAPLPKGACDAVVPGTARPTVTLDAAGLSAAGGAADPGLRCATVRLSRPRSLADPAYRAGTAAQRPLWARRAAGQGHADPALCPRPGTGLPGARVEHRRGGPVAGRRPGRQRGGDPVARLAEPLGAGLGAARRHRCRGALGRVRRLAANALQRQRDPDHHHAQLHRAEPAAVRRARAVEGPGWLQLPAVGAVRRGQPPAGAVRGQPGAPWRIVRPAGAGGGLGAGAAQLPRFPGPRARPRPPRRRFRRFPREAPGLVRAAVLRRAGRPGRRLRGRRADRPTGAAGLAGLRLCGDHRGLPWPSQSVRHPLRQPADGVALPRRRGRADEPQPAIGAVRAVPGDDAVLPPRLRRADPLPPTFARTLAQAPGAARRPGLSRTAEEPRWISICSTTCCSPWSAPVLRCCWWPWANWSAREAGCSTWARRG

SEQ ID NO: 28536 - protein, 98 aa, Pseudomonas aeruginosa
SSHLSRDLMSMGDSFQCLSGSSRREMKRRSCSSRLTENQYLNSRMPLLVSMRSSSGAWRMNSRYCSGEQKPMTRSTPARLYQERSKKTISPAVGRCWM

SEQ ID NO: 28537 - protein, 625 aa, Pseudomonas aeruginosa
  UNSURE (28),(405),(443): Identity of amino acid at the above locations are unknown.
FAGRLAEVLSSLLPWGALATCRATGFWXIAWISSRAFCAGLATRGRRVAGLRGARRAAGRAGLAGCAAGCSGEGGLTVGSSLMRDSFRSTFSAMQSPTLCPCREASVDPHQTAPGRHREESLTPLHKSLVGYRHARGVPSSPRGPGSADRVNTELALINRGPAAFAPARRSDEGPHMSRTWIRSPLAIFTANGLDAAGGLVVEDGRIVKLLGAGQQPAQPCASQFDASRHVVLPGLVNTHHHFYQTLTRAWAPVVNQPLFPWLKTLYPVWARLTPEKLELATKVALAELLLSGCTTAADHHYLFPGGLEQAIDVQAGVVEELGMRAMLTRGSMSLGEKDGGLPPQQTVQEAETILADSERLIARYHQRGDGARVQIALAPCSPFSVTPEIMRASAELAARHEVRXHTHLAETLDEEDFCLQRFGLRTVDYLDSVGWLGPRTWXAHGIHFNAEEIRRLGEAGTGICHCPSSNMRLASGICPTVELEAAGAPIGLGVDGSASNDASNMILEARQALYLQRLRYGAERITPELALGWATRGSARLLGRSDIGELAPGKQADLALFKLDELRFSGSHDPLSALLLCAADRADRVMVGGAWRVVDGAVEGLDLAALIARHREAASALIAG

SEQ ID NO: 28538 - protein, 148 aa, Pseudomonas aeruginosa
REARCTTPRWSPTCSSPRCSRASGSTCRSTAARASPSARPWPTGTAASSSRPTSSGSTRAMPRGSSTCSPSVSPACPESLAVRPAPGQPWRRLASWRRACSASPTTILPGTDSIRLSGRPNSSRVMPSRSRVGSSPISSGACRRIRSA

SEQ ID NO: 28539 - protein, 297 aa, Pseudomonas aeruginosa
  UNSURE (46): Identity of amino acid at the above locations are unknown.
RRRALRARPRADRPGLAGAPARYAGCGDPAGLRGLAGAAAGACRGXCPRRGALAPDGNTGEPPGHRRGRCPGSLPAAAPSVAQPAALGLPAGQRRLPAGDALAGRLVAARRLAAGLACRLCRRAGTGRRMEAGRWLLPEPGRRQRGARAYRRRPAAGRTAARRRRVAGEARRAAIRGRGRRRSGAGTGHRVRGPSRRRGDPRHRVARAGRGERRHRCGRRRGSAGRRPAGRLRRRQAGPARGHRRRRRAGLAPGLAELLPAAAGGSARRTRSLLPRTHSPARRRARSPAGQRQLPQR

SEQ ID NO: 28540 - protein, 444 aa, Pseudomonas aeruginosa
PAIRHGPREAQDLPRRPAARQQDQPLRLPRPGLWPGGAVDPGGRRRQRPDRQAAQRLAVLPGLDPPGRTLDPGRRRALPDLRPARRARPAVQRQHRYQRAEMGAARRPGLPPERRGFAVRQLHALVQAELDHRPAEHRRDHRFGDPAGAGDLLGAGRQAGCAGASQRHPGAVRHSQEERAGQRTRRCRQQQRARRRPGPLARPGAGPHRPAQRTLEPDRQLRLARRGSHRGPDPGGQAPAERGAQHRVAVGGLRTRPALRRRPPAPGRRRAPRRQAPGRPGQFLRPALLHRGRCLRQLRHPLRRTRREVPAQREEPVRPHLLPVQCQSTVRGDGRAPAVPGVDDGGVLSRRSLQVGFPGVLLDVEAPLKGEGSARCCPTMLHPVPSSPREGIARRVSRSAIQCLLPLGKGRRRTAWHDLAARHTSFPTRPLGTMPAPLAATAAP

SEQ ID NO: 28541 - protein, 231 aa, Pseudomonas aeruginosa
PKLAPQSLDPRLQDLRAALAEPGAGEHPAIALGNQRAGLLPPQARPPRQRPAAQLRPRRPAPGRAHHHVRPGLRPVRQAGPAHPGGDVAGQRRRALPAQERPLPGAARPELRRRRPDPHRQRGPLLLPHHQARALSLAQRPQRLAPGAHPRVCQRPGDRRAAGHPDVLRGRPADPQVPDHPHPCRPGGGAEPDRPARHEHGQPDGLPGLPLRHRPARAAQDLLRERLRSRP

SEQ ID NO: 28542 - protein, 159 aa, Pseudomonas aeruginosa
ATNCCGKPLPRPPVPMSTSAWRWPPPATRPVTWRSGTAWPAKTRRASTSSCSATSTTATATWCATRSWSSGRPTAKAATRSATIRSDRSTASAAPPPPSMPASGPCTRSSRGWCVTPRACRWRRTSTSRCSPAASTSTCRPGCTSMTRPRPTPPVRCST

SEQ ID NO: 28543 - protein, 406 aa, Pseudomonas aeruginosa
NPCQFWEFPAGSAGICMDREGEGMSDARGAFHSKGRWSRMALPAILCAGLLVGCGAEPPAEEHVRVLAQTVKMAEFASATSITGDIQARVQADQSFRVGGKIVERLVDVGDHVAAGQVLARLDPQDQRSNVENAQAAVAAQQAQSKLADLNYQRQKALLPKGYTSQSEYDQALASVRSAQSSLKAAQAQLANARDLLSYTELRASDAGVITARQAEVGQVVQATVPIFTLARDGERDAVFNVYESLFSHDVDGQRITVSLLGKPEVTASGKVREITPTVDERSGTLKVKVGLDSVPAEMSLGSVVNASVAAPAEHSVVLPWSALSKVGEQPAVWLLDQQGKARLQPVRVARYASEKVVIDGGLEAGQTVVTVGGQLLHPGQVVEVAQPPQPTQSTASRDAVGGGQP

SEQ ID NO: 28544 - protein, 788 aa, Pseudomonas aeruginosa
SDRAWPTATGWSAPESTASSPARRSNSTRMRDEGRFQPVGLGPAPPVPGLVPDGGIAGDGRVLLPQPGARGGSLVRHQDHGHPDPLAGRHGGRHPGAGHRPHREEARGPGLAGLREELHATRRIDGLRLPQGHHQGRRHPGYLVPGAQEDIRHPGRIPPGHPGTGFQRRVRRRVRQRLRLHRRRPGLPPAARLRGESAPGHPLGERPGQGADDRCAERGHLPQLLYPQAGRPRSRPAPGRAEPAGAERGDPVRRGRGRPRAHLGAHLRQLPFGKGPAGGQPAGQRSFLPAVRPGQHQPRFRRPADLAVPLQGRAGHRPGGGDEGGRQYPRVRRGAQCAHAGDHRRTAGWCRRAPGVEPGPGGEEGGRRFHPGAVRGGGDRPHRQLRQPRPARRAGGGLLDPAGAGDGLRVHGIHRHHHAAGFPRRADHRPRPAGGRCHDHRGDDDHAPRTGRLAARLGDLRLHLDGLPDAHRDPGDGGRLRAHRAQRQLRRRVHLHPVRSDRRGAAAVVDRRGAVRPGDRRAHPAEDSQAQVGAEEGPHRRAFRQPAAPGDAPALDDHLPHRAAVRRVAVPDEVRPAPVLPVFRPSGTAGRPQPAAKQQHPRDQGGDGPSGNDAEGRRGHRPLERLRRRRRDPLLPAAGPAVAEQLLWPAGDRHQGPGGPRARRRAPARSLAQGLRRHQHLRAAAGDGAAGGTADPVPGQRTADRQGPRVRHGPGRRARRQPEHRRYRLRLERAREDAQDRHRPGQGAPARAFLRGRGADHEQRGDRQRGDPGARRHLPGERHRPRRG

SEQ ID NO: 28545 - protein, 261 aa, Pseudomonas aeruginosa
RARLAGDPGEPADRHAQRHLDPAQGVRQGQLRAGAAAGVAPRPQADDHGEGVAARRDPAHRPGRPAGAGGQALRRRPAGELPDRSGRHGGGERQGRGPDRQGGAADAVPHGDLPDDPVAERAEAVPGGQRRAAGADRGGRGVAADRHADGLRGDPRDSRADRHHHPQLGDPGDPDRCLRERRQDALGSRAGSHPPPHPADPADGGGGQPGDDPHRPRSVLGADGLCDDRRHRRRHAAHADLPAGAVRRLVPDSGTGTLSAA

SEQ ID NO: 28546 - protein, 338 aa, Pseudomonas aeruginosa
AARRQGKSDQFTNLFCNRGNSGHIARHARVRQGGGQRQLHFRRPGPGPVHRAGIAADLRPGGAPADAPAAPHHPAPGPDRGRRALPGTVPRDPRGHRGRRGRSRRRAHPPLRPLARAVADGHGPASPGADDRPLRRTVPRRGDRADPVPAQPGHARGRPGRADHRRAPVARLGVRRPAPGQHPQRALRQSRLPAAARRATLGGRPGAPRLPAPAGPGLPGGLDLRRRAGRAHRQPAEHLHGQCRRGHGPGGQGRPRHRPAAQLRGGRGAAQRRAATGVARPCHAPADHLCAVSLAALPGREDPHLGRSVATGTSPGIRPRRNYHAKFKLLGTVKDCCY

SEQ ID NO: 28547 - protein, 449 aa, Pseudomonas aeruginosa
EGATAMRNLFALTPMALALCTASAAWADEGEAKEGFIEGSSLQLLTRNYYFNHDRRHASGHDSKEWAQGFIATFQSGYTPGVVGFGVDAYGMLGLKLDGGGGTGGTSILPITAPSKEGYESGKAPDEFSSGGAALKIRAFDTELKLGDQFLSNPVVAGGESRMLPQTFRGVSLTNNSFEDLTLTAGQVSFTKYYNQSGHRRLGSYYGELPGDRDSHHLSWLGGTWGGIEGFTSSLYAAELQNVWKQYYADVDYTYEIDDNWSLNPGAHYYKTVDSGDSLLGRIDNNTYSLHFAVGYRQHTVTAVLQKVNGNTPFDYINQGDSIFLDNSQQYSDFNGPNEKSWKLQYDYDFVALGLPGLSASASYSRGKLDLTRVDPDSPGYGGWYSADGKNAKHWERDLDLQYVVQGGPAKDLSLRLRWATHRGTGGYSAVDNDIDEYRVIVDYPIDVF

SEQ ID NO: 28548 - protein, 549 aa, Pseudomonas aeruginosa
PAASSFPEPTPMLDFSAHALPYASQRSPVHARRGMVATSQPQAAQVGLEILRRGGNAIDAAIATAAALTVVEPTGCGIGGDAFALVWTRGRLHGLDASGRAPGLLDRERVRAAGHERMPLYGWTPVTVPGCPAAWGELSRRFGKLPFEQLLRPAIELARDGFPVSPVIARLWQSGLDKFRAALPQRPELRAWFDEFLIDGRAPRAGEVFRQPGQADTLDELARSQCESFYRGELARAIVGHAERSGGYLRAEDLAGYQAKWVEPISLNYRGYDVWEIPPSGQGLIALMTLNILKGFEFGERDCARTWHRQLEAMKLAYVDGLHYISQPQSMRVSVEELLHEDYAASRRALIGERALDPSPGQPRPGGTVYLACGDEEGNLVSFIQSNYHGFGSGVVVPGTGIALQNRGAEFSLDPDHVNCLEPGKQTFHTIIPGFLSKDGVPLGPFGVMGAYMQPQGHVQMVMNLVDFGLNPQAALDAPRWQWLGGLRVGIEHAAPRALAAELAQRGHQVEIAYDSTSYGRGQIVLRDPASGVLCGGTEPRTDSQIAVW

SEQ ID NO: 28549 - protein, 571 aa, Pseudomonas aeruginosa
RTRSTSPPTRTPPASWSSTTSESVARGCRPGPASAPRHCAPCIGTVRDGRLRGPCVCLPLSARPTPGVPCSLSGRNKLINWTAFCRSRASSSPPEERHPETAPMHSEDQRPNDLIYGLDDRPRPLPAFLAALQHVLASFVGIVTPPLVIGSLLGLGEHLPYLISMALMVSGAGTLIQARRPFGIGAGMICLQGTSFAFLGAVLAAGMLVKQRGGGPEEILAMIFGVCFFGAFVQIVLSRFLGHLRRVITPLVTGIVITLIGVSLIKVGITDLGGGAGATDFGAPANLALGALVLLSIVLLNRSRLPWLRLAAIVIGLALGTLAAWATGLFVPRALPELPLVSLPQPFRFGFAFDWMAFLPVALIYLISSIETVGDLTANCMLSRQPLEGPAYLQRLRGGVLGDGVSCLLAATFSAFPNTTFAQNNGVIQLTGVASRHVGIYIGGVLLALGLFPWVGAILQQIPKPVLGGATLVMFGSVAAAGIRILGQTAMDRRSVLIIAASFGVGLGVAAQPTLLDQMPAVVKTLFDSAITSGGITAILLNLLLPEERVAEAAQASAKGGALARWRKPLG

SEQ ID NO: 28550 - protein, 468 aa, Pseudomonas aeruginosa
FDVTMMASRQRPVVRACRRRGLGGGGCGGRRKSAAGRPGSRSEAVAAAAPGGLLEQRGGDPFERQHVFRGAQFHRFAGHAVDHAGSLVLGQGVAAGLADRQEPARAVLAHAGEQAGEQVAPGAASQRLEHHVHCRAVAVDLRLAVQTHHVVGAGALHLHVVVARRDQGVAGQYAVAVARFADAEPGQAIQALGEAAGEAGRHVLGDDHPGTVRRQAEQHFLERLGAAGGGAEGDDLLGAEQRRRAFRRRRRVRRTAAQAGAGDGLELGADFLGIGLHAFGDAQPGLGDEVHRAQFQRAQGGFGTALGERGDHQHRGRPRLHQLVEEGQAVHSRHFHVEADHVRRVLLDQVAGDEGVRRAADQAQLRVGLDDLLEQAADQGGIVDDQDTDGHGGLSRRVRTGRWGRRPRCGRYGGGSRVHAAARCRSSAPPGTSPGPGHCAGRSRSCAGRPPARRWRAAGYARWPGSRG

SEQ ID NO: 28551 - protein, 1121 aa, Pseudomonas aeruginosa
RSPGLRRWRSIRRAKASPHRRRSTDRSSGSAARLPGPGDSSRSGRAVDGLADGAHQVAGVDEVLRMPGEEQALRPQQGHHAFQQAGLGRLVEVDHHVAAEDRVEFPGDRPVCLQQVDLAELHQLPQFLHHPRLAGVGPGAAEEEAFLQRRRHLLQTLQRIDALAGAVEHPGIDVRGDDLHRRIEAAQRLHQGDGDRIGFLAGTRRRRPDAQRAMPLQLAAGEVGEQGEVVAFAEECGEVGGQRVDEQLLLARLAVEVGEIFGEAPEPQQAQAPREAAIDQLRLALGQADAGQSVESLAYLLEVLAGVVELLVAEHRRRRGGGHWRRVSLVDPKGLPPSAWRRRGVVSELFPAVFLARLAGPRHAAAGQRRRRAGAWRGRPRAGELDHARRSVQPEHRHRLVEQARLLLHGLGRGRGFLHQRGVLLGHVVHLRDRAVHLFDAGALLGGGGGDLRHDVGDPADRHHDVAHGLSGLGHQGVAVLHLVHRVGDQRLDLLGRGGGTLGEGAHFPGDHREAAALLAGAGCLDRGVEGEDVGLEGDAVDHPDDVGDLARRLVDRGHGADHLLHHGAALGRHFRGIGRQRVGLAGILGVELHRAGQFFHARGGFLQARRLLLGARRQFGVAAGDLAGGGVDGVGGLANLPEHPRQALCGVVGEILELAEGALVVGLDALGEVALGQRPEHPRDVAQAAVGGIHQAVQVLRQPEEEAFLAGLLDALAEVAGGRRLHQLRDFLLGAVFLGAVGPLHGGAEAFVGVVEHWHHIEGEAPAAEVELGLVHAGEVGQQVPLVRRILVEHVDVGAHQAAGVEVRQLLADIRFGATEHLADGAVHVDDVEVVVGDHHVGRDVVQRALDPRVVGRRGQLRRGRLGGPAQAFANAVDGFGDLRLLARQAVHQRLEVALAVGGDHADHLHLHRDVRGHQFVDALGDARRATFQAFGGNRLVDPAGFVLAAHLRQPRLQAFHLLEFGALFAQLPLQRSQAVVETLVAGRRGLADGGVELAVGERLEERGDPVGALLRHRMCIEQTHFDIPCLSLVGAAQAAASSTSAISRLVISLSMSTRINMRSPAVARPSRYSVSKLAPNSGGGLIASPPSAITSDTESTTTPTMRRPMLRMITTVNGS

SEQ ID NO: 28552 - protein, 1129 aa, Pseudomonas aeruginosa
PRISCTRRMSMAYSSRPRVKVRYSCAGPFAWLASVPFIGGVLPRRQAWQRIDVENQGDAAVAHDGGAGDTLHAAEILFQALDHHLLLADQFVHLQGEAAPLGLEDHHDALLRRRRLAADAQQLVQAEQRQVLAAYADHRVVFAAEAAHVVAARLQRLDDVGQRNHVVDRFDGDDQAVEDRQGQRQADADASAHAGRRVDVDAPAHGTDVALHHVHADAASGQLGDRLGGGEAGHEHQLPDLGVAHPVMHRQVALAGLGEDARTRQAATVVGNLHHHAAALVAGGELHRAARRLAGGEAFGGRFDAVVDAVADDVGERIAEFLDHALVQFGVLAVQVQLDLLAQARGGVAHQPGEAAEDEVDRQHADRHHRLLQVAGVVFELGQGVLQALVAARVELLAELAEHGLGDHQFADQVDQAVDLFHADPDRAGLAVATHWRDCAPGRRGDGLRGRTGRGGAAGGAVEQAEGAFLRRWGTRCLIEEAERFARGRCAGRLVEEPERSRRGRSFRSARAFVEEAEGIVVRGFPGGTGGRVVEQAEAFLRRFLFRHPQPAAQALDRLQQRHPGVGTAAAMGVEQALQHVAGFEEGTDHVRPQVHLAAADAVEQGLQFVGDGGDVVETEHSAGTLDRMRGAEDSVQRLAVRPVQVETDQEEFEGGQVFLGFLEEHLEKLAHILGHGTSPAGERESGQDLARHFEQFRRVERLHQPAGGAGAASLLLHRVARFGGQHEDRHAAVAGQVTQAADQRQAVHVRHVLVGEHQAVALALGLAEAFLAVRGLVHLVAGGLQGEAQHLADRRRVVDDQNRFAHGLASSRCPYRSAKLGGEGGVCQVAVTEGSDGPLLVPVKTMSGGFQLLAPVSRRIVIRLDGLAIDTPQNNSTSPTLTLFWLTGLGKGRRSSSTSRATRSGHSWRGRASSAPRPRAKAPRRAWCLRIWPSNWLPMSWNCRAVTAASTPWPTSSESRSSSWMTFRVCRFMASRSSSMPWILCLESRAKDMSLSASCEIALSASWISWWTTSTCLRMAAENSVERVDSARTSSATTAKPRPLSPARAASMAALRASRLVCLAMASMSWVDCRISVIFRRTWSMRSTSCCEVRLVSRVASTNRLRVCWVVLTKSWKLMPSSTWPRPS

SEQ ID NO: 28553 - protein, 211 aa, Pseudomonas aeruginosa
SRPKASPMLTFNVPLGWLPTLETLARAVWMPSRLPPTSCRKRSPASVRVRRRVLRWNRRTPRLLSRRATFLPTPAGVRPRRLAASAKLPASALRTKHWMLLRVSMGKGPHKPLVSAEYSDYPLPGLQWTTETRGLSIHSDGDFHVRILCIPRRQSRLRPGRFPRHRRRHRSPAGRRRRQRRLHLRQLGGQVPGPGGRTRRRRSQHPGPACR

SEQ ID NO: 28554 - protein, 192 aa, Pseudomonas aeruginosa
RRRGGARRRRRRSGGSLRTHRHPGQQRRRPRPRFGGRAAAGRLRADPGDQRAQRLRRHPGGGQAHGRRRAGDQHRQHQCRTHAVRRRRHLRDEQVGAGRPDQGPGPRPRPARDHGEQRAAGSGGYRHEPGRRRLRRGPQGPDGAAALRPQRGNCQLRRLLGRAGSGLHHRGQPDHRWRFLGLTRVASFHPAK

SEQ ID NO: 28555 - protein, 436 aa, Pseudomonas aeruginosa
MRSCVSPARGARFDALAEGIEQGAGEADQEHAGADQVHAEQLLGADHQAADAAVGGHEVLGADGSQPGVDQRQAQAGEHRRGGTRQDQPEQPSPGTQAQHPGRLAEARRQAGDAALGGQQQREEGGDCDERQLGRFAQAEPGGEQRYPGEDRHLPQCRESGAEEAFRRAPQAEQQAAEETQAAAQQEPAERALQAVEQGAWEAAVERSAPGRPRHFQRAGEDRRIDPFGAARRLPQEQQRQRRQPHLQALPAASRRAPAEFAGGGLRPVQQAAVEPLDGAVHAHPDQADDEDADEHDVEHEQLPALHHQVADTLAGSKQLDRQQRGPALRQGQAQPGEEGRQRRRQDQPPDQQAWRQAQYCGGFAQLGLGVAHADQGMDGHRHHDRFHQHHQLEQFADAEEQHEQRDPGQRGDLREGAEGGEDQALGTRTEAQPGA

SEQ ID NO: 28556 - protein, 409 aa, Pseudomonas aeruginosa
TARRWASSSGRTTGRPRWSSILWRWRPSPNWWRRSRIRPANCGSSSSRGKSWCSTTLRCCTGALPSAPTNCARCAGSTSTATAACGRSWNWASRWGCDRTVRRGGAADPDLHRDRFRLEPFRRAGGYPRAGVPGGQRRLSLPAAVVAGPPRPVHWHGGRGVPRHRAGGAGVRPAGPGRPAPAADAGAALPAVDHAAELREHGHPHRLPGLRRGGAGVCGGVLHPDPGGPRDARRLVRFGRYHPGEHPAQPDDLCPGRGAGPDRPGLEPAAAVARCDPPAGRDYRAADAGDARPVAGRSAPARDLAAVAAVSGAGLGRFRGRLWDRCRPGHGGGGGGHLRHPVRDADRGAHLPVGQALRRTGERSGRHGADHHAAGAALHAFVHPVAAARVKTIRAAPRGGPGRHQIERE

SEQ ID NO: 28557 - protein, 253 aa, Pseudomonas aeruginosa
APDATSPQGIRFMNNKTLCPSLLLCLSLLAPLSCLGETAAAPYPLAHPPRLADYLPPPPAADSAAAVADLGAVLEAQRLRTPEQVRRVRAHDQWEDNVFPFAGDLLGASFDKERLPLTRSFFNRAQENLVEVLMPAKKHFARPRPYEVTPKVKPVLPPPEGESYPSGHTMDSYFKASLLSMLVPEHHDAFFARAEEHAQSRVLAGVHFPSDLEGGQTAAAALVASLLADPAVAADFAAVREELRGALGLPKLQ

SEQ ID NO: 28558 - protein, 830 aa, Pseudomonas aeruginosa
QSPGAEPSAGPLRTFRQIAALRGMAACCLRPAAPEPRTFTMKHHYRLPLRRTPPGGSDYALALLLALGGALPASAADAPAPAEEAPPLASSVPDKADTALGKVTVTARRREEDSQKVPTPITVLGGETLEAQRISRVQDLQQVLPSVNVAYIHARQSSVAVRGIGNNPASDGLEGSAGIYLDNVYLGRPGMAVFDLLDIEQLELLRGPQGTLFGKNTTAGVLNISTRAPTFTAERTVEVSGGQDGYFQGRGTVSGPLGETLAGRLSAYRTRDDGYIKNIHDDNYLNGGERQGARGQLLFEPNEDFSLRWIADYNEEDSSNGSMVVYGAAERFWQRAALVGASPLRDPQRRKVNINGRQHVSVHQGGSSLEANWNLAGGYRLTSISAYRYWHFTPANDEQLNVSAINDTGVEVHDRQFSQEIRLASPTGGAFEYVVGAYAFRQNLGNKTFTSYGPLADLYLLGANLGALNDTYSKANGKIETDSFALFAQGTWHLTERLDFTAGLRGTYEEKNAKVERFAPLGGAAVGGVGAAVRNGQLGAYDSGDLSQYNFAPSALLSLSYQFSDDLLGYASLSHGEKSGGVNLAVGSAPSAGADSLLVGPERANDAELGLKSTLFDRRLLLNANLFWTGIHGYQATTLYQAPGLTQLVQVLANAGSVRSRGLEFEATALPLRGLTLNFNGSYNDVTYLSFKDAPCPAEVSTRPGAPSSCDLTGQRVVGASKWIANLNGEYQWRLDDRFQPYVSASYAYRSAAEGTLDNSDLSKIDGYALVNLAAGLRSDLGDGQLDTSVWLKNAFDKDYYLSAFASINGSYTASVGQPRTLGVSLRYDF

SEQ ID NO: 28559 - protein, 224 aa, Pseudomonas aeruginosa
HEQCSTSPRHAGTARRPAGRRTDRRGDSRRDPVRRTGRRHRRGDPGRPGTPQGDLLPGPEPSRRPDPGGLRPLARRTGRPPHRAVPRRHPLPPRAGWRRRPPGQLLAYRRDLRRGLPEGLDPAQRGGPGVRRRHRLGQHGERLRRPAGGAARAGRPALGGAQQRVRLRRGLAQRLGGAVGELPQGVHLDRLRDRAPGGPRASAKRRADAAPRPLRETPEGSFAA

SEQ ID NO: 28560 - protein, 170 aa, Pseudomonas aeruginosa
ANPPPPGNPNPRSPRHSASPPWRRRWAPKSVASTRAGRWRRSRSWRSSRRCASTTSWCSASSTSTMSSTCASPPCSARCSSRRRTSRCCPRVATARCRTSSRWPTPATANWATSPCRHTSTTNGRRCRPPARSSTHWRCRPVAARRASPTWRAPTRASTRRPGARSMACA

SEQ ID NO: 28561 - protein, 372 aa, Pseudomonas aeruginosa
VQIGVPLETHAGETRVSATPETVKKLIGQGHQVIVQSGAGVNASQPDSAYEAAGATIGSAAEAFGADLVLKVVAPSAAELAQMKSGAVLVGMLNPFDNENIARMAERGITAFALEAAPRTSRAQSLDVLSSQANIAGYKAVMLAANHYPRFMPMLMTAAGTVKAARVLILGAGVAGLQAIATAKRLGAVIEASDVRPAVKEQIESLGAKFVDVPYETDEERECAEGVGGYARPMPASWMERQAKAVHERAKQSDIVITTALIPGRKAPTLLHEATVAEMKPGSVVIDLAAAQGGNCPLTEADQVVVRHGVTIVGHSNLAALVPADASALYARNILDFLKLTLNAEGFSVNLEDDIVAACLMCRDGQAVRKNG

SEQ ID NO: 28562 - protein, 107 aa, Pseudomonas aeruginosa
RPVKTMDIISDGIYNLIIFVLAVYVGYHVVWNVTPALHTPLMAVTNAISAIVIVGAMLAAALTVTPLGKAMGTLAVALAAVNVFGGFLVTRRMLEMFKKKAPKAGGH

SEQ ID NO: 28563 - protein, 108 aa, Pseudomonas aeruginosa
TWLLAEAEVPYKQVFEMEDINSEFGQTDVVLVLGANDVVNPAAKNDPKSPIAGMPILEAYKAKTVIVNKRSMASGYAGLDNELLYLDKTMMVFGDAKKVIEDMVKAVE

SEQ ID NO: 28564 - protein, 188 aa, Pseudomonas aeruginosa
DSSTDLSGHGVRQCKEFFMATPQPVDARTQPWRETPGGDLVALGRPVRQALHLVRHNPAQGRVLSRRETILLVLFALTLHGAVIHWLSQQRTPALPEVPPQVPPMTIEFTAPAPPVVEPPPPEPLPPVVEEPPPPVVDENAVKPPPPKPVPKPKPKPKPQPRPKPAPKAVEPAPPAPPQPAAPPAPPA

SEQ ID NO: 28565 - protein, 79 aa, Pseudomonas aeruginosa
APAGRVARRVAAARAEPARRPSAPAWAGVAAWAWVSALAPASAAAASPRSRRPPVVAVPRPPAATARAAAVPPPAAPGR

SEQ ID NO: 28566 - protein, 170 aa, Pseudomonas aeruginosa
ELSIDTTTGMSAPPMGMMISTPRTKASASITAKAVRLPVNMNTRPRPRVARPSTRFSRCCPENCTGVPWNRRNLYLPESLPKAITEPEKVMAPMAAPRNSSRRLPVGMVSPRCATIPSDCGSTTAAMAMNTAARPIMLCMKATSSGILVISTRLAMIEPAVPPTSRPTTM

SEQ ID NO: 28567 - protein, 333 aa, Pseudomonas aeruginosa
GVLAGSFCLWSPSPARRGPGPSCLPDRPAALPVDAYRHVAAEGHPAHHARLVAVVVDRVVLGRAVVPDRHVAGLPAPAHGVLQARDVPLQHREEVRRVMLRKTLQAFHEVAEEQRPLAALRMHADHRVLGLVDGRGEHLAVVLQLLHRGAGLDPGVVVLVAVHRPEPVGQLAQLRRQVGVGARRVGPDGVAAGLRGHHAAQDRGLRVGLDEGHVGMPGVGPAAFGAIQLEEEAGAFAGRHGGVGDRFAEQVGEGLLGLVVEMALVPEEDHLVAYQGGLDRLDGGGVQFAGQGHAANLRADPSGDRPDVEPYRRGEGLCCIAHVMFLMRGVLRG

SEQ ID NO: 28568 - protein, 195 aa, Pseudomonas aeruginosa
LPKCLTRPAVAHASPCQWQAPAKAEAGKHKRPAERLPRLRPPGTQVGENNKCKISDALYSPAWSPARFPKGRPRRPGMGASSRTANCSSSLAPTTSTATTATARTTPGATASSPGASATATVRKPPRACASSSPPATRRAASASASTPMPCSACNWTAAAAAPAPATCRSAPTAIPTIATARSVAPSGYATAKPA

SEQ ID NO: 28569 - protein, 794 aa, Pseudomonas aeruginosa
STARPPPARRCSPPAATARWPAWPTACCWRTARSTGCCSRAGASPPPPAPANPRSAATSAPSTDASAPIRCASTRSASSAVNGRPRSGCNCRSTPRASTTSGSRPISAPAIASRWAGSARCGSTSTPTAPATAARAASAASTPWPAPWPWATNRGRSASPWPTSVSMASSRSTTWPSATGAPARPWYSPTRWATPTSTDRASVPGNYAMTWTSARSACLGSACMRCMPAAVPGPAPAVPPRASTPDSTGVTGGTGKTTSASPIGSRRAPSPASRCAPRRPGTGATRAISTATSTKPGWSSITPARSGDAPGRPAGRPGSSSRARQQLDEQRRGEQHQQRGDQHHACHFVHRSVVTLGQQVGEHRGRHPALDGEGARRHRLHAQAGSDPIADRETAPDPHQRQQQRPPGLVQAQTGQRQAEHHQHQRHGNPAQQAGHIAQRRRQAPAQGDQAQRHGQGIDHRVAQDARRGDIARSEPDAERRVAHLDQGGERHRIHQRLLAEGQVGDGDAHVPGVRQHDRRQVAPHRHPQQAQGDQAQQGERQHRQRGGEEHPGHHANGQAGAVQRRQQQAGKADVGHQEHQRAGIHRPGGTAPGETDPGADQDRQHHRDELCDHNPTLKPSSSSARRRPWPSKLSRRISRSSLAQKAVRPCNTAVLSSTRISPGSSLIRSWQAGSSSAATSSAKASTATGCSTTSAAPSFCRNLMPSASPFRRNTGWVLLWCLRTMVRASPRSRPRCLVGMRRRRRSKASPALASRVSPPSRALRTHCRLHNCSGVSRKAPSVCSLCSSGVEPR

SEQ ID NO: 28570 - protein, 811 aa, Pseudomonas aeruginosa
NPFARLEPAPAAPGAAALRGFRPAPGGRPAALVAAARAGAAVVGRQPSPLDVGPGAANSRAGLAERPRVARRRTLERIGDQPAAPGLGPARRGRQRRRARRLAGLQSACRAPGLPHLQRPRANPHAGLDPAVHAVLRHRRTAQAGGAGESGRGAGDHPYPGRRARRPAQAARSRRSTAPAATPAGLAADPAGGAAGLPHRAAPGPGAGLDLAAGGRVACFQRGYRLPDGAGPATVHARHRVRLHPHHRPGRGGHGPRHPVARPPPAALAASRHRRIPPAPAGTRLAAPAGVAAAAGAAAPVAVGEQRRMGRSGDPRQPSGSGAGDLERSARRQPPRRPVRQPEAHARRAPAGRRPGFPRRPAARPVAPGGTLLRPHFRGTAAGGDLRLGTAAHRLVRPGRTGQADVRRNRRLLPAAAGHPARHRQPAAEPRRGGPGAAPGSLATAAPAGPAGCRPVGVRRPAPGADLRLAGNHRRRVLHALRRRHRQPDDRRPAIVPHGPDRRRHAPGRPHRRPAQCPRPTHRSARHALETRMNAFTAPATGTPLVSFRQVRKHFAVDGRRLEAIQQFDLEIGEGEFIAIVGASGCGKSTLLRLLIGLDRDYDGEIRVDGRPIAGIGGERGIVFQEHRLFPWLTVQQNVALGLVNEALGETDKAARIDEYIRLVGLHGFERAYPHQLSGGMAQRVAIARGLVASPRLLLLDEPFSALDALTRQQLQEELLAIRRRTRITTLLVTHDVEEALYLADRVVVMEPRPGRIRRVVEVGLAHPRERGGFDFLRQREALLHELTADGEYVAPPPRRVENLPFEFLAC

SEQ ID NO: 28571 - protein, 565 aa, Pseudomonas aeruginosa
KAPCPGPFPLREGRGRGPHLLLPSRRDPRMSKRPNFLVIVADDLGFSDIGAFGGEIATPNLDALAIAGLRLTDFHTASTCSPTRSMLLTGTDHHIAGIGTMAEALTPELEGKPGYEGHLNERVVALPELLREAGYQTLMAGKWHLGLKPEQTPHARGFERSFSLLPGAANHYGFEPPYDESTPRILKGTPALYVEDERYLDTLPEGFYSSDAFGDKLLQYLKERDQSRPFFAYLPFSAPHWPLQAPREIVEKYRGRYDAGPEALRQERLARLKELGLVEADVEAHPVLALTREWEALEDEERAKSARAMEVYAAMVERMDWNIGRVVDYLRRQGELDNTFVLFMSDNGAEGALLEAFPKFGPDLLGFLDRHYDNSLENIGRANSYVWYGPRWAQAATAPSRLYKAFTTQGGIRVPALVRYPRLSRQGAISHAFATVMDVTPTILDLAGVRHPGKRWRGREIAEPRGRSWLGWLSGETEAAHDENTVTGWELFGMRAIRQGDWKAVYLPAPVGPATWQLYDLARDPGEIHDLADSQPGKLAELIEHWKRYVSETGVVEGASPFLVR

SEQ ID NO: 28572 - protein, 291 aa, Pseudomonas aeruginosa
AEPLPSPSPFRRERLARRSGRGATSPGGTRRPGSGRETAIDGQAGPGDVGRFRPGQVGDEAGNFLAAGVARQRHQALEGLGEVAVVRVHVGIHRTRLHVVHRDPARAEVAGQALGQADQRRLAHRVGGAAGERHAFGIGAADADHPPAVAHVLDRRLGGDEDAAHVDRQGPLEVGQRQLFHRTEGEDGGVVDQDVDASEASRRFVDGGDERRRVGAIGMQGQDAGSGAFEFGRQGPGLVRRADVGEGDAGAFGGQPANDGGADAAGTALDEGDFAGEGCRGYGHGNLHRSG

SEQ ID NO: 28573 - protein, 259 aa, Pseudomonas aeruginosa
PGRLPQRADPHADHRIERRDEAAGTQRRRHRLAGEAVRPAETARSDAQGPALIPVPPRGRSHAPGYEPVSPGVLRGNRGTPGHPRTPPDRSRPGPAGQRDAARNLPRRAFDQGFQRNVRFRRHHRRHPRTGDPARPHPLRPDAPAAGHDQFLPRSPRRVAAPARRPSQRPSRPRGAVAGDGRAPARLAAGAGTGSGGGRLRPVRRRARQSRQGNRGRRCLRLLRRRPGRSGTSGRAGSVRALRRGARRTGRERSVRPLR

SEQ ID NO: 28574 - protein, 230 aa, Pseudomonas aeruginosa
GTGFPTGGGTRLRPVRRRPRQPRRAQCARASRRRDGQGRSRASAWRRRVRLDPGQRGKDRQPDQPGRRTGDHPGHARPARRAARPEPPRAPAARPGPARTQHPRPAGVGDVDPHAADQLHLQPLPQAGARHRHAPGQAGRAAPARRAHRTGQERDRETQRSAHPHRPQQHRPRHRNARRTPRRRQAGERHGEARRQPPGRQRGGGGFRRRSRPVASAHPRQGPRAQPAGA

SEQ ID NO: 28575 - protein, 209 aa, Pseudomonas aeruginosa
RDERRRGLATGVHARLLHRRDGHRAVRTRRRHGRGEAQHRCHGRAHRHRLGARHGHSHRHPPAADPGDPRRPDRRRRSGQLRDSADLHRRVAAGAQRRRARPRRRRQRDDPRTRRVPAAVQPARAVAHRRRGAGAGAGHRGDPRVRGAQLRPAGGRTGRPAAGGDQEPGTEFPPRGGYRRRHHHGRRQRRPDSRRRCAATPGGAGGHRR

SEQ ID NO: 28576 - protein, 719 aa, Pseudomonas aeruginosa
PAAKWRWSTKPRPERRQRGIGRGYRNGSVQCTCGGAATRRPDRHAPPVVRRRPARHRRRRGPGARLRASLRQPASAAAATARTTRRTPAGGKPGGGAGGDEPPARSRLDRPDDSRRTPGRSRGAHRQGRQRTGGRAHRGEDEGGQRGHRLRPGQLRAADGPPAGQEGADHRSHRRRSRTPARGRRGDLGATGHGGLQRADQERAGQRLGQRDDRRQRPQHHLHEPHRQRDARSRRSGYPQAVAELRRRPPDGRQHRRVPQESGAPAAPAGQPHRRAQGRAQPRRPALLPRCGASVQRRQRTPRLRRAMDRPHRGTPRRAGSLATGAGGGRRRLQQARRGGRQGRLLPQAGEGPEQPGGYRRPRLARRLADARGAGPGRPHPAHRGRLPGHLRPAQGFLQRHRTKPVADARADSRGRRHHQHRRQRDRQRQRRTVGAHRAAGVEPGGNRLEHGRTDQHGEAQRRECPPGQLAGGQCLGSGDPGRHRGAEGGQHHVLDQRVGAQDRRHHRGDRRHRLPDQHPRPQRRGRGSPRRRAGPRLRGGRRGSAHPRPAFRRRGQGDQDADLRLGGQGGERQHPGGPGRTDHERHRGGDPPGHRHHVGDRRRLRRAEHRHRRGEQRGLADGRHDPAERRAGGGSRGRGRGHAGAGGPAQPVGGGVQAGHSAERGPARQRAAVRATPQRAGAAGPQRHGAGQQGAQGRRLGRVLRPRRASARRRAASP

SEQ ID NO: 28577 - protein, 436 aa, Pseudomonas aeruginosa
PPLAAPAPAAARELRRIFHPPRPRAGRAAVVRQRADHQPHRILPRTPPLPPARRPRPPPVAAASPAAHLVGGGEYRRGTLFDRHHPGGGAGQLRSAGEDRRLGHRYRGARLRPPGRLSAGASGADAGAAEETLLPPRHRAQRRQGAGGGGTAATGGVPPDQPAGGRLVDRRGTRRDLLPQRDDLLRQADPDPPAGTHGGPAAAGGPVLRRAFGELRPRQPPGALRRPDRLQPGLIAMNLQAREGAPLNRYYDPYFACDAVKLLPGEYFASGEDLVIVTVLGSCVSVCLRDPLNGIAGMNHFMLPERGLGGDPASPSARYGSHAMELLINRMLALGASRERLQAKVFGGGSVLRQISAAIGQRNVEFTLDYLATERIPLLASDVLEAFPRKIYFFPRNGRVLVKSLVELKNDTVLQRERDYRRRIDRNADGGPIDLF

SEQ ID NO: 28578 - protein, 394 aa, Pseudomonas aeruginosa
LSGRARHAHQCPGRRRFRPDPQPAQGDHPGRPGAAPGRLRAGRLRRPRPDQAARAGRDQPRRGNAANGRPDLPRQADEGAADPGADDLLAHRARFRSHPARAGTGRGGLHRQAPAGHRRRHAGLCRGNPRQAQDRRPRPPAPPCGGRAGAAGKRGAAAQHREDHRPRRLHRRHRGAQGSAARPAGAQSRGGHHPAHASRLHPQLRRAPGSPDPAQRQRSARRRPHTARPRPGRAGRPPHGGAALRRQLRGAFEPPGAGQRPPPGSGRDVRVAGSLRRAQPARRPAHRHGQGRRARAPGDPPGRRLHPGPGRGYLRGLRHAPRSGGTGRRGRRAAARTDRRRAAPASRPARQRQPPLSGILAGPLRFFAAPRNLPRRDPADDRPEPRAFACSPSL

SEQ ID NO: 28579 - protein, 197 aa, Pseudomonas aeruginosa
SPTAPPPAAPANATGCSTCSTSRNSATPCARPCAWPAPRPARCTACGPASTAASNSSPWPTFPNCAGTCSPPSTCTPPRSSTTAGFGRWRARSCCCWWPCCWASPMPSSACCCAPCAASSARPRRSPPGATTRRCRWRARTRSARCRRPSPAWPTRSAGTPPSWKTRSRSAPRRWRKPTARWPPRRRRSATASTMPA

SEQ ID NO: 28580 - protein, 305 aa, Pseudomonas aeruginosa
KLHSPTHPALLQRTDLAQPDRGDRPRAAQLPARRTGQAERSDGRLRGVHRDDPEHPPLRQSQGLRRTRGGGHGSHRPQRGRPLRGVRRQPGGTRRRPEPGAQHPGHRQPRQGRPQGRLQGAATPPARQRLRQRSRSRPAGHRPQVQRTTGRIAEGTARRARLLQPARRDLTPCFRKNTIMSDLHIPGTQSTPAIQGDWQAGRLSMQGDSYPENSYELFGQVIDWVERFLAAGQRPLELDLRLLYLNTSSIKAMMDILDLLEEAHQGGRPVSLRWHYDRRNERVAELAEEFREDCSFPFAIQAHDE

SEQ ID NO: 28581 - protein, 277 aa, Pseudomonas aeruginosa
PTMSRERELDAWIDGLLADPQFHGHPLHQALARLRQQSLEQLVRLERIARISDGFQSMAREQNLSLSERYHKQLRRLEKVARISDRYQQMMRDLNLALKEASIRDPLTGLPNRRMLLERLREENERSQRHGQSYVLAMLDVDFFKQVNDTWGHDSGDRVLVEIARAMESELREYDLCGRWGGEEFLLLLPQTRLQDAGPVLERVRDSVRTLAVRVGTEALSVTASVGVTEHRIGETYSQTVNRADAALLDAKRSGRDKCVFAALPPLPAPSRPAPAR

SEQ ID NO: 28582 - protein, 405 aa, Pseudomonas aeruginosa
PASSRTAASARGRRRAPARDRAGPARARWRPGRAGVRGSRPGRRHRRQSRSRSARPPSARRRWRSPRRWHCRHGAISPARPAPPAAARWRPCRGGHGPANVARRREARGRRSRASAWAPGNLRRQVSPARLCRLATRRQVMTMNGQPAELHRPIPTLARLPRPVYARAESLRAGSWTSRHRHAWVQLSYAISGVLGVHTAEGSFFAPPQRAIWIPAQLEHEVVTSTRAEMRSLYIRGDACAWAPTRCRVLEVTPLARELIKSFCELPVDYPEGDSAESRLVQVLLDQLRLLPEVAFSLPMPREPRLLRLCQALIDEPTQSLTMGDWAQRLGTSEKTLSRLFQRETGMNYRLWRQRQRLLASLNALEAGDSVTGAALDSGYDSTSAYIAAFKGLFGFTPGELFRQR

SEQ ID NO: 28583 - protein, 263 aa, Pseudomonas aeruginosa
QLAVAQRRGRHVAGQQGDAEVGLGRLGHDLGDIDHEGVLRADGALALLVGEDPALRVGRVLQAQADVALQVVHRAWHAALLQVAGTGAEHAVDAAQALGDELRVGQLALAGDQHVLAFLEHVRVALGQGQLDHHVGEQCAVAGDHRHQVMLAHAHQRLHAQAAAGADVRAGGFGLGDLDVLEDPAAPFQVTLAGLGQGQAPGGAVQQARLQVRLQVGDQPRYLRGGQVQGLGGGSEAAAVHHPGEHAHALQCVHYYLGCKTDS

SEQ ID NO: 28584 - protein, 1087 aa, Pseudomonas aeruginosa
IGRIFPDAGLPILAAVAVATPGIPCPASGRMAHPPSALLPPAQTLLRRRPLPLTPRSASRFRNPVPGDVQRRQEDQREQRGGDDAADHRIGHRPPEHFAGDGDHPQAGRRRRQQDRPGAVVGGFQHGFPGRLAVFLEGIDLGHQDHRVADDDADQRENPEDRHEAHRRAGRQQRRDHPDQPQRRDAGHQEQLLHALQLDHQEGRHEEQHQRHHLGDRALGLAALLHRAAHFDPVVRRQAVGEALDLRRQPGDQVGGLDLAAQRRLHRDRRLAVAAPHQRLLQLVADLGERLERDRGAAGRDDLQALQGLQRAALAILGAADDVHQVDVVAHLGHRAAGHHAVHDLRHVLGGKPELARLVLGDVDLEHLPGLVPVVDDIADVRVAVEHAGQAHGVLADLVDLRSADPVLDRPSHRRPHLQRLHVGADADVVLAQAIAQARGDALAGLQVLGDDHQLAIEVVLQLLVQRQVEADRAFADVGAPVVDVLVVLQRRFQTVHHRPGLVDAAVLRQVEVDQQFRTVGRREELVLDELHQEQRHAEQQRGEEDGRPAPAHRQVQQAVETLGDAALLLLRLVLESLRQDVHGDHRGEQHRDDPRQQQRHGDHCEQGEGVLAGGAGVEPDGHEAGHRHQGPGEHREGRRGVGVGRRVVQRVAQFEARDHHLHGDHGIVHQQAEGDDQRAEGNPLHGDVGVFHEHEDHRQHQRDRAGHHQPGAQAEADEADDEDDHHRLEQRPGETADRLLHHLGLVRHLVHADTNRQFAGDLLHARIERLAELEDIAALLHRHRQADGRLALVAEQRGRRVDEIAADAGQVGQPVETIVDPQVDRLQVLFRTEVAGGAHRDALGAGLDHAGRGHRVLRLQALHDLALVETEGGQLAGREVEVDDLVLRTDHLHLAQVFHRADVQAHFLHVVAQLAEVQAVGGEGVDAAEHVAELVVETRSLDALGEFALDVGYLLAHLVPDIRDVAGLGGVLEVDEDRRFAGSRVALHVIQRVQVLELLLDAVGDLLQGVVHRGARPAGLDDHGLDGERGILLAPQVEVGEHAHHQRYRHQVPDQGLVAQGPVRQVETALHRASSSSLIFWPGLRL

SEQ ID NO: 28585 - protein, 458 aa, Pseudomonas aeruginosa
SRWPRRTRPSSPSAPAHGRVPRRAARRRNRQAGRRTGWRAAPSATSDLWNEKRLWRLTCLPLRDPYRYRPIRPETPRIGRDSSRVPKDCDYQMEAGVPFPNLWRGSPPASGEQARAQLAAGLQQQRQETAFQFGAGDPPGMGADVQRGEHMAGGVAYRHRQRAQADFQLLVDDAPALATNLHQARQQGLGGIQGTAGLGLHLHSAEVGVQRVVVQRGEEDAAHRGAIGGQPAADVEVHRNQPLGSGRTGDVEHVVALQGGHRAGFVELFAEAVEDRLRGDRQRRRRQVGVAEGEHLRQQRVGAPVGGGVAKLHQRVQAATHGGAGYLGAVADLGDGQVPLALLERMDHRQATGQRGHEVGIAGEGLDALGRRKDGRRRQGGGVFREFAHGRSGSGHGKARRLSDTRSIIAIDRSASDCSTVGATHRPPGVMSGTHRRVLGTPLPLRQGRPSFPRDRCA

SEQ ID NO: 28586 - protein, 372 aa, Pseudomonas aeruginosa
GPAVWEGVSRSSSWLMVGSSDVLEEGLALPAQDDVEAVGQAIHRVGHAHVEPADQALRRLRVGKGADDRALGDQRVALEVHLGDQPRGDRRAADRHVDVRRAPVVGAVAPGIGPGLDGAEVIVALAVGEGPADAAEVRVERRQVAVVLVPVAPAGVGLPHLHQGVRDRLAVLVEDPAEHDDALALGQAAVVEVEQQVVVVAAEPEVGEVRPAGFRERLRDAHQRLARRARHGGLVVGGQGFGVPVSVTDDETTAFGVVHVGLLLFALSVARLVDSGMENEVLRRRRDGDSELSGPIHNHLVMLYQCNSAATSRNTALNHCAPSGNGKAALWHSPTEPPGSRIPRSSSASSPLPTSRRTASRGATQIASLRNT

SEQ ID NO: 28587 - protein, 1386 aa, Pseudomonas aeruginosa
  UNSURE (1294): Identity of amino acid at the above locations are unknown.
RRKVTPASVSSAPALLRSNRRAPRISSSSLRVLEIAGCDTATASAALAKLRWRATSRKQARWRNLMRLSRFMGRPWRRVVRAWYPTGGLGTRCGVRRGRARRFSAFLSPKGEGTGWRNDSRAGQSLPWGKKEPDGAWSGSIAPTLRPSGGPPRPGGRRGTPPGASADSELHRRRHLELPGLAHRHVQSIGTGRVVGAVEQVLHVELELHAVSAEAGVVAGEGIGHGVGGQVEGIGRVARALADVARAAAQAQAVAAEELAEFVDRRQRRGVARHVLQALALQGRVLGDFRGEPGVAADQAPAFAELAGEVQLQAARADPAGGAHAAVAGTVEFVDQHVLLANVEQRQGAAETPRHIQLGAQLPGGRLLRQDRRIDGLAGAQRGDGRVRLERARVAAVQRNLVAQAVDQAAARHPFLPVDIGVGVERPAAPGELVVDLVARAADQDPAFVQVDRVLEVQRVAAQLVGLVAVAGDHPGRRHHLAIDRVEVVEAAGLAVAQQVGAEDLALLVVHAELQVMLHPGQLQRSAQAEGGEAVAADRAVGAVHAPGQGAVGIHGHHPGLVVVVGLATVAVAEVGLPGVVELPFEIQAGQLGTALGDVEGLVQAPAARDVQRAVGTRVDGRATVERRGELAVLVAQVDRRVLAVPGQRGRHQRLATLAEVAPVILVLMIEDHPVGQSAVAQRAGGVELAAAAVAPVGVGRATQGQGVGLLQLRLLAHHVDHPARVLDAIEQGCWPLQHLDVVGGGGEIAALHRGHAVAHDRAVAVVAEAALHHRVLGTAEGVGLGDAADVAQRVVKVARALVLQRLCRDHADRLGDFQYRRIAAADRGVGRRPVALRRGGGGDRRGIEVERAAGGDRFQGQGALVDPPRAQAAALQQALQRLLRVQRTVQCRSGRLRRQLGGVEQRLPAGPAERVERLGQRRGSLAEAVANRLGGLHGGGETAEAEEQGGESTQGEARERGHGLLVSVAFLMRINRGHEHYTKRRRIYLTPQGKKILRRERFLRPNGPGPPSANHHQASEQDLLAIAEHRLQRLQRGFGIIAAEAAADQLATERVVEQENASGVVASEFVEHFRQRPPVEAQPTLAPGQRGGGVDGHGPAQLAVGEADLLAGAQHFLGGARTGAGAHRDPPLQHGDAGRPGAATDLELGAQYPRPTFAGLDHEWQRVALHPQRGGAAQQFDPPLAAVDTHAHRAAGVQAQVGAIGQLPFGDLSRRGDIVGTPVLQPVAGLPPAAQPEHRQQAGDAGQRVGPAPRVARRSARPQVGFQGIGLFDGQAARRYFRQAPERLGAGIXLGMRRPLRQPVLEGPPGRRIRRTAQAHQPGLGGLLEDGLVGRGVAIGSGHGWALLACSPAGPARLALQASRARIICFSTALWESCMAWAISA

SEQ ID NO: 28588 - protein, 392 aa, Pseudomonas aeruginosa
AGPQMIMLIINTEKPATTKRLAGRAPGYPARRPSLHQARIQAVLRQAPGLLLGHSQALLQGMEVLGDIAAEVGRVIGVHRHLHAAFEHVEDGVLAHVVEHAELGVGQRADGQRDLFVDQPPHQPLVLEGAYAVVDALDLEQVEGFPYVLGRPLLAGMGDGEEAFAAGPVEDPLELARRMPYFRAVEADGDEGVAERQRLVEGFLRLFLAEVAEEAEDQPMADAQQLLAVLQRGADAGEHHLEGNAAIGVGLRVEERLDVDDVLRLALLQVGPGQVVEVLLGAQHVGAGVVKVEEFLQVVEGVGLAQGLDVVPGQGDAVALGEGEQQLRLQGTFQVQVQFGLGQGVEPFVHGVGSRSGWSWPASLTCPGSQARGKPTSRSRARRAAQAVSPRR

SEQ ID NO: 28589 - protein, 841 aa, Pseudomonas aeruginosa
SRTTRRSTPRRPPRRATRTWISRPEAGGRANENARGAFALRASLVRRSLAGSLRRGGPDQVVEGAQRSLGALAHGDHDLLVRHRGHVAGGEDAGQRGLATGVDDDLATRRQLDAALEPLGVGQQADLHEDAFQLDRLELLGVAVLVHQAGDLLAVALHFAGQGTGDHLDVRQAVELALQHGVGAQLAVEFQQGHVGDDAGQVDGRLDARVAAADHRHALALEQRAVAVRAEAHTLGLVLLLAGHAHFAPASAGGEDQGLGLEAAAALELHLVQLAGVLRRNQLAGALQVHDVDLVVTHVLFKRPRQLRPFGLLHRDEVLDGHGVQHLAAEALGGDAGANALARGVDRRRGAGRATADHQHVEGVAGGQLLGVAGGGAGVDLGEDLFHAHAALAEDFAVEVDARHRHDLARLDLILEQRAVDGDVTDVRVEHGHQVQRLDHVRAVLAGQREVGFELEGALDALDLLDHVRVELGGVAAYLQQGQHQRGEFVAHGDTGEAQADVRTGAVQRERRFARIAAVGLQGDLVGQADDVLQQAQQLAGFVAVIEGRDDLERLADLFQVGLQLGFKIGVQHGSAPRNSGKRIPGGWDIRPARRVGWVKGGRSARDRPPERLAANAAGAVLDLADQVQGRSEGLLAFLPLGRADFARVGGGVLGGLQLAHGLADVTGDLVGVDLDGLDHAFRVDHEGTAQGQAFFRDVHAEGVGQLVGRVADQRELGLADCRGGFVPDLVREVGVGGHDVDLGTGFLELAVVVGGVFDLGRAVEGEGSRHEDQDRPLALQGLLGHLDELAVVESVDLERLDLSVDQGHQSFLSQLNGVFQIDWENLNGVRQKCPIDLGHQ

SEQ ID NO: 28590 - protein, 485 aa, Pseudomonas aeruginosa
TSASWANSMRPSSGNSPSTGSASGANPCSGLPTQAAPTNDDRPTPKMVSASPQATWLAFRYRATPANSAASSMPASTARSTPSHRLPLEKATMKPITAPNSIIPSWPRLSTPLLSQTSSPRATSSSGVPVRTMANSRLSSRSISIVVPRRFGSGQGVAQRRALAPASVQTWAVEDQHVAGEEEEQHHPLEQPGQRQWQVEAHLRGLAAEVEQRHQQAGAEDAERIETAKEGHGDRRIAVARRDLRHQLADRPGDLADAGQACQRAGEQQHEPDQALLAETDETGGAAVEAEHADLETEEVALRQHPDRRQRQQAEQCAKVHPAVLEQRRQAAGLAEQRRLREVEAIRVLQRPVHAVQQQVQRDVVEHDGGQDLVGVEARSQPGGEPGPERPGSGAGEQHPGQRPAALPVEQLDRHRAAGQGADQQLALRADVPHARLVGQCQAEGTEQDRHGLDQQLAEPIEVAERLYQHGMQGLPGIVAETGEQ

SEQ ID NO: 28591 - protein, 182 aa, Pseudomonas aeruginosa
PAIQPPTCCGEALAVATAGHSRPEHSAAMRSLSRNSSSRSSETTRIAVPASRKAISARWISAAAPTSTPQVGCAATSRRGAWRISRPRMNFCRLPPERMRAGAPAPGAFTAKRRMISSASASTLRRRTNPRFTSPCWKAVSSALSARLISGHRAVPQPLGGHEGLAGAAPRIRRQVRAGAGA

SEQ ID NO: 28592 - protein, 209 aa, Pseudomonas aeruginosa
ADALGLGARQAHFAAEQSEQLVLAVAGDPGDTEDLAAAHLQIEAGEGHAEGVRVAPVQVAHLEERRAAGNLRIFRRQALGVAHHQPRQLEIGTLRRHALSGHPSAAQHRGALAERTDLGQLVADEEDTAALFRKTAQGDEEILGLAWGQHRSRLVEDQQADVLHQAAHDLHPLALADGQPMDQPARLQRHAVALRHLANTRLQPAGPAR

SEQ ID NO: 28593 - protein, 166 aa, Pseudomonas aeruginosa
KIFLKGWCFRRWNRRRTLRGQPAKTKNPGLGRGSGGPSGESLHRLDHVFDDFLGVAEHHHSLVQVQQLVVQAGVSAGHGSLVDDHGLGLVGLEDRHAGDGRLRIVLRRRVDHVVGTEHQDHVGLAELGVDVLHLEHLLVGHFGLGQQPRSCAPACARRPGGWRTSR

SEQ ID NO: 28594 - protein, 177 aa, Pseudomonas aeruginosa
PGSCSSVAPRLRRFLLEHFQHAPGDQEATEHIDRGQGHGEGAHGLAQRGHGQGGGEHGADDDDRGNRVGHRHQRGVQGRGDVPYHVVADVHGQHEDDQVVDPVRNDIHRFHRSSGRRREACAFIVIEASRRSGSAVLAHRLAVAAHQAGGDDVVLEVHAEAFGVQGELEEIEDVARV

SEQ ID NO: 28595 - protein, 337 aa, Pseudomonas aeruginosa
RRGVRRYQRGQVAVADDGHAVPDHDLVGLGQRAVAALGGGQVDDHRARLHLRHGRLVQQRRRLAAGDQRGGDDDVRLLGALVHGLGLALHPRGRHRPRVAADAFGALALFVGLVGHVDELGAERLDLLLHRRTHVGSLDHRAQALGRGDRLQAGDAGAEDQHAGGLHGAGGGHQHRHEARVVVGGEHHRLVAGDVGLRGEHVQALRPRGTRRGLEGEGGDAALGHAGDVLVVEGVEHADQHGAAFHLGQLGGAGRDHLQHQVGAEGLGGAADRRAGGFIGTVRLAGVDAGAALDDHLVALADQLLDGFRGGGNPRLTGMGLEGDTDLHSRISCVIVE

SEQ ID NO: 28596 - protein, 996 aa, Pseudomonas aeruginosa
ASTKVTSVCQELARRPSAPSSSRRKRVPSRDGTVGWATGSPSKWAKASWVWSSRWLWSRKKITLWRTRAAWIASTVAASSSPDRVTPRISAPIRPATGRTSSRTGVARACAALLMSCSSCVGYCVGEGSEVVAQRYAERARLPHRCGVGAVDAGEGAQVVVLVEGVLQPYRGVQLAVAEIAAQTGGEVHQGVAVDLRKVGVVQRALGGGAVGVAGADVGLEAVVEAPLVFAIEIGDPFRGADHALPGEVATARRAGPGADFRRARGILERQVGDVVIGAVEVQGQAAQRQRGGLELQTTRAHAAGVGQHLHQLGQARRLVQGGGLVPVDAGPEQVGVEQQAPVEERALQAQLGVVGALRSDQQRIGAGARCAAHRQVDPAGLLAVGQAGVAEQVVAELVAEAEQRRRGEVVLAEIAGIVGAELAVAHRRADPADRRAAQRSEALDLGVLLLVGTAQAGGEVQAFGEVPGALGEQREAVGLDLAVGLRVGVVQRAEIGAEQVQVGQRSVGGEGLVAEVLPERVGAHHVFEGTAGGRGQADLLGELPVVHFHPGVVDRRDVQLLVVGRGEVPVAVGADGGQAVAAGEVPVGLQRAAALVHADVLAAVDVDLPALRIAQRRSADQRGALPETLGGAVDHHAAVARILLVVVGDPAQAEVLVRLEQQLPARALALAAVEIVVVVDVLDVAVVAGAIGREASGEGFAERPGNRAAALEVAILPAGDLDGTLGSEGRRAGADVQHPGGGVLAEQGALRTAQQLQLLDVQQVEHGHSRTSQVDVVEVDPGAAFQAVAGGVVADAAHGDARLPRMDVGDIDAGQHLLQVLHPGDALGLESLAAEHGDRRRYLLRILLAATRGDSDLAQGRIGLVRDAAGQRRRFLGGRGSIGGTGRQRTAEGEQQGQGVVGAAGRRSAERQAVVVLHRECPRFRRSRTQAAGGHAAQGSDLAKGSKGAGGRLSPGRLSGATAAGDAEGHSERRRWGGKGTVDHVQLLGSIYTYY

SEQ ID NO: 28597 - protein, 287 aa, Pseudomonas aeruginosa
NQHIPNGKCLCPIFPMPVKHHGSAPTALLHRPRRTPQFRPRGGRHGHHPAGLQPQHPGPGAGAWLSVGGPWQQGPAPDAGRPGGAATRAEPGAGVGQPDPRDRPVEQAGCRRAALRQRAGAGPATGAGRGGRLHQPPPAGADQPGRGQLGKAQPRPAPRRDRILRRRHPRLRGRPELPDAPADPAPRPVLLPSATSAAGQGQPVHQRPVQLPAGLDPDSPGHPQAAGEPQRQDRLRRQHPLREHARADPYRPPDRRHRHRQRRDPAPLPAARRTATATVAQPAAEPG

SEQ ID NO: 28598 - protein, 282 aa, Pseudomonas aeruginosa
GSHPGPAPPVRLRLHAGQPRLRPRRPCHARPATGQRRRPHRHRQPAGRRRRPSRPSLRQGRWRPQATPRRNPPEVRPDHHQRAGVRRQQQPHAGRHGLRPAAGGPLVRRAAARGRALHRRLRPRRIQGPRRHQHRLRTPRRLSGAPRRGRLPRRSMAGHGAAATVALRLALRRHLAAGLFRRQPSPAAGRGARAAGRPRRLPHPRQRPEPLRPHRHPGQLPGPGLRTGAAAHHPGLPACPWRAAVRLHGLRRRALQRVHGTRQLGGLLRLQRTGRAFLAITL

SEQ ID NO: 28599 - protein, 598 aa, Pseudomonas aeruginosa
IIKIHFFITKSSMTGRTGLSASYAARAWKIFSKCICRCLVPFFKWPFLAKKCIDSAIYIPMKNIDKTLSPAWSRPLPRLAPPPSAAFARRLGDGLLPWLLPLGLALLWWVASHRHWMSAQVLPTPELVWQSARELLAGELWSELAISLRRLAWGLLAGVASGAALGAWLGFSPRAERLVFPTFSALAQIPTLAWIPLFMLFFGIGELLKLVVLVKAVVVPVTIHTLVGVRDAQPKLREAAAVLRLPPRLLVWRLILPAALPAFLTGLRLALAQGWTSLLAVELLASSEGIGYLMVQGRQLFMLDIVFVCILIIGLVGVGMDRAIQWLDRRLLHWPQAATGEFRRRPPGRGWQRLQVWLPPLALLLLWQSASSAEWVDPAILASPLEVARATWSGALDGSLPGALFDSLKRTLGGLLLGGGLGFLGGLLLGLWRPAERFFGPTFAALRQVAIFAWVPLLTAWFGLGEPAKLTFVAIAAFFPLLLATQRGIASLPPSLGEAARVLRLGPWRRLLRLVLPGAAPSVFAGLRLALIYAWLGTIGAEYFMPSDGGIGSLMIGAQQLFRMDLIGAGMLLVGLTGALLNALGQRIEARATRWRHA

SEQ ID NO: 28600 - protein, 142 aa, Pseudomonas aeruginosa
SRNRRPMHAVSSVPSRCCRAPPTTMVSSRPTTKALRASSRVRQRSTWKTSATSTRCRRASIPPTPSATSCCNTSRSATRAGRSSPTCRSPRRTGRCKRRGRSSRSTAVATTPVQKRCARNAWPGSRSWAWWKRTSKPIRCSP

SEQ ID NO: 28601 - protein, 586 aa, Pseudomonas aeruginosa
LRRGRQAPGPDAGRGGQERRPPGKQPRRAPVPAQHPAPDPDRSRGAFPARGRRQPGGHPDRSRQRLQRRQPTQRHVEGQHGAGLRPRLHPAAARRVPRTLSRHRARLAFRQSPGRPHRRRLRRRHRRWFRTAARGGGAQPDAGPPDPPRLARLPPRQAANPPSRRPGRLRRDPHPLAADRPRALLAAAPAQRRGGADRAARTHDHERPGSHLRGRRHGPGHHPGMHAARLCLPGVRRPGAGPAGLVRRRRQHQPLLRGEQAATGQDPGLRRLRRRLLPPPGPGPALLRLPNRLAPAIRRLGKREKALAPASPEKRQFDITDWDSSFRKRRRRAWKASSARSRGTAWKPCSDPAHGVQHARVPRCFVTIPAPAAEAGPAFPTLGVVRRAACRRPRRLAGPGARLVRQPGHARPPPARPSASGSECQPAGGCRFAGLERGATGARRRNRATGRSRPADRRTAAFGDPPAQRQLPRPRRTHRYPARPVPFADRALRRARPGRRRHQLPGLRQDHPADPQPVRRGYPGNQPDLAATGGTHGPGAPEDHRDPAVDPGHGRHRQADQPARPQRCHRGRPSRRERPRLRRGRR

SEQ ID NO: 28602 - protein, 125 aa, Pseudomonas aeruginosa
GRKTMGKPILIVDDSASIRQMLSFTLKSAGYEVDEAADGKEGLGKAQSKSYSLVFTDQNMPNMDGLSLIRSLRNLAGYRSVPILMLTTESSDAMKQQGRSAGATGWLVKPFDPPKLLEVTRKVLP

SEQ ID NO: 28603 - protein, 651 aa, Pseudomonas aeruginosa
FPFPRGGGPMPQDMSQFLQVFFEETEEHLATLELLLIGLDLDRPDSETLHGIFRAAHSIKGSSGMFGFDDITAVTHELETLLDRIRCGQMHLRPDMISSFLEARDVLQRLLDAHRSGRPDPGVPLLETVERLRGWLRVPEQEAAEEGFGLFDDAPASPARETADDDAFGFFDEGPGAPERAAAPGAFGLFDEAPGAPAASEAFGLFDEAPGSPPAEERAFGLFDGAPGSPAAPSAPAQAVAATARGAVAPVRGDGESGSIRVSVEKIDSLINLVGELVITQAMLGQLGEQLDPSRHERLQHALAQLEHNTRDLQESVMSIRMLPINFIFSRFPRLVRDTATRLGKQVELHLHGEHTELDKSVIEKLSDPLTHIVRNSIDHGIETPAERLAAGKPASGTVKLAASHQGGSVVVEVSDDGRGLSRPRILAKARERNLPVHDGMSDAEVWQLVFMPGFSTAETVTELSGRGVGMDVVKRNIGAMGGRIDIDSAPGMGTRIGIRLPLTLAILDGLIVAVEAVNYVIPLTYIVESLQARSDDVRGLGGEDNAMIRVRGEYLPLFSLHELLRIGGEAPAPEQGIVVILESEGRSFALQVDELVGQQQVVIKSLEQNFRRVEGIAGATIMGDGSVALILDVDALPRLAAREDTADERH

SEQ ID NO: 28604 - protein, 684 aa, Pseudomonas aeruginosa
AGDIEMGLFNAHAVAQQRADRIATLLQSFADGQLDTAVGEAPAPGYERLYDSLRALQRQLREQRAELQQVESLEAGLAEMSRQHEAGWIDQTIPAERLEGRAARIAKGVNELVAAHIAVKMKVVSVVTAYGQGNFEPLMDRLPGKKAQITEAIDGVRERLRGAAEATSAQLATAAYNARIKSALDNVSANVMIADNDLNIIYMNRTVSEMLGRAEADIRKQLPNFDAGRLMGANIDVFHKNPAHQRHLLANLTGVHKAELNLGGRRFSLDVVPVFNDANERLGSAVQWTDRTEEHRAEQEVSQLVQAAAAGDFSKRVEEAGKEGFFLRLAKDLNSLVDTADRGLRDVSRMLGALAQGDLTQRIEADYQGTFGQLKDFSNDTAQSLSRMLGQIREAADTINTAASEIASGNAELSARTEQQASSLEETASSMEELTSTVKLNAENARQANSLAANASEVATQGGTVVQKVVSTMSSINESARKIADIIGVIDGIAFQTNILALNAAVEAARAGEQGRGFAVVAGEVRTLAQRSAAAAKEIKTLISDSVDKVENGNTLVAQAGQTMSDIVVAIRRVTDIMSEIAAASAEQSTGIEEVNSAVSQMDDMTQQNAALVEEAAAAAEAMQEQAGLLNQSVAVFRLDTPPSVVQLASARPSAPRPSAPAPLARSGMARASKARKEDGWEEF

SEQ ID NO: 28605 - protein, 303 aa, Pseudomonas aeruginosa
DHAAPPPGGGRQALRVDQGNPTPMPTSTPSPVFGNQEFHYTREDFQQVRERLYRLTGISLAESKAQLVYSRLSRRLRLLRLGSFAEYFTHLDREPGEQQLFVNALTTNLTAFFRERHHFPLLADLARRQLQRHRPLRIWSAAASTGEEPYSIAITLVEALGSFDPPVKIVASDIDTGVLDCARQGVYPLERLEQMPAPLKKRFFLRGTGPNAGKARVVEELRQLVEFRQINLLEADWSIAGELDAIFCRNVMIYFDKPTQTRLLERMVALLRPEGLFFAGHSENFVHASHLVRSVGQTVYSPA

SEQ ID NO: 28606 - protein, 384 aa, Pseudomonas aeruginosa
RTTPCCSVNATTAAVSTATRTAAPSTCSDSPGEPAMPISVLVVDDSALIRSLLKEIIQADPELRLVGCAPDAFVARDLIKQHAPDVISLDVEMPRMDGLTFLDKLMKARPTPVLMISSLTERGSEATLRALELGAVDFIAKPRLGIAEGMQAYAEEIRAKLKTVARARLRRRAADAPAPPESAAPLLSTEKIIALGASTGGTEALKEVLLGLPAHSPGVVITQHMPPGFTRSFAERLDRLTRLSVSEARDGDRILPGHALVAPGDHHMEVQRSGANYVVRLNRQAQVNGHRPAVDVMFESLARCAGRNLLAGLLTGMGKDGARGLLAIRQAGGYTLAQDEATCVVYGMPREAVELGAAEDVLPLERIAAALLQQAARRGSGNRL

SEQ ID NO: 28607 - protein, 860 aa, Pseudomonas aeruginosa
FRPRAGRETDRDSHGGELGVARQIGGGAVAGLCPGTGPGGAAGLARDGRHPYALRPGLREELHPAAPAEDPRPGLPRTGVVAPFRRIGGDPRLAAEGRRPGAPRAVLPRGRGLPRRLPRPRLLHHRQRLPPLLLQRRPPTLQRTAALHPGGRRPGRRLVLQYPAQQRRLQHQRQCRQQAEPDQGLVQPGDPRPGPAHRPGRQRPGPERLPRRLHHRPRAGRDADDRRRRRRHPGPPGPPPDRLQLRRRRRQRTPPGVRPARPAGTARRPARGHAPGPRQGRLGALPVGRPRRPPATLRRGLHSPTALVRAHRRRPARRPGPRQPLALAAGGHVPAVAGGPAAGLRLCRRAPAVAPPAQPQALGQGDRRRALRHAAAAGAPGRDRLAVEGLRQHGRPGPPAHRRAGRQGPGAHPGAGGSQPRDGRRAEEDRRQPRLCQPDPARDPPRPPAQRHPRRASLHPVETARRGRRRLLRVPRAGRRLPDRRGRLRRSRRARRADDHARPRRHRPRHRGGGQPRPGGDPRRDRPGDAQHAQPGADPPGAGHQHGCRAGLGRPPAPPAGLRRGEDLAVRQRRRGGPGTQGRAPGDRRQAPWRLPQHRGTAGAGLDLLPEHRRFPRPGRRRTRLRLRQPALRRHAPRPRAAAAPRAGRGLRGDARRVPGRAPATRRHHHPVLPIRLGAPMETLDLLAMRESYTRQRILLCFNGPISRSLIEEIGHALRNYLHAEQAKPSEAMDVFAVYIEMTQNIRHYANLKGYGEHEAAATVAIARNEDGHYVVSAGNLVERDDGQSLVRSIQAIANLDKAALKAAYKEQLRRPRDSGCASGAGLGLLDIARKSSEPLAASLKEQPDGRAFFSLRAVI

SEQ ID NO: 28608 - protein, 511 aa, Pseudomonas aeruginosa
SRGGRTPPRPRRGSPPRSSGGCARPACRGRPGRGRALSGSCAGFHRRDPRVDTPARPRDTSQARKNLQTPVSTQRLAPARQGAALRAGLRRFGNALLGQQQVEQDGGDAAAGDRRVEQGLHHRRHLVEQGRLRGHAEADAERGGDDQHAAAVHRGLAENADAGGGDAAEHHQGGAAEYRLGDLLEDRADPGEQAERQQHAADIDPDVPAGHPGELDHPVVLREGGVREGAEGGCQQATDAVAEHPAAQPLQVRRSLQGLPREHAVGGQIADRLDAADQVDQRHRQEGHPVEGEAEAERLRQADQRQLGQRPRNEQAGRPGRQGTQRQADDDGGQAQPGQARAVQQDDAQQHQRAQREIGRCAEVRGPGSAAEVGDADLDQADADQGDDDAGDQRRDHPAKMAEETTEDDLHEGAEEAHAEDHREDLLGTAAALLHQHPGGQHGAEEGEAGALQADHPGADAERPARLDQGAGAGNHQRHADQVWQVLAEAEQRADHQRRSDDADEAGQHVL

SEQ ID NO: 28609 - protein, 496 aa, Pseudomonas aeruginosa
WANLSERSGLAMDSKNEAKTARALRRVSCGEGNACFFSVLDKGGEMPPTSLRRQKPDPKDSFCLALVRGREGRARLWVGSAKKTGYTKTICDKKNQQTFVHKTVRGLSTHHRPGVRARSGADDARDGGRNSSPNGVFRRVSGRPDVNSPGPGRLRWHDIQKALSMLRSGARSSTGRLAAYACRVFLLRHPQGGYALGIIRRTGLPASPTWVPSPHRDLRIGARLGAATEHAAGRVAQDDLAAPVAGRVVGDLHLVPTLRQLRRQRARRGMFDADAQPAQPLPARRVEGSLGVEAEVHQVHHHLHVALRLHIGAHHAERAERHAVLAEETGNDGVEGLLARLQAIHVVRIEAELGAAVLQGDAGAGHHHAGAEAVVVALDERDQVALLVATGQVHRAARPRLAGAGIERALADQRTAAGGVVLVQQFLDRDPHRLRLADVVQPVDVRQLHRLQLAMPGPRAVALAEFEALEDVQGHQGDQALAARRNLPDVIATVVQ

SEQ ID NO: 28610 - protein, 460 aa, Pseudomonas aeruginosa
AEGDEVVVVLQLPGLLVGTVEVGILLRVVEEDAVALVDVVERRVAVDLLQHRGDGVLPVADREMQAVGVVVDPAEQRVAAVDGLVVVRAGVQRPVVVDLVGVVDVGVVLLPDVLQFGGVQAAGEALDAAPGAAQPAEMMAVAVARQFAVVRAEATVATLVVVLGETDLASREGQVLETVVGQAHTAEGLRQHARLAAGDHRVAEELVAQLQLGVEGADLQRRPATGELIGRLAGFVAFLARRGDRQDAGAAGTAAAVELQPEHAVGVDAEADHAGRVAGLKGGDEALRPFLAVVPGSVPAVMVEVVVAGQQLEAGAFDEAFFGFPLIGPGGGRGAQRQRHRRQGEQIPHCGCSFLQRGEIRQGRKACCGVVPGDASAGVARAIAPMGRPAGRNPKKKAAGISGLEKTSNRSNQSSASGSLASVFPDTGNRLERSRTLLLKVSSTHQALGFPRPALAWRDR

SEQ ID NO: 28611 - protein, 163 aa, Pseudomonas aeruginosa
ALQWSMSSSSFSVVSRRSITALVSWMLLFCGRLRSTSSSGRSEDGKNWCWTNFIRNSDTPNSSAVRKMVVQRRRIARCSRLSKRSAMRPFFCSDLCLRVFGRMCTAITGANSTATIHDSSSATAITANRVKVYSPAELALSPMGTKPATVTRVPVSIGKAVEV

SEQ ID NO: 28612 - protein, 149 aa, Pseudomonas aeruginosa
VAESCSESPSSRRVIIISTVIMASSTSRPRAMISAPRETRCMVMSVYSMNTKTIASTSGIEQATTSPARRPRLTKLTMRTITTASNSARVKPPTAFFTTWAWFDTWCTPTPTGSSPVISCMRALSASPNSRILPPSFIATARPMAGSPL

SEQ ID NO: 28613 - protein, 508 aa, Pseudomonas aeruginosa
RCGRTVLPGAGHWPGRRSTVPRRWPGRPGWRATGSAGRWGRGSPAARPCRRSHRRRTGARRSVRWCGSRARSRSAPGCYRRSDRGRRSSGSSRSPSAPAAAVPAAARRRSRRGAGRSRTGRRGKTASWLASAHGVAAGGALGRLRRLGHLDHLARMEQLAAHRDHRLARLQATVDDHLLAGVACHPHRLQTRLALLVEQPDRRLLADLGQRRPGQHHAVLGRRGDAGVDHAAEAHFRRHRVEADLDLQRTAALVHRRGDLADLAAGGDFRLAEQADGDPLAVDIVAEQRLVDVEHRVALAVAGQGEDRHGGLHHLADLGLAGSDDPGVGGTQLGIGKQVAGVGQLRLGGLQRTLRAAHRGQRLVVLALAGVALGQQRLLPLVVEVGELRLRLLRGDRRLGVLHVAALVLRVEPRQHLASRDVVADIDQALDDLAADTERLVGLYPCLDVAGDRGGRGELGHLHRLRQHTDVFLGGRLGAATDKQAGAQDGGQRHPRPATFGMKSASGV

SEQ ID NO: 28614 - protein, 197 aa, Pseudomonas aeruginosa
AGSSEFTVTFTPRSSMSRMVCWLMSSNTQSLVLDSGQTVSGICSSISRRISRSSSKARTPWSMRSTLSRSRASHMYSGGPSSPAWATVRKPSLRARSKTRWNLLGGCPTSELSRPTAMKASRNGSAWSRVFCACSSLRWRRKLRISPWRMPSSFSPSCSAARMPASTTSKGMPRSVWVCGSKNGSTWTTFCALHFCR

SEQ ID NO: 28615 - protein, 176 aa, Pseudomonas aeruginosa
QGTHAMTAIYLAGPDVFRPDAEAHGETLKALCAEFGFVGLYPLDHALPADIREPAAQAAWIYRANVGLIERADCVLANLEPFRGSEPDSGTAFEVGYALALGKPVYAYLSDAGAYTERLARLAPEWLGEHPGEDRDGWQLEGFGLPLNLMLAVPSRLVAGGPREALRRFAEELERA

SEQ ID NO: 28616 - protein, 259 aa, Pseudomonas aeruginosa
LLADSRRPARRLPAIILDNNGPIREAGLQEASDEPIQGFQQPSYLPAPGSPAAARRRPARQPAGCTRRGQAAETLSGRSRCVPRRRRRPRRSTQGTVRTLRFRGPLPAGQRAAETARRAARTGGLDLPRQHRPDRTRRRGAGQPELLPRRRAGQRHRLRGRLCHRPRQAGLWLRRRRRQLRRANPPARPGADRRGSDPRPRRHDPGRVRPAAQPDAVGARQDRRRRRRAGPAPTRQPAPRLTRRRPYGERLRAGGRYAR

SEQ ID NO: 28617 - protein, 557 aa, Pseudomonas aeruginosa
  UNSURE (262),(300): Identity of amino acid at the above locations are unknown.
SASAAMAAPPFRQRTEEGWRASAGRVLAEGCKSDCMGGRRVTWGGSWWGMPQSSQLRATRRPMRTDRGSLAPPLSAPASPGDQGARRLAVAGDQGGQVEPFHGTVDHSPGAADHYPVGTVGSAQQQRRERVVATREAQLVELEQGQVGLLAGGQLADVAAPEQACRATGCPAQGEFRGDPLGAVAQALQVQGLARLEDHVRGVVGSRAIDSQADRRAGRLQLHGRADARGQAHVRTRAMADTGARLAEPADLLGVEVDAVGXPGARAEPADAIQVVHGAQAEALQAEVFLVEGLRQVGVXAYLVARRQFGAGAHDLRSHRERRAGRQGDLHPGTVSALVVAGDQSLAVGEDGLGLLHRLLRRQAAVLLAEAHRAAGEHGAHAQFLDHPGLHVDGLFEAAGKQVVVVGGSGTPGQQQLGQRHLGGQFEFLRGQPRPDRVEGLQPGEQRLVDHRRPGAGEGLVEVVMGVDQPRQHHVPAGVELAGAGLRGLLAGAEQLDDAAVFDDQAAGGVETVGGEDGEGTANPGAGHVRTFVGSAGRRERCRPSVDESQLSVHPVC

SEQ ID NO: 28618 - protein, 328 aa, Pseudomonas aeruginosa
  UNSURE (64): Identity of amino acid at the above locations are unknown.
KRRTEGVPHERRTHCQSPLPRATRRAAGQAGPASRPPRPAQAGDPPPASGQPGAEGPRGDPGNXPEAGGPAGRQCAPRQQRGQHLGEPAGELSLSHADAPQRVREGQARPADRTAQGAELGEGDRPARGGPVRRPRRRRQGRHHQALHGTPEPARRADRSLGETVLPGAGPVVFPALHPTSAHRRRDGLLRPLLVQPRRRRAGHGLLFAAAIPGVHAPGAGAGAHAHQQRHPAVQVLVLGEPRGTTAALHLAPRRSAQALEAVAHRHQVSGQVGRLHRRQAGDVLPYRHRRRAVDGHQVRRQEARATQLHPPLPALAGLPGQGPAHRP

SEQ ID NO: 28619 - protein, 186 aa, Pseudomonas aeruginosa
ARPVAGGAGLAGDRGRREGLRRGGRRAGPREPGYPGLRRAVAPTKTPGALSRSGRPWFDGRWPGHSGAEVRIRWSKALSEALAPSPTAITICLYGTVVTSPAAKMPGSEVSPRASTMISPRGDSSTLPLSHSVLGSRPICTKMPSSSIDLNSSELRSLYTRPVTFWPSPFTSLVRALVITSTFGRL

SEQ ID NO: 28620 - protein, 267 aa, Pseudomonas aeruginosa
LKQLIEEPALVSARPSTAGPGKPGHTAGCAGHRGRAGPAPGWSPHRAASPAGWPESTARSPGPPGAGCWPGRTTRHRAARGTPANWRRPPAPGRSSRVRRSCSPPTSACRPATGRHRPGRPWRRRRAPPGCARAAPAGPSRWPRRGSRRPPGEPARRGCAGASRRPRRTAPGSGRPARPGRTACARAAATRPAPAAPAGRTLAAACRPRRRRRTTTGRRRRWSAPARRPPGWRSGTGRPRRTAPPAACRRAPRGARRATGCRWRRRP

SEQ ID NO: 28621 - protein, 234 aa, Pseudomonas aeruginosa
AAHCPPGSSPATAPCPSRSAGTKAWPARRRASGARCAPAQAPRRMRSAWARGRRTSPLSRASNSSWPLPATPAIPRISPLRTSRSRPAKDTPKGSGLRQCRSRTWRKGAPPVTFGYSAARPSASPTISRASSRSEHCAGTHCPATRPPRSTVARWQSARTSASLWLMKRTLQPSSARRRRVTKRSSASRGVSTEVGSSRISRRMSCIRQRTISTRWRSPMDSPWTSRRGSSGMP

SEQ ID NO: 28622 - protein, 176 aa, Pseudomonas aeruginosa
GAGGAGGAAGCGGAGGAGSTAFGAGLGRGCGLGLGFGFGTGFGGGGFTAFSSTTGGGGSSTTGGNGSGGGGSTTGGAGAVNSMVIGGTCGGTSGSAGVLCWLSQWITAPCRVRANRTSRIVSRRLSTRPCAGLWRTRCNAWRTGRPSATRSPPGVSRQGCVRASTGWGVAMKNSLH

SEQ ID NO: 28623 - protein, 461 aa, Pseudomonas aeruginosa
GTSASASSHVHVPRHAPGDRVDGELHGDPAMGQLLRQFHQRVLGAGHRQAVAGDDDHAVGVGQQERGIVGRTGLHRTLLLGARRAAGVGFGAEAAEDDVEERAVHRLAHDVGEDRARGADQRAGDDQHRVVQREADTRRGPAGIGVEHRHHHRHVGAADGDDDQHAEDEGQRQHHGEGGEVAGEHEHQAQAEGCQAEHQVQQVLPGELHRGALEQAELVLAGELAEGDHRTGEGDGADGRAEEQLQAVAGGNGVAQVRDDPQRLRLDHRCDGDEHRGQADHAVHEGDQLGHLGHLDALGHDRAGGTADQQADDDVADAGGGDLRAQLEHQADGGGHGDGHADHAEEVAAARGGRVRQAFQGLDEADRGDEVQEGDQVHAHQWPPAFGAFFLNISSMRRVTRKPPNTLTAARATARVPMALPSGVTVRAAASMAPTMTIAEIALVTAISGVCKAGVTFHTTW

SEQ ID NO: 28624 - protein, 378 aa, Pseudomonas aeruginosa
ADALQAPPLAGREGVARMQHGLVVPPDDVAHRPGVAVAQFRARQMFAQATDQRLAPRGVVAGNLHLGVGAEEQYAPAAFRVGAYQRVLAALDRFDVRRAVGGETAAVAALAQADEGVVVDQAQAIDLAPGRLVEALVGARQVGEARLAATGRHLQCVEERAGGRHRRPLVVDVCRQGEVAQFAVAGVGHLDDVRHLAVATRGQHRDVRRRLEHRAEQGGEAQVLLIVEVLLAEHQDVVLAQRLLERQDLLRRQRPARVEATDFGAQRRLQGGDAECLGDLGFGLPGGGGLAHVRGPRGFVLPVVALPGEERAGSVMPSGSSGCVARRCLPARRRRGSPGAPRAAGRRSRRSRSAGSRGCPRSPRRRPASASARCSPGA

SEQ ID NO: 28625 - protein, 202 aa, Pseudomonas aeruginosa
TPCGSSPTAPPRRWARPRRSRTRCCAPPRAGRPARAAPPAGRRRRSPCWPRRCRRRTPGPPRCAGSRPSGRPRRRSRRYARSWPGGLRRHPARGGSGCLRGTARWGGRPVRRASGRRPPGSGRRDGSGPGRRSPCGVPGRPGSPRRWRRPVRRTGSRRESPRRSVRRPAGRRAVPAWRGLVLHCSCHVPHAWGTAWVKAQKS

SEQ ID NO: 28626 - protein, 307 aa, Pseudomonas aeruginosa
SIMDLRQLRYFIALAEHRSFVRAADAMGITQPAFSRSIQGLEQELGCQLVDRGSKDLRPTPEGQVVLQHALSLVQGSANLIHEIAQLNKLDAGELRFGSGPAPAQQLVPDAVADFINRHPRVQISLDVDNWEKLSRALLREEIEFFVADIRDFEADPNFQTRPLTPRRGQFFCRPQHPLLGKDSLSTNDLFNYPLASTLIPPGIRKLLANLSGKIDFAANIRCENMHALIRIVRQTDAIGIASDETLRPYLQRGELQPLQWRNLPQNLDSLSARCGIISRSGYRLSAAAKAMIETLVELDQAQHAAA

SEQ ID NO: 28627 - protein, 452 aa, Pseudomonas aeruginosa
MQNLRRAVFAGLVAGTLSEGAAATAGDGGFVEDSELQFLARTYYFNRDYRDSPNNAGRNRFKPRSERNGYREEATQGLRLQFASGYTPGSLGFGLDAHAMLGLQLDSGGGRTGTGNLPVGADGHPDHRYGKVGGALRLRHGETRLKYGQTTTSAPVFAASSNRTLAGMAYGLLLEDRSFDGLLLEGGRFTAASGPGESKVRGDISTVYGRLGAYPVRLDAVGFLGGQWQATERLQLSLYASRFDDIWQQAYFGASHRQPLGGERALRVDLDAYRTRDSGQSRFGRIDTLASSLALGYEQGPQRITLAYQRVHGEQPFDYMAFGDGRSSASMVLANSVGYSDFNGPGERSWQLRYDLDLGALGLPGLSLHALHARGRAGASASSAAESIYAGLYGRDGRHRENDLGFAYRVKAGPLAGLALRASQAWHRGNASYLDGDIDETRLVVDYSRSIW

SEQ ID NO: 28628 - protein, 340 aa, Pseudomonas aeruginosa
STAGSAAPASAAGAGRPGPAGRTPAPPARWRGTPRPPCQWTGRGGPATTAAGRESRRWPPGTPARGYPPARRNGSRRNRSRCRSGSAAPPRRTVRSQPHLEAQFQLRPQAAVAVEVEPAHLAQFVGAEGSAPVQHRSVVEHQDFPRLELDPQLAGRILERRHQFGEGLHRHRMLDHLGRPVVLPELDAQRLAVQAEHRLGAALVLAHDGQGVAAQQAEMLGRHAPAQALEGQSGAGQQGLPALPGVAHALQAAQLLRGVEESAVGVQLVLQRRGAEVAADIPRIADRHDAVGVGARVGGGAAEQLLEREKFLPVFALFAAQQQETKLVEGPDDRRLFLAG

SEQ ID NO: 28629 - protein, 439 aa, Pseudomonas aeruginosa
PADYPRETFMTRYTQNPRPTAGYFARSSHWLGRCKNLETYYKLLRNGAASAVPGSASLRRLRHGLGLRQLAGRLQQFRRGPLLGAEFATDQAETLGRLDRSIQPAKEIGVQARRQGVAQLAATVLALQDHHRVAGLLRHQFDVSVAVLLAGQPVLGLQLHLEQPLGDVRMGIDEGSGADQQRLQGAGAVQVAGAQRNFREPAVAQGEQSGQAPGGIDLPGCEGGQGGAEIEVDHLQVLLAETDAGQGIVERQLAGGATKDAYALALEILQGLDPGARLHAEIVVDPSRGSGQQAAVQASGLADDRRQVAEVGEVHLAVGERFVDHRAGALEEAPFHRDAVVGELLLQQLAGVEHVDHAAARVRTAGADVRHRDADFLRRSGARQRHVGTEQAGEHRRGEQTEQGRRKRFHGAAPWNGKRGIPAGSGCAASYAQRRLENK

SEQ ID NO: 28630 - protein, 614 aa, Pseudomonas aeruginosa
SAPACSWSASPAPCSMPSANASKRAPRAGDTHERIHRARHGHPAGQLPPGAQALRRGRPATGSDPAVRPGDRRGRVHRHRRRQWLRQVDPAAPADRPGPRLRRRDPRRRPANRRHRRRTRHRVPGAPPVPLADGAAERRPRPGQRSPWRNRQGGADRRIHPPGRPARLRACLPAPVVRRHGPARGDRPWPGGQPAPAAARRAVQRPRRTDPPAVAGRVAGDPPAHPYHHPAGHPRRRGGALPGRPGGGDGAASGADQAGGRGGPGASARARWLRLPAPARSAAARTDRRRRVRRAAAATGGKPALRIPRLLKSPLPWPFPPAGRAGARAPPSPPIQTRPAHEQTPQLPGDRRRRPGLLRYRRLRRRDRHAEPRRPGHRRPAPDRLPHRLDLLADPLDAAHRHRPPHRRDRHHGRGADPGTGRQAGLRRASQRARGGAAGAAPRGRLPDPHGRQVAPRSEAGTDAPCTRFRAFLLAAAGRRQPLWFRAALRRKHSAHPQGYASALRGRRALPRHAAGGLLFLRRLRRQAAAIPQGARPEPAVLRLPAVLRAALAAASAAGDRREVPRSLRRRSRSAAPGTPGPAQGAGPGGSGRRSPSGARPDPRVGGPGGRGTG

SEQ ID NO: 28631 - protein, 228 aa, Pseudomonas aeruginosa
VGAGDGGLCGDGRAHGLEHRQGRGLPAPAGRAGQHLRPVHVRQRRRRRPAGGVPEIRPGPAGLSRPALRQQPGKHRPRQFLRLVWPALGPGGHRTIAPVQGVHNPGRDSRASAGALPAAKPAGCDQPCLRHGDGRHPDHPRPRRCPPPRQALARPRDRRAARQVLAGLAFRRDRGGPRREHRDRLGAVRHACDPPGRLEGGVPAGPGGPGHLAALRPGPRPGRDPRPR

SEQ ID NO: 28632 - protein, 325 aa, Pseudomonas aeruginosa
SLYSADTNGLCGPFPMETLSNIQCFVRSAEAGSFAEAARRLGLTPAGVGKNVARLESNLGVRLFQRSTRRLTLTEAGERFLQEVGGSLEGIQTALANVSSVGNQPSGTLKVSMGLAFGRDYILPLLGEFLERYPDIVPDWHFDNRQVDLIGEGFDAAIGGGFELPPGVVARNLTPGHLILLASPAYLRDKPPIRHPGDLGGFDGIRIRSPQTGRVRSWPLRRRNGEEAPIELRERMTMSDPEATCEVAAMGLGITLVCMQHAYAYLESGALVRVLRDWYVDAGNTSLYYAANKLLPAKTRVFVDFVVDYFRRQDLARRFSAFPTG

SEQ ID NO: 28633 - protein, 454 aa, Pseudomonas aeruginosa
RQPSVASANGKRPWHRPRRKNGSLTLPIGTLVLENAADELGRRLPHGPEGPPGSPAPIRHMECSMRESLGVSLPSRPLLLKLGLLSLPWALCAGLHAVGLGVWLVLALGWFASLAMLVLLLRAPRQAVANANPQADAASPAWSAAQRALADETAQLDGHARQIDELLHSAIRQLSDSFHGLAERIDTQRGLSHSLIERYDGRGQVDEGINFQDFVRTTQQTLSLFVEATLETSRTSQQLVERMDQVRLKITEILQSTQDMDAIAKQTNLLALNAAIEAARAGESGRGFAVVADEVRALSTRSTEFSAAIRKHVDVVHHEIQDAESAISQLADKDMSFALDSKHKIQGMLDDLEAMNRHTLKVIHELDRLSLEVGQGVDAAVTALQFQDMGSQLLGQMRKHHARLGAFALGLGALEARPRQEWPERVAREVEELRRPLPSPVSQNSVNVGEVELF

SEQ ID NO: 28634 - protein, 173 aa, Pseudomonas aeruginosa
SVPSSKPATCCSACSTPIAAAVPTPGCRCWRRSSACAAGCGCRNRKRRRKASACSTTRPPVPPGKPRTTMPSASSTKARALRNERPRRERSGSSTRRPAHRPRAKRSASSMRHRVPHRRRNAPSACSTAPPAAPPRPVRPRKPSPRRPGAQSRQCVATASPARSGSAWKRSTA

SEQ ID NO: 28635 - protein, 178 aa, Pseudomonas aeruginosa
FSTSMRCHAWRRGRTPPMNGTEASQANGPAQEYLTFTLGREEYAIDILRVQEIRGYDQVTAIANAPPFIKGVINLRGAIVPIVDLRIKFHLAEVTYDPFTVVIILNIGRRIVGVVVDSVSDVIALGGDAIRPPPEFGASFDTEYLLGLATAGERMLILVDIERLMTSREMALVDEAAA

SEQ ID NO: 28636 - protein, 696 aa, Pseudomonas aeruginosa
CTSAQLALSPKVRHTLSIHDFGRGPGEKLIGIAMAANWGLRGKSVVALLLACALALVPAVLLGWRAMDDIRTHFGLAYAKNFTLLHRQKILAPVSRELALSRRFAESVVTRDWLLKEDDPARRALFFREAEGYRGDFRDHAYFIIASGSHHYYFNDGRQPYSERPRYTLEAGDPEDAWYFNTLRNSAAYNINVNVDSKLNLTKVWFNLVIRDQGRPIGLAGSGLDLSGFLDDFIIAREPGVTPMIVGDDGAIQAHPDRRLIAYSSAAGGASERHRVFDLLDQPEQRDALREAMRLARAKAGSVHCLWAGLDGRQQLFAVAYIPQLRWYVLTAVDLHAAQVLDNRWLWPLAGTFLLLLVALLLGFAYAVERLLLRPLRSLKRSAKAIAAGRYDTPLPLARQDEIGSLSKAFASMADQVRRHTAELEDKVQERTQALEEANREMAAAQKKIGDSLDYASLIQRAILPDRQLSATLGEHHFILWKPRDVVGGDFYVYREQADGYLIGVVDCAGHGVPGALMTMLARAAIDHAIEAVGSRDPAAILGETDQAMRSMLSQEQIPQALATNMDAGLVWVDRRRRQLAFAGAKISLYASDGEEVQELKGARRAIGDKRRGDYRNIEVPLAPGWTFYLSTDGFLDQAGGEHGFGFGSRRFADMLRDHARQPLPEQAEAFVATLAEYQGEHPQRDDITILSFRFD

SEQ ID NO: 28637 - protein, 246 aa, Pseudomonas aeruginosa
TVRPGDRLGRALPRRRAAAAGTGPAPAVPEHQFDQGHDGHPRPARRGPPGRSPGQPALALRPAQRTGRRAGRGVPRGLQLPLRHPGPRRVADDEPRTRTGRLDRRPAGRSAVPRASAAPGAGPPAPAIAGATGAAGAHRPDLRRFPVDGAGAEPVAVRALPQAAAAPGKGGADLRPLPADDARPQPGAEGSLDPRPTDRPAQPTHAAGAPQGGERTLPAPRPELRAGNARCGLLQAGQRYLGPRQR

SEQ ID NO: 28638 - protein, 136 aa, Pseudomonas aeruginosa
PGAGGNRPGHGVRATRIRPLRTLGRRGIPPAAAADPPAGRRPGTRAGARQRTDPGGTRRHRGAERHRQRRRYRTPHRRNLFADRQSRRRRTARRQAQRPRQMRVRRAPAASCPFPPGSSALSLLRRPAAAAAPGLG

SEQ ID NO: 28639 - protein, 421 aa, Pseudomonas aeruginosa
TPAPRPRRPPARRWCGSGSCGFPRGIRRGLAGCSASRSGRRRGQSAALEDDPHQVVGGGGEVLPGHALAAGDQADLAGEVGVVLGAAPEQEDQVHGIHRVHPAGGDPGLEYRGATAEPAAVVLVEMRGEALSAADDLHGEDPRGQRVAAGELHLGADVAGQRLGRIVVDAEGVEGTVPEFEDVAQHRRVEAQLVAEVVVQVGLGQADVLRDGVHAGALEAVAGELLLGRGEDRLLVLLADAPGRLVAGGRVVGGHCQGHAQVSIGVIPALIPQPGRGTQARRGKICKRPYQPSGLRQRARAPPFALACAASATRSSGSSRLSRMAVMPPLVIAESNRVFTTAGIWSSRVGCAATPRPTPNEAAMISTLRRSIAVWPRMRMPAAATLPNITRVAPPSTGLGICWRIAPTQGNRPSASNTPPI

SEQ ID NO: 28640 - protein, 248 aa, Pseudomonas aeruginosa
ISATGRKAIQSKAKPKRNGCGRLTSGSSGNARGTNRPVAQAARVPSARPMTMAARRSQGRRERFSRTMLSSTSAPSARLAGAPKSVAPAPPPRSVMPTLIRLTPIRVMTMPVTSGVITRRRWPRKRLRTICTKAPKKHTPKIIARISSGPPPRCFTSIPAASTAPRKAKLVPCRQIIPAPMPNGRRAWIRVPAPETISAMLIRYGRCSPRPSSEPITSGGVTMPTKLASTCCSAARKAGSGRGRSSRP

SEQ ID NO: 28641 - protein, 295 aa, Pseudomonas aeruginosa
PCQTLPTSDTTPSHDDERTACGTAPPDSHPRPPATAGLRARRKPARRLLDLAPPARLGTAFLRHQRRARRTYRRGQLLRPAAAGDLDSGAAGTRGGHLHPRRDAQPVHPWRRLRLGADALPGAGGDAAGARADQEFLRVAGGLPGGRQRRIAAGAGAAGPVAAAAGGRLLPADAARAAPAAAVPGTDRRTDPEPDHGRLGAAPGHLGKDPVAPVPARDRDELPALAPTPAPARLAQRAGGRRQRHRRRPGQRLRLDLGLHRRLQGTLRLHSRRTVPPALSPAKGPARGAQNTSMG

SEQ ID NO: 28642 - protein, 414 aa, Pseudomonas aeruginosa
NRPSSRILVEFDLLAGLEAVDSGADHPVAVGQALSDHHLAFVAAEHLYLAQGHAGLFPIDDPDLGLAVALQQHAGRQHAAHATGAAQLDLDGRTEAKRLRRLRQAQAHATGAGRGVGLRTQLADAAGGPGLRVELGADQEARVGRQALGDLGGQVEDCLAHFGPGQGDHRLAGADHLPGLGVPGGDDAVEIGHQARVGKLVPGLLHRRFGLVEAGLAGLQAGPRIVQARLGSNAAGEQFFLAPGIGLGVDQLCLGAGQVALAGAQLVLLVGGVEGRQQRALADEVTDVEQARGDPSVGAEAEHALVARLDATGEATEVVVLQGLHGHRQHRPRRCRRRLVAAAGEEQGEAEQAGEGKRLHGWPPPTASRLAVLWVGCGGWATSTTWPGWSSWPPTVTTVWPASRPPSMTTFSLA

SEQ ID NO: 28643 - protein, 292 aa, Pseudomonas aeruginosa
YCRGYPSPSGSNVRYPSAGSGYALAAPARAPFLPARSMRLEVKEHRLVVALDADVETVGELSVHFAALREQGVATRRLLDQVEHRTGGVGLGLVIEVQPGLQVDVDAAGEQRDVDVRRHRHALGVTHHPRLDRVQGPLAGIEGGGGAAEAVERSLRIVALLVAAFAVGLPELQERVAHQVAVAVVDVAEQEDVLARRVFAGHAVPDLQVTGRVAGGGQRQADVDIGTGGLGRGFPQQFVAHGRLLRRSRRRSCAARAGRCRSGRPGNPSGWPCSCRAGRSGSAPPPGRQGCG

SEQ ID NO: 28644 - protein, 444 aa, Pseudomonas aeruginosa
PFGYALSVQLGGHLAQHRAEPLRPQRQRQGRVVAQPDRTARFADTQVQLGQLAVADVQAHGIARRHPDRLAAQHIAAAEGRREGFQALSGERDAPLHEQAVGVAADGGAGQRQHQWEFGQPLQVAEGRGEQGVAGTHHQHHRLAVQVLEGQALDVRAIGHPPDHQVQLADLQLRQQVGAGSGGDADHQRTVAPVQAPDHLGHHQALHRRQHADPHRLDLRLVAAQGVHPVAQGLHAGAGIAQEGHARLGQLGAGLAPFEQARAEDFLQFLEGLGDRRLRHRHGIRRLGEAALAGDFEEAGEVAELDAVVEVHGAAVAASGAGMVPNGRVGNEVWRAARSCQAVLRLPFPKGRRHWMAERLTRRAIPSLGEEGTGWSMVGQHRADPSPFRGASTSRRTPGNPTWSERRLRTPPSSTPGTAGARPSPRTVDWHWTGSRCGRTGSSR

SEQ ID NO: 28645 - protein, 396 aa, Pseudomonas aeruginosa
  UNSURE (157): Identity of amino acid at the above locations are unknown.
RGSPRRRDGPRTRCPVPAPDLRRPRPRMAARRASPATRRRRAAVRPAAGRRRYARAPRCRRPGSGRSHRPASIRRPVPARRHSRHASPAASRRAATSRPARASPAGRRRWPAGRPSAAGCATLGAAAGRLPGHRPLRWPGGSPVFPSGARAPRRGHXPRHAPAAAPASPRRPAGSPHPAYRAGAPARPGRSARGRARRARRRYRVGSWLGAPCLLAGRAGQARLAGVEGAHHMFFHGALGKLHGLGDLRVGAAVDAIEQENPPGPLGQAAQGGLDPAPLVAGLERLLGTDRLALALLRQPIVQLPLPRSFATQVVDGQVARAAQEVAAKLLHRGGRAPPEAQEQLLDQVGGGRPAADPAADQAFHALALGQEGLEEIRAARRIAVCRQGIRARAGR

SEQ ID NO: 28646 - protein, 225 aa, Pseudomonas aeruginosa
SWTTTAPSGRPACKRHPMNRSKGSSSRRTFLRLAALLLPAGALLGSLPGVRAAARPRKLYLAGPDVFRADAVAHGEALKALCARYGFEGLYPLDNALPKQLAEPREQAAWIYRANIGLIERADAVLANLNFFRGAEPDSGTAFEVGYATALGKPVYGYVDDAGSYAERIRRHAPELIGEDPTRDRDGMTLEEFGLPLNLMLSVPGRIVVGDAEQALRQLASRRHG

SEQ ID NO: 28647 - protein, 142 aa, Pseudomonas aeruginosa
HGAAPGGECHSLASCGPRADLCEPTEEAWRLLCRRPPHPAIRALAASRWRAIRAARSSPSTAPSTTRQAPPTITRSARSAAHSSSAESGSWLPEKRSSSSLNKARSACLPGASSPMSLRPSRRAEPRVAQPRASSGVIRSAP

SEQ ID NO: 28648 - protein, 90 aa, Pseudomonas aeruginosa
  UNSURE (78): Identity of amino acid at the above locations are unknown.
RRRCRYRAWRASRIMFEASLEAEPSTPRPIGAPAASSSTVGQMPEARRMFELGQWQIPVPASPSRRISSALKWMPWAXQVRGPSQPTLSR

SEQ ID NO: 28649 - protein, 384 aa, Pseudomonas aeruginosa
  UNSURE (83): Identity of amino acid at the above locations are unknown.
WGSTDASRQGHRVGDCIAENVERKESRMSEEPTVSPPSPEQPAAQPAKPARPAARRAPRKPATRRPRVASPAQKAREEIQAIXQKPVALQVASAPHGNSEDSTSASLPANYPYHTRMRRNEYEKAKHDLQIELLKVQSWVKETGQRVVVLFEGRDAAGKGGTIKRFMEHLNPRGARIVALEKPSSQEQGQWYFQRYIQHLPTAGEMVFFDRSWYNRAGVERVMGFCSPLQYLEFMRQAPELERMLTNSGILLFKYWFSVSREEQLRRFISRRDDPLKHWKLSPIDIKSLDKWDDYTAAKQAMFFHTDTADAPWTVIKSDDKKRARLNCIRHFLHSLDYPDKDRRIAHEPDPLLVGPASRVIEDDEKVYAEAAAAPGHANLDIPA

SEQ ID NO: 28650 - protein, 369 aa, Pseudomonas aeruginosa
SKNLPSSVPGLPRLAQGNRGIQPGAQGIAGEQDQHQDGRRIGQHRQQVGRNRQPDPLGHQVQDAGQAEQPGTEQHAEHPPTGEDHQRQGDPAASGGHVLRPHRRVGQRQVGTGQAGHGAAEEHRQGAHAQHRQAHRAGRVGVLADRLENQPGAAAQEHPGDRGEQRQAQVDQRVLGEQHAPEQRQLAQHRQRQRGEPLQRLADPGGADERRQADAEDGQRQPAGHLVGVQVQGDPGEQRRQQHAGEHREEHAEPQAAAGEGDHEADHRAEQHHPLLAQVEHPASLADQFAQGHQQQRSTGADHGEQQVVEQIDIHRGSSAVRLRPGRRAAPGACASVRANVGGRGSARRRRGGRTASSPGTARTAPMAG

SEQ ID NO: 28651 - protein, 269 aa, Pseudomonas aeruginosa
AAVPARYAGSARDRGRDRRTVAHRRPGSAAPPAAERPAASSVTVGRAVPGTTASQAPLGNGAGDCRRRLELTGHPAADLLRRSARGGDRRAQPTRTQRGDAVAEQEQLVEVLGDHQDRRTGIAQGDQRAVDQRRRADVHAPGGMRRHQQARGLEDLAAEDELLQVAAGKDACRRPGTRGLHGETADDLLGQRQHLAPPDQPALHQSLLEGGEQRIVRQAHLRPPRRAPAARRARRPGRRGAAHPAPGARRRRRLGGCARPGRAAGALRR

SEQ ID NO: 28652 - protein, 579 aa, Pseudomonas aeruginosa
TALAGDAESGPSGPLTTGMNMSESFAKLFEESLKSLDMQPGAIITGIVVDIDGDWVTVHAGLKSEGVIPVEQFYNEQGELTIKVGDEVHVALDAVKNGFGETKLSREKAKRAESWIVLEAAFAADEVVKGVINGKVKGGFTVDVNGIRAFLPGSLVDVRPVRDTTHLEGKELEFKVIKLDQKRNNVVVSRRSVLEAENSAEREALLESLQEGQQVKGIVKNLTDYGAFVDLGGVNGLLHITDMAWKRIKHPSEIVNVGDEIDVKVLKFDRERNRVSLGLKQLGEDPWVAIKARYPEGTRVMARVTNLTDYGCFAELEEGVEGLVHVSEMDWRGGNIHPSKVVQVGEEMEIQVLDIDKNVVVSPWVSSSANPTRGEDFSSQFNKGDRISGTIKSITDFGIFIGLDGGIDGLVHLSDISWNEVGEEAVRRFKKGDELETVILSVDPERERISLGIKQLEDDPFSNYASLHEKGSIVRGTVKEVDAKGAVISLGDDIEGILKASEISRDRVEDARNVLKEGEEVEAKIISIDRKSRVISLSVKSKDVDDEKDAMKELRKQEVESAGPTTIGDLIRAQMENQG

SEQ ID NO: 28653 - protein, 454 aa, Pseudomonas aeruginosa
VPVVRSQARAGKIEVSWKMIDVNTVVEKFKSRQALIGIVGLGYVGLPLMLRYNAIGFDVLGIDIDDVKVDKLNAGQCYIEHIPQAKIAKARASGFEATTDFSRVSECDALILCVPTPLNKYREPDMSFVINTTDALKPYLRVGQVVSLESTTYPGTTEEELLPRVQEGGLVVGRDIYLVYSPEREDPGNPNFETRTIPKVIGGHTPQCLEVGIALYEQAIDRVVPVSSTKAAEMTKLLENIHRAVNIGLVNEMKIVADRMGIDIFEVVDAAATKPFGFTPYYPGPGLGGHCIPIDPFYLTWKAREYGLHTRFIELSGEVNQAMPEYVLGKLMDGLNEAGRALKGSRVLVLGIAYKKNVDDMRESPSVEIMELIEAKGGMVAYSDPHVPVFPKMREHHFELSSEPLTAENLARFDAVVLATDHDKFDYELIKAEAKLVVDSRGKYRSPAAHIIKA

SEQ ID NO: 28654 - protein, 650 aa, Pseudomonas aeruginosa
KRRWPSSVTCLQQVSAGSFISMSSSSSKLLNGMVAVSSGRNIRLDVQGLRAVAVLAVLAYHANSAWLRAGFVGVDVFFVISGFIITALLVERGVKVDLVEFYAGRIKRIFPAYFVMLAIVCIVSTILFLPDDYVFFEKSLQSSVFFSSNHYFANFGSYFAPRAEELPLLHTWSLAIEMQFYLFYPVLFMCLPCRWRLPVFILLAILLFIWSGYCVFSGSQDAQYFALLARVPEFMSGAVVALSLRDRELPARLAILAGLLGAALLVCSFIIIDKQHFPGFWSLLPCLGAALLIAARRGPASLLLASRPMVWIGGISYSLYLWHWPILAFIRYYTGQYELSFVALLAFLTGSFLLAWFSYRYIETPARKAVGLRQQALKWMLAASVVAIVVTGGAQFNVLVVAPAPIQLTRYAAPESICHGVQVGECKRGSVNAVPRVLVIGDSHAAQLNYFFDVVGNESGVAYRVLTGSSCVPIPAFDLERLPRWARKPCQAQIDAVAQSMLNFDKIIVAGMWQYQMQSPAFAQAMRAFLVDTSYAGKQVVLLGQIPMFESNVQRVRRFRELGLSAPLVSSSWQGANQQLRALAEGIPNVRFMDFSTSAFFADAPYQDGELIYQDSHHLNEVGARRYGYFASRQLQRLFEQPQSSVSLKP

SEQ ID NO: 28655 - protein, 445 aa, Pseudomonas aeruginosa
AVPANCNAWLWCFLDAAFPCANFFSTQDVFRKNSMSAAFINRVARVLVGTLGAQLITIGVTLLLVRLYSPAEMGAFSVWLSFATIFAVVVTGRYELAIFSTREEGELQAIVKLILQLTLLIFVAVAIAVVIGRHLIESMPVVIGEYWFALAVASLGLGINKLVLSLLTFQQSFNRLGVARVSLAACIAVAQVSAAYLLEGVSGLIYGQLFGVVVATALAALWVGKSLILNCIETPWRMVRQVAVQYINFPKFSLPADLVNTVASQVPVILLAAKFGGDSAGWFALTLKIMGAPISLLAASVLDVFKEQAARDYREFGNCRGIFLKTFRLLAVLALPPFIIFWFIGEWAFGLVFGEAWAESGRYAVLMVPLFYMRFVVSPLSYTIYIAQRQSMDLLWQLALLLLTFICFTLPDSVDSVLWFYSIAYAVMYFVYFWMSFQCAKGDAK

SEQ ID NO: 28656 - protein, 383 aa, Pseudomonas aeruginosa
VLREVVVMKICSRCVMDTSDAEIVFDEAGVCNHCHKFDNVQSRQLFSDASGEQRLQKIIGQIKKDGSGKDYDCIIGLSGGVDSSYLAVKVKDLGLRPLVVHVDAGWNSELAVSNIEKIVKYCGFDLHTHVINWEEIRDLQLAYMKAAVANQDVPQDHAFFASMYHFAVKNNIKYILSGGNLATEAVFPDTWHGSAMDAINLKAIHKKYGERPLRDYKTISFLEYYFWYPFVKGMRTVRPLNFMAYDKAKAETFLQETIGYRSYARKHGESIFTKLFQNYYLPTKFGYDKRKLHYSSMILSGQMTRDEAQAKLAEPLYDADELQFDIEYFCKKMRITQAQFEELMNAPVHDYSEFANWDSRQRIAKKVQMIVQRALGRRINVYS

SEQ ID NO: 28657 - protein, 186 aa, Pseudomonas aeruginosa
RAKFVGMTVPDAKRLKDLELENSRLKKLLAESLLDIGALKVVTRGKGESGSGAGGQEMQAQTDISERRACQLFRLSRSVLCHQPRTSVQNTELQAQLVELARASALWLSPPAHSAAACWCADQLQADLPAIPSRRLDGEAAEAPPQGRGGMRMPEPAERTELGLVDGFRLRRAQHWATDQMPDGGR

SEQ ID NO: 28658 - protein, 62 aa, Pseudomonas aeruginosa
LSPASPRRTPSSSFNGKFRNEHCCCSLVEARIRIVAWRHDYNEHRPSSAIGNLTSLEFAASW

SEQ ID NO: 28659 - protein, 113 aa, Pseudomonas aeruginosa
RSAPMHLIKSALLLILFACLPFSASAAPVAVAKNPLAATTPATTVSPGEQVNINTVDEAALIRGLNGVGEAKARAILEYRAAHGPFVSVDQLLEVKGVGPALLEKNRARIVIE

SEQ ID NO: 28660 - protein, 140 aa, Pseudomonas aeruginosa
SRPSVVPRATCTARRSSTPTTSPARCSVRSTRPSGVGPSRSPSTKPMASCPRGCARTSRTFSKAPWCPARAASARAWPRWRRRAGATRTNCARRARSASASANWRKRCTSWPATWSSRRRRNCATRSRRCASAWSTSDPQ

SEQ ID NO: 28661 - protein, 194 aa, Pseudomonas aeruginosa
EVEIHEPSSRVAASAPWMSFSEELVIWMSSTAMNAPSMALSTAIQSRRVGSPSGRASASAVTELDLGFDGHAGADAAMQRVVGLEHDLHRDALHHLGEVSGGVVRWQQAELRAGSGEQAIDAAVDRRVGEGVEGQARLLPVAHAAYLGLLEVGLDPDVFVRHQRQQMGADLHVLAVACAALADQAADRRMDQGA

SEQ ID NO: 28662 - protein, 309 aa, Pseudomonas aeruginosa
GTIMGLDDALIFTRVVEYHSFTQAAQSLGMQKSTVSRRIALLEERLGVRLLNRTTRKLRLTEVGQAYYERCRQIMHDFAEAEQAVMQLQQAPSGLLRITSPIEFGQMFLASLLGDFMRQYPQITAEVELASRSVDPLQEGVDIVIMVGQPEDSTLVARRLLSTSRWLCASPDYLAAHGTPTSVAELAGHRAVLLSTDSQRYWPLSGDSLPCQRVLSCNNITFAREAVVAGAGIAALPALICAESVHSGRLVRLLADVPLPVGELYAVYPSRRFQAMKVKAFLDFLISRLPADTGRLLEPEAARLITSRP

SEQ ID NO: 28663 - protein, 301 aa, Pseudomonas aeruginosa
TEEVRDEQPDLDSRFQRDDRPHRAALDGRAYASDVHGAWRVAAEGLGAAAAGQLGARHSALRAVGVALGRGAGSPAAAWLGRQADTVRPSDRATGRRGLFGVCPRCAGPWPLAGQGGERGAVRPRLAGGRWRVAAAACGGRSFPGWRGGVAGSPDGAAQRSAGDGLGAVADSRTVAPVRSFRRFAGPGSLAFHPPGRAAGGHIRGVPGCGALPSGNARTGGACRRRHARSGGKCRAHPCRLAGQSLAAPAGRRPPPTARRAQAERVAAGAARGAPGDARLPARGKDGERFLRRVAEGLSLS

SEQ ID NO: 28664 - protein, 321 aa, Pseudomonas aeruginosa
WFVQIALAPMEGLVDEILRDVLTRVGGIDWCVTEFIRITDRLLPATAFHKLAPELRDGSRTRAGTPMRVQLLGSDPACLADNAAFACELGAPVIDLNFGCPAKTVNRSRGGAVLLKEPELMHDIVAAVRRAVPSEIAVTSKMRLGYDSPDGALDCARALADGGSAHVVVHARTKVDGYRPPAHWEWVARVAEAVRVPVFANGEVWTLDDYLRCREVSGVEDIMLGRGLVSRPGLARQIAAWRDGGEIHEMPWSELLPLLRDFWLQARRKLAPRYAPGRLKQWLGMLTRTYPEAVELFARIRRESDCETIDRLLQVSFSQAA

SEQ ID NO: 28665 - protein, 123 aa, Pseudomonas aeruginosa
SMYSLGDPSREAIEDTLTMLPPRPPWRVDRRFTASRAQRKLPVTLVANTLCRRAASMFSRRVCASSTPALLTSTSRRPKRSSMAANSRSTSPSSATSAATARASPPWRSMRWRSASAASRLRR

SEQ ID NO: 28666 - protein, 311 aa, Pseudomonas aeruginosa
SEIIRQGAMARLEVNRSGELEVFARVVESGGFSAAARRCGMTPSAVSKLITRLEQRLGTRLLNRSTRQLQLTPEGCAFYERGVRILADLEEAERCASENAAPRGRLRVNANVPFGHHFLLPLLPEFLAQHPEVTLDIVLTDEVVDILEQRTDVAVRAGPLKSSSLVARKLGSTRMLIVGAPAYLARHGMPATPQALLGHNRLGANYVRTRSGWPLRDAGEELVVPLSGNAQASDGEALRRLAVAGLGLARLAAFQVREDIAAGRLIPVLEAYNPGDLEEVHAVYVGQGGYLPLRVRAFLDFLAERVDMSQG

SEQ ID NO: 28667 - protein, 323 aa, Pseudomonas aeruginosa
IASGRWSAVAECLFVEQAHEGARGVRQGPLGVQDIAELAAELDVLQRQAHHLVVEHGPRQHAPGQADGDHHLDGLQVVGAHGDVRRQPFGFEHAPHDVVGEGVAAGEYRGVLGDVGEEHRALSGQRVLRGGDEVQRVVPHRDCAHRFGGFRGQGDHRQFRTTMKDLLVGHFRIQELDIQRHLRMRPGEGAQQRRQAMQADVVAGGQDQPAADLAGEVVQRPAGVVEHVEQLVGARQQGAAGLGEVDLAADPVEQPGIELLFEGGDALAHRRLGQVQALAGFGEAAGLGNGDEGVEAVQVHCGPPLVSAARSLAPMDSCWECFG

SEQ ID NO: 28668 - protein, 480 aa, Pseudomonas aeruginosa
ADEEIPMAGKTLYDKLWDMHLVKQRDDGSALIYIDRHILHEVTSPQAFEGLRLAGRKPWRIDANIATPDHNVPTTRTERKGGIAAIADEVSRLQVQTLDENCDDFGITEFKMNDVRQGIVHVVGPEQGATLPGMTVVCGDSHTSTHGAFGALAHGIGTSEVEHVLATQCLVAKKMKNMLVKVEGRLPAGVTAKDIVLAVIGRIGTAGGNGHAIEFAGSAIRDLSIEGRMTICNMSIEAGARVGLVAVDQKTIDYVKGRPFAPSAEQWDQAVACWQGLVSDADARFDTVVELDAAQIKPQVSWGTSPEMVLAVDQNVPDPARESDPIKRGSIERALKYMGLRPNQAITDIQLDRVFIGSCTNSRIEDLRAAAEVARGRKVAATIKQALVVPGSGLVKEQAEKEGLDRIFIEAGFEWREPGCSMCLAMNPDRLESGEHCASTSNRNFEGRQGAGGRTHLVSPAMAAAAAVNGRFIDVRELLA

SEQ ID NO: 28669 - protein, 260 aa, Pseudomonas aeruginosa
RCPAPVWRPGFGLPEQRRACPGRGIRLAARRPGRAPGSAGPRPGLRRRPRELPGRRPGRGGGGLRSFRRDARRGGAERRGTGHGEHPYRTGQGGEPALRRRRVRFRLQSLFHPSLARCRPGPARGAAGAQARRGGDLRRRGGARAGLAGHLPADRRAAPRHQPCAQLLAGRVGAPERRGGLAGNRKPAPAPAPGVPVVGRADAYAGGVPPGDPQPAAGGGRGSQGVFRDCRRRLVQHRRAGAVAASGVTVRSRRRMPAVQ

SEQ ID NO: 28670 - protein, 183 aa, Pseudomonas aeruginosa
LRFFQCRPGLLRRGSRGVACPCRARPRGGLFGDRPERRPGTERRTAGHGFGECRTPGLASSAVPFVQSLRRSRRTVRSAGATPGHAGLPATEPDSLPLRLQPGARRGQGTRPADRRTAQCAPPGAASLRPPDRLQPARAGRRGGCRGTQRDRAAHLRGGAGLAWRAYRTVERYLHPGAGILRR

SEQ ID NO: 28671 - protein, 276 aa, Pseudomonas aeruginosa
PGFGRGDPEPGVAGRVQQGGRRSPVLPHRPEVHAGGEAQRQERHSRDLVEAGAGALPELPGPGALAERPPAARVHRPAGSAAVLPAGRGKRSASAGQRAARDRRPASPAGSGSGAYHRAGRQRHLSHRFQRHALGDRPAQPYRSRFRTPGDARVPGTESGRLRRWQHQPAEERPGPAHSHRTADAGALAARGAVPGAGAEPELARQPQSGRGQRWRQAVGCDPAQCRRVGAIQGRRHGQPAPGVWRGQGQQGCRQGREGRQQGARRYPGGDQGKPR

SEQ ID NO: 28672 - protein, 143 aa, Pseudomonas aeruginosa
HSPRERRTAEPHAGSAEPVGQAAEVDPAEGRPVGQAARAVGRRRPGRSPAERSPAGCVPAQCGRAGAGSARDSRCGSADSCSSRRSTRRSGAASGGAAARASCREASGTCRSGARSGTGGRAAGTELPRRTAGQPAVVGGDRR

SEQ ID NO: 28673 - protein, 321 aa, Pseudomonas aeruginosa
RFPSPYGAQHRWRPDDHRCRRAADRMGEGGARGARPARRWGHRSPLRTLSGAGGVPRGVRVARALPGAAFPFRIARYRRLTSNRAFATIENSRRTGRPAVRRSLAEDSPSLPAVRIKICGITRVEDALAAAAAGADAIGLVFYAKSPRAVDIHRAREIVRALPPFVTSVGLFVNASRCELGEILDAVPLDLLQFHGDERAEDCEGHRRPYLKALRVKPGDDIVGRAAAYPGAAGILLDTYVEGVPGGTGAAFDWSLVPTDLGKPLVLAGGLTPDNVGRAVEQVKPYAVDVSGGVEASKGIKDAARVRAFVDAVRSRRRDET

SEQ ID NO: 28674 - protein, 683 aa, Pseudomonas aeruginosa
AWRHRHDRASCRVAAAPGQSAVGLHSFAEPRIRMTQRSLADWLSYLEQLHPTAIDMGLERSREVARRLGLGRPAKRVVTVTGTNGKGSTCALLAELLREQGLSVGVYSSPHLLRYNERVRIDGVEAGDAQLCDAFSAVEAARGEISLTYFEMGTLAAFWLFERAGLDFAVLEVGLGGRLDAVNLIDADLALITSIGLDHADWLGDTRESVAFEKAGILRAGKPALCGDFDPPQPLLEQVAALGAPLYLRGRDYDLALADHGWHWRGLAADGQALALHDLPLLGLPMENAALALQAYALLELPWQAERLAEALRRTRVTGRLDRRDLSWNGQPRQLLLDVGHNPQAAQYLAQRLRAAAPRGRYLAVFGLLADKDLDGVLEPLTGLVQDWAVAPLPTPRSRPAAELEAALILRQVPASSHADIAAALDAQCAKATADDVILLFGSFYSVAEGLEWLARRTDNGELIMALLERGLKQRIVGALVLIALAVIFLPMLFTREDESRQVVVEAPPRPQSPAMPSVEVQPTEVPELQPGEEGNAPEIVEEGSPAAAGQPSQPIGGLPATPPATQPPAQAQAPAASLPPSQPQPPAAPPSPPPAEKRLDANNLPQSWSVQLASLSNRARAEELQKTLRSQGYNAYIRSFDGMNRVFVGPVIQRAEADRLRDQLSKQQKLNGFVVRFQPERG

SEQ ID NO: 28675 - protein, 505 aa, Pseudomonas aeruginosa
GLRHMCGIVGIVGKSNVNQALYDALTVLQHRGQDAAGIVTCHDDKLYLRKDNGLVRDVFQQRHMQRLIGSVGIGHVRYPTAGSSSSAEAQPFYVNSPYGITLAHNGNLTNVEQLAKEIYESDLRHVNTNSDSEVLLNVFAHELAVRNKLQPTEEDIFAAVSCVHDRCVGGYAVVAMITGHGIVGFRDPNAIRPIVFGQRHTENGVEYMIASESVALDVLGFTLIRDLAPGEAVYITEEGKLYTRQCAKAPKYAPCIFEHVYLARPDSIMDGISVYKARLRMGEKLADKILRERPDHDIDVVIPIPDTSRTAALELANRLGVKFREGFVKNRYIGRTFIMPGQAARKKSVRQKLNAIELEFRGKNVMLVDDSIVRGTTCKQIIQMAREAGAKNVYFCSAAPAVRYPNVYGIDMPSAHELIAHNRSTEDVSKLIGADWLVYQDLPDLIDAVGGGKIKIDHFDCAVFDGEYVTGDVNEAYLNRIEQARNDATKAKSQAVSAIIDLYND

SEQ ID NO: 28676 - protein, 311 aa, Pseudomonas aeruginosa
QRGERHDSGLGCRASRQRPGRRGLRHPGGSRRATADAGGRARRGAVHHFQLRLPHRRRRGRAVRRRSAGQRLFALHQPHGTHLRGAHRRPRRSRAGGGHGVGHVGDPRPGDEPVQLRRPRAGLAQRVRLDHQPVRQVLQALRYPGRLSAVERSRGLGGGVQAEYQAVLRRVAIQPAGRAGGYRRAGRDRPRQGCAAGGGQLLLHAGPATAAEARCGRGDPLRDQVHRRPGPGHGRGGRRSRRADEGSGRLPPHRRTDPQPVQRLAVPQGPGNPAYPHAGAQRQCPGPGRMAGAPAGHRAGLLRGPAEPSSA

SEQ ID NO: 28677 - protein, 351 aa, Pseudomonas aeruginosa
VGPAPAERLRRGRQLRREGRARCRLALHRRYPDGLDHHQPGRHQDHHRPPGDHLPRSTVPRGPRARRDRRQPDPGRGRPGRPRRPQGRHGSGAGRAVIEPNLRGNGKVALVTGAARGIGLGISAWLIAEGWQVVLADNDRERGARVAEALGEHAWFVAMDVAQEGQVAMSVAEVLGQFGRLDGLVCNAAIANPRNTPLEALSLGEWTRTLAVNLTGPMLLAKYCTPYLRAHNGAIVNIASTRAHQSEPDSEAYAASKGGLLALTHALAASLGPDIRVNALSPGWIDTREAAEREAAPLTELDHDQHLVGRVGTVEDVASLVAWLLSEDAGFVTGQEFLVDGGMTRKMIYLD

SEQ ID NO: 28678 - protein, 212 aa, Pseudomonas aeruginosa
VGGEMRKRRCSERSSAFFSYEAALPVWRRYSVFSSRRSTACPSNNWLALVGRMLGRPSGPRVPSMTRMSLYFLPESAARPALSRTTVGRRKTIRLRLVWVSLVERNRRPSNGMSPSRGTFDSAWETSSWIRPPITITWPFSARMVLLIERLLVIRSVLLRCWALGSRAEISCSISRRRAAPSLMCGVTLRLTPISLRSTVVNGLLEPSLLVV

SEQ ID NO: 28679 - protein, 259 aa, Pseudomonas aeruginosa
EPVWNGTFWPTRISAFWLSRVNRLGVDSRLLLVLAESAVTSAPKLLLPMPTMAPSGMDSGALLLSSDCSRVPMDSPVLAKLVLVPPMPPLLIAHCTPTASWMSPEISTMAASTNTWARGTSSWRTMSSRALTVSGSASRTRALVLSSARMRMLLGRPPPVCSPPWPPLFFMPSEIWPRVSARVLASLWRRRITRVLAERAVGVSSDCASCTSLARACGGPRMIRRLVRASAITWAPAAPLAWPRLMALLSTSAASITQP

SEQ ID NO: 28680 - protein, 509 aa, Pseudomonas aeruginosa
GYRYKASMMTAPLPDIAAPAAPPRRLPFSFAKRQGLLFLCLEEQYWLACRPQVELAAIAEAQRFAGRRLPLKALGEDAFNQALAASYQHDSSAAMQLAEDLGGSLDLAALADQVPETEDLMEQEDDAPIIRLINAILGEAIRENASDIHLETFEKRLVVRFRVDGVLREVLEPKRELAALLVSRIKVMARLDIAEKRIPQDGRISLRVGGREVDIRVSTLPSANGERVVLRLLDKQAGRLNLQHLGMSERDRKLMDETVRKPHGILLVTGPTGSGKTTTLYASLTTLNDRTRNILTVEDPIEYHLEGIGQTQVNAKVDMTFARGLRAILRQDPDVVMVGEIRDRETAEIAVQASLTGHLVLSTLHTNSAIGAITRLVDMGIEPFLLSSSMLGVLAQRLVRVLCPACKEPYRADEAECALLGVDPAAPPTLHRARGCGECHQHGYRGRTGIYELVVFDDHMRSLIHNESSEQEMTRHARTSGPSIRDDGRRKVLEGVTTVEEVLRVTREE

SEQ ID NO: 28681 - protein, 176 aa, Pseudomonas aeruginosa
YSWARWCWSSSWPFFFRSFLSTNSWGNRVNQSRPLQRRQQSGFTLIEIMVVVVILGILAALVVPQVMSRPDQAKVTVAKGDIKAIAAALDMYKLDNFAYPSTQQGLEALVKKPTGNPQPKNWNKDGYLKKLPVDPWGNPYQYLAPGTKGPFDLYSLGADGKEGGSDNDADIGNWDN

SEQ ID NO: 28682 - protein, 174 aa, Pseudomonas aeruginosa
PDMRASRGFTLIELMVVMVIISVLIGLAVLSTGFASTSRELDSEAERLAGLIGVLTDEAVLDNREYGLRLERDAYQVLRYDEAKARWLPVARDSHRLPEWAELTFELDGQPLVLAGSKGEKEQKKGTDQPQLLILSSGELSPFRLRLAERGPEGRALSLSSDGFRLPRVEVARR

SEQ ID NO: 28683 - protein, 494 aa, Pseudomonas aeruginosa
PWRLPQRGRERPDRRTHPWWLAQPARPGALAPAAGALVAVRGDPRTPLLAGSGPRPGQQATGAAGAGRGYRAELALPRQGAQLAGPLADRRRQRGGAPGKPAAGGGDDPGAPPLRQAGARLASARSAAQAGPAAGPAGRREWRERRGRSAAAAGRHAGGAGMRRGQNGVALITVLLVVAVVTIVCAGLIIRQQLAIRSSANQLHVRQAWHYALGGERLAEAVLRRDLRQGGENTREPVDHLGEAWARPMTPFKLDDGGELRVRIEDPSGRFNLNGLVRKRKVKPDSVKQFRRLLATLGMKEEIVQGLPDRLADWLDADQNPQGEQGAEDNQYLLEAPAYRAANRSFKDVSELRLLKLSEADYRRLLPFVSALPEDAPLNVNTASVPVLAAMFEIDPGQAENIVAARGREGFQEKTEFSKHLNELGSKASNVNFAVGTRYFQVISEVSLGDRRQVLVSTLQRGKDGKIRVMARDMGQGGLPIPSTGGDDWKKDER

SEQ ID NO: 28684 - protein, 177 aa, Pseudomonas aeruginosa
EVEMKVMTQFHERLRAQAETSQLAIRWRGLPARDRLALLWLGAFLLLVVLYLALWRPAERHLQSARQYFTEQRAVHAYIQQQAPNVRQADAAAPQAQIDPAALQGMVTASAAQAGLSVERLDNEGEGAVQVALQPAPFAKLLPWLEQLNGQGVQVAEAGLDRQVDGRVSARLSQRVE

SEQ ID NO: 28685 - protein, 157 aa, Pseudomonas aeruginosa
PRRCMRRVARSACRSCMPAATPTVRSTWRRARSRRRSIRSSPRNSTRKASRSRSPTSSTAPAWPRSPATTASRSWDRKATSSTSSSCSTPTSAPTAGAAATRTACACRWRSSAGCARRWGRTSSSSIACRCSTWSRAAAAGTRSCCWRRPSRRPARP

SEQ ID NO: 28686 - protein, 313 aa, Pseudomonas aeruginosa
ADSLPFPHWSPHTPLQRLELDWLQRAGVELALLRLDQADPLISGNKGFKLAPHLALAREQGLDGLISLGGAHSNHLHALAGAGARFGFRCVGLLRGHEVDTPTVRDLRSLGMELHWLGYGGYRQRHAAGFWLPWRERYPGLLPVAEGGGGLLGARGCIGLVERIATQLPTLGWDDYDAIWVAAGTGTTLAGLVLGEAGRHPVVGALAVPEDHGVAAQVAATLAEAGWADTGYRLLDASRGGFARLDGRLARFIVEFETASGVALEPLYTGKLLLALREAVESGAVARGSRLVALHSGGLQGRRALQERLLALL

SEQ ID NO: 28687 - protein, 515 aa, Pseudomonas aeruginosa
TGGQGRRGAGRPVHRREPLPPRCPGASRYRLDGAGRCAQRRGPAPGQVDPDDRVRAVYRRPVRLQPEGRRPDRRHAHRFHRLRAVRRRSDHASEAGCHRHRADVPTHAFQPPDRGGRQQRAEDRRVAEHADLPAGLLRRAEPFHLRPRRYCDDQQEAAEAAPDPPHRPQLLRDLPDQARLGQPPGRRRLMQLDPGRGYDLIGDVHGCAHTLDRLLDLLGYRLQGGVWRHPRRQVLFLGDIVDRGPRIREALHRVHAMVDAGEALCIMGNHEFNALGWSTPAAPGSGRQYVREHTPRHARLIKETLEQFEGHDADWRDFLGWFQQLPLFLDAGRFRMVHACWDGELIATLRRQFPDGRISEAFLQESAEPGSFADLACNRLLRGTDMRLPHGATLTSSDGYTRAFFRTKFWVEDEAPRTYGDIVFQPDALPEAIAREPLSEEQKSSLLTYGADEPLLFVGHYWRRGTPAPIRPNLACLDYSAVMYGKLAAYRLDEETRLDRHKFVWVEVKRPEADE

SEQ ID NO: 28688 - protein, 351 aa, Pseudomonas aeruginosa
DLPEPQAGHRDRQVAGRPQADPGAEGTLPAGGDRLGAAEPPRGGAHRLHGPAALLLAFRRADPEHPVQVGLRALMEEIARGALSKMTARLESNAPVQYAFRLDDREVAVNPLIGRPLRLEYLGSIFCTHCGRKTKKSFSQGYCYPCFTRLAQCDSCIVSPEKCHYEQGTCREPEWGERFCMTDHVVYLANSSGVKVGITRASQIPTRWIDQGARQALPILRVATRQQSGLVEDLLRSQVADRTNWRAMLKGEAEPVDLAAVREQLFDQCADGLRELQQRFGLQAIQPVIDLDPLEIAYPVEAYPSKVASLDLEKTPIVEGTLRGIKGQYLILDTGVINIRKYTAYQIAVHH

SEQ ID NO: 28689 - protein, 891 aa, Pseudomonas aeruginosa
AEGPQAMRTEQPKVIHLKDYQAPDYLIDETHLKFELFEDHSLVHAELKLRRNPERGAGLPPLLLHGQQLELLALELDGQALGADDYQLDDEQLGVKPRQAEFVLRSTVRIHPESNTALEGLYKSGKMFCTQCEAEGFRKITYYLDRPDVMSRFTTTVSAEQQRYPVLLSNGNPVASGSEGNGRHWATWEDPFKKPAYLFALVAGDLWCVEDSFRTMSQRDVALRIYVEPENIDKVQHAMDSLKKSMRWDEEVYGREYDLDIFMIVAVNDFNMGAMENKGLNIFNSSCVLARAETATDAAHQRVEGVVAHEYFHNWSGNRVTCRDWFQLSLKEGFTVFRDSEFSADMNSRTVKRVEDVAFLRTNQFAEDAGPMAHPVRPDSFIEISNFYTLTVYEKGSEVVRMIHTLLGAEGFRKGSDLYFQRHDGQAVTCDDFVKAMEDANGVDLTQFKRWYSQSGTPRLAVEGEYDAAARRYTLTVRQSCPPTPGQPSKEPFVIPLELGLLDGQGHELPLRLEGEAAAQGGNRVLAVTEAEQRFVFVEVPEQPLPSLLRGFSAPVKLSFPYSRDQLLFLMQHDSDGFNRWEAGQQLSVQVLQELIGQHQRGEQLVLDPRLIEAYRTLLADEALDQAMVAEMLSLPSEAYLTEISEVADVDAIHAAREFARQRIGEALFEPLWQRYQANRKISRDTAYLAEASHIARRSLQNIALSYLSLSGREEILAACLEQYEGCDNMTERLTALAVLVNSGFEAEKGKALAMFADYFKDDPLVMDQWFSVQAGSPLPGGLERVQALMQHPAFTLKNPNKVRALIGAFANQNLVNFHRPDGAGYRFLADQVIVLNALNPQIASRLLVPLTRWRKYDEARQALMRGELERILASGELSSDVYEVVSKSLA

SEQ ID NO: 28690 - protein, 177 aa, Pseudomonas aeruginosa
PHGVSSRCTSPTASPGCAPRRPGPASPSSGCCRCWAARPRPSNSASSTTRCPVRSTPPCPTAPCGGCRGRTRATTTSTPTTATATSIPAWFPRSTRSPRTWRRPGATMACSSAARRSMTPRSWTSATTTTATTIHRSRARAIPTTTVSPARPAISPGTRRKSSTPTSTAAGTSATCR

SEQ ID NO: 28691 - protein, 479 aa, Pseudomonas aeruginosa
STPSDRTDNDTGAASARHLTRRTLMLNKHLLIGASLALALGSGGALAGVSAGEAAQLKSSLTPLGAEKAGNAAGSIPAWTGGITQAPAGYKPGQHHPDPFAADKPLFTIDKANLEQYREHLTPGQLALFKTYPDSFRMPVYPSRRSGSAPQWLYDNTFANATSARLLDGGNGFADAYGGVPFPIPKSGVEALWNHVARYRGTYVVRRASEVAVQRNGSYSLVTSQQEALFKYYLKGGSFADLNNLMFYYLSFTKSPARLAGGAVLVHETLDQVKEPRQAWGYNAGQRRVRRAPNLAYDTPIAAADGLRTADDTDMFNGAPDRYDWKLLGKKEIYIPYNNYKVSSPEVKYEELLKPGHLDPQYTRYELHRVWVVEGTLKPGARHIYSKRTLYLDEDSWSAAVVDQYDGRGELWRVSMAYLKNFYDLPYTWSALDVFHDLQARRYHVQNLDNEEPGTIDFTQAIPDDSYFKPSALRRRGTR

SEQ ID NO: 28692 - protein, 425 aa, Pseudomonas aeruginosa
SLRSPAPTASLRGGGRRRSPRYRRLTRLTKDNVASIVSVAKRWLYNAHHEPLITTTGTVSMREPMTWRTSPGQTADASRHPAIPSRSPLASRALSFLGALSLLTFAATPVLAESTPTAAPPQFAVESPKAASSLLLSVAHAGKRLVAVGDRGHILLSDDDGKTWTQAKVPTRQLLTSVFFVNERKGWAVGHDAQILVSDDAGSTWTRQFEDLGREAPLLDIWFADEQHGLAVGAYGALLETRDGGQHWEDVSERLDNEDQFHLNAIAAVKDNGLLVVGEAGSLFRSKDWGATWEKLEGPYEGSLFGAIGTADAGGVLVYGLRGHLFRSADFGDSWEEIPLKAASGDLEFGLSDGALLADGRIVVVGHGGSVLESTDGGRSFSVFNRPDRLSLAGVSATGDGHLILVGQGGVHLAAANGAALEQQQ

SEQ ID NO: 28693 - protein, 676 aa, Pseudomonas aeruginosa
RGARAPVLAPAVELRQPEGGPGVHRHRPADARRRPLVWQAPEDRRPRPGCAGTASRLALQPRQRLHHPQLLDQFGRAGGDGQDLPGRLLHPPGPGGHGRTGLEAGEHRGRAVGDLDGHRVQAGDQGDERRQPEMGDPVAQPGRAEQLHRPCRRSLQHRLLAGAAAGLPQRPQGRDPRPRGGGGAGLRRGERQGRPAVPAGRRQRRDRGRHQRGDQAVRTDHPGSGVHLRGGHVHDHLPFLRRDPLHRPAADPHLGAGQRADGGAGHRREGRDPAGDRPRRRHRGGLRDLHLHPPGVFPAHGPAVAGGLLRDPPLHRQGGAVHRPVPGDRRGHLDLLGDQVPGRHGPDADLHAALEHVRRPLAAAGPGAFPDQPGQAAGQEGLAVRSLSRTEPRQDRGPGRGFFRAEEGRRASVRCGGEQQLAAEALLVAAVMQAPAALLAQALDQVEAQAITERHRLLRALGRTDGVADQQAAVAHDDFHHALVAVLQGVAQQVADDDPCAGLRQAVWLHVEVEGQAAALAQRLLFLEQLLQQATDLDVSVVAQFAALAAEPEQGFGHLLHAQRRAADALQGMRGGRAAGLVEQLQVHADHRQRGAQLMAGVAQEALLALAEVLDPGHAVPQGIRQHVEFAVVEARPLAVRGKVVEGHRPARQLAQRRDDEPDQQADGGQRRQGDR

SEQ ID NO: 28694 - protein, 431 aa, Pseudomonas aeruginosa
  UNSURE (10),(86): Identity of amino acid at the above locations are unknown.
SQTTPAASRXSMTVPARSKLSSTTSTWICMVSVRMTDGTLCLVRRGRCPRLLEHLDRLHRGAVAPLAHAGLLRRNAQGVLAVAVVXRRVGEAIEQLPGAVPVEGVDHQRVVAGIAAFGLLDFEALLDAVEQPVAVFFLRILRAEYRRGGCRVVGQQRRSAVAIAAQQQQVLVAGRNVPALAVDALGVGAGHVAVLVAADRQQQGALGQPRQAFLGHAVPALALALAGLDHHQRLRRRQLQAFAGGRQVGGEQSAGGVAEVGDLVQPRAHPQLAGLQAPEGVAEGAGGIVEEVCVGRLQVRLVARVDHHHAAADDMVDPGAVEVRLHHAPAVQEDHQRSVAGDRLLGGEHPVFASAFAEVPLMHAGMAIVRAARPFGRLRRRRGRGRRFGGRRGVAQEQAAQDEVQGTEAHAGPLAESEYRASPNHSAVQRG

SEQ ID NO: 28695 - protein, 433 aa, Pseudomonas aeruginosa
PLCFGRRVTIQRVVAWARPFCVARRLTWRVPRTSKRASSGLRSGLPKRVGSSDSSVSSTLSPSVRRARSTLALKLAWAETQRSARSRLQNRRIMAWLPGVAAVGTRTCAAAIRRDRRESVAAIARGPGDVRRRVRRRLPRRPSARPRRWAAAALGRVLRRSSRLRLPAGWSRAPRPGPSAHRRSPRRAAAAGCFRMAGSAGSLPGAVPCSRRPAAAPPVPGVGAAVPRPGPCCVARRPVAAGAPGLVRRRRRRLPVRPGGPGRCHGCSDRRPGRLGRRPGPRRRTRGPGRATGLSSGSPRSASPPRPPGPVATGAGLAGPDAARGLRTGRPWPVAAGSASTAAGRTASRAVRHRRPAGAAAGAASNPGRPSAAGAAGRSRDLPPACRRGPAGRGCRGRGRSAAGAGSRRRSPRRSGAARFRRAWAGGCRPGRP

SEQ ID NO: 28696 - protein, 411 aa, Pseudomonas aeruginosa
AGRPTAAPGYARCRRRRRSRSARRCACEAGRAACAGPAPGGSATGRRQASRESAGGSPPAGRYASSRAVPVAANWARARPAGPAARRCRGRSRACGSAARRRRPAARAGRPSATATASVRHDAGDAAASTATSQAAAPAAASRGAASAARRPATGSWLPPGTAARPGPVFPWPEFQRHQQHTQAEGGGQRPTVQRQGRARPGSLLGDRFEAVEGRGNAFQLGAGSRAEVFAASALGDTAQGRLVEIEPRVEAEQAGHAALLRVGADADGVDLHLLLGGQLRGDLRGYLSAGVGAVGDQHQHPAFRRPLAQALDRQADGVADRGVLAGDADLCLVQPDPHGVPVEGQRRLQVGLAAEQDQADAVATTVFDEVAEEFLDQFQAADLVFLPAHVAVVHGAGDIHREQQVAAAGG

SEQ ID NO: 28697 - protein, 1627 aa, Pseudomonas aeruginosa
QAKRSTTMAFFTAASKADFQHQLQTALAQHLGDKALPQVTLFAEQFFSLISLDELTQRRLSDLVGCTLSAWRLLERFDRDQPEVRVYNPDYEKHGWQSTHTAVEVLHPDLPFLVDSVRMELNRRGYSIHTLQTNVLSVRRSAKGELKEILPKGSQGKDVSQESLMYLEIDRCAHAGELRALEKAILEVLGEVRVTVADFEPMKAKARELLTWLGKAKLKVPAEELKEVRSYLEWLLDNHFTFLGYEEFSVADEADGGRMVYDEKSFLGLTRLLRAGLSKDDLHIEDYAVAYLREPVLLSFAKAAHPSRVHRPAYPDYVSIRELDGKGRVIRECRFMGLFTSSVYNESVNDIPFIRGKVAEVMRRSGFDTKAHLGKELAQVLEVLPRDDLFQTPVDELFSTALAIVRIQERNKIRVFLRKDPYGRFCYCLAYVPRDVYSTETRLKIQQVLMERLQASDCEFWTFFSESVLARVQFILRVDPKSRIDIDPARLEEEVIQACRSWQDDYSSLVVENLGEAKGTNVLADFPKGFPAGYRERFAPHFAVVDLQHLLSLSEQRPLVMSFYQPLAQGEQQLHCKLYHADTPLALSDVLPILENLGLRVLGEFPYRLRHQNGREYWIHDFAFTYAEGLDVDIQQLNEILQDAFVHIVSGDAENDAFNRLVLTANLPWRDVALLRAYARYLKQIRLGFDLGYIASALNAHTDIARELVRLFKTRFYLARKLTAEDLEDKQQKLEQAILGALDEVQVLNEDRILRRYLDLIKATLRTNFYQPDGNGQNKSYFSFKFNPKAIPELPRPVPKYEIFVYSPRVEGVHLRGGKVARGGLRWSDREEDFRTEVLGLVKAQQVKNAVIVPVGAKGGFVPRRLPLGGSRDEIQAEAIACYRIFISGLLDITDNLKEGEVVPPANVVRHDEDDPYLVVAADKGTATFSDIANGIAAEYGFWLGDAFASGGSAGYDHKGMGITAKGAWVSVQRHFRERGIDVQKDNISVIGIGDMAGDVFGNGLLMSDKLQLVAAFNHMHIFIDPNPDAASSFVERQRLFNLPRSSWADYDAKLISAGGGIFLRSAKSIAITPEMKARFDIQADRLAPTELIHALLKAPVDLLWNGGIGTYVKSSKETHADVGDKANDGLRVDGRELRAKVVGEGGNLGMTQLARVEFGLHGGANNTDFIDNAGGVDCSDHEVNIKILLNEVVQAGDMTEKQRNALLVKMTDAVGALVLGNNYKQTQALSLAQRRARERIAEYKRLMGDLEARGKLDRALEFLPSDEELAERISAGQGLTRAELSVLISYSKIDLKESLLKSLVPDDDYLTRDMETAFPALLAEKFGDAMRRHRLKREIVSTQIANDLVNHMGITFVQRLKESTGMSAANVAGAYVIVRDVFHLPHWFRQIENLDYQVPADIQLTLMDELMRLGRRATRWFLRSRRNELDAARDVAHFGPRIAALGLKLNELLEGPTRELWQARYQTYVDAGVPELLARMVAGTSHLYTLLPIIEASDVTGQDTAEVAKAYFAVGSALDLTWYLQQITNLPVENNWQALAREAFRDDLDWQQRAITVSVLQMQDGPKEVEARVGLWLEQHLPLVERWRAMLVELRAASGTDYAMYAVANRELMDLAQSSQHGVCIP

SEQ ID NO: 28698 - protein, 149 aa, Pseudomonas aeruginosa
INMPTNQDLQLAAHLRSQVTTLTRRLRREAQADPVQFSQLVVLGAIDRLGGDVTPSELAAAERMRSSNLAALLRELERGGLIVRHADPQDGRRTRVSLSSEGRRNLYGNRAKREEWLVRAMHACLDESERALLAAAGPLLTRLAQFEEP

SEQ ID NO: 28699 - protein, 204 aa, Pseudomonas aeruginosa
IQGFGFRQMEEEFPMNTALIGLDYIVDIMHPDGRIARCAEQAALRGVVARFNRALAVAEQRGWLRIAVRVGFEPGYPDLPEHSPIFAAAQALGALDLCGRGCAFHPDLKRDAVQMEVLKPRISAFYATRLEAVLRARRIERLVLAGVSTTWAVQAAARDAHDRDYQVLVLEEACAAASDEEHRRSIEVLGGIARIVTLDQLAAL

SEQ ID NO: 28700 - protein, 332 aa, Pseudomonas aeruginosa
AARRVCASLTRLFDGRAMGRALAVSLPLFVLYSASGDANWLLANIATISVAVVVERVGSAPLAALGQGVAIILGFLGLSFALAWGAAFAIACAALAAAAVALSGLDTRLRTLGNFVFIPVLYLACEVAATHRAALSLVPYLVVATLPSVALAGVDTLRHAALARRYGTLLRWRGAHLTGHAAAHDELLQAVLAVTLAVACSATLVAWRHIEYGQWAIWSSASVVTGNAASAHLKLRDRGLGALLGVPLGLVVGAALPHVLLVHTLATLASVLTLVGFRHYATGFAARCACIACASWAIQQSPLVASLRVAEVLAGGAIGVASVWLVRFLARN

SEQ ID NO: 28701 - protein, 207 aa, Pseudomonas aeruginosa
RRLRAVRQHPGAGLPGGERRRGATAAHRAALRSARGRPDPEPRPRLPRRPARIPRLSGRLPAHRPAAARTSAERYLRGGSHLDDQWTAAGQRRLRQLDRCASRRKGAGGVPRRPAHRERRPVAAPGYSPAVAEAQGQAEHRDPRPGAAGRLRSAAGDPGPRPAGAHRTRPGAGGPGAQAQGRRQGVRAGGDRRLGRLRPGALCAGGG

SEQ ID NO: 28702 - protein, 470 aa, Pseudomonas aeruginosa
RAPALDPRSVRLPAQGLAPCAAAESRRDHREWPAHRHRAHRWRRLRLPCRGARQSLCRPAGAGGLHQALSVPHLGLGDRRRGRAEGHVPAPGQGAGADRPAHLRRRQGRGRQPYLQPSVLLAAATGRAGRELRGPVWLQDGHPGLRQGRLRTRGDRRPRLHRAAPDHPAEAGEDDLLVRRRAARRRHHQARLRRRADERQRRQYRADPGLSLADRTLPADPAHPRRRAVLRADHQRERLHQSLAGAVLRLPRRHRYLRPDRQPAPPARPAPVLPLLFGDQAGLDPHHAPDLRGDAGGASVVAVDERLHPAPGRPASRQPGQACRWQLAVARLRRLAHGAPGPGAGLAGPRSLHGSRGRARPAPGALCTPECGECAPGPARQPRSAAGAGGGQPAAEALALPRRWPRRVRLRRAPAIAPGGARGGRLPAERGRQGLPGKGRQRPVDVRVADGAGARWPTRLPLTSIPRRAC

SEQ ID NO: 28703 - protein, 373 aa, Pseudomonas aeruginosa
PTARASAAERGPDTEFNRRNTTCNPSAAWLSRPSPCSWRAAPASPAKALRRWRAARSGAWCRCSITPRRRRPASVPSRSCSACWPRRACGRACTRRSRKATCNWSTTASASSARWTGHASRSWPTWSPAASRSGSTRTASTASRRWASACRCWSRPPGGCSGAPAGRAPAGPGKAWRAPRRKSCASWSATCGSSDGDVRAQGFRPRTARQRQRLLGRDAGHQRARAGPGLVVQPGRPAAGQRHLSLGDPRAPVAGHALRLRPRVGQRGAAGGGAVRVSRPGRRGLCPGTGGLHRRRAALRHVGGRVPRHLGTPPGAPGAGERVPPVAPRRIHPRPSHPAHLPRSPGTAGRRQRPEPAQFAARSATTAARAAGR

SEQ ID NO: 28704 - protein, 271 aa, Pseudomonas aeruginosa
GTARCAGGNRAGAAGPVRFAAHRRTLPGAPRPHPGAAILGDARRDAGAGRRRSAGAHLPGARRTGQRAPGTAGARRAACAQRAAGVRAAGRHRWADPRPAGGGADAILRLQRTYLQPAGDPRRAHRRLAAERPSRTATGRHRRPALLPVPQALPAGRPRPWVAGLPVCLRVDRCALRRRGPASAGRQPAWPRRAVATAQRRGPAGPAGVVAADFRRRLPGVSAAPEDSLRRTLRPGPRAGVAGRAHPPVRTGRRQRSAGAGTFPFQRVRPE

SEQ ID NO: 28705 - protein, 298 aa, Pseudomonas aeruginosa
CSATAVCRTSCAMRRTRTSGSRRSSPPGGCPARRRSRSSSWPCATPPTTSACWPTRCSTRRKAGSTSASRPPSAASPAPRRRDAARCTEPWRAGTGNWPTWGWPRAACWSTSSSRRASIPTRRCAAHPRPTCICWPGASPSNKAAWRMPDAPSRPPRRRESIAPSWRRSAPRWRSSSGATGTSPGFSPECPTTCCNGRPSRPWRDTGHDRTHRSDGARRRCLPAAGGHLALCPRRRLQLGQPVDPRSPRPDLLGVLHRRPEGCLRQAPLPDPGQCAAHRGTLPVNRLEFAEPADATGQ

SEQ ID NO: 28706 - protein, 445 aa, Pseudomonas aeruginosa
RDRKGVARSAPFLPLPGDAGRGGGRRAARPARRGPHRPRGLSPQQGQLGGDHRRLRALLHRSVLRQLLLDPALDAGAGVHARRGGPADAAGAHAALDLHRLRRPAGLHPATSLGLPLPAQRARHLHQGAQNRPGPGQLDRGEPRRAAEYRTGCRGQLHPSLVDPLLRACRPAHLSRGQSDRRPLRRQPPAPGTRWRRATAHPGDPQRHRPRCLGRRPRTAAAGDSAGGRAGRPGSADQGREDLHPRHARGGQRDAGGGGLDRRSGGGRSGLCQRMPQPGGQPRPAGQGEVPRFPSDRRGPAATRPDGPHLDQRSAAAGDPRSLGCRRPGGEQRRRLLPRTDRRRRRRRSRPGSRRGGGGDRRPAGHFAGDPRPAAQSAALAGGPGGRPATGRTLLHRGADARTLPRAVPRSHGDCMTWPASASNCGRSFPAIPIRRPCAPTSTPG

SEQ ID NO: 28707 - protein, 610 aa, Pseudomonas aeruginosa
REAARHCRADGETGLQADRGEQDLRRAAQDVQPGRSVGLPPGRHEPVPPRPHVPAGQGNPAHRGRGNGADLPPVGEAGGGGAGELRHPAGDPAAIRVRRPALRNLPARMELAGLREPARGVARQQGRRHFQAHERGSLSAAFDGAAPGGLPLRPAIAERPGQAPDLWRALWRLVPGAQGRRRPARRHARHPPSLDDRHCQFGRADQSGHEADGPQDRSDVHALRPHRGQAGARCGRTGGQPAPGHHGRTPACGGGGMNTRRSSAASSTAPSALLGDIRALIEAARKRAASTVNSELTMLYWRIGQRIRTQVLDGRRGAYGKEVLPTLAAQLVKEYGGSFAEQNLRRMVQFAATFPDEQILVSLIRELSWTHFIALIPLKDPLQRDYYAQMASTERWSVRTLRERIDSMLYERTALSQKPGETIAQELAKMRDAQRMSPALVMRDPYILDFLGLRDTWQEGDLEAAIIREMESFLLELGAGFSFVARQKRIQIDGEDFHLDLLFYNRKLRRLVAVELKVGEFKAAFKGQMELYLRWLDKHEREPEEASPLGIILCTGKKREQIELLELDKSGIHVAEYLTALPPRGVLVERLQQATQRARLQIEQRKTDNE

SEQ ID NO: 28708 - protein, 130 aa, Pseudomonas aeruginosa
AWRDRAVAVDDSAGGGLIASCGLRCVAPSRAAHIFISPQGGYNCHMNATHKHSTHPDLVKRLKRADGHLRHVIGMIESGESCLDIARQLAAVESAVTAAKRVLIHDHIDHCLAHDEDSVLTEMKALTKLL

SEQ ID NO: 28709 - protein, 439 aa, Pseudomonas aeruginosa
GPPMLSVLKNRTYRHLFAAQVIALVGTGLMTVALGLLAYDLAGANAGAVLGTALAIKMLAYVGVAPVAQAFADRLPRRSLLVALDLVRASVALCLPFVSEIWQIYLLIFVLQAASAGFTPTFQATIPDILPDEDEYTKALSLSRLAYDLESLISPMLAAALLTVISFHNLFAGTVLGFLVSAALVVSVRLPTTVPGPRRGIWDRTTRGTRIYLATPRLRGLLAISLAVAAAGSMVIVNTVVIVKARFGLGESEVAWALAAFGGGSMVAAFALPRLLDKIADRPVMIAGATMLVVGTAAGAMIPTYAVLVVIWLVVGFGYSVAQTPSGRLLRRSAHPEDRPAVFAAQFALSHACWLICYPLAGRFGAAFGLQSTFIIMSLIGLVGVGLALWLWPASDSSDIAHDHPDLPPDHPHLREHADRGGHRHPMIVDDLHRDWARI

SEQ ID NO: 28710 - protein, 178 aa, Pseudomonas aeruginosa
PRPRLWSLRPGPGDAGNRLGQPGRAGDRARQAGPADRARPVFPRREAVERLRARCPVGRACRRLNQPLERRKALLALSQPSQEINAMSSHHDYIIEITAQHDALKPFAPENGQPLRFKIGDAVIYTNEFGAQFRRRVTGFYQPTEPSGLYARGRRYYLNSTSPWMPVAESSLRPDDSA

SEQ ID NO: 28711 - protein, 689 aa, Pseudomonas aeruginosa
PQGVITMNAVLKTEAVAIEAAAPLEMADPSKNLILVPLSQLLPRRSKRNARKMPRLSIPELAASIARIGLLQNLIVILSADGEAYEVVAGDRRLTALKLLAKKKRIPADYEVPCLLVPDASARTVSLAENLMREQMHPADQFEAFAALVKEGRPIEDIAADFGVSPLVVQRRLKLAHIAPRLMADYRAGTVTLEQLMALTITDDHAAQEAAFFGAPEWQRSPSKLRERLTEREIDASHALVRFVGLDTYRQAGGGVRRDLFAEGDAGTYLTDTAVLETLVRDKLATLAEDVRAEGWAWVEAVPHLAYEERQAFQNAPRHRREPTTREARRIASLETRLEKIDAELEEACDAEDKAKAEKLEQRRDQVVGELQDAEDALQGYAPEVREVAGAIVTIDRNGEAVIHRGLLREAEAKALRTLEKLRRGFGSAEGEAANDEHEDADDAPKAASLSDRLAQRLSAHRTAALQIEVARHPHVALAALVHGMVQTVLQPDAYGDGLPLGVRLTAQDRLEGMAPDWPESPAAVALRELQQVAGEALPEDSAELLAVLLAKSQDELVRLLAVCVASTVDVVTPRATAHQPGEELAQAVGLDIAAWWKPTAEGYFKHVSKAVILDAVGAFAPESVTRLAKLKKADIASEAERLADGTGWMPAIFKAAGPQNAAQEAGPEQDAPEDAEAMADEPAEALAA

SEQ ID NO: 28712 - protein, 278 aa, Pseudomonas aeruginosa
PGPRQRASRKSLRAGMPTLPHLLSEWFGPRRPCLVVNPGGGAAAPRAYGCNRPAKTISPPLRGFHAQQILFASRLSTAFRPQAVQPARPPPAGSQQGRDGREPCSTERRNHHGQHRHLHRRQRRLHRHAAHPDAQRQGQAGSQRQGQQRERPRLPPPGRRPRHRRGVEQDQRGRAGIQVRDPRRSFVPGSGLCPPDRRRGRYARPDLVAQQAPGGVTAAAPRPSRRGAVLLFAAHHHVTRAASPRRAPSAPPPAPGAPAPAARRPCACCRPRRPASAA

SEQ ID NO: 28713 - protein, 128 aa, Pseudomonas aeruginosa
GRRKTALSRTAWFSETASIRLRCVAGALKAMEVHTMRPAPLRPAATVSTAAAQPQRYLTNDEAAEYLRLSPRTLEKQRVIGGGPRFRKFGRRVMYAVADLDAWAADRSFETTSDPEYAEHHSADSRAR

SEQ ID NO: 28714 - protein, 240 aa, Pseudomonas aeruginosa
GNAAAVDNHHAATNAAAKARFSSTEDRAMIVALLNQKGGVGKTTLATHIAGELAMRGQHVVLLDADPQGSSLDWTQRRSQQGLPRLFSVVGLARETLHQEAPELARRADHIIIDGPPRIAALARSALLAADRVLIPVQPSPYDLWASAEMVALIREAQVFRPLLRAAFVINRRVSTTVIGREARQALADQPLPALRAEVHQRIVFADSVAAGRLARETAPDSAAAREITALVDELLRWPT

SEQ ID NO: 28715 - protein, 327 aa, Pseudomonas aeruginosa
TRAHPPARPLAALRGVPTGRRVLPHPLAGQRLRHRALAAHGDAGLHAARCGAAHPRRAAGREPAAARRGRERSARGAGAHRRHRGAGYRARRRLARVLAHARQPARCALAAARIHRRAARRLADREGAAMTAVSTADAAPRPRSARTGLLARIVLAGLSACGLAALAWASFVHPLPRLIYNPSDSVAVGWYRVDPLGYGAGSLPRPLSVDSIVLTTLPPDAAALAAQRGYLPARVPLLKRVGAIAPQEVCISGRIVRIDGVPSAAVLPADRWGRPLSSWQQCRRLEAGELFLLSVTNPASFDSRYFGPVSASAVIGIAHPIWLEARP

SEQ ID NO: 28716 - protein, 454 aa, Pseudomonas aeruginosa
WRPIRCTLLCISSCHRACRSGGSLRVVARAVPAHPRCTSRSLPMCRRLASNAPGLWPSPRSPARWLLTQQRRRAADARSASEGQRRKARQKDAAPGRVESQSAHGGCAARRGFAAVPLVARGPRRCRHVRVLRTTGHARACRGHNHDRPPRRRFPHPPWRPEEQGPGLRLQGAQAGRQGQQRQVHSAPCGLGAWHRPAARFAPGAWPYGGAFRRGEADANVAARDHQDAAGQPAPGQPAVARQAPALHRTRRRGPRWRAGPSLRAADRCCRPRRLQGTLRRRPTPFPLHPLARGWRGTRRPAHLHAVPHGPHGGRPGHGPRLGGGQPLEYRQPAHAHRRARARRHRQRPHHRGRLHRARLPPSRRRAGDRMAGATHRAGDPADLAARGGTGAMDEPGSHPATRGWPGWPGADRTLQRTAAATPTPVADRPPTTLAAPGPGRRNTARHLGRPCRR

SEQ ID NO: 28717 - protein, 183 aa, Pseudomonas aeruginosa
KDAAHPGRAWRHHQHHAACHARRAARAGGVRAGRGWPNHSRPRGREGAGRRAARPGLSGYRRGGRQSPLRRAQRPRRAGELSNRCRGGGEGIGRRARRRQEHRCAGERWAVPRRSSPRHRAGSGRTGPQSAGGRRSPHPPPRSPAPCRHCGACGRRAMEGAGRPGRTGPPLRRAAPRWRGRGT

SEQ ID NO: 28718 - protein, 99 aa, Pseudomonas aeruginosa
FPGCTCAMKRIIPLLLFAAMTACGQSEAPQKANISEANIPTVEELAANPERLKELRQQCKTDRPRLGDVLCNRVAEATRKRFYGDGATPYNPPKEPPKF

SEQ ID NO: 28719 - protein, 138 aa, Pseudomonas aeruginosa
KTALARPSCPARKPSAPRAGLFWKRLSLPTKWSRASSTARSRAVSPSTSTASARSCRVRWSTFVRFATPPTWKAKSSSSRSSSSTRSATTLSFPAAASWKPRTAPSVKLCWNRCRKASRSRVSSRTSPTTAHSWTWAA

SEQ ID NO: 28720 - protein, 198 aa, Pseudomonas aeruginosa
SNWAKTRGLPSRRVTRKAPASWLASPTSPTTAASPSWKRAWKAWYTSPKWTGGGGTSIRRKSSKLVKKWKFRFWTSTKTSSYLPGYQAVQIQPVGKTSPASSTRVTVSPVPSSRSPTSVSSSVWTAALTAWSTCPTSPGTKSAKKPYVASRRATSWKPSSCRSTRSASASPWASSSWKTIRSPTTRPCTRKAASSAVP

SEQ ID NO: 28721 - protein, 102 aa, Pseudomonas aeruginosa
PLEKEGKTMTKSELIERIVTHQGQLSAKDVELAIKTMLEQMSQALATGDRIEIRGFGSFSLHYRAPRVGRNPKTGESVRLDGKFVPHFKPGKELRDRVNEPE

SEQ ID NO: 28722 - protein, 123 aa, Pseudomonas aeruginosa
GLLESLPGLCGLECYSHLDDYTMLGRSGGMGVLLEGGLSYHVLLVWLESLDGGLVHGIVSLPVGLRQRSSFYGTTFVSDGQDALRLLAESFMYCLHVIHPVEFAVGNVSSGRSVFPLLVCKNF

SEQ ID NO: 28723 - protein, 352 aa, Pseudomonas aeruginosa
LDFSMTDEIQKHGGVAGDIDLVELVRGLWEEKWIVLIFSLLGILFAAIYAFLSTPVYEARIAILPPSLSDVAGFNQGRTRETGLGPFKVQDVYSVFVRNLQADGTRHRFFNETYLPSLDEELRSVSRDALYKRFTDQISISLPGKDFPGRYLVAIEQEDPERAASWVRRYIADAAEISIQEMLNNAHREIEVKARDIEQRIQNLRENAKARREDRIVQLKEALKVAGALKLEEPPLISGQSSEELSAIMNGSLMYMRGSKAIMAEIQTLEARSSDDPFIPALRTLQEQQLLLSSLRVNSERVSVFRQDGPIETPDSPVRPRRAMILIFGLIIGGVLGGFLALCRIFLKKYAR

SEQ ID NO: 28724 - protein, 359 aa, Pseudomonas aeruginosa
LLTAVASTAPRRHTSSRLDHPSQHVHPLVPEGRADPLISIGRTMKNFALIGAAGYIAPRHMRAIKDTGNCLVSAYDINDSVGIIDSISPQSEFFTEFEFFLDHASNLKRDSATALDYVSICSPNYLHYPHIAAGLRLGCDVICEKPLVPTPEMLDQLAVIERETDKRLYNILQLRHHQAIIALKDKVAREKSPHKYEVDLTYITSRGNWYLKSWKGDPRKSFGVATNIGVHFYDMLHFIFGKLQRNVVHFTSEYKAAGYLEYEQARVRWFLSVDANDLPESVKGKKPTYRSITVNGEEMEFSEGFTDLHTTSYEEILAGRGYGIDDARHCVETVNTIRSAVIVPASDNEGHPFVAALAR

SEQ ID NO: 28725 - protein, 392 aa, Pseudomonas aeruginosa
AAAAERAGRSCLLTLRCALCTQWKDPEQGGRVTMIEFIDLKNQQARIKDKIDAGIQRVLRHGQYILGPEVTELEDRLADFVGAKYCISCANGTDALQIVQMALGVGPGDEVITPGFTYVATAETVALLGAKPVYVDIDPRTYNLDPQLLEAAITPRTKAIIPVSLYGQCADFDAINGIASKYGIPVIEDAAQSFGASYKGKRSCNLSTVACTSFFPSKPLGCYGDGGAIFTNDDELATAIRQIARHGQDRRYHHIRVGVNSRLDTLQAAILLPKLEIFEEEIALRQKVAAEYDLSLKQVGIGTPFIEVNNISVYAQYTVRMDNRESVQASLKAAGVPTAVHYPIPLNKQPAVADEKAKLPVGDKAATQVMSLPMHPYLDTASIKIICAALTN

SEQ ID NO: 28726 - protein, 439 aa, Pseudomonas aeruginosa
RMYILARVDRSILLNTVLLFAFFSATVWVNNNYIYHLYDYMGSAKKTVDFGLYPYLMVLALICALLCGGAIRRPGDLLVTLLVVILVPHSLVLNGANQYSPDAQPWAGVPLAIAFGILIIGIVNKIRFHPLGALQRENQGRRMLVLLSVLNIVVLVFIFFKSAGYFSFDFAGQYARRALAREVFAAGSANGYLSSIGTQAFFPVLFAWGVYRRQWFYLVLGIVNALVLWGAFGQKYPFVVLFLIYGLMVYFRRFGQVRVSWVVCALLMLLLLGALEHEVFGYSFLNDYFLRRAFIVPSTLLGAVDQFVSQFGSNYYRDTLLGALLGQGRTEPLSFRLGTEIFNNPDMNANVNFFAIAYMQLGYVGVMAESMLVGGSVVLMNFLFSRYGAFMAIPVALLFTTKILEQSLLTVMLGSGVFLMLLFLALISFPLKMSLGKTL

SEQ ID NO: 28727 - protein, 265 aa, Pseudomonas aeruginosa
IRYAVIQKLRGACLMVRRRVIPCLLLKDRGLVKTVKFKEPKYVGDPINAIRIFNEKEVDELILLDIDASRLNQEPNYELIAEVAGECFMPICYGGGIKTLEHAEKIFSLGVEKVSINTAALMDLSLIRRIADKFGSQSVVGSIDCRKGFWGGHSVFSENGTRDMKRSPLEWAQALEEAGVGEIFLNSIDRDGVQKGFDNALVENIASNVHVPVIACGGAGSIADLIDLFERTCVSAVAAGSLFVFHGKHRAVLISYPDVNKLDVG

SEQ ID NO: 28728 - protein, 358 aa, Pseudomonas aeruginosa
ARFHMKILTIIGARPQFIKASVVSKAIIEQQTLSEIIVHTGQHFDANMSEIFFEQLGIPKPDYQLDIHGGTHGQMTGRMLMEIEDVILKEKPHRVLVYGDTNSTLAGALAASKLHVPIAHIEAGLRSFNMRMPEEINRILTDQVSDILFCPTRVAIDNLKNEGFERKAAKIVNVGDVMQDSALFFAQRATSPIGLASQDGFILATLHRAENTDDPVRLTSIVEALNEIQINVAPVVLPLHPRTRGVIERLGLKLEVQVIDPVGYLEMIWLLQRSGLVLTDSGGVQKEAFFFGKPCVTMRDQTEWVELVTCGANVLVGAARDMIVESARTSLGKTIQDDGQLYGGGQASSRIAEYLAKL

SEQ ID NO: 28729 - protein, 324 aa, Pseudomonas aeruginosa
WARSMKAVMVTGASGFVGSALCCELARTGYAVIAVVRRVVERIPSVTYIEADLTDPATFAGEFPTVDCIIHLAGRAHILTDKVADPLAAFREVNRDATVRLATRALEAGVKRFVFVSSIGVNGNSTRQQAFNEDSPAGPHAPYAISKYEAEQELGTLLRGKGMELVVVRPPLIYANDAPGNFGRLLKLVASGLPLPLDGVRNARSLVSRRNIVGFLSLCAEHPDAAGELFLVADGEDVSIAQMIEALSRGMGRRPALFTFPAVLLKLVMCLLGKASMHEQLCGSLQVDASKARRLLGWVPVETIGAGLQAAGREYIFRQRERRK

SEQ ID NO: 28730 - protein, 359 aa, Pseudomonas aeruginosa
RTHPNPWSAITLNFNKVLFPMMIWMIACLVVLLFSFVATWGLRRYALATKLMDVPNARSSHSQPTPRGGGVAIVLVFLAALVWMLSAGSISGGWGGAMLGAGSGVALLGFLDDHGHIAARWRLLGHFSAAIWILLWTGGFPPLDVVGHAVDLGWLGHVLAVFYLVWVLNLYNFMDGIDGIASVEAIGVCVGGALIYWLTGHVAMVGIPLLLACAVAGFLIWNFPPARIFMGDAGSGFLGMVIGALAIQAAWTAPSLFWCWLILLGVFIVDATYTLIRRIARGEKFYEAHRSHAYQFASRRYASHLRVTLGVLAINTLWLLPLALMVALGWISGFIGILVAYAPLCLLAVGYKAGSLEKS

SEQ ID NO: 28731 - protein, 122 aa, Pseudomonas aeruginosa
KWSPGERGSPAAGRGGRRCRRKPTSPSVVPVSCSGCPALCCATSRELVCKTPSCKPNWWNWQGLRHFGYHLLHILLRRAGVQINYKRIYRLYRAVGLMVKRRRRRHRGAVACECLSLPSAPN

SEQ ID NO: 28732 - protein, 71 aa, Pseudomonas aeruginosa
VLSMDFVFDALSTGRRIKCLTVVDDFTKESVGILVEHGISGFRVTRALDEMARLRGYPKAIRTPRVHRQGA

SEQ ID NO: 28733 - protein, 442 aa, Pseudomonas aeruginosa
KGEVKPLPMTSPFSLQDLDDGLGDGLQVRFVQRGDADTAGADGVDTELGLQALDLVGGQAGIGEHATLATDEAEVALGAVGCQLLDHRQAHVADAVAHLAQFLLPEGPQFRAVEHGGDDAGAVGRWVRIVGADHSLHLGQHAGRFIAAFGYDREGADAFAIEREGFGERAGNEEAQARLGEQAHRGGVFLDAVAEALVGDVEERHVALGLEHVQHLFPVVQLEIDAGRIMAAGVQDHDRTGRQGIQVFQQAGAVHAIAGGVVIAVVLHREAGGFEQCAVVFPARVADGHGGVGQQALEEVGAELERAGAADGLGRDHTAGGQQLGLVTEQQFLYALVVGGDPFDRQVAARRVGLDAGLLGSLHGTQQRNAPLLVVVHAHAQVDLARTGIGVEGFVQAKDGITRCHFDGRKQTHFAAARSVKRGGQRNPLCGGAKGCANGGLL

SEQ ID NO: 28734 - protein, 555 aa, Pseudomonas aeruginosa
SRVLPEDGPAPGPRRPHRPARTAAATDQPAVHPQRHGFRPCDFPCAWRCDRHLPGRIRSRGDSCRVVRRRGGKPLGLRSAHRRGDPQAAALHLLPQEPLRDPARDAAGGGRPDQGRTQGTPGLPAQQQQAGGSAAPGAAHPFRPGDDPRAGLLQRHRELLALSFRAGPRRAAADALRLPAGQLAAGYRRIARQRSAGRRDVQGRPLAQGDPGGIRFPPAFGAGQPAAALRRVGGGESADHLRLRHPGPLRGGACRAGHRAGGASHRAGRSGDRGTSGDDPGGRPALADPPACGQGRAGAGDYPDQAHGRGPHRLSRRSRRAGALLALGHRYRRASGDHPRPARRCVRRAGGDQPAARRPGHARGVAGGDPRRGQGRLPALGALADPDHRSCRAQPARQGDPLRRQRHRLDAACDRRDRAASGQADRLQRSPWHRAQGGAQGHQGHSRRRRGARRARQAQGRGQGGGGERALRERTALAERDQQAHPPTGGKDVPVGPRPGVRGGGATARRDPDAARAPGQRLILSEPRRRRGCRCRPAASGSAAPRACSLRAPCR

SEQ ID NO: 28735 - protein, 217 aa, Pseudomonas aeruginosa
APRSSRAGSVRQAAGPAPQRSRSSTSASTDMPGRMRPCSGLSASNTIFTGMRCTTLVKFPVALSGGSRLNCAPEAANRLSMRPSIGVSGKASKVRRAFCPSRMRPTWVSLKLAWTQMSSSGTSDSKWVPTCTYWPLRALRWPTRPLIGEWIRVRDRLISACASSVRALAICASRRLISAPRVSRWTRCASRSARALASCERATWLSAVRVVTRSSET

SEQ ID NO: 28736 - protein, 502 aa, Pseudomonas aeruginosa
LPLGKRVSMTTVRTRIAPSPTGDPHVGTAYIALFNLCFARQHGGQFILRIEDTDQLRSTRESEQQIYDALRWLGIEWDEGPDVGGPHGPYRQSERGHIYKKYSDELVEKGHAFTCFCTPERLDAVRAEQMARKETPRYDGHCMHLPKDEVQRRLAAGESHVTRMKVPTEGVCVVPDMLRGDVEIPWDRMDMQVLMKADGLPTYFLANVVDDHLMGITHVLRGEEWLPSAPKLIKLYEYFGWEQPQLCYMPLLRNPDKSKLSKRKNPTSITFYERMGYLPQALLNYLGRMGWSMPDEREKFTLAEMIEHFDLSRVSLGGPIFDLEKLSWLNGQWIREQSVEEFAREVQKWALNPEYLMKIAPHVQGRVENFSQIAPLAGFFFSGGVPLDASLFEHKKLDPTQVRQVLQLVLWKLESLRQWEKERITGCIQAVAEHLQLKLRDVMPLMFPAITGHASSVSVLDAMEILGADLSRYRLRQALELLGGASKKETKEWEKIRDAIPG

SEQ ID NO: 28737 - protein, 441 aa, Pseudomonas aeruginosa
RRGSDGRGGAHRRRLLCPLPEQGCADARGVRAIARQAPRTARRTRSRIVGKGASCLGGRLLPVAQASGRTGRRRLSAAGDPSRGGAPAGGVSRGLEQTCRDHGRQPGGKSRGNRRRPGRPGADDWRFGAGPGIGAGGAVRPGSACRQAGGELRRCEMSSLTWIRGFNGTIGRIAPRWTAERMRRTFMVPGEWPPKDWELPLLASSERVTLRFGLSVLRWGEGPAVLLLHGWAGRPTQFAHLIEQLVGAGYSVYALDAPAHGRSPGREANVVLFAHALLEAAGELPPLRAVVGHSLGGAAALLAAQMGLRSEALVTVSAPSRILEQLRLFARFVGLPALARSHFIRLVERQAGISAACLDVARYRLEMPGLVVHADDDTRVAVENAERIHAAWPASRLLRLPGGGHHRLLGERRLSESLLALLEERPAMRACRRVEKTASAS

SEQ ID NO: 28738 - protein, 395 aa, Pseudomonas aeruginosa
QRGCRCPDLGSSVKSAVARAERSGGASRFESRNAHDIAAGSGPAAGQPGIAGAGDRGRGAGARPGARVVCGRRHGVGSDAAHAAGAGRDRRHPSRGARGPAGGGYPDPHRAVSRGTRRGRAVRRQPRMHAAPCRRRGGCRPAIPARGDDAFGSVAGAGVRLSLAEAVPGRWHCQRENAEKPEGAVHRHPLLPDRRGQPGQPAEFPPPAQCRLCRRHLAGAAEPDPGAGLGSDHTTGQGSARTGRQPGAALMNWDYADPFVIDLRVLAEDIDGLGHANNAVYVSWLERCAWRHSQRLGLDLAEYRRLDRAMAVLRHEIDYLAAAYEGDELQLATWIVESDQRLRMNRRFQLVRPADGATLLRAQTTFVCIELSSGKPKRMPAEFIDGYGQALLAGA

SEQ ID NO: 28739 - protein, 164 aa, Pseudomonas aeruginosa
WCMPGPRSMATGRRRTGSGWRGWPRRCACRCSPMAKCGRSTTTCVVARSAGWRTSCSVAAWSRVLAWLGRSPPGAMAAKSTRCPGASCCRCCATSGYRPGASSPRAMPRGVSSSGWACSRAPIPKPSSCSRGFAGKAIAKPSTGCCRCRSARRPSLRSRPSGRR

SEQ ID NO: 28740 - protein, 87 aa, Pseudomonas aeruginosa
AALQLVFGSSASNSDRCSSRGAALEDGVGRIASAKVEAEGLVEGAGAVQIAAGEGRDCAFHSDGSRKDEFRSEHDERSFSRLLKYFR

SEQ ID NO: 28741 - protein, 164 aa, Pseudomonas aeruginosa
RRVSHRHRRRRLPGRRPGPAGRARRADRQWRQAREVHGQRDLPAPGHRPARLQAVVPPRRSYRGQGGFAGQRPAEHRPGAAGSGRSQAEAYRHQWPAPGTGQPVTVSGDRKKAPSGAFFHFVALSARGSAGRPSGTSSSRTSRSTAAAIARLPSSLGCRWSPES

SEQ ID NO: 28742 - protein, 146 aa, Pseudomonas aeruginosa
IRRFRGRKLFFLALHPQEAIQMSDDIQRYPSSLPFPFSRAVRAGGFLFLSGQVPMSPTGEVVRGDIQTQTEAVMARIGETLESCGARFDQLVKVTVWLSDMAHFAGFNEVYQRHVQGALPVRSTVTAGLALGVDVEVEVQAWVGEG

SEQ ID NO: 28743 - protein, 90 aa, Pseudomonas aeruginosa
NTWACGRTRRSPTSSWTGYSSVPAPTRGSRTCALPPKWPGAARSPRPSSRRWWCRVPGWSRSRPRRKAWTGSSSRPASNGASRAVPCAWR

SEQ ID NO: 28744 - protein, 327 aa, Pseudomonas aeruginosa
WQGAGFRGRPVPQALPAQRPRRHRPDAAGRRCDPCLRGRLPPAAALAVPLSATRVPLPGASWVGCARFFSRSRFMSDHDDVVQRQFGAQASAYLSSAVHAQGEEFALLRDALAGRPEARVLDLGCGAGHVSFQVAALAGEVVAYDLSAEMLAVVAQSAAERGMANIRTEQGKAESLPFADGEFDFVFSRYSTHHWRDVGLALREVRRVLKPGGVAIFVDVAAPGQALPDTFLQTVELLRDTSHVRNYSPAEWARLSGEAGLLVTGSRRQRLRLEFQSWVERMRTPEVFRQAIRSLQLAVGEEVREYFEIADDGSFSTDVLVLWLRRE

SEQ ID NO: 28745 - protein, 213 aa, Pseudomonas aeruginosa
RYRPGNHGGSGQGAGTGQRQVPARLRTGRGRHRWRGHRQARRAAGRPDPAARAPGRCGAAGRGRGAEVGQDRTRYPSRARSAEDSLATGPVRQPASGHPLSATGRGLQPEAGSGRRAGHPHRPRTDRRHLLRPAPRAARAGERRAPSLRHPAVQRERNPSYRPRRFRHGPRTQQQALLGGQGQRPRLQPTVAGSGGRGGEGLPGRRAFPYVRG

SEQ ID NO: 28746 - protein, 187 aa, Pseudomonas aeruginosa
WLPASSLLSYRCSCDEACRSDRLARDGGFRTHAADAGRAGLRPDRAGVLHHVERRWPGPGSGQGHRSAEGRLQHRRAEDPRRDPDLPGRRLHQRSIPQAARGRLAGLLDRCRLQSAHGRRRGDRPRPGQPQGHRPGSGRRHPQLHRRQLHRQPDADGPGRAVRRRPGRVDECHDLPGRLRRRRAEHA

SEQ ID NO: 28747 - protein, 202 aa, Pseudomonas aeruginosa
PGQPGQRDPRHRPQGGGDPAQRSLPHRAFRRAAGRQPDPLDRQGTAQRAEPRGVESPGGDQQDPRPLQEPDPGRRYLRARRRHALPQPGADHQVEQGCAADRHRGPDQPAQSLGQAGAEPPRGKRARADPGRRHRHPERSGRAPAQAEHGLPVSRRLHRWRPVAVGRCRAAAAHAAHPAGALIDPAPPAMGGASIAWAKVGK

SEQ ID NO: 28748 - protein, 349 aa, Pseudomonas aeruginosa
SATPISQTAEAFPMSQPLNVAVVGATGSVGEALVGLLDERDFPLHRLHLLASAESAGQRMGFAESSLRVGDVDSFDFSSVGLAFFAAAAEVSRAHAERARAAGCSVIDLSGALEPSVAPPVMVSVNAERLASQAAPFLLSSPCAVAAELCEVLAPLLATLDCRQLNLTACLSVSSLGREGVKELARQTAELLNARPLEPRLFDRQIAFNLLAQVGAVDAEGHSAIERRIFAEVQALLGERIGPLNVTCIQAPVFFGDSLSVTLQCAEPVDLAAVTRVLDATKGIEWVGEGDYPTVVGDALGQDETYVGRVRAGQADPCQVNLWIVSDNVRKGAALNAVLLGELLIKHYL

SEQ ID NO: 28749 - protein, 975 aa, Pseudomonas aeruginosa
KILTHRFVELIELVNTGSIRCCRGASVHAWLGERTASTDALPLVKREKILKPRDYTMVRLRTLVRAIAAASVLTSGMAHGLGLGEITLKSALNQPLDAEIELLEVRDLGSGEVIPSLASPEEFSKAGVDRLYYLTDLKFTPVVKPNGKSVIRVTSSKPVQEPYLNFLVQVLWPNGRLLREYTVLLDPPLYSPQAAASAPQAPVSAPRATGAPRAPQAPAPVRTTAPAGSDTYRTVSNDTLWEIAQRNRTDRVSVPQAMLAFQELNPGAFVDGNINRLKSGQVLRIPTEQQMLERSPREALSQVQAQNQSWRGSRNPAAGSAGARQLDATQRNAAGSAPSKVDATDNLRLVSGEGKASKGADKGGKGDSKALADTLAVTKESLDSTRRENEELQSRMQDLQSQLDKLQKLIQLKDAQLAKLQGQLGAEGQGAAQPNAALPDASQPNAAAQAPAQPGTPAAAAPTPAPAGEAPAAPAQPPVAPPPAPAAEKPPAPAVPAPAPVQAAEQPAPSFLDELLANPLWLAVIGGSALLALLVLLMILSRRNAQKEKEEVQAFAADAGEEQEDALDLGKDGFDDLTLDEPEPQVAAAAPQVEKTTAQTSDALGEADIYIAYGRFNQAAELLQNAIYDEPQRTDLRLKLMEVYAEMGDREGFARQENELREIGGAQPQVEQLKSRYPAMVAVAAVAGLAGAKLAQDELDSFSLDDLSLDDSGHAAKPDAAGQDLDDAFDLSLDDLGGDDVQADLKSDSGALDDLTLDSDLDLAASTAADKPVDDLDFGLDFAELAETPSQPKHDDLGDFSLDLDAPEDKLSDDDFLLSLNDEVPAAAPADNEFTLDTEAAEEPALSLPDDFDLSLADEPTEPAAPEKGEDSFAAQLDEVSAQLDELASNLDEPKSATPSFSAEDAAVASALDGDADDDFDFLSGADEAATKLDLARAYIDMGDSEGARDILDEVLAEGNDSQQAEARELLERLA

SEQ ID NO: 28750 - protein, 292 aa, Pseudomonas aeruginosa
SGNEATLMNDVVPPAAAESAAAGVSRIALGIEYKGSRYRGWQRQEAGVPSVQEALERALSKVAAEPVGVICAGRTDAAVHASGQVVHFDTAVERPLKAWVMGTNANLPADISVTWARVMPAHFHARFSAMARRYRYAIYNDPIRPAHLAEEVTWNHRPLDIGRMREAAQVLVGTHDFTSFRAVQCQAKSPVKTMHHVRLLEHGRLIVLDIRGNAFLHHMVRNIAGVLMTIGAGERPIEWAKEVLEARDRRAGGVTAHPYGLYLVRVEYPGEFELPERYLGPHFLSGLPDIVG

SEQ ID NO: 28751 - protein, 339 aa, Pseudomonas aeruginosa
PRRRGMGQAAKRFAAVGPTAAGGHEDEFAQGRRHRIGAAIPTLHWRTKSMSNWLVDKLIPSIMRSESQKSSVPEGLWHKCPSCEAVLYRPELEKTLDVCPKCDHHMRINARTRLDIFLDEDGREELGADLEPVDRLKFRDSKKYKDRLAAAQKDTGEKDALIAMSGKLQGMPVVACAFEFSFMGGSMGAIVGERFVRAANVALEKRCPLICFSASGGARMQEALISLMQMAKTSAVLARLREEGIPFVSVLTDPVYGGVSASLAMLGDVIVGEPKALIGFAGPRVIEQTVREKLPEGFQRSEFLLEHGAIDMIVHRAELRPRLANLLSAFTHSPSPVSA

SEQ ID NO: 28752 - protein, 156 aa, Pseudomonas aeruginosa
SSCRCCSPAKTSRARSWWKRRRARNRRPCPVSRCSRPRCRNCSPAKKATLPRSSRKAPRPPPASPASRSAACRRPRRPPSRPPRPRRRPPACRQASRNRPLRRRARRPRRSAWTPTTCRRAGRYSLPACPTGRAPRNCRRPCAPRATTPTSAASTG

SEQ ID NO: 28753 - protein, 191 aa, Pseudomonas aeruginosa
NAAPFLLVGCIVAFTWVDWTMVAIIVVSSLISLSRGFVKEALSLLTWIVAGAVAWMFGGALAQHLGEYIQTPSARIIAACALLFIATLLLGALVNYLIGELIRVTGLSGTDRFLGMVFGGARGVLLVVLLVGLLSLAPVQQDPWWQQSVLMPHFLMVADWSKNFILGFAGQWLPAAPITPPSGIGGLLPSQ

SEQ ID NO: 28754 - protein, 436 aa, Pseudomonas aeruginosa
TGSNRRATMRPRPRARRSARSSICTTTDKGESGMTQDWDAGRLDSDLEGAAFDTLAVRAGQRRTPEGEHGEALFTTSSYVFRTAADAAARFAGEVPGNVYSRYTNPTVRTFEERIAALEGAEQAVATASGMSAILALVMSLCSSGDHVLVSRSVFGSTISLFDKYFKRFGIQVDYPPLSDLAAWEAACKPNTKLFFVESPSNPLAELVDIAALAEIAHAKGALLAVDNCFCTPALQQPLKLGADVVIHSATKYIDGQGRGMGGVVAGRGEQMKEVVGFLRTAGPTLSPFNAWLFLKGLETLRIRMQAHSASALALAEWLERQPGIERVYYAGLPSHPQHELARRQQSGFGAVVSFDVKGGRDAAWRFIDATRMVSITTNLGDTKTTIAHPATTSHGRLSPEDRARAGIGDSLIRVAVGLEDLDDLKADMARGLAAL

SEQ ID NO: 28755 - protein, 291 aa, Pseudomonas aeruginosa
PGRQPARVSHRLSRAVPGDCGCRRACRAPRPGAGATCRLHRAAPAVAAEDPAGAALSGDPDGRFAGHRRLPAGLRGARRGPGVHRQRADPATVDPRADRRQRLGQGLGRAGLRRGDRRGDRLPLRAAQGCLSRALAWLPAARAAGRSAGAFHRHRALRLDPGDPHPQRRAAGGGAGDRRRGDRQPDHPQRSGQGRAEGPRGRQPDPLAGSHRTVPADDAAHDRQRRALRRAGPDAGAHRAQPGERPGGADRPDGRPVRTVHADIHGRGGAGHRPGHSSSDPFSQPTRGVIA

SEQ ID NO: 28756 - protein, 380 aa, Pseudomonas aeruginosa
AATVSACHGSRWRGDEARAWFHPAGSAGGPGDLRHGRGQRAQCQRAQPAERLAAGRQDPGDVDRRQPSQRIATGTDAALQRPQPGRAGVRRAPLGVAHPGRQHRRAGYAAGDRLGRGEAPRPRAWQHRGTRRGAPRRFPREPAMRLQRGFTLLELLIAIAIFALLALATYRMFDSVMQTDQATRVQEQRMRELVRAMGALERDLTQAVERPVRDELGDNRGAFLSEGENDQIVELTRGGWRNPLGQARSRLQRVRWSLSGETLERRYWLVLDRAQDSKPRVQQVLDGVTALSWRFLDKEHNWQGHWPTDEGSEEERLESLPLAVEMTLEHRHYGKLVRVWRLLDPPLKQDQPQGQPGGENGENGEGGVPQPPEGMPGAPE

SEQ ID NO: 28757 - protein, 358 aa, Pseudomonas aeruginosa
WPATWGRAACPSRRRAATIGRRTSDEWSECAVPAARQHGGGRWGTGGMVGAGWRVPARAVRPGAGGDPRALAAVPAGGGGDRLRGEPAYTEGALVAPVAAFRGGGTTGRRCRADAPCPWVGAGRRPPPGIRRAAHLACRLAGAGRGRGQGAGFAACRCRLPAGRGQLPVLAGRALVARRQRRRTPGLRQRGLAGTARQLPAAPAGLRRAGGGGPGGSGSPAPGGQSARLAERAAAGHRPGPGRVRRAPAEQPVAPLAAAAGAGRAVAGVAMGLYPGPGLAVAARRRPLRGAERRTLPPVVSRGPQADQPARAVRPAPGRQRQQRRRGPVARPAWPGRHGDRRRANGERRATGLQRRSR

SEQ ID NO: 28758 - protein, 127 aa, Pseudomonas aeruginosa
NTGLSRRGSRVRVPSAAPFTSPPEFTTPNSPSSTRRRAAWLQQEEVALPGILPSRRAAVVQSVRIPACHAGGRGFESRPLRHTSSPRRGGVSHEESGQWPLFSFPSSPAPSVFSLFAGFPAPSVRAR

SEQ ID NO: 28759 - protein, 410 aa, Pseudomonas aeruginosa
PEIDQLRTAAGIGLAHALRRTEQALAVFGDVPQAAMGEGHGGAARTAGQQALADRQVLPGLGVAQAVRRQAYVAGNQLRIEAGPGLLPATALVQGGGDRQQFDALFDQGGVGVRVPAVGADQHAQASCRRIQHLQALAATVVEVAQFVAGREHLALRLAERPAVGTEGQADVVQLAGAGTQLAVLDLGVGQDDGAGDHRHLEIMGEPAEQGLVVVGHVHRLHPEQGVGETLIAARGDPAARHLQWVARGHPVHRRGPVGSGVDLGLLAAGHQPGADMLGEHHHRALVEQALAAGIFQVGVEFQLQPFGALVVRREQFRLDRQQVAALAGLALDHADLAAQVGQVVAYRAAFGPAGVGGEEGDEDQEDQLAHAGLQGSPQGRGVASACQASLCIPISNLSFRIIERSGGAP

SEQ ID NO: 28760 - protein, 591 aa, Pseudomonas aeruginosa
GGWQDLHADPACRPLRLQSEARGAERDPGADQSVQAQGTRRGRHPEADRRLRQLRQPGPGRRLRRRRDHGIGRLLHQPVPRAAHQPAHRPLGRQLREPHAPAGGDRPPGARGGGAELHHHLSPVDARPGRGRQQLGRDRAAGEGRREGRRDPDQYRHRLARGAHPDHRHQGTARGLHQGHRQAARRGRHPADHHQPHQHSRGGGEGPGRGRCRHGLHGPAVPRRPGFRQQGRRRPRRTDQHLYRLQPGLPRPHLRRQADQLPGQPARLPRNRAELHPHHQAEKNRRGRRRPGRPGRRHRGRRAWAPGQPVRRRRRDRRAVQRGQAGSRQGRVPRDPALLPQQAGEHRCRTAPEPPGRRGQPGRGRLRRDRPRHRHRSAHTGDPRHRASEGDQLPGCDPRAQAGGWQGGGDRRRRHRLRRLRIHHPCRSVHQPGARGVLEGVGDRYSPGSPRRHRRDQGRGASGGAPGVPPATQEEQGRRRPRQDHRLDPSRRREEQAGADGECRGVSRDGRRRPAYPRCRGRAAGAAGGYRDRLRRPGPAARVAGRPAGGRPERAPDRWRRRRRRAGCQARHQPGFAPGRRTLRAFPRSVA

SEQ ID NO: 28761 - protein, 526 aa, Pseudomonas aeruginosa
HARWVLPDAGRLARRSRVSDEHAEKATDGGGRAVLQRQRRLQGNAVSRIRGAARWPGAHAGIRRPADAPGLCVDQSAPAGAGGGVLLSRFRRAGRRRHRLEPASAQPRRTRRTRPRHGRRADPPGLSQPVPGVLAPDAPLGPGEQRRTQPFRAHPRRAQAQPAGPAGGRRACRGGAAAAADGRRRAMVRRRSRRPEGTARGASAQAGGRADGAPGATGQAAATTARRPGPAAGAAPGRARPAARRGTGQARTGRPRATGHPAQRSAQPATGPGTAGAGERRIAAASAGAGRAVPAQPRGTDPATAFHREPGAQRDRPAALGVRRRTGGSSGGGGGRLQGAGLDPRRRTGLPQRAGPATGAGTGRAARRARPSGRPGAGATAGASIRPGRGIRRLPSRRRAPDHPLAGHPALPGQSAGLRGGQVLRLREPVPPVAGPLPAAALRGAAARRRTLQPAARPGRQPGALRRRRHQLLRPAQDHGAPAHRELTPCRFPTGHRIHPCSVSNSTGCNGPGSNWRCCAWTRPIR

SEQ ID NO: 28762 - protein, 308 aa, Pseudomonas aeruginosa
SALSRPPAFRRNRMEPFPKIGIIGRLGSTQVLDTIRRLKKFLIDRHLHVILEDTIAEVLPGHGLQTCSRKIMGEICDLVVVVGGDGSMLGAARALARHKVPVLGINRGSLGFLTDIRPDELEAKVGEVLDGQYIVESRFLLDAQVRRGIDSMGQGDALNDVVLHPGKSTRMIEFELYIDGQFVCSQKADGLIVATPTGSTAYALSAGGPIMHPKLDAIVIVPMYPHMLSSRPIVVDGNSELKIVVSPNMQIYPQVSCDGQNHFTCAPGDTVTISKKPQKLRLIHPIDHNYYEICRTKLGWGSRLGGGD

SEQ ID NO: 28763 - protein, 98 aa, Pseudomonas aeruginosa
NGRYAFSPEPAMSSFNQAIENITPEIYQNLKLAIEIGKWPDGRKLTQEQKELCLQAVIAWELQNLPEEERTGYMGPQHCSSHSDEPIPNILFKSDSVH

SEQ ID NO: 28764 - protein, 65 aa, Pseudomonas aeruginosa
VASPPPSAPNSSATRCCSPTATRWPAVPKATAGTGRPGKTRSRSRPTCSPWSPATSGASRTASAP

SEQ ID NO: 28765 - protein, 564 aa, Pseudomonas aeruginosa
HPDHGQAQRLLQPQRSIAAEPELSPRRPFHQPDPRYRRAQGGNPRRLRLRQLGHRQHAAERALRPPGVQLGRGHLLPWRGQHHQPGGRRQVPPARFRAQGSADAGGSAELQHRPDRQPVDGNLLPVELEGNPPRPGRYLLLRDRPVRRRRQHRLQRLHRHRAGHPGARLRQRHRPVPGAGQQSAAQRRAEEHRPICQRRDPGLRQRDEGVVHRQGHQRAQRRPVRRGLPLHRRGTEQHRVRLLLRQLPLQGADPVRRHRRLCRGRPGGAGQHPAADRRQPRRSPGQRPGDRRRDGQHQCPPRVRRRHPHVRLQLQHHGGRRLGVRRAGLPAEPADRHRRHQRPDRRPRPRCGGSRQRRADQRRRADGRPRRADPQLRAGRGVQHLPRDHLQLRSVAELRLVDRRRRAGFGTPARQQPEVHRLRRQHPLLCRARQQLVRFRRRPWRPGEPQRLRLHPAAQRHLERRVRRGQRVALRGLQGRLRRQLLPDRQLHRRSQGLHPGDQGHLPEQPGRRTAVHRVLRRRAEQQHPRPRQHRPDREVLLLTEPITTRAPRAPGTSHGEPSC

SEQ ID NO: 28766 - protein, 236 aa, Pseudomonas aeruginosa
PSPPPRSWPSRRQPPRRRNSPWNRRRPPAACCSASPMPASGWSRSATVGISCSPTTTARPGPRPRCRPASCSPRCSSSTSARAGRSGTMRRSSSATTPAAPGPGSSRTSAAKRRCWTSGSPTNSTAWPSVPMARCWRPATAASTGKTSASAWTTRTSSTSTPSPRSRTTACWWSAKPAACSARRTGAPPGKNSKAPTRARCSAPSVPPMRAACWSTACAATCSAPPISATAGKRYR

SEQ ID NO: 28767 - protein, 789 aa, Pseudomonas aeruginosa
TSISKTRRALVERLIFNNRPVVIFLCLLVSVFLFYQATQVRPSTSFEKMIPLEHPFIQKMLEHRNDLANLGNTVRISVEAVNGDIFTKEYMETLRQIHDEVFYIPGVDRSGLKSLWSPSVRWTEVTEEGFAGGEVIPQTYDGSPRALEELRNNVLKSGQIGRLVANNFKSSIVDVPLLEMYPNPKNQSELIKLDYRQFSHELEEKIRDKYQLQNPNVKVHIVGFAKKVGDLIDGLVMVVGFFGICLLITLVLLYWFTKCIRSTIAVLITTLVAVLWQLGLLNLVGFGLDPYSMLVPFLIFAIGISHGVQKINGIALQSSGADNALMAARLTFRQLFLPGMIAILADAVGFITLLVIDIGVIRELAIGASIGVAVIVFTNLILLPVAISYIGISKKAVQRSKDDAVREHPFWRLLSNFASPKVAPVSIAIALLMLGGGLWYGKHLKIGDLDQGAPELRPDSRYNLDNDFIIRNYSTSSDVLVVMVKTSPEGCSTHQALAAMDELAWKLENTEGVQSAISMVTVSKQVIKGMNEGNLKWETLSRNQDVLNNSIARADGLYNTDCSLAPLLVFLNDHKAETLDRAVAAVQAFAAENDKDDLQFQLAAGNAGIEAATNEVIKQSELIILVLVYICVAAMCMITFRSFAATLCIVLPLILTSVLGNALMAALGIGVKVATLPVIALGVGIGVDYGIYIYTRLESFLRMGLPLQEAYYETLRSTGKAVLFTGLCLAIGVATWIFSAIKFQADMGLMLTFMLLWNMFGALWLLPALARFLINPAKLQARKASLFAH

SEQ ID NO: 28768 - protein, 719 aa, Pseudomonas aeruginosa
SWHGRKRRGAREAGCRTGGSWRGFLALLLLVPELAPQQFGGIVGNLSQPLLEGLATFVVESVVGFLVARPLVLGVGLRLRLAGCSGGLLAFVFRQAGRGRRGLGLLRIDGRRVARRPLAASGWRALLARFLALFLVLAGLLLRRLFLALAQQFLDQGLVALRGDQLRLALQGLFVGVDGGFQFALAGQGVATVVVIVGLVALGEGLGRGGVLAGLVERQAFPAEVLEALRRLVRLAPLQQALALLVRTQPEVFELEGHGRLRQAQHQQRQAEQPAAPSGTGGQQEQRQEQPVTLVGPALQAQQGVLAIFLQRAAAGQQAEAVEVAVVRPQALVAGADLRGEAAQPAFVEPGQEDAALVVLEEAAILLLHRSALRRADAEHGEARRPVLEGAADALALGFAQLAGQQQQAAAALGALFQQVEGLAHGEVGALAGLGHDRRFQGVEQVARGELVVRQRHQGMRAAGVDDDRGLRVVARAKQVEQLAPGLLQAGRRQVAGKHPGSQLEDRHQRVATLHRGLFQLLPTGPEQGQQGQQPGDAEADPGHAVLPPGAADQQPGLEGRRQQQLPASGTTLAMQQLPQQPAKQRRQQQPVGAQPVRPGVQQQVHGCLPERRRGQVRFSRGQSSSATSSTLRPRAAASGQLYSARAGRARVVCWATGSRRSRVAEMLSSSALDRARKYSPPVLSAIPRRVGSSRSSPGLKPNRPGTPPCCGSAPMPMV

SEQ ID NO: 28769 - protein, 313 aa, Pseudomonas aeruginosa
SMEPETSTASSRSRPLAGSGRGSPTHCGRAAASSRRNQSRAKRTCCRQAGRRARARRPARLSSSSRKLTLSAASPLSAAGSTRRSSQGNGAKAKTQGQANSNMLANPGGDGGVEAVHGLVVEGAVGAVAAFHQDHPAGQAGGRATVVEERQPGAAAEGVAAAIWPARPADPLEQAVDGLQPGPGGSPAVGLGKRRQFGQGRFAQRIQRRFAAGGDGAPRQVPAQSPEPPAEQRQQGGQQPPAGRWRPPADGQGSDQRFQPVERIHARYPGWCCSSRSRNCSTRSSWVDSGSSGTPSRWASRCQRARRASACSR

SEQ ID NO: 28770 - protein, 205 aa, Pseudomonas aeruginosa
AWRSSSAWVSSSRSAAPSRKRSSPAAGRAWSSGSDSGSSTRSVWRAIRLSCCSATSLSVRSSHSTRIRLPGRSTSRARRRARPNSSPGRSAGVSRSSRLARNSWLNSCSRLCLLRRGLISWQSRSLNTRPPIRSLWASADQPMKAAARAASTALKHRPEPKNRRWLCSTRTNTGRSRSSWNSLVCGSRVRAVTRQSMVRTSSPGW

SEQ ID NO: 28771 - protein, 301 aa, Pseudomonas aeruginosa
KASASRRDLPREARRIDAPGELRRLRRVGFRDANSEWTERLSGATLPGLARRKGEGRARRGWRRWVGGLLLLLGALASGCSNAPRNAAGEDTSQGSMRAGEFLQTDADRMATLAMRDNLQSLYQLLWKLYKRNPAEWKKTGLPSQADAELAIRRAIEQNRELSDLGGRRDIAALSYSLDPAFKGDRVGAFIYSLASMLITAHGGRTEFYVYQGIDAQYVYNAARNVEVATWMLATRKDDKGAPLLLSNALTDDASNLSYAREFAKIVARLDLLAEVLGERYRRISVNYAQGLLFMHFLPVQ

SEQ ID NO: 28772 - protein, 154 aa, Pseudomonas aeruginosa
SCRSAPRAASSRAACRLAVAATRSRPRRSPATGSSFPACSISPTTSRKAKWCRRPTWSATTRTIPTWWSPRTRARRPSPTSPTASPPSTASGSATPSPRAAPPATTTRAWGLPPRAPGSACNGTSASAASTCRRTTSASSASATWPATCSATAC

SEQ ID NO: 28773 - protein, 1007 aa, Pseudomonas aeruginosa
QFPLKNLAISIFSHYIDVNRLRLLWLCPHCQGFDVATGNRIHASDLPLRSVSTLPRRLGMRFSKKGIAVLRLPSRRNTLRPIERPLAWLAGLALALCAGTAAGAAGGPSSVALWYAERPPLAELSQFDWVVLEAAHLKPADVGYLKEQGSTPFAYLSVGEFDGDAAAIADSGLARGKSAVRNQAWNSQVMDLAAPSWRAHLLKRAAELRKQGYAGLFLDTLDSFQLQAEERREGQRRALASFLAQLHRQEPGLKLFFNRGFEVLPELPGVASAVAVESIHAGWDAAAGQYREVPQDDRDWLKGHLDALRAQGMPIVAIDYLPPERRDEARALAARLRSEGYVPFVSTPALDYLGVSDVEVQPRRIALLYDPREGDLTLSPGHVYLGGLLEYLGYRVDYLPTDQPLPERPLSGIYAGVVTWMTSGPPLASDAFDNWIAARLDEKVPVAFLAGLPTENDGLLQRLGIRRLSQKLKVKPSTETHDQALLGAFEAPLVIRVRDLPALTVLDPARVAPALKLKGDGKEYVPVATADWGGFALAPYVLEEGSEHRRWILDPFAFLRKALRLAPLPSPDATTENGRRIATVHIDGDGFVSRAEVPGSPYAGQQVLEDFIKPYPFLTSVSVIEGEVGPKGMYPHLARELEPIARRIFADDKVEVASHTFSHPFFWQPQLAEQGENFEAQYGYKMAIPGYDKVDFVREVIGARDYIEQRLTTPRKPVKMIFWSGDALPDAATIKLAYDAGLMNVNGGNTALTRAFPSLTGLYPLIRPTRGGVQYYAPIINENVYTNLWQGPYYGFRGVIDTFALTDSPRRLRGLHLYYHFYSGTKQASIRTMHQIYAAMQAEHPLSLWMSDYIPRLEGLHRASLAKRADGSWQLRGFAALRTVRLDPALGWPDLARSTGVAGVRDLPQGRYVHLSAANARLVLRDSRDPRPALEEANLPLKHWRYRDDGRVEFAFAGHLPLRLVVRAAGDCRLSAAGKAFPGKAGNGLWTFELPMEQVRDGQLVCR

SEQ ID NO: 28774 - protein, 115 aa, Pseudomonas aeruginosa
QASPGAPAESLGPAAGRSRGGAGAVADLQQRRGIHAQRRWRARRGLGELRRTAVAGAPGERRAAPDPDRPAGQARRLRAGASSPRPSARQGPPGNAVLRGGTGHPWRPGQARGHG

SEQ ID NO: 28775 - protein, 903 aa, Pseudomonas aeruginosa
RTQRQADVAARTGRWLRRGDARWQLARRRGPPRSGGAAQLAAELARRTGSGPRLAPRDRRDRPDASPRHARQPTARRPPHPQRARPVELVAGAQPLLHPPGRRPRQRRGAVPGMGPHTVLRRPGLATARRHRLPAQSPGEPRAGRPAGGPWRCAGARWRAQPGPAAGPLWPGLPRQHLAPWLPWRAEPQPSAIHLDRRHPGRLAVDREGVQLRHRSRHRHGAAGRRRTGVHLRLPVGSPGRRRRCRRHARGDLQHALRPLNAARIRNSTGGTQHAIHPLPGSRGRRPVHGGLLQLHQRKRYAAGARRAVGPGAAAQLLPGAAGRRACRADPAQRAGRGGRAAAPVPGAAARRPATGRRPRAPAARAGLGTPAEAGLRGHRQRRGVAVQERPRRRAGGGRQPAGAGAGLRAGALEHQRGARRLVPGKPGGRRAESPARAGRRPAARVTAMSAHKDFALAPRASGSVSWVETLVISALALGLGWWFSPDDPLQVNATFPWVILAPLLLGMRYGFVRGLASAALLVAALFAFRVQGVEAYAQVPAAFIVGVLLCAMLVGEFRDIWERRLERLELANEYRQLRLDEFTRAHHILRISHDRLEQRVAGNDQSLRSSLLGLRQLLRELPGDEAPLDALAETVLALLAQYGSLRIAGLYRVRHDRTPEPQSLATLGEMPALDADDLLVRTCLERGELVSVRQELLERGEQRAHSALQVCVPLVDTDGRILALLAVEQMPFFVFNERTFSLLAILAGHIADLLQSDRRALQLADIDAQRFSQYLKRSLLDARDHGLPACLYAFELTDARYGEEVQRLLEGSQRGLDVQLRLRNDEGRRVLLVLLPLTSAEGSQGYLQRLRILFAERFGQARELESLGVRIRQYELDAGNDRQALGHFLFNECGLNDQQVAV

SEQ ID NO: 28776 - protein, 275 aa, Pseudomonas aeruginosa
RRLPVRAEQLGERLRRPAVRPGAGALPVRPRPGQRAAVRRRMAAAAAALQVPAAVEPAVPLQPGLLRAADRSGRRRCGGIPGAVPAAPAWRAGLAGDGRPRAAVPAEGKAPRHDVQRRRSAGRPAPCAGPEPAAHGDLRHPADARQGGDPDPQAGPARPRRRRPPAGLLDARPEGKPDQPAHRGRPRPPRRRHAGATRRAARNPGALVLGTGLPGVGPGQRAGAHPRAGARAYRPGAARRTLGRPASAGRAHRPRTRPPGGCRTRPPGRRGGGNR

SEQ ID NO: 28777 - protein, 121 aa, Pseudomonas aeruginosa
RPAGAVPRRGGVLPAALPGHPPASRRNARRHAATAALRGPGEILDMTEHTAPTAPVADVCLLLEGTWPYVRGGVSSWVNQLILGLPDLTFSVFFIGGQKDAYGKRHYPIPDNVLHIEEHFL

SEQ ID NO: 28778 - protein, 430 aa, Pseudomonas aeruginosa
TAWSSPNPQTRQGSSETEKALRDLHRFFHYPETPDVEEGDALLDLLAEGRIGREDFLHSKASWEAITAGYERYCTDPSFVNYFWTLRSMQAPVFMLAEAARRMPRARMLHSISTGYAGLLGCILQRRWGCRYLLSEHGIYTKERKIDLAQANWIAENPDEQLSTGLDAEVSYIRRLWIRFFERVGLLTYRAANPIVALYEGNRQRQVLDGAEPRRTRVIPNGIDLDAWAGALERRPPGIPPVVGLVGRVVPIKDVKTFIRAMRGVVSAMPEAEGWIVGPEEEDPDYASECRSLVASLGLQDKVKFLGFRRIGEVLPQLGLMVLTSISEAQPLVILEAWAAGAPVVSSDVGSCRELIEGADAEDRALGRAGEVVAIADPQATSRAILALLRNPQRWQAAQAVGLQRVERYYTEALMLGRYRGLYREATEIA

SEQ ID NO: 28779 - protein, 354 aa, Pseudomonas aeruginosa
AVRLPPAGDGQLRGALQPVAGDHLPVGNEGLQTHPAGDVHRLRADGRLCLPAAFHADGRPAAGIADRPRQPAVRLPLRHPPRVPGQAHGGLRLPRPPAGLRQSAADRPLLQPGDLDRQVHLLVQPLHLGPGDRPAARLDPLRPADLPRLPVDHSRHGGVPGAHRDRLRRVVRAGLRGDPRRRDPAAHRPAQGADDPRHPPGPAGNLQGAGAGGGPAVPAGAATARLAGNFPLLPAAVLHRPDRGEHPGSVHGLAQRLLLPGQAPHRPRTLRAVRDRQRRPDLRQPAARAELLRLRLHPVAAGLRAGRAVPPDHRAGRPGVRDLHAQSLRGFAGGRVFQKGPIHPVESAPFFVSR

SEQ ID NO: 28780 - protein, 454 aa, Pseudomonas aeruginosa
LQPGSSLDCAVARYSRFINNLRASIICRCFLKLDPVFPRAAPIWLLESGLFRGVIMAKIKLTKTAVESAQPQAKDVELRDTVVPGFLCKITPTGRRVFMLQYRTNSGQPRKPSLGLYGELTVEQARVKAQDWLAEVRRGGDPGGAKAEARKAPTMAELCKKFMEDYSKKRNKPSTQDGYQGVIDRNIIPLLGRKKVHDVKRPDIAGLMEKLAYKPTEANKTFGVLRKMFNLAEVWGYRPDGTNPCRHVPMYPPGKETRLIVDEEMVRIFRQLEKLEAEGLENYVIPLAIRLQFEFAARRSEICPLEWSWLDFENRRVVWPDSKVGGISKPMSEEAYRLLSTAPRREGCPYVLPSPNDPAKHLTFGEHYGGWCRVLKAAGVPHVGTHGIRHRSTTDIANSGVPTKVGMKLTGHKTVAMFMHYVHTEDKPVRDAAELVASRRQAITGARQLAEAAA

SEQ ID NO: 28781 - protein, 187 aa, Pseudomonas aeruginosa
GGGLAVSLHRITAFSPCKGCARLARLRPGGRLRPLTAALRREGDGSGQFRPCNRRTVMNDKSHVSLEQHVCLVCGTAFDTGAILLDKRLRASMERHTATGWGLCPEHQKLADDGFVALVECDPQRSGSQAGGRMKPEQAYRTGRLAHLRRTVFAQVFNVPIADEQACVFVEPGVIEQLQSMTAPAAG

SEQ ID NO: 28782 - protein, 141 aa, Pseudomonas aeruginosa
PLTACAAPCPGRVGQFRPATFQEFTMNNALITDEQRIVLLANGRESLENPDFDPAPVVKLFTPDAGATWLLTEIDPDDHDHAFGLCDLGLGMPEIGWVSLGELATVRGRLGLPIERDLSFRAEKRLSAYARDARLVGRVVV

SEQ ID NO: 28783 - protein, 228 aa, Pseudomonas aeruginosa
PNAKSTPRTRWCASSGWTPTGRQAAASAATCSQKAMPEPTSPIPQCWKRWCATSWQRWPRTCAPRGGHGWRPCRIWPTRNGRRSRTPRAIAASRPPAKPAASPRWKPASKRSTPNWKKPATPRTRPRPRSWNSGAIRWSGNCKTRRMPCRAMPPRCARWPVPSSPSTATARPSFIAACCAKPRPRRCARWKSCGAVSAVPKAKPPTTSTRTPTTRPRPRACPTGWRSG

SEQ ID NO: 28784 - protein, 142 aa, Pseudomonas aeruginosa
FWMPWARLHRNLSPGWRSSRRPTLPARPSGWPMARAGCPPSSRPQARRMPRRRQARSRTPRRMPRQWRMNQPRRWPLDPRRRQAPRPRPGRFAARRSPHDPHHHQPPAHGGDLRPRHGARPPLARRRRRARLPPALGLVGLR

SEQ ID NO: 28785 - protein, 179 aa, Pseudomonas aeruginosa
ILAGVRLRLGLMAATVRRKQFPRRYAASTRNKFFSPPGSPLRFDRKRCSQPVPRRPDHNKDAMGANLVQPKGEIIMANIGTFTADKDGFTGTLRTLTLNVKVKLVPNDKGSSENAPDFRLQAAGHDIGAAWNKTSEAGREYKSVTLDDPSFPAPVYARLIEGEDGTHDLIWSRSKPQAA

SEQ ID NO: 28786 - protein, 201 aa, Pseudomonas aeruginosa
VPSRHLWFPSKNQDDSPLRPIGLQSIVFIWCSTFSCLYGNPHLLVPAKPRKRIRACTRRRKSGLAVLRLGVKPHPCIIGFVGLPTMPQPLATVPERAQLLANGEARAAGQAIDPVPVVRLFTPDAHVTWLLAALDPADGDTAWGLIDLGIGMPAQGTVKLSELAGIVGPHQQPVMRDRYFRPTRTLSEYTRLAERDGAIPD

SEQ ID NO: 28787 - protein, 270 aa, Pseudomonas aeruginosa
FFRRGQSCSQGGCVMVDRSAEHWYPTAAYLYVLHLDDLGTAWEYLRRNPDYRLDWLRHHRRPKAAQQAAHRWGLRLLEDPALDARDAHPAWLPGHVAVVQLYPDADPPQYAPAFTFWRIAGHKQLLHDGKGLALMAHSPGHCLRFALAPGLEDGMAVAYARRGGAAAPARNHALGAALASAKPRPAPAALLELHTLQALDATLAGASLREVAEGLFGGDAAADWYSDGGLRSKVRRLVRRGDALMRGGYRRLAQLPPLEKGRFEDDAKRP

SEQ ID NO: 28788 - protein, 429 aa, Pseudomonas aeruginosa
SVVVRAFASSAGASCTPWPTSMPGPPTAASRRLPIPSTPSTTRPTAVRADRRRAAGHRHVQHRAAVPAAADAGARTARPVPRLARRHGTARQPRPDGLSVLLARQVQAGQAHRLPRGQRHDPRGRHGRARHRHDLGCRRVDMGGLADRGGEGRGPAAVAADARHALRDPALHRAWQVAARLPAPQSRAGSPAIDHRGHVHPRDDRAALAPLLVDQRMEGTGRCQRHAAGHRADSAGLVLCGRARRRPGADHRPGVFPADGRHRAVAVPPGTQARRQAGIRLAVRFSLPAPEVRQHRQVLRLRLRPARACRAAVVARLRPGHRADAGQRHGAADVPARAADGTGITSGKPVDGVVLSGVRGIVLSGVGLSCYQACRSAANPRQHWVSSPSNFPNLISLTFSRETPLRWTTTTRPQTQQPKPGFPARRTAP

SEQ ID NO: 28789 - protein, 218 aa, Pseudomonas aeruginosa
HHARHAGAHQGVGLHARRDRGRSAARLAGARVSRTLQGEHAMTASASPAAGAATAALAAPTGQPASAPLTRVALAYIEPRFKLYLRFGEPARTLQLDRWRRCAVFLPGAVFCRIRWQANDYGTVRWQLMAMQACTPLDAAQRIPGVQPGASLLLHAEGENAVRAVLERIDAIEALGIAPGGASLAYWRTLANRLAARLPLPEYTAERHAAWLTGRALP

SEQ ID NO: 28790 - protein, 816 aa, Pseudomonas aeruginosa
SASRIQSGWRPVHDGGRFAARCCASHRAIGHAAPVALCVSSRVQCQRIRAALRAAFPCAGVLPRTRLAYGRRRVRRRAGCSRSSADGPPTPGAPARGKGGRQDKRTRHRAASKASLHMGVARHGAASPPCRLWREARADAGMSACFARPDTPELAEGITMTDRRDDDFRIRPGAPKNRGQGFVSKVLKQAGKASSGKSTVRRAASARGTVQRPGSRLGRGHTAARFAGAKLTRMSRRVTIKTLLVNQRQASPQSLAKHLRYIERDGVGRDGEPGQAYGPQTDAADLDAFKERCADDRHHFRFILSPEDGAELEDLRTYTRYLMGRMEADLGTGLDWVAVNHWNTDNPHTHIVVRGRDGTGKDLIIAGDYIAHGFRHRAAELATEWLGPRTELEIQQTLQREVEQERWTSLDRTLQREAGQGGRVQIERFNEPRLQRQRLLLIGRLQRLQRLGLADEIQPGTWAVHADAEKTLRTLGERGDIISTMQRAMRGEPRELAAFEPGEDGRTILGRVAAKGLADELRDRGYLVIDGVDGKAHYVALNARDELANYPTGAVVEVKGSADGRAADKNIAALASDGLYRADHHLAIAQGQAVPGRNPQEVVVVHIRRLEALRRAGIVERVAEGLWKVPDDLAEQGRRYDAQRLGGVAVELKSHLPIERQARVIGATWLDQQLIGGGSGLGDLGFGGEAKQAMQQRADFLAEQGLAERRGQRVILARNLLGTLRNRELAQAAKDIAAETGLEHRPVADGQRVAGIYRRSVMLASGRYAMLDDGMGFSLVPWRPVIEQRLGQQIAAAVRGGGVSWEVGRQRGSAIS

SEQ ID NO: 28791 - protein, 315 aa, Pseudomonas aeruginosa
SSYRSIVLFVDRFDFSSPPMNTKTRGIMEMTTAMVISGTVGWFVLETRMPAASVVFWRCAFGAVAMLLACAGLGLLRRGVLDARQAGLAALGGVALIANWVLLFTAYSHASISVATVTYHTQPFMLVALGALFFGEKLTANKLGWLGVAFGGVVLIVIGGQQAGSHAPGYLAGIGLALAAAFFYAIAAAITKSLKGVPPHVIVVIQMIVGSVLLAPFALWPDGASSPHAWGLLLAIGFIHTGLMSTLLYGAIQKISTALVGVLSFVYPIVAIVVDAWAFDHLLGAMQIVGAVAILAAVAGMNLGWNLFHLDRRNA

SEQ ID NO: 28792 - protein, 311 aa, Pseudomonas aeruginosa
PMELRHLRCFFAVAEELHFARAAERLHIEQSPLSRAIKELEEELGVVLFARTTRSTRLTRAGKLFLDHVPRVFAALQQARDSVKAAANGFHGQLRIALSDGITPSRLPALLALCRQEEPEVELRFFEVPLSQQIKGLHDDLYDVGFAQSDEVGDGIVTTPAWSDALMVAVPARHPLLAHKRIPLDELLRYPLVLCDPQVCEGLAKHVERVLRRTDMEPLIAERVASCDLMMALVSAGFALGLTGEAHIAASREPGVVARPLASRVPRLTTYSLRLEGDPSNELARFIERVQAIESPEAPKHYPDSPDAPAP

SEQ ID NO: 28793 - protein, 201 aa, Pseudomonas aeruginosa
TTTIECESQAMSYYQHPSAIVDDGAQIGSDSRVWHFVHICAGARIGAGVSLGQNVFVGNKVVIGDRCKIQNNVSVYDNVTLEEGVFCGPSMVFTNVYNPRSLIERKDQYRNTLVKKGATLGANCTIVCGVTIGEYAFVGAGAVINKNVPSYALMVGVPARQIGWMSEFGEQLQLNEQGEAVCSHSGARYVLNGKILSKVDV

SEQ ID NO: 28794 - protein, 235 aa, Pseudomonas aeruginosa
LCRLGVVVLLHSICCYVFCLFLDVLPVCQGRCQVIVVIDYGVGNIASVLNMLKRVGAKAKASDSREDIEQAEKLILPGVGAFDAGMQTLRKSGLVDVLTEQVMIKRKPVMGVCLGSQMLGLRSEEGAEPGLGWIDMDSVRFERRDDRKVPHMGWNQVSPQLEHPILSGINEQSRFYFVHSYYMVPKDPDDILLSCNYGQKFTAAVARDNVFGFQFHPEKSHKFGMQLFKNFVELV

SEQ ID NO: 28795 - protein, 412 aa, Pseudomonas aeruginosa
LFGVCQLGFSTEDCEKSSNDCPACAGSSHQCLLVMTGAVMTKVAHLTSVHSRYDIRIFRKQCRTLSQYGYDVYLVVADGKGDEVKDGVRIVDVGVLSGRLNRILKTTRKIYEQALALGADVYHFHDPELIPVGLRLKKQGKQVIFDSHEDVPKQLLSKPYMRPFLRRVVAVLFSCYEKYACPKLDAVLTATPHIREKFKNINGNVLDINNFPMLGELDAMVPWASKKTEVCYVGGITSIRGVREVVKSLECLKSSARLNLVGKFSEPEIEKEVRALKGWNSVNEHGQLDREDVRRVLGDSVAGLVTFLPMPNHVDAQPNKMFEYMSSGIPVIASNFPLWREIVEGSNCGICVDPLSPAAIAEAIDYLVSNPCEAAALGRNGQRAVNERYNWDLEGRKLARFYSDLLSKRDSI

SEQ ID NO: 28796 - protein, 419 aa, Pseudomonas aeruginosa
RILFSSMNVWYVHPYAGGPGVGRYWRPYYFSKFWNQAGHRSVIISAGYHHLLEPDEKRSGVTCVNGAEYAYVPTLRYLGNGVGRMLSMLIFTMMLLPFCLILALKRGTPDAIIYSSPHPFGVVSCWLAARLLGAKFVFEVRDIWPLSLVELGGLKADNPLVRVTGWIERFSYARADKIISLLPCAEPHMADKGLAAGKFLWVPNGVDSSDISPDSAVSSSDLVRHVQVLKEQGVFVVIYAGAHGEPNALEGLVRSAGLLRERGASIRIILVGKGECKEQLKAIAAQDASGLVEFFDQQPKETIMAVLKLASAGYISLKSEPIFRFGVSPNKLWDYMLVGLPVIFACKAGNDPVSDYDCGVSADPDAPEDITAAIFRLLLLSEDERRTMGQRGRDAVLEHYTYESLALQVLNALADGRAA

SEQ ID NO: 28797 - protein, 84 aa, Pseudomonas aeruginosa
RWSMTSPRSRLASWWSTVSAVFVSHGRWTRWHGCAATRRRSAPPEFTGKALDQWAYRRDIKLKLTQSGKPTQNAFIVIQRQVPQ

SEQ ID NO: 28798 - protein, 671 aa, Pseudomonas aeruginosa
TGLINRMLDNLRIKLLGLPRRYKRMLQVAADVTLVWLSLWLAFLVRLGTEDMISPFSGHAWLFIAAPLVAIPLFIRFGMYRAVMRYLGNDALIAIAKAVTISALVLSLLVYWYRSPPAPVPRSLVFNYWWLSMLLIGGLRLAMRQYFMGDWYSAVQSVPFLNRQDGLPRVAIYGAGAAGNQLVAALRLGRAMRPVAFIDDDKQIANRVIAGLRVYTAKHIRQMIDETGAQEVLLAIPSATRARRREILESLEPFPLHVRSMPGFMDLASGRVKVDDLQEVDIADLLGRDSVAPRKELLERCIRGQVVMVTGAGGSIGSELCRQIMSCSPSVLILFEHSEYNLYSIHQELERRIKRESLSVNLLPILGSVRNPERLVDVMRTWKVNTVYHAAAYKHVPIVEHNIAEGVLNNVIGTLHAVQAAVQVGVQNFVLISTDKAVRPTNVMGSTKRLAEMVLQALSNESAPVLFGDRKDVHHVNKTRFTMVRFGNVLGSSGSVIPLFREQIKRGGPVTVTHPSITRYFMTIPEAAQLVIQAGSMGQGGDVFVLDMGPPVKILELAEKMIHLSGLSVRSERSPHGDIAIEFSGLRPGEKLYEELLIGDNVNPTDHPMIMRANEEHLSWEAFKVVLEQLLAAVEKDDYSRVRQLLRETVSGYAPDGEIVDWIYRQRRREP

SEQ ID NO: 28799 - protein, 725 aa, Pseudomonas aeruginosa
REEGNATRYAGAQRVAQTGGYYRHPLMHAATFRCMLSAISDAGFSLASQLPARFFMDTFQLDSRFKPAGDQPEAIRQMVEGLEAGLSHQTLLGVTGSGKTFSIANVIAQVQRPTLVLAPNKTLAAQLYGEFKTFFPHNSVEYFVSYYDYYQPEAYVPSSDTYIEKDSSINDHIEQMRLSATKALLERPDAIIVATVSSIYGLGDPASYLKMVLHLDRGDRIDQRELLRRLTSLQYTRNDMDFARATFRVRGDVIDIFPAESDLEAIRVELFDDEVESLSAFDPLTGEVIRKLPRFTFYPKSHYVTPRETLLEAVDQIKAELKERLDYLRNNNKLVEAQRLEQRTRFDLEMILELGYCNGIENYSRYLSGRAPGEPPPTLYDYLPANSLLVIDESHVSVPQVGAMFKGDRSRKETLVEYGFRLPSALDNRPLRFEEWEAVSPQTIFVSATPGPYEAEHAGRVIEQVVRPTGLVDPEIEVRPAMTQVDDLLSQIRQRVAKDERVLVTTLTKRMAEDLTDYLGDHDVRVRYLHSDIDTVERVEIIRDLRAGAFDVLVGINLLREGLDMPEVSLVAILDADKEGFLRSERSLIQTIGRAARNLHGKAILYADNVTGSMQRAIDETERRRAKQIAFNEAHGIVPKGVRKDIKDILEGAVVPGARGKRKGVAKVAEESGRYENELRSPSEISKRIRQLEEKMYQLARDLEFEAAAQLRDEIQTLRERLVNV

SEQ ID NO: 28800 - protein, 408 aa, Pseudomonas aeruginosa
LDLVELRSGEVRVEHPGEEAGKAEQAEAGGAEQARRDQLHQLRDQRDQEQLGNAHPHDHLADLHGVVALDLCQVQRQYVDRAVQAHAQTDAGNAREAEVAVAQDAQVDQRVRPRQLQDDEQDQAEQGDAAEADDQLRLQPVLAVTFLEENLQAAQADAEGDNAGVVGTLQQFPMRRLFLQAVEQPGDHQQARRHVDIEDVFPAEVFRQPASQGRSDGGREGGGDGEQRHALRTVVFRQLDQGQGERQRNQRAAGETLHGAEHDHAFQVPGERAEQRGHQEAHRDHHRQAACREQLHQPGGHRDHDDLRHQVGGGDPRAFLEGCRQRALDVLQRGVGDLDVEHRHECAEHGAEHRDPVAPGRFAKRPGQRLSGHGARPRLRRTCRGGCGHAAGCRPRTRSSPGCVAPPW

SEQ ID NO: 28801 - protein, 315 aa, Pseudomonas aeruginosa
CADLHPRGGVPQLHPGRAEPGHAEVHGEPAHRPAGGAPGRAPAQSHYPQVAPDRSRAGLLRALPADHARFRRGRAGGHAVATGAVGIAADHLADRVRPDVPRQPAGRLHAPVPADHRRGRAGLAQRRSAAGGRRHRDHGRPAGGFHPGGPSPALYQPLALRQPRLPGGARHADIGGRACRASRGPSVHRLPALLAAFRRQPALPAGAVLQQHHLRPRGGGRRCRHCRATGADLCGERAQRASGAFAGGRAVAGRRTVCGLSFAAFPGDEGQGLPRFPDQPPAGRHRSFTGAGGGPPDNIAPLNFRFNFRLARESP

SEQ ID NO: 28802 - protein, 154 aa, Pseudomonas aeruginosa
PLFVLASPRRRRATRTSVPHTSRCSTCASRVSTAVSSSCASRTPTSCVRRGSPSSRSTTPCAGSASNGTRARTSAARMARTGRASAGISTRSIRTNWSRRAMPSPASARPSASMRFAPSRWRARKPRATTATACTCRRMRCSAASPPASPTSPA

SEQ ID NO: 28803 - protein, 253 aa, Pseudomonas aeruginosa
WPRTPPFHGGNRGSSPLGDATFSRSAGLYRAIPNWNGPFVFSLFEFPDRRPGRTLADFYYAYNISSIIFSEIVMSDKKTQTRARILGAATQALLERGAVEPSVGEVMGAAGLTVGGFYAHFQSKDALMLEAFEQLLGKRRELLGELDPGLSGKERRALAAAFYLSRKHRDAQVDAGCPLPATLAEVARLPEGFREVLSRHVEIMVASLAESPEETDVALADLVLMIGGLALARALGPGELSDRVLRAAKQAVN

SEQ ID NO: 28804 - protein, 236 aa, Pseudomonas aeruginosa
KALWPARSDPAGRAVSNRGMPMTLPLDRVLLQASPVLPVLVIEDVALAPDLARALYAGGVTVLEVTLRTPQALDAIAAIHREVPEVLLGAGTLIHTEQFLEARDAGAQFAVSPGCTPRLAAAAEDAGLPYLPGVMTPSEVLLALEYGYRSLKLFPADGTASVKMLKSLKGPFTGIRFCPTGGVNLDNLLNFLRLPNVACVGGTWLAPPSLIRARAWDQITQLAREARELAGSLEQH

SEQ ID NO: 28805 - protein, 221 aa, Pseudomonas aeruginosa
RYAALQAFDTAGLAAAGVDLGIDQSGPHRVDPDTLRRHFPGQPDGHAVDGALGGGIVDVFVGRSQPRGHRGYVDDAAAAPAVAGRQALHRLAGAEEAAGHVGREYPVQARRVDVFQARLRFQHAGVVDQHVEAAETFVDGGEQPLDIAFLGYVGRHRQGFAALALDALAQRFGGLAVAQIVEDDRIAALGGEQSGGGADAAAGSGDQHDVAHDDAPQVSSE

SEQ ID NO: 28806 - protein, 175 aa, Pseudomonas aeruginosa
RSGSRRPSPGPARTGWTAARQGPIARGSGRRRASAGPPRHCPPVPGPGPGGGPAAVRRALRSLPPVPDRPRSATGGRGRNRGDAAGPPPARASGCARRPGAVPGSPAGRRHPGFPRLRGHWLARARPPRGRRRRWPGEPGVALASHRAPGRPAAGCRRDRPGRIRAYPRAGLPGP

SEQ ID NO: 28807 - protein, 154 aa, Pseudomonas aeruginosa
FRRFAMSNAFSLAPLFRHSVGFDRFNDLFESALRNEAGSTYPPYNVEKHGDDEYRIVIAAAGFQEEDLDLQVERGVLTVSGGKREKSTDNVTYLHQGIAQRAFKLSFRLADHIEVKAASLANGLLNIDLVRLVPEEAKPKRIAINGQRPALDNQ

SEQ ID NO: 28808 - protein, 694 aa, Pseudomonas aeruginosa
GNPDGRQDPLRQTLGHAPGQAARRRFGADLHRPPYPARSDLAAGLRGSSPGRAQAVADRRQHRHPGPQRADHPHRAQGRHRRHRRRGLAPAGADPRRELRRLRHHRIQDERRAPGHRPCGRSGAGRDPPGDDRGLRRLAHFHPRRLRRAGPRHRHFRGRACAGDPVPGGEEDEEHAGQGRRQVAGRRHGEGYRPRGDRQDRHRRRQRPRHRVRRQRHPRPVHRRADDHLQHVDRGGRPRRPGRRRPEDHRLREGPALRAERRAMGPGRRLLAGAGVGRRCPLRYRGRAGRRADQAAGQLGHVAGNGPGRGPERAGPGPRERPDQARFDRARLEIHGPAAEPGDHRHPAGPGIHRFLHQLADRGPARCRRSGQGPQGRRDHQAGAGGAGFRVGQGAGREGRPGPDLHRGRLRMARAGLFHVPGDEPGPAGERRTLRLDLQPQLRGPSGRRWPYPPGQPGDGRRRGRQRPLHRCPRIARLRRTEMKPYTQTTGLVAPLDRANVDTDQIIPKQFLKSIKRTGFGPNLFDEWRYLDVGQPGQDNSKRPLNPDFVLNQPRYQGASVLLARENFGCGSSREHAPWALDEYGFRTVIAPSYADIFFNNSFKNGLLPIILPEAEVDELFRQVEANEGYQLSIDLAAQTVTRPDGKVLGFEVDPFRKHCLLNGLDDIGLTLQDADAIRAFEDGYRQQQPWLFR

SEQ ID NO: 28809 - protein, 444 aa, Pseudomonas aeruginosa
PEAGASACAWSSSRGSSGCVRRRCSARRSAACSWRWARKSGSISRLPTTARSAPTCWCCGCVGSDGSIAAAHARRSMNEGQEGVMSKQILVLPGDGIGPEIMAEAVKVLELANDRFQLGFELAEDVIGGAAIDKHGVPLADQTLQRARQADAVLLGAVGGPKWDRIERDIRPERGLLKIRSQLGLFANLRPAILYPQLAAASSLKPEVVAGLDILIVRELTGGIYFGQPREQRVLENGERQAYDTLPYSESEIRRIARVGFDMARVRNNRLCSVDKANVLASSQLWREVVEEVAKDYPDVELSHMYVDNAAMQLVRAPKQFDVMVTDNMFGDILSDEASMLTGSIGMLPSASLDANNKGMYEPCHGSAPDIAGQGIANPLATILSVSMMLRYSFSQATAADAIEQAVSKVLDQGLRTGDIWSEGCRKVGTREMGDAVVAALKNL

SEQ ID NO: 28810 - protein, 393 aa, Pseudomonas aeruginosa
SDGLGRRHDGCRPAHFSHIGVVAMKRVGLIGWRGMVGSVLMQRMLEERDFDLIEPVFFTTSNVGGQGPEVGKDIAPLKDAYSIDELKTLDVILTCQGGDYTSEVFPKLREAGWQGYWIDAASSLRMEDDAVIVLDPVNRKVIDQALDAGTRNYIGGNCTVSLMLMALGGLFDAGLVEWMSAMTYQAASGAGAQNMRELLKQMGAAHASVADDLANPASAILDIDRKVAETLRSEAFPTEHFGAPLGGSLIPWIDKELPNGQSREEWKAQAETNKILARFKNPIPVDGICVRVGAMRCHSQALTIKLNKDVPLTDIEGLISQHNPWVKLVPNHREVSVRELTPAAVTGTLSVPVGRLRKLNMGSQYLGAFTVGDQLLWGAAEPLRRMLRILLER

SEQ ID NO: 28811 - protein, 103 aa, Pseudomonas aeruginosa
VRSWTSWPATLTSRRARRRVSPPKMQRSPPPWTETPTMTSTSSPVPTKRRPSWIWLVPTSTWAIAKARAISSTKSWPKVTTASRRKPASCWSAWPDPEMKRLS

SEQ ID NO: 28812 - protein, 258 aa, Pseudomonas aeruginosa
PSVPASGRSNGRRRCSRRATGAPVGSPLTPTDSIWCGWSTPGSSSCPSATWGRISFPDCPISSADVESGFCYHREFPPDRPSGGSSLTRRGFSVVASRSHQDLRYHPSRGRPGRCRGGRRCHRPGVLCEEPAGGGYPSGAGDRSCPAAVRDQRRPVRQRQPLRTGRDSRCGAAGPAAIPWRRARRGLRGTSATLPEGPAGEARRRHRRARGGISGSCRDSPGYLCGRRARRHGGGVRLVAGADRPGQTPGAGRRSDAG

SEQ ID NO: 28813 - protein, 336 aa, Pseudomonas aeruginosa
AGVVGRGLQLAAPAALQRAGADRWRRGRRCATVRRLLRGGGRTWRDFPDLFRNGHSGRLLAVRARRAGLRGAGSRPWRAPGCGQPDRRRPGADHQHRPGPCGLAGRYPRKRGFRESRYPARRQTGPVRRFRSPAAIAGAGGCAGGTALPARSRLRPGARRSWLALARAGRGRPGAGAARSAVARVAHGKRRAGPAGLRVARVALAGGAPGRGAAADPGDRSPRSPRPVLERPATPAPAGRRAQSPGRPVPGATPACRSATRTLPGGLRPAGGQRPGWRTGTLDRLGAGLGRCTVADSAFAAGRGAGGGADPAPGSGEQPCGYRRRPGRAVRQGYRG

SEQ ID NO: 28814 - protein, 248 aa, Pseudomonas aeruginosa
RGVNHGLAGKRAEAAHRRGVGADRPGGDLPADAVHPRRRVAPGRGGSAAAPAIAGHAQCRGAADRGAGTAARRRRQRSRDRRGRLPGRRRPAQPADRRPAGDPAGHPAARPGPGAGRQPAAKPAATARCAAEPAARGEAPGRQQPAAELVGTACQPVQPGARRGIAEDPALPGLQRLHPQLRRDEPGLRRAGDPARRGGSPARPVEQAAEAQRLRRALPAGTRLTATRGLPSRARSAKMQRLFCLWAA

SEQ ID NO: 28815 - protein, 324 aa, Pseudomonas aeruginosa
AVPAQGQRPGPRRLPAAPHAAPDRQRRHRPCALPDRRQLQLGGSAAVLRQLALRHHPGAQRQPDQCRAVGQGNLRIRPAPREHQLRFGSAAQRVRPRAGGAQQAAAHRGGHLRRGFLRARPLRRRLRGGGDDHRPWHRRFPRPQCDPSDRLRPAAYRERRRIHDRLRERGPGRTRLHPDPRPGAGRGGVHHRGRQALYPPVRQSTEVRAVHLRARLPGASGFDHGRHLGVQGAPAHGREACRQDPPRASRPRHRRGHPDPGHQPHRGAGTGQPARREVPRGLRQEPLHRPHLHHARPGGAEEIRAAEAQRHRAGVPRQERDAGG

SEQ ID NO: 28816 - protein, 142 aa, Pseudomonas aeruginosa
LHRPRHHLQADHPDGPRGRGEERLLLLRRAGRALPQRLRHRHAECARADRAQSQHRGRQQADRRRLAGLPGPARPDRRGRRRQDQDRSLRLRRVRRRVRDRRRQRGLPEPDRTGAQRCDQGQEPGGQRDHRSVQRLTKGRAA

SEQ ID NO: 28817 - protein, 673 aa, Pseudomonas aeruginosa
GRLAGMAPLFRLQFAQIDGLSIEQLVGVGRQDAGSSLRAASAVDDPDVAVFLARERGETGAVADHRRTQEDHQVALGVGVLGGTEQATEQWDVPEQGNLRLGLGNVVLDQAADHDHLAVLGEDGALDRALAGDQVGIVALLGVGQQGRDLLLDLQAQGRAVVDVRSDLEADADILALHGGERVARTFAVGGVGAGLERYVLADQNLRFLVVQGQQARGRQQVALGVGRERGDQRAEAAAADADDGAVGDGFRCLVALERLQQGADGQSGIGEVGLGSAHAALVDRPLHADGILDVAGDLDDGRFHQYLGTRHVELANDVFESVDRVRVGQQDQGVGAFVGTDEDVARSAAAGLFAALAAIVLHAFGNLAEGFREGLGVVVAQADHPGVGRARGRGVQRLRQLHQLGARLRRAEDDQAVGARVGDHLGARRALGLAAAHGVVEHLGGVHHPAVAQVDHAVVVAALLVELADHVFDSRDIGAAVADDQRVGRGHRGEVAILWDQRTDQRDEFRYRALLHLDHPRLQAIRRALAAAGLGLGLGVGHDARLVALGNHGEAVGAHHREEQLVDLAQRELGLGDHADLALDPRVDDEGLAGDFGNLVDEFADVGILEVDRPVRLLLVAGRDEGVPAAVFGVRRLDAEGQAEKDGGNVRTTGRGKQGAEQRLGHRVSRFP

SEQ ID NO: 28818 - protein, 220 aa, Pseudomonas aeruginosa
GIHDDSPITRHRRAGRTATASAVQLRQAPGPAVPVPGGAVLAGLPAAGGAGGDRRGAALRRPPPAAQGARRGRLQPGPGGLLPARLLGGHAARRGPRRQPGPRRAGRPGPGNRGPDGAGGRRADHSPDQRDPRRGDPRERLGHPPGNLRETPGGALPRRRRAARGAGAQARAGGPAGIADQGHGTAGHRREAYSPGWADFPAGRRARGGHPRLDPALGQR

SEQ ID NO: 28819 - protein, 225 aa, Pseudomonas aeruginosa
TGGAASARQAGRAPEPATLGHERARPQADGRNGAQAARHPAGHRPHRLGQDHHPVRQPDHAQRPHAEHPHRRGSDRIPPGGHRPDPGQRQGRHDLRPRPAGDPPAGPGRGDGRRDPRPGDRRDRGAGFADRPPGALDPAHQQRHRCDHPPGGHGHRAVPAVLLHAWRAGPAPGAGALPGVQGALPRRRGRVRAARRRSRRAADPASRPRLRRVPPAWLSRAYRYL

SEQ ID NO: 28820 - protein, 463 aa, Pseudomonas aeruginosa
AGGVRRPHALADPQRILRAGNDPACPHQRTEHPRRRSAQGAGRRHHGRGSPARDPGRIMAAFEYLALDPSGRQQKGVLEADSARQVRQLLRERQLAPLDVKPTRTREQSGQGGRLTFARGLSARDLALVTRQLATLVQAALPIEEALRAAAAQSTSQRIQSMLLAVRAKVLEGHSLAGSLREFPTAFPELYRATVAAGEHAGHLGPVLEQLADYTEQRQQSRQKIQLALLYPVILMVASLAIVGFLLGYVVPDVVRVFIDSGQTLPLLTRVLIGVSDWVKAWGALAFVAAIGGVIGFRYALRKDAFRERWHGFLLRVPLVGRLVRSTDTARFASTLAILTRSGVPLVEALAIAAEVIANRIIRNEVVKAAQKVREGASLTRSLEATGQFPPMMLHMIASGERSGELDQMLARTARNQENDLAAQIGLMVGLFEPFMLIFMGAVVLVIVLAILLPILSLNQLVG

SEQ ID NO: 28821 - protein, 307 aa, Pseudomonas aeruginosa
LGQLTGHAGFARLHPHRADGGDGHHQRTDRPGGAQHRLRQHLAGAGQRGRAARRADRRADRRGRAGQPRVRPAPGARCLPGTALRRSEGALVAGGARQPPPAGVGGADLRAGRPAAGAGRQQGREGAEERHRPAAIADPLQWRTQSVPPAPGRARTRGAGVVAEQRRFPPATGRGGAAMKRARGFTLLEVLVALAIFAMVAASVLSASARSLQNASRLEDKTLAMWIADNRLNELQLEQTPPSSGHNQGELEFAGRRWEWRTQVDSTAEQDMRRVIVWVAAKPLGRERGSIEERAAARLVGFLGSQP

SEQ ID NO: 28822 - protein, 446 aa, Pseudomonas aeruginosa
RQLCRRHPLLPGDQRGQPGRPPAGAGEYLAAGQGRQDTRDGPRHGAGRPAHPVDGRRRLEEGRAMSGVSALFLPPASTAGADGELAVWWVQDGECRRAPFAQALAEIRAPWRLYLPVEAVTACAVNLPTQKARWLRQSLPFAVEEQLADDVEQMHLALGSALADGRHRVFAVQRTWLAAWLALAEGAGKAPASLHVDADCLPGEGSCLFWLEERWLLGGSGAVRLACGSEDWPVLRDSCPPPQRAFAAQEVAAPEGVEVQPLAGNPHVWLSEQPLGTDLAQAEFAARQQSSQWRRWRPLLGLVGLWLVLQWGFTLVQAWQLQREGDRYAAQSAELYRQLFPEDRKLINLRAQFDQHLADSASSGGEGQLLGLLGQAATVIGGEPTVSVEQLDFSAARGDVALQVRAPGFDVLERLRSRLSESGLAVQLGSASRDGSTVSARLVIGG

SEQ ID NO: 28823 - protein, 207 aa, Pseudomonas aeruginosa
DEGDDAIPRAPQGPGGNLAAGDPLARAAGAGPPGAALARRVPPAGGALPGAVAPGRAPSAVGAAVFHRTARGACIHPAAGAQRAPGRCRGATGADRPGGAAGHGHGFGGPGRTECRAPRQRRRGRRAGGPAAGAIRQAAALAGAVERAGRAGGGGRPGPPGRRPGLGAPEPAGRVSGPWLGPAWAPAPTAPTGDRRNFKKNSIRALT

SEQ ID NO: 28824 - protein, 457 aa, Pseudomonas aeruginosa
SGALSLGAAEFAGRLPAPALEGALEGFRRGEAEQVGDFAESQVGLADVDHRQVAAGVVEDAAELGAFLGQLAPQGPGRQLEARGDFLEVRFATIEHRPQQAADALAPTAGAGQLLQFAVAEFQHLAPGARTVLGIRQGQAGLAQAQLVGRRAEFHRAAEECLVALGPRRRWIFDLHPLRFQRLPCQGAEMADPACQHRIDDEAVIGVIRADRIEAQPGAAGVFHQARLAPVVLRVKRFQVDHCPRGGAHVGRLGDADAGQAHLSETAQAAHLQAKGGVSAELYGGMAEAHVARDRQARPGFGQAPLVEAVLLEQCCGLDAGGEQGVGQRLDEADREVAEANPGRAHSQRLTSCAPPPGLAWRMPCDEPSRLWPSSVTFHRRLWAKATAAPRAPLASRRSPTARCCQASALLRLFGARRTSPGTSSASKPGQGCCQRPLWFRAAGIASSSTRCSTRVA

SEQ ID NO: 28825 - protein, 765 aa, Pseudomonas aeruginosa
AAKRVMRIRKISLRMRVSKAAHRVGEWRRLAKHPCAFRSVTCHLGSLSAPVALLRVVAIPTAARPAHCARGRGISVNAFRPMWRPPMTAAVPYPHLLAPLDLGFTTLRNRTLMGSMHTGLEEKPQGFERMAAFFAERARGGVGLMVTGGIGPNEEGGVYSGAAKLSTPEEAEKHRIVTQAVHEAGGKICMQILHAGRYAYSPKHVAPSAIQAPINPFKPKELDEEGIQKQIADFVNCASLAQVAGYDGVEIMGSEGYFINQFLVQHTNQRTDRWGGSYENRMRLPVEIVRRVREAVGPNFIIIYRLSMLDLVEGGSSWDEIVLLAKAVEKAGATLINTGIGWHEARIPTIATKVPRAAFTKVTAKLRGEVGIPLITTNRINTPEVAEKVLAEGDADMVSMARPFLADPDFVNKAAAGHAERINTCIGCNQACLDHTFGGKLTSCLVNPRACHETELNYIPTTRPKKIAVVGAGPAGLAAATVAAERGHRVSLFDAAGEIGGQFNVAKRVPGKEEFHETLRYFRNKLESTGVELHLNRRVGVDNLVAGGYDEIVLATGIVPRTPAIPGIEHPKVISYLDAILERKPVGGKVAVIGAGGIGFDVSEFITHAGPSTSLEREAFWKEWGIDTRLEARGGIAGIKAEVHPAARQVFLLQRKKSKVGDGLGKTTGWIHRAGVKNKQVQMVNAVEYLGMDDAGLHIRVAEGEPQVLPVDTVIVCAGQDPLRELQDGLLAAGQSVHLIGGADVAAELDAKRAINQGSRLAAEL

SEQ ID NO: 28826 - protein, 539 aa, Pseudomonas aeruginosa
SPSAQNPTASQFPLPLGGPSGIARVSANPVTLPATFFPLDLPEQRDSACFSGDMPDGYCRMRAASPGVRGLAMSMQKKPQMAEAVLFFNDSGVCKEMLYPEFEALLDGLVRMPEYADRQMHLAYVLINPRLQARAAVFFYLDFDEQGGADTGWNLPLRNLAERAGRGPDMGGGPIRLACRSQCPVSWHQMHLWDPESSAGRNHFVLIRDALRRNQLGLLVDEEPAAVEPQRLQMAAEEQWYAAGPAAPKAPPAEPPRKQEDEQTARLAQLVKQQRQQLAALARQQEQRLAGLARQHEEELARREQDARGQLDILRSEVLSLQQALERQARENAELQQRLLEQGEQFQRNREELTRQLRFIENQGRNETDLLRSEFADELEARVAAAVAGYKEQVSIRDVELAYRNELDQQLEQELAELRAERDRLAAQGPEQLLERLSGQGVVFVAYHPGAGHLTIPLQDIPRYQDNPLAYAAAKCFVSESQYRQWLDHFQQPRCEALLPGGERCNLPLDRVDNPARFVAGDTNCCARHKTTGRLRTVS

SEQ ID NO: 28827 - protein, 330 aa, Pseudomonas aeruginosa
STPSTTTTTRSAGPSSAGAAAWAEATDATRPRTWLRPDRRCPRLRAYPGPPPRPARLPPAGRRLAPSAAPGAVPRRHRRPRPAHPRGPAPGARDGRRRRGAVHHGQPRIQRARLEHPGGARQRPPVRPRAYAAACPADQGDPRAVRGPRCRLARLPRLVPATAAVPRCRALPHGPCLLGRRADRDPAPAVPRRADQRSLPAGVGGARQLCRPGLQPPAARHRHAPAARCHPDQQRWLYARLLPHQVLGRGRGAAHLRRYRLPARRVARSDRPRAAQRGAEVQPADLRRRRTAVVRRPLLATRHAGADPAEPGLPGLQRGDVRQAGGLPPG

SEQ ID NO: 28828 - protein, 287 aa, Pseudomonas aeruginosa
RVSAVQVLKFPLSVDLAGFVGLLRRLNVPHRVSEESGQQVLWVPDERLAEQVRELYRRYPEGDPQATLEAAPRPAGQGFVRQLRMSPMTAAVLLLTFVVAAVTYLGDNFATMRWLTFQDFRIQGQYALFTPLAESLAAGQWWRLFTPMLIHFGWLHLAMNAMWFWELGRRIEFRQGRPMLLGLTLLFGLVSNVVQYAVSGASLFGGLSGVLYGLLGHCWIFQYLAPNQAYRLPRGVVAMMLIWLLVCLSGVIDLLGFGSIANGAHVGGLLVGCLSGLLGGLLARRRR

SEQ ID NO: 28829 - protein, 551 aa, Pseudomonas aeruginosa
SPGSCRTSPRRSAPATWARSTAPRIPTSRSRTSCSSRTPCTDGRNRPRRAEQDDGAPGKQCSRAIRLPPRRPRSRGEPADRPAAAPGVPRQHLLHPLRPQDEEEFQPGLLLSLLHPAGAVRQLHRQPGEVPLRAGHLPRTGVGRAVLHDRSRGVPGQLLRGEGRHHPRQPDSHPLDRPGRAPGAADPARGHPPAVRPGGRPAAQPGRRPHQLAGHAQGRSRAGRSGGSPRAVVRPVRRRPARIAATFRPAGDPTGYRPRSARDRLPGRGLPEQGRQPRPGKNAYRRRHASRYQGPVPDPRHRGDQHSQIHGLPDRRASLSRRATSHAHRATESHPPQGLSGAGLPDRRDPPEVRTVRRPQPGTRRVEAAAQPRARRRPAAAVAAWPATGAAGARTGRPGARRGRLPTGRRAARGETAAGRVRPQEHGAYPSGEQHRAGRPVQVRQDVLHPVRGRGFPQDHLLPRPSRRDESLHHHRQRRTAALPGAALQRQPGGQRFRRQRPALGDLGRPVQEAGLPVRPGRRRPLVRRGQLPHHEPARRGVAHLRRAGEH

SEQ ID NO: 28830 - protein, 374 aa, Pseudomonas aeruginosa
VFPQLVGQPGHLPRLVPTVAQGGLHRIPRLGVLRRHELAHGQARRGRRLPAHQPVRRGRRADGASGAPRLVHRDFQLLHPDRLREGLGSGADDPHPARRRRLPQGLGPVLPAPRRPGGDLRRFRQGHGRRQWRRPDPVQALVQPVRHSAPGGGRRVRRRRPPLHPDGAPELPADSRPAEQGTLRHPAGAGSARRPGPRTSAAPGRRGRGPGRQPRAGGDRGRAALRLRRGAGAAAAIAAARLLRAGETELPLQPRPVAVPHAARQRRLQPLGGRPTALGAGPAGADRPAPARRATGTRPAPDRGLPHPPGGRGAGPGDGRRDALAAQRGLSHRDQRSRRCRRDPCRPRIRPPAYRRSAVRAAVAALPGQPQDFP

SEQ ID NO: 28831 - protein, 681 aa, Pseudomonas aeruginosa
QGRRETAERRTARSGGAQRMTTWSEFPMYIPNRQPRLRSAPARAGFAFVGLLPLLGGQAQAVEFSFLDNEVSGSLDTTLSYGTLWRVQGQDKSNNDINTNDGNRNFDTGLVSEVYKITSDLEATWRNYGVFIRGTAFYDTQIMDKRNDYYSHNDPSQPSQSYPHDDRFTSQTRDIAGHKAEILDAYVYGSWDIGNMPLSARFGRQVFNWGEGIFYRGGVNTTNPVDAAKYRLPGSELKEVLMPVEALSFNIGLTDNLSMETFYQWNWKETRLDPVGTFFSETDLFADGGNTGYSDFTGTALDTPVPGFGNVIGLYQALGNNPLLSGALKNTGLYANGVTPAYGNVMKVSSIGKDINARNDGQFGVAFRYIAEELNSTEFGFYFVNYHSKEPTLYADIGDYAGADLAALANTLRPIAGNLAEALANGLVTADVMGNINARREFAEDIRMYGFSFNTTVGDASVFGELAYRPNLPIGIAATNDLIGDLAHGAAEAANGGQINVGGQMVGLGGQIHNYERVEAFNTSLGTIYNFGPSLSFDSLTGVAELASEHLRGSSLKYTAYDGSTRYYAGRGNSSYVSGGDRGDQVNRNAYGYTLLLSGTWNDVFAGVNVSPYVVYKDDFEGNSYQTGNFIEGRKAYTLGIKATYLNSLEGELQYTEFYGGGQNNNIRDRDNIGLTVKYSF

SEQ ID NO: 28832 - protein, 208 aa, Pseudomonas aeruginosa
RHGRRERPAPHTENPHVEQAPADRRFPGAGTGQRRRAGRRFRRRGGATEVEPHPAGRGEGRQRRRQHSRLDRRHHPGAGRLQAGPAPPGPVRRGQAAVHHRQGQPGAVQGTPDPGPAGAVQDLPGQLPDAGLPQSPFRFGAAVAVRQHLRQCHQRQAAGRRQRVRRRLWRGAVPDSEERRGGAVEPRRPLPRHLCRAPRFGSRGTAQR

SEQ ID NO: 28833 - protein, 382 aa, Pseudomonas aeruginosa
AHDVAHFARPNRGRFAASGHSFQIAPGQQGPVVSRGTFSSDLRRHPGPGRVDANRRAAAIRRGIAEGRQQPAAQRRPCRQAAGRGRRPWAYPALRRRRQDLDPGQGADPPVAHLGVLRQRAQGLGGRARCADPRQRRRRQHLDQAVRGPRPRSAVAGHLVRRRTARPGRRCLWRAAGDPRRRPALGRRQRAPGQRGPVPPQRHRRGQGQRPAGGRRSRQPVPLEGLGRHLGKTRRPLRGLAVRRHRYRRCGRRAGLRPARPPVPLRRFRRQLGRDTAEGGVRRPGIRSLRRRAAGGRAYRRGRPRRQCPRKHRRRAQLQRVQPSRPAVPGRRQRHRRRPPDPGRPGRRAPRCGERCRARTTTIRRGSHECHEPASAKQGEPW

SEQ ID NO: 28834 - protein, 187 aa, Pseudomonas aeruginosa
GHRTASRCRTSRGRRSPAGRGRYSGLRPAGLRGASRRGRATSRCLLPSDTAGRIPARWVPRGWPAAAERRGDRCAAAAGSCRWAECAGSGGRCAWRRCRPRGCPSRRRPPAAGCPWPAPTGVPGSRRPSACPGSCRARPPSAPSPPAASGVRWRPPGWRRAVRRRSGRGRRPGSAAGAPPARRPAGA

SEQ ID NO: 28835 - protein, 173 aa, Pseudomonas aeruginosa
GLASAASSARAASRSGSSGASPRVAMVRRGRCRRSRQSPQPSNGSRAASSHQPGAGGHQPTGRGAISGSSRSSGFMRDTPAGVVPAGPATAPPGLPGSTAAAAARPVAGPAAASARGAPRPVRDRPGAARRRGCPARGRRRLRGSAAVRRREGHGRAGRTAAAAPGRYGVRSG

SEQ ID NO: 28836 - protein, 589 aa, Pseudomonas aeruginosa
PAHRGLCRRLPARTGPAVLRQGCPSEPCAPPGLPGLRVDPRAGRQGPGDPRVPLHGPVHLLGVQRERQRHPLHPRQGRRSDAALRFRHQGPPRQGTGPGAGSTAARRPVPDPGGRAVQHRPGDRPHPGAQQDPRVPAQGPLRSLLLLPGLRAARRVFHRDAPEDPAGPDGAPAGQRLRVLDLLLRVGAGPRAVHPPRRPEVAHRHRPGAPGGRSDPGLPFLAGRLQQPGGGKPRRGQGHQRPGRLPERLPGRLPRALRPALRGGRPAAPAQPLRAAPAGDELLPAAGAGRAATALQAVPRRHPAGPVRRPADPGEPRPARARRIPLPPAPPERPRILDPRLRLHLRRRAGRGHPAAQRDPPGRLRPHRQRRRRERRLQPPGADRQPAVARRRPAACLRALPEADPPGLRPRLHRQCAECPHRHRPRAGAAVQDPLLPGAQTHRGRPGRQATEAGAGDPRCPRRSPGAQRGPHPAALPRPDQGDPADQLLPARRQRPEQELLQLQVQPEGHSGAAQAGAQVRDLRLLAARRGRAPARRQGGSRRLALVGPRGRLPHRGARPGQGPAGEERGDRAGRRQGRLRPAPPAAWR

SEQ ID NO: 28837 - protein, 311 aa, Pseudomonas aeruginosa
PRRDPGRGDRLLPDLHFRPARYHRQPQGRRSGAAGQRGPPRRGRSLPGGRRGQGHGDLLRHRQRHRRRVRLLARRRLRLGRLRRLRPQGHGDYRQGRLGQRATALPRARHRRAEGQHQRHRHRRHGRRRVRQRPADVGQAATGGRLQPHAYLHRPEPGRRQQLRRAPAPVQPAAFELGRLRRQADLRRRRDLPAQRQEHRHHPGNEGALRHPGRQAGAHRADPCAAQGAGRPALERRDRYLREVEQGNPRRCRRQGQRWSARRRPRAAREGGGRGRQPGHDPTGAGRVRPARRCQQHRLHRQRRWRGLLRP

SEQ ID NO: 28838 - protein, 230 aa, Pseudomonas aeruginosa
YPADPDGRTDAPRPPRHPLVPPQPPQRAGRGARRGPLRPAHRRPRPEAQRAARRADPRAVAGALPDLRRRRRAGTAGTHGGRYQPLVHAAADHRGVRRDRPGHRGSGQGLFRRGQRAGPDLVPATDHQPAGGEQLAGAGPRGVPRRPRLAAAGDHRLGVADAGRTEGGRGSRRPVAGTAPAAGRALAGDAGRTACRVGYRLRHVRRGQPRADGPGAEQPARCLHPLMRPD

SEQ ID NO: 28839 - protein, 128 aa, Pseudomonas aeruginosa
SGSATCRRSPYSTRRGWPRRSSSRATARSTCRWRPPTGAASPWRPMCWRRVASTGAGSSIRSPSCARPCALRRCRVPTRPPRMAGASPPCTSMATASSPVPRCPAVPMPASRCWRTSSSPIRSSPRSR

SEQ ID NO: 28840 - protein, 1219 aa, Pseudomonas aeruginosa
ARPARPSRERPATACGRSSCRWSRCAMANSSAADKHPQARLLNPWALLPVALGVALVLWLTFNSEEVFMPSGDGEPDAVSVNYAELLLQAHPENDALRLTLIDLLVKLGDFEQARHHLARLRGKDRLATPFYEVELDILGALARPEGMDEEQTRRLLERLRKIEHVSLNDAMLERLARHALALDAPDLAARTFAELAGRDPQGRQRWLDEAARWYLASGEPLPAADIQRQLAEAQTEPAKRLAYLRQAFASLLAGERGEQAALLLDERLDALPEDESTLAWLAQGVRAAEGSQRYDLAERFIRRWRELRPEDHEALAADLRLNMAAGRVERAWEVGQELLALRPEDRTLLADLARLGEWTGNGPRALGLWKQLLAGADDPALRGHAWRLSLQMFDFDSAIELLAPIGAQRQMTDEELDALVYSHETRGTPEEGEAWLRGYVQRYPKQRLAWQRLQQILEHTQQLQEETGVWARMARHFPLSVKERMQWAETHWNLFDPRQAWKVLAGVDTRAIREPEFWRLRAALAWALEQDDDARAAYERMLALDIRLNSSDEDQLIALYRDSNPKQALQVLIGSWQRSRDPRRLASALQLAENLHDWPALKSLLAEAEGLPEAQGSPYYWVARARLAEQEGHGDVAERLYREALVRFPGENLVRERLLWFYIDRGRRDSLAPLLAQWHGLALRDSTLWLPFASASLLLERNDQALAWFRLYLKSNPNDWLVQAAYADALDASGYQDKALRLRRLLLRRLDREAVRATPDSFAAYLRLLAVAQGPLLAQGEARRAWNGEPAMLQLWFEQFLDQLAATNQEPLKDDWLAWARGRGLKIGRNEEIQAALRSQNRAALQRLLERGELDPAQRVEALVRLGHGGEALGEALGALGDGHSRDNREQLRRQAAEILERTPQGLQLGWNKRDFGGLDFKGPTLRAARHLGDDWYADLELGSGRYHGDALDSSLLGSERNARLTLRRELADGFAAATLDGSWRDDEDRHGLGVLRNWRLSSRDELEAGLDWHRETDETGLMRALGMRDSLRLGGRHTLSGRDQLSWSLAHNRFSTRQGDDLGNGEALSLEWAHTLFFDGPAWQLRGGIDYQRNRLENRVPDDLLAAHGGALALDGARSQDLLQDRYGQVYLGSTWRRGFPGALNRSRPQYTWIVDTLAGWQWTEKEFNYGIDLGIGMELLGDDELAFTFGYQSAPQGGGGDAGGTLGVTYSTRFGR

SEQ ID NO: 28841 - protein, 185 aa, Pseudomonas aeruginosa
TRPGYGIQQEEHNMQSIRCLALAAVALFMAGCSSFTSESATPLARGAQWGLVPLLNYSQAPQAGERAEQILLSVLAEEGVRPRLYPAQPQGDLQLVDDRERQQRALDWARQQKLAYVVTGSVEEWQYKNGLDGEPAVGVSLQVLEPASGRVLWSTSGARAGWSRESLAGAAQKVLRELVGDLRLE

SEQ ID NO: 28842 - protein, 297 aa, Pseudomonas aeruginosa
SSRPCCWACATASSAGWPARRCWWRRCSRFASRASRLMPRYRRPSSSACCSAPCWWASSATSGNAAWSAWSWRTSTASCASTNSPAPITSCASPTIAWNSGSPATTRACAVRCSVCDNCCASCRAMRHRSMRWRKPCWRCWPSTVRCASPDSTGCATTAPRSRNPWRRSARCRRWTPTICWCAPAWSAANWSACARNCWSAASSVRTARCRCACRWSTPMGGSSPCWRWSRCHSSSSTNVPSACWRSSPGTSPTCCRATVAHCNWPTSTPSASPSTSSAPCWTPATMGCRPACMPSS

SEQ ID NO: 28843 - protein, 329 aa, Pseudomonas aeruginosa
MISKWLFSGAFLFELSSWASVFADLPFGQALALYLFAHGLGSALLCVGVWLLLPRRYKFPLPWSPLFLFSLAFFVPLIGAVGVAAAVFPALYLPRQRGEQAWQAMGVPELPFRPKEKRLDMMFSDGGLQDVLRHAPDPNQRLTAIFATRRMPGKEAIPILKLALRDPADDVRLLAYSMLDQKESRINQRIEAALGRLAGATPARRGALHGTLARWYWELAYLGLAQGSVLEHILEQAREHTDQALRGAPSADLHLLAGRIALEQGRLEDAGRALQAAEEAGIDSAQLAPFRAEVAFFQRRYRDIPRLLAGMPDDMLQRPPFAALARYWT

SEQ ID NO: 28844 - protein, 195 aa, Pseudomonas aeruginosa
PSRCSSSAARRMPTASATTRSRTMCCTSRNTSCKPPGVRRTRRRDRAVARPKRRCAICTVSSTTRRRRTWRRATRCSTCSPRAASAARTFSTARPVGRRSPQATSAIAPIRPSSITSGPCARCRRRCSCSPRRPGGCRGRACCTRSPPATPACWAASCNVAGAAATCSASTASTPRSAKSTWPRPTGSRRTPTSS

SEQ ID NO: 28845 - protein, 473 aa, Pseudomonas aeruginosa
CSDVTAGCTAKPRRLHDMAGIGFELRKILSRDSYTATLRAYLYAGLISSGPWVLSIVSVMLIGVLSLGVVVPDVLVRQFLITVTYLMALSLIFTGGLQLFFTRFISDRLFERKHEAILPNLLGVLLLVTLAAGLLSAILLATLFDEPFAYRLLVMANFVVLCNLWLVIIFLSGMKAYKRILLVMFIGYALMVACAYLLRFMQMDGLLLALLIGHASLLFVFLYDILREYPARRMVAFDFLDRRQVFVSLLLTGLCYNLGTWIDKFIFWFNPSTSDLVIGPLRASILYDLPIFLAYLSIIPGMAVFLVRIETDFAEWYERVYEAIRGGETLQHIGLLKEQMILAIRQGLLEICKVQGLAVVLLFLLAPQLLGWLGISRYYLPLFYIDLIGVSIQVVFMALLNVFFYLDKRRIVLELCVLFVIVNGALTFVSLLLGPSFFGYGFTLSLLVCVLVGLYRLTTALDDLEYETFMLNR

SEQ ID NO: 28846 - protein, 195 aa, Pseudomonas aeruginosa
PSTSIRCALPALCQRNLANLSADLRLAGGVRRLHADLSSHYPGHPSRRRRVHESTVAFPAGLRFGKPDFPDAGRRATDGHQLPQPVCRNGSRLPRVSRACGQREASHNRSRPASWHMGSHYAGHAHLPRHAAPSGSAGDQPRGGSSGVNGDREHGGHREGTLRPGRIRGSVGAGGLRRRVDGCGLRAASPARQDC

SEQ ID NO: 28847 - protein, 286 aa, Pseudomonas aeruginosa
TANPLFFVRRKIMQLASRFASRSPVLRSERPLSDDQIRAVAPSIFADAPHESRSERYSYIPTATVLQELRGEGFEPFMVTQTRVRHDDRRDYTKHMIRLRHASQINGREANEIILLNSHDGTSSYQMLAGMFRFVCSNGLVCGDTVADVRVPHKGDVAGHVIEGAYEVLHGFDRAQESRDAMRAITLDAGESEVFARAALALKYEEDKPAPITESQILMPRRHDDDRRDLWSVFNRTQENLTKGGLSARAASGRRQTTRPVQGIDQSVRLNRALWLLADGLRQLKA

SEQ ID NO: 28848 - protein, 555 aa, Pseudomonas aeruginosa
IPTRQGQAAALAASLAAASLTARSYHHERRTQNRSRRHRSRRTAGNGRPVQEPDSGSALAVAAAPLQAQRPQDAAPVHPRTGREHCPHRPAAKPDRHPFRRWRGLRGGGRRPPTDRLEAAGEEEAHPRRLRSAVPAGARCFGPYRQPRGKPDARADAPRRPVRGVRRAGQGRPAHRGHCRRLRRVPAGGAAPLEARPHRAAPDGRLPRRNRHAGTVDGLDHHRRPRRAGSRVLWCAGMAAQPVQAARAPDRTRNRRLARAGALRRAGHLPAGRRRRPPRPVRRRRCRNLPHRYRSAGNAGARQAGNAGRGRARRGVGMGGGRAASGLRGTAGVPERPAPSPRADHPRSPPHRLAGNPPRKDRRRTGRSLRRRGQGQGREAGTAARSGGRGTARRGGCLAGLCPRGARGGRCHRHHRPQRRGRHSSRPAARSRGQGAAHAGKAAARFRQCRRRSRQRRARGRRRRAQGREPVRPAGAAVERPPHGGAANRSCTASACRAGRAGAWHGADRLAARRLRRWPAAGRAPHGARPTGRHGPGLAGIARCRGAARTATGGR

SEQ ID NO: 28849 - protein, 98 aa, Pseudomonas aeruginosa
TSRGAGRLTRAEGKRPGLDRGASLQGEAPMTRTTTSRPRMAAIYAPGTVRARRWHGDGDVRGYRPPLGWSACADLTDIHPITGHALPRAVWWLIETKK

SEQ ID NO: 28850 - protein, 408 aa, Pseudomonas aeruginosa
DCLHPVALCGRSFESYGGSHHASRSFAACRHCLDRCRAAPTLSHQRRSRRIPAPVAAHAGKAARDRWWSALSQVRPARHVRRGRPRCLGRRPQLRDDFRSRVRRAPLGRQPCALIGGARQAIAMSSTALPSRQRPMQEREQLDLFRALPGDMAPRDSQDLMAYPFFSLGKSKRVKPIDFRAGNVTIRVEGTAEHGIATIWDADVLIWAASQIVEAKDAGLRPSRLMRATPYEILRFIGRGKSLRDYQRLKAALDRLQSTTVATSIRETTGRRLHRFSWINEWKELADASGTPLGIELILPDWFYAGVLDAALVLTIDPAYFRLTGGIERWLYRLVRKHGGKQEYGWQFDFRYLHQKSGSTAKSYDFACDLRALVARQSLPGYVLGIEQMPDNGMELLTFRPVPPTARG

SEQ ID NO: 28851 - protein, 112 aa, Pseudomonas aeruginosa
CRCPRNHRLGGRTAAVADMTEKPPPNSKRTAKRVGIGARPPANPHAEAWIRQGDADALGKGDLYTARLTLDITPAMRARIKVSAFTQGVTVADLLRGLLEREFPEHCRENTP

SEQ ID NO: 28852 - protein, 142 aa, Pseudomonas aeruginosa
RAWRWPTSNRASSSICASVNPRAPSSSTAGGAARCSYRAPCSAASAGRPTTTAPCAGSSWRCRLARRSMRRSASPACSRARACCCTPRARTQCARCWSASTPSRRWVSRPAAPRSRTGARSPTGSLRACRCPNTPPSGTPPG

SEQ ID NO: 28853 - protein, 202 aa, Pseudomonas aeruginosa
PSRRCWSTSARPARSRSPSTCATSNATAWAAMASRAKPTGRRPMLPTSTPSRNAAPTTDTISASSSRPRMARNSKTCAPTRGTSWAAWRPTWARASIGWRSTTGIPTTRTRTSSCAGATAPAKTSSSRATTSRTASAIAPPSWRPNGWGHAPSWRSSRPCSARWNRSDGRAWIAPCNARLARVAGCRSNASTNRGCNANACC

SEQ ID NO: 28854 - protein, 829 aa, Pseudomonas aeruginosa
GQRKPTSPRAGGSRARRRRRASGGRAPCRGRRSPPCAGGWWWCGSWGLLLAAKRPGRGRGACLRRGSSGQRLGWFIRHCLGILRGVLLRACLLRGILRACGLEDGGHPARAIGQPLGLAGNVGLLELRQPGDRFRCKRAHGIQNHSLGNVLEVAFCGRLPPCGYVEAHGLRQFLAGLVRRGARRHHVHRGSHAHGQQPHQFVLRLRQQHSEQFGAVLRQGFTGHLLQFAQRHGSGRFRPVRGHAFQSVLRREAHAQRQAIAVGVGLQDGLHHAMHQRGQRDMRMPCNFDLQRRRAVGAQPLRQPVGQARGLGRVVGVLVLVVGGFAFGTAETAPQLFQRAQRLGLGFAQQAAMNDGLAVAVDGDDGTGHLAHLGGIALQGILRVLQFPDHLIAPLFQLLGLGLVLGVAGFFQFGVDLFEAGFQRGDAAGFAGGRLAAMARGVLERLPFLVGQMRHGLHPCPPLGAHVLGQRCQLVAHQRFQHCGIGEVGSGIAFCEQVAADAAACLPVGVQPDEAHQRVRGVDFAFGQALAQLGRAALPFRRTKERGFLRGVVVGDGQGHQLFQRDGSGAVVGHQARRDVGELQAALHHQRGHAEVGGNVLDGPAFLDQRGERLELVGGVHLLAHQVFREADGTGRSIGHQQARHFVVGGDALLLRQQLQGGQSAVACHHLVSLAICGKDDDQVLQQADAGNARGQFGDGQARHLAGVALGAARQQLRERNQNQVLGRVGHFQRCGGFDGDGFGFEYGVHGDNSLRLGMQQREKRQGLLPAPAAWGFRLSTGAGHRPAATGRDSGARFGRCPARAGWSGGGHSRRGRTGRLWSSSPACG

SEQ ID NO: 28855 - protein, 73 aa, Pseudomonas aeruginosa
RGQQDRLPRTSTHAVFGKRSAQARIAIRAGGISDVKGGQFLNARPVPVQIVNDHGMTVPASVCMFAQVRMIWR

SEQ ID NO: 28856 - protein, 149 aa, Pseudomonas aeruginosa
RASVNSKAYRQAGNPWSRASSRERLRYWEKRWASMSASCSARRSLCSKSAMCPARIASRLKVRSLKTKNGICSTASRARIRPSVSTSGTHTCSALCARCSPRSSSSWRTLTSSPRSRQVRTSRSSASSAGISPSVAKDCGSGVRSWRTR

SEQ ID NO: 28857 - protein, 128 aa, Pseudomonas aeruginosa
TPSLSTASRPGCRRSRCIADGCGSARQGSHGARCCRGRPGHSGPAAGPGCARHRAPAHRHGPPAGRPARGSPGDCAGSRCRRAVARPGRRRTVCGPIPGTAPRRCRGRRPGGWRSGCAPATSSTGRAR

SEQ ID NO: 28858 - protein, 165 aa, Pseudomonas aeruginosa
SRDRRSRACSNPVAGPGECVRGFPPPAAAAARGCRASGRRPVRPGPRPALRRHGRDAPAPRPAAPDPARRAPAGVAGRRDSGCAGRPGSLRCARSSGPGRAPRPASHPSAAPGWWRRAGRGTARTTAAASPARHSRPAAPRPGRAAAPGPRRAGAGRRRSCPGWP

SEQ ID NO: 28859 - protein, 180 aa, Pseudomonas aeruginosa
HSAGNAGPSAPRPRSLPATAGCVRESVASAARPGAVSDNAARSRAAMPRPLPACRGFHGCRPAHRVPRRSSVAAHRWAPAARWRCRNRTSAATGARHARAGPGHRRRPAVASTGPAPAGRCRSIRQGARDRPAASCPPGAGPAAPGRPPRPARPARRPCSDAGRRPAPHGPRGAIRASAG

SEQ ID NO: 28860 - protein, 194 aa, Pseudomonas aeruginosa
SVRPGRSAGCLRRRVRPGRARPGSIHPPARRPAARPATTPPVRRARQRAGWRRPGADRPGASPARFALRPVAAGCPPPAAARRKPGTSAPPRPASAAGPAGRGRPVRQRSAPPGPARPGPGHDGQVVRAWRRSTKRARSCAGAPAIGASAPHPCPRAWPGRQGCPVPPRRTALPGGPCRADGRGDDAPARSRRA

SEQ ID NO: 28861 - protein, 72 aa, Pseudomonas aeruginosa
PDRPLAVFDVPPRHQGRAAGYGECDRQHSLEQLVMRGRVARQVRPTPAQQGAVTACERCVAQGIDTGERHRW

SEQ ID NO: 28862 - protein, 467 aa, Pseudomonas aeruginosa
RDSSSGERCASDGKRRSPGERERQAEKAEDDRHPLAERRERCATDPLDDDRHGDRRDIRQQPVGIAAGAVEHEQRQRHGERAPHGAAVEQACQRGAHTTRRLERCQLVERDDPRDAAQDLDGAPVLLVAGRRAGLLQHQHLVVAIVRIARGGLHSPGRTDTGEHQALDPPRPQHGLQARGIEGADARLEHFHLHGIPLQVRMKCATAPAEVESAECLRGSEDRRMFRQVRIAGLEAHPHRDPQPATLLGDGESAVETRDHATQGGLFCTAGNPTVGMHDIDDVVETDQCCVHRELLFHLPEPKALDSGLLELRQACQQRTGRRQQGALALVETGVHGTHQPFFALGAVAVEISPALRAQRHAGSAPILRIGVTDDQPSAFQFAQQRGQIRRAHPLGGGQLGRCDVAAKAVDRAKHDQLRELHRIGLRLATQAAGQGGDLAAQMRCQLEILVGGHIYLHNHSYIFIAK

SEQ ID NO: 28863 - protein, 1627 aa, Pseudomonas aeruginosa
HIQRRPPWDPTDGTTAEMKEPRTRAGLLLAVSPVASGDADTVLAALRQVHQLAVGHGVHGVVGTRRGTQFDQHRPPALDQRQVLFQPQADASLDLLRSVLHLQHRDGDRPLLPVEVVAERLAGQRLPVVLHRQVGDLLQVPGQVQRAAHGEIGLGHFRGVLAGHVGRLDDRQQRVQVAGTGHHACQQFRHAGVDVGLVARLPQLAGRPFEQLVELQAEGGDARAEVGHVARRVQLVAAAAEEPAGGAAAEAHQFVHQGQLDISGHLVVEILDLAEPMRQVEYVADDHVGPGDVGRAHAGGLLQALHEGDAHVVDQVVGDLRADDLALQAMAAHGVAELLRQQCREGGLHVAGQVVIVGHQRFQQRFLEVDLAVGDQHRQLGAGQPLAGTDAFRQLLVGRQELQGAIELATRLEVAHQPLVLGDPLAGATLRQGQRLGLLVVVAQHQGADRVGHLHQQRVALLLGHVAGLHHFVEQDLDVDLMVGAVHATGVVDEVGVVGTAVQAELDPRQLGHAQVAALAHHLRAQLAAVDAQTIVGLVADIGVGFLARLHVGTDPAVPEQVDRRLEQRMDQLGGRQPVGLDVEARLHFRGDGDALGAAQEDPAAGGDQLGVVVGPARTRQVEQALALDEAAGGVRVRVDEDMHVVEGGHQLQLVRHQQAVAEHVAGHVADADDADVVLLHVDAALAEVPLHADPGALGGNPHALVVVAGGAARGEGVAEPEAVLGGDAVGDVGEGRRALVRGDHQVGIVLVVADHVGRRHHFAFLEVVGDIEQAGNEDPVAGDRLGLDLVAATAKRQAARDEAALGADRHDHRVLHLLGLDQAEHLGAEVFLAVRPAQAAASHLAAAQVHALDARRVDEDLVLGHRPGQLRNGLRVELEAEVALVLAVAVGLVEVGPQGRLDQVEVAPQDAVLVEHLDFVEGTEDRLLQLLLLVFQVFRGEFARQVEAGLEQPHQLAGDVGVGIQRTGDVAEVEAQADLLQVTRVGTQQGDVAPRQVGGQHQAVEGVVLGVAADDVDEGVLEDLVELLDVHVQPFGVGEGEVVDPVFAAVLVAQAVGEFAEHAQAEVLQDRQDVGQGQRGVGVVQLAVQLLLALRQRLVEAHHQRALLGEAEQVLQVDHREVRGEALAVAGREAFREVGQDVGALGLAEVFHHQAAVVVLPGTAGLDHFFLQARRVDVDARLRVDAEDELHAGQHRLGEEGPELAVAGLQALHQDLLDLQARLGGIHVARHVGQAVAEATVGVLAQEHADLVALLDADDRQGGAEQLVHRGLEQVVARQYFQHLGQFLAEVGLGVETGAPHHFGDLAADEGDVVDALVVHRGGEQAHEAALADHPALAVQLADRHVVRVGRAVHTARMGSLGEGQQDRFAQVGDGIVLDVQVILAQAGTQQTGQAEEGFLVVDHAPAVGLVGDAEFLVAEEGEVVVQQPFEIAAYFLQFLRRHLQLGLAKPGQQFAGLGLHRFEVGDGHAYFTEHFQDGLLQRPQFAGVGATVDLQVHQRFLADVLALATLGQDFLQLALGRAAHAEDVGLQGMDAVAAAVQFHAYRVDQERQVRVQHFHRGVGGLPAVLLVVGVVYADFGLVAVEALQQAPGGKGATDQVGKPTLGQFIEGDQAEELFGEQRDLW

SEQ ID NO: 28864 - protein, 186 aa, Pseudomonas aeruginosa
RLCRLSRMARVAMRSASVWRNSPARIEPWLVSSPAALRGAFEHPLASAPSSNSSPPTQRRHPRRARPSPLRRASPGNVAPDKRSVHSLFASRKPTRLSRRSSPGASIRRASRGRSRREAEAFHRHTRAGSRIGAARASESTLGSRRALTCAGSGSVIRRRAEPSPRPRAPASPCATERHPSRPWNR

SEQ ID NO: 28865 - protein, 108 aa, Pseudomonas aeruginosa
PTATCWWKARRDWPRPRPSRTSPKASKPSSTVSSSLPTCSPPTSPAPKSTVRRPAPSCSSKARSSITWCWPTRSTAPRPRCSRRCSKPWPSARFRSAAAPTTCHSCSW

SEQ ID NO: 28866 - protein, 341 aa, Pseudomonas aeruginosa
PSRRKPPASTRTGSCSASSTWSPWPEAAAMLSAAPGVELGLDELLEMRHRLHEARLFSSQNRRSPLVGLHHSRLRGRGVDFDQVRIYQPGDDVRTIDWRVTARTREPHTKLFHEERERPVFVLVEQSQRLFFGSGLCFKAVLAARAAAFIGWSALAHNDRIGGLVFSDRDCHEIKPRRSKHSLLQLFNQLLRANRELRETPAERPGELFGLALRRAREVLRPGSLILVLCDERTLNDVAEQQLSLIARHTDLVLLPLSDPLDHALPAAGLLRFREGAADLELDTHADELRQAYREQAEARRARWQRLAQRLGVPLLPLSTQEDLVEQLRDLLEQHQPGYRA

SEQ ID NO: 28867 - protein, 116 aa, Pseudomonas aeruginosa
SLPCPSAGGRQRPAGGCWPPCCRCSAGGSGDCAGTCRGAPSPPAAKRRWIRCAKRPWPNWRRLPSPTAGLPPGPGCKPSTACSSGSAGRAGQIAAATPSAAAPGWRSSTTVARPPA

SEQ ID NO: 28868 - protein, 371 aa, Pseudomonas aeruginosa
SWWKAATAPTAPSTTRPWTASTPPSPPGFASMFEFAWPWVFAFAPLPWLLRLVLPAADSGEAALKVSFLDELESLAGRRARARLPAWRQQVRFALLWFLLLLAAARPQWVGDPLPLPASGRDLLLAVDVSGSMDYRDMRWQEDEISRLELIKKLFGDFIEDRRGDRVGLILFGSQAYLQAPLTFDRHTVRVWLDEAQIGIAGKNTAIGDAIGLAVKRLRQRPAESRVLVLITDGANTGGQIAPQIAAQLAAEQQVKIYTIGIGADPQQGGVPGLFGFNPGLDLDEPTLRGIAESTGGEYFRARSSAELESISATLDRLEPVAQQTTRARPALALYSWPLAAALGLSVLLVALELWPRENRTWPRRRSGRQP

SEQ ID NO: 28869 - protein, 133 aa, Pseudomonas aeruginosa
ANPSARASAAPSSTGRRASPCSASARRRALRCSRRMAASSRTTRAASSCPGSTKAGCAASPRRSAPATSACGRTTATSTASACWPAAARWRKIARTPCCACSAGPTRVTGCSCRCSCWPPVPDGAAGCSACRC

SEQ ID NO: 28870 - protein, 1020 aa, Pseudomonas aeruginosa
ACRNRPWPSSSKTSGCVRTSKASACCNGARRTRRRSASRTSAGKACRSTRPASTPPRPRPSPKATRPTITTTVATPWPARANWKPPSTPTNKPWSASRNWSPRNATRPWSRNCCANARNRRRSSRPARTRNSARKRASRARHPEAASGRRATRRPSMRRRPRPRRPRPACRKTKARRPPEHPAKRSRSPTPRTSGRATRKPTTDSTTNVARPSSNGCDRFPTIPPNCCGASSGTNSSNARKPRHDPPVLQPASRAPLRFRPCQLQRQRRPRPPDRRGKRRTDAGIGRPDPLRQTRPEPAGRPLRGPRHAPGQPSRHAERPGPGHHPLDRHPPAEAERLRGDPADQPRRQQHPADQAARTGGARPRQEQQAGAGLHRCQRRPGDSLRAGPGDPHPAHLPLGVAIRRQQPDPAGDERREGRTARRGAHLREGDQRHPPRRDRGALRDLPAEERHPGDSCASLQCDPGRPWQRRLQPLRPAPRPADAGDFAEHPATGPAQARRLSGRRALDAGPRAEHQRKLEPAAGAGTGRRIADAQRAAEGRGAFRHPASAVAAARRARPAALPGPTAAGRPEHRPGPHRQSRGARGAGARAGRAHRVAGARSGLVEHPRRPPGAHQPATAHPGSGRRAAGRGGAAGGGAAARRTPGADALALATGYRRAGPDHPARLRPLVARPPAAGGDPRRGQRPEQPQPARRAAPRLPGQRSPCDPPGPGRLGPSATRYPGRHGGPLRTAVRRPGWPQRRAVQRERPFLAGRGPVAGDPRPAHHGTSAGGSGRQWRPATALSALNGAMVRTGTIFRFRKRARMRFRTLYLVLCGLLLGHAATAAEPPTAPTPPTQPAEGPGGADYRHASVHQWHFGEGAREYWVFTPEQPVPGNAPLVIFLHGWSVMQPDLYRAWIDHIVRRGMVVVYPRYQPDLKTPNADFLDNAAGALGDALRRLQAGELGVRPRLNQVAYLGHSAGGLLAANLAAASERLKLPAAKALMVVEPGKSQGKRWDGVTQERLSGLAKGTLLLAVCGD

SEQ ID NO: 28871 - protein, 143 aa, Pseudomonas aeruginosa
  UNSURE (109): Identity of amino acid at the above locations are unknown.
DSHVACTDAKRIYRQSRHIPPSDKNLLLLRSDRHGAPPLLANHAAPTAPVFGPQYPKEEDSDWLLDRVEKRLEVQQAEGRYTGHDPLVIDALDWYGTWKLFDGLTDAAXYNRNRQYALGVTPEQTGMGQWSDGTPVKPIKVLK

SEQ ID NO: 28872 - protein, 179 aa, Pseudomonas aeruginosa
  UNSURE (41): Identity of amino acid at the above locations are unknown.
ARATPAANQAQRPIRHANRYHAYPRTRRRRQLRSRRHRHRXPRGRRGGLRSRPRRPGRPQPGARQPLLRDPAGHHAAAHQRPAGLSPATRSRPADPGTHAHRPGYPAGQARRLRRRRRRLPAQALRTAGAAGPPASPQPAPQRPGPAPAGRRPGDGPRQPPGQPRRHAPGAVPHRLEDP

SEQ ID NO: 28873 - protein, 494 aa, Pseudomonas aeruginosa
VPDARQPRAGHPRAAGAQRLGRRTAGKQHPQRAHAPPAQHRRQGVRHPSDPYPAQRRLPAGAQMKRGLSLIPIVGGGVTLILAGVLLVYTRMLGDYGETGALYLLSMMMEEEGLYFAQRYQEDPATPAPDSYYFKGSVGTAGLPPKLREMLDTPPYKSIGAMQLLGNWDDDDEEEDDDAPSDDAYVVVRQPLADGKTLYLYDNDAAGSIDTPLSDAIIDARVRQTWIVTLSVTLPSLAAVGLLVWFIVAPLRKLTRWSMTLDDLAPDSQRPRFNYRELNVLADTLWNSVTRIKDFSQREERFLRYASHELRTPLAVIGMNLELLDQPGRAPSPHALQRIRRSALGMQQMTETLLWLSRESGELRDDGHIEVGRLLEELLEEQQALSQRRGLTFHLDVEPHSLPQTRARIIIGNLLRNALQYSDEGVVEIVVRDRSLLISNPIGAAQGTEESMAFGYGLGLDLVQRLCQKSGWRLHYSSDEQRFRCELLFPATPD

SEQ ID NO: 28874 - protein, 416 aa, Pseudomonas aeruginosa
NRKTLTSRQRKITTGRLLKIRRSTRARLVLLMLVHGTHATPALLLLFERGTVRRSEVHAALADQDQVAVAGGADAGQGQPVGTVEHAEAAPAVGAFEDTAAVADHDDTPVRQQRAVGETEFQVAGRRLQRYLFPAVAEIGGAEQVAAQAVDQHAARIGGTDGAEQRALVGAFEFFPGGAPVLRAEQAAGFADHQQAVVLDRGDGVEVELVLVVQALADVFPVLAAVAGLQQRAIGTDGQAVLFVGEPDVQQRRFAAEVLELPGPGAAGVVADEDLRIVPDRPALALVDEEHRGEQLAGRHLGLGPGLAVVVGEQDMPTVADRDQPLAGMGDAEQQAAGGLRRFHGELRRRGGWRRLGQDRGGGEGQKRKCPEKRQGPAGQGRSGRNGRMPRSVRGLAGRSAPRHGLTHGYRPRCCY

SEQ ID NO: 28875 - protein, 543 aa, Pseudomonas aeruginosa
ACKPSVTGGSAPPSSPEGSGRRRRAERSAGAAAAQGRGLEVGVVRYRLGEVDGTRLLVVQVLHVVATRLQVVEHIQRAPGVRQVVEVLQVGHRHPPQFAATVVLVDHRRAPAVLVEVQGALGVDMPRARLQGTFHHPHAVQLVAGVLRIEVARLEQFLVLHLGAADLVVVVGNVDFLLAQQLPVIAVRRAVEHVGVVGGAQAVGGGDRRVVGKVRRTPHTALAGVVAPGLARLLDLVEGLVHQHRAAGQARRALGERQVVEHQVVQVGEAAALEVVLEQRFLLRGHQRVATVALYRDFRSAAHDIGAAVAGDVVPQRLHAALRNRERHPAIGVGEPVAAVQQPGAGGIGEGVVVQPLRRRTGTATGVDRHPEAVRVGLEQRQLARGQVFPVLLQVGLVDGEQRLVRGERVRVVLARLVAGRRLGDAAGPGGNAAGGVAGLLRAQRGEARLQLRRLAGGNAGQRAAAAQCQRQGSADQQVLVQHEGSPCEVPGARGARVVIGSVRRSTSRSGRCCRGRGCCCSARRRRTRCTAVRLPGCSGRWP

SEQ ID NO: 28876 - protein, 1205 aa, Pseudomonas aeruginosa
HPLPGEAGGSGQALAHHFVDVAGQFAGGQDAFQLAAHQRLPRLVVLAPAGQRHQQARGDLRVECVEHDHLVGEEAIAGAVRTMEVDQVLVGERADQRAHLVRVLQGEGRVLHQRLDPLQPARQRRAGLHAEPLVHHQRVILEVIGEHGQGLALLRLEAGVDQHRQGGQALGHVVAAFVLLQAGGEDFLPARQRQVGQRDVLQAAPGYVRGLGEVGGVTGNLAVGLVTLPQRLEQRFADTLAGEFAGGMDRVDIGDFADLGEIGLAGQREHLGDHRLVQRLVRQEGAVGLDQARVEYQLLAALVLADQLLQDLHRELLAGLPAVEAVAVVLHEEQQLVAAVGEAQFHRRGEAAQQRWQRLLRHLDEDEALLGLGHRQHAVAALGRGLAFQAQRKFVALAVEQTQLQRDDEGFLARLAGSRRAALAHRQGVAAGGGVVLAFHRQARSAGLAVPALELGQVDAIGVFHGLDEIVAGHRLAVVALEVQVRALAEAFGAEQGVDHPHHFRALLVDGQGVEVGNLDERVGAHRMRHRPGVLGELVGAQEGDVLDALDRARVHVGGELRVAEYGEALLERQLEPVAAGDPVARPVVEILMRHHALDPLVGGVGGGFGAGQDATGVEDVEALVLHRAHVEVVDRDDHEDVQVVLAAVDLLVPAHRLLQAVHGVLDLVNVLRLDVDAQRHVALAHGAEAVLDAPEVAGDQGEQVGRLLERVFPGRPVPAVAFGTAGHRVAVGEQHRVALLFGADGGGEATHHVGTVEVIGDLAETLGLALGAEHLAGLVQAFQRGVALRMDTHRAPEDELGLPRFHPELLVVQLVVVRAERLAVQFERQQLQLLAMQQQRRQAGAALGVAPQLQLGVYQAVVFEQFELQVGLVDQVVRRLIVLEVDDFRLLGAHGLWPFCSVMHGDLVGRVFANVDHPGVEDQVLALDTAKRAFDDRRFFQVEAGDLARVGLDRVGDLERIEVDNRLDRLQAETLLQFAQAVGALVEQLLADCRQIDRLGFALEHGPPIGAVGDLAAQQVFHQAGLLAGGHAQDRQRLARALVDPAGGNLAGAGDADLHPGGVGQVHHVIGHAEPLAPLRFAAGALLVVALLRADDATVALRQPGEAGIAIALAETLLRLAAAMGAEDAAEVLQAQRPADQRVHRDFAVVEAEGVLHGSIAFQARRHLAQRAAGDFFHQCTESDLNRMFGIGSSECEEQCCGPM

SEQ ID NO: 28877 - protein, 324 aa, Pseudomonas aeruginosa
PLGMTLLTELLDELRHPAVRDLAWTVLAPPLMRRTPEPQRHPLAASRWRQEPERLAAWLREQERQPQHLAAWLAQWPRQRLGLYYEHLWQFALEQAPDVRLIAANLPVRDGGHTLGELDLLLRDDDGIHHLELAIKLYLGPQSGPGDWLGPGGQDRLSRKLEHLCRHQLPLAATREGRQVLAAHGAESAVSALWLSGYLFHPWPGPGSLPADIEPRHLRGRWLRQRDWPAYLASLAGPQAGQHWLHLSREHWLAPAMRRQDPLAPPRDGACWNIAFADEARPQMLVRVVPRDGYWVEAERLFLASDDWPPGLSLWGSARQAADA

SEQ ID NO: 28878 - protein, 188 aa, Pseudomonas aeruginosa
PVGKRQGVSSRCAGAPWSCAGRSSWCRRRRSAPGCRPGRAAGCSVRRRAAAPRSAAAGSGPATGGTGSRRRSTWPPRRPADCPGNAGCPARGWSGARRRDGRRRIPRPGRIDAPAVAPAPGRPDGRARRAARPVPAPVAGPARCGRPVRRRGSRPAPCSRPPPPPLEPPVRRRTPSAAGRSRCAPGSR

SEQ ID NO: 28879 - protein, 203 aa, Pseudomonas aeruginosa
ATPRPGSTWRSASACWPAVRAAPPWPSPIAACGTSPKTARACSVRRRACARPIPAAVRNWSISGYERAPGSPRRPLGRLRPGAGRRPARRRRRARSTARAVRPRPAAPGRTRGAPVDPSLHAPRPCRHTAQRRPRPWPADGPPEPSRTDGPGRRQRRPGAQHARRRAGNDPPGTALRAELPGPVEPGGRRRRRLAALLFDQPL

SEQ ID NO: 28880 - protein, 184 aa, Pseudomonas aeruginosa
SPIATPATARPAPAAAASGATGCSAGARRTRPGPGRCPAAARSARRADCPPGAGLPLPPGPPPPARRRPAGAAGNCRAVPANPRCRRPGVRRRCRRATSALPARTGNCPRPAGNRHRHAAKPAPCPRPRPAPARRQARCAARRIPGGGRRPAPTQGQGASARHRRPVVPPPRKAATGATSAPSV

SEQ ID NO: 28881 - protein, 131 aa, Pseudomonas aeruginosa
AGSPRRRSPPPPAGTAARARGSPPAPGRTARAGTRHPAPTIPPVPHRPPPCWRAAGTAHSLHSSLVLLPIVAARRRDGQAALPHVAGHHAYLAVLAPLQGTHQHLPAVAQADLADHLEVAGADGKVDVTCL

SEQ ID NO: 28882 - protein, 336 aa, Pseudomonas aeruginosa
NHARASSPRHLDPWQAETVAAQRQRPPLGSALGQAQAERTEFATGEDQQLRLVGAFLLLLLALAAGQHQRLAVQLEGQLRPLRQAVAVARHRQPARLRFVVAQYLVGIALQAQAVLAVVQHGLVGQHADQPGEPLGLAVQLPRGAGEAGAEHRQADQYADDDHHHHQLDEGEAARSPHVRSVVPVTDVGVVVAAAFLAVGAQRIQVERALGARRQVLVGIAPRIDRQLLQVAVLVPVLRLRIAGGLLHQRLEALLGARIGEVVQLVHVQRGSDGLDVALGHGDLGLVGTAHYLRHHQGGEDAEDDHHDHDFDQGEARLLATLQWAALIHAITPRVG

SEQ ID NO: 28883 - protein, 696 aa, Pseudomonas aeruginosa
TPGPRRAPRSPAGSRRWPAKRPSGSPDRAAPAGSSAATAGAARCSRQVAPAPGRGARHARRQPQSPGTARERRWETRAGCRPGYGLRGPWRAPREASTGCAARWTAPRRRAAPPRSATRPGPGSPVAGSPMPGRARTVRGRTSGARPARSARGYGWASRRAAPIGARAATGGPGARCPPPARPSAGDRWGRGRGIRRRPLFFPGHAQDFLDRGDAFQHLAPTVVADARSAGAGMPGHFLLGGFVVDQRAHVVVEHHQLIDTGTPAIAMLVALAAAAGAMQGRRRGGIDAEQRALGLVGAVGLLARRAEHPHQALGQHAKHGGGQQERLDAHVHQAGDRTDGAVGVQGREHQVAGQRSLHRDLGGLPVADLADHHHVRVLPEDRPQAAGEGHVDLGVDLGLADALQVVFDRILDGEDVPRAVVERGQAGVQGGGLARAGGAGDQQDAVRLAHRFVHQLAVALAHAQVLQVQAPGLLVEQTQHHPFTVGRGQGRDADVHLAPADPQGNPPILGNTLLGDVQPCHDLDPRYQQGRQLALGLQHLAQHAVDAEAHHQAFLEGFQVDVRGVLADRLAEDRVDQANDRRVVLLLHQVLGFRDLVGQRGEVQAAAEVLGELHGRRGVVLVGGRQGLVEGVLAERLERQAAAGEALRLGDRRQLHLRPAGQPVLLLQAQEQQALALGEAERQTPWRCGRRGDVG

SEQ ID NO: 28884 - protein, 243 aa, Pseudomonas aeruginosa
VAYWQRTAMIPRRSSDITIKTRSDVLPFSGASSRWLQRYAPALLAVALIIAMSISLAWQAAGWLRLQRSPVAVAASPVSHESIRSDPTRLARLFGTSAQDPNAPPPATNLDLVLKGSFVQSDPKLSSAIIQRQGDKPHRYAVGGEISDGVKLHAVYRDRVELQRGGRLESLPFPHRSGGLLASADDITSENDSIEQLQSLQDENAAALRERLDALRQQMEATPIAEPAEEDSSEPTTTPTESD

SEQ ID NO: 28885 - protein, 1043 aa, Pseudomonas aeruginosa
PDVPAFAPRPVCPFQSFVRSRRPSQPGPRHPGGARRKQRRERLRPGRQPAGGALDDQPQGCRHPRIHRPDFRNHRRDLRRRPAGQGPGQRGLQGPALVERGLPVVPLGDEHPRLHRGCPGRPGAHRAQRRGQDRGRRRPERAGSPGDAGDPGAAEPGIGTHPADPSAGPTIWPPRRGALGQRADHQRPQRQYRANRRRDPPARPEGQPRLQRDQPALRLGDGRRRGAQQRHEPRPGQGRGGRPGDRRRAHQPPDHPRPAAGARQAGATGAIAGHPDRALGQHPGDPPAPQRRQDPRGNPRPDFRRHEEQWRPGRRTDRRRPTEQHPHPCRRKHQRPGPAGRPGHGQRSRRHRSPARRAACPGIGGSGHRRDLRRHPGCRRRAMGDQQGRHGRNQDQLRQYRTVHRHPAAIAREQQGTGIHPRRRHRRHRQQQLRRAGHRALGQHQEQPAVDPEPVDPGQPESGDSGRPERTVPDRLLHHQQRRFEQPVHHRGAQGYRRQPQGHSAHQRRRGPAPGDRAGDLGPAAQRPAAQQYRPDHQQALDQEHHPRRERPGDRDRRPDPGRRFPSRVEGSPARGHPIARSPVPFHQGHPHQAQPDGLPASYGGPRQRRSRRALGQEIQRHPGHRRHSRPGGTTQHPADQRQPVVRWTGRRSARTEDGITAPYRQGGLIRKKGAAPFGTAPFPHLPTNSVEVDHFPGHAAIDQEFLAGDETGVLGEQPSHQRRDILHRSDPADQVLVVVQLGQRRSLALGGLAGIDPAGAERIDTDIRAQAGGQGMGQRQQPALARGVGLGVRLRLVGTSRGDVDDGAIVRAQIRRAVLGQQHRTGQVDRQGPGPLAETQRLQRRIARIGDGGVADQAVEAAELTEHLGHAHRHLALLGHVHGHEPGVLAQRLGHPGPAFTVVVGKHYLPALGDQPGTDAQANAPGRPGDQGDLAVASQVGFDHSAASPRAMSALRSSRSSRPTATRIRLSPIPARARSSGDSRPWEVVAGWAMVVLVSPRLVVIETIRVASMKRQAASRPPFTSKLTTAPKPLCWRRANSC

SEQ ID NO: 28886 - protein, 153 aa, Pseudomonas aeruginosa
TRSMPGWRSSHSARARALALCACMRIRRVSRPLRNSQALNGLRVGPAVRRKPTTSFICSPRPATTPPMPRPWPSMYLVAEWITTSAPSFSGCCRAGVQKQLSTASSAPLAWAISASAAISTSSASGLDGDSTKNSLVFGLHAASQAARSLNGG

SEQ ID NO: 28887 - protein, 679 aa, Pseudomonas aeruginosa
VMPLSPLSVVVQIDDRADRLALGLGRIVARLFDPVQVSLVDVAGHVLAVEHGAVEVIDLDLAAADRVDQVGQVLVDQPVGADQLADVLGAAIVRDQLVRTRHVDAVDVGVAHGRRGGAEVDVLRPGLAGHLDDLLAGGAADDGVIHQHHVLAAELQLDGVELLPHGFLPRRLAGHDEGAADVAVLDEALAELHAEPVGQFQRRGAAGVRDRDDHVDVVVGTLAEDLVGKLLAHAQARLVHRDAVHDRIRTRQVDVLEDARRVLRCFGALAGIELAFLGDVHRLARRQVADQGEAEYVQGHALGGDHVFDAVLGMPLAEDDRTDRIGVAETDDAMAGDHRHHRVAADATVVHAGNRGEDVLLGGLQLVAHRQLVGEHVEQHFRIGVGVHVAQVGFVDFLGQLLDIGQVAVVRQGDAVGRVDVERLRFRRAGAAGGRVTHMADADAADQALHVALLEDVADQAVVLAQVQLIVMAGDDTGSVLAAMLEDGERVIQRLIDVRLAHDTDDATHVTQPLLGSSWKDGKRDRSVPDHRADQGLWAAGSRESVTFAADWLAARPVPPAPRHRRAALENRGTRPRPVSRQNHWLGSSPPMPLGGVIGAAGNHWPAKPRMKFFDQSATIRKCGISTDCCHQGSCCTGARLSRPTSSTTSSTPRAPPKTMPRKRSVPERPVTRISSPMR

SEQ ID NO: 28888 - protein, 436 aa, Pseudomonas aeruginosa
LPVIRSTGQPFQAFGHAIERSEQQNDIIRGSLGALRVQGGGDIRMAARRNLAQDQRRLQLRGRPRTRSRQRCNGPILHQAGQGFQYAIQVFVRQQAEDRQVASSWRCGTQALRQVLGGLGIVPDVQQELAWLAVPGQVAAIEATGHPGPPQRLGQALRLPGQLEQRVGLQGQRGVFHGQPEQRQIVQRQRLAVRGQPAPVPAMIGERQVVVATAQVKRCPQRSHLLQQWLRGIEIAAQGRFAGAQDTGFLESHAFAGIAQPVRMVQADAGDQRQVGVDQVDRIQAPAKADFQHREVQPGALEQPEGGQSAHFEIGQGNLATCGLHRGEGVAQLRIAGLDAIDPHPLVVAQQVRRAVDPDRQPLLTQQFGEQGAGGALAVGPGNGDHAFRRPSQAEPARYLAGTLQAHVDGRRMELFEIAQPIGQGTLGHADTGLGE

SEQ ID NO: 28889 - protein, 75 aa, Pseudomonas aeruginosa
VKADSRLARRGRNSARCTIMSMAPCSRRNSLRWKPSGSFSRTVCSITRGPAKPISALGSPTITSPSIARLAETPP

SEQ ID NO: 28890 - protein, 151 aa, Pseudomonas aeruginosa
TGSVNTETNGMPSSRRRARTAEVLAICISEISASCMRAPPEAEKQISGQRFSRATLAARTKRSPTMAPIEPPMKENSKAQATTGIPCSLPLMAISASFSPVSFCAAARRSLYFLLSRNFRRSTGSRSAPSSSRPSSSRKMSRRVRALMRMW

SEQ ID NO: 28891 - protein, 224 aa, Pseudomonas aeruginosa
ARARSSLVAASSAPERKSKSSSASPSRAEATAASSAEKLGVALFGSSRLLANSSNCALTSSNWAAKLSSPFSGAAGSVGSSASDRSKSSGRDNAGSSAASVSRVNSLSAGAAAGTSSFSESRKSSSESLSSGASRSREKSPRSSCLGWLGVSANSAKSRPKSRSSTGLSAAVEAARSRSLSRVRSSSAPLSDLRSACTSSPPRSSRLRSKASSRSCPAASGLAA

SEQ ID NO: 28892 - protein, 156 aa, Pseudomonas aeruginosa
MSASPRASEVCAVVFSTCGAAAATCGSGSSRVRSSKPSFPRSSASSCSSPASAAKAWTSSFSFCALRRDRIISSTSNASSALPPITANHSGLASSSSRKLGAGCSAACTGAGAGTAGAGGFSAAGAGGGATGGCAGAAGASPAGAGVGAAAAGVPG

SEQ ID NO: 28893 - protein, 79 aa, Pseudomonas aeruginosa
SGRGSCWSPPGLSTPRGSARWAVPCRSRGSGCRPAARRNARWGRLRCAGSPPPCGRCRGSRWPGWPGHPPPMHGRRPSA

SEQ ID NO: 28894 - protein, 516 aa, Pseudomonas aeruginosa
SDRYRRWRDPAERRDRSSGYRVSSRFSSGEQFADIDEAAVDGRGGGHRRADQVGTATGALTALEVAVGGRGAVFAALQPVRVHRQAHGTARLAPFEAGLDEDPVQAFLLGLLLDQPGTRHHQRLLDGRGDLAAPGHFGGSAQVLDPRVGAGTDEYPVQLDVGDRLVRPQAHVFQGALDRTALDRVALAGRVRHVLVHGQDHFRRRAPADLRLDLRGVQLDHGIEAGIGVRHQPLPAGDGLVPLLGARREGPALHVVDGLLVDGDQADAGARLDRHVADGHPPFDGQVADGAAGELDGVAVAAGGADPADHREDDILRRDAGRQPAFDLDQHVLHLLRHQALGRQHMLYLGSADAVGQRAEGAVGGSVRVAADHGHPREGRALLRTDHMDDALAHVVHLEFGDAEVVAVLVEGLHLQARDLVGDGGDAALALGAGGRHVVVRGGDVGVDPPRLAPGQAKTLEGLRRGHFVQDMAVDVDQRRTVVALLDQVHVPEFVVEGLAGHRDFLISSFLCPQGL

SEQ ID NO: 28895 - protein, 308 aa, Pseudomonas aeruginosa
APGSRNQRRPAMDLNSLNTFIAIAETGSFSEAGERLHLTQPAVSKRIAALEQQLNARLFDRVGREVNLTEAGRALLPRAYQLLNVLDDTRRALNNLTGEVSGRLVLATSHHIGLHRLPPLLRAFTRAHPQVALDIQFLDSEVAYEEILHGRAELAVITLAPETAEPVRAVPVWDDPLDFVAAPEHPLARQGTVFLADVAKHPAVFPGGNTFTHHIVRRMFEAEGLTPNIAMSTNYLETIKMMVSIGLAWSVLPRTMLDDQVVRLPLQDIQLSRQLGYILHTERTLSNAARAFMRLLDEQAFGNGTPAA

SEQ ID NO: 28896 - protein, 332 aa, Pseudomonas aeruginosa
SARKKSFRPRNRRIHVALRSTLAHIDALRQKVQERPHAQRQIAALADVDGVDFLQVAWVVCLEHGNQAPGGYVLAHLERGQPRQAQAGHGQTAQRLAIAGLGVARQRHHEFLAGVPQRPAGARSHIVGAEAVVPQQRLRRGRHAMPGQIGRRTDDQHARAPQLARHQARAFQRPRAHGHVGALLEDVDDLIGQHDIQRHLGMLREELGQQRQQEVMPERHVGVDSQAPTRRRVFARTPLGFLQIGQDTHPALVERASLGCQLQLSGGAVQQAGSQALFEPGDQLADCRGRHAATSSGGGKAPRLDDPGKHLQFAGTVDFKPGHGALPDDFAS

SEQ ID NO: 28897 - protein, 458 aa, Pseudomonas aeruginosa
IFEFIISYRITTEFNDMKRPIERLPAATSSATRAFALATSLLYACAAPAASWTASWQASPQPVWAEDFLFPSNVPAELHDQTVRQLARISLGGTRVRIVLANTYGKRPIRIGRATLAKPGSERAAVATGSLHDVTFGGRRTATIAPGATLLSDPVAMPVAALSQVLVSLYLPAATPMETFHWDGRQTGWIVAGEQTQSHALQLDAADSQSTSARLLLTGILVETETATRTLVTLGDSITDGASASLDRNSRWPDFLAERLAPHGVAVVNAGISGARLLSDGMGASALARLDRDVLAQPGASSMVVMLGINDIAWPGTAFARNAAPPTLEALIAGYRQLIERAHNRGIRVVGATLTPFEGALPGTPLSDYYHPAKEALRRQVNEWIRHAGAFDAVIDFDAALRDPEQPSRLAARYDSGDHLHPSDEGNRAMAAAVDLDVLLDEVPDGLPAEPRADSATK

SEQ ID NO: 28898 - protein, 315 aa, Pseudomonas aeruginosa
IISKYSGAEPVFGIPHELDRDHRKYFKSLENDRSSCSDRNSSFREPSLWNAQSRPSPAAIWTAPAPSTSPSASTLALAIRPTPSSSAAPLELHLSLFEALEPKTNCSAAYLRLEDAQALHRQAAALGLGGQGIPRITALEDQPWGMREFALVDPDGNLLRVGQELDATPEQHRVRLASADDVPAVAALWQANVREAGETLDAGDQQAIQALLLAASRNRLLWLAEAQQHPRGFVLAHLWQIEDGQARVGEIAELYVLPQARRQGLARELVGSAEEALRSRGAGLIRAQSALDAPLSNLFWQGLGWDADYLTFTRY

SEQ ID NO: 28899 - protein, 317 aa, Pseudomonas aeruginosa
PGEHHHAQRHADHRSQPRHRRRHRSARRRARLCGRPQLSAQPRGRRSAAPAHRAPGRRSPGGGGRRSRGRRCRAAVRRHRRTFRPPRRAGQQRRRAGSADAPGKHRRGAPAQGIRDQRDRQLPLRPRGGEAPVDPPRRARRQHRQRILDGLAAGIAQRIHRLCRRQGRHRQHDHRAGQGSGGGGYPGQRGAARTDRYRDPRQRRRARPYRTPEGRHTARTRRYGGGSRAGDSLAGVGRSQRQHRRLHRCQRRPLGLLRKLGRLAERHLQQPVDGFAIAFPANPREQLDGFGIGAREHAQPLLETPRGIARGELAPGL

SEQ ID NO: 28900 - protein, 267 aa, Pseudomonas aeruginosa
PEVAQQRQQLAPGHLVDFAAIAPGGDLPSQARTRDQAATEHDVLHPADLATTQVVVERPHFAIGEHRHAHRLGHPRHPLPVRRRPVAIDLGPGMHHYMGRAAVGQGPRAIQGAVGTVVAQAHLRGHRNLARHRATHGGDDVVHQLRLLEQYRAAARAVHGLGRTTEVQVDHRGTQLTGERGVIRQARRIGAEQLHTHRRPGAGPAAVAQLRRQLVESRGRQQAIGDADEFGDAPIDAADAGQHVAEDFIHQTFHRRQGDLHEPLPRK

SEQ ID NO: 28901 - protein, 236 aa, Pseudomonas aeruginosa
RGNAGTGDHRLAGEGDVVAGQHPLAGQAVSGKRPVALGVGGQKDRAMPGKLGHRCRRAVRRQVVGAGAEPAAGREQATGHQGGILRLADHDHDVDALLQRIDAARGQLDLGGDLRVLAHEVAQQAGEEHLAELYRRGDPQQSRRRLLQLHDRLLGLGEIVHDLPAALVVGLPYFGQAQLAGSAIEQAHAQALLQQGDAPAHRGLLHAQALRGLGEAVVLHHAGEDQRIIKPHYCSL

SEQ ID NO: 28902 - protein, 373 aa, Pseudomonas aeruginosa
ATKSPKCSAYNVRRNTARLAEFCRRNTPPMPAQLKRRLTVFLVAVGLIALAFFLHWWFIGRHVESTDNAYVQGEITRVASQLGARVEEVLVRDNQHVDKGQLLVRLEDADFKLAVERAQAALATREAELAQARSKLVQQGSLIAASAADVNASQATLGRAQIDLNRAEALRKPGYVSEERVTTLTADNHVARSQLAKARADLEAQRVQRDTLGAEIKRLEAQIASARTELAQAEINLSRTLIHSPISGLVGQRSARNGQYVQVGTHLLSLVPDEDIWVQANFKETQVGRMRDGQKARLTFDAFPDTPIDGRIDSLFAASGAQFSLLPPDNATGNFTKVVQRIPVKIVFEADNPLHGRIRPGMSVEAEVELRDR

SEQ ID NO: 28903 - protein, 520 aa, Pseudomonas aeruginosa
GAGPAAWRTDPARLDRGAQRHARRIHGGARHPDHQLLAEGHPGRAGGNPRGRLVDLHLLPGGGDHHDPDDRLAGATALGTPPGGDDLGGLPGVLAALLVRLEPGKHDRVPRHAGFHRRRADSAGVHPGPGQVAGTPPSEGHGAVRHHRHLRALHRTDPGRLADGKLRLGIHLLYQRAAGPVDDRRAALRPGEKGAALGTAEEYRLRRHCHPRHRPGLPAGFPRGRSPQGLAGVATDRQPRQRRPVQPGPVRHPATVAAEPADRPGHPAQPQLRPREHFQHRSGHGPVRLDLRTAAVPGTNPGLQRHADRRGDHVDGHSPAVPDPAGPEVDEAGLAAPALRRRLRPVRPCQLLLRGAQPGLRRTAVQPDPATARPRPADDHGDHFADRHRLPAATGCRLGLEPVQHPAQPRRRHRHRPARDPARQSRQGVLRLSARSPGADQPAGRRTPRATRRATGQPAGGAGQTQRDHPPAGDDHGLQRCFPCHRHGARSEHARGAADPLAAGRHRHPRRRRGSLRIRR

SEQ ID NO: 28904 - protein, 140 aa, Pseudomonas aeruginosa
TKPSTPIPVRARSTWAWACTTTRRGAFRCCVPCRLPRRPASRPTRRAATCRSKGSPPTTRAYRNCCSVTSPSCWPPAVWSRPRPSAAPARSSSAPTSSSACCPTPPWPSATRAGKTTAHCSKPPASRCRTTAITTPPAMA

SEQ ID NO: 28905 - protein, 136 aa, Pseudomonas aeruginosa
PKCRSPCQFHQLGLQLGVLHTSSRLVAQHRAGQPEQLTGTTLGDVGLRLHLLPPRPAAGLPLSPGDHFQRPDVEEGLGEQLLQPAVFQFEILQALGIRHGHADELGPLGVERGITEAVSATQLLHRHTGFCLLQKV

SEQ ID NO: 28906 - protein, 71 aa, Pseudomonas aeruginosa
TVLLDLPNYLLKALLTTSIGKQLPGLNIVKFMAVITDSRLIKYDFSVRCIHNTARTDLHHNNLPKHSPRPA

SEQ ID NO: 28907 - protein, 162 aa, Pseudomonas aeruginosa
LISTARCLPWKTNRLPAATADTHVRSKRSMRSAMEPAPPQAITGTWTLEAIFSTRALSKPFCTPSRSIEFRKISPTPASSSACAHSNGERFMSRVPFSENTECPPQKPLRQSIEPTTLCEPNLSAILRINERSIRAAVFIETFSTPREKIFSACSNVLIPPP

SEQ ID NO: 28908 - protein, 97 aa, Pseudomonas aeruginosa
RTTGKSGVARPKSSKLTLCRFSKATTIMKRATTNSPTAINVRLTQSMATPTSEQGRDHSGSLTRSRNSLPGLKCGTNLPSRRTDSPVLGLRPTRGAR

SEQ ID NO: 28909 - protein, 218 aa, Pseudomonas aeruginosa
WIRDLALILHLSTDQITDGGRTSAFYFLLTQFFHCVLLVVDVLGLDGEADDAALAVDADDLGFDFLAFLQDVARVFDAVTADFGSLQDTFDVVAQADDSALGVDFLHGTADDAAFLVQGRVVGERIVFQLLDAQGDALALRVDRQDDGFQLVALLEATYGFFADFVPGDVGQVDQAVNAAVQTDEDTEVGDRLDGTGDTVTLVELAGEVFPTGWICTA

SEQ ID NO: 28910 - protein, 365 aa, Pseudomonas aeruginosa
YPGRYDDVFVDVQNLNFHFFTNLDDFRRMDVPPPPVHFGDVYQAFHALFQLGEAAVVGEVGDASHDAGAFRVTRLDGNPRVFAQLLQAQGYTVALAVELQDLDVDLVANVDDLGRMLDALPGHVGDVQQAVYAAQVHECAVVGEVLDDTLDLLAFLQRFQQSFTLGAVLGFQDAAAGNDNVVALLVELDDLELELFAFQVGGVANRTNVDQRTRQERADAVDVDGETALDLAVDDALDHFVGSESRFQNNPALGALGFLAGQLGLAKAVFYRVQCDVDFVTHLDGQLALFVVELLDRDDALGFQTGMDGDPVTIDVDHDAGDDGTRLHVEGFQTFFKEFCEAFAHVHTCSQRPGRARFRITSQCG

SEQ ID NO: 28911 - protein, 189 aa, Pseudomonas aeruginosa
RPPSQTSPPSPIGLLAASIKRERERLGLSISELAKRAGIAKSTLSQLEAGVGNPSLETLWALAMALDVQVTRLIAQPRSRVQVIRADEGATVASEQAHYAATLLAVCPAGVQRDLYRLVVEPGAPRLSDPHLPGTLEHVVICHGRARLGPVGHPVELSAGDYASYSADEAHMFEALEAKTTAVMLIEHT

SEQ ID NO: 28912 - protein, 108 aa, Pseudomonas aeruginosa
QSAGRCRPRAAHRPPGDVPGRFRQQCPSQPAPVPGCATCPAGCAPGSRAARDALPIPVPPGSRRAAASPAWPRHQSPGRPGPSRRRSTAGRARWPRSRGPAARWVGAI

SEQ ID NO: 28913 - protein, 139 aa, Pseudomonas aeruginosa
IRRGSGCTKDAQASAARPQADRPASTMRASKPVRAERGRGAASAVETAVMAAPSRSARRRAARRCIRAAASAQRAGWRACASTRARRRRARYPAPRWRRCAPAPRALRSRPRRAAAGSRPAARRGCAAPHRAACKPASP

SEQ ID NO: 28914 - protein, 411 aa, Pseudomonas aeruginosa
RARKPSAGAGLRPIGTPDSTIVPRLIARYPARLIARRHPQAFPKLSPCRRRHGPERQQLHAVVRHLLDAQDVAGQRLPRDKRAQVAGEVVGLGGAAGLLVQVAKIELPTVFLLAAVLAYQAVQPPLDAARQPEIRRVDGQHQGGVEHARIEPVRQNQLDAQRRAAGIGQFLPFVDPREAVQAPPGRLADGRGHGGRLQAIQRGFEALVVAQRLATPDEAQDLVGRGAHQPRRPQARVLRLHDLRGRPYQHVCIPNRGDAVLGRAFHADRDVARAEVDGLDPLGLAEREERIGHQVLAVARCHVAGQGAEQVELFALLHRPLPGRQRGAGHGDGLPRAADQRARLSAEWCSAYSGSEVVSKLRSAAQASRSATAYMTRRPNLRKRGPPPITRCFSSVRGDRRRYSAASSLVR

SEQ ID NO: 28915 - protein, 179 aa, Pseudomonas aeruginosa
TRLFLRLDEPPHGTRQGVARDGMNVGEVSASRPAQGRAVAAHVAVAVPAAGAHRAGGVDRRHARAAGGGAGHGGFSLQRSAPVEAGALAFGAGQAASASAGSSAIASASSGASCSGPASCAAFCGPAALKMAGIQPVPSASRSASLAMSAFLSFASRVTDSGANAPTASRITALETCLK

SEQ ID NO: 28916 - protein, 600 aa, Pseudomonas aeruginosa
LRRSPANYRAGVIVKQKKGPIQPGESALSERPCRRRNPSAIEHEGLVLQVVQRGGQAVQPDQHADQQRQGEAVAEEARPEQQADEGQGAVDDHEQHAEFEDDAALVQVEEDVEQGHEHYLDAHPDQVDVEQRQVIAGNSQPAEQLRRQQEQQDHRQPLHLADFQQALADGEDHLLLEQADVLQGLSAADRLVDPLVPLGEVGLDAHQEHRHAGNDRQVGEEDRQVVEDRGAQRADHQVRGGGVEPEDELVDPGPQVVAEAGQQQTDEDLPAVEEVEGHHAPGRVLAEDVVEEDEQQAGVADQQCQQQAVHLHETQQVGTGDHQRVADEHHQQDAFVGLHSRQEDDHQPQVAEHHEVGHHQQAVGERLIEQGRQQYRREQARRQRHQQQHAQQVGQDRLVLALEQAIGNEAGEEQLQSPGEDQRQRHQVGHRDQELPDQHVRHHHAEAQHADQHHADDRQHPGTGADQPGVEVGAQGRRIGIAGKDLPQFEADAGHVMQSPWLRGTARGNVRASAPRCSSVRPVAGRPPGPPASAADCAAGRGSPAKWPAGRRSPPPPRRDPGRDLRRRRLRSVRGRSRRRCSPPGRRQPRLRGSPAAALR

SEQ ID NO: 28917 - protein, 366 aa, Pseudomonas aeruginosa
PSWRRRRGHRARCPPAAGRHRRRAPSERCVRSCPVSRQGREGRPLQHVVGHSGEKPGDVPVAPLEERHLGAERRQLGAIDSRLLGGLEGASGILQAALFEGDAPGQQMQVGRGCAAQRLVGMLARLLEDVLQHAALGQPQVGQFPVPARQGSVQRAASRRRGAGEAAEGGLDALVDPAFLLVEHRVGQQADVVGGVAQGQLEDRDRLLAGHPPGGEDRREPLVRVRRMAQDVLQTAVAEHHVEALFLRPERQLGDAHRLPGLLATLARQVQRREYRRSDADRSDQRHEEGQAEEEQRAPRQRELVAPRQQQPYADAQQRAAQAVGEQVERQRLAERQVGEDARPTAQLEQEGAAKQPLADHSGRTR

SEQ ID NO: 28918 - protein, 920 aa, Pseudomonas aeruginosa
SAQAQGLVLVAAGIQCVGVGGLHQPVVGIGLEVQAEPGQRLVVTLEQQAGAGERQPQRAVPQRQAMPLRQQGRQAVATATVDVEPEQAFAHQVLAGETHQGFPVQTLGDVAMAFLFRQPRPSHPVIGAALRFRQAFGLGQQALQGRPVVEVLRQLQGAGQAPRIAAALPTADKHLQGLLRIAVPVQGDQLVLVAAVQADVQGQHALVGGAGIVVLLQGPGQRRAQAPELRLADRAGIHAGEDLPGLARIEQVPVGFRPLHAFLDTQREMPGHPRPDPGLFLQLLGVFENLLQALPGQALFRITLHVAAQPCLALFRRAAGFMAVDQRIEFLVGHLSLRTDGRQQLDGAVEIEHLQRQAPGMPAQGRVIGAGQQLLPQAQRPRAVAGPFAKAREIGQQRPVLRAQGQQLLADLPGPLDPPGGHVQTQVGGQRLMVLGAQFAPAPDEAFGQVVALAAFGGAYALGEPGQGRFILRQGVQPLVQQQRRLFAALASEQAGEGLAQIGQALRRLGLRFGQLPLDVRRRQRLAGSQVPARRLVQPALPALRVAAGQFGKGPRRQVRRVQGQGMTGKSFEHGVVQRNVLDLAQALQQSARLLLIHALGPGQGAKDVQFHLVERRCQAVLAAQTGEVMTRLLEVAELDQQVDQGQAQRVVLRVRLQQQFGVVHRDRVGLAIAAGHEYLFAVEGQPQHQRHPESDRQQGPGIQQARLGMLVSGRRVGHRAPAPSATRTSTGRCRPFPGRPCRPRSAGNRPPRAPPGAMAGARRRRTRRGHRRGSASASAAGWPPPAPAADRGCRAGPGAHSPHSGVHSAPGAGRARPRLPWSERGPANPAPGPGAPCARRRSRATASCHRHAWPGWRDAGLPGAGCSRSSTATTDAPPASPRRSGAWCGSRPAWSPNRSGSTGAGRAGGAGCRSGRRYR

SEQ ID NO: 28919 - protein, 373 aa, Pseudomonas aeruginosa
HVRDRGASSAAERSLLPARARRPRRAPPSDTPAGLGTGSPDNEQRARKHAAQERPAGTEGLPVEPDPRPGKTRRPPADRAASRRPPAGGRRAGTGQDQGHQGPRRRPRSRVPPYPVHSRPAPRRHHRHRNLPSGDRHLRVPARPDLPSPGAGRRDQPRPGQGAVGAARSHGRAPGFGRPQHLRPATAVPGDGDTEPDRAGRYLPVAGSPARPLPHARQDRLPGGLGGTPHTPAGAWRGTERRGPAGAPGDPGNHLRRAPGNPRPVHGRRGGGIPGATDHGHPHPGQARRGTRRMDLLRRQPARLHRPRPLRARPRLAGRTRLRQPRGHPGGAVRRAAPSPDPDLRGGSRRHRPGPGRAAHPRRGRRGLRPPPC

SEQ ID NO: 28920 - protein, 193 aa, Pseudomonas aeruginosa
APPRASNWASTSFWKCATGSTKRACSPRRTAAARWSACITRACADAAWTSTRCASTSPATTYGPSTGASPRAPASRTPSCSTRNASDRCSSWSNRASACSSAPACASRRCWRHARRPSSAGRRWPTTTVSAAWYSATATATKSSRDAASTACCNCSTSYCGPIASCARRRPSGLANCSAWPYAAPAKCCARAA

SEQ ID NO: 28921 - protein, 1034 aa, Pseudomonas aeruginosa
RPAGGDPPADSRDACRRPVADPPGAGPAQAARPASHAQRRADRDRRLRRQRAYPGAAVGRPAHRAQPARRPETFDHARARPARRPRRAPGPRPAGTGRPGPRPPAAADQRAERTRAPGHPQRPRAPGGAPRRARRRHAEGRSGAAGGWQLPQGRPGRHPPAQARRKRAAPLRRGDRRRLPAPAAERPRPRQPRPAGPRRHAGGRSRERPAAPAALGRPGLLAAPAAAPAGRLCRTARLAVLPAAVDAEPAATGHGLPVRRPLAASGPARPAPVATGPGGRGGEALRGLPLERPVALPGPRVRRRGPGLRPRRPGRRSLQPWQRPGPPGRTGSRRRRLRTSPGAPAATGRRATQQGPGRGTAAPTPGTGGAAAGRREQGTAPGSEPAEPAIRKQPAAAARRGDRRCAEGPGRGALDQPAGRRRREDRRSTRPSAAAAQRRGRADGRRGSRRRTRRRTSPGPRAMAATDSRRSRRIAAAQVLVPTAATPGSHAMIRLFCSLLLALLCVSAHASFSASVDRARLTEGESVELTLESDDPTLFGKPDLSPLDALFEVLGTRQVNRLATQNGRAQATTRWIVTLLPKQSGYVAIPPISLGASSTQPIRLHVLEARDRAKSSKLAPVFIDASVDQETVYVQAQAILTLRIYHSVSLYDDSSLTPLAMNDAKVEQLGEARTYEKEINGIRHGVIEVRYAIFPQKSGTLEIPAQAFSATLVDRGSDDYNPFGPRPGRQMRVTSPSIPLQVRPKPADYPADAPWMPARALSISESWSPQPEQAQVGESLTRNVLLKVEGLSGTQLPPLPLPDVQGLRRYPDQPQLADQSTDQGLIGSREEREALVPEQAGRIELPALEVVWWNTREDRLERTSLPPRTLEVAAAPQAEAEPPAAALPLGERLEPTLWPWQLATAVLALTTLLGFGLWWRARQLPAVIRAAANGPSSRSLLDELRRACLANDPHATRQALDAWARQQPDTLADMAARFVPLSDALDGLNGALYSESGHSWQGEDLWRAIRALPTTEQAPAGAVDNGGLPPLYPR

SEQ ID NO: 28922 - protein, 251 aa, Pseudomonas aeruginosa
  UNSURE (48): Identity of amino acid at the above locations are unknown.
SRSRCSSRRGQRPRRTRHSVPSVMRTDTMHIHVLVVEDNFDLAGTVIXYLEAAGVVCDHARDGQAGLNLARANRYYVILLDIMLPRINGRQVCRQLREAGLQTPVLMLTALDTLQDKLDGFDAGADDYLLKPFELPELLVRLQALSRRRSGQAQRLQVDDLVMDLDSRQASRGGTPLALSPTAWKILECLMRASPALVTREQLGRSVWGDEPPESNTLNVHMHHLRSTVDKGFATPLIHTLHSVGFQLERK

SEQ ID NO: 28923 - protein, 145 aa, Pseudomonas aeruginosa
WKRKGCTSPSATRKTRLRRRRTATTSRAASAPRGCRRNSGRCSTPRPTRASAPCNCSATGTTMTKRRMTTRPATMPTWWSASHWPTARRSTSTTTTPPAASTRRCPTPSSTPASGRPGSSPYRSPCLRWPPSACWSGSSSRRCAS

SEQ ID NO: 28924 - protein, 433 aa, Pseudomonas aeruginosa
PAGAWVMPPVQAGMLPAALPAFSAPSGVRLDFSCAASPAETPASAPPLPSASAREAPISRCLFNMRVLRVRCRALAAPVSLSVRSEGVLHGQADVVAVADVVVLPAAVELGVLQFAFQAVQVGGLDPQGVGLATFDEVAGLVGVAFEVVLVDHVGRHVDPGEHVVPGAAEQQGVAVGVAVHLVATVAAGNVRAVAAPGIVAGAAVVGGVLQAAAAQVFRSQLGDAGQRVEAQRRTEVVDGPEGGVERLDPLVVVDLPAEADHLPADVDLPAVGGFRRTVGEVADQVVGGGDADRQVRPVGQLAEHRGVAHRGVEAEAVHADVFGELAAGIDVAHHVGGHQAVGQGFGEVAGDRPQGVGQRRQVGPGIVADVGVQGRLLGVVVDEVEAELGAVQFLGDVAEGHAELAVVARVDVLADGRHLHHVAVGRGHAVGI

SEQ ID NO: 28925 - protein, 463 aa, Pseudomonas aeruginosa
AGVLQRAAEQRIVAQRLVQADDVAEAGHRGVQRGAGEVAVAGVAAVGEQVGLGEEGTDRVEAGFLPVPLVEGFHRQVVGQADVEAQRFHRHQHFLELGTGQAVLGGVHRVGGVDPATVEDALAPVEHLAAEARAQRHVADVPAAVDVGVEDFRLVPGDIAGLAGETVVVGIALARLRWIVVAVVVVALVHDLGVIERRAADEHAIVAPGRLQVRGDLVDLGNQAGIEVAVAVVGVDVVVALVLPLHPPQGAVGQGGVERTGHLVVEEAEFDGLGLAAQQRQQPDEGEAGPGRRGAQPGLAVGDVHRELTPCGHALGAATAGGSPFGRFSAALLWVVAASPASHRRKGTARRGSATGMPIQRNPPGNSMDCEKNRTSCGMTVHSLTRKQEVSDKTRQANFAGGAKSPFAEPAQGGSRNTIKRTPSMENSEAIPRSNKGRYQPVASNTLFRAKLADQARLLLTTS

SEQ ID NO: 28926 - protein, 781 aa, Pseudomonas aeruginosa
SGRVLSGRRSPWQSATVHRTGAQRPAAPTRADRGDTQNLCELEKSRFQRSFSATQQIAERLSEFGGQARTLVDGALGIQLGGDVGATDQVHALAGRQQAVLQLAQRVLAGADDHGIHRQHLRLALGNADMQAGVVHPEILHGIHHLHLLVLHAGAMDPAGGLAEAVADLALLALQEEHLARRRMHLGLDPGDAAAGFQASIDPPLLPERLALQAGGRTGMGDEFGDVEADAAGADHRHLATHRLALEDRIQVADHLRMLDAGDRRCARNDAGGEDDLVVAARDQVVHADPAVQVQFDTGALQLVAEVAQGLVELFLAGNPLGHVELPADLAGGVEQADPVPTLGGHGGGGQAGRAGADHGDFFRPGGGDVVQLGFVAGARVDQATGQLAAEGVVEAGLVAADTGVDPFGVAGGGLVDEIRVGEERPGHGDHVGIALGQDLLRHLGSVDAVGGDQRDADLAAQLGGDLGEGRARYLGGDGRDARLVPADAGIDQGRAGLLDGLRQQHDLVPAAAALDQVEHRQAIDDDEVRPHRLAHPADDLHRQAHAVLVAAAPAVGALVGVLHEELVDEVAFRSHDLDAVVAGDLGQAGAVDEVGDLLLDAFLVEFLGLERIDRRLDRARRHVLRTVGVAAGMQDLHADLATRLMHRLGHDPVLLRLFRRAQLGRAGIHAALLVRADAAGDHQADATAGAFGEERRHALEALRLLFQASVHGPHQGAVAQGGEAEVQRGEQVRIGNGGGHRGSPHRAKRVHGYAAASGAMRGTGSGRYGDDSKERHRSAQ

SEQ ID NO: 28927 - protein, 191 aa, Pseudomonas aeruginosa
SECTGMLGKPTPLPYPVGCLGDPHAQADLPDPHHPLRRLRRLGRTPPGRPLPVRPAQPGQRGPGPARRARQPAGGPAGTVHAGLPERRTVATEIPRLPGKCPPPGPAQRAHGGGVPRACRHLAGGQRREARGLRRCRLAHGDGLDGREQPTEGGARLDHRARRSASHRHPVPDEGGGHGPRLPDPVRRARP

SEQ ID NO: 28928 - protein, 167 aa, Pseudomonas aeruginosa
FQGDGGRRLHRPARPRGRGRRAASRHRPAVQRQPDLRSRRPAARPAATQGVPDPPRTELPQQRSRRAPAGAGYAGRTPGRADRHRQLVPGHLRHPGRTARRTAGDPRRPEPERSLAAALARLRCGAGSRRRTPGAEQPEQRRGLAAPGGRRAPAGQRCARRRRGLRP

SEQ ID NO: 28929 - protein, 380 aa, Pseudomonas aeruginosa
PPVERHRRRPEPARFVAGHAPGQSRRRCATGQSLAMSAPRVRLGDLSVGFVQALADALLAAGVEPAALLEQYGLDQRRLAEPGARLSIPRYMRLGHAAIQLSGDPALGLQMGRLSRLGQMGLAGVSVAQAPNMRAAARAMIHLEPLYAQNYRGQSSLVEDAGGAWLRFYSISPYNAYNRFVVDSVLAGWISHLGALARQPLKAERVEIEYPAPPWAERYEAFFGCPVEFGAPTNQLRLSQASLALANAEHCPSTWSQMLELCNRELEQLTRTRSWRERVSRLLGPMLNGREPDLEEIAARLKLPTWTLRRKLAEEGTQFRSILNDTRRDLAMVYIRETDLAFGEIAYLFGFASAEAFQRAFKRWSGQTPGEFRRAQRQSA

SEQ ID NO: 28930 - protein, 485 aa, Pseudomonas aeruginosa
STTSRRNAPSQSSARRSRAGSPRQRIASCEVSAWALRRSWNCVITFISTSYHQTRADRRAIAAGRTQLHRQPGLAETRTQPFQHVETGSPHLEGDVTASGAEVQLLDAHRWLAADHRGGLAKQAEQLALAAAAGAVGQVLVELRAQVDQLAVLGKQLAVEFCALRRVAVAFALQLPGLDQGKAPLQHQPQPDQPQQRPPAAPLAALLARGELGLGQVGAQRLLAQPDVRIARQGLDFHSLRGRHLLRGEGPLGRRATVAQYRPILAAAGQAYGAAAAEQPALFQPEQATALARQAIGIDMQRSRRLARALGQRQPGGKPGALHGEYPVAAVGQRRPKGKVHLLDIVGQLFLHRERQRLAQPARLLCRQVHRAGGHRLHRQVQPPGRADLRQRLGERRAPALAILHPPYRQFPIGPRRAGGRQEQRTHSTHRSSFFQSSPPVDGMGRPPCPMSRAITRILPSLPRCKVLTSTCRRSPRLTSLITWK

SEQ ID NO: 28931 - protein, 229 aa, Pseudomonas aeruginosa
SPAVASWLAPEETDEARRGAFLDAATLAAEGLRRDPDDHPPHILLGGAVDLGAPLPAAPGELQLALVVAAGGRRLFQLQFVETVVGDPHRQGLVFQPRGVLQAARAGTEHAGRDHGEDRQGHQHFQQGETTRALHRRATSTRGRRKPSLLSDNARPSGPRSARRRRNGLSSPLERISNCGWSVPFFCSFSPLLPASTSGWPSSSKVSSAHSGRRWLSRATGNQRAFASS

SEQ ID NO: 28932 - protein, 468 aa, Pseudomonas aeruginosa
FTRLPHELVERKDRKKNGQDDDQHHRAHEYQHERFEQADHQADLRRQVVLLVARGARQHLVQLAGALAAGDHVQHHRRELSGGFQRAGQAGALADLLRGLDHFVADDPVGDHLGGDRQRLHQRHAAAGEDRQGRGEARGVGGTHQPTDQRHAQQEAMPALAKGILAQRVAEADHPADRRDEGQRAPGLDPVADADQHAGQQWQGLPAVDEHPDHVGHHVAQQEADDGQRSDHQDHRIEQRQLDLLPRLLALLGVVGKLLQHRAEVPGMLAGSHSRPVQLGKGGGKLAQAAGQAMAFEDLGAHREKHRLDALRGGLRRGGAQRLLDRQRGLDQGRQLPGHQCQVARGQSAGERQAPALPALLAGTGGLHVERRQLALAQQLADLARAVRLQHALLLATAGVEGEVFEGGHYSSRVTRRTSSTVVTPSSTLRRPSSRMLGPLVRACRVISCSEDSLWISERMWSSNTTSS

SEQ ID NO: 28933 - protein, 322 aa, Pseudomonas aeruginosa
GSLHAGQSTRTRRWASTPSMEEDSRNGSMPMSTRRVIAPMALLVCRVESTRWPVSEACTAISAVSRSRISPTITTSGSCRRIARRPRAKVMSTLALTWVWPMPSRWYSIGSSTVRMFRVRSLSVVRLAYRVVVLPEPVGPVTSRMPCGLRTVSSISLRSRSLMPKCCRFRRPACLSSRRSTTRSPLAEGRVETRMSTSRPPTRREIRPSWGIRFSAMSSRAMTLIRDTSRAASSRLGSSTSRSTPSTRKRTTRRFSKVSRWMSEAFSRIASPRIALIRRMIGASSSCSIRSSVSGTWSASAARSRLPPRSSASCMAAEESCW

SEQ ID NO: 28934 - protein, 753 aa, Pseudomonas aeruginosa
SCTRSTATASNCSAAGAWKACPSRTVPGDCWPARTTLQARTTRSNNCKACRMRTLQHCASAWTPCASRWKPRPSQNPPKKTRASPRPRLRKATDPMSQPLLRALFAPSSRSYVPAVLLSLALGIQAAHAENSGGNAFVPAGNQQEAHWTINLKDADIREFIDQISEITGETFVVDPRVKGQVSVVSKAQLSLSEVYQLFLSVMSTHGFTVVAQGDQARIVPNAEAKTEAGGGQSAPDRLETRVIQVQQSPVSELIPLIRPLVPQYGHLAAVPSANALIISDRSANIARIEDVIRQLDQKGSHDYSVINLRYGWVMDAAEVLNNAMSRGQAKGAAGAQVIADARTNRLIILGPPQARAKLVQLAQSLDTPTARSANTRVIRLRHNDAKTLAETLGQISEGMKNNGGQGGEQTGGGRPSNILIRADESTNALVLLADPDTVNALEDIVRQLDVPRAQVLVEAAIVEISGDIQDAVGVQWAINKGGMGGTKTNFANTGLSIGTLLQSLESNKAPESIPDGAIVGIGSSSFGALVTALSANTKSNLLSTPSLLTLDNQKAEILVGQNVPFQTGSYTTNSEGSSNPFTTVERKDIGVSLKVTPHINDGAALRLEIEQEISALLPNAQQRNNTDLITSKRSIKSTILAENGQVIVIGGLIQDDVSQAESKVPLLGDIPLLGRLFRSTKDTHTKRNLMVFLRPTVVRDSAGLAALSGKKYSDIRVIDGTRGPEGRPSILPTNANQLFDGQAVDLRELKTE

SEQ ID NO: 28935 - protein, 188 aa, Pseudomonas aeruginosa
PWERRVFCNSSARARLDRLASCTDQLCGRLLASRRFSAGGGLGGAAGGCGWLGGRLAAGAWAWAGGWVAGGVAGRPPIGWLGWPAAAGEPSSTISGALPSSPGCSSGTSVGCTSTLGMAGDCGRGGASTTTWRDSSSRVNSIGRKITARAISTNAPTMRCFSPLSSKAMINSPLSVLRASHSRPSATL

SEQ ID NO: 28936 - protein, 147 aa, Pseudomonas aeruginosa
RPTADWPGAAATRHDARSCRWRHAQGGTRYAGSLPAASRGRSARSRGDRRSRSAPWVRRRSRRRASPGWRKRRRRPGRSIPRRTGCLLRAGAPGPPRSWPSASARSALPACARRRRRRSRSAGSASPGRRWLRERSARRRWRPSNRP

SEQ ID NO: 28937 - protein, 148 aa, Pseudomonas aeruginosa
ESLHFRIRPGAPATRGLPPAGCRYLRPGLRRGYRARLRYRPCRCRHEPDPAWSPLRRHRRGSRSHRRRLRPGRRRPLHLRRRNSASRSSARQGCWPTRPTAHSPRPTGRRNCPRPSPERPAPSARRPATGRSRPAGTTPALRQPRYRG

SEQ ID NO: 28938 - protein, 341 aa, Pseudomonas aeruginosa
NARRRYRCRPRPEHRKSARWSSRPAAQRLRPAAQARRGSGRRSRPFPGPAHPPVPRRHPRRKPGLLPSLSAHCAATGSSAAPATPAVRYRRSPPTTAGWPAVRRGSSVPAALPPVPERAPERQVPEASRQLARAAAPPEAAPERRVLLRLEQESALPQRESRAEPAPARPHWAGTHPAGLRSAGLRPGLRRPTALAAWPTGRPSAGSTSAACPTGSADPACGSAVLRSRGECYRGFPWSPPGYRRAPCCRPSRPCRHPCWPCPRQTPGAGCPWRRPWMAPTRRHCAGSHPTAWRQRCPRPDCGCRASSGSAPAPGTAPRAASAPASAVRWECAGPGRSSAG

SEQ ID NO: 28939 - protein, 787 aa, Pseudomonas aeruginosa
AWHFTCPPSPRQSRRHPLRAAPDRSALQQDAQHAPQRLGSAPQQLVANGEGAEILGAHVQLAQAPDRNAQGAGDGGRGQLAHAYLAVVRHQLDPGIVLADQALDVGQRHILVQLDGQRLAVATHGADAHADTVDRDRVLEAGEDLVGLRLGFPLLAALPVGQFLVDPGDQAAAQRRAEMLGGEGFAAQGLRHLAVDVEDRAGRVGQVIRHRCMGGAHLLEQFTHVLRAGAGGGLVGHGTHPLDQAGVEQPAQGHQHQADGAVAADVVAGAGVQSLVDDLAVDRVEDDHRVVFHAQTGGGIDPVALPAGLAQLGEYFAGVVAALAGQDHVEGLQLVDAVGVLQRSDVLAHFRALATDVRRGEEHRLDQVEVPLFQHPLHEYGTHHPAPTDQTYTLHRNYTYMREVSWPAAIMAPAKPVRLQILECRDYGIAHFPGADLAAAFGPDVAGAQPLVEDLAHRLLDGVGGGRLAEAVAQHHRDREDGRQRVGDALTGDVRGGTVAGFVHALVVRVERGRRQHADGTGQHGSLIRQDVAEHVVGDHHVELLGRAHQLHGGVIHVHMGKLDVRVVLRHLFHHFPPQLAGGEDVGLVHRAEPVVAYAGHVETDAGDTTDFALAVRQGVVGLALAVLQHALLAGLAEVDAAGQFADDEDVQPGDHFRLQAGGRGQLRIEDGRTQVGEQAQLRANLQQTALGTDIAFDPVPLRPPYRAQQHRIGLARALQGLVGQRHAVLVDGRATDDVLGQFEAELEPVVGQFQHLDRFRHDFRADTVTGENQDLLAHNTLLSFIH

SEQ ID NO: 28940 - protein, 272 aa, Pseudomonas aeruginosa
TYSGRKTGRTLPRMRPARGLAWRSAEQPGLLLAVAVLEGTDRIGVLQRQADVVEAVEQAMLAERVDLETQHLAIRTGNGLRRQVDGQLVAFVRLDLAEQFVHLGLGQDDRQQAVLETVVEEDVGIARCDHRAETVLVQRPGRVLAGRAAAEVLPRQQYAGALVARLVEDEVRVQRTLRVVLSRLPDIQVAPFVEQVGAEAGALDRLEELLGNDLIGIDVGAIQRSDETGRLGIGFHLGSPQASNSRTSMKRPLTAAAAAIAGLTRWVRPPAP

SEQ ID NO: 28941 - protein, 194 aa, Pseudomonas aeruginosa
RPSKLRLEVEAQCSPLSSRSGFIARHMEQPGSRHSKPASMKIRSRPSFSACSLTNPEPGTTSACLMVAATLRPLATSAAARRSSIRELVQEPMNTRSSWMSVIAWFGRRPMYFKARSIEPRLIGSLSRAGSGTFWSTARTISGDVPQLTCGLICAASSSTTVSKRASASDTSPCQQATAWSHCSALGAKGRPFT

SEQ ID NO: 28942 - protein, 220 aa, Pseudomonas aeruginosa
SMVFWSTATRPTRAPASIDMLQMVIRPSMDRSRMALPANSMAWPLPPAVPILPITARTISFAVTPAGNLPSTLTSMFFIFFATRHWVASTCSTSEVPMPWASAPKAPWVEVCESPQTTVIPGRVAPCSGPTTWTMPWRTSFILNSVMPKSSQFSSRVCTCRRETSSAMAAMPPLRSVRVVGTLWSGVAMLASIRHGLRPARRRPSKACGEVTSCRIWRSM

SEQ ID NO: 28943 - protein, 62 aa, Pseudomonas aeruginosa
TTSPARSAAGWSWPPATTSACIACRRCCAPSPGRIRRWRWISSSWIRKWPTRRSFMVVRNWR

SEQ ID NO: 28944 - protein, 173 aa, Pseudomonas aeruginosa
RLLVVQCRALAIDGDTLRLGFFRNQPHQVDVQQAVGQRSRLDLDMIGEAERQLEGALGDALVQVGHVVRGLLALAATDGQHAALDLQVQVFFLEAGGGDDDAILVVTVLFDVVGRVGTPGLIAQGRLEQIVEAIEAYGMTEQRGEGKSVAHCESPELSASTLVRNPSSASRTN

SEQ ID NO: 28945 - protein, 259 aa, Pseudomonas aeruginosa
PSLATDLGSIIMRNVMLITGASRGIGAATALLAAERGYAVVLNYLRNREAAEALRQRIERQGGEALAVAADVAEEGDVERLFAAIDERFGRLDVLVNNAGVLEAQTRLENIDAARLHRVFATNVTGSFLCAREAVKRLSTRHGGRGGSIVNVSSMASRLGSPNEYIDYAAAKGAIDSMTIGLAREVAAEGIRVNAVRPGLIDTEIHASGGEPGRIERLKGGIPLGRGGTAEEVARAILWLASDEASDSTGGFIDVSGGR

SEQ ID NO: 28946 - protein, 186 aa, Pseudomonas aeruginosa
PRRIFEVTAISLGTARRTAATMSCISSGSLSNTAPPRERFTVLAGQPKFRSITGAPSSQANAALSARHAGSEPSNCTRIGVPARVRLPSRSSGASLWKAVAGSRRSVMRMNSVTHQSMPPTRVSTSRRISSTRPSIGARAICTNHYLENDRRRILYNPPPGTKCECLPADARRVRPRRAEPGHSRR

SEQ ID NO: 28947 - protein, 364 aa, Pseudomonas aeruginosa
GRSRTDRRSPNSSMLLQAAGQFARFPGQLCDLIPGPRPDQARRRQPGAADTGDIGQAEEIQQVVQVDPAGRAEADAGERPLQAFQHFHAGSAIGREQLQRAITVLQRQQHFRRRHHPGQVWQAGILRGGGKARRASGADGELRARVACLEKLLGVDQGTRPQQDLGHLAMDGGDRVQRLRRAQRHFQHRDAARIQRARQVGRQRHVLDHQHRQYRAGLQQDPIQRQCHGHSSIRNGSPRRIAPRGPQRFLPKNRGQDNDNPSATRLRKRSPSFPRAGKRASPGAPRAAPAATRSACARRAVGGGRRPAGAASDWPARRHGCARHFPPLRACRRRHAPPVRAFPDGSAPHPGTPRICPPAARPGG

SEQ ID NO: 28948 - protein, 134 aa, Pseudomonas aeruginosa
NASEPGPANRRNERTGATVRESATAPRPSPALRCAAPSGLPATPPRHPGNDRPPHAAAATRQRPPARRGRTAPRSPPCPASGHGPAHRGHTPNNPRRPVARSDGRTVSACRPSHAAAGLPAPLPSATPTARSAE

SEQ ID NO: 28949 - protein, 545 aa, Pseudomonas aeruginosa
RSCSRPTTRCMAASAPACPSKPRSSSVTAEALARPLGEPTRRDWIAVLSAMLGAFMAVLDIQITNSSLKDIQGALAATLEEGSWISTSYLVAEIIMIPMTAWLVQLLSARRLAVMISVGFLVSSLLCSFAWNLESMIVFRAMQGFTGGALIPLAFTLALVKLPEHHRPKGMALFAITATFAPSIGPTLGGWLTENFGWEYIFYINVPPGLLMIAGLLYGLEKKAPHWELLKSTDYAGIVTLGIGLGCLQVFLEEGHRKDWLESQLIVSLGSVALFSLVLFVILQLSRPNPLIDLGILRNRNFGLASISSIGLGMGLYGSIYVLPLYLAQIQGYNAMQIGEVIMWMGIPQLFLIPLVPKLMKLVSPRLLCAAGFGLFGLASFFSGVLNPDFAGPQFNQIQLLRALGQPMIMVTISLIATAYLQPQDAGSASSLFNILRNLGGAIGIALLATLLDSRAKVYFDYLREALVPTNPQVDERLAQLAAQLGSQQAALGKLSEITHQQAMIMAYNDAFHVIGMVLAVSMLAVLLTRSLPAGIGTRADAGAH

SEQ ID NO: 28950 - protein, 679 aa, Pseudomonas aeruginosa
GSDVDQALAQRLDLVAQLRRRLELQVAGQLVHLFLQLADALADLARRAQFVLVAPALLRHLGHALALAARAGHHGAFENVLDVLAHPLGHDAMGFVEGDLLGPTPLGLVDRTLHRAGDVVGVEDRLAVQVARGTTDGLDQRALRAQEAFLVRVEDRHQRHLGHVQAFAQQVDPHQHVERTGAQVADDLHSLDGIDVRVQVAHPHVVIAEIIGEVLGHALGQGSHQHPLVLGHTLADLREQVVHLGHRRTYLDLRIDQPGGTHHLLDDPPGMLRLVGARGGGDEDGLRTHRLPLFEAQRPVVQRRRQAETVFHQGLLARAVALEHRADLRNADVRFVDNQQRVGRQVVVERRRRLAGGPPGKIARVVLDAVAVAQLEDHLQVETGALLQALRFHQLVVVAQVVQAFLEFGLDLVDRLQQRLARGHVVALGVEGEARQLADHLAGERIEGREAFHLVVEQLDTNRLEIGFGREDVDHIATHTESRTGEIHVVAGVLQAGQSPQQFALVDAVAAVQVQDHLQVGRGITEAVDGRHGGDDDRIRTLEQRLGRRQAHLLDMVVDRGVLLDIGIGRRDVGLRLVVVVVGNEVLHGIVREERLELPVELGRQGLVRRQDQGRALHLGNHVGDAESLARARHPQQGLVRKPRLQPLDHLPDGFRLVAGGLEARVELERIHEKPRREL

SEQ ID NO: 28951 - protein, 140 aa, Pseudomonas aeruginosa
IGPRAVPGEASDPHQLFEPTDPRRQRRLLRAQQPGTAGPLGAGTGRDARPHPRHAPGDGRATGSPRRQARLQLRRSPTWHVLLFRPDRRPGRAPEDRVRYLRRQHRPYLRRRAEQIEPGDHHQGHRPGPVGKMGKSSGEA

SEQ ID NO: 28952 - protein, 637 aa, Pseudomonas aeruginosa
RASCPSTKPPYRRGTHLDRQPQQSSRFLVRHRKHRTEKTKKAARRPFPENDDSGFSPPLAIDPVDDFTVRRIAADGFPQQLANPRVVVLLHGGQQLLQHDLEGLPAQVFLVGPHDHRMVGGIHVVTDQQLFVELLARTQATELDGDVTMGRTLGTHAQAGQVDHLLGELQDLHRRPHVQHEYISALPHRTGLDDQLRRLGNGHEVTGDARVGDRHRAAALDLLAEQRNDRAGRTEDVAEADHGETGLVDVMHVLPIAEQHRRRFVAERLKDHLRQALGAAHHIGRPHRLVGGNQHEVLHADLHRGLHRMQGAYHVVENAFGDVVLDDRHMLVGRRMVDGIDLPGTHHVHQALGIAHRTEDRQQVHRKRLALDPTLQFLMDAIEVVFAVLEQDQHARRTTHDLPTEFRTDRAARPGHHHHLTADAPFQQLLARCDAVAPQQVSDVHLLQVVHLDPAAGQVHEAGHAAHVQRERLQGLENLSAPGPSGGRNRQENLLRARLVDHLADMLGGIDPQTGNDPVGDLLVVIDERHRTHRPTETQRRNQLVAGRPRAIDSHPGQAILAIEKWYRLHSRVPVAHEILAHGQTQAADQQHAQPPVVEHQGTRHRRRRGAVPIDQQRQDQRGNGDGLGDRDKGVVA

SEQ ID NO: 28953 - protein, 60 aa, Pseudomonas aeruginosa
KRSHVRFTQQLLRHILMGVEDNLLTLLFQSKTNRYQFGIMKMIDISPKRQSLFINFSGGF

SEQ ID NO: 28954 - protein, 79 aa, Pseudomonas aeruginosa
ASTARTATARSPWTSSRMFLPELTATIPFSNLELLDDMLMNDPAETCCKQVTEDGHLLFYLNAQAPRRTDALRYQRPVR

SEQ ID NO: 28955 - protein, 150 aa, Pseudomonas aeruginosa
SVRFLTIPLTCWPSCSDSSRASRSALFSASRTLRRETTTLLRFWSSLMTLNSSSLPSRWVVSRTGRTSTSEPGRNARMPLTSTVKPPLTLPLMTPLTTSSAAKAASRTIQLSARLAFSRDSLVSPKPFFTASSATWTSSPTLMVSSPCSL

SEQ ID NO: 28956 - protein, 101 aa, Pseudomonas aeruginosa
VAAGNSLAKALKTVRKARGLSQEAFSDVSSRTYMSTLERDLKSPTLHKLAELCEVMEIHPLTLLTLAYAGDSTHKADELLAQVRRELEAVLKERGAAKPRA

SEQ ID NO: 28957 - protein, 78 aa, Pseudomonas aeruginosa
RDGQEPPALRTGTHLHNLPQRAPACSPAPAHRGGALAGPIRRSRFGGIEGRQASRGGDSPQGFPLEASEARSAAGAKA

SEQ ID NO: 28958 - protein, 548 aa, Pseudomonas aeruginosa
SASSSILVSVIRESARRGRWPRTAPCGAGSARQSCRRTPSPTAPPGWAGLPCHKRPGARPRPACGCAGRCANRASSARYSPSRRRACAPPRSVPECRPAAPKALWTMLRMTGACSCRRLRKLACARDGLAPAGHQFGRIAHRLVLGVDVVHEHRYGLVARQLHAHFGRHARIGNVGRRAMADAVRADVRDAGGLEHPAPAAIVLAKGQVLGRVVRRWQDVGAALPARRRRKQPIGFLAHGLGNAADLAVGPHHAPVLEVQPAPFERADFGAPGGELELQPDRQRDDVVLQPLRLQLLQLAEDPHHFLVHDEPGFLARRVHGDVAARVRAVRAVAPHFGQVEHLAQHAEGLVRLGRLVGQFLHQPGNVGPLHVMHLLAAQQRDDVAVYDALIAVLRAGLVALLGVVLHELLAQLGHRGRLARLGLGAAGVAAPANLGQPVLCLDSCLFDGQLPVQPQRGLAGLAGVRAVLEHEHPAAGRGNLAQEAGHHGIPQFNILGLGLGRLHGGLGELDLCHDDSSEQPGFQEPDRSGARENRVKFQKAPAYDGRA

SEQ ID NO: 28959 - protein, 552 aa, Pseudomonas aeruginosa
ESRERIFRSSKPMPAMSCNLRGFAVQPAVTSEHQRLGVVAFDPLQADRLGRLPALRIAQQGEDRPRSGLRVGDRHHLPGATQGAIFGVGAFDQFAAGADVAAHHRGAGSPGFEDHQRLRFADRGEDHQAELRQDLADPTETEELHLVLQAEAGHQAAAFAGIVRIFLLRTDDPALRLRHRADHPAHGADEGLHVLDRHYPADQPDHRRNPRRPPFEGAGPGIEVDAVGDHPGAPWLGAIEYLALAVAFVEGDDRIGRAIGEQADTLEEADPQATDVADLGIQSGTQLLVGVLRDPVGLGQVDFALLGVDAVLAEQVAAAPATLQDAAQQAGVAGGDRVQHARPRHPPGRLGEHEHRRLHRAQGPEVIDEGRIGAIALVACGDRLPTGLAVEKVLAADAALGEQVEQRVALLHVRRLRVVEETVQIAQRLFGLATALSRLRVRRTPGGLQEVFLDVQHIVRDRVVALAVGILLAADEEHREGQVGETEDQLVDPAGDAAADIGPGALQQQADIGDGRRRSGVFGHVQYLARAAKGGRCSMSSGIPARSRGMSR

SEQ ID NO: 28960 - protein, 553 aa, Pseudomonas aeruginosa
SASAWPNGRSAKTLAQLLSSNRKAPLNSHLLIIQAALVEKEMSQRLPIVAGVQFVLADAHAQRLQLAGLAEAFGEENPQALQIPLGAFGGSQRQQHQQDPPALVVAQSQLHVEATLAAFQQTLDLFAVARIGQLEGIQAGRQPMVAGVQQGALEVLGEALGVDVGQLQCATVALQQVGDVPGEDRQQAEGTFVEDEEWHLLHRQQGEDPPIGVDQRHAHLQRAVRTLLAALQQFLAHADQFAALQAGAHQQIVGVQRRHLAERRQGLRLRGAVVAHPVESGDAQRTVLGQQRQHGFRQRIERCLIARQLAQQLSQTEQRTAQALVVAGDPLFQAIVGDAQDVMGAGEFVEAQLAVLVRQLQALQAAFPDVAELAHQHGAEQHADDEGRRYLGISLDALDAKREQRRHQQRRAGQPADEAVAHAQQQGREDHPGKGGVDLQRVVRAEPPAQAQRERADDQRLDPGDAAAGARCEGEILVRGHRRHSSRRSPTSSRRTFCAAPARLSRDQPARAPLVLQSTRPEAGSSTCRLTPTAGSPSRPFLYCHSSTLPVTT

SEQ ID NO: 28961 - protein, 830 aa, Pseudomonas aeruginosa
FTETASGSPSPLGMNTSSLLKVSHSTSATPRATGSRAQGFSRRAWGCLSAADELAIAHLLHRQLERPQAVAGLSREGLAGRAQPAIARRAHHQAQWQVPGEGELDAAIVAVAPVLQRQVGLLQRRPRIAAVAQDQARIRRTQVYIAPLGQVAHARDSRGASEVRPTQRRVQAHRAQGGEAAQLPAAIGTLGQAGAMQAFQARDVVAHPQRQRMLRLHRRVDLVHGADRGLLGPRIEVVVQVQAAQAARAVGQGEGIDDAAEAVVRPLPEIGVDVLVDDRRVVLHAAAGGPDQRVESGQRGKGPGQRGIAAVDVHQPGVVGELDGGGVGQRVAGPEDHLHRLPRGGQALLDVVAGADHLAYEVDLVVARDGHLVAILGLEVLALLGQLRLPEERMAEGMAGDLDLVVGEDAPGDRLQLPGQVRVHALRPDLAFDHRDRGEERIGLDEVLQHLLAGIGTAGHLGTGDEAVAIDVHGGDAPAILGGRVGTRQRRKAQGLAQEGERIEDPAPVLATLLQHIGRQGEAAPVGGRHRHVLLAVALELERRGHPRRVEYGERRQVADPDHQRRFEGAQQRLVVGLGARLDLELLRQPANTQALQQAVVLCGQAGEERHRHLFVETRSDPVVEGVAGQRRSTGHPGDYPRVDTAQRTFGQRLVGGQVVDPITEVFEQAAEVDVAGAQGQVALARIVEQRDAPRLHLDVAHPQVVQRRGADERHVAFATQARSERARLVAPLRRQVVDGDDGHALGAQGIQVTLQPIAIVLGHLAVLPGSGVPTGMDRLHGHRRRDAGQLRQHFETAIEKQLEARLLAMQLGEETGQRPALALAALLGL

SEQ ID NO: 28962 - protein, 435 aa, Pseudomonas aeruginosa
QTLCPFAVRIAETDPPEPAKFPGRVDPPRFARQVTARGGGFSPAYPRGFTNRRGTSVGEYARQSPCANMCGIGERHPPQSGAFSPPARAGLAVRHRATPQQALEPVVQTMSNEPESTQHKSALQGLKGYLSSQILGQEKLVDRLLIALLADGHLLVEGAPGLAKTKAIKDLAEGLEAEFHRIQFTPDLLPADITGTEIYRPETGTFVFQQGPIFHHLVLADEINRAPAKVQSALLEAMAERQVSVGRSTYDLPQLFLVMATQNPIEQEGTYPLPEAQLDRFLMHVKIGYPEASVERRILQQARGEALNGEARPERRVTQETIFAARQEILGLYMADAVEEYLVQLIMATRTPAKHDAELAEWISYGASPRGSIALDRCARAHAWLAGRDFVSPEDIQAVLFDVLRHRLILTFEAEAAGIDQDRVVQRILDVVAVA

SEQ ID NO: 28963 - protein, 268 aa, Pseudomonas aeruginosa
RRRAATQPDRTPYRPGAAAAVRPARPCPSRRRTAALPRRRRRPRAGHPRRRAAPGLSRTGRGAPRALAAAGPATGRAAAAAVDPGRPGGAVAGPAGTTPAGVSRMNPLDRLEPLIAPLPVGWWPPAPGWWLLAALLPLLGWGLWRLRRHLPRRTIATRGEAPLDPLREAALAELAALAKPYGRASAGPWLQAINGLLKRVCRARWPDSGSHALSGRAWLAFLDNRCPAAGLTRWMILVEGGYRADCTLDDKAVDGLDAAVATWIRKHV

SEQ ID NO: 28964 - protein, 923 aa, Pseudomonas aeruginosa
VRLALGLRLRPVALAAAPGAAGRRQRRGGAQGELPRRTRKPRRTPCPRTPAGLAAAGALRPALVPPAARRGPPAVGRRPPAATRQRPRPAARGGCLRLHGLPRHALAGRRDQPPGTDQETLRRLHRRPSWRPRRPDPVRQPGLPAGAADLRPAHRAGLAGRGTDRHRRQEHRDRRRHRPGGQAPAPAACGKPGAGADHRRRQHRRTDSPADRRATGRRATGEDLHHRHRRRPAARRRARPVRLQPGARSRRADPARYRREHWRRILPRAIQRRAGKHFRDPRPPRTGRPADYPGAPGPGAVQLAAGRRPRPECAAGGAGTLATGKPDLAAPPFREATMNLLLDAWPHWLRPYWLLLAPLLGWLLWKLLHRQRRAGRWQLLLPTAFQPWLLVGGAGRQNRMPWICLGIAWLLALLALLGPSWQQLEQPSMKRSDPLVAILQLTPGMLAGDLSPTRLEQARRKLLDLLRTRNDAQTAIVVYAGSAHTLVPLSDDQLTARNLLDALKPSIMPEPGQRADLAVRQALDLLEQGAQGRGRLLLLTSELSEPERQGIRSALEHRAARLAVLGVGTPKGAPVQQEDGSFLKDDQGGILLPRLDESGLRRFAAEIGAGYQRLRPNDRDLDSLGLLARGGTLEEDRENALLRLQRWADQGYWLLLPLLLLAACAGRRGWLFCLPLLMLSLPQPAMAFQFEDLWLRPDQQGQRLLQRGQADEAAKRFEDFRWKGLSLYQAREYAAAAQAFAQGDQADDHYNRGNALARQGELEAAVDAYEQALERQPQLVAAQRNKALVEELLRQRQEQAAQQQAGENKEQRQEASQQSPPSGSSQRPPRDAATVDAQKAQAAAPSTSLPEDEGEKTAGAPGQAQPQPNAEDERTGDEEADDGLDDERRQALEQWLRQIPDDPAELLRRKFWYQQQQRQEATP

SEQ ID NO: 28965 - protein, 441 aa, Pseudomonas aeruginosa
  UNSURE (338),(413): Identity of amino acid at the above locations are unknown.
DWHDIPIPQEGPHALPYPVPRPVRPAPGPRRDGRRTADRAHAADAAGRRAGRRGLSPCQRASVALRRRRSRILGVHPRATGPRQRSAGDLPARLERDAAGPLPRLDRPYRPPRHGGGLPALPAGPEDAQRRLPRQCRRRPRRRPQAPAGRRAGGAPAAEPGRLPRPLRRRTARRQPGGRQRTPEAAGGEGADGGRARQEPGQALGRRDPGTPVGAGQGHPAAGGLRRLGQPRGLHRRQAHLPPEPAHSAQRQEPAAAAQRSPRRSAAAGQPRGTHRAGIRPAVSEGRRQRLVARPRREAPRSPAGRRPLYRPRPAGDRRPRLVRHLEAVRWPHRRGVXQPQPPVRPGRYAGADRHGPVERRHPGEADQGAQVGAGNARGEPGTASHPSCEQIPCISTYSSSKTTSISPAPSSXTSRPPGWSAITPATARPASTWRAPTATT

SEQ ID NO: 28966 - protein, 1039 aa, Pseudomonas aeruginosa
AAHPAGGDRHEPGAARPTRPRALPACLATHPPLGAGHAADDRNPALAQPRERRTARRRTHRGRSPAGGAARGTAGAEPAPRPDLPPRRGATQPAADPRTDHHRQPAAQRPAVQRRGRGGNRRARPQPADQQPHRCGPGHGGVDGVRLWPGPRPGPAPVPEERLAPALQQRRAALPLRAAVPRHTGLKRGGLPPREKNRGRGRGLGEARCDSVSEQRGLPGLQLGRVDQETRQGRQQPEGAEHVPEQHEGQHQAHVGLELDRREDPGGHADRQAQAGEQHRLAGGAEGLVVGLLQRQAHAQERLQAGVDVDPVVHPDADAEGDHRQGRDLHADAQRRHQRVAQHRGEDQRQDDAEGRGEGTEGDHAHGRHADVHQNQDDQFGLLDHLVGGGLDPGVAGGQLELQVVLVVLRGEGLHRRHRAVEGLGLVVVEEDQQRRQRAVGVVETVGTGDGVVQHVLVARQGLPFQVAFVHPLDHLLGHGDHRDRRLHALGVLQLPGQFVHGRQGLVGGAAFRGGLDHHHQHVRTGRVVADDEVVVEVVARVGTQFRRTLVEVADLQVLAIPEAAAEHQQGDGDGHRGHLRAGEVRQQAPERVLAHRVILAALHRLLADADVGDRHGQQDQVGEDDHRHADRGADGQLADHPDVDHQQGDEADGVGEDRDHPRQEQLAEGQPRRHQRIVGAAGLQGDAIDLLHAVGNTDGEDQERHQHRIGIEAETDQVEQAELPEHRDQGGDQHGDGAADALGEPVQQDQGDQQADTEEADHHHQPVDQVADLLREADDVHLHVGILQLVLVADLLFQLMGELAVVELDQFALVLRVRVHLQQRYVDDARLEVVRHQAADLPGLEHVVAQFLQRPRRTVVGLRDHLAAGEAFLGHFGPAHAGAPQRLQAGTVDAGDVEHLVMDLPERLHVLLGEDVAVHRLHRDAHGVAEVGQVVAVLEHFLDERVLQRDHLLEAGGRPHLGGLVEQEDADQQAEEDHHRPVVENQAFYQGSPCFADAGSWHSCDPRLIVVVRARHRSPQRGARRPGRPGSGGRRRWR

SEQ ID NO: 28967 - protein, 104 aa, Pseudomonas aeruginosa
SRWYPAPRCPGSARGSDAPAGRGTHPARSRCTAGRRSSSGRPSTPATVRRDRRTGRPPPRSSCPRRGTGCAWSRYAARPASGYLPPPTRGAARSGCIADRGGPA

SEQ ID NO: 28968 - protein, 133 aa, Pseudomonas aeruginosa
RRYNSRTCSASRSSGTQRTCWPDSSLTRCGTFRRRSRPTKPARSTERGNFRTCTALTRQPPAASLRPKQTCAGPGGFPHPGGRPPACRTSPRCSPGRPGSAGSAPACRVASSGRRTTAVRRRRRSAGWTSAPR

SEQ ID NO: 28969 - protein, 382 aa, Pseudomonas aeruginosa
CTAPRRRRPSRAPGAGPRGCAGRGRRCRRGTAPGAADGARRRPAGGSRAGRGGGPGYARSRGHRRSGRSHVRGRVASVASAQAAAPAELGPADLVVVVVDGVDQAQLLRLLADRHSIAGGAGEMVLPVAGDLRVDLHVRRHDDLQLAVAVHHDRAAGKHVWVHRHDDDGIQLRMHDRTAGGQRVGGGTGGRGDDQAVGLLAADELAVDIQLELDHPGRLARVQDHVVERIALPHRVDTATHLGIEEEAALDDVLAVQHLADLGLQFIRADVGEEAQAAAVDPQHRHLVPGQRSGRAEHAAIAADHHHQVADLAHDLPRAGLQAVSGQDFGDGVLEDHMQVAIDQEFLQPANGVQHLGAAEASDYADFGKGFHAVPAKSWRAG

SEQ ID NO: 28970 - protein, 343 aa, Pseudomonas aeruginosa
SGLWAKAGDSGTPAHVREIAASGATRLTSGYDAVDRIARRIAPPGRPRPGLDRARPAVDAPDPGAAAPSARRQPLAPGTGAPGRLVARTGATAAASRRVARAMATAASRPVLRTSLAIRPGTGPGRAPDRRQPAGARRRAYPWRTRPAAAGRRRHPPPGTGDQTLPGAPVRPRRLARARRPGPPVTQAGTPLPTPVAAGGDPRGSPGAGRPWRRIGRFRIVAERLPVPSLARAGQPARRHRATASAWPLAPPARLAGVPGQPGRTAGRAALAASVARALAGAGHAAAGPARPSARRRLLEHRLRRRGTSANAGKGGAARRLLGRGRAPVPGQRRLATGAQPVG

SEQ ID NO: 28971 - protein, 185 aa, Pseudomonas aeruginosa
TAPIAHRGGRNHHGWRPAGDSRYRPSPPRQGSPRPGRRRRGPPAPPARPPRDAARPRRAPGRPVSYRYRRPPRSRRNRPSRASATGSLCAPPARYNRARPAARHRPRRPAASLGNVPAREARSRRHAAGDSRRSRASAVPCRDCAGRAPSAYRLRVRATGRRNGNRNARQRRPARAGGWSGRRRG

SEQ ID NO: 28972 - protein, 249 aa, Pseudomonas aeruginosa
PATAAATRASSSSANSERSRSVSLRPWFSMKRSCRVSSSRLRWNCSPCSSRRCCNSAFSRACRSRACCRLSTSLRRMSSCPRASCSRLASSSSCCRASPARRCSCCRARAASCCRCCLTSCARRAVCSSSCLRGGSAGGAFGAAGPAAYHCSSAAICSRCGSTAAGSSSTSRPSWLRLSASRMSTKWLRPALLSGSQRCIWCQDTGHWLRQARRIGPPPMSGPRPARSARLRRGRFQPVSAPPCSSKSR

SEQ ID NO: 28973 - protein, 153 aa, Pseudomonas aeruginosa
FSSVSWQARGLTRQLVSLPPKVWSRQAWLQPIQVLIRSAWPAAALLTKSGSARNGRAMETMSASPSARTFSATSGVLMRLVVISGMPTSPRSLAVTLVKAARGTLVAMVGMRASCQPMPVLIRVAPAFSTAFASSTISSQLLPPSTRSSIDRR

SEQ ID NO: 28974 - protein, 399 aa, Pseudomonas aeruginosa
QVTDRNAQGCLASRRHSPTLWAALETRMRKLIFLILITLFAAYAGWAERRPVGHYLSDLRSQVSVVQGQPGERGNLLAVQPELFTPDYQSAERLQLKFHAYLENARRQGLLNERTVVVFPEHVGTWLVASGEKPEVYAAADWPTAMDWMAASNPLKVARGWITARGDQRLTDTLFRMKAVDMAHDYQTLFGGLAHDFKVTVVAGSIVLPDPEVEDGELRPGTGQLYNVSLTFGPDGRPLGQPQRKVFPTRHELSYLNNGRGERLQVLDTPAGRLGVLIGTDSWYPDTYATLVEQRVELLAIPAALNQSGRWQQPWPGFDAELVPGDVRLAPNSLSNAEAWQHLAVGERLLASGARGAAVAFAHSRLWNVTEDGQSLLGSSQGMRQANPGGGAQLVNLWL

SEQ ID NO: 28975 - protein, 137 aa, Pseudomonas aeruginosa
PAPAVGASASAACWGRCSMVANRTSRKSPRASSCRPGPCGASWPRKAPSSAASSTTPAATWRWSTSARPTWLSAKSPTCSASPRRKPSSAPSSAGAGRRPANSAAPSDRAPDHISVASSAGSGRSHSAACCSSSSSW

SEQ ID NO: 28976 - protein, 310 aa, Pseudomonas aeruginosa
RSPSRCNCQAWTRVKPHCNTSHSPTSPSSGRQRRHWLLCWRAANSAWARSVPSGCSLSQTCGLPARGWTSTPSGAATSCAAKARWGGGQLSRSTGQSSLPQARRTAPLPPSNQRSSSQNRQLPSPGRQSASTCSEAGALPAPSASASQAASQVRCTANTRWRPSASADPRARCICSTSSASCSSTAKGSDWRNQRAFCVGRFTAQAVTASTGRYSRQGARISASAWANGARRHSPSCTHHTASSPSAPAVLAGGRNSALTPLIARPSSNRRRPSTGWAGRPAPCRGPSRVSCRPCPAARYSPAPAGGRPG

SEQ ID NO: 28977 - protein, 164 aa, Pseudomonas aeruginosa
PHGWLPRKPTRRAAARSSMLPRSRPRGFAATQTITRRISCSAVLSTWVRHSQRRPANSSSPWLWPLEGGVCSSCNSLRRLSAIHIARVLSSSREAFCRLRALALSTLAATMAKIARATSTSSRVKPRARFIAAPPRPVAGGNRRCSATTPAPRVRARPGAGGTD

SEQ ID NO: 28978 - protein, 103 aa, Pseudomonas aeruginosa
SRAKPACPVSCPSYRCRRRCRCRLPCRRRPANTGRTGPWCPAPGTGRDCPTDRPAASSGSRPCSSSSAADCRWASSPAPRGPAGCSDRRSCPACTCPARQRWP

SEQ ID NO: 28979 - protein, 108 aa, Pseudomonas aeruginosa
TADAVAVRPARRCRVMGLSSWMPYSGNLTEVSWSYMTTERLPSVLLVVSRFVRPIPSSSCRSILASRYLKHKRAWPGQSHLLIEVGSLLATNCYDPSAIFRHNDKDQE

SEQ ID NO: 28980 - protein, 178 aa, Pseudomonas aeruginosa
CIAFLRRLFPLAAAVRPGPSGCCPDHRHEHQPRLAGGRLVAPATQPGSRRRLAGQPRVDPQRSDPPGAPLRHQRPGPQRPATGHQPRPGAQGQLRPERSQAVQRDHPAPGRQAAPLRGRRRDQRRREAARGLPRPRRTAARRAPGKPALPAPFRGTAGQRGRHYKRERLDRTTAKPAG

SEQ ID NO: 28981 - protein, 139 aa, Pseudomonas aeruginosa
ERCSIARAPGRLAPADGSHAHRRTRRRRLERAHDHAYGKRLTRCPSLCSAPCLPLPVVRTFPPSFSAWPSASRRRTPKTAAGTPSSRPATSRRRTGRSTSRMPTSANSSTRFPKSPARPSSSTRGSRARSAWSPRPSSR

SEQ ID NO: 28982 - protein, 148 aa, Pseudomonas aeruginosa
RTMAARAANRPAAADRATSSSVPTKAPTPWSCWPTRTRSTLSKTSFASSTCRVPRYWWKRPSSRSPATSRMPSACNGRSTRAAWAEPRPTSPIPDCPSAPCCNRSRATRHRNPSPTAPSSASAAAASARWSPRSRPTPRATCCRPRAC

SEQ ID NO: 28983 - protein, 429 aa, Pseudomonas aeruginosa
PGRPCRCLAGWVRSQRGQPPSHVGLEVVEVFQADRDPDQAVADPGARAVLGGQSTVGGGRRVGDGGLGVAQVGGDRDHPGSVDEAPGGIAPALHVEADDRAEAALLAPGQLMLRMARQARVVDPLDARLALQPFGQGQGTGAVRLHADTQGFQALEEQPGVERAEGRSGGAEEADHFLHLLAATGDHPAHAPALAVDVLGRGVDHHVRTELQRLLQGRRAEAVVHRQQRTLGVGDLGQRGDIHQLGQRVGWRLDEEQLGIRLARRLPGREIAQRRIVDLDTEALEVLVEQADGRAEHAARDQHVVAGAAQAHHQGEDRRHARRRGHRLLGSFEGGDALLEGAYRGVGVTRIDVARHFAGEPRGRVGGGAEDVAGSGEQRLAVLALRRPPLPGANRQGVEGRAFQVAVETPGIPVLSHAALPFVSRCTDR

SEQ ID NO: 28984 - protein, 176 aa, Pseudomonas aeruginosa
ASAACSTGRAGDPPRRAGSPARRRPGSSRRSCGCRRCSPGSAGSSAIPRRAPGWTGWQAVPTSSAAGCWRPGASPRAAGSAAQRAVAAGLAAGWRPAPGPGRAAGWPAGSPAGRRSAGWAGRRRPGSLPRRSRERCLLRRAAVPAPRSAAPRHWAWPAIAGAAALPPRPGATRLRG

SEQ ID NO: 28985 - protein, 239 aa, Pseudomonas aeruginosa
PWRTARPGRRRYPHGCSPEPGAGSAPPPAPRPAANAESATVQRPNPAPSRSRVPVRHPGLCPPAGRRPPGSVLVALRHAGVAPGTGRPGDCARRPAGAGVAGRSRTGRGDRGDRSPGSAAAPRPGAPPARATRATRRPAGPARRFPWATRATADRAAPAPGRPRPARASASHDRRAPGRSRDRAGKAVPPAQPPAPAMAAGDRNRRTGPVCRRAGYRLSRKPRFRGYRPASPHGPGRCW

SEQ ID NO: 28986 - protein, 445 aa, Pseudomonas aeruginosa
PRVSPAFPGRAGALPRGNAPGPCRWPSDGVVRDSSANRPGNAGSCGYGARRMSEGRQQIGQARPQLGTMHDHVDGAMLKEELATLEAFRQLLADGLLDHAGTGEADQRLGFADDHVAEHRQAGGNAAVDRVGQYRDERDAFFAQARQDRRGLGHLHQRDQRFLHARAAGGGEADQRAALLQGDVGCANEALADDGAHRTAHEGELEGAGDHRHTLQLAAHGDQRVLLAGVLLCRGEAILVLLAVAEFQAVHRLEVGTQLLATVLIEEDVQAGTRVDAHVVIALRADIQGLFQLRTVQHGFAGRAFVPQAFRYRTLLGLGTHDGRDQLVYQPVAHALCSPVQGRDGRTDPVTASLSKFIFVTAGSGGPHGCEAFRGLSHPPPARSPGRYPASGYREISGLPIGGRALSRKRRHASGRRRAARRHIMSRRGAANAPRPRTRGPSPHP

SEQ ID NO: 28987 - protein, 109 aa, Pseudomonas aeruginosa
PARLPCRRYPASDRRPAPGVCPGRSAPATSRTPPPCRRARLPHRYPGESRQLPDMPPRARRCRRRASPAGPSGRVADVPRSPRRARRHGIAAGPAAPHRESRPVRSGWR

SEQ ID NO: 28988 - protein, 1225 aa, Pseudomonas aeruginosa
QKPDSTSADDIGQSGKEMRPQVALGQLELPGVLHPHQIESVGVSGDPTGAPVARLEHLLRPFDRPLAGTDGHQDASDVAHHMVKESVTADVQHDQPTMLQQAHVMHGLDRRLGLALHRPERGEVMGADQYLGRLAHPPDIQRPMVPGDLLGQVRRADRIVVDGVAIAPGHGREARVEMRRHHPRPGHTDIRGQVGVGAHHPCFQRALHRGVEMHHLAAGMNGSVGTAGADHPDRLGGNLRQGALQRFLHGRHAGFLALPATIAGALVLDAEGDSGNASGSRFGCRWRNNIVHESRFISGSGQALQQLAGFRLLAVVTFGQDFVEDIARAFAIAHVDVGTSQIQLGRRFVGTGEEVEVIVGVSVQGGGDRCIFGGETRRRALRLVKVAGQLVQLRTHLVQLGGETVLALLRSGRLRRLVGQRQVEVVRQGQRRLFGSLGIEGEFVVGGRRGGHFVVQRKQEVVVRKLVFRRIEIQGEIAQVVMLGLARSLCQLREIQAEVEIVDRLVRRGRGRQVQIAVQGQVVQRPAVGLEVGLHVVAAQVVQAQVEGVVEILSCRIRLGRVTAVVERQVVEAEAIQLVLRQLGAGQAGNRGDRDHCRIARLELLDLRLCAADFAQLVFLASETFAIAHLGIDFHQLEAQVGALRLVVDGVLQQFGGLVETPVGDIDVGLAQSIGSLRGGLLDLRRSGCDLRLRLVEGQVVEAVLSQVQRILLFLAGIRGESLDFFLLFLRIAPRQDHQQHQQRQQCATADHRQPQRVGQQFVEEARCRLLCRLYRSGRRNGRCRRLLGSWRGRRRHRRLRRSGGCFSGWSRSRRCRSGSPGLSRRLRGRIGLGRIRQGCVRLGCALAFGAQLPLQLGQLGVLQLDQLLQLVQLALQILHAALQFFVLAASAIEAFLGHRQGIGERLAVALPALVGTLAGLALARHQAQVVRGVDLGWRRPGGIALGRIQLPGASAARGRIAAAAPALVLRLHLGQRLARRALQHLLFGGNAQDLAALQPVDVAIDEGARIQFLEREHRLGYGNAIGTVALGDLPERVVGNGAIGVAACRRGGTHRSRSLRGSRGAGRARRADRRLRSACRGLRGVQRRIQQDGVLAQQAAVRPEHLDQEVQVGLLHRLRRGHANDALAVGLHHRRELQVGEVVQAIDARLAELFRRRQARDHLARTQVTNFEQLDLGIQRLVQRRLQGDFPQSQSMRHAGSQDRGRRDCPNQCTKPNHSVIPWF

SEQ ID NO: 28989 - protein, 590 aa, Pseudomonas aeruginosa
FYKSVGKYLLQIVFYQQLTQEHGIQRGTFSHIIRHNPQIDLTGISLPRPHPADIGLVLAEGIADHRRIIALADPFDTFRRIEDPRHRGQVHRLRALQGHAEAIAEEYRRLDAGNVQRSDTLAKQGLHLREDAPLDRAVSLGIHRADLREQVEGDLAVEETRLQGARIEQFGGLPGEFLDPFAPQAGDGEAGCQVQLPAIQRGQEWRQHFAQFGGYGARTGQKERRCLRGQAFGIHRNHDRRCDARFQGAAQVDHRTTRRAGALGMGTRHLGCRGEEGQADTGKIEAIDIADAQAAFGETHALPGRLGAGQQVQTMKREVAFVEETDQSLANRSGGAYDCDIEGLGHGKSLGGLRNRRGTLLAHLRPGNRGATHCGRRRIDQRSSRMRSMRRSGSAAPHSNWSPTVKAPRYWEPMFSLRRRPTGTLRVPVTAAGVSSRTLTSRWFGTSLTQGLCWLIRPSMSVSGTSLFNLMVSAWLWQRMAPTRTQIPSTGIGFLKRARILLVSAWAFHSSRLCPLGSSLSIQGIRLPPSGAPKCSVGKASLRRVSATLRSMSRIALAGLARSSATDAWAAPICLSSSRMFCAPAPEAAW

SEQ ID NO: 28990 - protein, 76 aa, Pseudomonas aeruginosa
PAMSGAEPWQGSYMPLLFASSEAEGSMPMEPVSMEASSDRMSPNMLSVTITSNCLGARTSCMAALSTYIWESSTSG

SEQ ID NO: 28991 - protein, 417 aa, Pseudomonas aeruginosa
RMAGRRLANRPSCERIFSRPRSGRISRSILSHFGPPTAPSSTASAWRARCRVWSASGTPCLSMAAPPMTSSASSKPSWNLSLASSSTLTASAMISGPIPSPGRTRICLLITPSCPSFIERRACAAAIEPSLPTQPQHQHVGAERAVVGNLEILPDFLAHRQLQAADRLAEHLRRTHPLDPRLELQAQALAPASGYQQARLAAQARPLGRRVVAHMAGVAEQLDGLQEGVRQGLPGRRHVDEDRHPAGLEHPPHLAQGQADIAPVMGGIATEDEIELAVGEGQALRLALFGTDVRHAPFRGALRHHGEHLGGKIVGHHLPCQGGDLEAHVAGAAAQVEDPRFRAPGQGVAQQGEFLALGMHGAAQVGRSLGAKLALDNVIVVAHEPTPGEKPGAPYPGCARQGDSRGAQRNSQGCCWR

SEQ ID NO: 28992 - protein, 493 aa, Pseudomonas aeruginosa
LKFIFFIQSIPNRNPLALSSGQPKPAEARNGPEQPQHLHRHCRDRQLLRSRRAPAPDPTGGEQAHRRPRTAAQCPAVRPGRPRGQPHRGRPRPAAARLPVAQRARRHPPGAEQPHRRGQRPAGPGHQPPHRPASPAAAAARLHPGASAGGAGYPVPGFGSGLRGDPSWSCGTGGDHPGPGNRRTGARSPGVGRPAGLRRRPGAPAGPTGHGVPRRRRQAPRGIPRRQHLHPPHRAAHVRSRRADAEHRHEHQLPGDHQDDGLHRPGLERAAADHARRPGGAPAAAGHPAQPPARLYPAHRADPVERRARLHAPARRTGIRQRHSSGLKRFRSDATGRPSPLCRPRPALTRPACQCPRDSALADPRLHLDLHVDPQRQPGGHRRAYRQGPLHMTLVDLVETGEVGHVRQPDGDLHQLVETRATALQGLADACHHRFGLGLDIATYHLAGRTHRHLSGKKQEAAGPHRAGKGKRQAAGVTLDVIAHLDCLLWMKR

SEQ ID NO: 28993 - protein, 220 aa, Pseudomonas aeruginosa
EEKLSAAESAYSCSTAINPGSYRRAPPESPGTPARAAADSRPGRRRRRGLPPGRLGCMPRARESGARRLCPRAPGTRPAAPGPGRPRPDGAAPRHRWPGRCPTTAPRVPRRRPAAASRSAFAHSWRRGGCAPAAPAAWPACHAGPDRPAHRRSACACSPACAPPGSSFSAAPRARPRRCAARGCRRPHRSARYPASPRDAARGTRAAAAAGSDARKARWR

SEQ ID NO: 28994 - protein, 261 aa, Pseudomonas aeruginosa
ERPFVVLRSKLILSRTVAMERAIPTFPCRDLDSASAFYQSLGFHLGARYPTYAILQRGAPGAAPVAVRSARTEDQLQRCLPAPGGRPGAASPGRGPRPGRPGDSTHHGPGRPALGYARIRPGRSRRQPAAGRPGARCDARATPGSPGQRRRRPRGGRALASQCPRSRGNPGCRRPAGDPGTAPGRLAQPLALAGGGPAASPRFRPRPPVADRGRSGTGGRDRRALRTAAGPPPGPGPGTGGQCRGGPALARRRPDPRAIGP

SEQ ID NO: 28995 - protein, 544 aa, Pseudomonas aeruginosa
PYSSASNTSEGVITPGRYGRPASSAAAARRGVHPGLTANCAPASRASRNCSVWIRVPAPSRTSGTSRWMAAIASSACGVRSVTSNTVTPPAYNARARSGASATSSITSTGNTGLACSRTRSSGNVMGIPRFETARPAGSLRAGHSAFYRRTEVRTTTTPLLRASGSARRLFHAPASAHRRALLEQRQQRLAQPALAEQSVVAAARQAQQATGRPGGMDALGIFHRYARVVVGMHHQSGHFQTVARHIQARRGYARLPLDQADEMRASQGRQTDETSEQAQLFENPRRRRDRHQRFAAQPHLGCQQRRRATQGMTDHRTQRRQLASGLQQGVGEQHHVRLPARRAAMGRRIEGIHRITRADQLLDQMGELCRPAGPAMQQQDCRPLSPAQHRQPEAQSDALRAGQQRQLPILRRPLARHHERPTHTLGRPTRRDAADRPVETANPGQAAHLAPPQFTACLAARRTRSDSSPGPNARASAKPPIISTRSARATSVSSGLSARLATMISTCLLKTSRNPSGRRATSARVAGSGQPASTCASRCLRDR

SEQ ID NO: 28996 - protein, 563 aa, Pseudomonas aeruginosa
KILPEEQSLTSPPPKTRPATGRASSSTVEESRSAGNGVADLLPFLGFLFRRPAQQLQGLAQAIARQVGAKDLHGVQHRNRAGMPGDGREHQRHHVAQLELEVFGDSLDAAGDAFLLPLAQGFEFPQHQLQDLADLGRIELLVFEQRSVQRHPAAEEESGQRRDLAEVLHPSLHVRSDLHQVFGIQRPLLHLTGELLHGLLADPLPVQPGELLQVEDRSAQGDARQVEMLDHLGEGEFLALVRHRPAHPPEVVEQRLRQVAHALVEGDRGRILALGQLALVRVAQQWHVAQLRLLPAEILVELDQLGRRRQPLFAAQDVGDAHQVVVDHVGEEVGGQAVGLHQHLHVHAIPRNLDIAAEHVRHHADALGRHLHAGDVGLAGGEAALHLILRQVHAVAVVARGFLARHLLGANRIEALGRAEAGEGMALLDQFVRILLVDMPALALPVRAMRAADVRALVPFDAEPAQGVVDLLLGLPRRTQLVGVLDAQDELTAVLTREAQVEQRDVCGTDVRVARRRRGDASTNSGHGDSLAKRKLKRKFRGAMLSGGPPPAPVNDRCRPAGG

SEQ ID NO: 28997 - protein, 295 aa, Pseudomonas aeruginosa
IGRILPTEHSTHARPTQTSPDRLPGGRRPDRPGLLPALVVHRPPRGKHRQRLRPGRDHAGGQPVGRAGRGSPGARQPARGQGAATGTPGRRRLQARRRARPGRAGHPRGGTGPGAQQAGAAGQPDRRQRRRRQRQPGNPRSRTDRPEPRRSPAQARLRFRGTGHHPHRRQPCGSLATGQGPRRPRGTTRPARHPGRRDQAPGSADRQRPHRTGASRNQPVTHPDPFADQRPGRPAQRTQRPVRAGRHPFAVAGAGRRHLGPGQLQGDPGRPHARRAEGAPDLRRLPRHAYRRPHR

SEQ ID NO: 28998 - protein, 77 aa, Pseudomonas aeruginosa
RIALPCRLRAARPMVWISERSERRKPSLSASRIATSDTSGMSRPSRSRLIPTSTSNAPARRSRMISTRSTVSMSECK

SEQ ID NO: 28999 - protein, 413 aa, Pseudomonas aeruginosa
RVALPSSLHTPSSRKMSLFSAVEMAPRDPILGLNEAFNADTRPGKINLGVGVYYNEEGRIPLLRAVQAAEKARIEAHAPRGYLPIEGIAAYDQGVQKLLFGNESELLAAGRVVTTQAVGGTGALKLGADFLKRLLPDATVAISDPSWENHRALFEAAGFPVQNYRYYDAASNGVNRAGLLEDLNALPARSIVVLHACCHNPTGVDLELDDWKQVLDVLKAKGHVPFLDIAYQGFGNGIEEDAAAVRLFAQSGLSFFVSSSFSKSFSLYGERVGALSIVTESRDESARVLSQVKRVIRTNYSNPPTHGASVVSSVLNSPELRALWEQELGEMRDRIRDMRLAMVEQLAAHGAKRDFSFVGRQRGMFSYSGLTADQVERLKTEFGIYAVSTGRICVAALNKSNLETITKAIVQVL

SEQ ID NO: 29000 - protein, 104 aa, Pseudomonas aeruginosa
SSALPVNSGGADRLRVAAQPCHLVQRPCDTKTADTVLHQDANRLLGEVIDHRQAFDPSPSAERVEDEIHRQDLVRCARQAQAFACHRAPVAAPPPLHHQADGSV

SEQ ID NO: 29001 - protein, 166 aa, Pseudomonas aeruginosa
RATELFMHGSLTQQAHYKLQQHRWKREKSWTPAHSPTQGLDHLRNGNILAIRHQKQFARSIGVFGTKTQETHDVSPRNQAARITDTVKRKRQTTSDELEQTAEVTWRIIGIDQRRSDNHQLHTFTPEQSPQLLLSLVFGDGIGRMWAGWRIFVESLLPGAVTVNAN

SEQ ID NO: 29002 - protein, 103 aa, Pseudomonas aeruginosa
TDKHETLHPSLERTGSQPDSRISVDFTKCGERVCNLVSEYMGTSSEMNNAIHRRELAGKRGWIGQISFDVRHRRYSFNNPPYHRNHRIPCPSKLTAQGRSDES

SEQ ID NO: 29003 - protein, 459 aa, Pseudomonas aeruginosa
KHTLIRSSLENHAQALTGVIERKTHLVGATAQPGRGDGLHVTERQRQCRSLAAQQVVGERLAHYRTGGHAASVVAGHRQQAFRRLEQAHQMIGGEGDATRPAVLPVDLAQVGKVMALDSIGPLPQEPGGLVRAIAEASQQQATLGIATDAAEHRPGVPGTLAVRQDALGRGAVQRRRSHLVVVAGKEVPPQVGPLALGIGVGGDHHLFRQYRPRATAHRPQRALPLQGEHRRALVQLAAPLYDGGGQSARIGHGIESAGASVEQRRADSPGAAGLVASRAGQQLQRSAAARPLRVTALQIGHAAGVVRHVQGALAAQLAIDAEAFDGLHHQRRRPPQHGVELFSLLGAEGGDHLVRGNPGAGVDQSDITSRPAVADLVRFQHAHRTAGLQQVERRRKPGETGADHTYVGALLAVQARRSGQARRNHFPQTPLLQTAHARLRCQPHCHAAGARRAPFNRR

SEQ ID NO: 29004 - protein, 110 aa, Pseudomonas aeruginosa
RCTTTVPGEPRCSGAGPRRNRGSRPRTGSVRRSPCAPLRSVPASRRWPATRSRHPDSAPAIAARRRTPAPPARGLAPGRPAWPGSCVRRSAARPGCPPADDRYGPWNRLP

SEQ ID NO: 29005 - protein, 234 aa, Pseudomonas aeruginosa
DGNPRRERRREQVRHPRPGSGLPGRRAVAPGRGDPPGAGPVPQPGAARFRRGTGHPAHRAGHPAERRRQPANSVPRPRGGRAEDRLRRSRGVGHHASLATGPEPDRQAPGRRDRGEGLPPCGGNPRRRLRLLLRRTAGAAELRARREIGAAGDTAQRRQGAAAALAESCRRRIRGAAGATGHSRRDWRRRIAALTAVMTAAVMTTALSMMTPTHQQPFEEPHGTTLSSGSDGFQ

SEQ ID NO: 29006 - protein, 188 aa, Pseudomonas aeruginosa
PAPPRASIASTSWLIALRATRAVLRRERMIRSVERSSAARIAAFTAGCIGHSRVARKRVPMLIASAPSASAATRPRPSAKPPEAMIGTRSRLAAAGSNTRPGMSSSPGWPAHSKPSMETASTPSRSALSAWRTAVHLWITLTPCRRNSAMCSPGSLPAVLEDGGFPSRGGLRDIRHRAPASASAARSG

SEQ ID NO: 29007 - protein, 261 aa, Pseudomonas aeruginosa
AMPAGRTSRSAASNATRSSSGSSGATSPASISGSGSRPRPSASSNAAYSLMPRPLPPNASSRRSAGQPMAQTSRQAWRSTPLPVKRPRRTRVRSPSRGTSEAALSRIIRRRCSRSPAHSSCSLICSPSCRYAVRPSVICTGGAGLSARSDRAGRGPDARRMAPAAAPPEIRYGLAARYLKLPEAMAMTSPSSLQISAVQKQIVRVRRTTLPTARSSPRALPMKWVAMSMVTIEQSGRQARIAWAMAASSTDINTPPWNCCR

SEQ ID NO: 29008 - protein, 373 aa, Pseudomonas aeruginosa
PGSGRSPRLPPATAAATPGAARREPGAARPRQSPDCPARSPDDRAPGPCTAMPGDRGTDRRRPAGARPAGRRPDRGSMRRRRCRAGCSAGVLRGSGSSGVPQDRAPSATSSTSNTASTAQAPWPSRKAMTGLRSTERKRSPASQANRERFDSSRASAATSARGRPRAPNRSGAPLMLRIIASASSTSNGQRRNTTSCSTSTKIPPRPNNATGPNSGSRWIPMKHSTPPCSWRATRTPSRRACGAFSAARRRSSWKPARTASASLTPSSTPPISDLCWMSAEASFSTTGYPMPSAKATASSALPSTASAADSIPARASRRLASASPGVEAGNCSPPAGRRRRNGRAKASPSRPMAWIATTARVGSSNSAKPASS

SEQ ID NO: 29009 - protein, 469 aa, Pseudomonas aeruginosa
  UNSURE (31),(34): Identity of amino acid at the above locations are unknown.
SVCLWPARQPSRGRAGPRDAATAAPGMPVGXGSXACRRYRATRLPGWTACRRCRAATPRRPWPHCRSPALAAELGHRLDDQEHPVHPRMHAGQPATVGVHRQLAAGRDASALDEWAALALGAESQVLEEQQGVDGKGVVEHHQVDVGVPHTGHLHGSRSAFRGRRHGEVGHRHDRAMPLRSGRAKEVHRRIGQVAGALGAHYHAGAAAVGDQAAVGGTQRVADHPRGKDVIDAQRPAGERLGIQVGPLPGRDRHLGELLACGAVLVHVPAGRQGIGGDRVARLVGRLVPLWLAHRYQAAAGGSLVGAVADQRSVAETGLQCQSGLQQVQLETGAADIGAIHEFRADAEVFGDRQGGKGMGAGGGEDRVDVGKLQAGIGNGLERRLAEQFDGAVARRLADAGATDADDGGLATDGCAHGRPSWWGTNTTTLAPSCSTMRACTRVPIGRLWCPSIRDIMRTPSSRSTSATL

SEQ ID NO: 29010 - protein, 271 aa, Pseudomonas aeruginosa
MKRGKMTKDATTKGTSSKDVGAVVNAIQILRHLAHADGPQGVAAIARATGISPSSAFNILRTLSNERLTSFDDAGKTYQLGLGLSELAVGFVGRSYADLIQPELERLSLAHHILIALWQVTDDAHIRVIALAAPPVAHVNVAVGTRLPELVGAAGRCIAGLRELPEDELRRRLTRVRWENPPSFERYQAEATEAVERGWAIDQEHLYRGVSMVASAITDRDGQPRFAISAIGISAQHQPDDLERIGTSLRDTARFVSRALFPQGEALKGKS

SEQ ID NO: 29011 - protein, 114 aa, Pseudomonas aeruginosa
TQLLINDRLGGRTLLTGGSLTYQALGFGILLRGLLPSPIHSLRGIPGPLFAGHAQRGNLPDLLCHCGLQLSPGGTAGSQIRARGIQLRPVVSRAEPDTAGGAEADQHQAGQRDR

SEQ ID NO: 29012 - protein, 950 aa, Pseudomonas aeruginosa
LIQALDGYGIVRRNDRLDGCDPALRRHSPRFKQARPLRLRFVLVRPHGDFGGGSSNGVPALQRIGLLSGRRLPAGGSLQNIQARSRRFDLTVELGDIRGVGGHLLGQAVGRLDRLSDVGPVGRVRRRGVERHRLLCLIQPVADPHDIVLRVGLRRVVGQHIGQIIDLALQATDIDLHLIDVGEELLAQRGLDVLLGDQFVVLARIRRADTVDPGRPGADVACPVDQPPAEGQASAGRQRGQRVGVGRVREQAQGSCVLFAAARGNRLLDLGVGGVRRATGRESPLQADLPRSAGGTQERQRRRRAGLTGDVGQHRVRWDRRHVHGVHSPHARKVLAGVYPTHFHHQLPRTRNPDPLARAPAPLYVVRYRVRCRVPGDGHDRDRQALLDRDVLRDQYACRRILHPGRQDADRPRIDDRPVIDRIKLAGLVLDNLKLELLPTWSGHVLDVELHQGQVVVVDRPTALGGRLFTEVGHHRYDASVMTLNRPGFRAPTGQVDSQPRADREIHISVYGDCSSRYRRDPAAIRTTGKHGVCQSHHLSRPRDESIQANLPDGPTSLQLLSHKRPLPRPLRLTLAGAAESPDRYLPDDPAKLDNRILVEDRLLVCLERIGRVVPRDHRQRMAVSRPRPRIRNHTIVQNLRRGIGVNRVLRHVGVDSDLATIPERQPMKDCSEILKNGIRLLLLLKIEVASEPRLLTALPIRNQLVAVLRNAIEGPTVDHALVDALTQAVIGVQHQVIENPGRIVGISLLEGAVPNAIRGTGAAGKIGPSLRVIVHRNPHDPPAHERRELRKVAPELLGVILHAANGGERKLLVAVDNFSYRSQHHGVLDQRAVRLRRDPPHANRPVPSCRQVDPMRTVVSRNVLPVDKRAEYGLVRSAIRGDIDRVLNTHPIDVPGRILRLQVGPGQAHAYRIRRGVRDGVDVGLRAEQGLAHRNLVAGLRYTFQSLLI

SEQ ID NO: 29013 - protein, 534 aa, Pseudomonas aeruginosa
TPQRKRGRSPGPLQSAGGQRTSHESLGAIDREGQPLLGADGDHVVLEVLVVLGGNQNLDVHAVEDLGAERERTGQELVLSDGLGFHHRQTPEGRSGAVLRAADDVAVLGVLGQLDQRPVDGVEHDTAGRELGQLRLKDRQADAVDSLLGSHHYAARRSVGLCLRNDAVQVGAGPVPVEQLTFFDQHQAVTSTRIDVALQGRCVVQDLATCLEQVGDGANRRVFQLEGEVGVRLLSAFRNRSGIVDEAGLADVLDGVRLSGARRNQVADGQSTLRSGNDTGTTIRSNQGTARAVDGGDGRARHGYAMRTAQGAGYPLLFQALCDHLAGGLRCFLAAVTLLVGQHGLFRGAQPCLQLTLRYQKFVNIGSCRLAHLAEVGDLGVDLFGLSLDLVADLLEAGVQFADLFFEVAHCDSPWRNLVMSCAARSAAERSGATAPGISVGVSPPPPAAPSMLVLKSLMSSLRWLLGIPLRARAASIRRLAKMASLRLLGALEISSDSRKASAHPLSTASRPPIQVSASICFTMSSMSIPVRCA

SEQ ID NO: 29014 - protein, 222 aa, Pseudomonas aeruginosa
RSRRETMVDLHDEFGESRIFHEKRIDRRSVDALAGLAAGITADGHINQQEAEFLQDWIATNLVHLDDPVTNLLYRRLSDMLSDGVLDADESAELLEILRGFGGLSASKPKPSDNTFTPSNALPLNNPAPKLEWSGHLYVFTGVMVYGPRKHCEEIVVNRGGGIASGISKKVHYLVVGEIGNEQWLHSTYGTKIKRAVELREEGHPIAIISEKHWQASMFNLV

SEQ ID NO: 29015 - protein, 260 aa, Pseudomonas aeruginosa
KAAQCAAFALEAWMHLLYLDESGSVADPNQRFFVLGGVSVFERQSHWIETELNKIAERFNAESPYDIELHGSPMRSGRDGWKHHPLSARIQAIKDALAVSLTSKNVRLFAAVIDKRVFAGADPVEHAFEKLSMRFDLFLRRLYTKHGDAQRGIMLFDKSSTERRIQTLAREFKHTGHSQGQTKNYAEVPVFLDSKASRLIQLADLVAFALFRKFEHADDQFFDVIKENFDDDGGIQHGLYLRTQSGPPPAVIAQVQPARI

SEQ ID NO: 29016 - protein, 214 aa, Pseudomonas aeruginosa
RRPRVRRERPPARRELLTTTTLPVAGHHQLQPIYPSGRTIAQPRANLKRKPAMTTIPDSIHPSDLPEIGQTLADGIFFARHWLNGKEYAYVDLSKSAEFTGEWGEYGQDVDGAVSYRDGASNTVSMAEAGSPIAKQAMEIGEGVFIPSVLELALLFSAKQAGELSGFADRWYWSSSQSSADYAFRTYFYDGDTGLNVKGYGFRVRPVRKILILQ

SEQ ID NO: 29017 - protein, 233 aa, Pseudomonas aeruginosa
FSHSIHFAAGDSRDRNPPTSQTRSLPGSAGRLPFSLGATMTTITVNAGSTSLTTDNPQFAAVVLQMISEETGNASLAEVDGIPAIGAEWPVQGGIYAGLMRGRDGHPDYHLIVASAESDGELQWGGYGSKSSATSKWDGLANTKALVEEGGHPAAEFAASVTISGHNDFYLPAQAELMLAWANVPEVFAEGWHWSSTQYSAYGAFYTSFLDGDTYGSGKYDDFRVRPVRRLLR

SEQ ID NO: 29018 - protein, 262 aa, Pseudomonas aeruginosa
PLPSLAAHARRGSLMHTQNMRLWDQVQATDPSATKSAKVDGQQITSISGQHMIMKATQMFGPVGIGWGWTVIEERFDQGGPIFREITDADGKKVSELIGHEVGHTVRIKLWFELDGKRGEVEQYGCTPFSYRSKWGITTDTEAPKKSLTDAVKKSLAMLGFSADIFLGLFDDRDYVEARREEEQIAKAEDQQAAEEQANEERLAYIKSIIETMQGAQSQYELKKIHDVAVRKLTARKDDSGVKRIAREFSEQIKRFTEEKAA

SEQ ID NO: 29019 - protein, 128 aa, Pseudomonas aeruginosa
KTARTYPALIWSGRSLQSGSSEESSMSVKYDVVATVGQYEKDGQTKYLSRKVGVIVNTKHGFRLKMDACFNPAGCPRTDDGGVWLALFESKEKEQQQRQQQSQQAAPPASNDFDDDIPFSPLPYLAGS

SEQ ID NO: 29020 - protein, 132 aa, Pseudomonas aeruginosa
DARLPVRSAVQQVLQLRAGGRDERCRVSLRRVRGGIQTARRRARQGGVVMSYDRFGVFFQCGFWEKTVAFRVDNPLIEGTKIIVCGQCIDPADASDSRNIGGSFLCEDCGLPFGRPEAHEKAIALSGLEKCA

SEQ ID NO: 29021 - protein, 194 aa, Pseudomonas aeruginosa
RQSFAPCSARTRRTAMAEELKPCPFCGCSMRLESNHDWHRIVGDHSAECVFLDSETMMVPDIEDQREIAIADWNARAVPAGHVVVSAADLESLRKDKARLDAIEDNCWDVRYGISSNADAGDSSISIEIVGRYQGVPHIRVLGENYTENLRAAIDQAMTAEACPPERPEYDDHGRPLRALLSEQEGGNDVSNHQ

SEQ ID NO: 29022 - protein, 168 aa, Pseudomonas aeruginosa
SAGRTSPAPSLADPIWKASHVLRSNKLWTTQAPPHAWIRHTHDRVAVIATHRQPLYAYTAIRIMGYPLPGLHMRTKPFRPPQRHEIAGLRYYRTASAYNWLGITMAHPTRAIQLLLEQCEPDVLSPMFEIEIDAILRQADEYAKTGQVLEREQLREMLMHLIVKAASE

SEQ ID NO: 29023 - protein, 137 aa, Pseudomonas aeruginosa
VFICASCSGVAQPKAWTWDSLMNGSPRASFFRNNSKVGGVRAMPSSTPRRRTRLPAAKLRTTHSTGIMSSFFTRHSVSDSSLSNWVGMPAASSFCMMKALNLLFTAPLRSSCSMRLPSKAEVSLRNSRMRRSASSVW

SEQ ID NO: 29024 - protein, 303 aa, Pseudomonas aeruginosa
SSQYAGLAHGLTQRLVATRAEPGQGQADALGDQTHLMQGPLHRNGVGFDEQRLVQRHQAIVDGARGCGVAAHGGGAQVAHGARRDVGGHGDVALATQQHQLDGRGVVAGIDEEVLADALDDFLGALQVAGGLLDADDVRHLGQALDGLRKHVAGGAARYVVEDLRDRNGFGDMAEVLVHAFLGRLVVVRRHQQAGVGAAAFRGLGQRHRLAGGVGAGAGDHRDAALDLVDHATDHLDVLFHVQRGRFTGGADGDDGVGAFLQVEVHQLGEAVPVQSTLSIEGGDQCHHTARNHATAPAAKLKR

SEQ ID NO: 29025 - protein, 185 aa, Pseudomonas aeruginosa
MSTSQPREQFLLISALGPNPMELTTLLCRACVESRCAVVSSRLTRHGEFSALVLQISGSWDALARLEGSLPALTKRGDITLSMTRSNAHVTRAQALPYVAYVSAVYRPDILNELCQFFIDHNIELENLTCDTYQAPHTNTTMLNATITVTLPAGTQISWLRDQFLDFADALNLDALIEPWRPQHP

SEQ ID NO: 29026 - protein, 204 aa, Pseudomonas aeruginosa
WQRCSPASSPRPPAQGMRVSRRSPGPRRRRSRTSCAFPGRTSRKPTASASPTWFAPVTIRARCRTCSSAWRGSIATTASRRSSSSPTRSPNRVSPTPATAPNSIPRAARKTACATSRCARAPSCSSRKPRGWPASASAPCSTTIPSWMPRATDWPSRRRASASSTMPVTTSGNCWRRHPTTWPTTWPRSSWTSPPTAFRMPISG

SEQ ID NO: 29027 - protein, 234 aa, Pseudomonas aeruginosa
RYPASTSACSATPRRSSSPIRSTPCAMPPCTASRAWPITGRSASAAAPGSIRTCCGRSATRCSSWKTSTTCCVWWKPASDGASRRIISSRNACATVPWQSSANSTNRAASTPRCIATTTPRWNPSAASCAFSKAPASACANSAASVSTMRRPGNRASSKRRSAAQARRRSRTASAPHQSRAFSSRRWPWVVRIDSGWNCKPSCRLRGSAIAMISPSASARQSKPSGRRLTTSEW

SEQ ID NO: 29028 - protein, 897 aa, Pseudomonas aeruginosa
VKESKLSNSVMRIALSPFAFGSGHGGQHRQRLVAGFLGLQPWIRIQHHAGACPDPGDTFADLGGADDDAGIEVAGAVENADRATVAAAIAILVLPQQLHGTDLRRTDQGAHVQAGTVGMQRIQFAMQFASHARDQVHHVAVAIDLEHVAHLPRTAAADPRQIVARQVDQHHVLGDLLGVQAQLRFQAIVQFRIDGAPGIASARAGAGDGIEFHLATLRVVLQCRLRRSAEQAEVPRIEEEAVRAGVAQAQLAIGPPGVRTRHAEAARRYDLEHVAGPHVGLQALYLAGKARIVQVDLVVAGPYACHRRLGSLLHGAMEFVGTLAQAGGQPVVPGRIVDERLQRSPARQVIDVQQQLRHQEQVVRAMPRRFGRRRQGFELLGQVEAEQAAQQRGPLRVAQRSEHAAQRLQAGQAMQASPLVRMRLFLGEAPVQGVAVTQAGDLGRTVLAQRRQQGASVGVQRPQHHIAPPALDAQAAGKDRHATPRSLAVHVEAVEQHPVGAGHAPDRQRLRHQRAVLQTFFQSIANPAHEPPPRAHGRLACATLARNGMFIIGNPPFPPIATAAVGGDRRNGCPVSVQRQRLAGENLQHPAHAPQVQFAGQEVDALPTPGAVQLLAQFVEGFAHGLAPEQPPAQAQTLGIGRLGPIRGQPPPQQAAVSRDQLQQGRQTLQTFQGLQVSLHVVEHQRPPHPLCLVELAQGIAAEQASASHVVENHVIVAVAVGLYDLQAMPRSQLQPLAVGHRANRQSVPGTGLGQPLLRTQQLPVQALDHPHRAFRLPGLAGPLGRQDLYVRQPRTQVGQQAAVVVVLVGDQPVVHLGRVGDPAAQVRPNQFGIPADPSFNQRPARLTETQQEHRHLDVPQQAQVIIQLTGSRKPQHGRFTSSGLRYSAAPQVAPEP

SEQ ID NO: 29029 - protein, 332 aa, Pseudomonas aeruginosa
FFLLQLLLASSPTCSKFCRGEIANRAVRSVFVVIPPPGRDADSRFGQRTEPVLIEAFVPELTVERLDEGILRGLTRLNQLQLDVALIGPLIECLAGELGPLVGADRFRVAAKPRHLVQRPCDAKAADTVLHQDADRLLGEVIDHRQAFDPPPGAQCIEDEVHRPDLVWCARQTQTFALHRDAMAAAPPFHHQAGSAVQAIDPLVVDLHASTPQQDVQAAIAKAPALLGQFHQLGLQLGVLHTGSRLVAQHRAGQPDQLTGTTLGDAGSRLHLLHRLPPCCRAYPFPRATTFSDSMSRWASASNFFNRLFSSSRSFNRLASATVIPPNLARQV

SEQ ID NO: 29030 - protein, 106 aa, Pseudomonas aeruginosa
ERCLMSKQRRTFSAEFKREAAALVLDQGYSHIDACRSLGVVDSALRRWVKQLEAERQGVTPKSKALTPEQQKIQELEARINRLERENAILKKATALLMSDELDRTR

SEQ ID NO: 29031 - protein, 141 aa, Pseudomonas aeruginosa
HLRAKRAVHSDGSTLIEPCRLGIRSSRCNKRIWRMGICRPKRSRLAIPVLRAGYRTKGSRASQQIARPVGKIWNYRERLDSSAGMLAEPRNFKANTTVPSVIAAYVGGALLRLQNGFRALETEKPTYKGGLFHIDITSMRA

SEQ ID NO: 29032 - protein, 200 aa, Pseudomonas aeruginosa
WQAEREERQDTQVLGHNDFLLLQLDATVMSPGMLVVAGSDRTLFTIGNQFQLGRRNTLQHQVALNGLGTTLAQSHVVLAGAAFVGVAFQHYALTAAFQVFRVYVQSAHGFRLQVGAVVLEVEGGDRTQSGFVAQAAVNGTAVGAIACVRVDAAIGTFTGSIAALGGATHSHSHGQSQRSKFAEFQHFHHVTPNEPQCISL

SEQ ID NO: 29033 - protein, 430 aa, Pseudomonas aeruginosa
YWTCLPATRCPPGSRTAPRRWEWHGRYRWRSPAGRQPAQHLPPGPGRTAQCESGYSQTQILRFKDDAALTIQAVEGSPRQLLHLGNTADVAHRRHRRTVERLVATRTADAGIGDGTVRQHFDQYFYAHSITRRWRTPPLLAHQVDDQVVETAGDLAAHLVGQGLLALGRIRKQLGQCLRLLVLGSLAGCRGSGGGLFLGGLDGGFLLRRFRSSLLLGLLGRFLLRVLGCLFLGVLSGLFLGLVLGALLGYVSLLLLFGGLGLGSFLGFIGLFRLGGFLGLGLSSLVSLLLFRRFRSSDLLLFQLLLLEFLLLELLLFELLDFVLLGGGLLRLASDLLVGLCRRLALRLELVERGLHDRLGGRKLRSKRPADEQHGEDQNVQDHRQDDGPEITLGRRALELLLQDQGASVINPTLGTPACCKAPMAPTTAP

SEQ ID NO: 29034 - protein, 265 aa, Pseudomonas aeruginosa
RTLAISAYLSVVLVVAGVHLAVQDGLELVGEGVVTTDQHLRTCGEAVVGDDRRDRGEQADGGSDQRFGDTRGDGGQGCLLHGGQATEGVHDTPDGTEQADVRAGGTDGCQEWQAGFEFLLLTGDGHTHGARHALHHRIGIDAGLLAQTGKLLEAGTEDLLDAGVRVRIATGLAVQLGQVDARPEAFFEGIQCLLGGAHGVTALENHDPGCDRGGHEGQHDQLHHDTGVADQAPHGGMVDDVRFHFNLLLKKNPGFRQKPHATFRG

SEQ ID NO: 29035 - protein, 290 aa, Pseudomonas aeruginosa
DCSAGTGFHHQRCNRGHVFPSLEAVLQLHQQALGGLLANTGDLHQGGGVLCLDATHQFVHFQARHQRQGQFRTHAVEPDQLTEQLSLALFGEAIEQVRILTHNQMGMQGHRLAQPNATDRGSSSALPLHSRRHSHRGSGVAAVSPPGCQRKRPITKSFPYSKTQAPATSACAHQAMGDQTLLGMGMTQGDGQGVGSIYLRFLGQLQQMHDHHLHLLLVCTAGPHDCLLDLRGGVLRHAQPLLHCRDDGRPPRLPQLQGRIGVARHEHLLDAQGRRAMGADHLADAAKHHV

SEQ ID NO: 29036 - protein, 300 aa, Pseudomonas aeruginosa
NQSHKLDTKSRKRGSNASSVPHFRLRVIAPIGSAELRHHVVRDIGIGIDVLHVVQVLEHVDQLEHLLRGFQVQGRGGRRDHGDFGFVALESGGGQRLVHRNEVGEGGEHVDGAIVVDYHVIGASLQGRVHQRFLVHAGSEADLSLALEHVGDRTIGAQVAATLAEGMTHFGSGTVAVVGHRLDDDRYAARRITFIGKLDHVVGIVGADAARNGTIDGIAGHVGGQRLVHGQAQTRVVRRDAAALPCSDGQLTDQLGKDLAFLGILPLFAVLDVGPFRMTSHNSLRIALSAGGAASGASAG

SEQ ID NO: 29037 - protein, 600 aa, Pseudomonas aeruginosa
FESLGLRLLAQANVQLAQGLAVHGTRCLGHDVASALGLREGDHFADRRCTGHQHDQAIQAEGQAAMRRRTVLERVEQEAEFLFLFRLVDAQHTEHRLLHGLVMDTDGTATQLGTVEHHVVGAGKCRARIGLKLSRGALGRGERVVQRGQRAVVVLLEHREVHDPHGRPLPGEQLEVMADLDTQRAQGIANDLGLVGAKEHDVAVDRANAIEDHVQVGLGDELHDRRLQAFHALGALVDLDVGQALGTIDADELGVVVDLAARHGGGARYTQGGDTPLRIVGRTGEDLELHFLQLVGDVHQLQRDAQVGLVRTVAAHGLFERHVRELVELDIQHFLEQLAYHLLGDADDVALVEEAGLDVDLGEFRLAVGTQVLVTEALGDLVVAIEAGDHQQLLEQLWRLRQGEEVARVGTARHQVIARAFRRRPAEDRGLDVEEAVVVQVAANAAGDARTQLQLGGHLRTTQVDEAVAQARFLAHIGIFIQRERRSLGLVQHFQFVAQYLDGARRHVRVARAFRAQAHLAGDLHHELAAHPVGLGEGFRTVRIEHHLGQPLAIAHIEEDHSTMVAAAVNPTAKGDFLAVQALVQLAAIVAAHHGVVRFS

SEQ ID NO: 29038 - protein, 462 aa, Pseudomonas aeruginosa
PSLRHCDGRDNFKTKGAITMKVMKWSAIALAVSAGSTQFAVADAFVSDQAEAKGFIEDSSLDLLLRNYYFNRDGKSGSGDRVDWTQGFLTTYESGFTQGTVGFGVDAFGYLGLKLDGTSDKSGTGNLPVMNDGTPRDDYSRAGGAVKVRISKTMLKWGEMQPTAPVFAAGGSRLFPQTATGFQLQSSELEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSIL

SEQ ID NO: 29039 - protein, 138 aa, Pseudomonas aeruginosa
RPPLGPSGETPRGAGPGRRSQRTGTEPDRAHAQRPRTAAAVHACPAPGCRSPGRGPWRDALTANSPRQRRTTKPAIPCSGICSTSTAETSACRGPRPSHRSRAFARSSSPSQTTSTRPSSRFRTQPSSSRRSASSRVA

SEQ ID NO: 29040 - protein, 133 aa, Pseudomonas aeruginosa
TDTLLLMKDHLIGSVPAHLVDAARPTLTAHEGLVADYNIAAWLHLPDACDLLVSLVVSYLDGGRQREVAVDHGRIDRQQRILLSGIARLPVRQKVENMQVRLKSATAFSRLVVEEFFVQAVEQENRSQQVSEA

SEQ ID NO: 29041 - protein, 491 aa, Pseudomonas aeruginosa
TGTSAELRSETTVTRGFARSVPTALSLRLLGFLRQHAAPHAHRSPQTDTLRHLRSRGSVRQPVGQAFSEQRLLLHLQALHGLLERRIPRLVQIRRHALSARHGPGAAIQQAMQTVGAKIPAQHPLASAGATDELLLLEKVQQFLPLILGQQPTRTMQVGQAQRLSKLLALVEHPQHAEQDDQLGQRAPPPETGRREIADQHRAEQNDHPGKIDPQQEDRHGGEGTVDQLVAGKQAYVQPEQGFRGFEQYRGEHAAHQGMAHRDPGVRDRRIEQGEGRHAERQRHQPQQRLRARQRVRAMEQRQRSDVGGHGEAGPQQQWAQAEDRPVEEEPPDTAAWLANPPDLVEGFLDGHQHSEGGDCQKDHPDPGQVPGLGGETLQVGFHRFSSGRHEIAKDESLDRLAHAMECRNQRKHGKHHRHHRHYREQRGVGQRRRAVGSLVGDEAMSEEASELDPIVEMFAHALSLKSRRFFASRGGTSRRRVQSWSTRRLE

SEQ ID NO: 29042 - protein, 214 aa, Pseudomonas aeruginosa
QGGGWPASGKSPGDPRLSSPYILVLYYSRHGATAEMARQIARGVEQGGFEARVRTVPAVSTECEAVAPDIPAEGALYATLEDLKNCAGLALGSPTRFGNMASPLKYFLDGTSSLWLTGGLVGKPAAVFTSTASLHGGQETTQLSMLLPLLHHGMLVLGIPYSEPALLETRGGGTPYGASHFAGADGKRSLDEHELTLCRALGKRLAETAGKLGS

SEQ ID NO: 29043 - protein, 290 aa, Pseudomonas aeruginosa
KAVTSCRKRNPRTAARPCGNSPTDCRRLPAEGFLEERNGQLALSLERSAIQLLQQIEQRVHAARTAVEDETTDFIGQMQATTGCPQLQGTKLVLVGKTVQLEDQRHGEAGLQVRQLDLLLPGRLRCRQQQAPTGITQSIEQVEQPLFPFSLANQHIQVVDADQLALLEIVEDFRAVLHQIGHRQVDGSLFELLETQAGRLQQVAAADAVVSPEVDEAFRPASLGFAQTLDISQCRGIGTGIVVGEGGVVAQTHTEGKLNRFHARLGGQSENAAGVTVRAAKFIRLGKAAQ

SEQ ID NO: 29044 - protein, 437 aa, Pseudomonas aeruginosa
QEKTENEESGYAHGGLSTNGWERRRRAVKAAQVDLYLKQQSVQRQPRWPLRGKPDKIARLQNRQTALHAWAAGRSPNYPYRPGFMSSKQPSLSYKDAGVDIDAGEALVERIKGVAKRTARPEVMGGLGGFGALCEIPAGYKQPVLVSGTDGVGTKLRLALNLNKHDSIGQDLVAMCVNDLVVCGAEPLFFLDYYATGKLNVDVAATVVTGIGAGCELAGCSLVGGETAEMPGMYEGEDYDLAGFCVGVVEKAEIIDGSRVQAGDALIALPSSGPHSNGYSLIRKIIEVSGADIEQVQLDGKPLADLLMAPTRIYVKPLLQLIKQTGAVKAMAHITGGGLLDNIPRVLPDNAQAVIDVASWNRPAVFDWLQEQGNVDETEMHRVLNCGVGMVICVAQSDAEKALEVLRAAGEQPWQIGRIETCGADAERVVLNNLKNH

SEQ ID NO: 29045 - protein, 298 aa, Pseudomonas aeruginosa
SRKIRRNAWPDGFTRKNTGSTRWPCAGSPRAACAWANRAPCWMARPCLPPAIRFAPRRFAMRKAMLFLLTLLTLPAYAFELKPFTASYTADWKQMPISGNASRSLKALGDGRWQLDFEASMLLASLNEVSTFKVENDTFLPQTYRFARQGLGKGKQIELDFDWSQKQVLGSDRGDAVRQPLNRGQLDKSTYQLVLQHDVADGKKSMSYQIIEGEDVDTYDFRVLGEEKVRTQAGLINAIKVERVRDPGKSNRKTILWFAKDWDYLLVRLYQMETDGKEYQIMLKEGTIDGKTVTGEKS

SEQ ID NO: 29046 - protein, 91 aa, Pseudomonas aeruginosa
KRIVSILNSYRRISMTKAIYYHAGCAICVEAERSLLPLLDRKQVDIEVVHLAEQSARIAEAEKAGVRSVPALVVDGQVLHLNFGAALSDLK

SEQ ID NO: 29047 - protein, 170 aa, Pseudomonas aeruginosa
QPGALLSAFLASPQRLSSSSSEHSSAFRPASRRFRSMNRNRRSNLPLAWRRAASGSTLRCRARLTTTNSRSPTSSPTAPSSPSAIASRTSSSSSRTLSTTGSASGQSKPTCAARFCSFAARDNAGRATGTSSSSDNCCGSLALAARSSAFSSSQRCLTAASASFAASGLP

SEQ ID NO: 29048 - protein, 1161 aa, Pseudomonas aeruginosa
RTRSSPPRGRYLGRHGPGARWSGAASCLPVSRDRAHHRWAGSAARPYFWPWTCSARVIDAGRQVAVAAVADDRHQHGILQFAGQAQHRRHRPTGGHAAEDAFLAGQPAHDVLGFVLVHVDDPVDATGVIDLRQVFLRPASDSRDGRALHGLQADDLHRRVLLLEVARDAHDGPGGAHGADEMGDAAAGLLPDFRAGAVVMGFRVVAIGELVEDLAAAFALQLVGQIARALHALFLADQNELGAIGGHRRLAFGRGVVRHDQDHLVTLDRRRHGQGDAGVAGSSLDQRIAGADVAAQFGTGDHRQGRAVLHRSRRVVAFELHQQGIGGFPGKALQTHQRGIANAVGDSRVLHGHGGTRSALTVKAEHDTGKLGPDPSTAISGHACRFSRKTARNGMRCDDQRRPKRKPGVGQPMPDQRQRKVRQALRLPVKARWPRRSERGGHRNVVGATRLVVGCRAGVEGVALAVQALVEEVAYPAPYAQVLAEGVAGADAPDAIGTHLFSRDHRRVAAGAMLRRLLAAVDGAGQLGGKTLAGLPVQGRVQGVLGDHRKRVAGVLVLGLQHIGQVGAPAQVLVQGDQQVAFQALDHCFLRVAPLQDVVTGPGLPHDVQRRDDLVLVVVAEVGEPGDPAIAPELDAQFLVYAGLGVQVLVADQVAAAAAGLDRAAVATGIEQVVRVALVQVGRLEGPCDTGLDREVFAERLGSVQARAPVQAEVAVIVQAQPGGEHGAGAQFDIVLHVQRTDLRLAFRASRAGRGGPRQAIASHEALLERGRVVEGFLVPLRAHRQHLLEQRMQRKVEFAAEAIVLQLAGAERTVGADLPLDGTGQPLLQTVVAGGVVLGDEPGSAERPGPVVGDGVVLAIHAVGLRTLVGESLGIGGAVVVLGIAGIDVALSAEARFEIDDLVGGHLPRQHPAEIAIAYPFASGHGTARVDGMSEVDVGIVRIGLVRAAVRAEAQGFGQRPAEAEVGAARGAILGAFRNVGEHRHGTTQTIGRALGDDVDYPARRAGTVACRRGPTEDLDALDLLRRHPVAVAAGVAFAAPAVAHRVARADRLAVDQDQGVLRPHAADVDLPVVAALAAGTVAGEVDPGHGADDLGEIVHRRALPDVLGGDDGYPRCLLELLFGGAQHHLVTQLDHRFGAFVQFFQALVLGQGLPVQQAR

SEQ ID NO: 29049 - protein, 150 aa, Pseudomonas aeruginosa
ASRSGNSNGSAARPWCFARPPSRRNTTRPCPTNRSRPSPPAPASCNASCRSCFKSARRAATSPTPWFPDGRHGCSASTTTRPTCCWCRPCSATSAPRSPRWTAATRPSRWCSASASTWSSWTCRCPAWTAARPPRRSAAGRPSGKSARCR

SEQ ID NO: 29050 - protein, 381 aa, Pseudomonas aeruginosa
ACSTPRKGCAWPPARPTSPPTCWRCCWPRWRRTARRFARPATTTTAPLCSRGSTGCMAPPATVACRSCARPARPAKPCSSRTIRRRPRPWTSWTRPSRPWPTLPRPPPTCPPPASTPANSDHAHPVLQHPGLRQRELPGQQPPARLRTALPAGPPAGGHGGPRPGLRSSLRLRQRRPLAAGAGTPGGRRHAPGRPALGRLQPRRPGRRRSARPAGGARPGLFAARCRRARGRPDPDAQPAPAPRLQPDPRGRFLAAWADRLRPPRQTRRSDRHRTDRRDLRPHHGRLRLRAAGLRSLSQSAHPSTRRPLPVARRPARRVRHRQPALPADRRHPPPHRRAAPGDDETRRDADQYRPWRPGERRGADRGAEERTTGLPRPRCL

SEQ ID NO: 29051 - protein, 149 aa, Pseudomonas aeruginosa
HARLIGGSMAEHDFRYTLLNPQYTLNECRALSPGRYQVTGTGGSIKADDVLLVSLKGSKTLSMRLTVEKVRHLINPPGQWLAVARGPAFRELAIHTWQVDCDQCQARLDFEFAVDASLGRKALAPAAEERIHELGWRSREDKHLCPKCQ

SEQ ID NO: 29052 - protein, 180 aa, Pseudomonas aeruginosa
GERSVRPTVCELSPVRNAQRKRHETLSRPLRLRRPGPGRLRQPGDHPGNRAGLPGRLGRRTTDDGLQPHQPDLRRPGPRLRQWRLQPLVRQLHPAGRPPSVRRHRQHPPPVRGGDHGAGTALPGPAAERPALGHFAVRRAAPVAGRRQAAAPGPRARLKPEAALPGAARLHFFDIHFIPA

SEQ ID NO: 29053 - protein, 156 aa, Pseudomonas aeruginosa
SRCTSPADCSCISMIAFPCASVRGWQACWPSSAARRYRYCSTPTAPSTTCTDSTSTVSASACWSRPAASPASAAATAPCSAQAWRPWPCSACRCCCTAPARSAASAFPRSLGAPGATCWRPSSAWPWANAWPMRSAPCATTGRSCWPANAIRFTCH

SEQ ID NO: 29054 - protein, 109 aa, Pseudomonas aeruginosa
RPASRRCSWRYSGSRTTSSGSMPRNVSAIRPSTAACSSTCAPRTCTCWIARSLPGSATPGTPTTCCASSIADYPTGRSSPACSSSRATPTTASATRPRKSAPIWSTSTT

SEQ ID NO: 29055 - protein, 430 aa, Pseudomonas aeruginosa
NADMSVVKRHWRRFLVAALVLIVGAALLLWSRPAAQAKLEALDLDDGGHATLAEPGEKPRSRVVVIAAPEQQLNDAQMLNLAHDSAARVIQYFPPENGDCRAQQSRLEAVIARLGGKPNLVAGIGPGSTTAWRWLASQDDDKAKALSVGFDIALAERDCDAPLPHQASHGQWLLAWNDNPDDDTAVFVRKQSSAETSISDYDTPLSDVLAHQLRLQLQGNAEALPVLEVPAAQPSDIVTLFYSGDGGWRDLDKDSAEHMASMGYPVVGIDTLRYYWQHKSPEQSAADLSKLMQHYREKWGAKRFVLAGYSFGADILPAIYNRLPGKDQQQVKAMLLLALARTGSFEIEVEGWLGKAGEEAATGPEMARLPAAKVFCIYGAEEKDESGCTQSQAVGEKLELPGGHHFDEDYLSLAKKMLQAIRDRENAPDA

SEQ ID NO: 29056 - protein, 169 aa, Pseudomonas aeruginosa
SAWFRSPPRRRQPPATPRTRSRAPAGPRRPSAPNSPRRCRSAPARGWKCAGWSSAARSRAGSPGGSGRRRRRSPPGRRSPWPGWTAPPSAAAPSPAPAGRRGCAPPRRWKGWSRPGRSSSAPAPAAPAGTRHGRSACDRSGPCRRTAPRRRSAPVRWRRGWRHRCRDAS

SEQ ID NO: 29057 - protein, 467 aa, Pseudomonas aeruginosa
GRSDLRRRRRRGGQHLRFHRQRQGRVPGSDRRSHRRERQGHRHRLHGRGRARDPRRASKRAGGHRPATVRAGGYRGARSGAAEDRTQPAGRPGPAARRQADPAPLRLPEDFRRLQPQLQLLHHPVHARQAGQPAGRRRAERGRAPGQGRGQGTPGDFPGHQRLRRGPEVQDRLLERPAGQDPHEGTLRGAEQHGRVGSPALRLPVPQRRRRDPADGRRQAPAVPRHPLPARQPEGAQGHEAPGLRGQDPGPDQAVARDLPGTDHPLDLHRRLPGRNRRRLPVPARLADGSPARPRRLLPVLPRRRRSGQRAGPGAGAGRGQAGPLGTLHGPPAGDFRRSPAAQGGQGNRSADRRSRRTGRGRPLLGRRSGNRRQRVRRQRRAEAGRQGPRAHHRCRRVRPLGRAGLSPPEEPRPAGLFHRQPFRRARCSTTTYYAACATCWIFPTHIWPNWPPRSASKSKRTCSRLT

SEQ ID NO: 29058 - protein, 134 aa, Pseudomonas aeruginosa
PCASVAERAEPLLAVLLQAPPCADPWFLECRQDRAGLTILVRDLANQRTWRVEFVEVEGLRQLDAADLLEFWPACAASEGWLYRVEQGGWLDQECRREGFVARETKAVDEYFVNGGDRCLSVLSWSPPKVSPLI

SEQ ID NO: 29059 - protein, 191 aa, Pseudomonas aeruginosa
PALTLIRPGVPPMRSLSLLLLLSLASTCEAAAVFRCEDASGHVSFTQLGCPAGQAGETVVADNPPPGGRSVTPMAETKTKKASIGRKSVPLAVIGEREDRCGRRLDEKERRKAIVEQRIMAGMTRSDVERALGKPDRVSGNNAEVRYQYKADKRRGARSVSFDQEGCVKGREGTGWSESIPGAKAGPSSYR

SEQ ID NO: 29060 - protein, 255 aa, Pseudomonas aeruginosa
YPYTDACNATGTPLVFPPMELKDRIKAARKHAHLSQVQLAQAVGMTQTSISDLERGKSRATSFVAQIAGACGVNPLWLAEGRGEMLAERGQANAGPNASWLGAVESWDDETPLDADEIELPFYKEIELSGGKGSTVILQTGGRKLRFGKYTLRKKNIDPASAACVTVSGNSMEPVLPDGSTVGVDTSARTIKDGDMYAFDHDGQLRVKLLYRLPGGGLRIRSFNSDEHPDERYEPQEAAEHINVIGRVFWYSVLV

SEQ ID NO: 29061 - protein, 176 aa, Pseudomonas aeruginosa
RRHLPSGSLRPDESESAFLSPHANISGQQSAKKKWRRIRRNQERDPSPSIDQSRRNESSCRTVKNDKRRGVAAPFACQRHSPCRAGASSSNAVCRARTASSRYFSSITTETLISEVEIIWMLMLSLASASNMRLATPACERMPTPTMETLAMLVSPMASRAPMLAAVCLRISRAFR

SEQ ID NO: 29062 - protein, 136 aa, Pseudomonas aeruginosa
SLRCTVKVKSVVLSCATFCTIMSTSTLAALIGPRILKATPGVSGTPRMVSLASSRLKAMPEMIGCSMDSSSSSIVMRVPGPSWKLCSTRSGTLYLPANSTARICSTLEPRLAISSISSKVILSSRRACGTTRGSVV

SEQ ID NO: 29063 - protein, 207 aa, Pseudomonas aeruginosa
TCHILSLPGLAGRTAGRASRGAGRPAPHRSGAGPAWHQSPCSTKRWARARASSNFAASVPPPWAISGRPPPLPPTAAAACFISSPAFSWPVRSWVTPATSTTFPSSSPPSRITARPSLFFNWSTSASSALPSRPSRRAASTFAPLISTAAAERSSPAALAALALSCSSSFSSERLRSSRAPSLSSRLSRLPLTRLAASLSCSSAPFR

SEQ ID NO: 29064 - protein, 195 aa, Pseudomonas aeruginosa
ASAAAPVTASIRRTPAATPPSLVILNRPMSPVRDTWVPPHSSTEKSPPMLSTRTWSPYFSPNSAMAPLALAVSISVSSVSTSVLRRISALTISSRAFSCSALIASKWLKSKRRRWLSTSEPFCCTWSPSTWRSAACSRWVAEWLSAVAWRTEASTSALTAPPTLRLPRATTPWCKCAPPALVVSRTSKRTPAASR

SEQ ID NO: 29065 - protein, 463 aa, Pseudomonas aeruginosa
VSYSLNTTLPGITLPCSSARSCSRIFRALLQGLGELFFLGLQHALDVCLLLLQLGEGIAHLGDQRCDDLVEEGAPGAQLVAVAAGAADDPPQDVAATLVGRQYAVGDQEAAGTDVVGYHLQRRRVVVGAADGLGGGFQQVLEQVDLIVRVHVLEYRADALQAHAGVHARRRQRVHDAVRGAVELHEHVVPDLDVAVAVLFRRTGRAAPDLRPMVEEDLGAGTARSGIAHRPEVVGRIGRALVVADPHHTLGGHADFLGPDVVGLVVGGVDGDPELFLGQVQPFLAGEELPGVMDGVALEIVAEAEVTQHFEEGVVPRGVADVFQVVVLAAGAHAFLAGGRTGVGALFQAEEAVLELVHARVGEQQGRIVRRDQRTGSDTGVSLLFEEAEEGFTDFSAFHRFFHGKLAATNRRQRAALYRPLGKVVVYLRDSYCLLPTFSLMSDERPRRHPVLVLWTRRKRPGG

SEQ ID NO: 29066 - protein, 115 aa, Pseudomonas aeruginosa
SAPRARRGSRAARPPARRHRHRPCWSAPAPPHSPVRAARRPGARRWRGRRPGVPPGGRGRTGRQPPTGRPGASRRRPSCASDGPCRSVLRCRKAPSPPAHRGPWTGTPTPSRSVG

SEQ ID NO: 29067 - protein, 599 aa, Pseudomonas aeruginosa
AGSSRSARGRPGSSRAVCRGRAWDVLSQWVWSQPQSGPCSWSSPSSIGSISSCRLTRLVAIGRSSRLVYSVSPSSTSTPISNWPLPACWTHTSLPCQTTAKRVQEVSSWVPSVSSRISCRLSDMVARLSIELEGINRAQFKDLRQFIQCRPALQQQLGVGQVGLAQAVAVVPVDPGYQRVVQAGAHDHPRIHRRQLPFLQRHAQAQASRTAAVLHALLEVEDLHFADRTVVAGELVQVVPDPRVVPTLLRYHQQHRTVGLRQQLAVEQVGLHRVLHRDLVARHADGAEAAAAAAQLVVQFGKDLLGIEEGVLVMEQHLAIAHRDHIVVEHALVDHRRVLLSVDHSGLAQPVQTRDGLAGFQGLARRIALRRREATVEGAATEDEELHAGIAIVLAEARVVGRAFVAELAHCRQRRVMGEMPLVVEHRRQHAAGGGMLDGSVELAVQVGRGEMHAAIGGVGTRADRGGIGGPHARSRAAGGEERHRFLRRAADHLLVAAGEAQATQRSGIRAGLRSEYPLLETHLHQRLHLRQALLRRFLRVGHRLAVALRSDIAVGQAAVVVGRADQAVEIHFMGIHRLIPGVRVAGRDTLGLSSEATG

SEQ ID NO: 29068 - protein, 139 aa, Pseudomonas aeruginosa
GPNTATTPCGLCRSTAVASASGPDFSPVRSRNACTEIATLLTMLVTSVADSHSGLPVSSPITRASSSARDLRVAAKRSSNSMRCSSGRRAQAGKASRAARTAASTWVTSAPRPDQTTPWPTGSRDSRVSPWPASHWPAM

SEQ ID NO: 29069 - protein, 261 aa, Pseudomonas aeruginosa
MLLEAAGEELLEAVRLRVGEDFLRAAVFLDQALVQEHQLVRHLAGETHLVGHHHHGAAFLRQVLHDLQHFAHQFGVERRGRLVEQHHFRLHRQRPGDRHALLLAAAHVRRVGVLAVRHADLGQVVLGLLDGFLLRHAEHMHGRLDDVLQGTHVRPQVEMLEHHRQARAHALQLAGVGGLQRAVAARHQLQLLAVEQDLAGVRLFQQVYAAQKGALAGTARADDADHVARFRRQRDALEHLVATVALVQVLDFQFVHVCVLG

SEQ ID NO: 29070 - protein, 324 aa, Pseudomonas aeruginosa
RIASVRTVDVEAEVLVLDLLVLAVGAQRVDGRVELAGQLAIALAHGDADAFAEVLGIGQLRTDEGVALAGIGLEEAVLEVHRVGDHRVEATGHQVHVGFLLGVVAHHFDAGRGQFGGGVAVGGTATQHAGLLALQVGLGIVEAGAFLHHEARRGVVVLVGEVDRTLALVGDGHRREDRIDLAHLECRDQAVELLLDPLALHLHLFAEGIADIHVEACQLAVRGLQRERRVGRLDADAHRLVGGESGQGEHGQRQGAEKCELLHLELLRRGWHRLAGEIEPCPGCRRICVITGSCAWRLLVDRAPAGVSGILATGRKWLFLQCDN

SEQ ID NO: 29071 - protein, 675 aa, Pseudomonas aeruginosa
KTPRGSHRAGSFRIRRKSGGLHRAMGLDQVLDHARVGKGGDVAEGVVLGRGDLAQDAPHDLARTGLRQSRRPLDHIRRGDRTDLAANPLLQLLAQRLARLDPGVEGDVDIDALPLDVVLHADHRRLGDLRVGDHRAFHLGGAHAVAGDVEHVVDPPGDPVVAVLVAARAVAGEVHALEGLEVGVDEAVMVAEQGPRLARPGVEDHQVALGGALDQVAEVVHQCRYHAEERLGRGARLHRVGARQRGHQAGAGLGLPPGVDDRAARLADGLVVPLPGFRVDRLAHRTEQTQAGTVGTGHRRLAFGHHRADRGRRGVEDVDLVLVDDFRHAGHVGVVRHALEQNGGGAVGQRAIDDVGVAGDPADVGGAPVDFARTVVEDPLVGQRGVHQVAAGGMQHALRLAGGAGGVEDEQRVLGAHFLGCASAAGNLHQVVVPDVAVLVPLDLRTGTLADDDLLHAGGFRVGQGVVDIGLQRSALAAAHAFVGGDHHLRLAIDDASCQGLGGEAAEDHRVDRADAGAGEHGDHGLGDHRHVDGHYVAAVHVLPAQGVGEPADLLVELAVGDFLVVGGIVAFPDDRHLVAAVGEVTVEAVVRHVEGAVGEPLDVHVMVVEGGLLDLLERLDPVDPLGLLAPEAVGVDDGLLVHRLVGGFVGEGPCHRFRVHGVQGCRRHGFNLGT

SEQ ID NO: 29072 - protein, 700 aa, Pseudomonas aeruginosa
TGTAAGTGSARSWTVLPGLFAGQFGGLGGLVGEAQPELATAQQVDEDFQVAQQHQAEADRHHHRDVGLEDAEVVEVLGADAGDEQGLHPVVAGDHEQPGVAQAAEAGEYPDQALQGTRRQAHQGIHPEVAGGAYAVGDAEEDQPAEQRLGQRVAPGHILGYPEDRVAHRVQRSPQCRQAVAEVVEQGEDVGHHHIEEGHQRHRRQQEGDSALLEAVPDAHESIHRSVLHDAPPGRAGPDGSIGTVGSFGGLEQIGTDIAAEFLPYRLHRLAPVGALLRAQGMDLAGATGEDALAGVAVEALGLEVHLHGDLVHDPLQFFADVRRKAIPELRVGDHHVVHQAVVGLGEILLYLVDLLALVVRPGVLGAIHHAGLQALVDLGEGHLPGDRAELAELLVEHVGRLHAEFQPARVFRLQQRAIGGELLHPVVPVGQAEDALALHAGQQGAPLRAALEAVDRLDVVEEERQVEDLHLARVLLELGQGRRQHLHVAQQQRLHFLAVAEQRRVGIDVYLDPAAQALFDEFLEQQRALAFGRVFRDHVGELDDDRLRGIRQAGATDRQGAQQRPYHRLEHFVTSDCCCAFEVSTSLTQPARSENSPLLKPAFASVERVQPPSPARSSRRRARPSTGASTISPSTTKTPAPEAPASATRRAHSSSAGLGINVWWIGSTWLGWMHSNPPKPMSRAKRTASTSPARFWIAG

SEQ ID NO: 29073 - protein, 232 aa, Pseudomonas aeruginosa
PRICSAALLPLLRSRSRARSRLPKDSRSTPAAAAISPSAARPRALSTMGQTGLPLATAAWRTWAALSTFGRSRPITPAWSRHSARSSACPGCSAALIRTSTRASGVSTRKRRRLARASTFSPSSTASSRSTMTRSAPLARALGIRSGRVAGTNSALRTICRFMSASSYRSGRAQALDIGRGTAQFGKQRVAVAAQRRHRIHARNEGAAAGRRQQRRQAPGRAVDGGPALPRL

SEQ ID NO: 29074 - protein, 218 aa, Pseudomonas aeruginosa
DRRRAARRRRPWRYATAWNRRRRGGTPRARRPGFRRCRAGRRSARGRSPSACPPPLPRRGCRPWQWYGTPGSGNGRGIRRCGCRPRSRPPPRGSARRRCGRGPGPRPGQQGRPPPRGAAPSCCAGRPAPPRGKPRRSPGRRNTASCAAGWAGSARYRRPGPCVRRSARTMGSDAGPCRPAPSRASRGTILPSAPTPPAAGPGSAGRRESRRVAGCSRS

SEQ ID NO: 29075 - protein, 403 aa, Pseudomonas aeruginosa
EFAITQWRVRICRTPWSAHAFRSRRPAPVHPYRRVAQPDPGRAPRLPFPGRRQRAGQGARRPAWQPPAVPRQPRRRTDPGGPASATARAADHAPGGIPEERVHRVRQRRRRAYPHLRQYHRGHRIPSGNPRRLPRRSSRGHRRPAGTPQPRHCPRRAGRLHRPRHHRRAGGGHRPADPAFQHRPPGDGGAPGPSAGRTGQGTPTRHPAVPAYRPARGHHPARLPVRTGGADGRAAIAAHPGLQLRGDLPDDRGRRRHRRDPAVRRAPPQPDDEAGDHRTRRALGDPRAQPAGTRPGSTAELPAGVDRGVAEGGRQPVGRITPLALSAGLRRIGGQPPGGYPPYDSRQAGVRSSRRAPPTTPAQFANPPLSARLCSSAASIAGMCSRRNSTQVRIFASRYCREG

SEQ ID NO: 29076 - protein, 113 aa, Pseudomonas aeruginosa
SRRSPRPRRIPAGCRCNSPSGPSPGPAPGCSCCSTCYPTWTVSRCCSAACCRSSRSAPCCSGGRSGTATASAYWCGSASPRCRPTWRATTPWPSSTNTWHYSCRWSSPRSPPW

SEQ ID NO: 29077 - protein, 90 aa, Pseudomonas aeruginosa
IVMKAFALMALFACSPLVMAAGAQDQPASQQENAVEEYAYGMQLDVARVISSTDTSNACGIVPARMTYEDSNGQKHTVEYQVWGNGCTGG

SEQ ID NO: 29078 - protein, 543 aa, Pseudomonas aeruginosa
PRGGLVLWWTGTARAPLPHATTKDSHHDRTHPSPLRSLPRRRPARQRRRTARAAAADPGLEHRSPRRHHAAREGLPVQELQACPGLHQCRRRDIRGRRPPSGPADRVGQSHRDLVEPLDQGPAPQRFHHGGAHRRGSENRRGAQMSHFAKVARVPGDPILGLLDAYRNDPRADKLDLGVGVYKDAQGLTPILRSVKLAEQRLVEQETTKSYVGGHGDALFAARLAELALGAASPLLLEQRADATQTPGGTGALRLAGDFIAHCLPGRGIWLSDPTWPIHETLFAAAGLKVSHYPYVSADNRLDVEAMLAGLERIPQGDVVLLHACCHNPTGFDLSHDDWRRVLDVVRRRELLPLIDFAYQGFGDGLEEDAWAVRLFAGELPEVLVTSSCSKNFGLYRDRVGALIVCAQNAEKLTDLRSQLAFLARNLWSTPPAHGAEVVAAILGDSELKGLWQEEVEGMRSRIASLRIGLVEALAPHGLAERFAHVGAQRGMFSYTGLSPQQVARLRDEHAVYLVSSGRANVAGIDARRLDRLAQAIAQVCAD

SEQ ID NO: 29079 - protein, 429 aa, Pseudomonas aeruginosa
NAQLWAPVHTAPHGPHFLVLVSNAREKPSPVTGHPVPVPQRCHRGIRLPAAQGRAAAATGAGVGQRAGYRPEHRQGTLLAQPRPGGADRLNHQADDRHGRARLETAAGRGTADRHQRDQRNARGVFPGAGRQPDQPPGHAPARPDVLGEPRRRQPRAELSGRQERLRQGDERQGPRPGNEEHPLRRADRAVAAQRLHRSRPHPPAGGQPAISAAQSVEHHSGEDRGLPQPQLHPGLPQHQPPDQQQDLEHPVDQDRLHQRGRPLPGDAHHDQPQSGQSGGAGRLRQIHPLRRRHAPATLAGNRPGHCDPGRGQGLSPATRPRARPRPAGGPGRTLIRREDRPAQKSTLPRPAFTAPRLALPSSRRFCEPRVGLVGRRAFCTLATLRINSARRSRASSRFCSWVRYCWALITTTPSPLMRWSFSASRRSL

SEQ ID NO: 29080 - protein, 69 aa, Pseudomonas aeruginosa
ITWLIAFGITVLGLSASAAVKPSISRPPKENMMIAMAITSPLTPLGKKPPCAQRLLTEACGPPLPLNSR

SEQ ID NO: 29081 - protein, 403 aa, Pseudomonas aeruginosa
VRPEYCASASGAPCLRRDGGRNGSSAGSATCTRGTARPPASRRSGTGASAPGSARRRACAGTARGRKPGPCSPGSRRSVAAPTADSFPPPARGPYGQRTRSHPSPFSSSRQRPHSSETTLSSLRGHLPEVLSEARPQALGIQPCARRLATERQGRADGQALGIVDADLAQRFHDFDGLDELGDGTFAHHVADMVDHLDHGAIDGILEHVLDEAAIDLQVIHRRVLEVDEGRHASAEIVQGETTTGVLELVDEADGAGQVGNRHGFGDLEADRLRRNAVTGEQLGEELQERLVADGRAGEVDGAGADRLGARVLGALDKGAEGILHHPAIDQRHQAVALGGGYEAQRRHQAPALVAQAQQQFDVQALLRTFAQRHDGLGIETEAVFLQRQVDALDPGHLAEAHR

SEQ ID NO: 29082 - protein, 474 aa, Pseudomonas aeruginosa
FDVVLMEHLDPVAALFLGHVAGHIGGAQRLLEGRDTRQQVHQANADGAVERLPAPGEVQVLDGLAQMVGDLHGFFRRTVLQQDAELVAAQPRQRVALAQALLQQGTDLAQQFVAGGVAAGVVDQLELVQVEEHQGVPPAVALQAFQRYLQAILELAAVGQPGQRIVGRLPGQARHVLALAGHVVKHQDHPGDLAATVDRRAHQGHRHAAAVVTQNQLGMLATAVDLAAEDLLDQQHALLPRAFVDDPEQRRQGQAAGLVQRPVGHLLGGRVEVGNAPLGVGGDHSVADRGQGDLGPFALGIEGVLHFLALHQLLPGPQERQEDEHAGGGQVGHQQQPEQGPRALAKGVAEGLGRRRDLLVDRVDLGLPLLHLLGAGLPGADARAHLAGDVDQFHDVLVTHQPQLDGALEVTEVVEVAVQPDDRGNVVGMVAALEDALAGRLDVRVGLVQGKAHLAVAEGDRDGLLVAAEVFVGA

SEQ ID NO: 29083 - protein, 661 aa, Pseudomonas aeruginosa
WLFAEPALHLAEQTAFFIAAANKNRMSYMEYTRKTARRQPGASHLLQMSVEPGVEAAFGDQLLVIAVFGDMPAIEDQDPVGLLHRRQPMGHDQCGAAFEEVPERLVQGVLGSGVEGRGGLVEDHHLGLGEDHPGDRQALPLTARQAHPGTPDHGVQPLRQAPHAVGQLGDLQSPPAGLVTAFAAHGQVGPHAVVEQRRMLEDHRDMFAHAVQADFLQGHPAVADAAALRTVEAEQQLHQRALAAAAGADQGNLLAGADVQVQLLQDLVLAVGEIQPAHLDANGRAAGERIAQRRVARLVGPRQQLVDPLQRAASGVVGVLQAEQLFDRTDHEPEVAEHREHLADRQVREQHGEHRRGAEHVDAELEQQAAGAPGGVALPLRGHGVVADLLGAVAEAAEEIALAIAGADFLDRLEGLGERLGEARGAVVLELLEMLDALAQLHRGPDHQRVEQQDQQGQLPVHPDQDRGGAEQRQQGDQEAAEGFPDELVQGIQVGDQVGADRPAAEGFVFAQGDMPEALDQTQADAVDDVLGQPREQLRLEHVEHQRRPPQQKGRRQHQADVAERHLPVGGQQAVHETQRAVTLAEQHFVHQQRQQQGNRHGAEGGQHRHQVGEQQGFLMAQCESTNLRPAQAVSALTHAGPVPASGRARVKVRQAAGSRW

SEQ ID NO: 29084 - protein, 174 aa, Pseudomonas aeruginosa
HRDPRRRTPAGSPLPAARRFPRRGCAPPPGPGRPARCHRRSLRATRRRSGTAGRWSAARSASGRGCSRGYSGRAPRRGRRAGHRLPGGKRRRRRPPAGTAPRRPGRSPSTRSTWGPSRTAGGPWPRFSSPAWTGADRDRAGAAGCAAAPVRSVSAARERRRGSSRSASPSSADS

SEQ ID NO: 29085 - protein, 339 aa, Pseudomonas aeruginosa
MNGTAADTLAVSPPPLRNLCDGHGRLDPRAVGWSARPRVLCHIPGHFGRRKRWNHWCIVSPGWMLSLTIADLDYLTYGAAYFLDLDSGQAVAHTQIRFFGLGCQLPDEPQASHAFEHPRLQLRFDEQPGRLRVTGQAPDLGGLPLELALEVRRPSHLESVNLVVPMGEHTFHACSRQLGLPISGCLQLGRRRYDCQAGQSFAALDFGRGVWPLHTYWTRAAFAAPGGIAGNFGTGWTEASDLRENALWFGGKLSRVLDDVHIREPRDPLAEWRLDSACGRVELLFRPEQLHQARPSVGLFYANTRQWFGRFNGTLRHDDGDCVPVDGALGWIGSTRARW

SEQ ID NO: 29086 - protein, 259 aa, Pseudomonas aeruginosa
TRTSATTRPPKSPRRPTPKAPPCAPRRCSWATWTKRSSTNGYGRSRCWRPATMVETAKTGATPLEGDGKRILLIVGSPKRKSFCHLLAECYAQGARSKDHVVRELKLGELAFDPILHEGYEQSQVLEPDLLEAQRQIHWAEHLVFVYPVWWGGLPALLQGFFDRALQPGFAFRYRGTQDKDWEQLLGGRSADLLVCHDQPLSRLRFLKGPPAHRQMVRSVLGACGIATRRLEEFAPMRSSSEEQRQGWLRRAEQLGSQV

SEQ ID NO: 29087 - protein, 398 aa, Pseudomonas aeruginosa
IRFWKKGLVMKHYSATLALLPLTLALFLPQAAHAHGSMETPPSRVYGCFLEGPENPKSAACKAAVAAGGTQALYDWNGVNQGNANGNHQAVVPDGQLCGAGKALFKGLNLARSDWPSTAIAPDASGNFQFVYKASAPHATRYFDFYITKDGYNPEKPLAWSDLEPAPFCSITSVKLENGTYRMNCPLPQGKTGKHVIYNVWQRSDSPEAFYACIDVSFSGAVANPWQALGNLRAQQDLPAGATVTLRLFDAQGRDAQRHSLTLAQGANGAKQWPLALAQKVNQDSTLVNIGVLDAYGAVSPVASSQDNQVYVRQAGYRFQIDIELPVEGGGEQPGGDGKVDFDYPQGLQQYDAGTVVRGADGKRYQCKPYPNSGWCKGWDLYYAPGKGMAWQDAWTLL

SEQ ID NO: 29088 - protein, 794 aa, Pseudomonas aeruginosa
WVNCESMETPTTSTPSSRNLSMRLLWAMISEGQTKVKSSGQKNSTTYLPRRLESWKASTMEPSPRTAAAVKSGACLLTSTLIARLLEGWVAPGDARLPEEYAAQVTQPRRCIEMSNFNSHDRVSLCSQPAARLMLSPITRPHRMPLRTRLLWLFLPLLAASLGGIWLLSESILLSRFDREDQQRLQEGATVLHNRLDFELKRHLDIVRTYAWWDASYDFIQRPNETFEQENLDHEMLDDLGFDFVLFLDDRGHLQLKQWSPPAPDQRVLFGAPSASDQALLEALQQRAIRLGALDFRGRTDHSLSELLLVDNLPTLLVSVPISNNQGSAPAKGAILAGYFLDRERLANLREQMQADLQPMPNIATDSTWKPLRSRSGSTHNQALLSPRRFIGEHVQQVSVQYLSSSGEPQLRFDITKKRLLYIQGEKAINFFLGASLLVALGAFLVGYLALELWVLRRVQRLNREVAEVGRNAHSIRLSDFGNDELGQLAGEMNQMLERLEHSEARDRAILQSMRDGYFEMDVDGVILTVNPALCQLLGQTRETLIGHPYYELLGEDDLARARQPFQRAMQSGAGKTFAIPLQRADGSLGYFEATVSLIHDLQGELRGYRGIVRDVSDQIAYQQQLLEMAYRDPLTGLGNRKAFDEQLGQALLRAGSGGSELALLYLDLDRFKEVNDRFGHDIGDALLRTVAERVRSTLRQPDKAYRLGGDEFAVLLEDSQENNPQRLAERLLAALVQPIALNGERIDFVTPSIGIALYPRHAGDAEGLVRAADSAMYEAKRQRNHYCLYQAPA

SEQ ID NO: 29089 - protein, 258 aa, Pseudomonas aeruginosa
GFSPHPIGEPFPMPALSGPQYLGEGLKLIMRPGLRLFVLIPLTLNLLVFALLIGFAMQQFSHWVDLLMPSLPDWLSFLQYIVWPLFVLLVLVIVFFTFTMVANIISAPFNGFLSEKVEVVVRGRDDFPPFSWAELLAMIPRTMGREMRKLAYFLPRALVLLVLSFVPGVNLIATPLWILFGIWMMAVQYIDYPADNHKLGWNEMLAWLRSKRWACMGFGGVTYLALLIPLVNLVMMPAAVAGATLFWVREEGEKALVK

SEQ ID NO: 29090 - protein, 158 aa, Pseudomonas aeruginosa
SPAPVPSTTSSTTPARSVCANSPRPTRSPARPRRKCSANWIRASVSSTSPACRSARSSPTASRASCAPRPSAPAWPPVAPKTVQARWGWRKATIRSSRPLAGCSPACRRRNWCNARRKRPSSPTPATRNPTPGRRRCCRSRCSASASWNCSAPPPSSP

SEQ ID NO: 29091 - protein, 741 aa, Pseudomonas aeruginosa
WKSKNHPGNKTMTENWKFRRRTFLKHGAQAATLAGLSGLFPETLRRALAVEPDIRTGTIQDVQHVVILMQENRSFDHYFGHLNGVRGFNDPRALKRQDGKPVWYQNYKYEFSPYHWDTKVTSAQWVSSQNHEWSAFHAIWNQGRNYKWMAVQYPEAMGYFKRGDIPYYYALADAFTLCEAYHQSMMGPTNPNRLYHMSGRAAPSGDGKDVHIGNDMGDGTIGASGTVDWTTYPERLSAAGVDWRVYQEGGYRSSSLWYLYVDAYWKYRLQEQNNYDCNALAWFRNFKNAPRDSDLWQRAMLARGVDQLRKDVQENTLPQVSWIVAPYCYCEHPWWGPSFGEYYVTRVLEALTSNPEVWARTVFILNYDEGDGFYDHASAPVPPWKDGVGLSTVSTAGEIEASSGLPIGLGHRVPLIAISPWSKGGKVSAEVFDHTSVLRFLERRFGVVEENISPWRRAVCGDLTSLFDFQGAGDTQVAPDLTNVPQSDARKEDAYWQQFYRPSPKYWSYEPKSLPGQEKGQRPTLAVPYQLHATLALDIAAGKLRLTLGNDGMSLPGNPQGHSAAVFQVQPREVGNPRFYTVTSYPVVQESGEELGRTLNDELDDLLDANGRYAFEVHGPNGFFREFHGNLHLAAQMARPEVSVTYQRNGNLQLNIRNLGRLPCSVTVTPNPAYTREGSRRYELEPNQAISEVWLLRSSQGWYDLSVTASNTEANYLRRLAGHVETGKPSRSDPLLDIAAT

SEQ ID NO: 29092 - protein, 252 aa, Pseudomonas aeruginosa
PWCPAAASAWNWQRRGFERLNLLSRGVDSQLFHPSRRDPELRRRWGLGEQDIAVLHVGRLAAEKNLGLLGGTFRALCAAHPQLKLRLVLVGDGPERRHLERDLPEALFCGVQRGETLAAHYASGDLFLFPSLSETFGNVVLEAQAAGLAVVAFDQAAAGQHIRHGHNGVLAAPGDKSGFVEVASWLLDDQERLRRVRLNARQHASRQGWDSIVEHFQNYLEDACASPLVQPARSKPERPPAEDGGALPRSRE

SEQ ID NO: 29093 - protein, 206 aa, Pseudomonas aeruginosa
RAQAWRMTRKAPTGAFRYTSLAVPPADGPGHQSANERRSVVVTAFAMDVAVGDFLGVGLAHVDYLDLEVQALAGQRMVAVDGHVVAVDVADGDDLHAAVRSRGVELHADFQFVDAFEHLAGQGRDQFGAVFAIGVFRLDGDAQFVTDVLAFQGLLQADDDVAGTVQVDQRRATSGTVDDIPGVVGQGIVDGNRLVGRDLHGSKPFR

SEQ ID NO: 29094 - protein, 423 aa, Pseudomonas aeruginosa
RKRAAQTARPRISLRLVCPGRRRADQGAVMPSRNILVINCGSSSIKFALVNEAHSLFPLHGLAERLGSRDAVLRWKRGGDSDSLMIPNADHRAALAQLLPMVQNAAGGKLHGIGHRVVHGGELFTHATRIDDRVVEAIRATAPLAPLHNPANLQGIEAAMTLFPKLPHVAVFDTAFHQSLPEYAYRYALPEALYREHGVRRYGFHGTSHRYVSHRAAEMAGLAVGDSSWLSAHLGNGSSTCAIVNGQSLDTSMGLTPLEGLVMGTRSGDVDPNLHSHLARTLGWSLERIDSMLNNESGLLGLSDLSNDMRTLEQEREQGHPGAALAIEVFCYRLAKSLAAMSCALPQLDGVIFTGGIGENSPLVRAKTAAHLRLFDLRLDQEANARCVRGVAGPIQAAGHPRVLVIPTNEERQIALDTLALLD

SEQ ID NO: 29095 - protein, 133 aa, Pseudomonas aeruginosa
TRKSRWTTASAPSGSPSSSPGTSISNGSSSAAARRASCACRRRRSATRWCNARRRPASASSCPRAASRAPYRRRRSARRAASPAACCWPSRKRSRRWPRPRASCYRKAWRSSTLTWCGSATSNRWSSCARARG

SEQ ID NO: 29096 - protein, 72 aa, Pseudomonas aeruginosa
KSPPNGGLFRPGRDQYCGWVCAGPWAPGTGRRLTSTRRFCARPSAVELLAIGWSGPMPRVLRRVPSTPWAVR

SEQ ID NO: 29097 - protein, 206 aa, Pseudomonas aeruginosa
SRAAGRSRTAVAGWWSGIAGPGACAHRRGPAGRWCPTTTGAGAGCARWCAVRGRPVRDRGSRRDAPAAGGAHGSAGLPGRPGWPAAPRTAARTSAPWPGWPAPSVVPGTRWACSASARAARTPRPPRTPRRSAGHGPAADRRSRPARPATARRPGSRRWNTASPSGPQRRTPKRRPAASTPPRATRRGRHRAPVPVRRPGRAPGST

SEQ ID NO: 29098 - protein, 163 aa, Pseudomonas aeruginosa
ATPGGWKAPTRPWPACGAGTHWRKPSTRRWPTTCSCWSTARPGCAAGRWSRAPSSSPSTPPRAWSTCSSATACCGTSRSGATASSGCGARTACSARWWACTWTFTRRTSTPGSTITCTSSSSTATSSNRNRRPPDPPRRPSAPREGLASLPCPAWYFGLSSMH

SEQ ID NO: 29099 - protein, 154 aa, Pseudomonas aeruginosa
CPGRSALAASTAASPGSSRAAPPRRSSTAPCASGNRPGRSAPAAPLAAAAPGRSSRRYNRPGSCRRSRPCRSSGNRATGRGSPPCARRSNGCHAPARSGRSPARRSARCGSRATSPSPSRPRCAARRPRRGSSPAPACRGCLRRGSAAGNRPAR

SEQ ID NO: 29100 - protein, 382 aa, Pseudomonas aeruginosa
TPGSPRAGCWFVADAPPAAPRPAPPGAPARRSRRGPRIPPASRPTAPLPSRPPQSKRGVTAASAIANLGRSTRPARKVRADPITPPALAAGHPFTGSRPPARGRRPLLPRPAHPGHPEALGQPRLPGADRRPEEDRGNPEERPAATQRRIHRAALPAHGQRGKLPPAAEHLQPPGDPPERGPRSTVQAQGADAPVLRFPRRQTALRRRGAGPDELLAARAVDPVHPHRRILDDPVPGRAAQPRAPAGHAGNQGGRGDAHRQRPRLPRPHRPVRAPGLGALLRRTGQGNARAVHPPALPGARPVAGTHRRFRQGPPLPRGPRQHARPATGVAGDPGRRGKTAGARAERQGTGQTPGPEPASGGETQRRQRFMSGGLDSRSPLP

SEQ ID NO: 29101 - protein, 106 aa, Pseudomonas aeruginosa
ERCLMSKQRRTFSAEFKREAAALVLDQGYSHIDACRSLGVVDSALRRWVKQLEAERQGVTPKSKALTPEQQKIQELEARINRLEREKAILKKATALLMSDELDRTR

SEQ ID NO: 29102 - protein, 68 aa, Pseudomonas aeruginosa
TQENARLENTCRGTERLSNIYSATQCCEGRLNPPKRNQVGAGTFGKKAARDSRFPSPNNRRRVRKIGW

SEQ ID NO: 29103 - protein, 78 aa, Pseudomonas aeruginosa
IQLLIAHELQLHYVTADDLVRTDSLLSDIQQTSMIGLALPTRPEAQRWIAQALLQLPTEPSVTLLEVIGELRSHIHFT

SEQ ID NO: 29104 - protein, 108 aa, Pseudomonas aeruginosa
PSRPAQPARRRHDRRQRFPQRPPHCADRAQATAGPSNSRLPSKCDRGSSVLRPAPPAHSVPNHSAEPSSWSCRVPPRAESLPARDDPRPTTSPTPDVGSTAPSPPPAR

SEQ ID NO: 29105 - protein, 1058 aa, Pseudomonas aeruginosa
SPTTRSRTYLYSESTVLWVCACSLRANAYRRCRSMRPLSDIATTLFLAIAVRYVTNEPTLADAAAIIAGRTRKWSTWGSLTEAQQTLIAQSLRLRPSLLAQPKRFMLSAEGILKGKLSSFELVDSSNLNTELHEQDRYRLSSHLDIDQVIRENFEALKNGRTAPAHGQLPNEGDVVLKHITGDHVRVFAIPENERHVLNALDQHVLIPPSTALPEISWEHARLMKLAKQMDASPDLHSQHAASLVNIWGDEPVRKADSGNFYRVNAPTGSGKSVAMVMMAIDAAERGHRVAIAVPTLVEVENTVRIIKQSAAAVGKELKVAPLHSASRIYERAEMQFEQGKTDHPYDYACLLDVYSADLMAVEPGNEPCFNIRISACGDDGEESSKRLKHCPFLFRCGQTRMLSQAMEADIVVINHHALLSGTTRIPLSDAEQFPGPRSLVEILLRTTPVFLVDEIDGLLKSAIDSSVIELRLGNVGDNSPLLRLFNHVVGKSHIPGIDRSSLYRVNWALMYCTLSVSQLMNLQQERYFEWPIKETTWSDADDTFITQALGITRETLEYLFSNDLGQLPHHLQSLSRNLANWRSNDGEHRLETLAITLGNLIADLSESGRLPERLKEHDRIRLKASLILRGTLLVIETHLRNLQVELPAFVNAEIPYAYEVRRSIAGPEPLSPSPNGPLQRAVFGFKRKDSSDQDSTLHVVAMRGDPHSTLLSLPDISALGYAGVKRLFIGFSATAYFPGASAFDLKAQDFIDVPDAKGQVTFENVNQTTAISGGPFAQRKFLVTKLAKELWPWLKARLEKLANDPETRDRARLLLVTNSDADAEALAMTLAKMADGPGESVGWVRGRQSEYKPSSLEAQQMLVYDDLAEFTSGKHKHKTLLVSALGPMARGHNIVNADGLSAIGGVVICVRPLPASDSPNNNLAHICYETGNTVLPRSSPGEVMTQERKLSNALLQTIRTARPAFSQQPANIRHYTIMNILVSLTQLIGRGRRGGTPVTCYFADAAFLKGLKPWSEMLNESVNRLKEDGDWEQFERHHAGIASAVQQYILRSRKESV

SEQ ID NO: 29106 - protein, 119 aa, Pseudomonas aeruginosa
SKAFGQELVLLGFQAALIALPHPISDALAQLIYPCAPYSQVALAMLIDHTFLGLKLTFALLLIQFGLFVLLLEPVGFSQPQSIPLLGEPNREDTFESLLIVQLFLQDLVTLPAIGDRLQ

SEQ ID NO: 29107 - protein, 177 aa, Pseudomonas aeruginosa
CKDPHMSGKPAARVTDPTTCPVPGHGSNPIVQGSPDVVFDGLPAARQGDASACGSPMISAVSSTVLINGLPAVTLGSIGAHGNVVIGGSGTVLIGDVFTPAPRAPALPPNRNGVPCSGRFQLIDHETGKPVAGRRVRVWSSGGWNAFDTTDADGMTSWIERPTAETLYIDLVQRGDA

SEQ ID NO: 29108 - protein, 372 aa, Pseudomonas aeruginosa
FPPIDQEEKPMEQPFDLAAELAKQPHLLEIAGNLLMKGGPEDYIGAVLCLRGTLYFKEAHTPLVRESLCQCFDEFKRLAEPHLTRLWREEPAQGKPLTAYRDTQPLREMMGAMDEDDHLSFCYTSGKKSRDAGAWLFDIYGKRSWQAKMGHDLSVLEFSVPLLYQERQPLDFLQLFIDFARRLEPEQGYAGHAYNLSPTSWDNDEPSEAFMAARMPGLDVGTACLLANTPEFKPTRIKTVSWLTLLNNERLALAGGLVALRAQLPSSHFAFYRYGDGVVIQAGAYPYIAGDAEDSRPAPYVLLNHALKGIRYETVGSLHGGSHDGELRLVGWAADQWLKRLDVEDSELPRWRDKLLNTEPCLDATNSLPERP

SEQ ID NO: 29109 - protein, 61 aa, Pseudomonas aeruginosa
GLTFSGIKSARRGYTPYEASLTEKISAPHKSAYKQEFNLSNRAFNITQTVSITYYSTTIPL

SEQ ID NO: 29110 - protein, 152 aa, Pseudomonas aeruginosa
WSAAAVRRRTTWSVNSAAPCWPRRRLRRPRRPPRSAAPGAPARRGRSTGVRPRRVAAGGDGSGCSATARRSAGRRRAPGDGWRGPRGPGYAAARRRPGATGRRSAAPRSGWSCDGAGGTGRCRAAAVPGPSPGGIPRSSRGTIALRSAGGRG

SEQ ID NO: 29111 - protein, 163 aa, Pseudomonas aeruginosa
ASPGRSSLRVPQRSGVFSLLRAAVPVARLKFGLFCRFGKQLVDSRKTDREKRPTVVRSRFSSHRPARASWPGGSATRTGPCRHPPLRPSSPAAPTSRWCSTPASPTSAASCRASTASCAGPARSAANSTWNRPARPPGSARRAACRRWRRRWAACNGSSGCSR

SEQ ID NO: 29112 - protein, 202 aa, Pseudomonas aeruginosa
SRRCGHERALPRRPRRLRCRRTAAPAPRDPGLGQLRALRPWLRQPAAAGALRRPRQLAGSRAALGRAARRRAFRRALAGGPRQRRASARHPATAHRPARLRQPRMVGGLCRGPGRPSTDTGDQQLRRIRFQQPVPARRAPAARAGAAPDRRTRRRRTAVATARRAVARPRPRPDAAAVAQRGAHRAWRGYRAGGRGRAHPRP

SEQ ID NO: 29113 - protein, 482 aa, Pseudomonas aeruginosa
RSATTASCCARLSTNCAPTAPRPSSTANGSSSAWAWNAPSANTCRCSACIRSAKPTSPSHGSSSSDRRPRREPNPALPLGHPADRHLRPGLRLLLRPGHRRDRRVHPERPATLVATDRPAGVGGAAGADRRPAGGRRAARPLLRAAGGRPRHADRRAGPLRLAVGHRLPDHPAVPGGRRRRLQHGAAGRQQVGVTLVRQDPAGLRHGHPPGRAAAGRRAVRRAAAVPGGDLRLAQRIPRRRPGSVPRRAGLHALLPHPAGRPRARREPRRTRPGRGGEVAAGDDHRPGDEKHRLFRGGADLGAVRHPGVHRALPARDPGDRHRHGRDPAVRRPGQRRRRAHPAGRLERPLPRRALLPGDGLPRRGDPRPAGAGPAAPAITVGDGPGIGLAGLLRLRLVQSLGGLCGGYRAGRQNRLRPRPGDGHQPVGDRSRAAGAGAAQGLQPQLRPRLAGALPDGGGSPCGHRLERPRTAHRAATEALKR

SEQ ID NO: 29114 - protein, 177 aa, Pseudomonas aeruginosa
PVAPAESRGPGRRVRPGAGRGPAATHHWLLAPPAAVAGHARRDARAEGRLLARRAEQRQHRADARRRAARRAALGHAAVRRPVRPLQARPAGLPRRLPPARPAAAGGDALRGAQLRPQGRARPRPEDRVHRPAAGIRPRPVPGPRRRAGLGPDRQRPAGPAPATGGLGLTDFLLPAP

SEQ ID NO: 29115 - protein, 367 aa, Pseudomonas aeruginosa
WRCCCRRCPRAWASPAAWTWPRPAANATRRSTCRLLWLACQNGDHRLRPGRGDRHRHRPESAVRPAAGLGRLALRGRRAAGAGPDRTWPAAAGGLRGGVADTDLRLLRGTVAALASRTRRGAPRVLAEPAGAQRPGCPVPGDRHRRRDRHAAQPLPAFLAGAEPRLPAQPCRQAPGAALGGGRQQPGADPGAAGQRGDPDRRRQRVPPQRAHRGGRYRAGPRAALAIARPGTRLAAVRRGAARVRPQLDGHHHPGRADRHGGLPPPAPGALGAAPADPWRRSAAGAAGDPALRRGWHRAAADLQPGDPVDAVAAGSDPAATVRFRPAPDGPAGDRRRDPVAGLGGSAGDRRPEPATAGRLRVRLSIA

SEQ ID NO: 29116 - protein, 122 aa, Pseudomonas aeruginosa
TASLLFSKKAGITSTFPRHKAFLALSRSGNICNIRCSISVKVKEHKNMSIQHRTQDAIRTLTAAFAPFDCLIQATRKGNFSFTIVDQHGVACHSERLYPEQYDDSGKMEEVINRVRKKTLAA

SEQ ID NO: 29117 - protein, 163 aa, Pseudomonas aeruginosa
MDGASCPGIIAAEAPDVALRIAASEAATAVVLVLDVDDDLGAGGLGAAEQGVGIGDHQVEALGIAAGFVDVPHQPTVGVVADARAEHQHTVGAVRAGVGQLGVEHLSVLAGHHQLALEAKGPAQPVDGGRRIAVTQAGNDAGDGVAGGRVHGAYLRGKARPPA

SEQ ID NO: 29118 - protein, 487 aa, Pseudomonas aeruginosa
PGAEQAEAQQAEVDAGQHPVAALQAGQQVAFRATQQAEQRQAQRQHGGEAQLRATEGPAVAADDGPQRDQRPTGAKHADLPGVAAGQLRRQQAVAPQQRQAGQRQAAADRQVQRPHQTNATTAADLALGQPDLQPAEDHHRPGQPEQQVHPAHQLAAPLDHVQAGQPAVGGVAGRIGRLGMQQFAAGGIEVDRALVVEDARGVAPADVHGGRLVIGMVDADPARRAAVAPDLAGLDDQAVDGRRRPRRAADFLAFVGALHFMEEALAIVLVDHLQARLHVVDDEDHQAGVGDHQVERQADHPQHVVRVEPGALPRRLRAQGEEVLEDPPVHDGPADQRHQHQHPGDADDVQADHAGVQVVVQGEEELAADCLRQRLAAHRVQLKDLELAAVARLPAGVPVGRPLARRQHPPGMGIGGALAQPVAHLVGAQRLRAGQVHVRLHPAGQLLVEAGQAAGEDDDEQQPADQQPRPGMQAGHRLTQVHGRAP

SEQ ID NO: 29119 - protein, 904 aa, Pseudomonas aeruginosa
PSRTATRMRPVTDSPPARAWLVMGWRPGWKQGLASSLPRLAGTATPRSRVARRSSIRKVCDCISITFAFVLAPDDRQVASRQGLPGSDECGSYPVAFVRRAIRPSPLCASAPSLVISAVCGFGWSRRRTYRMTSPSAPDTQLSLAIDPARPYARLTLGSHVHSGYDLRSGRMQSISRHRAALAFIYAGEAVSGRPGSEPREAQRRIERRPAHEQEYRETLRRLGFKPATRRSDALEESAGEMFELPGDNAWLHFMQDDLPRLRQQGWFIDIRADFAYDLTPIDAWYAEVEEADDRQWFELELGIQVAGQRVSLLPALTELIRRSPALLDPRALARHADEEQLVLRLELNPPLRVALPFGRLKPVLAALSDFYLGDPEPQRKLRLGAPDAARLADLDELPLAWEGGDNLRDFARRLRSFQARPATPPQGLRAELRPYQLEGLSWMQTLRELDSGGVLADDMGLGKTLQSLAHVLLEKQAGRLDTPALVVMPTSLIPNWLDEAERFAPDLRVLALHGAGRRRDFARIDEHDLVLTTYALLPRDAAELGKRRFHLLILDEAQNIKNATTKAAVAARELAARHRLCLTGTPLENHLGELWSLFHFLMPGWLGDARQFAQDYRTPIEKHGDEARLSHLAARLRPFLLRRTKEQVASELPPKSEFTQFVELSEAQRELYETVRLALDRKVREEIARRGLARSRIVILEALLKLRQVCCDTRLLQRQEDGARSGRALSSGKLAYLLDMLDELIAEGRRVLLFSQFTSMLALIEDALRQRGVDYVLLTGETRDRRAPVQRFQSGKVPVFLISLKAGGVGLNLTAADTVIHYDPWWNPAVENQASDRAYRIGQDKPVFVYRLIARGTVEEKIQHLQQEKAALADGLFSEGNGDGWKLDEADIDALFAPLPKAL

SEQ ID NO: 29120 - protein, 101 aa, Pseudomonas aeruginosa
ARRPLPPASASAKPWPPNTRCRWSAPSTPTTPCWPSAPASRPSTCPAAVSPPVPWACRTWVSAASTTCSPTCAGSPTSATCRCWWTSTPASAPRRSTSPAR

SEQ ID NO: 29121 - protein, 117 aa, Pseudomonas aeruginosa
RPRWHPAPRWSPNTCAKPACCRTWKPSASAWWPTPVRLATACPAPSTRRSSRRSSSATCTPPRCSPATATSTGASTPTPSRPSSPRRRWWWPTPSPGPSASTSSATCSAWWTARRSA

SEQ ID NO: 29122 - protein, 426 aa, Pseudomonas aeruginosa
DGRRVASSADDRQRLSNAAAAPEFDCRGRRRMAHPPQIRIPATYLRGGTSKGVFFRLEDLPESCRVPGEARDRLFMRVIGSPDPYAAHIDGMGGATSSTSKCVILSKSSQPGHDVDYLYGQVSIDKPFVDWSGNCGNLSTGAGAFALHAGLVDPARIPEDGICEVRIWQANIGKTIIAHVPVSGGQVQETGDFELDGVTFPAAEIVLEFLDPSDDGEDGGAMFPTGNLVDDLEVPGVGTFKATMINAGIPTVFVNAEEIGYRGTELREEINGDPQQLARFERIRVAGALRMGLIKTPEEAATRQHTPKIAFVAPPRDYRTASGKLVAAGDIDLLVRALSMGKLHHAMMGTAAVAIGTAAAIPGTLVNLAAGGGERSAVRFGHPSGTLRVGAEASQANGEWTVTKAIMSRSARILMEGWVRVPGDAF

SEQ ID NO: 29123 - protein, 508 aa, Pseudomonas aeruginosa
PKRKPTTYEPLEYAMSANVDLNQRPDYDAVLQDIADYVLDYRIDSTEALDTARNCLMDTLGCGLLALRFPECTKHLGPLVEGTLVPHGARVPGTSFRLDPVKAAWDIGCIVRWLDYNDTWLAAEWGHPSDNLGGILAVADHLSQKRLANGEAPLSMRQVLEAMIMAHEIQGVIALENSFNRVGLDHVLLVKVASTAVCAKLMGADREQLLAALSHAFVDGQALRTYRHAPNAGSRKSWAAGDATSRGVRLADIALRGEMGIPGVLSAPQWGFYDVLFSHTSKDLATKPEDKRRFSFPQGYGSYVMENVLFKISFPAEFHAQTAAEAAVRLHPLVKDRLQRISRIVITTHESAIRIISKVGPLANPADRDHCLQYMTAVPLIFGDLVAEHYEDAFHAAHPLIDRLREKMEIVEEPRYSREYLEADKRSIANAVEVFFDDGSSTGQVAVEYPLGHRRRRAEGIPLLQEKFKANLATRFPPQRCQRIFDLCSHQASLEATPVNRFMDLLAI

SEQ ID NO: 29124 - protein, 282 aa, Pseudomonas aeruginosa
NCAGWYAATRPSVRRWRGCRARRGTPRRAPASAARAARARAAAASRPPPAHGATASPTRRRDLRCRILGACPPPPATVAAAAATPPAPGSAPASPWRCRARCTGCGCSPRAFAPRARRPAESTLRAVAAPPSRRRRYAPASPRWHRTAIARDDADGAAAGSRRDSRYPWPPRPGAWRRTARWKRCAWSKHLAETRIVLANLAKRASPGTPKLAFRSRSGNPPCSISCSFSAAASPGSAPCCSALAAASWWCRCSITCCNSVAPPTTRWPRRPCRSRWPPRPA

SEQ ID NO: 29125 - protein, 1047 aa, Pseudomonas aeruginosa
TSPQVRMNCAATGGASMGASERSTNDPSELQPCSLPASASPRKSRLRQRLMLIGFALPILAAVGIVVLHEAHTSRLQARELARYAATLDYEVRQGPSEAILFPADGPFDRRLGYQLLPSFMQRLYDRDYAITRQAHFSPALMRYAEHRLFPPYAEKAQAGLDIADCRGVPIYDFRYPQRRYANFASLPPLVVQSLLFIENRDLLDHERPYLNPAVDWGRFTQAALSQVGKMLGFSAHSSGGSTLATQIEKYRHSAEGRTGSIGDKLRQMLSASVRSYREGPANFAARQDIVLTYLNSVPLSAAPGYGEVTGLADGLWVWYGADYRQVGEALDGKAGLAAQGLALRQVLALMIAHRRPSFYLAPRGRDELDRMTDSHLRVLTQAGVIEAPLRDAALAQKLAFRDPRSQPTVQPLPTNKGVTLARTRLAGMLGVPLYDLDRLDLRANTTLQHELQESVTAYLQKLADPDYAAQLGLIGERLLTPTSTRSVRYSFTLFERTPSGNQVRVQTDNTDQPFDINEGSKLELGSTAKLRVLASYLETVAQIHRDYGGMSVAELRKVEVEPLDFILRWGIDYLVASRDRDLSAMLQAAMERRYSASPYESFFTGGGLHTFNNFRKEDNGRRPMLLEALRESINLPFVRLLRDLIRHDIYQNAGSKVQLLADDKDPRRADYLDRFVDKESQVYLRRFWVKYRDKDANQRLETFLDGLRPWPVRLAAIHRYLQPQADLASFSAFLRERLPRGSLTDKRAAELYERYGPGKFNLNDQGYVARVHPLELWLLGYLQKQPQATFGEAVAASGAERKEVYGWLFKSRHKNARDKRIRILLEVEAFLDLHQQWKKLGYPFDHLVPSYATALGSSGDRPAALAELMGIIVNDGVRMPTLRLEHLDFALGTPYETRFAPEATLGQRVMTSEVATTLRNALSQVVDAGTARRLQGTFSRPDGAPLVMGGKTGTGDNRLQTFSAGGHVRSSKALNRTATFVFYIGPRHFGTLTAYVDGSESSQFKFTSALPVQVLKGMAPLLRDYLDPRTATRCQVPLSPQQIGRL

SEQ ID NO: 29126 - protein, 183 aa, Pseudomonas aeruginosa
APAAPAAAATTGRRSTAGIAGCRPTAPRCAAAAAGRAARSALRSALPGCQCAGGCRERHRPPPRPAPPHRRSRGWSAGPRPGRRRRRPAPVYGCRSADTAPAPRRRCGNGRRSARSGSARAGRAVPAPVAGPPPRPACCRRWRGAAPPLPSDRRRRVRATTARDGRRGHWPGAGTGRPRCIRA

SEQ ID NO: 29127 - protein, 230 aa, Pseudomonas aeruginosa
IPPIAATTVSNDGQSLPKPLENFMPMAKATSKAAATSRWNQAMAAPQADRASASRRCSASAQESSKDLPPDSSPSAATTVTSSMPMKPSAVRNQGSAWFIAWFSPPGPKPWPPRLVTISARLPRSSGRYWATPLSRTKSKVTPRRTIWSIQAFRPLGTLKLYIGVEITSRSLSNSSPTSWSLSARSACIASERCSGWGWKAAATKASVTAGSGTRPTSRRATRACGWASR

SEQ ID NO: 29128 - protein, 302 aa, Pseudomonas aeruginosa
LHRLAPEEVWRRPDLLRPGVRPPARAGRCHAQGRSQRRRHHGQRPALPGAQPGAEERRGDDRRTDPDRPGPAHRRGPREGDRRAPAEDLRADPAGSQPRPLRRVARLSQGRADRAFRQALRRRGQGAVPGLSRRRMADRFGRPPRQPWHSGASRVYAGALSIRAEERCMSFSPSRLLLPLSIVVLAGCAGQQKPVVTLDDADDCSPLKLTQGQELVLTLPSNPTTGFRWELRNPAASVLKRLGPEVYSNSEEDSGLVGSGGESTWRFRVAASGDDRLELVYRRPWEKDAEPAESFSCAIQVR

SEQ ID NO: 29129 - protein, 163 aa, Pseudomonas aeruginosa
NRCPRRTHSVRRPTSCAVATWPILTGPVALRTPCSAPPSSCSPCPAPLLCSRWPNRCASQATTAAPTCALARRSGPATWSRRSARSFGSHRTSTACPGRAPCRWSATAIATAWSAPMDSTACGSAASPSAGSGWPSIPATTATGTTPAMHPCSASAWASPRAT

SEQ ID NO: 29130 - protein, 255 aa, Pseudomonas aeruginosa
KAVMPEVTRVSESDRLFAQPQQRVADFVFNEDVVRVFPDMIKRSVPGYPTIVENIGVLGAQFAQPNSVLYDLGCSLGAVTQSLRRHVRNDGCRVIGVDNSHAMIERCSEYLHAQDAMYQELLPVELIEADILALDLQPTSLVAMNFTLQFVAPDQRLGLLRRIRQALLPGGALILSEKLRFADAQEHALLTDLHIAFKRANGYSELEIAQKRSALENVMLPDTFEEHRERLLAAGFSRVSQWFQCLNFASMIALP

SEQ ID NO: 29131 - protein, 336 aa, Pseudomonas aeruginosa
  UNSURE (35): Identity of amino acid at the above locations are unknown.
RVVCGLREVIASFCPRMWLSRVDLPTLGRPTIATXPQRLPAGMSSCMSVMAILHAQSHQRGGRGHLLGDAAAAAVPVGLVAQQGHFAIDEEGPAMGFALDIHHLVARQVAATRLQELLQAGLGVLVGVHRGQLAQLRSEPGDDPLARGVHAGIQVDGADQGFHRIGEDRLAAEPAALQLARAQPQVVAHLEAARQQGQGLALDQSRAQARKLAFASLREVVEQRLADDEVENGVTEELQALVVAPGVAAMGQGQDHQVPVFEGIAELALESVQRITHGMRTRNSLSKWTTRSMLLISGSRFSYFRCARNWLSSSCTSRAFSRSRLRMPLICIPLPT

SEQ ID NO: 29132 - protein, 484 aa, Pseudomonas aeruginosa
KRAVETALFSPAGLFGQLEGNEAGASLAQHPHRNRTVLRQGLGHVGEDLGRGHRLVVQVGDDIARTQADDRGRTVLDFLDHHAALDIQALALLGGQVGDGHAQAVAAALGARSAHRGDFLVVVRKAAYRHAQGLALAVANHVQVDLVARLHVAHQVRQVGGLVDRLAVQAEDHIAHLQATLGRRAVFHQLRHQRAGRLVEAEGLGEILVHFLDHHAQPAATDLAGFLQLVGDVQRDIDRNGEGQAHEAAGTGEDLRVDADHFALQVQQRTAGVTRVDRHVGLDEGYVALVRQATTLGTDDTGGDRVIEAERRTDGQDPFAHFQLVRIAQFQGRQVLRLDLQHRHVAARVRADQLGLVLATVGQAHQDLVGIGHDVIVGEDVAVVGDDEAGTQRLRLALLAARIARNLRDAAFEEVAEHRRQPFEVGDRQLPARHGAIRQLLPRTDIHHRRRRLFDQRREVRQFCPGRHRQAQGQQGHHRSHTAF

SEQ ID NO: 29133 - protein, 93 aa, Pseudomonas aeruginosa
SPAAPPALRCSRPARPGLSPEAGRSAGWSPVAPSAAGRRSGCTDARRPAPPGSPRQRPPGDRPSATVPSPLSAERPRRPGQQRPPQRYPASAG

SEQ ID NO: 29134 - protein, 87 aa, Pseudomonas aeruginosa
CRPLTIPAAACSSTSTGIPTCRASTPSAKPPSPACTAPTAWPAIRCWNASSMPALPPPTCSSACPARPCRKACRAGTPARSPTPTRT

SEQ ID NO: 29135 - protein, 200 aa, Pseudomonas aeruginosa
SSARPCSAAKAGACTTRWIIRTCCPKPATLSWCRPSTATEAQADTQAPMAVGAQCIGRDTAAKDAPAARQAHAQYDQPGQRQAVRAQLHRLPAASGAPQLPAPLVMAHAAEGPRAAQQYLAVQPPGTVGQADQRKRRLQPDRQRRQQDRQQRQGPQCQARRQQDRRDPPAAFERLNPAGHGPGSSAPSAAGRRLPARRAA

SEQ ID NO: 29136 - protein, 319 aa, Pseudomonas aeruginosa
PRSIAMADPAFHTPLVHEGILAVRGPDAAKFLQGQLTCNLAYLNDETSSLGGRCNIKGRLLSSFRILPEGDGLLLAMAGELLEAQLADLKKYAVFSKASLADESAAWLRIGLRDASEALRALGIDTPAESGRIARHGDLLAVALGDARVELWVPAQRAEAVLATLREHSREAPLDDWLLGQVRAGIGQVFGATRELFIPQMINLQAVGGVSFKKGCYTGQEIVARMQYLGRLKRRLYRLALDADEVPAPGTGLFSPVHSTSVGEVVLAARTPENSVELLAVLQDDAVADGRISLGSAEGAPLVLLNLPYTLDSDREIQR

SEQ ID NO: 29137 - protein, 293 aa, Pseudomonas aeruginosa
GGGRPGCQHPGPEQGDRQRRGADRAHHPRGEQSAAAQPEGNHRPADGDQPAGHQLHLQPGHRPGHGADVPGHHRRGRSQDARSLEQEHRDRRHLPRAGPSLHPPGAGPGDPGRTGAPDRRAADPHLRRGSQRAAVGLHQPEPCDRAHPSADRRAHSQGLGFPRADRRGPAPAPGLRPQLAARGLYRPGPGRHPAELPWQRASLYPPGLEPDPGVRQARPRADRRHEGRRGPLQRPGSRHQHAAIGPPYSTGKRTRTSKPPSSPWSSWICARCARQTSPTIASPRPLPGLSPRR

SEQ ID NO: 29138 - protein, 212 aa, Pseudomonas aeruginosa
ASGASARPSSRARAVRSIRSAPPSAMAWAPLSMRARESSWLARWIRRSVFFAVVSRVERQASGSCSRRPSSRRALSAASGVRNSWAASAMKCDCRSNRLRRRWVKWFSDSTSGRNSCWTSSIGNGRRSSGWRSSTSRRRRSSGRSAALTASHTSTSAPTPRTPRRSRVSVIRLRAMRSRAPSVSATRISAMPLMLGSLTGCSRLTTRTSTPW

SEQ ID NO: 29139 - protein, 258 aa, Pseudomonas aeruginosa
ALRPLARSTSSRSRASHSSSLPRRLPASVTQRLQQVAEAAEGDYAHGAAFQLLAQAVDVDLDGVGAGLLVQAEDLGGQLLLAHHPPRTGDHRFQHRLFPRGQGQRLLVEAEAPGAEVVDQGAAALQLFATEHAAAQQGLDPRLQLGQFERLCQVVVGAEIEAVHPVLHLAARSQHQHRQGLAAPAQARQHLEAVHPRQADVEDRQGVLLAGQSQVGGHPVLQQVYRPAGALERLDHAFGELRMIFHQKDAHGRFSTTG

SEQ ID NO: 29140 - protein, 475 aa, Pseudomonas aeruginosa
MASLPPGIAESLAKAWRLRISRWTAQIVRQNALQRGARRTRTRIGDHCMSTSLPQAARSVRSSRSTTLTTTAVVLASIAPLGNAAGFLEDSKASLETRNFYMNRDFRDGPGQSKREEWAQGFILNLQSGYTQGTVGFGLDAMGMLGVKLDSGRGRSGTGLLPKDSDGRAPDTYSKLGLTAKVKVSQSELKVGTLIPKLPSVQPNNGRIFPQIFEGALLTSKEIKDLGFTAGRLEKTKIRDSSDSEDLALNDKNGRFAGVSADHFDLGGLDYKLTDQLTASYHYSNLQDVYRQHFVGLLHSWPIGPGELTSDLRFARSTDSGSAKAGGIDNKSLNGMFTYSLGNHAFGAAWQRMNGDDAFPYLEGSNPYLVNFVQVNDFAGPKERSWQLRYDYDFVGLGIPGLTFMTRYVKGDNVELAGQRGEGREWERNTELQYVFQSGALKNLGIRWRNATFRSNFTRDIDENRLIVSYTLPIW

SEQ ID NO: 29141 - protein, 607 aa, Pseudomonas aeruginosa
  UNSURE (326),(375): Identity of amino acid at the above locations are unknown.
SRGRRRSATPRTNNRWAAPCCSRCSPASPCCWCSPACSKRSASSSAPPWSAPAWPFSTAPGQSLRWSPRACSGSASTGCSTAPWTSRCRWAFSTSCRCEDFVMETLNYLGQGFGVAMTPTNLITALIGTLIGTIVGLLPGLGPINGVALLIPVAFALGLPPETALILLAAVYLGCEYGGRISSILLNIPGEASTVMTTLDGYPMARKGLAGVALSLSAWSSFIGAFIATCGMVLFAPLLAKWAIAFGPAEYFVLMVFAIVCLGGMAGDRPLKTLLAALLGLFLSSVGIDANSGVYRFTGDSIHLADGIQFVVLVLGLFSVSEILMXVEKTHHGQEAVKATGRMLFNFKEAASVFMVNMRCGLLGFVMGEWPGAGXTLASAVAYMTEKKLAGAKGEFGKGDMRGLAAPETAIGASACGAMVPMLTLGVPGSGTTAVMIGALTLYNITPGPLLFQQQPDIVWGLIASLFIANVMLIILNVPMVRVFTRILAVPNWALVPAIAIITGIGVYGVHATTFDLFLMVGIGVIGYILRKLDFPLSPLLLGFILGGLMEQNLRRALSISNGELGILWSSPISLVTWALVVVMLLLPLVRAWRRRAARRATGLADA

SEQ ID NO: 29142 - protein, 311 aa, Pseudomonas aeruginosa
RDHRLRRRGHHAFQRAGDRLHAPQRRGPRHRVLRQHARWCQRDGQPRAAPRRGAQPRRRSAEPAPVAGSAAGAGGVPVPARRRPARPAPGRAGGLALAGPAVPGRGAGRAGLAEVAPTQSLAARPAVAGGRRQPRLRPAYRPAGRFQRRRPMADRQRPGLPFQPQFLPQRSSLRQSYPGLHAVDDVRRGARRRVARLADHPRPPVADARHDARRHRRAEPDRRSLAALGAAGHRLAGTEAIAGAVPRRAVLPLLEEARRLIEPRRHTGCVAFSSPPRAGFFFRARSEAHSGAHHVKSWATAAFRGPAATSR

SEQ ID NO: 29143 - protein, 540 aa, Pseudomonas aeruginosa
SESQDRPSLAQDRQSTGGLRPAITTQNNIPVHREAEATMAKAIPQLIDGEWRGSRSRELVEVTDPATQDVLALAPKATADEIEQAIASAQRAFETWREVPAPERARLMLRYQHLLKEHHDELGELLARETGKNLADAKGDVWRGIEVVEHAANVASLMMGETVENVAREIDTASWIQPLGVCAGITPFNFPAMIPLWMFPLAIACGNTFVLKPSEQDPLTPNRLAELFLEAGAPKGVLQVIHGGREQVDALLTHPDIRAISFVGSVAVGQHVYRTGTAHLKRVQAFAGAKNHMVILPDANKAQVLGNLVGASCGAAGQRCMAISAAVFVGAAREWIPELAERMAALRPGHWQDPDAAYGPLISPQARQRVLRLIAEGKAEGAECLLDGSQCQVEGYPNGNWLGPTLFRAVTPKMGLYREEIFGPVLACLEVESLEEAIALVNANPYGNGTSLFTRSGGAARRYQHAVQVGQVGINVPIPVPLPFFSFTGWKGSFYGDLHAYGKQAVRFYTETKTVTSRWFDDEPTTDESSAGPNMTIHLK

SEQ ID NO: 29144 - protein, 282 aa, Pseudomonas aeruginosa
REAWLPGLIGGESLASYCLTEPDAGSDAARLRTRARREGDEYVLDGSKCFISGAGSTQVLIVMARTGEDGARGISCFLVPADAPDIRYGRNEDKMGWRAQPTRTITFEGVRIPAGNRIGPEGQGFVYAMKGLDGGRLNIASCSLGAAQAALEQSMRYVEEREQFGKPLATFQALQFKLADMLTELTASRQMVRLGAHRLDRGDAEATLYCAMAKRFATDRCFDVCNEALQLHGGYGYLNDYPLERWVRDTRVHQILEGTNEIMRVIVARRLLEQGGMLDRLL

SEQ ID NO: 29145 - protein, 161 aa, Pseudomonas aeruginosa
SRVPANARRTPGCRRSASASSICSTPRTPAKGSTPSSRSAIPSGATAEPSHRTRRAAPQPARAESPDMNVLFEERPSLHGFRIGIATLDAEKSLNALSLPMIETLAAKLDAWAEDAGIACVLLRGNGAKAFCAGGDVRKLVDACREQPGEVPALARRFLRR

SEQ ID NO: 29146 - protein, 292 aa, Pseudomonas aeruginosa
IPPRLPHPYLPETLHLLGPRLCDGWRHGADAGCRDSHRHPVQPPGDAGDRHRPVPRRRRQLVPRPPARQARPVPRPERGADERPRRSRPRPGRPLPSRRPAGRPARRPGADELERVAPGATSQPASRPRTRGPRRTAGGPVAPAPAAPGRTARPAGPGERLAGAGGAARRRRPAACAWREDPGRGLPDDRASGLAADRACALPVAGRGVPPGIRHEPELHAPSGLRRGGTRKADRSRQRTELALAAGGIDPAGGDRGALRADLGGRASAGGALIRRAALCRRKARARHVHSV

SEQ ID NO: 29147 - protein, 316 aa, Pseudomonas aeruginosa
AVSQHPQEASRPPQEELHETDRLHRPRPHGRADGHQPAQGRLPAERLRPGAEAPSTAWSPPAPAPPAAPATRCRAPTCSSACCRPASTSKACTSRRMACSRTSPPAPWWLECWTFARTSARRVHPAARERGLAMLDAPVSGGTAGAAAGTLTFMVGGDAEALEKARPLFEAMGRNIFHAGPDGAGQVAKVCNNQLLAVLMIGTAEAMALGVANGLEAKVLAEIMRRSSGGNWALEVYNPWPGVMENAPASRDYSGGFMAQLMAKDLGLAQEAAQASASSTPMGSLALSLYRLLLKQGYAERDFSVVQKLFDPTQGQ

SEQ ID NO: 29148 - protein, 249 aa, Pseudomonas aeruginosa
AGLTSASPSQRFIPASAGRMMLIDAALRHFSNGRCSMKIALIGATGHVGHYFLNEALQRGHAVTALVRDPSKLAARDGLGVVQADVSDPAQVASAVAGHEVVISAFNGGWGSADLRARHAAGSQAILDGVKRSGVPRLLVLGGAGSLEIAPGQRLVDSPEFPEQWKQGALGAADALDQLRGEQRLDWVFLSPAMLLEPGQRSGKFRLGGDQVLFDAKGESRISLEDLAVAMLDEAEQPRHHRQRFTVAY

SEQ ID NO: 29149 - protein, 152 aa, Pseudomonas aeruginosa
FQCIPGPHSMQSPHERSTPVPPLRRPRRARPLCPRRRSGESQPAGAVTQHPGAGGTVGLHPGGARQPRRGPHGPRPAGAGTRSAPAGRASRTAQRGEPVGQSRQRRATPGRRSLPRRTAVARGTGRFLQRPPTRARRTAHRRLADPTPAPAG

SEQ ID NO: 29150 - protein, 265 aa, Pseudomonas aeruginosa
RRRTLRRRYPRAARRSAVAHPPATRVSRRTLLPPRPSVAASGEAERRATGRLPAGRPAPARGSPRRPGAPAATRRTARHTVRRRADAQGPGRLQRADQPGALGRGCRRRRGRPPGAAALARRLRARPRQGLRLRSGQPRRPQPVAGRGSVRRAGAGTGPALRRHLRISASERRRGAPARNGSSRARGCHGRGRDSARNGSRDDAGGRCGRRPRRPTAAGRGSAGKANDAWRLLCGSGLSCGCGRIACSGTCTSDCAARGRCPRRE

SEQ ID NO: 29151 - protein, 202 aa, Pseudomonas aeruginosa
AGRGQPTVHRRRRPRPDRPAPALPRAPALRHRQGPGASLVRGRRRQDAGRRLHQPYRPRRDQRATTMARGIRQGRRTKLPASAAGTAPQLRPAPGALDHQRRSPLKRPAWRTMLASARRALHPGHPPAIHRAMNSEIDPGRCPLCQQSNRCTLAYPASATQACWCFTTEIDAAVLERIPAELRRRACLCPRCAQLLPPDADD

SEQ ID NO: 29152 - protein, 252 aa, Pseudomonas aeruginosa
TDGNTARMPTFLRAALRRLSLAGATLCALASGPVFAMPLPSAKDLQKLAPQASLPTLELALTAYACASASQGGDNGLLTVIDYSRPSRDKRLWVFDLKARKLLFEEWVTHGKNSGDDLATSFSNRPNSYQSSIGLFQTGQLYTGKHGQSLRLVGLEPGFNDKSEERAIVMHSAAYADPRVVPGLGRLGRSQGCPAVRPAVAARLINTLKRGSYVFAYYPQPKWLETSRFLAPQSCAVARAARTPEVIASLLK

SEQ ID NO: 29153 - protein, 96 aa, Pseudomonas aeruginosa
SAARNSTPSAMPATSSTSSTRPPGNRPRTPCWPSSARSARSRSTRSTAPSPTAPASPSPPSPANRHRHGEPRSPGGKTQRNQQKPRPGLHLPPRIW

SEQ ID NO: 29154 - protein, 72 aa, Pseudomonas aeruginosa
SRASSTASAPTDANDRCRNTNALGKIGNSGTTAQTREKAATNQAWRRHRKYPRRPIAEPIPYLPPGFSDERP

SEQ ID NO: 29155 - protein, 303 aa, Pseudomonas aeruginosa
QERHMIEEATSSKHSGTTDAPLVSVVAPCFNAEKYLEEALRSIYEQDYPNFEVIIVDDGSTDNSYAMLEQLQKVHGFQLYRQQNQGVSAALNFGLQHARGDYVATPDLDDIMLPHSLSVRAAYLDQHPEVGCVGALVIYIDSEGQETKRQNGNRIRQLDFDYLLGNAYVCGAPVSLYRMEALRAAGFYDPEIKVQDFQMTLRIASQGYQIHKLPVLVTRYRRHPDNLSRRYKVLLDADLRTIAPYQSHPAYERGRTELVNKALKYAVVADKRHAWQLLRSLPLRQWNRTTFRRLKRFLLHHES

SEQ ID NO: 29156 - protein, 477 aa, Pseudomonas aeruginosa
AGRLTPAAVLRGSLNDRAARPPGNPPAGTVRPPGTLAWRVLRASAGPHPALGTASQRAVSLRPATGSRTGRGGHRALAQGTAQRPAGRAAGNHQGADRHRWRTYPIGQRRHRPATRALRRAAGRSAARSRRDRPGQDYGSRLRHAFIRPLQLPRSHPQSLEPGQQYRRLQFGRGSGGRRRLRTAAPGHRHRRLGATAGGLVRPGGLQAKPRADPHRPLLHRSLRRSDDPLHGRLPAADALPRAARRPRRHQPAAGSAGLERRAAVGARPEGRPATRPRLRPAARRGNPRRDRGRGAAVRGARRSAQDRRTADGPEPARRPERLLARPPVERTAAPRRDAAGQGAALCPRLGRGRRTGQRGRCGARFQPDLRDAPARRPAVRRDRPAADADQPGRGLPRRLGLAAERSAAAVRAHRLHRAVEYGRTARALDKLRLHGRRHADRPATGRAALRRYLAVAHRQDLRRLARSDPRLAPAAG

SEQ ID NO: 29157 - protein, 175 aa, Pseudomonas aeruginosa
SIPCTWAWKRSAAPCRCCCSACRRRSPRCSPSPSASSCCCNTATSTCASAGYAMCSPGHRCIACTTSATGAPATSTSRCSSASGTACSAPPSIVPTTAWTAPTWASATSLTIPATMPASCSRHSATCHAAGTSHSRRKDWGVQPARRRCGSDRPARIPSRLRTLRDRCAASAKPA

SEQ ID NO: 29158 - protein, 252 aa, Pseudomonas aeruginosa
CACSRVSPLTPANSAWSRASQTSPCQCRSVIAYLPSTVPWRNGVGYGDRRQARKVSVRTSRADRRRRARSDRARHAPPRGSPLPAARSSRLPAASARRRPAATPPGCAPGVRRNAAAGRCRRPRGSPVAAGRGSVPRSLPTGEPPPAGSRVPGRRWRPGRGAAPAGSRPARPRWPAACARANSACRCAAGTPAQRCAPVRRSGLPSADAAAPDRRSRWRSPPALRFPASPRATRRGLRAGWRSCAGSPTARD

SEQ ID NO: 29159 - protein, 233 aa, Pseudomonas aeruginosa
GESAVRSAAACVPAAAGATNGPSVRAAVHSRSARRRCAGRRDGRSSRVHRARPAGRCRYSATAPPRAATPGRPAAAARFRRLRPGAAGPARRAMRHRRPRAAGVRRGTARARRTASCAGAASGSRAAHAWPPGCRPSVQFRQGLAEQRAVDAQGSVVHQAIQVGLGYLLLALRAQAFAQATTDLVEGGEAGVATLGQLDQVETVGALDRLGHRADLQPFQRRTDRRQQLRLRQ

SEQ ID NO: 29160 - protein, 414 aa, Pseudomonas aeruginosa
LGIPAEVQVEQIELRGQADVLRVRRVRRVGRVGHDVAQEEHRVALLHEGRTAAVGVALRISGPGPAGAGTPPFDIVEAVVGQRAGKAVLRVDLPGGAQLRAVHPLVVAVFLVETVRRGGVRAVLHGERADRAEQRDIAAQRLVEDRRHAVEVEVVGIQQVGGQERIGDPPAGQAQALAGLPGQVALVEPEVLLAEAAAEGLGGRHRVVVRTGADADAGAPAFRQRRLEAETRAQAHQAVAVLAGIEQRRQARAGIRVDVIGTVVVEFGEVGDLVAVAVAEGARLVAQAHVAVEADARGPVREGVGLRPILRLGLGHYLGLHFVADLVAHHLRDIGYADLPGDSGNGRRGRHGLARLLGLLRLGLGLPEQRIGLLPSSTRPAVPIRRYQVGSWAFLPRGPGGWALPLGAATAGKQ

SEQ ID NO: 29161 - protein, 675 aa, Pseudomonas aeruginosa
RRCRSATPLALCDMCRVPSRRNWQSMPRRSMVSITSAGARPSTALSFSPCSAPRVATTSSGGIQVPALINPTLRPDPPWPTSYASSTHTERPASSRWSAAESPVKPAPITHTSARCSPFRLAAPDRRGVTTSHRHRCCKPPMRDSAASLIAMRREPAAPRSIEGDALCQRQLAGIVDGVGLPSHVGLPGVRAGLAAAAGLFLAAERPADFRPAGADVDVGDPAVTARRALEQFRLAQVGGEDARRQSLGNLVVQAQGLVEIAVADHVQDRCEGLRAHHFGLSRHLDDGRRHVVGIRIALLQLPLAAEHPPPLLAGSRQGVLHGQVAAFVDQRPDQVALQRMTDTDPGIGCLEALDYLVLHRLMGNQPAQGGAALPGGAHRAEQDAAHRQVEVGAWRQDHRVVAAQFEDTASETRRHPRRHFAPHASAAGGADQGDATVVHQRFAGLAVADQQLAQVRRRIAAEGPRGTLEQCLAGQCGEGGLLRRLPDHGITADQRQRGIPRPHRDWEVERADHAYHAQRVPGLAHVVAGTLGCDGKTVQLAREAHREVADIDHFLDFAEAFLGDLARLPGHQFAEFGLVPTQFLAEQPHQFTTARRRHLAPGAERLFGALDLGGNGGAPLQSHRSQATAVDGGMHGKLAIAKGIGVEAETAQQSVDHVRFSWLFVSARFSRFAR

SEQ ID NO: 29162 - protein, 198 aa, Pseudomonas aeruginosa
QQTTFIRHVIPSFHTGSKLSRSAVFPVPCTPSPASPRLPDMDKKKLLRLITEKLAADLEVAVRAAQTAHETATHEENVAENKYDTLGLEAAYLAAGQSRRVEEIRQALGLYRNLVLRDFDEEQGIQLTALVTLLNADGSRRTVFLGPEAAGLKIDCEGREVLVITPRSPLGQSLIGRHPGDETGAKDSPLAVEILAVD

SEQ ID NO: 29163 - protein, 349 aa, Pseudomonas aeruginosa
SVACRRSAPCRRTPWASRDTASPGATTAGTTRGFPRAPGDGADCGCAADSWRRSTHGPSGERRCHRDCRSRSSQFPLNTGGRLARKAALPSAWSALRNNWLCNSPSRSSNRSRPSASNALVIARGNGACCSTRPASSSAIAKAPPAAQRRSARPMRSASSACTTWPNIRICRARPQPMRAGKVCNWPRSASSPTLPKPAAKRAPAPQTMLSQASATDSPAPTAQPSTAAISGLPMRTICRTSRALSCIRALPAANSVTRMSPRSPPAQNTSSPPVSSTLRIDGSHSAASRARSNSMRSAGDSALRRAGLSKRSRRTVPRVSCNKPLIRPPPAVAARRSAPCGTPASRGH

SEQ ID NO: 29164 - protein, 193 aa, Pseudomonas aeruginosa
GTPGFARRRHPSVQPDRPRRPALPRPEPVPLPRRTTTVPAHRGNAGAPGERHPGSPRRAVPRHRHRARPAPGPARRPPARHRRHQPDVRERLRRATALAAYEGVAAHRGRRCPPAGPAAQRPATQRARLPAAAAPPARPRSAARAAGRAPAPPATPRIRSCPGRCRPTLHPGAAPASPWRRPRARPGGPPRYR

SEQ ID NO: 29165 - protein, 472 aa, Pseudomonas aeruginosa
TPGSWRAAAPPLAVVEKNSWMCTPSAGSGLGRAPLGGIHGTARRLPSGSALGIAGLAVRVVEPVRNEQRRDQSGEHVGDAHHQETRADRHVGGQQADAGGRHRRADTPQVVGGAHCRAADAGGEALGHVGGQHPDRNAVDEAEGDEDPEDVGGRVVEHDQRHESGTADGPGGEGQAPTEEIGADAGGDLAEDHRAVGADHVAGHRLEVHPQLALQVGRHPVVGAVVAEQQEAGGEAPEQEHAARFRIAQHPSQRAGAASLGVALRSRAGTLAPGLGREPGRRLRHPGPQGQADQRRRHGGEEQGAPAELGDDLPRQQGRHQVAHGPAGLHGGEDGGAVPGSDALGHQDVAGDEQRAEAERGDEADQRELPVVLGQPQQRGTDGEQHDGPGHHSHPAEAVAAPAAIDTADGHAGESQAAEGAGFEVAQAEFGLQAVEAVGQEHQVDAVGEQAEEAEDEGDQHGAPGNGRRRVR

SEQ ID NO: 29166 - protein, 173 aa, Pseudomonas aeruginosa
STPPRPAVGAPPGRHRDAPAAPSRRPGAGAVGNRRVPRPHRLRQAARRRFPTCAGCPPRRASAPPGIRCPRRRQPPLRHCPAPPRRRTRYRRAPAGAWPRLRRAWRRATVARRQAGAGATAGRRLRRAAPWPGSPLPPGWGLRTVRSRPPRRVPAPPPRPSPRPRTDARDEPP

SEQ ID NO: 29167 - protein, 193 aa, Pseudomonas aeruginosa
FLHAARLRQRIPGLDLLDLGGPGAVVRLGTGLDRSEFSLGLERVTLQAVGICSRHGCGIVLSLPALLRLLFGGLYLAPVDHRGNSTGPSASISSGSGKRAAALASSASGNRRLSSSRPARRTAGPANHFDPIASAGSSPPSGSGVKSNAWPFTMSTSPSLLSDRRSSLPGSGAYGDNLMIIRTTSRWRRPCYS

SEQ ID NO: 29168 - protein, 83 aa, Pseudomonas aeruginosa
WRFLVTTDIFDLQKQETPPKRGLAAVVLELVFRVNPARLDGAADLSLAVKHWVWVALSNSGHGATESIARVIPILVLRGGSLS

SEQ ID NO: 29169 - protein, 113 aa, Pseudomonas aeruginosa
RGQHLGNATKRQASAASHHCNAYCRGGAEREIARNDQRRSQDRLKNSGTLAALDDWHDADDRLAGSGQVKLLFAKISPPYENREPHPALFCGSHEFLETIYHAGQGNGGLSRT

SEQ ID NO: 29170 - protein, 231 aa, Pseudomonas aeruginosa
NASGSMFALAVASRAWMRPGAEEASGMEDPRTTNYRYDAGPNSAMRAEIGQIVVNHSLCDEPLMRIFGFLSGLRADTQSVVVESLRLRSTSLAATVTKLLETSPLPIDIPERLNVALSTFKKMTAQRNKIVHWAWGLSPEGKDEAPIYHPTKRNSDGTPYSETLTLLELRKIALDLMQVYYLLGIIAGLLECGVPDEIKSASLSKFDKLIEKVRSSILEYPEAEAEELPLS

SEQ ID NO: 29171 - protein, 151 aa, Pseudomonas aeruginosa
VPSETGAALLTKPVSRTYSTEFDSVVPGATRSRMVSRRCGAATTPGRRSGATRAPPELSMEVMAERGMDTRCEPRRELVTPCSFRLSATIWPAVFGASSPPSRFSLASMACSAALSRACNSPCVTRSLSTSARADLLISPKLAIWVLTCSA

SEQ ID NO: 29172 - protein, 376 aa, Pseudomonas aeruginosa
IRSWLASRPVDWIGLGNGLGGVRWEGLNLLSRVGSVCVFGDIDVTPDPQRLVQCALGQSKQRSGLGLALLGRKFFERNAVHNPGLHGLSMDKVLPAVISKSMPAAMDTYRLREYSSHMSDKKREISQWEKEECAKLKAALEEFNAGKSRKESLTQGKIAEALDMSQGSVSSYLNGYNALNARFASYVASQIGIRIESFSERLAAEVGEMAKAVHAEPAKGNVISADFSRQRTKNGFIVVPQYDIAASMGKGLARPEFDVVIDSIVASVDYLSRNVRYSAPDNLALITGYGDSMQPTFSDGDILLVDTGITEIKIDAVYVMALKDELYIKRMQRRADGTFLMISDNNAYPPIEVSSAELKRFQVLARVLLAWNAKRL

SEQ ID NO: 29173 - protein, 130 aa, Pseudomonas aeruginosa
QPEDEPTGAELIRLLSSVGRYEMRNALTTGYRREGLRETPRFLRCPSQEGHRRSQHALEGKTMNEKALLALRQSLRIIRRESDVHRARIEYYETVGMLRGLHYGGAIDSWQLLALTELAGSAYINAGKPY

SEQ ID NO: 29174 - protein, 66 aa, Pseudomonas aeruginosa
GVDPMTIIHECDRCNAPGRVIETSDGFRCEGCYEEAQEQVRSEASCPECGRLGVTATGICYACENT

SEQ ID NO: 29175 - protein, 101 aa, Pseudomonas aeruginosa
EHCHGSPGHHRGKDMKINEDECRAAGLDRKEVRRIAAGISLYARQAEALGLTVFGGGAGDLRTRSCNRRAGYIVATLDGSFDGGDGAHEYDENGLLRGESC

SEQ ID NO: 29176 - protein, 208 aa, Pseudomonas aeruginosa
SASNSGTHRSSQYGAEQAGAPESVARKHLDGELPTPRSGQPKANQPQATLLRDATHCLYRQTGKRLERKVRNRALAHTHWRRDMYKHASISDLLGKTIKQITGLEAGSGSVDFECEDGSLFRMYHQQDCCESVSIDDIEGDASDLVGQPLVVAEDVISEDFPAPPGDYVESYTWTFYRLATAKGFVVIRWLGESNGYYSESVDFSRIK

SEQ ID NO: 29177 - protein, 217 aa, Pseudomonas aeruginosa
SRRNGGGGNRGALRAPCYPYPALEVRGFPRKLMSIDWNTAPEGATHWEPTGPDFYEGWMKKEGTDWFYWSESGHKWINGILTCDVSAEREATFEARPQEAWDGQGLPPVGTVCEWHESDGWAYTESKVVAYTDDGLFVCMQKQGRRPEVLRIDNCDFRPIRTPEQIAAAERWAAIQQMLAFADVKYGAGELMSPKEYVETAVAALYDAGYRRKESST

SEQ ID NO: 29178 - protein, 86 aa, Pseudomonas aeruginosa
CLTLHCGAADHCLEKVMRLTSIPRIKSINLSQKRFERRRRLYARKIHWELFGGPLGGAWLCTPGTLKFSIPGWSGYYDGENKWVEA

SEQ ID NO: 29179 - protein, 476 aa, Pseudomonas aeruginosa
PRNRGLEKAPMTESKICTCPSGDGSLRHPCPAHPAVEQAGGDERAVDGKPRATRCPDCGESDLMPGDLCTCGYETDPAAGYACSECDGSGDGYVGEVCRECDGTGWFVTPEQARAALAQPSPAQAEAEAERPEVADFNPCRYHAEKIRQRADEAASAYEAGRSALGYMEDIAESALIVRNGLDELSAQHERIVGELRAKLQAAEDRADTLEHRMMGMMTRHFAEAWRNRDTQKALDGYLSAGIAQLEQERDAALAEVERLRQFERICEGLPQDAIDGGWTVQGIRCYAKRLEDQLKSALARVAELTANRNRYGVDAHYFNKNLQRILRDFESFTPDELARSLIILAKVADEKVVAQHSVPEGFIGRLSEFLAQRGATGKALLRELRDMLAAAPARGQHSVPEEFSFEYRHPNGECHTVTVSREQVINEMPDFLFEALCSKFCNCEPVGETNVVECRCDEYAEEFKLLAAAPGKEGL

SEQ ID NO: 29180 - protein, 171 aa, Pseudomonas aeruginosa
ASRREVTMSAIISECGRYRYRLERDCCPPFEGSKVYAYFGVNPSTADASIDDATVRKWRGFTLRNGGHRFIVGNVFCYRATDVKELRRQDDPFGPLSTEHFRAIVADADILVPCWGSLSKMPRDLRGAPHQLLHWLIRSGKPVMCFGVTSCGQPKHPLMLGYDTPMTAWPS

SEQ ID NO: 29181 - protein, 227 aa, Pseudomonas aeruginosa
SSKRRANNPTTNPTVSAPRRTNRGQRKRNPGRAACHRADRLRHLPDSRGLPEPIRADRVERTGVEQMEQAVNRREVTFLSAVDASRIETPSNVISIGSKGDWYAFACDHKRVLRLEFDDVDGYVGSDGFRVFSHIDAKQIHDFVNECGDESIIVHCQAGMSRSAAVAKFLADKRGYTLNLSKPCLGTTQFYNRHVYGTLNLNDAESMSAYYAEMELADRLCGHPKES

SEQ ID NO: 29182 - protein, 149 aa, Pseudomonas aeruginosa
SSRDLHSWRYRTHSCSCDCSSRKTKTQKVVGIIMIDNAELRRLAEEVIRIEQNEDEPISAAWELFDSAANPNTILALLDEIDRLKAENEALRGALHAVQAEVDGNLRPLTRDLVNMVSGLKNGCHPNDIYEHCDEIERIIEVALEGAKP

SEQ ID NO: 29183 - protein, 452 aa, Pseudomonas aeruginosa
SACSCVTRIASSCAGLSPRRARRLMISRSGKPQSISIRVSELLTKAELPRLPLPRTANRIAHALLEFFQYVLRDIGRRRGVDVLVDGDLHGVADGGQADLVALRLGVFLFLGLLAAAEQATEEPGLVFVGLLRPFGDVHVVHAKAAVEVVDADIGVIQGTPDTDPGAVEVGLQGQHRVAAAVLAQLEGAGRVVDRVGCQQGDRAALLGAARHARDHLVEQRRVEARRHRLARPARAAGVTGGAGLAEHVDLAGIALHAGLDTHPNPCLAVRLDTAHAAAKAACQRRGKLRQRLPVGTELAGLRALVGDAETVLLEELPGHRPDFRRRTLGHDPAAITAALQAVVADVAGVGQRLRTRNLVLTLFFVGGGDVQRNRQQRIERLAVHPFGQLHGRRFAGAEVVVTAVAEIALRPPQPAAAGSVADNQGEGGQSSQSLHCVELLDQANTPVWRMA

SEQ ID NO: 29184 - protein, 90 aa, Pseudomonas aeruginosa
YGVTSRQASAPPLFAASVSATASRVELAPVPAITGMRPLTWSTTRRITWMCSSTSSVADSPVVPTATMALVPSCKWKSTSLARLSQSSRP

SEQ ID NO: 29185 - protein, 435 aa, Pseudomonas aeruginosa
SGLPTVRRDQAEEALRQGIHGRRPQHLPDRQGRRTAPGVARREGARACRRGSRRRPSAQRHLSPAPKKRPHPRPFAFFMRPMLSRGCRSLGKVLGPGIQHRFHQGRQGDREEHAPEAPEPAEQQHRADDRHRVQVHRLGEQQRHQHVAIQRLDDRVGHHQVDELVAPAPLEEGDHRHRYAHHHRADVRHHHRQADQQGQQRCVVEPQVGEGDVSHRAGNDDLDDLAANVIGDLLVHLGPDLFHQPALARQVAVEPGLEALLVLEEEEHQDRHQHQVDHDVHHHRQAGQRRGQRPLADLAEFAARGLDGLEHLLLADQAGIALGQHQQHALPFAEHPRQFVEQGEQLLPEQRQQDHQEQRQQAEEQAVDQPHGEQVRHPEAFQHADHALDQEGDHHRRQYRREHPAEGEDDAEAEHQHDRQHHCLLVGEVALHPVA

SEQ ID NO: 29186 - protein, 207 aa, Pseudomonas aeruginosa
QPQAIAGEGTQRRGLQPGPGRAGHHRQPPSGCRSAVEEDARPVPQQLPAETGARRPDAEDGQAAGIGEDPRRPEQGAAAGPGCLEPPGRGAQPDQQRHRRAPGPCRVPVSDRRLPGRHRAARFRQAPRWRQLPTGCATRRSPAGNSPTGKDGQGNVPLSGISEEKHPAKLIETGGWANNRTALTRPTQRDALARIRRSRPGAGARPG

SEQ ID NO: 29187 - protein, 212 aa, Pseudomonas aeruginosa
PGDDQAGQRGNRYRHHHRRGTEDIPLQPVRARLHQGVRRRPSAAPLVQCLPAQHREPGQLPADQPRQPLRAAFEPAAAGQRQGALRGKLRRHAASGGSRRRMGHRAALFRRGTPAQRYPGSPQRTLRTGRHRHQGVLLLQHRAGIRAQLPALSRKRPPAPARTRPPAFRRCAGLATEHRRNGAAPLRPEGARVPPARRTRVERSPADAGRGW

SEQ ID NO: 29188 - protein, 123 aa, Pseudomonas aeruginosa
PPASGSARRAGQRCRRTAGDADRNAGTCSCRAAASSPRPPRHRRPAPAPGGRGRRRAPASARGPRRAIPACSRRLPADRAPATAPAVRNRRPAIPPGSSATAYRCASPGPPRRAGRTARPGCR

SEQ ID NO: 29189 - protein, 116 aa, Pseudomonas aeruginosa
PPLRRHRRRAGSTGCGRGPNSPCAWTAPRRRPPGHAVPARRGSAREPSASRTATRCTVPGYPAPGCAAGPAAAGSGRPGTGRGGPATGCSPATGRCPPAAARQPRWPGVPPAPSAR

SEQ ID NO: 29190 - protein, 162 aa, Pseudomonas aeruginosa
ASPASSRVTPSTTMPNGSKLISSSSSRRSRCAARSCDASSNGPRQRPSGRPWPNHSSRTQFSCGKSPARRVNPARTASGNPGWAGRLRCPLTSPTWRISVFSGMLSGSHSCAGSPPSAPRRNAALPVGRQSSARAPSARAKPDSLSTSNPWLDSPRTTRTLR

SEQ ID NO: 29191 - protein, 204 aa, Pseudomonas aeruginosa
RSAPPRLPFAGFPVEIPLRSTLGEPAEEDTYMPHSYRKMESPVGTLTLVARDDAFLVAILWQHERPNRVPLDEMRLSEDSSLLAETERQLREYFSGKRSRFELPLDFQGTEFQKKVWSALLTIPFGETRSYTEIAVQIGSPNAVRAVGAANGRNPLSIVAPCHRVIGASGGLTGFAGGLAAKQWLLRLETRGRTPDLLSMIEDE

SEQ ID NO: 29192 - protein, 270 aa, Pseudomonas aeruginosa
NSGISHYWRTQAYEEDAGNTWLKTSSTDHRAARVLSMANPLDGLHDADHAKAEKTEGRMPSVSDPRALARLLELILSTAQAGLAFSKDRFDIGRFRALQHAVAEFIASDQGVAYERVENWIALDSHYPTPKLDVRALILDSQQRVLLVREASDSRWTLPGGWCDVNESPADAVVRETQEESGLEVRAIRLLALLDKHKHPHPPQLPHALKAFFFCHVTGGSLQQQTDETSAAEYFPVDALPPLSEHRVLASQIQTLWQRIHAETPEALFD

SEQ ID NO: 29193 - protein, 199 aa, Pseudomonas aeruginosa
PSAVGNKTFKDELMGKPFLHARRWLLPLTFICTATTAVAESTGDYWIVYGKGERYNNEVFVANATGILQQPKGIQSAQIIQLFEDQSMPTLTAYEVQFKCKERRVRFDNARAMRRIDNVITNVKTVDGWIDPGKYDYWLQRSFAFVCAPAIRDNNQMLPLGKMPIARMVQTVQAMFVELQGVQAKKQTMRDLDAMLGNE

SEQ ID NO: 29194 - protein, 90 aa, Pseudomonas aeruginosa
PRNRAISSSARVTRKPLIPCSTRMPTDSLVKSSTTVRHLIRRPVLSASKTKSIDQTWFGALGKLRRSRSTAMPWRRRRRFTIKPAARYRR

SEQ ID NO: 29195 - protein, 79 aa, Pseudomonas aeruginosa
CRSTRPDGPDHRRNHPVEHEPERQGRHAVCDEPLGFFKMSRSSSRRRIWARSRRISLLASNSSLACFSDLSGVTAFTHL

SEQ ID NO: 29196 - protein, 229 aa, Pseudomonas aeruginosa
VETPKRAAISATEYPRSMTCLTASALNSGVNRWMLMDFLLCSKRRPGMSIVPGVVHSLYGDAKARWTINEYADLECPFCKVYTPRLKRWVDSHTDVNLVWRHLPLQMHGEAARHQARLVECAGIQGGAKAFWSAIDAIFAQSAGNGGGLPGGTLDFPDLDQARLEKCAKDMHLVDQLIKTDIDTARSNGITATPTLVIQDNQTGRSVKLEGMADETTLLSAIDWLAKDL

SEQ ID NO: 29197 - protein, 85 aa, Pseudomonas aeruginosa
YQLATPIQGLCPLGHEGVTPNAASSSSGYGRADGFLLPHRKQSCLLSIPSSSRYQPAPLHRFPKWATTPLAIGLLLVLLTSACLT

SEQ ID NO: 29198 - protein, 401 aa, Pseudomonas aeruginosa
HGAIGRNSGRIVQSGVRQHPQIAALEVLGGDLEVGVALLAVDHYQGLLVGRKFRVGVVVADEGYPVHGTAVHVHLVDLRLAATVRGEVQGRAVLAPEGFGIDRQVVGQAAQGAAAKVHDVDFRVAVARQHEGQAVAVRGECRSAIQALEIGDLLTTASIDVLDEDTRALLFEGDIGDTAAIGREARRHDGLARLQQGHRAGAVVVGALQGVAGVVDRETLGGDIEHLGGERALDTGELLERLVGDVVRHVAELIGAAGHAAGQDLLLGADIEQCVLHLQASAGRHDVADHHVVDANCLPVTEDHFAGLRRLADHVLPGQRLEVAGVAQVVADDIGHVFRQHVAPLEAERHHGDGNGTVVTAGDHQRVGSLRSTCHQGQGEQRNANQGTHRLKSSGLKMMRR

SEQ ID NO: 29199 - protein, 281 aa, Pseudomonas aeruginosa
RYRLSKVARGNCCISGIRPTLRTAATAELSKGLSPLERLTLALVMVPSGSISISTSTLIPLRADGGRRHCWLTRLTIRSSRLPVTSLPTSSARACWRSVVSESNSANACAFLSSAALRAAAAAAAAFFLAASTAAFFFAASAAAFFLASSAAFFFASSAAFFLASSAAFFLASSSARFLAMSACFFCSAALASAAFLASSAFFASAAFWASAFRASSAFFCSAAFAAATCCCSSFCCSSFCCSSFFCSSCSTSYCLEAVFFASPAIFWLVCVVAWLFDLSW

SEQ ID NO: 29200 - protein, 140 aa, Pseudomonas aeruginosa
TMPFRAWRIISSLDKSSPGTAATARLASCGLKPRAISALTASASALETVALARGSITNGAIVGMFSQALKRSFNSTSRRSAVFLPTPGIFTRVEVSCAWTQRTSSSTSRPDISARASFGPTPLSRISSRNSSRSRFSAKP

SEQ ID NO: 29201 - protein, 142 aa, Pseudomonas aeruginosa
PAITHSVLLSRQEAPQAAPPRVDSNHSAFGCSRRRMCSSRRALPSTEPGAWVMTSPALWVFGKAITSRIDDAPVISMTRRSRPKARPPCGGAPYLSASSRKPNFSSCSASSMPSTRNTACCMDLSWIRMEPPPSSVPLSTMS

SEQ ID NO: 29202 - protein, 160 aa, Pseudomonas aeruginosa
KENAMEINIGIGEQDRAAIAEGLSRLLADTYTLYLKTHNFHWNVTGPMFNTLHLMFEGQYTELAVAVDDIAERIRALGFPAPGTYAAYARLSSIKEEEGVPEAEEMIRQLVQGQEAVVRTARSIFPLLDKVSDEPTADLLTQRMQVHEKTAWMLRSLLAS

SEQ ID NO: 29203 - protein, 245 aa, Pseudomonas aeruginosa
HVENRPSGHGRRRPIAVLHSQPKNRSHTLPATSRCHLPGHSGPDQPALRSRTAIVTSNPPAAGRRSRPAGPGRRPAGTDPAGAAADHRRPAGDRPAPAKPGAGHGSATGGQPETRQAGLAQRQRPGSPRRQPGQRQPGDRYREVVQHLKRFRLHFPRFGRGHLRPLPSDSRRRPPHPHRRPARGVLGGTTGQGPAGGRRDRLPPLTAAKNRKPAERRVFCAFNNGEEALRLPPPRPPAPGRLPDA

SEQ ID NO: 29204 - protein, 159 aa, Pseudomonas aeruginosa
SRAQRNQGCQPAAGRQPAGIRFGGRDPCRHRRRPRLAGPGQPADRLHRRPLRRPDERFRRWRQHRGQALLRRELGARPAAARGRRPAQCRRRRPQPGRQGHPGDQARHRGRSYLPAWHQVQRSDEAERPERTGQAGQPDHGLLRHRRIPRGRRRHRAEP

SEQ ID NO: 29205 - protein, 343 aa, Pseudomonas aeruginosa
QRVAEPADRRTDVVHHRKTQPLSVTMPTGRPLRLFAAALCGGLLLSGCANQLPQRSEHEERVERKLLEHTLQVDVGQPDVLELPQRRVRINDQKSFEVTEFEVTRRYDRYTPYQAWREIYEIPLGAVALVAGVGANIVNVVTFGSVPDNITHGWINYGLAGVNPFMNVESNGRAEQNLASIDEKQRDKRLEYSSLPWAERPVLVSSGKELNELLTDRHGVLRLNLLDSPFAEQDISRISQIHLSVSDPQDGTRADASLRVSRSLRGKLLEAHALIYDDLEGDDVHHWVHRVKRLAELGLEEEASELEQSLIELTRNDPELQQQFMHALLRDAGRLAADPGETP

SEQ ID NO: 29206 - protein, 129 aa, Pseudomonas aeruginosa
NSRHFTGHATPDMSELILLHNPRCSKSRAALELLEARGLQPQVVRYLETPPSVAELKAILAKLGIPARQLLRTGEDEYKALGLDEPSLGEEAIIEAMARHPKLIERPVLVAGDKAVVGRPPERVLEILA

SEQ ID NO: 29207 - protein, 159 aa, Pseudomonas aeruginosa
PCVARWANAWRKPPASWGVEMARKNKPLPEVVWLQPRLALSRAISLGSFVGLVLLILIRDLIYADAHGAASWVPWLVLAFKLLPLLVVAPGLLMGSARGHAWACYVVNLYFILGVLAAFDPTQRLFGWAEVLLSVTLFCAALLYTRWRFQYDRRVAGER

SEQ ID NO: 29208 - protein, 135 aa, Pseudomonas aeruginosa
RDCDSRGCRSHSAPWPLHPSPGRLLRPMDSYRPIACDLHDYLEIACLYRYRLLLELEDGVRFEAEARTTHTRAVRPGGGKEEYLEVAVEGATLLLRLDRLLAITALTEAALFGRIRLREEACSRASGMPSSHLGN

SEQ ID NO: 29209 - protein, 77 aa, Pseudomonas aeruginosa
AGFALMQINPGAEKMSVTVTERDDDHKSRELRALGRRCWDVHQQGLLVGVFHNEDDAHAYRIKLEKEEELRQIGKSA

SEQ ID NO: 29210 - protein, 563 aa, Pseudomonas aeruginosa
GGAGRRVGTWVSRVFSERSGHSALSGNEKATGSLRAPVACFHLASRRTVAPRLDDVGQLRDARQQASKSVQTGNLDGQLHGRGVVFLVRTGIHRQNVDPLIEQHLGHVAQQAGTIIGTDRDIHRIGANRLRPPADLDHPLRFASRQLQRGGAILAVDGDPTAQRDVADDGISRQRLAAAGHLRQEIADTLDLHVAALAVADLARLARDQFELLAVAVRLDQLLGIVDQVRQAQVAGAESGEHILGGTHVGLLRQPVEIHRRQRQARQLAFDQGLAGSDVLVPRLQLEPVDDLRPRPGGGDVAQVAVQPVAARTAVLAGDDLDLLAGLQAVVQRHDASVDLRPAAVVPDFSVDPIGEIQRGRALGQVDGMAVGSEDVDPVRLDIDPQLLRQATDVAQFLVPFEHLAQPGDLFLVMVGAGLDVGPLVAPVRADSELRLFVHGVGTDLYFQHLPLGADHCGMQRAIAVFLGVGDVVVELLGNVPPEGMHDAQRGVAVAHLRNEHAHGANVVDLAEVQALALHLAPDRIDVFRPSAEIGLYAGGRESFLQLAHHVGDVLLAIQPALV

SEQ ID NO: 29211 - protein, 237 aa, Pseudomonas aeruginosa
QLGDLLVLVGLEVTEGQVLQLPLDMPDAQAVGQRRVDIEDFPGDAVALFLVGVLHRANGAGALGQLDQGDANVVDHRHQHLAQVLHLRLGTQHHGMARIEAGADRGHAQHALDQLGHHRPEMLVDRFQGDLAFPHASIDDRGDQGLLIQLEVREDLGDFQSGLEAGRAFRPGVLCGDRSLLGFASELASLQQALTIEPGDEVLDVVQPGLEVDTAVGVDRLVRSHLYHLAYPLPRCA

SEQ ID NO: 29212 - protein, 476 aa, Pseudomonas aeruginosa
PTDDCASLRTGWSDYAGILTCLEQSHGLDMCGLRKHIEDSGALQTIALPGHFASIARQGRRIAGYIDYPPGTQRTHFAYRLERAVARRIEQHSGKTLLRPGRFGKRFGQVGLEKVRVAKAIGQRVGACPLDHRRHALHPDYPRHPARQRQGEIAQPAEQVEDPLVGGRRQPVKGLADHRLVHRRIDLDEVSGSVCQSQLPVTQGVAQFGGRLHRQGLFRTLQPELGLVCGAESGQALAILVDQGSRMPQQQCTGRAMEELHVADAFRLAEVLQKSRQGTGNRLQRRHQDQALIEGDDLLAGRGTEADIQTPRHGIPAHGDPSAAPIAEFGPDQRGGPFFRLDPGETLQLLLQGTLLQGQLLAVFQVLQGAAAAATRYSAGLAATQVATAEQALAARVDHLASCAQHPGLKFLARQPAADEPGHPRLVGDTSAVMGQALDGQALLLAYRYRGTARTTAGLEAQPALISGHGHAQRGS

SEQ ID NO: 29213 - protein, 87 aa, Pseudomonas aeruginosa
SSRRSPGVSMVPGRSSILSSTYSARISALLFGLREPAAGVPGKLSLPTKPCLSEDGSLRVSLFHSAPTVSTCSNNACNGRLSSPLRR

SEQ ID NO: 29214 - protein, 167 aa, Pseudomonas aeruginosa
RTELRELTGLPSTRIRVFSGPMPRMSICRLLPRWPLELLPVRLTPGMVRMISERSFTGGRFLMSSAVMMDTPGACLSSCSAVPSTTSSPSWTTDSARSSSSSRRSSSARACPSSRLDEAKRTAAARWPRRNWGYMRDYSCRGKTGSRRATRDTLTFFLKPGSPALRG

SEQ ID NO: 29215 - protein, 1113 aa, Pseudomonas aeruginosa
RRARTRLGRTGTVAPRDSAARISQPVHQPLADRRRPRRHRPPRPAHESRDQRAAGTDQPGRRPAQGRPHGNPPATDGQQRAGRTGLRHQPHGGNAAERPGGNAAQHRPGHRGRTAEPGNHRDPEHRAGPGAQGGPGGEQDQVRVPRQHEPRDPHPAQRHPRFHKPAAEKRAQPAPAGIPHDHPEIGGKPAGDHQRDPRFLEDRGRQAGSGKPPFQSPRPDPGRPDHAGSGRPREATGTGQPGLPGYPDPIAGRPAAAEADPHQPGRQRHQVHPGRHRRRARHARGRKRRPRAAADQRTGHRYRPLRGGPASLVQGLQPGRQLTVATSRWHRPGPGDLQAPDRADGRRDRRRQYARGRRRVLDQPESAEKSRRQRGAGRLLGRGPTRGAARTAGTDAPLAAPPAHRLRPGSERIRRPRQPPGKPAQPAARPVADQPGGARRLGRDPSAGRAEPVVLGIRTARLQDPGALPDHRAGAIPRDPARRTGRGQARLHPQAATQAAGVASSPPDAQRQAPRHGFRTAATAALRRRQPGQPAAGADPAQRPRRPGHRGGQRLRGPRGGAARALRPGLHGRADARHGRPPGHRGDPPLGGRAGSQPGAGDRAHRTCAFQREARIAAGRHGRLPDQADRRAAIGPGSAEVDRTEPGPVAGQHEPCAAARPVERARPRGRAAPGRRQGRPRRRHAGDAAGLAGGGPPGDSPGPRQRRPHRFAREGPPAAWRHPLLWRAAVARGLPDQRNPAQAERSGGGRGPGRAGQGHRGPGRHCLGHHPPVLHQPRLQRTLTMRILFFSTQAYDSESFQASNHRHGFELHFQQAHLQADTAVLAQGFEVVCAFVNDDLSRPVLERLAAGGTRLVALRSAGYNHVDLAAAEALGLPVVHVPAYSPHAVAEHAVGLILTLNRRLHRAYNRTREGDFSLHGLTGFDLHGKRVGVIGTGQIGETFARIMAGFGCELLAYDPYPNPRIQALGGRYLSLDALLAESDIVSLHCPLTADTRHLIDAQRLATMKPGAMLINTGRGALVNAAALIEALKSGQLGYLGLDVYEEEADIFFEDRSDQPLQDDVLARLLSFPNVVVTAHQAFLTREALAAIADTTLDNIDAWQDGTPRNRVRA

SEQ ID NO: 29216 - protein, 234 aa, Pseudomonas aeruginosa
STLPASGWRSPAARHSANWRSIPGRSTATSARLVSTSSSPWTPVSVARPWRRPPKNAFTNWAGAAAKTSTCARNASKANAPSDRRSVNYRPYEMRKGNAMKPSLALFASAALVLGGCASQETTLETEQAYQVDWVGAQPTMDYSHISLTFDGQGRAFGNGGCNHWFASYTLQDDLLQFGAIGSTRRLCAAEIMEQERRFLALLQSVQHWDISPSDELRLWPAEGKPLRLVPEHD

SEQ ID NO: 29217 - protein, 297 aa, Pseudomonas aeruginosa
SPSRAPQSVAGRRAGHRRQRGGTDTALRRPHPLRPVRIPPQRFQHRPAGLARRPLQPRQRRRHPAQRKPGGPGPALPAGAAVQRLPGQPRAPSRAPSARLALPVGGLPLPGPGRTPGLCVQLPARLPADPAGQRTLSALPAIDRPQPGAKPGHPADAHPARAAPAAERPALSAPAAGDQRPGAPIEHRLDRRRVAPRGHARSALHAQAVGLLQPGDPPGQPLQQRQPDPDGRLRHVLRAARRLLGRRAEGRPAAGAHGGTQAAELPVPDQCRATFQLSALRPQRVRQPAPPGPARAG

SEQ ID NO: 29218 - protein, 115 aa, Pseudomonas aeruginosa
MLGNGYGKDRQMLNVEQLKRSVNRMELDDIRQAVDELQMDGLVTDGKTPFTRVHFNTCFAEIEALFQRAGFHRPLDVVGYQGEIYALYDPSRWEAVEVLRWLKEYREESRHLTPA

SEQ ID NO: 29219 - protein, 673 aa, Pseudomonas aeruginosa
MPAWIIVTLPPSEMVGQCKPPLCPRQAEPSLNEYQQMAFGHFADATPAKPGGLLPVTGRRPAQKKSAATTWELAREAILCRANSHEVADAHRRSRSRTSRSTQLSRVPTTHPADRSDYRLPPAHRPGLHLAAVRPGAGGLLPPATGDRSRRPPRCHRRRAQAGAARRPERDHPRLRHPARLRVVGQPLRWRHAAHAQPGHRRLQRLRHRQCGRPVAAFRRLRTLPTVFPAWHRRCRNSPDDAICQPFPGLRTAGAGGTRRTLRPRRCGVGAAPAPRPGRRHRDRRPVAGCRPGGVPGPAPSAGRTAVPRQPAGPPRPPQPAPARPAPIAAATADHRPRRRRRRYRPLSVAAGNPTLRGVPAGLPARPGRRRAQPRTGRSRGVRGGAAGRVRRPTGRRAAGRGPALVPLDLCGTATAAGLPFVAVPRSAPVVGDAPGDPRRLGFRRTDPGDPGLPLRCRAAVFRRHTGDRHPPGTPRFPHSTSPDRCLAPGRQPDRRALPPARAGFAPTAVGRLGPDPGAVAGGRPAFAAERLRLGGSQPAEPDRRAARHVPPLLLPSQPADGSTLLAALRRRQHLRGRRLGLAAAVRQPGRALQQPALVAVRPGRRRPARPARRPRQLPAAPGPGPWLAAARGTAGDPRAERGRAAARGADHPPLGPAGWRPGPDRRQGPALP

SEQ ID NO: 29220 - protein, 190 aa, Pseudomonas aeruginosa
TGPGSAGRAEGDIGRLAGRQAGARERLLPGPLHPGVPELLPHRHRPPPGQAGGLRQPAGNRQPRTGEPRPDARAPGRAEADHGVPHARPHPPLQGPGPRALQPRHGAAGRAPAKARRAVDPAPGRAGLPAGRTVLQFPGAATLQGQVPARLGTPLPGRASRARPAGGPGRYRRADRRRPDWIGETLICLS

SEQ ID NO: 29221 - protein, 201 aa, Pseudomonas aeruginosa
SSTSLRKTAIAGRSSPGSKRSLPASAASRTWSPASARARPPPGAGSPARTTTRPRRSRSASTLPWPSATATPRCRTRRRTASGCWPGTTTRTTTPQSSSASSRARKPASATTTPRCPTCSPISCACNCKATPRPCRYSRSPRRNPRTSSPCSIPATAAGATWTRTLPSIWPAWATRWSASTPCATTGNTRARNRAPPTSPS

SEQ ID NO: 29222 - protein, 217 aa, Pseudomonas aeruginosa
TEPAGGIQAGFSGAAENTGRPAAERAPESRREGTVMSWKNTESRYGSLTIALHWLTLLLIAGVYACIELKGNFPKGSETRELLKQWHFMLGLSVFLLVWLRLLVRLATPTPRIEPAIPAWQATLARLMHYALYLMMIGLPFAGWLILSAAGKPIPFFGLELPPLVDKNPDLAGQIKEWHETIGNAGYFLIGLHAAAALFHHFVSRDNTLVRMLPQRR

SEQ ID NO: 29223 - protein, 680 aa, Pseudomonas aeruginosa
ETRKKTRPIGRAFLQRSGSDLDLGSQLDHPVERQVEIAQVAVGVLQQEGEQPLAPARHADALGWNHRLPAEEVGGAHRAEVQFVEMAQAQGSRDVWLFHEAEVQDHPEEPVAIGLDLETAIRRNPWAVFVDHGEQHHLLVQHLVVQQVVQQRVRHRVGTRGKEHRGPLDPVRRLHAHAGNEHRERQRALVETLHQQLAATLPGGHQDEDDDTRDDREGAALDHLGQVGGEEQAVHREHHAEERDAQPQRPFPQAPDHHAHQQGGDQHGSGHRHAVGSRQRRRGLEAEHQQDHADHQRPIHPADVDLPLLVAGSVLDGHPRHVAELDRLAGQGEGAGDHRLGGDHRGQGGQRHHRQQRPARRQQVEGVARRLGVGKDGRALAEVVQHQRRQHQQEPGTGDRLATEVAHVGVQRLGAGQRQYGGAEDGDTDAGMRAEETHGPYRVHRLQHFRLLDHPVDAQRRQGAEPEHHDRAEQDADPRGAVLLDQEQADQHDKRQRYRPVLQAVEGDLQPFYRRQYRDRRGDHAVAVEQRRADQAGNHHEGLQPAERRRRPARQGRQRHHPALALVVGTQDEDHVLDGNDPDQRPEDQRQHAKDAIVVGLHPVAADEDLFQGIQGTGANIPIADSNRPDHQADGRAGMPLRSLLGTRRCITHETLSPGKIRQMLRPCRPRCKRRGHGLL

SEQ ID NO: 29224 - protein, 480 aa, Pseudomonas aeruginosa
VFPGPEKSCTGDWKSRGAAARIAHFLIRGASKRARLPRLAMSTPTPKVGFVSLGCPKALVDSERILTQLRMEGYEVVPTYEDADVVVVNTCGFIDSAKAESLEVIGEAIAENGKVIVTGCMGVEEHAIRDVHPSVLAVTGPQQYEQVVTAVHEVVPPKTEHNPLVDLVPPQGVKLTPRHYAYLKISEGCNHSCSFCIIPSMRGKLVSRPVGDVLSEAERLVKAGVKELLVISQDTSAYGVDLKYKTDFWNGQPVKTRMKELCEALSSMGVWVRLHYVYPYPNVDDVIPLMAAGKLLPYLDIPFQHASPKVLKAMKRPAFEDKTLARIKQWREICPELTIRSTFIVGFPGETEEDFQYLLDWLTEAQLDRVGCFQYSPVEGAPANELGLEPVPDEVKQDRWERFMAHQQAISAARLQLKVGKEIEVLIDEVDEQGAVGRSWADAPEIDGNVFVDSDELKPGDKVRVRITDADEYDLWAELV

SEQ ID NO: 29225 - protein, 204 aa, Pseudomonas aeruginosa
APLKSPAPRGFFIANRSGEHDAQQRRTTQPALPAGSSRRTSGRTGRPVRRASRSGPARGLPEEGRRRRLPGLPRPLPGALPGRTDHPAPRSRRVASATAAGAAVEQQHDPEEAAGRLRTQGGRPPCHPRQRRLPGLQTRAERPVSQARPQQLPDLRRPVAAQLPQGPDPARPWLNARSHCWRFCSRRRPAPTPGSWSAARIAPA

SEQ ID NO: 29226 - protein, 484 aa, Pseudomonas aeruginosa
SDRHEKSRPWAASRVALRLHQEDRRQAEEDEETAAVGHRSDHHAGAHRRIASETMQGHRDQHSHHRRQQQVQGHRGGHHHAQFPVAVKIEGHHADHSAPRQAVDQRDAKLLAQQAVATVAGRLYLVERDGADDHGDGLVAGIATDAGNDRHQRGQRHQFLDGAFEQADHPRGDEGGDQVGGQPGPAVAHRLPDRGEDIFFFTQTGHVEDFAFAFLTDQVDHLVDGQTTDQLAALVHHRRGNQVVTLECLGGVVAVLVRVEGHRVGGHDFQHLLVRIVDQQALDRQHALEHAVVVDHEQFVGMPGQFLQAAQVAQHHFQADVLADGDHLEVHQRADLVLLVGQRRTHSLALLRVEAFHQFMDHVARQFRCQVGEFVGVQVLGRGDDLVVVHVRDQGFPDRVGDFEEDVAVVLGLDQLPDRQAVVQRQRFEDVGDVGGVQFLQLALEFYEILPVDEVFHPVMVLAFLTMGQVFHHLVAMQQLDHLR

SEQ ID NO: 29227 - protein, 275 aa, Pseudomonas aeruginosa
RTGTDAADTTAGQAGAKYVRSMQAQDPRQVAARLQQQDQQHQQYPEHPRREVLGTIQPGHYSQRLAAGAQRQQVGAQGNAGAETRAGAAIGDQAHADRRADQHGQGGQRINHRTCLPGGATARASSWAVRRHASTRACRCRRSRRGSRRRRRPCRWSGSIRGRALRFRRNSRRPRTPAGSRGGSGRCSHGRTRQRRWRRRSLPARRCHRYPAGTWPGRRQPLRWRRRPQSLARTWMTPGNAKARRKGGPGTAEARIGGLRPEEFQSWRIYTFIVP

SEQ ID NO: 29228 - protein, 746 aa, Pseudomonas aeruginosa
ATKGREGIQYLSYGLGGNVQVGDQAQTRRRADPHLALGEEVAQRDRPLADIDIDHVGLHRLHRIAQFAQPVAQARGVGVVVGQACHLVVEGVQAGSRQQAGLAHPAADHLAPATGLADQFYAAAKHRAHRRTEALGQAHRHRVEVSGDLAGVYAQLHRRVVQARAIQVQGQATRASEGARRGQVVERQHLALHGVFQGQQAGPGEVEIVGLDRRRDLVQVERSVGLAVDRLRLDRAQHRGTAALVFVGMRLLADDVFVAALAVGHQSEQVAHGPGRYEERRGEAQARRQFGLQAVDRGVLAIDVVAQFGRGHGFAHAGGGLGDGVAAQVDDRHGGLLGSAEKPDPTALYRQPQGKSGNLPGRNGNGAPKRSVMIEREGRYASELGRHHQDSGTQAVLHPWIGEDDARADLVHHPARAADILGQQVARREFGEVGHVVVEVQAEVVAVLDHLARHAEQLEAVEPGAVRLFLAAVDQQLQAPLQALQVDLLVLSERTCLAQFQGKGLRAELAVGVGAEGDARLVLQQHRLDAGVAQAGQFAAGMLAALGPGVEGELLDLRAADRGMQVVVQVDSLGLAEEHLGQALQLGGTEGLVAAALLVATVEQAVHVLFDVALAAADGFGVAEQEEDPGGRLEGASGDLADQPFEQFDGRGLVAVDTGREQQVDAVIAGADRRDFQRALGQPVQAGAVGGELDLLGRLAAGQGQVEQFAEGEHGMSSVSGCGRSRSRGRARGRRPLRSAPSPVAG

SEQ ID NO: 29229 - protein, 138 aa, Pseudomonas aeruginosa
WAKCRSSLNIAASTRLVVGCSMDRWNLQFRLAAVKCTRPSAVSALGLTVAALAVHMLEAELQAARRGIASFAARRITSSSLPEKPRLRSAAVSGRACGASTPCLKPISISAFIFARPCFAASFGLDTAWLLLCEATLP

SEQ ID NO: 29230 - protein, 845 aa, Pseudomonas aeruginosa
LAPSDRYQAHAGAFADAQGLGGFNTQGHRLAGRPVQVQHDRAEVLQLAVGDQVWTPALRRLADLHRNHPALGDRANPRGTRVQGRAAIEDVDVVVGLEAFAHQDIEGDLRSRVDLAHGLLGGIRQQWHIDRIVRHQFGEEGAALQPGELFRLDVVQVEEVAPDRVPERRFALLVAVADDLHHHRVGEALRMAGHEQQATARVEFGVDALHQVALYVETGQQAVAGKVVAQREDMDLVVDRQRARGVHEGFVAEAVERFREPGRGDDRRAADQLAAGAVLEDEEIAFLAVVAHLRGERGLGSEDLVAQAFGVIRQGRDAYRAVRRQTLHLWQVGRLGGAHHQHGVTPFSDNDDCRIHARDRGTFLCHGFERPAGKIPRHARRHGSRLRRGPLRDVASGAPACAGAPWVRSAADQLGHGALEALQAFVDLGVVDHQARREAHHVRAGLEHHDRLFLGGVEHIPGLALPLVGQRRTDQQAHAADLVEDAVLLADLLQAGLEALMLGLHAIQHFRGIDHVQRRLGHRRRQRVAAVGGAVGADRQVLGDLAGGQHRTDREAAAQALGAGEDVRDHAVVHVGEQLADPAHAALDLVEDQQRVVLVAQLARPFQVGLLRRQHAALALDRFQHHGAGLVGDRRLQRFQVVVGNVGDTLELGPEAIGILRLAADVDGEQGAPVEAVAGGDDLVLLRAVDIVGVAASQLEGRLVGFGAGVGEEHPLGEGGVHQLARQAQGRLVGEDVGNVPDALGLLGERLDQRRMRVAQGGHGDAAGEIDQFAAALVPDARSLASHRNEGGGGVVGDHIPVEIGTFYLRMGSGHRCFSCLKAAIDERIVGIGTGPALPPCDNLL

SEQ ID NO: 29231 - protein, 426 aa, Pseudomonas aeruginosa
TRDALGCILLLRRPAGGNSRETSHAHRGNRLPSRLRLRRQSARRPRPGVLARRTAAVRGLSRRRRPAFRGQPVRQRRSAGTAGDDHSDGPSRTRRLPEAIHLPGRRKARLKPPRRWRSAAFDGSEGRLEGAAAAPLVAVLARSDAEEVAVGAGEMRPGRETAGQADLDDRLAGLHQHLPRAVQAQLQVVLAGYAVQVLLEDPFQLAPRNTHMLGDLIGGQWLLDIGFHQQYRLGQLRMAGAEAILQRDALALVAFANALHHQLLRDRAGQFSAMVAGQQRQQQVEYRHAAAGGHAVAIPLEQVIGGDDLGEALGEVIVPTPVHRGAIAVEQAELGQRVDAGGQRADRRSRTRQLLERQAQRWRHRRRRLVGDQEQPRALLQPTVPGRSRQAPALLFGRRFGEQEQRLVEHLGVQPPGRPQGFLGKR

SEQ ID NO: 29232 - protein, 140 aa, Pseudomonas aeruginosa
RQRAGGGPEEETDALGLGSHGSSLAGLCDECYLRLPERNCLRRSDCGLARTSFGQPCSSTRPLCRNTNWFDTSRAKPISWVTTTMVRPSCARSCMTFSTSPTSSGSSAEVGSSNSITSGSTASARAIATRCCSPPLMCAG

SEQ ID NO: 29233 - protein, 352 aa, Pseudomonas aeruginosa
STRCMPSSSEVAGGRASSAARRAWRTSATLAAGSLPRRSPTLSITASSRSGKSRLKLRPAAHFEAPLVQRLDHLPETDRIAHRHQLDGAAQAAFRLQQAQPAASAPRRCACPAARRRAGWTGCRPCARRSRRRNTLRRFSLPRVLHGSRWSIRSMRSSGSGFARRQVGQPAALGKLEQAHQDEGQAQVEQAGGDERLERQVVLRVDGPRGAGDVHQGDDGRQAGGLQHHDHFVAVLRQGAPQGRRQEDTAVHLQARHAHRLGRLDLAMGRGLQAAGEDLGGVGAGVDGERQAGAEGRVRQPGPQRALAHRVELRQAVVDQEQLDQHRRAADHVGIEPGREVHQRLLGDPHQR

SEQ ID NO: 29234 - protein, 173 aa, Pseudomonas aeruginosa
IANSFSFNGLAATTRLDCYPVSHLGCAWRFLSPQLCAGAHHRSVTAAPFPARAHSKRPPPRPAPNERPRAARTARGRFGSGGSQAACIERWVSIRCWTTPGSARVEMSPRVSYSAAAILRRMRRMILPERVFGSPGAHWITSGVAIGPISRRTHCFSSWRSASLGSTPELRVT

SEQ ID NO: 29235 - protein, 509 aa, Pseudomonas aeruginosa
RAHTPRTIRPWSYHCATAPIVAISRADRSLAPAAERVPRPAAATSAHAQQARQPQRDQRHVGHQDQEQQQDHQPRQRRADGRPKRHAGDRRSDEQVEADRRVYQADLHVHHHDDAQVDRVDAQLHGDGEEDRRQDQHDRRGLHEAAGDQQHHVDHQQEADRGQAFLHHPFGDLLGDLLGGQHVGEEHGIGDDEHQHDAQPPRLQQHLGTVAQAHVLVHEQRDEGRIHRRHRRRLGGGEQPGIHAAEDDHQQQQAPACTACGGQPLAEAGARLRRQLLDPRDDVDHHHQDHPEQQPRNHPGDEQLAHRGLGGGGVHHHHDRWRDEDAQGPGIADDPRAEGARIAGADHAGHSDRADRRHCRRRRTGQRGEQHAGKHRSDRQAAADMPDAGIGEVDQAPRHATGGHERAGEQEERDRQQGVGLGGLEQLDRQRAHRIRAEQQDRQGAGQPQGDGDGHADEHEQEQQQEQDQHGHGRFSPASSPASLEASAASSARPSPSWRPRNRLTRISR

SEQ ID NO: 29236 - protein, 146 aa, Pseudomonas aeruginosa
RSRRVRRIRHCSSPRSRLSNAFSHPPRPAPAGVARAPAPARRPSRRRPRRRRHRRRRPLPPDAPTPVPRDSASMSGGSARPGSDGCTATRRSPCRERSALPRPVRHGSGSPDRRRPAAAPGLPGAFAGAVRNGRDRESVRLRCCRC

SEQ ID NO: 29237 - protein, 568 aa, Pseudomonas aeruginosa
SDQRRYGRRLAQAPGALDEDFRLGVGGRAGERQQAAELIGQFVAAEGIAGIALGFVDGGGMAPPLAIEHFDPPEPALRIGGIDLRVQAHLDPLAERCDPRVAQRMPMELAEAGLAVHGDQAQHGAHGELRLVHGLRLDHPAEHVDGALVDPRGDRGDLRVIEPFALHQRQQRVGRGMGMAARGVELERGFQQRPAAAEAIHQALGVGVAGHPGGHPLLAFEDVSRAAQAVGGEIGGEQPVGGGLGGMQLLGIGGVAEELPEPGGLGSGAAEQVDEALAVEVHQLAHRHCRGEGADRGSGMEHPVVGTAEEFADADAGLVAGHRREDQLGAAAAEVLGRGQGSREDHRRGVQHRAVVQVVLLHHVGSRAVHQGGEIRRAAPPAGQDLRATVGRAHAFGVALEQWDRMLALAGQRRAEPVEEQFFHPRQHRRRQVLVAQAGEKAGELLGVVGHDQRSLVVVPRHTAYSGLLSSIRFRSGSRRYSERIGPPAPVRCTGPSRISTACWRSCSATASSGVATMKQRSADPGVGRSALGSNSPPAWCRLIFCAPKARALRPAPKVTARMPSTRV

SEQ ID NO: 29238 - protein, 319 aa, Pseudomonas aeruginosa
RFENLQLRNGAFGFAERHGVPMHFDLADLRLFIHIAESPSLTQGARRAFLSPAAASARVKALEGQLGSRLLYRDSRGVELTPAGQRLLQHARLIMRQVEYLKSEFTEYGSDAAGHIRIFANTTAVTEFLPEILAGFLAARPGVTVDLQERLSRDIVRGVLDGSTDLGIIAGPVAATGLQILHFSTDRLVMAVPQGHPLAGQARVRLRDTLQFQHIGLPEGTTLHAFLYERVEQMGEQLSLRIQVSSFEAICRMIEGGVGIGVIPQSAARRHSRTMKLATIELDEPWAIRERSLLVRDLEALPSCLRALIEELQRVGDSL

SEQ ID NO: 29239 - protein, 742 aa, Pseudomonas aeruginosa
RRRRLGLRVQGPAHRQPRPVAGLSPGAAAAEHGAGDGLHRHADAERAGPGQELLPHRRNPDRPQRDGHSDRPVRPGARAVPRLPGALGRPVHRRRRALPRFPRLRLRTRRLHRDHDRDSSHRAPGRRFHGGAVAGPGNIPGHPLHRYRQRHLPAADQRRRPAQHTLRALPRLRRVRRRRPAGQPRRRALRRAQRALRRPVRGPGKPAQRHYFRRSAHAPAQRPADSPEQRIHGHDQSLPRPPPPTRTPARARGAECPGGPGALPGGACRAARADSRTDAHRRRRRAPGRTHRGLQAGTDAEHPPGPPAPGGAAPRRERPAGFQHRRRTGLPFHRRPAQLRPDPRFPGRTPPCPRAMEGKLRRPRQPGRRAGRRSAQRADDRPARHVLDPDLLAPRRHLRPHRGTDLGALLDLAESRPVVAATHPRDPRRGLHRAVRAALPATPRGRFPDAALLPAAGLRGRRPAALAAAVERLRRRPTGVVLLRLAAGQHGALRRPGLLQRIPGTTLVDGPRHGRRHGDPAAEPAVDVEAPGARPARAGGVRHQRQEQGPGLRFRKRHPRPAEPGLHLLRRPPGRATPVAGLDVPGAGGRPGDHRAAPRTATPAPGALLRRTHRLAPGDPPDGPGADPAVPATRAEQPPARPARGEPGDHGGTGGAGAARTAVRYLAAATGAQLPALHSQRPARPAIAPGPGKKPVSRSQSRGAEGHRDIVTDPYKVLVLTESICRSLSQLTINPTAEVNSR

SEQ ID NO: 29240 - protein, 646 aa, Pseudomonas aeruginosa
PTKIRTARNIPSNIRSGATAALAAKLCSTSGSTSEGSRHEGQLAHPARSLCTRRRQSRPSANILAVLPTPHRAAALSQGPTPPPFLSQPATNRQACRSALALPHAMLAQLVRRRGMRNAEALAQLAAARMFAEQALQHRLLEAPDDGVEVSFQGKIPQRLRRAVVRQADVLGLDRSPFAQRNRLEQHVFQLPHVARPVVAFETFQCLRGKLRQAAADLPAGLVEEMLGERRQAIQALAQRRDVQREHIETVIEVLAEFALGAEFGQVYLGGADHPHVQVHLLVAADPAETAVLQEAQQLGLQARAHLADAVEEQRAAGGKLQQAELALRAGALEGSRTIAEQLGLGHGFRQAGAVQRHERRLPARAGQVAGARQQLLAGAGLALDQQRRVQRRHAPRLADHRGHYPRTLEDTVEATQLLLAHMVDALADAIRAMQGQHRSSQRLALVVLGLQRRDVGEEHVALHLHPQPVDPRLVGAHQFGQVEVLHIARQRNPRHLVDAHAEQLRGGTVGGDDLPAHVHREHREVQGGEQRVEFQVPALAGHQADALDAEDPRHRLQLGPQRLQLEVDHVRTEQVDGVALVAADFAAIDVDAVVDQQVEDVAEDAYTVLAVHFDTHGVARCCRSDGLAAGFLTPGRKFPSRICDS

SEQ ID NO: 29241 - protein, 433 aa, Pseudomonas aeruginosa
GNDNNKDPAATSRSWSPYENNAVRGPPARRQRFHPLSGNRAPGLEYPDHPATEGDRRPRLSGIPRRHRTARPAPRPDPPARRDQQGSPGHHRLARGAGSGADSVPDLLRTAGQPAIPRRHLHPHPGRTGLPAGAGHLPRDLRPLPTADQPLVRRVHPYLRQARPQGEQGGTRVPRPPVLDDHRVRPGRDRPGQAHLRRRHPLLAEGDRLQPLRRAAAPGLQSAGGDAHALPHRHPATALFRPARPQAPVPTGPGRHHGAGPRGHAPGPARAAVPAQAGGLTRNAAAAADPAAALYYGGRARPVRRSHMRQPRTPTMTALTQAHCEACRADAPHVSDEELPVLLRQIPDWNIEVRDGIMQLEKVYLFKNFKHALAFTNAVGEISEAEGHHPGLLTEWGKVTVTWWSHSIKGLHRNDFIMAARTDEVAKTAEGRK

SEQ ID NO: 29242 - protein, 313 aa, Pseudomonas aeruginosa
ATHVRNRLLSLVTLFLSLSVATAVSASPPPKAGLPLQQELASGSALVTDQNTGKVLYSRNPDLVVPIASITKLMTAMVVLDSKLPLDEVLPIAISETSEMRGVFSRVRVGSQISRRDMLLLALMSSENRAAASLAQNYPGGKNAFVKAMNAKAHALGMKNTRYVEPTGLSLHNVSTARDLTRLLVASRQYPLLSQWSTTPEKTVAFRNPNYTLGFRNTNHLINNKTWNIQLTKTGFTNEAGHCLVMRTTINRSPVNLVVLDAFGKYTHFADATRLRRWLETGQVTAIPAAAKAYRLQRDRERGLGQPVAQAVR

SEQ ID NO: 29243 - protein, 308 aa, Pseudomonas aeruginosa
TRRIRIRRYRWDCAVRSWPRRSSGLLVVLVEWTAAGPGGRRHGRCLHLTPWRRGGQAVGRTRRRAWRRVSGNYSLRAGGMHGERPVFVKLSLQRGAKSCQQRCHGCDESRRCMIGVKRLTCVFPPRRHSHGTTRPTRPERQSPAPARGRPQISCRAPRRCPRARLGPGALCGVRDDVAGDARRGPAGPAATGGLVASGPAPCGAGRLRVADAQHLPEPGTLPRPGGPHPGAGGRPAAARADRQPGGAGTAERPRLLSGAGRSRRARTRPRAPFQPPRTAAGRLRQAPARAVPGGDGQSLPGHRPGAPG

SEQ ID NO: 29244 - protein, 80 aa, Pseudomonas aeruginosa
RLADTCFFGQLDWHHRSPSLSAAMNYLISLGIGLLVGALYAVLDFRSPAPPAIALVGLLGMQLGEQLFPLGRDLLQQWLH

SEQ ID NO: 29245 - protein, 207 aa, Pseudomonas aeruginosa
PRAVPDPAGRRRRAQAGKPELRPGRQLRGALQHRLGRPATQPGQGRHPAPGNRRQRRGRQGRAGAGQGPGGRSDRRDAARGATPGAGNAGHRRAAAGRAGRTGGTGGRDLPRRGRGDLRYDRFLARGGGPGAGRLRSPGDHRRTGRRPCAPTRIEPVPPRWLGGGDQLAALWRGSLRRLPRRLRQAVRPGPPAAAGRAAGSPAGAGR

SEQ ID NO: 29246 - protein, 522 aa, Pseudomonas aeruginosa
KFGKRLVAVGEQRQLAVAFGQQGREPGDAEILDPGEIGGGGVTRLAAVEGRGELDARKPHRFRQAGEHRRLGDIATLGVERPLDRPYQRPGAFLVEAARRHQGPAGRLGVIDEAFGQRVVEAERLAGGLLHGLPVAEDVAAGIRVERRAVAGAQATGYQVESDAVGDRLPGQRLGDRGEAPAPGAHGVHHVQQAGLGQGSVLQRGLARIATERVRLVALPRQFDLFLPLASAGAGLLAQRVPAVRTADAGHVVLGLAVLQRNRVAAGVALIVLALAKIVAHGHAVVEYEAVAAPQALFLRHLFEVLEDAALEVEDLLETGAEHVAGSLLAADAAGAEHRHLLVPRRVVVGLDVLGELAERPGLRIDRALEGADRHLVVVAGIDQQDFRIADQGIPVLRLDILADLLVRIHARHAEGDDFLLQLDLGAVEGLFVAVGFLVLDIGQPGIAAQPGEQRIDAFAATGDGAVDAFLGQQQGAFHTVVEQGLQQGFTQRHVIVESHELVQRRHDDGCHGDIASRWSPA

SEQ ID NO: 29247 - protein, 229 aa, Pseudomonas aeruginosa
TWWCRWANTPSMPAAASSACRSAAACSSAAGATTARRARALPRWTSAAASGRCIPTGPAPPSPPPAASPATSAPAGPKPATCARTPCGSAASSAACSTTCTSASLATRWPNGAWTAPAVASSCSSVPNSCTRRGPASACSMPIPASGSAVSTAPCATTTATACRWTAPSAGSVRPARAGEAGGGQSISDPQRGEKCPRGSDGSGTQGGSEGLNCRIRTLENTHEPDRNR

SEQ ID NO: 29248 - protein, 475 aa, Pseudomonas aeruginosa
PGHHRGARRRLLGRPDPAFAGELRHRRPAHAARRDPRPGADQESRRAGQRPPRRTAAGSRPADRTGRRRSPRRPPRRTLPAGGLADRQRHPDQHERQRGDRWPRQRTGRQSAWRQVAGASQRPRQPRAEFQRQLPHRHAHRRRQGRARTIAAGHRRAFRRSRRTVGAARQPGQDRAHPPDGRHADHLRPGTLGLRRPARLRRARHPRGAAGGLPVGPGRHRGGHRAQRAEGLRRRHRRGNRRRIGPALRRRAEQVRRPGRPRAAGHPLRRPEEPGGGPDEDRQRPAPARFRPTRRLRRGEAAGQRAGQLDHARQGQPDPVRGAVDAGLPGHGQRQHDFLRRQPGPSATQRVQAGDRLQPAGVHPPARRRLPQLQQALRRRPGAGRPAHGRPAGARPDAGHRTEPAHRLRQGRRNRQEGLRRRHHPARRGAAAGLPGRSAVRRMGTAGADAGGRPPWLKPPRPAPPRWKATASASC

SEQ ID NO: 29249 - protein, 248 aa, Pseudomonas aeruginosa
SWASWPSTRSSTKATNRARCSNPTCWKRSGRSTGPSTWCSSTRSGGAACRRCCRASSTAPCSRASPSATAAPRTRTGSNCWAGAAPTCWSATTSRCRGCASSRARRRTGRWCAACSAPVASPPAAWKSSRRCAVPARNSARAGCVAPNSSAARSSSLPARLRPGADTDRSDRSATFPPASLPRPHGGPLPASTGSQCGCRPLCIPRHPSGMGSESDRPVTFGRDLKPAPRARISPLRNESGSGKKDLS

SEQ ID NO: 29250 - protein, 154 aa, Pseudomonas aeruginosa
RTLRADRYGFGHLRPDRRARRAGPEDPHRRRGVRPCAGLRPVVRGRHGDQPPGRHPPGRRHGVQYAGPERAGNDPGRRRSSGAGQRQGDRRGHAPVLHQHPQRRRGRRGGGAGRRLAGARAPEGAEGRPDPQRSERRPRGIRRATGRRRLSRRR

SEQ ID NO: 29251 - protein, 470 aa, Pseudomonas aeruginosa
SVWILGRLEQLLYSQSAVLKSCSAGTPLGPDVRRRRMRNRTTHCPRPSERTKKSPAEAGPSLHAALRAVFSSERIEIALHIQRGHAAGAGRGDRLAVDVVGHVAGGEHTRYVGRGGVAFAPAVDHQVAVLQGQLPFEQRGIGSMADGDEHAIHGDLLAATIAGLQAHAGDAHRVAKHLIDLGVELEHYLAFGDPRLQLVLENLLGAEGFATMHQGHPAGDVGQVQGLFDSGIAAADHRHFAVAVEETVAGGAGRHALAHERLLRRQPQVARAGTGGDDQCVAGVGAIVAAQGERLAGQVHGMNVVEDDLGLEALGVLLHPLHQCRAGQAVGIARPVVDLGGGGQLAAGLHAGDQQRLEVGARGVDSRAVTGGTGTEDDHSGVAEGIGHLVGLLPTSASARIKAGPPKHMGKAWKERSPREKVGRANFAPGIGITVPRRSRPGTRPRPRRSPSCFSGPCASRPGRPRRVPR

SEQ ID NO: 29252 - protein, 484 aa, Pseudomonas aeruginosa
NKHAPGVRCRHCQAGVSALTAGVGHTTNALGSVGAGRSRDLRQPLQTGSTLPNRLAAGASPRRRPFFTRLPCRPCRMAGAHPLPVRYAPLDSTTLALQWQPGEAGSGPLSMTTVPSPPSGGKQEEGRHVTFRIHRALAVLRPAGALHACQGRRPALPLRPGQGGHHRRSRRSRHDGLLLPRTEDRRHPHAPVGACLRDRGSGQRTSPGLRQHRPGDDLPGRAPEGPGPAQGEVPRCLRREQRDARRHPHPLRSGRLLPLRDVQPVGARLPGKDLQRHRRRHRPLHRAGPGQVAARPPVLRQRRAAQRQPQPFAAVAPEESGHRRLRGWHRPADERAQLRRRQRRAGRRDQLVPGAQHLDDQRQSPDLPGQQGLRLLSLGARRQPQERFRRRLRPDQCRQPVAQPEPEARLRSLRQRVRQHPRDRSAPIRQGLRDRRPGPGGSARRTGFALPFRRLHPPADPPGVHRRPAAPVVHRGHRHQPGRR

SEQ ID NO: 29253 - protein, 181 aa, Pseudomonas aeruginosa
HRRRSRPAGAGGRQQSVPLGPWRVAHRRAAAGTGAMPGGKDHPRRHRQQETLPLDADGAADPDVPHRPVGTARRPRRVHRDGRGADPPRGAGGQRSGRYPPCGLQWLRECLCQLRHHPRGIRRPGIRRRLDPLWPLDPGRLPAVVRRHGGGAARTPAGGNLGDSAGPVLLPDELPDRSSGR

SEQ ID NO: 29254 - protein, 238 aa, Pseudomonas aeruginosa
RHEQTSKHRPDQRNLPTGSQRRRQYPGSPACRSPAAWPSGPGGAPAPARRRRPAQRRRAGADPRLAVARLPRPAMGHVEPAQAAALLEAPAPGRALHRHRRPARLLCPARRAAPGHPGGQRLPHQLPAVQRALRLRSADPAGHRLPALVPQPHADDPGAQRQPAHGIGSGAVSNVSTCSPAGSTANSSIPPGAIPNYAGAGAWANRTSPCCTSAGWRQRRTSACSAAPSARSAPPIRS

SEQ ID NO: 29255 - protein, 229 aa, Pseudomonas aeruginosa
SCAWYWWATGRSAGTSNGTCPKRCSAASSAAKPWPPTTPRATCSSSQACRRPSATWSSKPRPPASRWSPSTRPPPASTSAMGTTACSPRRATRAASSKSPVGCWTTRNACAGSVSTPANTPAGKVGTVSSSTSRTTWKTPAPVRWSSPLGRSPSGRRQRMAGPCHAAASSSQAKAFGVAMKPRLMAPAPRLMPPVGLSMPRCKWMSRSRQAFSSAAKPGRSRSAVGSPA

SEQ ID NO: 29256 - protein, 434 aa, Pseudomonas aeruginosa
SQPAARRVFGKNHGHEKSHPEGWDLLAGAAPGRCVADAPSDQAGQGLAAERLDVADTPLADLHRPLRIHQQRAAHRDQVELALVQALHQAVDARRLRHLVGFAEELQELAAVQADVTHGNGRLAGQLAGPAGQVEFRAFELGNPEAAGRAVEDIDAGLHQRREELAQALRGFHQARGIVLLLPLGEAEDDREIRADRRAHRPHQLDGEARAIGQAAAVLVVPLVAAFPEELVDQVAVGAVDLHPVHADRLGVAGGLGEGGDDVLDVGLTHAVDQHLTVLGLLHRAVAGHAGVRLHAQAPNAADVPELRNDAPALGMHRVDHLLPAGQGVLAIEARHVRIAVGGLVADRCAFADDQADAGGGAPAVVLDDLGVGYAAGGKVAGHRCHHHTGGQFQGAEAERLEQGFYGGTHGRTPEREWEVRAGIRRGAAAPGAT

SEQ ID NO: 29257 - protein, 277 aa, Pseudomonas aeruginosa
SRPTKSGRSPSTRWPCSTELDRRPRPTRRRGQTHGLRSPDAYLLHRPDRFRRRPHLDQPRPASRPGTRRAEGWLLQTHRPTASRRPRPGALQRTGGAHPRPGYAEAAAAGPGRAHARRRPTGRTARRDHQPLPARRRRQGRGDRRRHGTDPSRQLRRAGQLPPGKESRRRGDPGLRAGKRDAHRTDRPYRDPGPAVRRPARSEGARGDPQQGPRRGRRGQRRGRRGGLRPAPHRTLAAAARRLPPDRLHSLAGRTQRRAHPRHRRPAQRSGDQRRRL

SEQ ID NO: 29258 - protein, 210 aa, Pseudomonas aeruginosa
AAPGAEDRAMRPRRAQHRATAQARRAGGDPRRPRRHHPRRQPGRDERRTLGRPAAVQRLPARPADHGTLPRRPAGRPAGAVGGHRLLRHRDQPEPDEQGNPGGRPRARRAGHRVRRRAHRFRMAQAALRHAARAAPVAAGVPLPGGATRAEGRQAHRPARGQRAAHRTGGGDLPGARHRPLRAAGQAGRGPGGGPGPGHRATGRPGDHRP

SEQ ID NO: 29259 - protein, 322 aa, Pseudomonas aeruginosa
TAGPRPAPRARPWPGAYVQGLLDAVVSPPFPARLPGRPAAGVQHPVLGLPAVRHDPGQAAPAVRRRSAPVQQDHEPDRRRLDRLQQGLDEPGPAHPLERPGPGGPGVPTLLPGHQQPPELGRHPRPAIPVEPTHPAAALLPQAGTDLGPDHRPVLVGPRFPLHEALQQGLPGQAPGEERPGPGDHAQGLRQVQPHPGSGVQLPRRHPFHPRQARRAAVAVPPPAQAQGRRYRLRPRRHGRAIEDPGQRDHPLPGRQPDLLVPAFRTPEGRRGALRGTGDSAPVRRQELRPGRRLPRGIPAMGQPAVGAQGPVARQPAPRVSR

SEQ ID NO: 29260 - protein, 270 aa, Pseudomonas aeruginosa
SIPWSFTITGSRYGQHHPRRSGDPPASSGLRPARSDAAPLAQRRRFQDPHVQRHVGAVPRWRALLHRLRAPLPRTGRGPGAEATDPWLHRPGRPPQPRAPGLQRPPARPRLRHRPPGRRRQTAHPLRPAETAPVAATGGHRGPGAPHRDHGRRPAEQPQVAGRRRPDHGPPVALARTGGNRAQGGGLRRVHAGQRQGQAAPPGDGPGHLLLRPRHHQGPGPHAQARRPAVELQGLARRHQVAVGQGRRVPLAGGRVPGLLQEGLPPLAAQ

SEQ ID NO: 29261 - protein, 302 aa, Pseudomonas aeruginosa
ADPRAPQGKSVPTLSRRLLWPLAILLLVLGRPLAAADLYYLGQRIPDIQKPWDSHDYQVLIDALKKIEETQKNALPRRSGEFTGPLYLRMVSEENFRPQLNIYSPLEIRQNEAREVLFKLKELMRLYFDFRAAKQPYGAEALGLMSYSLREQSILFTLTVEFWMTLSQAEQRNPARLQGMQETKAAAAMLTGSALDYLGLTAQFERQDLVLYSAELAKEMPELFIHLPSPVRAQLLERIAAFAKDHPYPEVRDNMRDLQPVLQAIQADVEKQLAPGRNAKAPDKPLDLSPPPEGKPSGVKGL

SEQ ID NO: 29262 - protein, 109 aa, Pseudomonas aeruginosa
HFFGLKSSHRGLQGILNLCRLIHRDPHMPTHAPKKYLISHASLQHCFDKSRSGLEKLRESDPSFPRPIKFGPSKQAGVYFVVAEVEAWLESKISERDGITRALSERDEQ

SEQ ID NO: 29263 - protein, 569 aa, Pseudomonas aeruginosa
AAGYPESAEPRIRDRASQSGVVWRHHLRLGARPLALPGRGAGSAYSAGDRLGVLGQAGCRTGDQGPGHGLRTARQATAGAVPFRPGQPGWIQPVVATPLIVEVFMGRPAGWMQELTGRGAMRSPGAPSLRREIERLFWEQIATGITSERAAEAISVSSAVGTRWFRHRGGMPLFMSNHISGRYLSFAEREEIGLLRAQSVGVREIARRLGRSPSTISRELTRNAATRSGRLEYRASVAQWKAELVAKRPKPARLVTNPQLRHYVQERLEGKVHNANGREIAGPLQAPFKGRNKPHRGDRKWVNGWSAEQVANRLQIDFPDDKSMRISHEAIYQALYIQGRGALKHELVSCLRTGRALRVPRARAQAKAWAHVSEDVMISSRPAEVEDRALPGHWEGDLIIGLNRSAIGTLVERSSRFTMLVHLPREEGYGLTPRTKNGPALAGYGAVTMTNALKRAVTGLPVQLWRSLTWDRGKELSDHVRFTIESGVKVFFADPHSPWQRGTNENTNGLLRQYFPKGTDLSRWSYQDIQAVAHTLNTRPRKTLGWKTPAEVLNDYLTSIQQPSVARAD

SEQ ID NO: 29264 - protein, 145 aa, Pseudomonas aeruginosa
NYKSKISSDWMLEKTPLATFQFPPYLPHGSVGKLMSLQSEMLVEQKVSNAQKSTGTAYLLWFFLGGFGAHRFYLGKTGTAVTQLIITLIGCFTLFPLIITGIWWIVDAFLIPGIIQGHTEQTRRDARLEVAALQVAGASVSHPQD

SEQ ID NO: 29265 - protein, 150 aa, Pseudomonas aeruginosa
RFCPDKVPLGQGAKRFTKCQTEGERIQSPTRNRLEWPLRFLVMRGCRARLQRIATHTGNPMPYRVLLLILALTPALASSATLDERLGDLEHAFKPDLDGTTSAKPASPPPERFKLAPLGSVVRKKECATSSLPDEQSSCAALEFCTDCAQ

SEQ ID NO: 29266 - protein, 1041 aa, Pseudomonas aeruginosa
GRAFPAIDPPEHRGRAGPPRGQDHADIPRSGHRRRRRLPAGGAPRRHRLRQRPVAAPARRAALDRQGRQRTRPGTGPPGRPALRGALPAGAGGGAGRPATGRAAAQGDRLRRQRGGFRPAAGGDRCRQRIFRRGARRARRPRPRRRRRGRAAARRRGGGGTDRGGAAMSALFPAAPDAFGADELLRLRRETPAWGSYAHFAHGSASLPPQVLYDALDSWLEAERRWGVQRAAEHFAEPLLAVRDSVARVLGTQPRHIALLDCASRAWSVAFAAALAAHPRIRAISSFDEYGSNSLCLLAARQQRGLELRLIDARGDAAQLLQRLDEQLHDLAPGQTPLLSLSAVPTGHGAATALEGVAERIRAHDGLLFLDASHAVGQLPLAVEATGCDVLVFPPRKWLRGPKGLGVLYLGERALERLALPDGLDVGGAQWSDAFALQARDDARRFRMPGVQPGLPPGAQGQLRLPVADRCPAHRPTQPPVARTHRPAALPPARLDAAGTRAARQRVDDLRGPRTERRAMAEAPPRARRERLLHRPAVCPLGAARAGAAGGTAPDSALPDRRRRDRAPRRGPGGLPATARRQLSDLARMATLRRRAGGWRNAGRFAQGLCAGGNERCRMRRARPPPCGLNPSRRTTHNDPASDIFHLPETPTTFDALGSLSVRRGPLRPQWNDEWRKDDHDRIPENPDSRMRLHRRQVHPAQPRRHRRPPARQHLHRRHHPHRPWRTAGRSAPTLRDGLPLLPLSRAQPADPGTDHRQRHLPGGQPRPAEPLPRPDVELRRQPQRQRGAGEHPPLRRVGAGQPLRHPAAPGRCALRDDPGGHRIAGDLRAGEAKAQARPRLCLQPGLPRRPARLPAVDGAGKGRVADPLHQQGRRLRGDLADDPVPGLPQRHPGAPEARPVPRGGVGAACAQLRHDPFRRGAPAPAPGRFRPVERDPAVRLLATPAVPGDLPAVPRGDRERQEPGVRHRRTRRAQAQGQHHGRRGGDAAACRAALPAARRRPSRRHPALRGAPAGRLCRAGGQPGRRAAGRHGGHALRGGR

SEQ ID NO: 29267 - protein, 483 aa, Pseudomonas aeruginosa
RPGDAQRQLPVAAPGSRRTARQRRRGRARRRTDLPAHGHGTHPRRIPVAAAPASARRSQLHPRTGVRPVTAALAANPTQRYRWVILLIATFAQACACFFVQGIGAIAVFIQNDLQLSSLQIGLLVSAAQLVPIVGLLVAGELLDRYSERLVVGLGTLIVALALCASLWATDYLTILLFLVVVGAGYSTAQPGGSKSVSRWFAKTQLGFAMGIRQAGLPLGGALSAALLPYLAGIYGWRSAFLAGGLVAFLGALAFMLFYRTPPDAPAPGANPAERDLGAVVKSRLAMITDPAMKNIVCSGVALISVQYGILVFTVLYLHETLEIGIGMAATLLFVAQGSGVAGRILLAAWSDRCRAGRYFPVMVCLGAVILGLLALVLLPLQSPLGMGLVLAWLGFFGFGWYSPWVAYVADTAPVGKTGFALGLAMAINQLAIVLAPPALGLLKDFSHSFVPGWLALCLMAAVALVVTAWSGRGLPTALPQKH

SEQ ID NO: 29268 - protein, 243 aa, Pseudomonas aeruginosa
SDDGHGRGGTMRAILFDVFVTLVDWRSSLIEQFQALERELGGTLPCVELTDRWRQQYKPAMDRVRNGQAPWQHLDQLHRQSLEALAGEFGLALDEALLQRITGFWHRLRPWPDTLAGMHALKADYWLAALSNGNTALMLDVARHAGLPWDMLLCADLFGHYKPDPQVYLGACRLLDLPPQEVMLCAAHNYDLKAARALGLKTAFIARPLEYGPGQSQDLAAEQDWDLIASDLLDLHRQLAASA

SEQ ID NO: 29269 - protein, 474 aa, Pseudomonas aeruginosa
PTSSFLPPEPLAQPARHGAPGKARAAPARVRQELRHVREGYPGPPGRRARSRPAGRSPRRRPLVAPPAGLRRPRLPGRGGLHGPGQLGHRRRRRRATGLPAALGNPALQPDGDAAAGAVRAPGHRQRPGPGPGLPRTLLAGAPAACCGWPAKTAIIACDLAEVIGTAIALNLLFGLPLAWGALLCVGDALLVLVLIGRGQRPLEAFVVALLTLIFACFAVQLLLSRPELGEVLQGFLPSPRVLSDPAALYLAIGIVGATVMPHNLYLHSSLVQSRAYPRSLAGKRQALRWAVADSSLALTLALLVNAAILIVAASVFHRNGHTEVVDIEQAHALLSPLLGLELASLLFAVALLASGLNSTVTTTLAGQIVMEGFLRLRLAPWARRLLTRGVAVLPVLLVTLLYGEDGTARLLIFSQVILSMQLPLAVIPLLQFVSDRRLMGPLAIGAGTRWLAWAVALAIVGLNLQLLADFAFG

SEQ ID NO: 29270 - protein, 184 aa, Pseudomonas aeruginosa
QHPAQPNFKLAGRRAGAPQSLSHRSPPAASGCAAGRNDEARRWGRASRATTGNVIMGKNYRERPAACNTVRPLAALLCTSSQSSPIAIQTLARAATTLSTPGPIAPPSPGIPGHCPPPHSGFFSPAPSVVPAAPRPAPASAPGCSRGGTPAAPGERPAASAGRMGTGRGAATCRGWPGSRRGSG

SEQ ID NO: 29271 - protein, 187 aa, Pseudomonas aeruginosa
AAETPGRAPAGHRRSVPGRPPLHSGGCERTSPPSGSRSPPAPVARPGRPGRCWRRGARRSRRAPGAVAACRPAPPDSRPSPACRAPGTRAAGRIRCRVPPGCTSPGWWHRRCRPARTCRPGRSWTRPSAGSCPGRATARRLRWFPPADTGPASAAGRGRWFRNRAGAGCARRPPADPCGWRCAGRPC

SEQ ID NO: 29272 - protein, 262 aa, Pseudomonas aeruginosa
PHAIQAIAFANIVDTSTRTASTMTQNPPPLEIAHDDGETLSEHVFRKIQSAIVSGEIAPGSKISEPELARTYGISRGPLREAIHRLEGLRLLVRVPHVGARVVSLSHAELIELYEIRESLEGMACRLAAERMSQAEIDELRRVLDTHERDEAFQAGRGYYQQEGDYDFHYRIIQGSGNATLTRMLCGELYQLVRMYRIQYSTTPNRPRQAFAEHHRILDAIADRDGELAELLMRRHISASRRNIERQLEPQPAKLASASSTV

SEQ ID NO: 29273 - protein, 390 aa, Pseudomonas aeruginosa
NRVAASRKSSRKERAMAEAKVLSGAGLRGQVAGQTALSTVGQEGAGLTYRGYDVRDLAAAAIFEEVAYLLLYGELPNKQQLDAYLKKLQGQRDLPQALKEVLERIPKDAHPMDVMRTGASVLGTLEPELSFDQQRDVADRLLAAFPAIMTYWYRFTHEGQRIDCNSDEPTIGGHFLALLHGKKPSELHVKVMNVSLILYAEHEFNASTFTARVCASTLSDLYSCVTGAIGSLRGPLHGGANEAAMELIERFSSPQEATAELLKMLERKDKIMGFGHAIYKDSDPRNEVIKGWSKQLADEVGDKVLFAVSEAIDKTMWEQKKLFPNADFYHASAYHFMGIPTKLFTPIFVCSRTSGWTAHVFEQRANNRIIRPSAEYTGVEQRAFVPLEQR

SEQ ID NO: 29274 - protein, 801 aa, Pseudomonas aeruginosa
HPRADRAGRPRRPARRHRRQGRRPGPGQPGGAGATDRRPLAGGGMRRLRPRGLRQEPRHRGPPQRGPLPLHRLDQAGLPQRRRDPAGQRHHAPDQPGENVAGDPGARRRGLPRYLRGHRQPYPARRRPRRDRHRRRRPGSGKRDARPRLLDAPAGHRRRRAERPSPAGHHRHRRGAGPDRVPAQAEGGRRLPGVLRRRRLQPDPRRPRDHLQHGSGIRRHRGDVRHRPADHRLPAPHRPRRRTGRPGGGLCAHRRTLGRQPGRRRVRAGTEVRPVQRGAQHGRPVQSARQGRHQRTGGERHRRQPRAGPRRGSRGPDAGRRGDHRRDHQLHQHQQPAQRDRRRPAGAQRRPPRPGPQAMGEDLAGTRLQGGHRIPARSRPAAAPGSPRLRRGGLRLYVLQRHVRRPRPGDPAGDRRARPVRHRGALRQPQLRRAHPPLRQAGLPRLAAAGGGLRHRRDHPLRHRARRARRGGRQGDPPEGPLAERRGDRRGGQGGGEARAVPPGLHPDVRHHPRRAREGRPALRLAPDEHLHPPPAVLGRRPRRRTHPARHAPAGGAAGQHHHRPPVAVQRDPRRQRGGRVPGENGPARGGLQLLRHPPRRPPHRTTRDLRQPEAVQRDGAQRRRQREAGFAGAGRAGRQGDAHVGSHRDLHGAQAAADHRRRRRLRAGFFARLGSQGRAPGRGGGDRRRGLRAHPPHQPDRHGRAAAGVQAGYHPPDPGDRRQRDLRRARRSPAARRPDPGHPPARRGAARSAGDLPPGQRRGSLHLRSRRRTATLRPGLPGGGRRLMAPAKHPGRTDDA

SEQ ID NO: 29275 - protein, 102 aa, Pseudomonas aeruginosa
WGPTASNCWPPSPTPSSTARPCAPTVTHRTPARASPGPLATRRAAACAWRTSPCAARWASPACSARRNGVSTMSCSATPARTWRPSPRTSGASASPRATAAT

SEQ ID NO: 29276 - protein, 514 aa, Pseudomonas aeruginosa
RQRRYSPDAPDRISAQRKKGLVRGPFSFPALHRSGRRAAYRAGAGRLLRRQVEGVVQDGQQQDERRADVEGDAGVLEEGHQHHHHHQERQRQVGTDRVQPHAVLQLVALGRAERLAEAQLGQQDHRPGPDRAEGGDGSHPDEYLLRHQVVQQHAQQQRQDRQDQRPARYAAARGLAEEGRGLAMLGQAVEHAPGTEDAAIAGRQRGGDHHEVDDPGGGLDAHALEGHHEGAALGADLVPRIERHDHEQRADIEQQDAPEHRVDRAGNGLGRVTRFAGGEADHFHPEVGEHHHLQRHQHALDAIGHEAAVGPEVGDAGGDAVVAEAEGDHADADHHHRQDGEDLDQGEPELELAEGTHRDEVDRAHARQGRQGPDPARHVGEPDTHVDGDGGDFGDTGHQPEEPVVPAGDEARQRAQVVLGVLAEGTGHRIVYRHLAEGAHDHQDRQAAEDVGDHDGRAGHLDGLRRAQEQADADTGAERHQADVSLTELALQGAVLNLLFADRRHGNNLILLLR

SEQ ID NO: 29277 - protein, 208 aa, Pseudomonas aeruginosa
CATPNTGCSRPTRKRPRPGWTSPIAAACRSTTSAIRNGATRTSPACRRWWCRACCSSRTATCSITNAPTSTRRWTGVASPRRRCRRSARCSASARTPPAAAPWRPRSRNTATLPKGAPAASATSCGRCSRPAYAAIAKARPTSPRARTSCSPTSTRCRCRRRRATARSPAWPMACGSGTAPTTGRSARHSTARPDSPPRAWPCARCWR

SEQ ID NO: 29278 - protein, 482 aa, Pseudomonas aeruginosa
TAPPLSSSTSARGTSVPSPPTSTAASRASSSSPRPCQCRYSRAWHRSSGTTSTHAPPPAARYRCRRNRSAACSGSAHRPVPGRPVQLAQPLDAGLAEVLLQPQRMAFRVLFERRDKPRGVRHHQHLGVLRGLADQAPEGRQQVGMQAGFRFVEHQQRRRPRRQQGGDPQQVSQGAVRQLRGAQRPQQAGLLDQHFEAPSRVVNVQAAAGKGIVHRLVQRRRIADLADGLQGRGQVGAVGAQHRCMGADLRTPRRRLGVAAEMVVEAPGADPLAQAEQFRHLSRVHRRAQHAVEGGEVLRRHFPATAAAACAQQRPATVDEDIGRAQERAGPDAFALDHRVETELALAWLRQAEVDAITEILPGEAQAQVHRLPAHAAFDRLGATAHGPADVLRSRPQGRWQAALARQRRDHFAARAVRQQAQGPVDVGLAGAVGAGDQVQAPQRHHQVAQGAVVGHRQGGQHGCSRRNGNAADCRPNAASLT

SEQ ID NO: 29279 - protein, 1174 aa, Pseudomonas aeruginosa
GLPYCLFLSGPLRVQATGSGPLVGRMALVASLRERLPEQAGNVGGLKRVRTGPRLTIPPLSGRENRPLWSVPGTHRNGGHFPRRSLRRTPETDPGAKAPGNGVSLGVGQRQQRRVAAHRGGVHRRGALADETQQVVRPAGLGTGAGQAVAAERLHAHHRADLVAVDVEVADPRQLFDATGGFLVAAMDPHGQAETGGVDRLHDLFQVLRGITHHVQHRAEVLFLQLVDAADLERDGSDEVTVQVARHLGLGDQLAGGLQRGDVLLQAGLGLGVDHRADVADAHVGRADLQLGHGALEQLDHPLGDVLLHVHHAQRGAALAGAGERGLYRILDHLFRQSGGIDDHRVLPAGLGDQGGDGAGLLGQLAVDDAGGVGGAGEGHPGDPRVTAEHAAESGAVARQQGDNVLRQAGFEHQFDGARGDQAGLLGRLGQHSVAGHQRGADLAEEDRQREVPRADAGEDAAAFVEQLVALAGRATQFLADQALAGLLGVVAAEVDRLADLVDTVLQRLAGFQGAQRHQLAALGFQQVGETLEDAGTLVHRGGAPARPGRLQHVEGLAGLLGGRVLDAADQPLQVVRATHFVGRAGELLAVDDRRGLPLAGQVWLVGELQLVPLVLDVHVDALGVFPPGAEDRLGQRDTVVGQRLELAQLGNRVLDQRLHRHARVHQLVHEGRVGAVLQQAADQVRQQVLVRADRGVDAHVAAVLLDHRVVQRVAHAVQALELEVALLAAGGPGFVGQGEDGGHGVGVVAGELRVDHPAGVLAEQVAGAGQVGSVGAFLAGVDGVAIGALHLALLDLAVPVGTLHQAQRDACAKLAAEQGQPYQHRQAALGVGLDDQAELAPAGDGRVAHQLLVEFEGQLQAIGFLGVDGDADVQLARAHRQFQDIGEQLAEHPLALRHFVARMLRRELDRDRRPRPRTDLRLGADGVDGLAVVGQAFLGVGGGQRGLAEHVEGIGVALLAAWTTVLQRFGDGPAKHELLAHQLHRRVHRGADHRFARALHQPADDARGAAVGAFVDVHHLAGHHQAPGGEIDQNVVALAEMALPVGGGQLVADQRVGGRRVRHTQQRLGQTHQHQAFLGVQAVLAQECVEGIDGVVPAAHGFDQCAGVAADSLDAVGTGVGELQQFAQVGFLVDRVVGADDREEFGCGPGLVLALQDVTGFEHHALLLWSHCY

SEQ ID NO: 29280 - protein, 809 aa, Pseudomonas aeruginosa
  UNSURE (31): Identity of amino acid at the above locations are unknown.
TLMFQSVRCLMSDQDVNPEHISDAQPAGTGXVLPGQTLPTTLYVIPIHNRPFFPAQVLPVIVNQEPWAETLELVAKTDHHSLALFFMDNPPEDPRHFDVNSLPEHGTLVRVHHASREGGKLQFVAQGLSRVRIRGWIKRHRPPFMVEVDYPKTPIDPSDEVKAYGMALINAIKELLPLNPLYSEELKNYLNRFSPNDPSPLTDFAAALTTAPGGELQEVLDTVPILKRMEKVLPLLRKEVEVARLQKELSAEVNRKIGEHQREFFLKEQLKIIQQELGITKDDKSADADEFRARLEGKVLPEQARKRIDEELNKLSILESGSPEYAVTRNYLDWATALPWGVYGKDKLDLKHARKVLDKHHAGLDDIKDRILEFLAVGSFKGEIAGSIVLLVGPPGVGKTSIGKSIAESLGRPFYRFSVGGMRDEAEIKGHRRTYIGALPGKLVQALKEVEVMNPVIMLDEIDKLGASYQGDPASALLETLDPEQNVEFLDHYLDLRLDLSKVLFVCTANTLDSIPGPLLDRMEVIRLSGYISEEKLAIAKRHLWPKQLEKAGVPKGRLSISDAALRAVIEGYAREAGVRQLEKQLGKLVRKSVVKLLEDPESKVKIGPRDLEDYLGMPVFRSEQVLSGIGVITGLAWTSMGGATLPIEATRIHTLNRGFKLTGQLGDVMKESAEIAYSYIGSHLKKYGGDPTFFDQAFVHLHVPEGATPKDGPSAGVTMASALLSLARNQVPKKGVAMTGELTLTGQVLPIGGVREKVIAARRQKIFELILPEANRGHFEELPDYLREGLTVHFAKRYGDVAKVLFPA

SEQ ID NO: 29281 - protein, 247 aa, Pseudomonas aeruginosa
GLHAPRLLRPARPVLRRSSALAGRTVALRRRRRLPLPVPWHAAAARLPGRGAQPGPSGATALRQPALAARRADGPRRPSRRPGRRLWTRRPAGRQRAHRLGRAGLLYPPRQRLALLRRCIPARPAPGPRPGLREQSALRSLAQPGRRRRPAPAGPRRRARAAAQPAETAARPHRRAIGRPRHHRALPGASSAARRTDPPRRRTTRAAAAARRPQPAPAGGRRASRGTRRRATPTASRRHPEGPRRAL

SEQ ID NO: 29282 - protein, 212 aa, Pseudomonas aeruginosa
IPAGLFGVVYYSIYDGTERRRVMGTALRYSLLWASTVFVSSCGSLLPSERAEVQSPFVDYLDAELRYSQAQPGSTTRSQLFGLGFDPLTQGNGRMLSFIDVRLMFIQPNIPIDYLPGGLVQCLEAKDRCIGYAFDFSKTDTQRVGSFWADVFNFRKKRELQGWSFKAVFVFVNDVLVHKVSNGEPNIHRLEDKKNPLGPLQGAGEYFSDKLR

SEQ ID NO: 29283 - protein, 612 aa, Pseudomonas aeruginosa
SPCHDPAPRPRRPPATPRRLSAVRLGDQPARADRRAHRGRPRRPGPLVERGPAPAPGARTEGRTGPALRPAQRPRCGAASAGEGSAARADSLAQGAVRLLRRTGRYRMAFRLEMGACLATCRTAWQTRPRRRLRQRLLPVAHARRRRGKRGRGRSELAVPLPVPSRQALPAGAAGLAPAAGPGRPAGEARRLRHGILHGRALSPSLAHRPPAGAQGLPEARRRTGPGDPGGGRRRQHRAGARGPLRADAQRLVPALGGSPGALAAPRRVRRRALRRRQPDQRRGTTLHRMDAFPVAAGIPRSAGPFANRRRPAGTDARHAGGAQALTANREKPILGWFFFLLSSAPQVDGKRGAIASALGRRGQHQRFHLGHRLPEADEEGVGDDGVADVQLVDAVDGRDRLDIVVVQAMPGVDDQAEGTPEGHALAYPLQLTGLLLGVFGVGVATGMQFDSRRADPGGGLDLPRIGIDEQRHFAAHRSQASHRVADALFLAGDVEAALGGQFLAALGDQAAMRRPDLLGEGEHFLGDPHLEVHPRLQHFLEHPHVAFLDMPAVLAQVHGDTVGAGFLGVQGGLHRIRIAGAPGLAQGGDVIDVHAEQNSSGFSHGVTPYGS

SEQ ID NO: 29284 - protein, 625 aa, Pseudomonas aeruginosa
VSWVLAIHFEHGEEGFLGNFHATDLLHPFLTSLLLLQQLAFTAHVATVTLGQHVLPERLDRRAGDDLPTDGCLDRHVEHLPRDQFLHFLHQLAALVGGVVAVDDQGEGVDLLAIDQHVETNQVGRLETIEAVVQGSIAAAGGLEAIEEVEHHLVHRQVVDHLHLAAEEVHVALHAALLDAQGDHVAQVVLGHQDGGAADRFAHFLDRRQVRELGRVVDVDDLAILLHDLEDHRGRGGDQVQVVFALQALLDDLHVQHAEEAATEAEAQGFGAFRLVLQRRVVEGQFLQGVAEVLEIVRADREQARVDLRLDPLEARQDLDVRRVVQGQRIAHRRAVDILDTGDDEAHLARLQVDGLGVLRSEYPDAVHLVDLAGGLHQDLVALLHPAVLHPYQRDHAKVVVEPGVDDQRLQRRLDLAFRGGDGGHQALQHLQHAHPALGAAGHGVGGVDADDALDFLFHPLRLGLGQVHLVQHGHHFQPLLDGGVAVGDGLRLDALAGVHYQQRALAGGQRAADFVGEVDVAGGIDEVELVGLTVLRLVVQGHAVGLDGDPALALQVHGVQDLGLHFAIGEAAAHLDEAIGQRRLAMVDMGNDGEIADMAQVAHGSTHSKRARAAIRRKIAGEFT

SEQ ID NO: 29285 - protein, 292 aa, Pseudomonas aeruginosa
RIDGHEKGRWKPPFFRQPAYSASLKVMKLARPWRSTRIETERFFGRALATSAKTLVEVTALLSRWVMTSPGRRPMTAAGPSWTSLITTPPWISRLLRCSAVRSATVTPRRLLLRSAPGAPIEAISSSSSGRLPTAMLRDLRWPLRITSRLILSPGFMLPTRCGRSADSLIDWPFRLRITSPTCRPPLAAGPSSTSCATSAPDGLSRPKDSARSLFTSWITTPSQPRLTLPAFFNWSATFSATSIGMAKDRPMKPPERVKICELMPTTSPCRFSSGPPELPGLIATSVWMKGT

SEQ ID NO: 29286 - protein, 412 aa, Pseudomonas aeruginosa
CTGCARRPGPLPGARRRAGAGAREPHHRSPRDARSHGWRSCHCARRRRCLGNCSGDRPRRDDSASRKRRQPEWREPPSGCQAKATGRWCACLSSAVFQAGCPSVGQRALCTTDGGLLHVLTQVDRQTLLMPAGIAGRGVGDHLRRPLLFAVAGQHGRAFHLRQGDLRGGPLLRHLRQGVVLVVQTHAGQHRQGHRGSDRQATDHPPRSLLRFRRSGLVGQGSRDRRSDIQLRQGRLTVHDGPRQLVTRPGGTQLGILAASCEHPPQLEFIRFVIHHSGQSFVQGFTTHSDTSLGICRCVRLLATKAAELCRLLHERGRSATVPSPPDTASRWRYLRNSNLRTRAGSGPCANPRATAGWSGARWPRSHPATSPVPATRCPSGRGRPRRTPHPLRSHRCPVADARERPGGSSRC

SEQ ID NO: 29287 - protein, 430 aa, Pseudomonas aeruginosa
STCRRSAGSASRRAAIPARKSSPACSISAASSAACIAWRWTQTRCRRPAPGCSRQSIPPASAKWYWPPVRRRTAWNCSPCCRTTPSPTAGSASEAPKERRSSSSICLTRWTATAKSSADRKLCLAVRGRPASIPMAGARRACSGHCVFKGNAMSKLADKVQQDLIRAIDQDELVLPTLPEVALQVREAAEDPDVSIQALSKVIGNDAALTARIIRVVNSPLLRSPKEITDLQMAISRLGINYTCNLATGLAMEQMFQATTDVVDRKMREVWNKSTEIAGICHVLARHYTRLAPDQATLAGLVHQIGVLPILTYAEDHNELLSDSISLSHVIERIHPLIGERILKAWDFPAPIAEVPRQHLDFARNSPRADYTDLVQVATLQSYLGSEHPYTRLDWSQIPAFAKLGLEPTVDMKEDEDLSSALEAATSMLQ

SEQ ID NO: 29288 - protein, 426 aa, Pseudomonas aeruginosa
RGGRPTPGRRRHHHRLLQRLAAEPGPGQVRPLRRERGEMAGRHRHQLRRHRGAHRLALQEPRRPGEGAQGRPEQGGDRLRRHRRQPGLDADRADRQGRRDQSARPALRGPGRRRRDRHRAARRAHPGRQHRHFRLHAAHPQRRHAPARGVLRRTPARGGDGQHPHRQGTGLRHRLAGGSRVLPRAEGQRRRLRLVEERLRPTAGLRGLRQAARPARAVPLRHDRRGTRRLREAAGPAVQATGQGLRPDPVSQPARGRTPAAPRGSSHDPFQPVPAPVRRALAARLRRPGGRRLALPGAVFLRTGRPARLPAALPGADGRRPGVADRAADADPPRRGRTTAGRRRAAQGARLHRPAAGVRRPVRNARLHPQRRPGRLLHGHSLRRPANPCGGHREPARDRPLLAVRPRPGRPAAAGRSRLPAAVRTS

SEQ ID NO: 29289 - protein, 367 aa, Pseudomonas aeruginosa
CCCCRWSAPGAAARPVARQGWPMPERVTWRLYWATPLVGALGGWLASLVGWPLPWMIGSLLAVMLVRCLADLPLAEVPGARKCGQWIVGIGIGLHFTPAVIEQVLAHSVIIVFGAVATTLSSVLAIAFMRRSGEDRATAFFASMPGGASEMVNLGQRHGAVLSRVAAAQSLRLLLVVLLVPAAFQYLLGGGQPGPHQAAPVDWHWLALLFPAGALVALGWQKLRQPNPWLLGPLLLAAGVSLGFDLHIGLPAGSSGVGQWLIGSALGCHFNRSFFRSAPAFVSRTLVCTLWMMFAAALAAELLGWLTTLDHQSLMLGMMPGGIAELSLTAEALQLSVPLVTALQVLRLLLVLFLAEPCFRYWRKRAG

SEQ ID NO: 29290 - protein, 124 aa, Pseudomonas aeruginosa
RRRWACTARKSSARCWPAWRWKAWKRPSPWSTPTPMAMEQASSPAPAAPLGATSTRCRSARWVSTYRSRYRCRSSPSPAGRVPSTATCTPTASRRCASIPRPRPSPAAGSTMNRRPTNRRPART

SEQ ID NO: 29291 - protein, 298 aa, Pseudomonas aeruginosa
SSEGLHEHCRRTLQGFLLRPDPQAHRGKARAHRADHHQPPAGQHLGPRLADRPPPTDRAPQPRRRYLRPGSDRPGAEVLLRRRRPEHVRRRRQGPRSRDGPPLRRSLRGAARFPRGVDRGDQRLRHGRRAGVRPRLRHPHRRAPGADGPAGGRGGPAALRRRDPGAALAGGRRLGQADDPLQRAGGCGNRPAHRPGRTGGGQRRGARRRPAAGGQGGTPEPGGDPHHQAADPGCPRTRAEHLAAGGARALRRSVRRPGHPRRGQRLPREARSQVAQLLSLPIEPGGLRHSPPEPRAPT

SEQ ID NO: 29292 - protein, 294 aa, Pseudomonas aeruginosa
WTPAASNPARYRPWRDASFADEYRLDYRIHTYPKPFICWAHGYVMGGGMGLMQGAGIRIVTPSSRLAMPEIGIGLYPDVGASWFLARLPGRLGLFLGLSAAQMNARDALDLDLADRFLLDDQQDALLAGLVQMNWNESPQVQLHSLLRALEHEARGELPEAQLLPRRPRLDALLDQPDLASAWQALVALRDDADPLLARGAKTLAEGCPMTAHLVWQQIERARYLSLAEVFRLEYAMSLNCTRHPDFAEGVRARLIDRDNAPNWHWPQVESIPQAVIEAHFEPTWEGEHPLAGL

SEQ ID NO: 29293 - protein, 154 aa, Pseudomonas aeruginosa
SAAPPSAEGRRGPATSIASKLFHSIPKRPRGRHRRSSMKQIAFIGLGHMGAPMATNLLKAGYLLNVFDLVQKRRRRPGRRRRQRRPQRPRRGAGRRRVHQHAAGQPARRRPVPRGGWPARAHRPRHPGGWNAGPSPGPRREGSTPPPASAAWRC

SEQ ID NO: 29294 - protein, 261 aa, Pseudomonas aeruginosa
SRAMRSGTFPWCRNCSIRHKANRQAGGSAPRLVDSTMRGARLERPAAALPFPPAVLFHRAVHGDPRPAVEHQATGARQPPAAGAGRDEHLAQTQPAGLPDGLLRPVQPGPVHHCGLQQSLLQPAARPAARAEPDPAVPDPVRRAVPPRHPGAPGDPRAALRTLRALPADGAGLRSRLLHGRTDAACQLHRQPWRTRPGYLRLLQPGDPDHRGLRRHPGDQPAGAPAGRQRRSDRGPVHRPRRGPQPDPDERQRGGLIIKLG

SEQ ID NO: 29295 - protein, 98 aa, Pseudomonas aeruginosa
NAPACRACWFSAAPGAWRSPPASAWWTARNSPSSGSRAPSAPPTPSTNCAASNDWTGCSSARRCSSNPASAAASSASAATRFCSTPRARAGFPWKTWR

SEQ ID NO: 29296 - protein, 628 aa, Pseudomonas aeruginosa
PCSTRPSSPVIIASASPWPTEKTRRPSRAPSSSAFGLRRRRDDIEPEVEVAEHAEQLPQQQRIAGTLQLALEDQAYRRYLFEQQPVEIGAVDAHGLPGVLALHAAQVVQVRVLQFQQVVLTDVRQAQVDAQRLALRSAGVQAHAEIVEQQAGVHRRQGIGAAGLHRRLVARYAVAQFVGGAEVAVAPAGVLRLVAELLQGVGLQLARGPIIRLGEDQPVDHLDHPTVFAPGVRRPRLLQQALGAAHVFHVAARRVLRAERVEGRRVAVVVAQVAVQHGPCVMADRAVVAAVVPFLVEAGRQAQAVVHLADGHALVGQVQGLVVQVAVQVALLLQHLDDLRVAPARPVVHREHHLGLPAETMQRLVDVLAPAQRITYLGAAQGVQVVQGTDHVLGHQQGLLPRQPDVHLRRRLGARRVLEGERHAVQHQVLALAFDQAGRRQQAQRSARQSLADGHVDLPLRPLGQLRAVLVGGAAHHGVAGQDVLLDRRLHEAGRSDDLHRAAGDLLWLYQTAHASKVIGVGVAVDHRTDRPLAQLAADQFVGRPGGGRGGQGVDHDPAAVAADEGDVGQVEAAHLVDTLGNLEQAVLEIEQGLALQAGIDAVARLAVEEEVVATELPGDAAVGVADE

SEQ ID NO: 29297 - protein, 400 aa, Pseudomonas aeruginosa
PLRAPDQAAVGALEVGAVGEGQFRFDPPLGLDGEGTGRFGRGGFGGAGEQRGERQECKQTAHRILRFIVVGFGWHYAERHGNNSNAFQVHIRCRVRMSDLRQFRHFVALAEHGHYARAAEAVNLSQPALSRSIQALEGQLGCTLVERGSRGVALTAHGRLVLEHARRLLAGHRALHNAVSQLANLDSGELRLGGGPFPAARLLPEALAGFSSAHPRVRVVLLIEDWQTLRQRLLDDAVELFVADIRELQGDPQLRIHPLREYPGVLFCRPGHPLLRLVRPSAEQLADYPLAGPRLPEAVRGDLARLLQREEPLGIQCDDVLMLKGLVGSSELISLAPWDVVAADVEAGRLALLPWPAGSEPARAKGSAYGLVSRAGRSLSPAAAVFVERVLEQDRRFAAT

SEQ ID NO: 29298 - protein, 273 aa, Pseudomonas aeruginosa
LMGTSSFRYRQSVPSKCAKRVRTFDWKARRRPQAPPFLAHLSCASEVSRPAGPGVPDDPADRVVASVAENARAIAAGRRAASCPDAARHDGPGAIRGSAAGSDIARAGSRGGHRSGVAPGSSVGRSSASSSSAVRCASHRHTRDSAALRRRSRRAGRDSGANRRHRSRSHTPRSHPGWREAEEAGLSGMCATWQPPAAPLPTGRTTGDAARRAYDVKTREMEVGSAPAFLGVARRTMGRAAAIVAVVAIVERIQFDVGARHPNAATAHQEGRQ

SEQ ID NO: 29299 - protein, 69 aa, Pseudomonas aeruginosa
QPEQSHDHQHSPSSQNAAEPRLDKIPMEREAGCGGCNPAAIETEGKNGNSLNPTNDTGLQNVTAAGVSR

SEQ ID NO: 29300 - protein, 373 aa, Pseudomonas aeruginosa
SARTKDCRPRRNRSRSMHATHRPRPGTAARQRHPGVPARAATPRPGAGVPPRTGPGPATRRLSPGPAGQLPRPFRHRPRPAQPATFAGHAGSLVLRRPGLRRQRVPAVLSLLGPVPHRRPGGDPDRQRLRRVLRHALGPGQGRLGLLQQAGGDGRVRLLRPRPDHARADIQRHPQRPGAGALGALRPAPGLPVQRPPAAGGGDPLRDGFHRRARRYLGRRLLAERRRATGELLPRRRADLRRTAVLRAAQLQRLRRDLPGVRPARPVPADAGAGQLGLRQLPGVTVGAHRGALPGRRLRRRRPCDLARRATQLGGREQYRDHLLRHLPLHQVLRLVVGSDAEVPVLPGARPQRPADPAGPAPPAHAPGHRRED

SEQ ID NO: 29301 - protein, 272 aa, Pseudomonas aeruginosa
RMNRNRRNALIAGSLLLLAANLAALGGVAWNRSGEAESKLVLSQRELQRNWSYGFWSEENSGVELRLELRSPSSEPPSDLAPPLPPEQMRALGFSIPDALDEESVRRYRRQQEKQVLLVLELDGPAYRREVRLAEERLAEASARSKALPKDEMLSSQMEAARHQLKHEQGEASRLFIVDAGLDLTALRQRYPERQRYAIVKGRVRPWSAVDGGRTLVGGYISRTDLAAINVPRQWHAVFAKVDEQNYRLAPLELHLSFGQRLEPWITNAVRR

SEQ ID NO: 29302 - protein, 150 aa, Pseudomonas aeruginosa
LYRELRRHRDPGAVHERRAGHLHHAPRSPPVRPTDPRRGIPHHPQCRPLHRRRAQGRLATDPGRPAGLPPPAAHAAAQPDLPPPAQRRQRPPRRPRQLTATATGSPAPLAEKPSEINKNPAPGFTCRRASGKKAPWPQKPSERASYNGIT

SEQ ID NO: 29303 - protein, 317 aa, Pseudomonas aeruginosa
SSDNRHFVIPHEVSPVICLRHGSHAPFRAVRPRCHTDDYRFYRHERFQAGTTDASRLGPGRPYRLPSRRFGQDHPRRVLQPRRPPAARLHPGGVLQAEEQGPGPLPPGQALPDIHGRAESRAPAGGQSLTPFLFHCPRRDKAGVPRSACMNISIRAETPGDIDAIARLTEAAFRNETHSSHTEQYIVDALRRAGALTLSLVAEANGQVIGHIAASPVTIDGEAGDWYGLAPLSVAPERQRQGLGSQLVRRLLTELRLLPAGGCVVLGEPTYYSRFGFRVESGLALPGVPAEYFQAQSFSGRMAQGIVAFHAAFDASG

SEQ ID NO: 29304 - protein, 277 aa, Pseudomonas aeruginosa
GTAPTSQRTPLRLPSRQALFGAFPGLAVQQSGLLNADAAASRHARLARYPARRYPWQFRRTGTTVMGNYFESPFRGKLLSEQVSNPNIRVGRYSYYSGYYHGHSFDDCARYLMPDRDDVDKLVIGSFCSIGSGAAFIMAGNQGHRAEWASTFPFHFMHEEPAFAGAVNGYQPAGDTLIGHDVWIGTEAMFMPGVRVGHGAIIGSRALVTGDVEPYAIVGGNPARTIRKRFSDGDIQNLLEMAWWDWPLADIEAAMPLLCAGDIPALYRHWKQRQATA

SEQ ID NO: 29305 - protein, 464 aa, Pseudomonas aeruginosa
MTALHDLPGTRLLALFARRELSPGEYYEHLLAHIQRWEPHLNALYRFDPQRVREQAAAATERWRKGQPKGPLDGLPVTIKELIATAGEPIPLGSAATALQPAPCDAPPAARLREAGAIVLAKTTVPDFGMLSSGLSSFHGVTRNPWNLANNTGGSSSGAAAAAAAGYGPLHLGTDIGGSVRLPAGWCGLVGFKPSLGRIPIDPYYTGRCAGPMTRCMDDCLLLMRYLAQPDARDATSLPPEALDWSAEPLSVRGLRVGLQLDPGCGLQPDAEIRAAIEAAARLFEEHGAQLRIVEPLMDRSLLDGLNDFWRARLWSELLLLDETRRARVLPYVHAWAEGGARVSGVDAVRGFNQTFEMRRRAARLFGEIDLLLTPTNQVEAFPADWASPLNDPQRPFEHIVFTVPWNMGEQPALSINCGFTAAGMPIGLQLVAPRFADTWLLRIGKTYEGWRGPIHGWPRPPAD

SEQ ID NO: 29306 - protein, 618 aa, Pseudomonas aeruginosa
VFQSSLREGLRHALPHPSPSGRRSGQPPQRLCRGPRQRRGILRLRGLCHLRGDDRTDFLPLRQRLRQPAPVGHRVRRRLRHPPPRRDPYRRLRRPRRAQAGDAPYPVPDGAGHRRHRGAPRLRQHRPGRAAAAGADPPAARPGLGRRGRAGDHLHPRGGTAAQARHLRLLAGRSARHRGGRRRADGLPAHPLARRAPTAGMGLADSLRGRPAGPADRPVHPPQPGRDLCRTRPPGQHPEPARRIVRQSSASPAARSADPLRKHHHPVLPQLHDHLRPYRATPAGGHRDALDAGRRRRTGALGVARRRALRPLRAPRRADPAAPGAARGAVPGTAGNDPSPRAGSLPRRPRPALGPAWHERRGADRAAGRKLPPGAALHRFFPGLCDRRRRVRRHRADRGDLADRRHRQSAVAAGLPAAGQPGLPGWGLAGPRDLAGSRGHGRRAAGAARLRTCAVRSSAAGLSRATLGTSFIRRSHHAVLPALRLRAPLLVRLHRPGDLAGRLSPSFPRLAGRPVPRGARPVLSRRTTTALPATLEPAARRPPARCPARVGQRKPERTWHPRPATAGRSPGLLAGMAAGLAAVAATAAGDRPGRSRHHPGALRQPPFGAALAAARGAP

SEQ ID NO: 29307 - protein, 231 aa, Pseudomonas aeruginosa
LSPRLCRPVARAIPRPATQQARPTAAGRIGAFSRPGVGAAATGRRGYRAGCVRCATGARRRQSRRDGPPRSGCAPARPGRRPGTGGARAPGGVPTGRPGRRTAAPVGSAKDWRCAPVFPPRPAPRVARRAPPGPFRRGGRAVDEAAAQAAPATPRARRERPREADAGRRCRTPAARRTAPATAATLRRNGLAARAPASAGPPVPGQRRAPAAASPPAATGGHSARARGYRR

SEQ ID NO: 29308 - protein, 310 aa, Pseudomonas aeruginosa
AALRRSTISSFTDSWAINRRKVVQRCPAVPTAPNRMPRTARSRSALGARIIALLPPSSRIQRAKRAATRGATSRPMRVLPVALTRATRRSSTSASPASRSPISNWLRCAGASLPKARAARSNSAWQASAVRGVFSEGFQTTELPQTSASAVFHDHTATGKLNALITPTTPSGCQVSRMWWPGRSDAMVRPYNWRERPTAKSQISIISWTSPRPSWVILPASQDTSSPSSALCRRNSSPNSRTSSPRRGAGTWRQARNACSARSTLAATAARPSSRTAARRLPSMGVCTASSPSRKALGSRPRLRSNPSIM

SEQ ID NO: 29309 - protein, 143 aa, Pseudomonas aeruginosa
GTGFCVGSKVRLTPNGRSVSSRQRAISAASASGLGWVNADSVARPPALATAAAISARPTHCMPPCMIGCSTPKVSVKRVLNTPMDCLLGQIGSQENTSGLRARSMKLPRNAGMPCSAMLSGVQPCSLCTLRSGRLWLIRKSSW

SEQ ID NO: 29310 - protein, 564 aa, Pseudomonas aeruginosa
LAWPKLPISPEVLVMCTKAPACWVRKRSAAARLTKKLPLRWTLITDSQSSALILWKIASRRMPALFTTISRRPKPSMAHSTIRRALSQSATLSVLIRPSPPRWRIRPRVSSAGEADPPSPCSDTPISLITTRAPESARARAISRPMPPPAPVTIATLPSLSLLLMGNPLRPVDVVRLRSARQAEDALGQDVALDFVAAAVDGGRPRLDEDPRRMQLGVFGEGLQQGRILPGDLQAQLADALEQFGLEDLQHGYLRAEALPTPQAFGETLVKRLVAVQVHAQRGEAAHEQRVVPQSQVPGQALQALESEGGLLGRTEEDPLETEQRLGHAPTLVDSADQAVIGHPHVVEKHFAELAVQLQVEDRPHLDARAVHRHQQEADAVLRLGAALGADQQEDPVGLRAHGGPGLLSVDHPLAVFQARLGAQAGQVGAGVGLAVALAPDVFAAENARQEARPLRLVAIADQQWAEHGHAAVGQARAAVLLHFLHHDQLLAGAQPHAAVLPGPAGTQPALARQQQVPLAGFLAPQATGRIADALRIVGGDPLTDHQAKGVVIETVVVAHLSFL

SEQ ID NO: 29311 - protein, 236 aa, Pseudomonas aeruginosa
ETTGSATRPPAPAIGQGPRRATPWSSPGATAPAAPPARPAPAPSPRRRQRRRGGRPGRCAVPPRPVPPGRTSGSAVPAPNRCAPARYATGRGRRAARPCRSRRRSGRRRRKRCCRRPAPRTARPPPPSPRPRRSAACPCAPSAAPAARCPAFAPCRRPTRSPACRPGRRRRRTPLRHRSAARCGSMGRIRPPPGPAAIPCAAPATVRCAGPGCRSAAGAPCRAFPATNRSSGHLPL

SEQ ID NO: 29312 - protein, 572 aa, Pseudomonas aeruginosa
QRGVARLVERQRAVGIEQYHGAAQEQADVRLVGVADAAVQLDGLAGHQQSRFRGPYPCAGNLPLALAFRRPGIDRGGGLLDHGARQFDLDPQVDHAVLQRLETTDLAAELATYLEVLQGSLEGAIHQSNQIGRAGQRCLVQNLFRYLAGQPPCRRIAETQARQVSAILGRLAEQFHAIGIALDQRQALLAGHQPGIGGTSQMYVSDFAVQPPLLHTRASPPIAVGDARRQDQPLSGQQRNALVFRQQRRHQPGLDQRLGQQAAPQRLQQRRVFAHAQAAAAQRFIQAQRRPAHGADLAPGLAVHPATGETTAAHAGQVAVAWHQRSRAVADHPQTLLALAGPLVLLTHLFALLSIRRPPVRHLHGRRRLVRAERPRRPWSGRATDGSRCRAAGNPLRLSRAVPEAARGHGDDLAVLVADFRRAEADRAGPSHHPANRTKLAAGATHEVGSHVDGHHRAVRQAGTDRLGHGGVQHRHQHPAVELLQVVHQFRAMPQAHPRHPVGIGPALEADELLEAGGPLLRRWLSWKRTHGCALLPQDQALAARRSAVSTALPGACRREALSASRDSRFGS

SEQ ID NO: 29313 - protein, 274 aa, Pseudomonas aeruginosa
PAGRPAQAQRPGEGFAEPPHGLDRHYRPGGVFEQCEAGLLVGCQLLPLAHHRDHEQTLGMSLLDPPELLGQTRADGGGGAGLGEEGEQRTVATVDHHRLGKVAHQRQVVQGLRGAVHRVDRRSEGQPCLQPLLGHVRHRRHRQADFLGDIADDDPGAAADGDHAEAVAHRIDTPGWRGRRCPSVPRWSWRGSPHSRPARRPAPSRRRPAKRCGTAPRGYPGRCARPCAGSPACRRDARPPGRRGSCRRCGWIRRRPSPRRSPATPPASRCCRPG

SEQ ID NO: 29314 - protein, 195 aa, Pseudomonas aeruginosa
PPRRPHTAHRRFAHVPGAGLRHTAPRPAAVPDPQPARHPGPAVRRPRAARQPAGPALPLRTPTLPGRHGRQPDPRSRHPTAAGSVARRARHRRRCRGRPAPGRPARPIKRGRRSRQHPLRPLPQRQALRLAVEPAVDAPSDGGELAAVGQVVQAVTGPPPGRRDRRPLRLLEQFGFLLQRLAQPRCRRRGSSTGR

SEQ ID NO: 29315 - protein, 566 aa, Pseudomonas aeruginosa
TTSLQVEFCRLVTMDECKPMKRSASLIAFLLLSASLHAAEHPQKSLAARSAVELAPFQWSWMDPVSYDEAGLQKTAAKKDPLRPFFLAFRLLVEHEKTGEEKSLTSAKRVLDFMLDEYQPATREADGTRWFYGFDYDRGIKAPWWSGMDGFFGPMTLFAGWQATGEERYREAALKSAKLMIRQPTEGGSLWRDGDSCWISEYSWNGITRDKEYHVLNGHLWGLQALYMLAEASGDKALNEAYQCARKGTLDRLPEFYNSTGSWTWYQLVPKVINPTHYNILETAQFRALHAITRDNAYKDPEQRRIAAFQKAYPLYLIETKKGLEIQFSMMGAPNAYWTDTYPVTVSCTVGNKTVSQTNKDAYSTKPIHERMILRLPVNKVPKKCSVSVKSSMDIAMYTQSKFKTIKSPVEDFVKFTPLPSMQASSLQEGIIHITTEKGDTAKPGEGRVMFDVNRDLSESEMIGMVIHTTEDSQLGIVLDGANEKRASSYYPLIKSGKDNIVIFNKLGFDKGSELEGHIAKIMLRFYTKPNERDRDIEIKEVSVIRNTANLEDFLRRNQSANFHQQ

SEQ ID NO: 29316 - protein, 64 aa, Pseudomonas aeruginosa
IYQRHPDSTEDSCSQQRHIARKASLACRQQGVGDNFVLEIFQKVFPDGVIPSTYTLDIPNINRE

SEQ ID NO: 29317 - protein, 253 aa, Pseudomonas aeruginosa
CSGEVRSDSARHIGRGVTTPASSAKHAGLEVVDEFIALASRHSAASQGGIHSALGQDGFAAVAGSAGDLIGLQEGICPPFVDGFAPTDPGLGVHLLHDVVDVDSRALCVNVSQRHVEWLQPIGDLAEIIPIAHGDQPGVVDHQEGGAADVDFIPRHGDERGGRGGQADDVHRDLALVLAQQVINSQAFEYIAAGAVDIHGHIDIAAYGAQSSSNAFCRDTFTGPPVVANRFVDGDRGVRVIARSCSKLRTPCI

SEQ ID NO: 29318 - protein, 169 aa, Pseudomonas aeruginosa
LRARARINAFALAALVHAAVPEQDSRSDIARLLELLRVHPWPSFVRDFENDLFSSLLFVFASHWAVHVIAENLQVRREGIDRLLNHAGERLMNSPRRADVALSPSLMDSWHEGVLAVGDGFPIIVDFGDTAPDITASLDNSKSSSLRRLSHAAVPRGIERIVPGNARAV

SEQ ID NO: 29319 - protein, 133 aa, Pseudomonas aeruginosa
SRGRTLRTNRLLLLLFPVLGATDEARELTLELQQAEARLCVSTLHDIKLGDTVLSTLSAHIPVSHDDHVGVLFDLAGIAQVAHFWLGVGPGFDAPIELSKRDNWNAKLFGESLEPSAYGAKFLVSVLMTVTRI

SEQ ID NO: 29320 - protein, 84 aa, Pseudomonas aeruginosa
QEAHTSTLANPIKETEMAQFNIDSHLSDGKSLQWLALPDAGEQPLDVEVKVRQAAMKKFGQSVFFNCWEHVVASNGYITVRMHA

SEQ ID NO: 29321 - protein, 142 aa, Pseudomonas aeruginosa
EAGMAMHTELQIHKTAEELLSLTLSLVRNIPRDLKQVIGSKLRDEALQILVLIGRANMARNKLEHLSQLLESIWMVNYLLRALANQRLISLKQHSSAMQLTASIGKQENAWKGKFATAPWRIHTGGEICTSTLRFLIFSERP

SEQ ID NO: 29322 - protein, 117 aa, Pseudomonas aeruginosa
SAGLASRTATTPNRSISAGSNDCPARTRHCAYTHWRQDMAAGDYYSCDVCGGKCFYDANLNYEWPDKNGNDSWGYHIPADEMMLGTNCKLDYCGDIAAICRDCRATHEIVVREKSSD

SEQ ID NO: 29323 - protein, 127 aa, Pseudomonas aeruginosa
WYGEEVMNTALKYAQERWDNALPPDDDGDREYVTEQVGKLLNCEDGDCVPFHDRKERPFIGPEFTVYGFAGFVPEWLAEVDSKECPMTQLLLAVRRGDLELAQRIWFRAFEATLIENAERMVRERRV

SEQ ID NO: 29324 - protein, 291 aa, Pseudomonas aeruginosa
RQPWPRSMTPAIAARSHPHDSHHRPDQGRPSPDLRRLFCGQRSRVRLGFCGDGYAMKFPDDVGKGICIFLCDITGKMAKPWFDDGYTCILVDPKHPRGVTVSQCGRWITIGEIIDHPTTWSVISAAIRTNRVVFVAGFPPCTDLAVSGARWFEEKRKADPLYEMKAMHVVWQCQVIGELSGGKWFAENPVSRISSFWRRPDHAFHPFQYTGFCAEDNYKKKTCLWVGGGFVMPDPYRDYSLGAPDNRIHTCAPGDERANIRSETPTGFAIAVHLANRGPRKGQLDLLEEAA

SEQ ID NO: 29325 - protein, 187 aa, Pseudomonas aeruginosa
WRQAHCSRILRADQAIHRGEGGMTQLYKLTEQFLELAALAETADEGMAVAVRDTMQAIGGEFEEKGKALATVVLNMDTDVEALDREIERLNDRKRAIKARQDSMKEYLRENMEAAGIKKISCPLFSITCVEGREIAVIDDEKKLPDELVKVKVETSPDKNAIARALKDGKDVPGAHLERAKSSIRIK

SEQ ID NO: 29326 - protein, 76 aa, Pseudomonas aeruginosa
RLRRRHPIQPAALSSRLLTHAGATMYIKKDVIEVIKYAAMMAACSRQSWGIYPMNQGYKAMPFRGDYHRVVEVCHP

SEQ ID NO: 29327 - protein, 199 aa, Pseudomonas aeruginosa
KGNRLVWPGEMRMNNVQRFWCHEAQNIRCVRESDYAKLEAEAQALREERDSQQRVAINAMEELAALRTRVLALPDASTVYAALDARERLFTSPENIQVALEAQSRLNGMTVSEGLLRGMAAFAQEIISGALEGGSFDGADIQESAERHGLIAKQMMREPCRGPEEYCACAWSTSFPTECYRITAELRALLSQDKENGNG

SEQ ID NO: 29328 - protein, 101 aa, Pseudomonas aeruginosa
DRRDPAPSRRVRENRTGARARATARNAHAPDRQSGERITQQRTQPYPPPGGPTVDNENETLVALLVIALIVFGIFRIVGDFQNLYEQTELKGQELSRWSKQ

SEQ ID NO: 29329 - protein, 199 aa, Pseudomonas aeruginosa
LWKEPSHDRHQQAEGAGGAVHRQSIRSRRRRLRIPCRRRDRQVYGRWGVSDAPIEPHEYLYGVKVVQIEDLRVARGLTRRPVSSCRHRKMVYDDKERRIWCSDCEAEVEPFDAFIHLVQVFDGGLKDLNRRRRELHEAEQFAIRSRAAKVIDEAWRSTKMAPLCPHCNEALLPEDVVKGVATASKQLIIARRNKQKQPK

SEQ ID NO: 29330 - protein, 110 aa, Pseudomonas aeruginosa
GLFLRPARLGNQSYHHALSGNSWGGEVLPMEPEIIHVPELAKLLGRTESSIRSAIQARPDWLPPYFKQGIRVCWRLETVRKFLREYEAGEHKAPKVGRPRKEPPRLLKRA

SEQ ID NO: 29331 - protein, 313 aa, Pseudomonas aeruginosa
YQLVRRTRSFLEDFFAFFQMVARVRRLKRHAQALGYLFVGFDHIAEALAEAVLVHLLAGFLVPQTAAVRAKLIAEDDLAMEQAELQLEVHQQQTGVVEQLVQHFIDLEGIGLHLRQLLGSGPAEGLDVGFVDERIAQGVVLQEQLEGGRSQGDALFHAEATHQAAGGEIAHHALDRDHVELLHQALGIRQQLVELGRNAGSFQLLHDEGVELVVHRALAIELFDALAVEGGGVVAEQQDETIGIVGLVNRLGFAAVEFFAFFHDGLRLRVIGPRRSRANPGLNADRPPAASPDRTRECRRRFAGPAAASCSFR

SEQ ID NO: 29332 - protein, 377 aa, Pseudomonas aeruginosa
QAADVSLGGAFRYPSRFRYGPCRQRIPGKLNVHQPTPRTIPSDQRPRPQSDGADHPALPRLRREPLRRGQQPPDPPRRVQRPGAADLRKLGCPRPPRGQPAGPHQARRHHPQHDPQQRPRDPRPGVALRGLCQRGVSPGHPQRTLPVLHRPQHRAGEPDLRHLPGAAHQHHHAQRHDYRDAARRHPDQLAARPVPRLRRRPEPGCPDRTLAPPTPLRSRAMPVAIDKPVPDFTAPATSGKEVTLSALKGKQVVLYFYPKDSTPGCTTEGQGFRDQYAAFQKANTEVFGISRDGLKSHENFKCKQEFPFELISDKDEAVCQLFDVIKLKKLYGKEYMGVDRSTFLIDRDGVLRQEWRGVKVPGHVDAVLAAAQALNGT

SEQ ID NO: 29333 - protein, 480 aa, Pseudomonas aeruginosa
ASCMNVLRPALLTLACMLASPVMSDDLPSLGDASSSIVSPEQEFQLGRAWLSMLRNQVDAISDPQLKDFVESSVYRLAETSDLQDHRLAFILIRDAQINAFAAPGGVIGVNGGLLLNAQTEGEYAAVLAHELGHLIQRHFARGIEAQQRMQLPVMAAMLAGIVAAAAGAGDAGIAAIAGTQAAAIQNQLRFSRQNEQEADRVGVTNMVRAGYDPRSMPNMFERLARQYRYDGKPPEFLLTHPVTESRIADTRNRAEQYPQGGKEDSLRYQQMRARTQLLFEETPGMAGKRFRAMLNDNPKLDAARYGLAISQTRIGQLNDARDNLRQLLAKAPNDVAYNLAQVELDITANRLPDADQRLKKMLAQFPSSYPLKQVRADLMLKMGKPQESEKILDDLSKARPLDPDVWNRLAEVRSLTNNAIGVHQARAEYLSLTGDYQAAIEQLDFAKRRAGGNFQLAARLDARQQEIRQQEKMVKEMFR

SEQ ID NO: 29334 - protein, 205 aa, Pseudomonas aeruginosa
AAYPRKNTRRSSSKQGVGRTTAPRLLALRSGTPSPGSGVPGLAQARGLGEVEHALERTDRPRDQRRVDEDFPAALAQAGQGPLERVHRHPRAVRTAAAGGAVAGGGGLDEILDRAQLLHLVEDAAIGGDDEGLVRQGLRGLDQLAGRAHGIGQRDHAFRRFGVDQEWRRPGRAPSCLPAGLALNSSWKMQAPSQSSMSAPFSRWM

SEQ ID NO: 29335 - protein, 188 aa, Pseudomonas aeruginosa
RPRWWSGRPEDGLAVVHQVLDDVHRASGGHDPVGACLHRRGGVRIDHHGPFRVLVAECREFIHRAAQVERAGRFEGRHQHTLLRVEDLRRLAHEAHPGHDHRLRRMLVAETGHLQRIGYATAGLLGQRLDHRVAVVMRHQYSILRLQFGRDRRAMLGALLLAQHTGLLGGQVGLYQESFGNVRHSRYT

SEQ ID NO: 29336 - protein, 333 aa, Pseudomonas aeruginosa
GMPIHNLNHVNMFLQVIASGSISSAARILRKSHTAVSSAVSNLEIDLCVELVRRDGYKVEPTEQALRLIPNMRSLLNYQQLIGDIAFNLNKGPRNLRVLLDTAIPPSFCDTVSSVLLDDFNMVSLIRTSPADSLATIKQDNAEIDIAITIDEELKISRFNQCVLGYTKAFVVAHPQHPLCNASLHSIASLANYRQISLGSRSGQHSNLLRPVSDKVLFVENFDDMLRLVEAGVGWGIAPHYFVEERLRNGTLAVLSELYEPGGIDTKVYCYYNTALESERSFLRFLESARQRLRELGRQRFDDAPAWQPSIVETAQRRSGPKALAYRQRAAPE

SEQ ID NO: 29337 - protein, 238 aa, Pseudomonas aeruginosa
SVLQQTLAVGGENRLGMELQAQLSIARIGHRHDLAIGIGQAVETFRQATDHQRVVARDAQVSDAVEQRVTLIETQGRALAVQRLPRLAHRATGGQRQRLVAEADAEHRQAPAGPGEQFQHAAGVFRPTGPRRQHQQFATVGQQYRLDRRQRRIVAHHPDLRAEQAELLDQVVGEGIEVIQQRDAHRALPFRVRQRPRRSAPPAPCCGFPRPPAVDPNPAPRRRLPGPGRYLRGPRRSG

SEQ ID NO: 29338 - protein, 112 aa, Pseudomonas aeruginosa
PGPDSPRSTAPARRVRWSSTPAAPHRAPSTRCAGSWKGSPRYAAQPCCPRRSSRTASGWRRPCARSTAPPAPACGTPDFLPVDSQPRSRATSSRPWATGLRDASAQRHVHHR

SEQ ID NO: 29339 - protein, 85 aa, Pseudomonas aeruginosa
PAGDAAVPAPATRRRPPREPAERPRHRPRATAAPHATVAGSSARPPAPRFPTSRPGRSARTPGPVRSAAADTGRAAGRSGRSACG

SEQ ID NO: 29340 - protein, 759 aa, Pseudomonas aeruginosa
SLLQPAPSSPHRDAAGTPAPGRPPTGTGHHPVDREPKASTWPVHLLRFAVQRRAPGRAGAVGQDQHPLSRLDVRPEHRQRDRGRGRSHVAQTIHGHRELVLGNAQLLLHRIEDAQVRLMADHMVDVVQGQLMGREHFAGDPYQGLAGMLEHRPAAHEELAPALAQDILVEEGRRGTARRRSHQQVEVVAVGAQAQVQQAVVEALAGADHHCAGTVAEQDRQVAAAVRTVHALGQHLAADHQDMPCQPGEDLPASHLQAVQQPAALCPDIQHRDVPQAQQRLDQAGLGRVVVVRRQGVHQQQVDVLRQQPGSLDGLACRRHHQRADRLFRLDVIAGAHAGTFDDELVRRIDAPYQVMIADLAFRQAETQPGQDRITHVQPSSDTVVQHGDASAHQHLAQLPDLGGEPPASGCAGHDDTIAGADLALAQAGHQGVRDGNGDHHAGIAHRQLVLLRTGTDALGPGLDQERRWLVEDEIIDVIAAQAGLFQRPAHRDRHVGRDEAGHLVLAVAEQREIQPRLSLAGRVFRQAPATGGHFIERSVAVFGRSQQVAAVIVAAGQQGHRAAIGEQGRGTRGEVEQVGDVLAAHHQHFLGLTLADHARCQAQVEQEAGALHLRIQWQRPTQAELLGQHVGHARVETSAQVRQDIAGVGHDRRGSRTDQHVHAIRRGIAAAQQALGGPDHQAELVLAVPRVEIAPPIDAPELPPGLAEVRYRGEHRIVVFVAASRKFTGDRCQFDLMHELLPPVPGSRPPPPCRTDRS

SEQ ID NO: 29341 - protein, 582 aa, Pseudomonas aeruginosa
PPPRPGLREPPAASAASASRRPGREGVRLPAAPPDTHRMGAGSPPQPESTCPFLRKVVVIKGVGQVAQLGARQLAVVVARQGRQHMQLAGQHVRGNLFGEMLVDALRQQDLVVVQRSGQGDEQGRTQAVVQPAGRNQNRLAHFRQMTADRLLDLGRHHPAAIHLEQIVFPPTVTVGTRLVALEQVAGAVPATCEARLLLFAGPPVTRTQPRATHQQHALLASFLDSVPFAVHQPALIARQRQPGAVGTRLPRAVGEEHMADLGSPDAVADLQPVRGPEFELAARQRRAGGKRQAHAAQQLPGLRTQRGIDGRHPKQDPGAEGDQVLQNPLRARPGIVEQRRGSAEPGKEQAVAHAIAEEHLGNRIQPVSRLQCQQLRSERPAETERVAQAVHHPLGRPGGTRGVLQETGCRRVLAMEGTPIEVRRTDQRVQREIVEQRASGGRTQGQRRQRTAQRRCIGFTHHQAGLAVGSDIGQGLLAGLGIDHGGNGADRDAGQEQAGQRRRVVQRQHHAIAGLEQAGQLAGLGENVGPALQPAESLAPIVINGGIGIEIEAEQNLGQVGQCGHDRTFPLQRYASGSGDT

SEQ ID NO: 29342 - protein, 258 aa, Pseudomonas aeruginosa
PDCSGDISDRGPTATERNSFVSQVLVPGRQLIVDGTGAIAPANGQAPLVLDTEHQQTGQVVDHSHDPLFLVVCLCTEGTLSSRVHAQVELHPPTGLRGETLGDHGAPGRHGHLRAVADLGIASKGIGIQVHPVVTIGLHVGEHGIATAVGANRRVAVEADAADLRNLHQAERFPHRLAEGHSPRMHHYRTACSQVDLLVVAPLAVIGGQLGLGRVPTQADAAGVAAVLAVVGLCAVVERIGFIQVSGDTGVQTRITML

SEQ ID NO: 29343 - protein, 505 aa, Pseudomonas aeruginosa
AIEVALFGHVVDMLAESTVAFRGIAIAHHGKAGFGGVDGLGIEKPQTLSLVAPTPPRAGLAMGHVRRKTAQGRVEAEAQVGGIVLLRSEQAAKAGNPVGQAIHSRPLEQVDRRLAIIMVFTGSQAIAQVPLAGHDRQVGIGLLEGPLASVRLDDLDLQVAIGAAGIDVGDLERTGRYVGGIDHEAILAHLDRRIGFSDTAHHRGIADLVVGQHAYIGLQLHAAHTHALESIPLSGGIQLAEGQGPLQGTNVTFHIGTVATELVAHAGTSAQGGVVAQTPAKQVEAVAQAQVAIIAVLAKVGVAREVGLVVGKQRGDTVIPKRGIHIATRVPLYIQLWNADQQGKAVDVELDGCTGDEFGDIQGRIVFQIIRNEFVSRQPGDIDPDLLEQPYPDDRTNASGFGIGTEHDIFAPDHDLVQMNVDAVSAGRHRVAVLEILQFNRRPALVVQELGVEFHRESYGRQSQSQGHETGRPGIDGQLEVELFPKYGHANIPWTNFRQNGNTHP

SEQ ID NO: 29344 - protein, 180 aa, Pseudomonas aeruginosa
PARQHAAAGCAGGDSQSAGALGPVPPVGLAARCFAHWLAAGSATPSGTARSTDRHDARRCRFAPASPAPPPAVLSGLPFSPSDHFQRLDVEVGLGEQLLQSAIFQFKILQPFGVRHGHTAKLGPPGVERGITEAVSATQFLHRYTGLRLLEEVENLLFGKTLFHCRLLLGKRTLLSSAWY

SEQ ID NO: 29345 - protein, 498 aa, Pseudomonas aeruginosa
MSNDNEVPGSMVIVAQGPDDQYAYEVPPIDSAAVAGNMFGDLIQRDIYLQKNIYYPVRSIFEQGTKEKKEINKKVSVQVDGLLKQITQGKREATRQERVDVMSAVLHKMESDLEGYKKTFTKGPFIDYEKQSSLSIYEAWVKIWEKNSWEERKKYPFQQLVRDELERAVAYYKQDSLSEAVKVLRQELNKQKALKEKEDLSQLERDYRTRKANLEMKVQSELDQAGSALPPLVSPTPEQWLERATRLVTQAIADKKQLQTTNNTLIKNSPTPLEKQKAIYNGELLVDEIASLQARLVKLNAETTRRRTEAERKAAEEQALQYAIKFTADFYKEVTEKFGARTSEMARQLAEGARGKNIRSSAEAIKSFEKHKDALNKKLSLKDRQAIAKAFDSLDKQMMAKSLEKFSKGFGVVGKAIDAASLYQEFKISTETGDWKPFFVKIETLTAGAAASWLVGIAFATATATPIGILGFALVMAVTGAMIDEDLLEKANNLVISI

SEQ ID NO: 29346 - protein, 168 aa, Pseudomonas aeruginosa
GMATGLPLCAPSSKGVSMTRQLTTLTLCLLLASCTTHKAEPARPAFDSSRNPDLLSPDLYPNGVQPEKEPVVRYGRYTLVSTQPDAGQRDLMAQIIDVTIPSSMNPSVKDAMQYVMSRSVFLRCPVLLQGDAFGPAAAGFRSWLPTVRWPVSPTCRGSQPLPICRGCE

SEQ ID NO: 29347 - protein, 322 aa, Pseudomonas aeruginosa
AAKDPGAGSPDQPVGAGERDIKKGYSSLDVGRTRSYALIDQLSEQESVEVVCSAFEVARSCYYVHRLRRRRVDARRVALRSQVNQLFSQSRGSAGSRSILGMLREEGVTIGRFRVRRLMRELGLVSKQPGSHAYKQAMVERPDIPNRLNREFATEHPNQVWCGDITYVWAQGRWHYLAAVLDLHTRRVIGWAFSAKPDAELVIKALDMAYEQRGKPQQVLFHSDQGSQYASRLFRQRLWRYRMQQSMSRRGNCWDNSPMERLFRSLKSEWVPSTGYLTAQEAQRDISHYLMHRYNWISPHQFNDGLPPAVAEEKLNPLSGMG

SEQ ID NO: 29348 - protein, 225 aa, Pseudomonas aeruginosa
RTAWRRSERAGPPPGRRARNNSRKASARTVASRSGGLGNQPDVGHTGLLQGTHGANHRTIVHRLVAADEYLGVRTGTHDLGDCIGHLFQRHGTIGLFFSIHFAADVPVIGTVGLHRKGQDLLVVVLRQRLAGHLRQVDLDPLVEHRCGHHENHQQYQHHVDVRHHVHFRDRLALVTNPCHIGLPLSRLSRRWCAPCGAGWPGTRRRRCSNDRSASQNVRRSGCRR

SEQ ID NO: 29349 - protein, 403 aa, Pseudomonas aeruginosa
NQVPALPIGNRPQMQLITIFRREQIRRHPRPQPFRNIQAKVQVRMACYHAPPRCPHDVALLDQIGLQYIFDRVPLLAQRRSQVVDSYRPAIELVDHGQQQTTVEVVEATLVDIEQVQCLVGDHPGNVALPPDLGEVAYPAQQAIGDSRRTAGALGDFRRALRLDLQAENAGRPTDDGRQVLDVVELQALDDTEAIAQWIGQHAGTGGRADQGERRQVQLDGAGRGPFADHDVQLEIFHGRIQHFFDDGRKTVDLVDEQDVAGLQVGQQCGEIAGTLEHRPGSTLDGNAHFLGDDIRQGRLAQPRRTEDQRMVERLLAAARGMDEQLHLLAHAGLADVVGQLQRANGAVQLLIAFATGNGGYEAIRLDHRAPPRPCPSGPGGSFLRWTNPLPVRLRRHDWLPVA

SEQ ID NO: 29350 - protein, 214 aa, Pseudomonas aeruginosa
SLPHQGELIDMLKIVLLVTGVAALLLSFIPSLRTEATPFLQHPDAIYLAILGLINLLFAPVLQSSHPTRPLQAGAAALLVLGVVLQALILLAPLPTIADQPAIVLPLLSLVLATALQLAGSLKPGKPVSRSASAPAALGGSQDSGNRETGTVKWFNTSKGFGFISRDSGEDIFVHFRAIRGEGHRILIEGQRVEFSVVQRDKGLQAEDVIASRR

SEQ ID NO: 29351 - protein, 574 aa, Pseudomonas aeruginosa
RPKMRTSQYLLSTLKETPADAVVISHQLLLRAGMIRRLASGLYTWLPMGLRVLRKVETIVREEMNAAGALEVLMPAVQPAELWQESGRWEQYGPELLRLKDRHEREFCVGPTHEEVITDLARNELNSYKQLPINFYQIQTKFRDEIRPRFGLMRGREFIMKDAYSFHLSQDSLQQTYDGMYQAYSKIFSRLGLDFRPVQADNGSIGGSGSHEFHVLANSGEDDIVFSDSSDYAANIEKAEAVPRESARGSATEDMRLVDTPNTKTIAALVDGFQLPIEKTIKTLVVHGAEEGTLVALIVRGDHELNEIKAANQPLVASPLVFASEAEIRAAIGAGPGSLGPVNLPIACIVDRSVALMSDFAAGANIEDKHYFGVNWERDLPLPEVADLRNVVEGDPSPDGKGTLVIKRGIEVGHIFQLGTKYSEAMKLSVLSEQGKPVNLIMGCYGIGVSRVVAAAIEQNHDERGILWPSALAPFQIALVPLKYETESVKQATDKLYAELTAAGFEVLLDDRDKKTSPGVKFADMELIGIPHRIVVSDRGLSEGVLEYKGRRDSESQNLPIGELMSFITEKLSR

SEQ ID NO: 29352 - protein, 158 aa, Pseudomonas aeruginosa
AWIYEQQATLVELQGRWCGHRRRRSPGGTHQRRGQAHRTPGSDGRPRRLRRPLRNPGRLQAAGAGIRHRRGGHQAAPGAQPEQARQHRPGPGGDVRQRPGGLRRRAAVLSRLLRHRQAQRRRRRHRSHRHRCRLRTGGLFPGRRRDRRNARHVRRRRL

SEQ ID NO: 29353 - protein, 420 aa, Pseudomonas aeruginosa
PGRLLRRRRGKGRDHRRLQGPGRRRAYRPALLRPALQRLLPDPQDHRGFRRRHRAGPTRRQAAGRPADGADPHLRQAAAATDQADRRGQGHGSHYRRRPAGQHPARPAGQRPGRDRCRQLEPSGGIRLAAGTGQRRRDRDASRTQLRRRHGHLRGPERRRESPGSPACRRRATLADRSHRNLRRGRRARGPEQSEKPLMPKLCNVVVLISGSGSNLQALIDSLRDGATPARIRAVISNRADAYGLERARQAGIQTEVLDHKAYADRESFDQALAQRIDAHEPHLVILAGFMRILSADFVRHYQGRLLNIHPSLLPRHKGLHTHQRALEAGDREHGCSVHFVTEELDGGPLVVQAVIPVESQDTPERLARRVHEEEHRIYPLAMRWFAEGRLRLGEQGALLDGQALPATGHQIRTKEIRNA

SEQ ID NO: 29354 - protein, 98 aa, Pseudomonas aeruginosa
LRCGAQRSEIRRTAMEVKIFDTHVRTRDGRYLHFDVLVTEELGARAGEFARRWLAGRGIDEADISQGHCSYCHSEIATAEVAEAIRLHGHYILPLEGC

SEQ ID NO: 29355 - protein, 320 aa, Pseudomonas aeruginosa
YRRHGKQGMSVSLLVKVTLVGLFVASVLFVHFRGRARLPFLRQLVNHSAWFAPYNSLMYLFSSVPSKPYLDRSRFPELDELKNNWQTIREEALNLFDEGYIRAALNNNEAGFGSFFKKGWKRFYLTWYDGPLPSAQQLCPKTVELVSRIPNVKGAMFTLLPGGSHLNPHRDPFGGSLRYHLGLSTPNSDNCRIYVDGQPYAWRDGEDVMFDETFVHWVKNETEQTRVILFCDIERPLRSRLLTRLNRWISGILGRATAPQNVEGERVGSINQAYSVAIRGGNAIGAQVKRFKRAYPKAYRILRPVLAVILLVILYRWIFG

SEQ ID NO: 29356 - protein, 260 aa, Pseudomonas aeruginosa
QRRQGDRNVIQQRQLLRLLGLGGTLLGLQFFPALLDRRFGQLRRIGLAIEIAIEEYVGVSTDQLAGDAVHHLVESEAILFTSQLAVIDHLEQQVAQFLAQLREIPLLYGVRYFVGFFQGVRDDGRVALLEIPGAAEFGIAQARHEVEQVVESVHGYLGSSVNGPGILPFPETKRPRAACERPWPVSTSPQGVRLRRASMMLGSCETRASRRPRASRPGISMVSCMVAVLSSLFERVFTARTLIRSLSSTWDTSRNRPERS

SEQ ID NO: 29357 - protein, 138 aa, Pseudomonas aeruginosa
TTLRAPRELISRTASNAPSRGGSSSTAVKPCSAQGASASALDRSAWKKCALPRPLASALAPARSTIAATPSTPTTRATRRASGREKLPSPQNRSRTRSSAVGASQSRAWRIIDSFTGALTWTKSPGRYARVSCQSPKE

SEQ ID NO: 29358 - protein, 394 aa, Pseudomonas aeruginosa
AEGSTRHRRSPGSAASAHRRPPWSTTARRAMLSPRPKPLPVRAEDSRVNGRKMVSNWCSATPSPWSSRQSHQQLPSRRPCRRITPPSGECRMALRSRFSRAWASALRLPRTTQSSGRSLRNRSAAQPLSKRAFSTSRSHNAGMEMSSSANTGRSVSIQASSRVLSTSCCMPCTSCSRRSRRSCADSVPSAATCRRASGVRSSWERSRSSWRCNTMCSSSRSAIWSNARPRSPSSSLRRLISACVRAVRSLPRRALACARRRPSGTIQRRYSNTPSSRASPAGTRPWVTRRLAGDKPGGTNSAGRRRTTRPCSGCSGKRRLMNGRDNERELIGQSTPRRKVRRSASSVVSGRLPSDCNRPSSTTTQSSARWRGSASQRSMPSRPSSSQARSARRA

SEQ ID NO: 29359 - protein, 947 aa, Pseudomonas aeruginosa
TARGKRMAGERRPSRSGSTERRVFKDLGIKGRVLLLTLLPTSLLAMVLGGYFTWVQLSDMRAQLIERGQLIAEQLAPLAATALARKDTAVLNRIANEALDQPDVRAVTFLDARQERLAHAGPSMLTVAPAGDASHLSMSTELDTTHFLLPVLGRHHSLSGATEPDDERVLGWVELELSHHGTLLRGYRSLFTSLLLIAAGLGVTALLALRMSRAINAPLELISQGVAQLKEGRMETRLPPMGSNELDELASGINRMAETLQSAQEEMQHNIDQATEDVRQNLETIEIQNIELDLARKEALEASRIKSEFLANMSHEIRTPLNGILGFTNLLQKSELSPRQQEYLTTIQKSAESLLGIINEILDFSKIEAGKLVLENLPFNLRDLIQDALTMLAPAAHEKQLELVSLVYRDTPIQLQGDPQRLKQILTNLVGNAIKFTQGGTVAVRAMLEDESDDRAQLRISVQDTGIGLSEEDQQALFKAFSQADNSLSRQAGGTGLGLVISKRLIEQMGGEIGVDSTPGEGAEFWISLSLPKSRDDNEEPGASWAAGQRVALLEPQELTRRSLHHQLTDFGLEVSEFADLDSLQESLRNPPPGQLPISLAVLGVSAAIHPPEELSQSFWEFERLGCKTLVLCPTTEQAQYHATLPDEQVEAKPACTRKLQRKLQELLQVRPTRSDKPHAMVSGRPPRLLCVDDNPANLLLVQTLLSDLGAQVTAVDSGYAALEVVQRERFDLVFMDVQMPGMDGRQATEAIRRWEAEREVSPVPVIALTAHALSNEKRALLQAGMDDYLTKPIDEQQLAQVVLKWTGLSLGQSLASMSRAPQLGQLSVLDPEEGLRLAAGKADLAADMLAMLLASLAADRQAIRQARDNDDRTALLERVHRLHGATRYCGVPQLRAACQTSETLLKQNDPAAAAALDELDKAIEALADTASATTHLSSTSLDSSEL

SEQ ID NO: 29360 - protein, 664 aa, Pseudomonas aeruginosa
HPFHSRLTTTSLGFRILARRRLMFAPPSTETLNRFFLLSWLVVLWQVLRLQDGIVFDDAWLPLWSVAASLSYAFLYIVPVYLACRLLLHFHDRLPVRLSPWLAGVLAIVGSAAVQILLYADRTLYDLYGFHLNGFSIGLLVSPGGLSSLGSGDGTLLSASLAALALLCLQVLLYSACQVSRERLPALPRRAWRYLLAAFLCLALGERLAYAFSSLRDYRPILLASERYPLYLPLTVRSLARSLGIQPTPTQRELLQQQSDLHYPLRPLEISAPAHPLNIVWIVAESLRGDMLDPRYMPRLWDFSNRAIRLDNHYSSGNLTQMGVFGMFYGLHGGYWDAVLKAGQPPVLMEVLRQQNYQFRINAAQRFSYPPFDRSVFVNLRPQDLHVLDSPEPAWQRDARNTDDLLRFVDRRLPDRPFFACLFLESSHANYSFRDETAKIRPYLVNFNYLTTDFQAQMPLIKNRYLNAVREVDTQIGRLLQHLENQHLLENTAVVVLGDHGEEFMERSRWGHNTEFNRYQTGTVAVLSIPGQAPRAVRGITSHIDLPATLLPLLGVHNPPRDYSLGQDLLAADYHRDYAVSADTTRIAYLGEGFKVSFPLRGADRHHGPVSDGDDRPLDVEQQEAIRGPLRAARLELLQDLGRFSALPVGEEPSPRNLATSLTP

SEQ ID NO: 29361 - protein, 366 aa, Pseudomonas aeruginosa
GASEQPELFVGALQVEQAHADADQAHRTIATGKGLAEQLPVALQVAPGAGLFHRGLGEIVKLQFHERLVRPITAIQALQASVQLLEQGRQFLQASRQVRQVAIEGTFDAHRLAPAVDFHRSLVDTMGQPPQAFAEAAELAHQTQLAALAQVGAGADAHPRQALRRDLADAMQLGHRQLGDEPVDLLRGNHEQPVRLAPVAGDLGQELVRRDARRNGDVQLLGHPAADVLGNPRGATGEMRRSADVQVGLVQRKRLDQIGIIAEDRMDLLRHRPVDIETRAHHQQIGTQLERRAHGHRRAHAIGSRLVAASGDHSALVRRTANRQRLAAQAGVVAHLEGGIETVAVYMDDFPHRNLATSPAGPAPER

SEQ ID NO: 29362 - protein, 913 aa, Pseudomonas aeruginosa
QDAAPHRKNLLRPLGNSPERPYSVAQIPMRWLMRTDAPVPEHPAPPSSPASPQRIRLIDRITAYRQPIGLVFTLLLFGLALVACYHLLREIDPGALHDAIADVPRPALLGALSATTLGFVILLGYEWSASRFAGVTLPMRSLATGGFSAFAIGNAVGLSLLSGGSVRYRLYSRHGIGAAEIARMTLFASLSLGCALPVLAALAALCDLDDAASALHLPRALVAVIAIAVLSLAVGLVAFLARHRLPGERPSPDSLLVRLGRRSLRLPGLRLSLLQLLITALDVAAAATVLYLLLPETPPFAAFLLVYLLALAAGVLSHVPGGVGVFEAVLLAAFAGQLGAAPLAAALLLYRLIYVVLPLLLACLLLLFLEARRLWVTRQAIRVASGFAAPILAILVFLSGVVLLFSGATPAIDTRLEHLGFLIPHRLIDASHLVASLIGVLCLLLAQGLRRRLSAAWALTLVLLLVGALLSLLKGFDWEEASLLSLTAALLAMFRRSFYRPSRLMEVPFSPLYVGASICVVGASVWLLLFANQDVHYSNQLWWQFALDADAPRALRAALGSCLLLLALALGWLLRAAPPAIREPNAEELQRAARIIRHSDQPDGGLALTGDKALLFHESDDAFLMYARRGRSMIALYDPIGPAMQRAELIWQFRDLCELHHARPVFYQVRAENLPFYMDIGLTALKLGEEARVDLLRFDLENKGKEMKDLRYTWNRGQRDGLALEFHEPGQAPLDELKAISDAWLGGKQVREKGFSLGRFTPAYLNFFRIAIVRHQGKPVAFANLLETDSRELASLDLMRVHPDAPKLTMEFLMLGLILHYKAQGHARFSLGMVPLAGLQPRRGAPLTQRLGALVFRRGEQFYNFQGLRRFKDKFQPDWEPRYLAVPAGLDPLVALADTAALIAGGLTGLVKR

SEQ ID NO: 29363 - protein, 310 aa, Pseudomonas aeruginosa
YVCRETSLAPFSGRRPGADRRCRPAALEPTGGPGETGSPGPRRRRPRHPCRTRREAALAGGGDRRPRTATERRPDAEPGSRQRRPGDPVLPSGKRRLQGAAVPARSGHCPPRRQAEPGRRHRPGLDHRLALARQPGRRQGQGALGRLRHCPGRARLRRPAAAPGVARPVAAGLERQPGRRHRSLRPQAVERGNQHQRLRHPAVRRARPSVAPATARQRRGPAGTRGPRGATLGHRHPVLFRRRRLARPGQGLCRAYGQHGLPGGRHRHPALLLATQEPGTERRRPLQADATLPREVGRETFRPGRLLVRR

SEQ ID NO: 29364 - protein, 170 aa, Pseudomonas aeruginosa
RAPPRGAFSSPTVPESTMLNNDVLRSLRYLLDLPDAHLAELAAPFGEQVEADLLEAYLKKEDEDGFQACPDRYLARCLDGLIIQRRGRDESRPLPPLELPLSNNMILKKLRVAFELKEEDLHAILDSVDFPVSKPELSALFRKPGHSNYRTCGDQLLRNFLKGLTLRVRG

SEQ ID NO: 29365 - protein, 213 aa, Pseudomonas aeruginosa
TRGATAGGSAPGAALRRPLVPGVPPGSRRPDHPRPRPRQPAHLARRVRRSRRPAPARRCRPAGILASLCGIRGLAVPGRARRLAGPGMPSRGLRRPRDQGRRRVFRQWRRSLPERAVLVATEGFPADLTAMKKAARGRLLAWRSGYIRKIVARPRKMKKPPLSVIAVIITLEPIAGSRPKRCRVIGISTPIIAASSRFRVIAAVITTPSSQLP

SEQ ID NO: 29366 - protein, 154 aa, Pseudomonas aeruginosa
KATTPITPPHARPLTSATPSSLRSRRLRLLLVGCTWSSAMARTIMVMVWLPELPPMPATIGISAASATSFSMEPSNRPITREATKAVIRLVASQAQRLRTDFQTEAKISSSSRRPAMLRTSLSLSSRIRSTISSMVRRPISLPPLSTTGAEIRS

SEQ ID NO: 29367 - protein, 248 aa, Pseudomonas aeruginosa
VHGGVPRALSGQIRIMITLRLRFARYKMAARTSACGTKFIVTRRLTATPEISLRTLGPAEKGNALACTHPYPTRSAAHAFPVPPSPPLAGVHLRGRCGIPLRRRQRPCQLHPTRLPRRAGRRDRRGGQPAAGRQERHADGRDEDEKGVHRPEKRAARGDRRKRRSLRQTPGREGTPQGDRGAADNGGNDPLRCGAGAGQAGPGQREQCGGALSVQGRQATGSEKRELRSGGMCEGKRRYRVERVDPGS

SEQ ID NO: 29368 - protein, 1048 aa, Pseudomonas aeruginosa
KFLPNGQKRQKARGCRAFRLPASLTLSRRRVELERRVQGTYRQFQVLLFDHHGNLDFRGGDHLDVDAFLGQRLEHAAGHAGVRTHADADDGNLGDVGVADGFARADVGGGLLEDFQGVQVIVAMHREGEVGGVIVRHVLHDHVDFHIGGTDRPEDLEGHAGGIGYATDGQLGFVAVEGDAGDDRLFHGFLFIIDSNEGARTLLEAVQHAQRNVVLAGELDRPDLQHLGTEAGHFQHFLEGDLVQPTGLRHYARIGGVDAVDVGVDLAFVGLQRRRQGHPGGIGTAAAQRGDVAVAVDALETGDHHYPAGLEVGADVGVVDVQDARLGVRTVGEDTHLVAGIGDRRHAALDQGHAEQGDGHLLSGRDHDVQFARNRLLHDLVGQADQTVGLAAHGGYHHDDVIARFAEFLHLLGHLLDTLDGADGGPSKLLYDQSHFKPPDSVKGALLNLPHSFATRTGGAHRRPGIKGRWPPGPASLWRGAGMASEPLLDEALGQGQGLVQFRCIGAAALGHIRASATFATNCRRGLLHKLAGLQLAGQVLGHACDQYDLPVQLAAEQDHCAAELVLQLVDQRQQRLAVQTIEARGEYLRALDFHRRRRKVVAGRAGSLGLELFQLLLQRAVALQQGAELVQQVVAAALDQAGGFLELLLGTVQVGQRRRAGDRLDTAYAGSHATLAGDLEQADVAGAGYVGATAQLDGEIAAHAQYAHLVAVLLAEQRHGALSLGGVDIGFLGLDLGVATDFGVDDILQGLQLFRLDRLEVAEVETQALAVHQRALLLYVVAQYLAQRGMQQVGRGVVERGGLAYRSVDLGLDRAADAQVAPGDHAMVQVRAASLGGIAHVEAHASRLEVATVADLAAGLGVERRLVEDHDALLALLQALDGLAVPEQRDDLPGAGDALIAEEAGLAVDLDQAVVVHAEGAGSAGALALGLHLALEAVLVDGQLALAGDVIGQVDREAIGVVQLEHHVAGNHAALQFGEVLFEDLQGLAPGSWRTVLPRSSARARCVPAVASARGRHRPSRRPALRRSCGRRCPWRPACCRGGRRGG

SEQ ID NO: 29369 - protein, 119 aa, Pseudomonas aeruginosa
PSSRSPSPRRAALAWSSARRATWWSRAYRPAAANRPAWRIPPPTILRQRRALPISSTLPQSTEPTGAPRPLDRHTDTESKCRVISLASTPSFTAALYRRAPSRCRARPRARVKARAAAR

SEQ ID NO: 29370 - protein, 157 aa, Pseudomonas aeruginosa
TGRTSPRPPPRPGRAARRWRGSGRRGGPACRAVRQGPSRYRGRRPRDGTAPRHCPPRSHRCGTRPGRSPPGSVERRPLRPRSARADARRPGRLPGSGAPDSVAAPGSDCRRRCDRRRRTPRRHRHSPCRSACGWPRLRRRTGSLPAAPRDGRNAARR

SEQ ID NO: 29371 - protein, 355 aa, Pseudomonas aeruginosa
ADPGSQGGRKGHAGAFQRGDRIGAVIGGVVGARPVVAGRADTAERRAAGGAGELLVPVDDAGAAFHEELLETLAGIRQQPGGQAVLGGVGFTDRRSEIGVADHLQQRPEELFVRSLGHRADVEDARGQQGGAVDRLGHRQQRLCALADQMLLGLEQVLGGAQRNHRAHERRRLFVEATDPQGSADRHQARQQCVAPGALRHQQAAGAGATLACGDEGGLDDGVDGGVEVGDLLHHQRVVAAHLQRQDFLRLAAKLAVQQVAGATGPGEEQTVEPTVGGQRDAGFATALDQVEHAGRQAGLDPGLERQLGDLRGQLAGLEHHAVTGQQRRDDMPVGQVAGEIVGTEYCHHAMRLVP

SEQ ID NO: 29372 - protein, 579 aa, Pseudomonas aeruginosa
HGGSVGQRTGFLASALAERLHRDRHLVDHAGHFGGRLPQRLAGFLADHSGQLVGAGLEGRSEALEQLDALLQRAPRPGREGLAGGAHGSVDLGDVSAAPGPDHALANRVEGLQGLALARQPLAGNVMGTHHRLLGRPRRDASIRLSTALLRRQRHRAYRGAGRQAQALGSQRIDHQGAGGGPRRRGGDATVFALAVVDQVGLGVVAGSAHRQHQVLALGDGADLVGLGLDRRAGVEDVDVALVAEALGLEHGQRRLGVRMDAADHPARLLGEEAGIERELRHQLGDEGLVADPGEVVGLGEFHLEEVPAEAFPEWRTPLLVGHAAHLGDQLVAEQVTEFGDEQEARARQQLAVEAAAVVGVEEQRAQLGIAGQVVGQEQRGDLAMDVEFLRGAHGEADPVVVPGFAKPHRSGDGGDADDLAGVVLEDEQVVGVAAFGLAAEGLLGPADAMLQALLVGRQGGQAGAGAARQLDQGRQVGAGNRTYDHDWLLQTATRRTLAPSPTPRASAASTLRATGLPGAQSRSSTTARKSCNWPLVTRYGRPLFGASPIFTGTTRLWAIERIPEVRACRVGPPSKMSM

SEQ ID NO: 29373 - protein, 240 aa, Pseudomonas aeruginosa
LTSAANEASEARILSRRRSASSGKDVTPTGLSAARRCTCGRSAAWAGRITNMASLLSQTTMIAASMRGTAAPSCATVSNVQQGRSRATHGGTVPGSGAGRSGMSHRVPRPAPGPRGFAQPRTSLATARSKRSRPSSISASSITRLGAKRTTSGLAWSTMTASFSAALSTSLALPFHSSVSAAPISRPMPRISSKMPYSWPIFCRRDLKRSCLAFTPSSTSGVLITSSAASATADASGLPP

SEQ ID NO: 29374 - protein, 147 aa, Pseudomonas aeruginosa
GLGPGRHCRHATTCYSANPGISAAFGNATESIGKAQCKRAMHSGAYFFYAAPRAGTAGKQAMPIEGIDYRLVFASDVNPRDGLGLECWRGEQPLFEVFRDDVGRRFVVNLFASDVPLELLETIIPTARRELGDFPRRSTSRGVAKPG

SEQ ID NO: 29375 - protein, 260 aa, Pseudomonas aeruginosa
SGRLSQMTEKSKITIGPLDSQFRGFHADRIAAFEQAQQQQRHAGHQQVQAGHGEVVGERLAGRIGGLLGLEHHVLQADHGNQRGGLDQHQPVVGEAGDRQADHLRHLDAEEHLAVAHAVGVAGLALALGNRHEGAAEGLREIGAEDEAEGADAGHEGIQVDVVVVAELRGDPVQQALAAVEDQQDQHQVGDAAHYRGVQVAAPGQPAHRRQAEGRAQQAEDDGQEHGKQGQLESQPGAIDDGRTVASDHQNGTSMQLMQR

SEQ ID NO: 29376 - protein, 221 aa, Pseudomonas aeruginosa
VTRIRNSSRIISHGSAARMVAPSGMPVTAEVTNRLRPTGGCTRPISMFTTMTMPRWIGSMPSFMAMGKKIGARISTIAEGSMKLPATSSTTLTISRKPIGVRPSCTTHSVICWGICSVVNTWAKSMALAMMNISMMLSRPDSSSTLGQSRRRMSLYTNSATKAEYTAATAAASVGVNSPEYMPPRMITSNNRPQPARRAAASHSRKLARGCAGSFLTRATM

SEQ ID NO: 29377 - protein, 76 aa, Pseudomonas aeruginosa
PERTMPATAIEPTAATVAGDEPDSAANSMQASTAAIARPPRICPTQALAKSIRRRATPPVVMNAPESRKNGIASRV

SEQ ID NO: 29378 - protein, 205 aa, Pseudomonas aeruginosa
SSPRSVRRRPVPGGAGPCRRRPATRARSAGRASPCRRRRRGMAHRGRWSSAKRRRAAAAARPGRRSTSGSPSTPPGSPASTRRCGCPRRCARAAAGPKGCCCRRTCRRRYRRSNSRPWPSRSARRRRSPKGSRPRSGSAGRRPSSSRRDRLRRSRRYRRRSVAGSARATPRRTGPGARRRPARGSAPARRRRPAASPATAAPRPA

SEQ ID NO: 29379 - protein, 403 aa, Pseudomonas aeruginosa
APGGRDGRSAWAAPASERARQFEQVLGHVGQDQVGGDRRHLVQAGLAELALDVVLAGEAEAAVGLQAGVGRLPGSFRRQVLGHVRAGPGVEPGVVLLAGAPAHQVGGLHFDVRLGDGELHALVLPYRPAEDHAVAGIVAGLVDEPAAVADAFGGDQGALGIEAVEDVAEALAFLADQAIGGDLQVVEEQLVGLVVDHVGDRLHGQALADGLAQVDEEDRHAFGLALHLGQRRGARQQDHQVGVLDPRDPHLLPVDHIAVALAHGGGLDLGGIGAGGRLGHPHRLQAQLAAGQLRQVEALLRLAAVTQQREHVVHLPVHGAGVAAAAVDFLQDHRGLGQAQTGTAVLLRDHRREPAGVGQGLDEGLGKTALLIDAAPVGGVEFGAEGTYTLADRVQLFAVRIHR

SEQ ID NO: 29380 - protein, 87 aa, Pseudomonas aeruginosa
RASSPSTAATPPGISASSPIPPRSPNSFRKSSPASSPLVPGSPSTCRNASAATLSAACWTAPPTSASSPGRWRPPACRSCISAPTAW

SEQ ID NO: 29381 - protein, 409 aa, Pseudomonas aeruginosa
SRSCRGWETACRADNAPGVVRGAPENRRTTARRLSALRLPTSRGAIVAKGAAHHSRSVRQPTALRQAVLVRGEHRRHVLAEELDPGADLRIQVLPRGVEGVDVEMEQAIARQHPHQAAVLQAVDRRVHRQRADTHAGDHRLGHGVGGVDLEMRLVDAGQFLAVGTVEQPAVQRHHRVHQAQATVRGQLRRQLGEAMRGNVARRGAEDAVGLADALGDETGVRQLGGDHHGNVVAFVENVGDPVGQGQVEANLRVGLAILRDGLDQVVLADAGHRVDLQRARRPRMGVARLSLGLLDVGEYLLGAHQVALPGFGQRDAPGGAMQQAGLQVGLQLGHRTGDIGGRQVQALGGGSETAGLRDADERAHIEQDIHHGPLGSDAYGASLFHATRRTPQGGADSVTSQPTYYCLL

SEQ ID NO: 29382 - protein, 765 aa, Pseudomonas aeruginosa
QKFFTYPSSYPQARALLEFPAVSASPRRRSGFAAVPRATRKGLPLVPPAPLAFFPSPDELRRALLEWARSDGVAWVFVFKALLTASLALWLAYRLELPQPSTVLVTVFIVMQTQSGQVLAKSFYRIVGTLIGLSVMVTLIALFAQERVLFLACLALWVGLCTAGAARYRDFRGYACVLAGYTATMIGIPATAHPEGAFMAALWRVLEISLGILCTGTVSAIFLPQTSGAALRNTLYGRFRDFAGFAAEGLQGSLDGERFGELSARFVAQSVGLENLRSATTFEDPHMRLRSGRLIRLNNEFMVMTSRFHGLHRLLERLRGRGAQNVLEVLAPCLAELAGLLAPIRERTPTDADAARLAERIEAYKPELMQNIRQARQRLVEQRPGENDLLDFNTAAELAFRFTDDLHNYALTHASLAEHHHAREQWKESFVARANPVAALVAGARSALMIGLLGTFWIQTSWPHGGTFALTAVLISALSSTSPNPGRLSLQLTLGTLAGACTGLFVLLYLLPHVDGFPMLLCCLLPVFAVGALLLWRPQWNGYGVGLLVWFCFASLPANMARYDALAFFNEYLALLLSMVLATVAAMVILPPNRPWMWKRLEHDLRERVVFAISGKSKGLVSGFESGTRDLLNQAYTFSAGRPDVQRRLLGWMFLVLEVGQAIIELRLEQQRLPQEPCYAERTAWRRAIRLMGRALIRLFLQPGPSNRQRALHAVNQAIMAVRAAPEPRAPQFDTSPLRRVLSYLHFIRSALLDPQSPLGQERNP

SEQ ID NO: 29383 - protein, 86 aa, Pseudomonas aeruginosa
RSWRNSPLAQSSDRSTWVAQITRTSRYTSSSLPTRRKQPSCRKRNSLACRRGLISPTPSRNSVPPAVSSSRPSLPSGRAPSKAPGP

SEQ ID NO: 29384 - protein, 308 aa, Pseudomonas aeruginosa
GKLYENADSSPLPGPYPGLHGPSRRGIDKATTTTKTPRPQAAHGVRMKTTQYVARQPDDNGFIHYPETEHQVWNTLITRQLKVIEGRACQEYLDGIEQLGLPHDRIPQLDEINRVLQATTGWRVARVPALIPFQTFFELLASQQFPVATFIRTPEELDYLQEPDIFHEIFGHCPLLTNPWFAEFTHTYGKLGLKASKEERVFLARLYWMTIEFGLVETDQGKRIYGGGILSSPKETVYSLSDEPLHQAFNPLEAMRTPYRIDILQPLYFVLPDLKRLFQLAQEDIMALVHEAMRLGLHAPLFPPKQAA

SEQ ID NO: 29385 - protein, 354 aa, Pseudomonas aeruginosa
KKSCGPPGHAKERSPLLCAPAPHRSLGDRLHPQARHRPRGSLESVAGPHHQQPDRDGIDRDLDAGDQQHDAEDEHHEGHAQVVAVRIPERAEVRAGALAVHLRAELQVRHADHRPVDHQRRHHQRHQQLQRLVRDHIVHHHREEGHQRRYHQGAYRYAALVDPGQRARGIALLGQAEKHAAVAIGAAVVHRQCGGEHHEVQQVRGGAAADHREDLHERAAAVGIAGSVEGLQQAVPGRQREQHDQGADVEDQDAIDHLVDRLRDHRPRLVRLGRGEAEHFQATEGEHDDRHGHHQSAHSVGEETAVCPEVAHRSLRTAAAAEQQVAAEQDHADDRHHLDDREPELGFAEGLDVG

SEQ ID NO: 29386 - protein, 142 aa, Pseudomonas aeruginosa
VDRVDDDEEQRRRGPGRHLRPPVVDVLADRGQFRHPDQDVQHPAVPAGEEAGEAAPVLVREVAEGAGDRLLDDHLAELAHDHESDEAGDGVAEDHRRARRLEHPGRAEEQAGADGAAEGDQLDVTILQAALELARMRMLAVH

SEQ ID NO: 29387 - protein, 465 aa, Pseudomonas aeruginosa
REWAARLVARRCGQGWRDRRRWNGNAERKENRQPRNRLAAAGSDHAAANLIFLDGLEQGLEIALAETLVALALDDLEEDRADHRVGEDLQQDAVVARGAVDQQVQFAQLLERLAMPGDAGVDLLVVGVRGRHELHAVVAQLAHGGIDVVGGQGDVLDAFAMVFADEFLDLRGIVGRFVDRDADLPARCGHGAGEQAGELAFDVEVANLAEVGDALVETGPDVHLAALDVVGQVVDVGQADRVVVGAAAFDELEVDVIDAAVAVAVDEIQQRTADAFQAGDVQLAEVGVAAHQLGTLGFGVGGGLGSVLHPEGHGAGARAVLEGEFVDMPGRAAVEHDVDIVLLEQEDFLGTMLGGFGEAHHVEQLAQLLDALGVGGGELDEFESVGTDGIVLFDLGHGVHPASSLFLLNGPPPVQAAGDMGDAFISPRGGAADKPSAGPGAGPGAGFLATIPYAPAACMANARSS

SEQ ID NO: 29388 - protein, 272 aa, Pseudomonas aeruginosa
PASFLRDGIPMARPAPPDLSDSRRPLRGVARRYPAGHRVDAHEHAWGQVLYAVSGMMWLETPDEALPVPPQRAVWLPPGLRHAVRVASELQMRNIYLSPELSRGLEDRTLVLVVGPLLRELIVSLVEQERQSDPDYYRALADLAVLELGRARRSSLRVPLPDASDRRLLALCQAVMANPSLDIGLERLAEDAGASVRTLSRLFQRSLGMGFADWRRQVQLATAAAALIDGRPVAGIAHALGYTPSAFSDMFRRELGVSPTEYRAEHHQPFQP

SEQ ID NO: 29389 - protein, 381 aa, Pseudomonas aeruginosa
SPSASACWSARSTPSSTSARRRPPPSPWSACLACSSANSFSPLAATCCSSGCTDRRDDTEPPMKALQFDRTGDLAALELVDMPDPLPAADEVRVEIRAAGLNPSDVKNVLGRFPYTTLPRVPGRDFAGVVVEGPKALLGQAVWGTGREPGFFRDGSHAQFLTLPAAGVALKPESLSFAQAASCGVPYSTAWDALQRSQVKAGTRLLVIGANGAVGKAALALAKALGAEAIGAMRREEQRQALETQGIAALLLGEPAELAAQVEGIFPGGAEVIFDTTGFWLEAAVPALAAFGRLAIIAAPADGHVRLPALNLYRRGGSVVGINSLLYGVEACAGFLDAFGKLFDQGRLPLPDGLREVPLEQGVEQYRAVNEGTCEKIILVP

SEQ ID NO: 29390 - protein, 438 aa, Pseudomonas aeruginosa
GWVDVSVGPDILRLSSKSAQARRRISGESYPAPARSMPSTISSVVGTCRLPSAAGMLASACHMDVLDERNRRRYPRRIAPAPAQPLRRPRPARSPGGRLVRPAAGALPHPRPLRPAQALEPLVHRQPRLDALADHRRPRLPDLRRRLFPRPGQRPGGSAHADPLLRPRLPVARRAAGQPCLRASPPAIALRRTARAPARHRPGPGPRWPAAGAGAGSATTVAPGVGEPGGADGRTHLPCLQPPARPADQRLPAARPPALRLPGGPELCRAGLRPRRLAAAYLLDPRRLRRPRRHRRQLRHRLDRSQRPARERPVVRRQAQPRARRRAHPRASRPAGRMAPGQRLRSRRAALPSRTAAPGAAQRRPVLCQYPPVVRPFQRHPAPRRRRLRAGGRRPRLDRFDPRALVRPAAGNLFPTRSAAKNAHEEATAAEPKAGAKA

SEQ ID NO: 29391 - protein, 474 aa, Pseudomonas aeruginosa
TAGYAPWRTLMSRTETDSLGTIEVPDDAYWGAQTQRSLENFAIGGQRMPLAVIHALALIKKAAARVNDHLGELPPEVARLIEQAADEVLAGRHDEHFPLVVWQTGSGTQTNMNVNEVIAGRANELAGNPRGGKSPVHPNDHVNRAQSSNDSFPTAMHIAAAKAVHEQLLPAIAELSGGLAEQSARHASLVKTGRTHLMDATPITFGQELSAFVAQLDYAERAIRAALPAVYQLAQGGTAVGTGLNAPKGFADAIAAEIAAESGLPFVAAPNKFAALAGHEPLVILSGALKSLAVALMKIANDLRLLGSGPRAGFAEVKLPANEPGSSIMPGKVNPTQCEALSMLACQVMGNDSTISFAASQGHLQLNVFKPVIVYNLLESIRLLADGCRNFNKHCVAGLEPDAQRMADLLERGLMLVTALNPHIGYDKAAEIAKKAYAEGTTLRAAALQLGYLDEAQFDEWVRPEQMLEAGHHG

SEQ ID NO: 29392 - protein, 487 aa, Pseudomonas aeruginosa
NRQDRRHPAGRRRQAHPADRRLAQAQELLPPARRMLRPGRAQQGSRGARTEAGRAGLRPDPPRRLRTEPGARTRPAGSAAADPLGRAPGVRLPGLVGRPAGVAAGLLRPRPAAGLRLPLPRHPGQGLGATAGRAQRRPAGLPRPAAVAAALPQGPAGAPADGAQRARRLWHRHPPPGRVRADAQFQRGTAPGLAASRRTARQPGLVPFPPGCGRARTLIVLTGPPPSRRLPFPAPMAALCLPLPAHSAGADRFAFRDIHQEWVANLTGPSHLVGTSNRHRGLGSARFEMNPVLEKRTCHETLLSHPGTPATHPRPVPAPGSPCPRLDGNAAQSGLRLLPRRSGESQVGRLQGRRRRRRHPGAVRLEWRQPGQRQRQPPGGGPRRPALRRRQGTVQGPEPGSQRLAQHCHRAGRQRQLPVRLQGQRAARDPLLRLLHHQGRLQPREAAGLERPGTRAVLLDHQRQAGERHLPDELPAAPGQDRQACDL

SEQ ID NO: 29393 - protein, 331 aa, Pseudomonas aeruginosa
AGPTTSTGKPRMPFSLAALQQAAAIVHQSLPPTPQIRWPLLCEALGCEVWMKHENHLPVGAFKLRGGLVYFHHLAHQGERPAAVISATRGNHGQSVAFSASRYGIQPIIVVPHGNSREKNAAMRSLGAELIEHGEDFQASREYAAERARREGLHLIPAFHPWLVAGVASYSLELFAALADLDELYVPIGMGSGICGLIAARDALGLKTRIVGVVSAHAPAYALSFEAGTAISHPVDTRLADGMACSTPDPSALEMILAGADRLVRVSDREIGAAMRLCFTSTHNVAEGAGVAALAAAWQERERLKGLKVGLILSGANVDREVFAEQLAAGD

SEQ ID NO: 29394 - protein, 261 aa, Pseudomonas aeruginosa
KRGHQSTWGRLGRSGRPGKRSAGQISRPASGSQCLGVLGQVRGHALGDRLHAFLALAPAGRADLAVFLGELQGLDQAHHLVHLAPQRQIVHHLVLDHPGAVDQERSTQGHAVLVLDAVGAGDLVLDVGDHGELDRTDAALLHRRAAPGVMGELRVDGDTDHLDAQLAELIHAVVVGDDFRGADESEVERPEEQYDVLAAQAGKLEGIDDGTVAEDRGGSEIGGLLVDQYAHREAPRRLGCARRRQAPGRICSAGYPATTMH

SEQ ID NO: 29395 - protein, 759 aa, Pseudomonas aeruginosa
RAGEGRDPRRLLPRPGTPGQPPRTDAGRPATDAQHRHRLHLEAAAQPQRQYPQPGPAQPTAVHRRTCPAGLGAVPEFQRRAAAALRHHQETPALHPGREGHQLLPRRLPAGRAGRFPGRLPGPGAVGPAPGPTAQPGGRRSRTQRPLDTPERLRQRRAGTTGGRDEPDARAPGTQRGARPGDPPVDARRLLRNGRRRRDPHRQPRALPTARPDARNADRPSLLRTARRRRPGACPPTLPARHAERRRQDLRHPPAARRRQPRLLRGHGFADPRPAGRTTGLPRHRPRRQRPDRLPAAIAGNGLPRPADRPGQPQGLRRTARPGVASRRLRRKRTGAAVPGPGPLQGGQRPLRPRHRRCPPQDRRRTGTQHPAAAGQGLPPGRRRIRRAPRGQPGKQSAAPRRTPAGGAGPTDRAEWRTHRLRHPEHRHRSLPAACRRCRRTGPCRRQRHVRGQAPAQPLLPVPGASLKCAVKQALSRAFASLLRFQPASHRRTIPYASPERPAIPRRRPEADHASRPAPVRADPPDPQPAGVRPADRLRDAAVQPLGRPADAQPARLAELPAVHRLAVVRPAGAGDRVLHLHHGRQHHLRAVQRLPLGKGRGGGSRPRRLPAVQLGRTAGDDPAHHGSRDAQARLLPAARAGAAGAELRARGQPDRHAAVDPLRHLDDGGAVHRLSGGQPQARLERDARLAAQQALGVHGFRRGDLPGAADPAGQPGHDARRRRRRHPVLGPRGRREGAGEISMRPVSAVGIVRRASAP

SEQ ID NO: 29396 - protein, 686 aa, Pseudomonas aeruginosa
PPSPARPAAENKKRVAMSRSAFTALLLSCVLLALSMPARADDLPYRFGLGKADITGEAAEVGMMGYSSLEQKTAGIHMRQWARAFVIEEAASGRRLVYVNTDLGMIFQAVHLKVLARLKAKYPGVYDENNVMLAATHTHSGPGGFSHYAMYNLSVLGFQEKTFNAIVDGIVRSIERAQARLQPGRLFYGSGELRNASRNRSLLSHLKNPDIAGYEDGIDPQMSVLSFVDANGELAGAISWFPVHSTSMTNANHLISPDNKGYASYHWEHDVSRKSGFVAAFAQTNAGNLSPNLNLKPGSGPFDNEFDNTREIGLRQFAKAYEIAGQAQEEVLGELDSRFRFVDFTRLPIRPEFTDGQPRQLCTAAIGTSLAAGSTEDGPGPLGLEEGNNPFLSALGGLLTGVPPQELVQCQAEKTILADTGNKKPYPWTPTVLPIQMFRIGQLELLGAPAEFTVMAGVRIRRAVQAASEAAGIRHVVFNGYANAYASYVTTREEYAAQEYEGGSTLYGPWTQAAYQQLFVDMAVALRERLPVETSAIAPDLSCCQMNFQTGVVADDPYIGKSFGDVLQQPRESYRIGDKVTVAFVTGHPKNDLRTEKTFLEVVNIGKDGKQTPVTVATDNDWDTQYRWERVGISASKATINWSIPPGTEPGHYYIRHYGNAKNFWTQKISEIGGSTRSFEVLGTTP

SEQ ID NO: 29397 - protein, 263 aa, Pseudomonas aeruginosa
SVAVTQQPGLVRPQRDRQQYGSQLSPPPGRTRRDRQAEQERSIARHRSDLKRGVHRMRPTLTWTLLALLLCGTAIGAVLLLYPSEPAPVAPFASPPQATPAAKPSIPSRAPEMNTATAPDNLEQQLGEFGRNAGQMSEIERKQAAEGLIEQLKREVAVGADPRQTFEEIQRLTPYVEADARRREALDFEIWMALKDNASVQQQAPTPGEEEQLREYAQESDKVIAEVLASVDDEEQRHAAIDERLKALRKQIFGEENPRLLQR

SEQ ID NO: 29398 - protein, 446 aa, Pseudomonas aeruginosa
NPRRPDRGAVTQASPKLHIRYTASVDTDVMSRPLSIALISETYPPEVNGVANTLGRLHAGLQQLGHRVQVVRPRQPGDDGRRSDAELVLTRGWPLPGYPGLQWGMSSLHKLLRCWKRQRPDVLYIATEGPLGFSALRAARRLGIPAVSGFHTNFQQYSEHYGFGPLTRLVTGYLRWFHNRTQMTLVPSGSQRMELAAARFRTSQPALPRGRQPTLPSLPARSRTTPALGPGRTGHRRAARRPAGGREEPRPARRHLPRALRRPSAAEAAPGTGGRRAGAQAPRTGPARSAVLRRPARRNPGRPLRLGRPVPLPKPVGDLRQRGPRSPGRRPRGGRLRPGRRRPAHPPWAQRRARRAGRQERLRRSRQLAAGRPGTPAPGPSQRPPTRQPARLGQYRRALPELPGRRLRQSAGPARSVEARAAAGRGWRGLATQPRVALRQRLSAWR

SEQ ID NO: 29399 - protein, 244 aa, Pseudomonas aeruginosa
SGARQERKRRDANASRGRSTQGLLDGLHQGRVVRRRARAETRQHATVGTEQEFLEVPGDVAGKLRALARQQAIERMPRAAVDLDLGAHREADAIVQAAEGLDIRLAARLLPGELVAGHAEHRETALAVGLVEILQAGVLGCQAAFGGDIDHQQHLALERGKRQVLSIQPLQGEIVKGTHDVLLAHSATQRAKPRTGQEPWLRRIPRDGVKSPGMAHDAKGAHRRLSLYQLSSSAGGRPRPSIGE

SEQ ID NO: 29400 - protein, 245 aa, Pseudomonas aeruginosa
AWRAPLRFPRHQPPLRQPPRRGNGRVGGRRQQLAQRPPRQRQFDLRHRQRPEPRHQHGPDPAGRPGNGHPQRRRRPQPAQPPGADPGLEPGAHRLDAEQRKWPARPLRPVQRHAHPGAGARAGPPRRGPGDRGVLLPPGQVPGGDELRPAATGRGDLHRWHRRELAAGARQDRRPPAAVRPAPRPGGQRPLRARRRRADPGRGASAGTGDPDQRRAADRPRHAGPARLNWIDAPAQPGGVAKRTA

SEQ ID NO: 29401 - protein, 707 aa, Pseudomonas aeruginosa
GAQMHTFFIAPTGFGVGLTSISLGLLRALERAGLKVGFFKPIAQLHPGDLGPERSSELVARTHGLDTPKPLPLAQVERMLGDGQLDELLEEIISLYQRAAADKDVVIVEGMVPTRHASYAARVNFHLAKSLDAEVILVSAPENETLTELTDRIEIQAQLFGGPRDPKVLGVILNKVRGEADAANAEDGVADFARRLTEHSPLLRDDFRLIGCIPWQDELNAARTRDIADLLSARVINAGDYEQRRVQKIVLCARAVPNTVQLLKPGVLVVTPGDRDDIILAASLAAMNGVPLAGLLLCSDFPPDPRIMELCRGALQGGLPVLSVATGSYDTATNLNRMNKEIPVDDRERAERVTEFVAGHIDFEWLKQRCGTPRELRLSPPAFRYQVVQRAQKAGKRIVLPEGSEPRTVQAAAICQARGIARCVLLAKPEEVQAVAQAQGIVLPEGLEIIDPDLVRQRYVEPMVELRKGKGLNAPMAEQQLEDSVVLATMMLALDEVDGLVSGAIHTTASTIRPALQLIKTAPGYNLVSSVFFMLLPDQVLVYGDCAVNPDPSASDLAEIAVQSAASAQAFGIPARVAMISYSTGDSGSGVDVDKVREATRLAREQRPDLLIDGPLQYDAAAIASVGRQKAPNSPVAGQATVFIFPDLNTGNTTYKAVQRSADCVSVGPMLQGLRKPVNDLSRGALVEDIVYTIALTAIQADAQAPA

SEQ ID NO: 29402 - protein, 346 aa, Pseudomonas aeruginosa
RNAAQWAALASARHEDVPCERRDHAPLHAPGPGRAPTYKDSLMLSFLPHFLRGSLAGLLLVSSTLCWACLLFGMTLVKLLLPFAAAQRLCSKIMSLIAEGWIACNKGWMNLVQRTRWNVQGLEGLEYQHSYLVTSNHQSWVDILVLQYQLNRRIPLLRFFLKQELIWVPIIGLCWWALDFPFMKRYSKAYLARHPEKKGQDLATTRKACAKFSRIPVAVFNFLEGTRFTRAKHDEQQSPFRHLLKPKAGGIAFVLDAMGEQLKTLVNVTIHYPDGSPTFWCLLSGRLKDVVVRFEELEIPRQFVGKSYDQDAGYRAEFQQWVNQLWERKDQLLDSLHREFPGNAKA

SEQ ID NO: 29403 - protein, 280 aa, Pseudomonas aeruginosa
DEERRPAPIKKPAEWRAFSSRPRSVLRLGLRRALGARNRSQVDLDAPVLRATVGSGVARDRLVRAHAAGAQAGAVDALGGQVAGHALRTTLGQVHVVLAAAGAVGVADDLDGVLVVLLERVRQVVQRRVEARGDVRRIGGEGDVARHDQLDVVTLALHFHAGAFHLPTQLGFLLVGVVAITRGGRAGNGSADQRALATVVVVDRSAGDGAGQRTQSAVLGRLAHATLALALRVVGVVVGTTGEQRQCGDGCGQRQATGGEHGKTTPRGTETPLREGRPIS

SEQ ID NO: 29404 - protein, 245 aa, Pseudomonas aeruginosa
SIARWQNSRCSEKSFSAPDEGVLAHLFAQRGVRAMAGDHRGVLVEAVQTLPDRTLDRRRVAAPQVGAADATAEQGVAGDQQLRPGEPETHRARRMPRRVQCHSATAGQFLVVGQPAVRGRHRRVGHAEQLALHLQVVPEELVVLVQVQAGAGALLHLAGGEEVIQVRVGMDDADHLQAEAVEALQDQFVVAARIDDDGLPGQRIANDGAVALQRPDGKGFADQRGGCRHARLRSRSARQARHGFL

SEQ ID NO: 29405 - protein, 333 aa, Pseudomonas aeruginosa
ATGTSSAVKLSGCFMAVYCSDRWPDMTGKLAEDNLVRLSPASDSRSHGPSPSQGAAMASTTPEGLEIRPRHLDFDLPDPMPRHWHSGDAFKTHMFNAMSVLFPDGERFFIDSVRHYRERVEDPALKQQIRGFIGQEGHHSREHLVYSDRLRALGYDIDRLEGGAKRRIRFAQQKLHPSRQLAATAALEHLTAIMADGLLSNPRWLEGADPTMARLWRWHALEETEHKAVAYDVFMLVNGKARLRRRAMVQGTFFFALDTTKGLVHMLKRDGLLWNFKVWRDGIKWLWGKDGVFRSLVGVYLDFYKKDFHPWQHNNLHLIEQYRDQFEPEPKAA

SEQ ID NO: 29406 - protein, 238 aa, Pseudomonas aeruginosa
AAKDPGAGSPDQPVGAGESDIKKGYRSLDVGRTRSYALIDQLSEQESVEVVCSAFDVARSCYYVHRLRRRHVDARRVALRSQVNQLFSQSRGSAGSRSILGMLREEGVTIGRFRVRRLMRELGLVSKQPGSHAYKQATVERPDIPNRLNREFATEHPNQVWCGDITYVWAQGRWHYLAAVLDLHTRRVIGWAFSAKPDAELVIKALDMAYEQRGKPQQVLFHSDQGSQGGFNRSLQHL

SEQ ID NO: 29407 - protein, 405 aa, Pseudomonas aeruginosa
SAHAPFFMHPHLSKCFGVKSRRGVGRKHDSLAKRISLRISVDGKVRPKPSYRRRQRLSEMDNTQYAQRLLSLLAQGATLCATDRKKAFPLLQRASALLWRLEPGRSPVTTITLEHKLNLPIEQWLPEAIRADYSGPLLCSNMASQTCNEMMLELNARQLWETIQARVNRVKQACRLRSDGDTLYRNFRLFLIEHGVIAPSQARDVFVPLNLSLSDFYEPIPLHLRHNGLLYLCPECHWPLNTQRHEVSCDSAWCRDKKSLFLRDGTKLVNRVNNSHLEGQDAQERLMLNPALWKFTLQPGLLELSLAHALTERGYEVELWPNVDRTDLRVRIGQSTQDIDAKVWVSAHELAKHIEQIPSHLPRWIVIPDYQKQNIPLLREHCPMGVRVFTQSQCVQEVQKHASPF

SEQ ID NO: 29408 - protein, 820 aa, Pseudomonas aeruginosa
KCQPAQGRRRLGTVRASPCRHRIGGSAIHSSIKKGVRMKTLELRTSLFRFDPTQLGRAYRVVIGEHYLDAWQALKGLAKKPHPGLPIIALEEMLTVLSGGPVKVNLSPQKDGGVSAILLLKPLPIDTINETLRLWSMDVLRIWNERLEGFEGKLAVTDLVPLETSLLVTPGDISSLAYTVIPWLVGQAMIRNPMQASKPITLYQASDATLLAWDDPVVSENDIRYASAVHAIEPKLVLLRGRAEPYLQLRVKLSQVMPNLVGTKKHAWVKVGDQIVKAKLKTQPHEGGWKTTYEHPIEDLLGFMGVSSFPSIQEGDIPIDSDFRPIYAIPPSNPLIASGPGPLFLDQAGFHLLDNLPGTSPLLARKAVGSLREEKAQATGEVVTLPVMVLAAHSEVMLRLHAASGTLGEDSQFFKEVMPPLVTLTRLDVPDAGRMLAGQHDLLVLRAWLSNHVLPAASQAHCGGPKVMIVETCASAAKLEGAQDPKHLIRQVLAEHGIATQFIMHIDPDEQLKKKRKGKEDDRDFKATNTIIEAIRLSGYLPAPIPKSKASPEKTTVVSVLLDRIQEKGPAVLLPVITRAVLGEPNTEIFWFESGPDSGGKWFSYNEGVSAIHAFATLLTSDQLTRLVTQALLVPTKVADAPLIACLDSGLRTFYKGLQDSPGEGLPPVPEGAAIVRIRADLDVAQMSGNQSLSPDTPHYIGTKVGIFQSNESLDVYYFVAPSKQYGSVRSQRNNTRYEISEKDLRDPWQQLGVTEITIIRAGSFAHPTATAEQVALLCRNAPLWAGYLRLPGPMHLGKQVAADHPILERLRKTEANRSD

SEQ ID NO: 29409 - protein, 119 aa, Pseudomonas aeruginosa
RGIFQPLGGIARFLVGALHATCPRARQVTAPRRHLSVMQSSRSLRMSRRYRLSKPFTNSLFDLPAWQILLLKAPPLLCKEIPIEISFVGHQSFGSQFLSFSWLDDRASQGVLVKQLPVH

SEQ ID NO: 29410 - protein, 61 aa, Pseudomonas aeruginosa
NPMTGFFKGIQKSRQTLLGRRAFEALIEEFRQQDSVSLEKLGVHSVLCKQAQWAALSAARR

SEQ ID NO: 29411 - protein, 243 aa, Pseudomonas aeruginosa
AGVLYPWKAKPKTEIPKHDKPASTDARRTRKMKKEPKGAKNRIVIAKDEKNVLTCTSEGFEYTPDIVKNVYGKSSRPALEDWFLTELDFFRRYYPGYEIFTLGSSCVFGEKFVNYLTICEFDIDSTYAFDCLKKALRESDQAIRRKLSAMWKWDMAARKDWSIVFMVGHMDFAYFLQHRKEFQGDAHKRFMSTFTTAETKITSRDYKVMHDGAILPFDETALSPEDRFIFENYQKIKFETTPL

SEQ ID NO: 29412 - protein, 300 aa, Pseudomonas aeruginosa
PQRRALFRALPAHRPRNGQARRRTPGQGLVEWRLECVRHHGCRRHDLLDRAPHRGDPLHRPGAEGRRMSDQPSLSRGGMSPEGRTNPVGTLEPRLDPQDKKVLCSAVCHCSSTPNLSQNGKSLKQACVAQRLGELDEVLQGRSPYKPEVSYDMTKNPPQPILDSQTGNSPHGWIPGWISKYWDEDPEHPPFKPGKGMIRRPDVIIVQNPNRPPTQDNIKQVVEMKFPPDPHNREQLEDYAAIAGNKNKIVEMKPSDCDCGQENQRSKVPVEQVGWAAAIAGGVMFVLTRGRSPRPMIPAY

SEQ ID NO: 29413 - protein, 348 aa, Pseudomonas aeruginosa
KRRAAGRSWTGMARWKGIRLMARFLCGCAGIICRADFDGKRIIFRLSNTFFEAWMIRELRTLVAVARRGSFAAAGEQVGLTQSAVSAQIRALERSVGVELFKRTPRAAHLNEVGRQAVRTAEQILALFDGIGQGDSPRGRLRIGAVNTAQTGLLPEVLKRLAEQAPHIEPQVMPGVSLHLLDQVDAAELDLAILIRPPFNLPRGLSAQRVERQPFVLIAPPQCTATDALELLRTQPFIRYDHVSFGGRLVGDFLEAQQLRPRQVMELDEIDAIARMVENGLGVALLPRAGLWLREPARVRVIELGALEFQRELVMVSRSGSAQDDLVGEFRRALLAETAAQEAAPTTA

SEQ ID NO: 29414 - protein, 345 aa, Pseudomonas aeruginosa
SQSTLNLALRKSACRRGIQCGKNTEERMCGAQKRMRRWASSSRSRIDWRRLSRARTASCATPCNWRPASVSSRACLWRSNTGAPSHCSRVWIRRLSPDTETWHSCAARLKLLIRQRTRKSLSITRSIIVARSSTVGRFQSTSRGGACCKAKVRFVLPIWQAARRLPQNRPGKAAHSSEVALFQPSTRPSIVAGRVRHEDRTMQTSPAPAIVAGGAYQPVVLHAGIAYVSGQLPRQHGELRWTGKVGSELDLEQARQAARLCAARCLQALEEALGGLQRVERLLKVTGYVASAAGFVQQPAVIDAASEYFDEVLGARGGHARAAVGVAELPRGAAVEVELIAAVRP

SEQ ID NO: 29415 - protein, 272 aa, Pseudomonas aeruginosa
STHAATPHSCCNGSTSSCTTSPPARRRCCRSARCPPGMARLPRWRAWPSASAPMTGCCSSMPAMRSASCRWRWRRPAATCWCSRHASGCAGQRDSACSISANVPWSAWPCPTGWTSAARNGATPSPCRRGMTRGASECPEFNPGCRLALKASCDYLLQTDVRRIARRNRQLRERIAQQLYRRLGWTPLEQGPHASALMTYAAPELSGEQWLKRLHARGVNASYIGPQYARWALREQALPGVLRLTPHYLTDDGEIERLGEALEDCLRQRAAS

SEQ ID NO: 29416 - protein, 481 aa, Pseudomonas aeruginosa
IPLVEQRITIPPATSFTCLRHRRLSTPWAAFRSAADRSALNGMMNGGKTTMTGSRKTLILGCASTGAKFTPRNHAATGDRLLDSICTGATIRTAPGELLDEARQLYEMGCRYYHYHARNPLTQEQTTDNDIYQAVSRALQNRFPDLMLSFGASRNGSEVQENIRRFGEWERVSHCAIPLHLGGAHFVTIQAAIELQVICELEKQRRKLDLDYASSPAFLADLRDYQPSTALEKAELQTHSTSKGADYGVTSPMTQFQVYRNAIQARQKLGLFHEVEWVQHVRSYAMTRFAVEHPRLRLGGSGQLNVILLFGFSPRLPFPETYQQFRAVIESAKSLEYDIGEPGVRKRKVSITVGAAVMPQHAAQHFRPLDVGPRAGTPLCAVRRLAAYAAQADSQVDVLRVGMEDTPYAVDDDGQVTLSDNCQLLRQALDELRANGAEAELDGERIFQRMGMERTLGEYLSLQRLHPLGEANFTLAREFVQ

SEQ ID NO: 29417 - protein, 179 aa, Pseudomonas aeruginosa
SPATCWTCTGNWRPRPDRLPPSCPLNRSPNPRATARRERRAQRRHASGRSFVMSAKDTPAPQAAEPGRAQPVEVPGGGHWWRRLLAFAGPGYLVAVGYMDPGNWATDVAGGAQLGYLLLSVILLSSLMAMLLQALSARLGIASGLDLAQACRERYSPEHLPPAVAGLPKRRSSPATWPR

SEQ ID NO: 29418 - protein, 226 aa, Pseudomonas aeruginosa
QPAALPHRTVGHHRHAALLAPGQQVVFDAAFLQVVHHLVGGTGAAVQLVHVAQVEVGHAPAQDLALVAQPLEGFDGFLQRIPALPVQQVEVDGFATEPAQAALAGRRQTLAAGVVRVDLADQEDLFAASRDSRADHVLGAALGVHLGGIDQRHPQLDAFAQRRDLALAFAGLLADMPGTLTDGGDLLAIDQRERFHAASPVVNGRGLMPRDHSCRSSRRGPPDRGK

SEQ ID NO: 29419 - protein, 1008 aa, Pseudomonas aeruginosa
PAAPTRYAGRTSIDAGSWTRSVVEAEPGQAAQRQAGQRQHPAGAPGAARGEGVDDGRDPHGEAAEAAERDPVGTRQRQVDAQAGGDRIGQRVAKQDRDEDAAGDGQSAGQGLAGHGVASRVETGPCIVATSSGWHGDAALAGGEAVVDSEGLRLYLNYVRICTCSGRPPGRVAPGIAGVRRVRVVSRRIRPPRHTSISALRKRAELGNIGCLRFRLVSPKDIPDDFTLRPRHPAQPGHRPGPAVCAADPRQPRAQRLRPAQRTHAEHFPAPCGAGLHLCRRGGFRASRQRATGGPAAYRTASGARAGIPRDPAPPRLQAGDPAQRRARGERRRDVRTARRQRLAALHAGRPAAPAPARLVHRHPRRLRLRPDAHRRLVRRGRGSRRPPVVRAGTGHPGRRPAGQPAAGADRTDPPQSGPARSARPRPARRRRATGAAPGTQPAAARGAALRPPEAGAGGAFRLLPGRPRTAAQAAPGRTGRGAPGRSRRVAAGLGRRRQPARLRPPPTQFPGSSGDPAARPARRTAALPARRPELDADPARTRQRRRAGRRHGAGQDLAVAGPRAPGKAGRAARHAGAGGDAHQPDPQLAGRGRALRPRSARAGPARRRPAPRLRPHRRARPGADHLCPAATRRRRAGQAAVPPADPRRGAEHQERHHQGRRRRPRAGGTASPVPDRHAAGEPPRRTLVAVPFPDARLARRRPPVRPGLPHADREARRRGTPQSPGRAPAAVPAATDQGTGGLGTAAEERVHPVRRTQRGATRTLRDRAPGAGPQGPRGDRPARPGAQPHRDPRGAAQAAPGLLRHAPAATPGRRRAQRPGAQLGQAGLPARHARRTDRRGSPGPAVLAVHLDARADRGRPAPARRRLRPADRRDPRPPRPGTALPERQGAGVPDQLEGRRGRPQPDRGGHRDPLRSLVEPGGGEPGQRPRLPHRPGQAGVRLPADRPRHGGREDPAPAAGKGRPRRRPVQRRQRRRLEARRGRYRRAVRALAQGALRAARIQRATPR

SEQ ID NO: 29420 - protein, 332 aa, Pseudomonas aeruginosa
CAATSVRRAAISSASWNPSRRSSPPLPPPSKRSVMSQTSLTPGQRFREAVATEHPLQVVGTINANHALLAKRAGFKAIYLSGGGVAAGSLGLPDLGISGLDDVLTDVRRITDVCDLPLLVDVDTGFGSSAFNVARTVKSMIKFGAAAMHIEDQVGAKRCGHRPNKEIVSQQEMVDRIKAAVDARSDDSFVIMARTDALAVEGLQAAIDRACACVEAGADMIFPEAMTELAMYKEFAAAVKVPVLANITEFGATPLFTTDELASADVSLVLYPLSAFRAMNKAAENVYTAIRRDGTQKNVIDTMQTRMELYDRIDYHSFEQKLDALFAQKKNA

SEQ ID NO: 29421 - protein, 142 aa, Pseudomonas aeruginosa
SRVGRSSSPTRSATRSCSRFPRPSTRPCGSRRSCSPTPTSTTPRRITSWASRPSCSRRSSSARGPAAGPPTSSNSAPTTASSARAPSTPASSSARSCRWSNADPRRPARRTRARRTVAAPRIRKAGVGCATARATRFRTPRD

SEQ ID NO: 29422 - protein, 871 aa, Pseudomonas aeruginosa
VRAMNSAHRKPLPGTRLDYFDAREAVEAIQPGAYAKLPYTSRVLAENLVRRCDPATLEASLRQLVERKRDLDFPWYPARVVCHDILGQTALVDLAGLRDAIADKGGDPAQVNPVVPVQLIVDHSLAVECGGYDPEAFAKNRAIEDRRNEDRFHFIDWTKQAFRNVDVIPPGNGIMHQINLEKMSPVIQARDGVAFPDTCVGTDSHTPHVDALGVIAIGVGGLEAENVMLGRASWMRLPDIVGVELSGRRQPDITATDVVLALTEFLRKQKVVGAYLEFYGEGASSLTLGDRATISNMAPEYGATAAMFAIDQQTIDYLRLTGRDDEQVALVEAYARTAGLWADSLVDAEYERVLKFDLSSVVRNMAGPSNPHARVATSELAAKGIAGNLERARAEEAEGLMPDGAVIIAAITSCTNTSNPRNVIAAGLLARNADRLGLVRKPWVKTSLAPGSKVVTEYLREAGLLPHLEALGFGVVAYACTSCNGMSGALDPAIQQEIVERDLYATAVLSGNRNFDGRIHPYAKQAFLASPPLVVAYAIAGTIRFDIERDVLGVVDGKEIRLKDLWPSDEEIDAVVRAAVKPEQFRQVYIPMFDITHGERERVDPLYAWRPTSTYIRRPPYWEGALAGERTLRGMRPLAVLPDNITTDHLSPSNAILADSAAGEYLAKMGLPEEDFNSYATHRGDHLTAQRATFANPKLFNEMVRNADGSVKQGSLARVEPEGKVMRMWEAIETYMERKQPLIIVAGADYGQGSSRDWAAKGVRLAGVEAIVAEGFERIHRTNLIGMGVLPLEFKPGTTRLTLGIDGSETFDVLGARRPRADLTLVIHRRDGERLEVPVTCRLDSDEEVSIYEAGGVLQRFAQDFLEAAGA

SEQ ID NO: 29423 - protein, 762 aa, Pseudomonas aeruginosa
RRLPLRPGLHRQALRRLERQLRQPLHRGRRLRPARRAGGSGADTGRRHLRGAHLAGQYRQDHHRPRAGERRPSPGNRRLRAGRSDLPGGRDRAGVPRPVRRRRGRRRHVPHRQPGGRSGGAGGRYLQGDHDQRRDSHGVRQCRGDRLPRHRAARRDQRRPAATGALRTDPRRRRPAHGPDQDPRGSRDPPAHAEDRLRRPAPRLPHRQRQAGGGRRYRPAGPRAVHGQAAPRDDGYRGGGHRHRRSHSRHPGEPRRRRRRTQRGTLRPSLRHPASGRRGQPGERRMDGDQGDHEPQRANPHGRLGARTRRRLLNRPILAPAFRHRERPGPSCSHDKKNHPRTSLTQEETHHLRTTGVRDECQRRSQPTSRLRRRPAGHRRLRAGLPHRFHGGPGHRPQLPDGYPRLRPAGAALPGMHQAPRPAGRGHPGPARRAGAGHLLPARPGQGRLGHRLHRPLAGLQRHLAGRRVGPSLGQPRRHPRRRRPPLAETPGQRRSAAEHAPGTGSDDHGPRDPGRDRPGELVQSRRPRSCAAGQGRVHRRLRQADGGRPRATAGRPLPRLRRRPGPAHLPSRTERRLAQVLGRWRRDEPRRAPGGHRLARRDGHPRRAQRAAMGFLRCPVQPHQQGPGDQARGQAALQLPPGLRQLRDGKRAVQDQLPRRIPRADRRRGRRAPASAGEGPPATDQPHRHHHPRVGDPHHFQGRPAGQPRRPRPLPAVHDRRAADLRRPGGRALRGRLPRRPPADRSLARENGDRRGAALQP

SEQ ID NO: 29424 - protein, 166 aa, Pseudomonas aeruginosa
RRKVRLKLRRLVCSNPAQRSALARMSGSTRNASQSASQRGSGGKGTCSGSVSAAASSWSNSVANAPSRPSVSYSRGMSTAASNSCRSSGDTASTWQCAGIAMALPGSMYRLRVLTPSIRTSCSTPGGIHTARCGGTTQPASPVRTCITPLAPYSNCARRCRWRGSR

SEQ ID NO: 29425 - protein, 282 aa, Pseudomonas aeruginosa
AGLPLSLRKPAMFYLLLFLCGCLTGVSAVLFGFGGGFVVVPLLYHLLQLGRAADDPLAQAAMQVAVATSTCVMIVNAALATYRHRRAGSLLRAYVWPLGAYIGVGAVLGAALVGLASGDFIRLAFVAYLAITILDCLLRRGFLSRAEERQARPLGVGETRLGGTLIGAIATFLGVGGSVMTVPLLRRCGLSMTQATSMANPLSLPVALGGTLTYLVLAGYQEQGLGRGFVGYIDLLAFATLAGGGWLGIRLATPLIGRLPDALHARVYVGLLAAVMLSMLAG

SEQ ID NO: 29426 - protein, 63 aa, Pseudomonas aeruginosa
CPSLGRANNANGVIRRMHRTGYRRNEKRASSEAPFLFRRYTAQDAARLTEPVPAGSFGARLKA

SEQ ID NO: 29427 - protein, 1476 aa, Pseudomonas aeruginosa
GSGFRQRRGPCAIPHSGRRRGVIGSRTAHRKRLSALVERTWALRESTTTEVGPEFYTRFQGRHAPRWGNWTKGVRTANAEWIHSLGRARSSRDSGRPSREWTVSRWPCRRQLRSSSRLRCMGSAQGFAAAEIAVGAVEPDPAVSRRGLHAGDLAVELALPFVEGRRRGLRREAGETRQDDTDEKGKKCAHRHSGPETQGTQTDTLTPAPRRSNPRSSDCHRGDFPCTNDSRVAAGQLDFPPGADELRSYRRCEHGCIRTIHERPFRAATLQSPCLRFSSKKPSPPTPDADRLRLADPRRGGHRGTSRSAHLAAAGTRAGTLCRDPGLRGAPGSQRGHPVPGGRPLRPPPRLPVAAFVHAAPVRPRLRHHPPGALLPGTDALRRTPAVPALRGKGPGRAGHRRLPRRADLRLPLSATALRELRQPAAAGGAEPAVHREPRPARSRTPLPQPGGGLGSLHPGGAVAGRQDARLQRALLRRQHPGDPDREIPPLCRRAHRQHRRQAAADALGQRTQLSRRPGQLRRAPGHRAHLPQLGAAVGGAGLRRGHRPGRWPVGLVRRRLPAGRRGTRRQGRTRRPGPGPAPGAGADDRPPPAFLLSGAARPRRAGPDDRQPPAGPDPGRRHRGAVTRCGAGTEAGVPRPPQPADGATAADQQGRDPGSHPPGRDARRATVRPRPSRPAGQYHPPARVAGKRHRLLAETRRPGLRRPARADRRTPADPDLDPLGTLQLHPVRTYAERQPGAGADRQHRPALRHQRRQQAGVGLHRQATGAGQLPGDRRADPPRLWRHERRRAAQGGSGAARFHPPLGHRLPGRQPRPRSFRDAPGGHGTALFGQPLRELLHRRRAAHLQQLPQGRQRPPADAAGSPARIDQPALRAPAARPDPPRYLPERREQGAVAGRRQGPAPRRLPRPFRRQGKPGLPAPLLGQVPRQGRQPAPGDLPRRPASLAGAAGRDPPLPAATGRPGELQRLPPRTPAPRQPDRQARRRAVRALRPGQVQPQRPGLRRPRAPAGAMAARLSAEAAAGDLRRGGGGQRRRAQGGLRLAVQVAAQERPRQAHPHPAGGGGLPRPAPAMEETRLSLRSPGALLRHRPGQLRRPPGGAGRTDGDHRQRWRAHADPAPGAPRLRPGYALRDALRPGSHPRPAGDDLGGRHDPAQRAVPGGRRRHRAAPARHLQPSGRRATGDGRQDRHRRQPPADLQRRRPRAQFEGTEPHRHFRLLHRPAALRYPHRLRRRQRVEPVQVHLGPASAGTQGHGTAPQGLPRPTHRHPLPGTVVAATDRPPVAVQRTGQYQAGRSSSRSPWMRVSPKSFSSPSEWHSGCSSSVATSRAACDTTSTWECCAAWPTRRPRAGSRSGCRLVSGSLSTSSAGGRGDNRAAIHSRYRRVPSDSSAVRSGRSRPGCSISTSKRPPGLSMCRRLPGKASSTASSSAAASPISRMVCRAAARSAPSAPSTGVWVPICGHRAGASASLRKWS

SEQ ID NO: 29428 - protein, 320 aa, Pseudomonas aeruginosa
AIVVQGEFSSPMEIPMFASLPLTALRTFESAARQSSFKAAAEELAVTPTAVSHQIRSLEAWLGVPLFQRLPRKVRLTDCGERLFRSLHGALLEISQSVDTLRPQRSVGNLTVSTTPAFAALWLVPRLGRFYAAHPQINLRLDTNCEVLDLHQDASIDLVIRYSLEDHPNFYGLCLFDECFAVYGSPAQVALAAERQPTLISVRWHNSRLYAHGWEAWCAQAGEDWMEGQPVIRQYDEEHYALQAAIAGQGLVLASSILVSESVASGLLQPYRADISVDGAGYSALCVPGRERHPPVKAFFEWLRLEARQSGHACRLERDA

SEQ ID NO: 29429 - protein, 690 aa, Pseudomonas aeruginosa
AARRDRDNAAAVIRPARRGAAAAGKNDGPHLAGRAVSMRGRFTRPQARSALGYRSGGALVRLAVLLLRIVEALEHARRRRLAEQAEDDDGDAGEEEAGDDLVQAGPAQQVLPQDHRRRADDHAGQRAVAGHPLPQQGEQHQRAEGGAEAGPGIGHQAEHAVFRVGGQPDGDHRHQQHHGATDPDQFQLAGALAQEGLVEVLGERRGADQQLAAQGAHDRGEDGGQQHAGDPRVEQDLGQLDEYPLGVLADRAGLLRMRLEVGDAEEAHGHGATEAEDHPGHGDAARGRDRFHRVGGHEARQDVRLAEVAQAPGHQRDHADEGGALEHVEAGRVLQLDGGEGRLDAAGGEHHDHRGEDQREDHQRGLHGVGPAHREEATDEGVGDGRRGAGPQRGLVGEAEGALEQARTGDDAGSAVDGEEHQDHQGREDPQQAAVVLEAVGEVVGQGQRVAVVLGLHPQAAGDEQPVEVGADDQADGDPAFGQAGQVHRAGQAHQQPAAHVGGAGGQRRDEAAEAAATEDVVGEVVGGAICRQADQDHGRDVDHEGDQRGRIDTHRDSPIACFYPGPCVCKQRVAGPWLAEWRLWRHSVSACRSKPETWVASNESEQAHASRSLPCRAGKIVLYGPFRARTGTAVISLGVRCGEPRKPTRAPRRPGTEYHSASASDSSDALPPTAVVFTDVVRSLTKRSR

SEQ ID NO: 29430 - protein, 224 aa, Pseudomonas aeruginosa
PFRLPGTLVSAISLPAAFSAAMCCSRPALASASITGPTSLTRTSVGPTFSSAMAPLSNSITRSAMSCCTYITRSAEQRWPALVNADCTASLITCSGKAVESTIIAFCPPVSAIRVAMAPGFSASWRLMMRAVSVEPVKATPATRASRQNTPPRVAPSPGSRAITSFGRPASNISSTVRAAIRLVCSAGLASTVLPATSAALIWPRKIASGKFHGLTQAKMPRPS

SEQ ID NO: 29431 - protein, 172 aa, Pseudomonas aeruginosa
PCSRHGRPFFSASEMVRPSTNCLPISFIAGFIAARITGSPERCTSRLMTLGARPSVRSSMFTTLPVITRPQAAKLTRTLSLWPRWRCQSAADSLSRISASAVAASGTRNSASARHISIRPSWVSRLYWRRSASRVSTALSRLRTVSISARALRRIASMPSGPGSASCSSSPR

SEQ ID NO: 29432 - protein, 718 aa, Pseudomonas aeruginosa
IRRSDPVALPPGRAWVRFGLKKVRPMTMEPAMSSSGLFPSRPLWPLTPLALACLIVSGETLGADGRPSELPSQVITANPLGNESPATPSSVLEGDELTLRQKGSLGETLNGLPGVSSTYFGPGASRPVIRGMDGDRIRLLRNGIGALDASSLSYDHAVPEDPNSVERLEVVRGPAALLYGGNAIGGVVNSFDNRIPSEPVDGIHGSGELRYGGANTTRSRSGALEAGDGNFALHVDAASREFNDVRIPGYAHSSRQRQIDGDTGKHRVQNSDGRQDGGAVGGSYHWEHGYAGLSYSGYDSNYGSPAEDDVRLKMQQDRYAFASEIRDLEGPFTSLKLDAAYTKYEHKEIEDGETGTTFKNEGYEGRIEARHRPLGPLNGVVGAQFANSRFSALGEEAFVPHTETDSAALFALEEWKLSDRLDLSFGARLEHTRVDPDAKGNERFAENDGSQSFTTGSLSTGAVYKLTPIWSLAATLSYTERAPTFYELYANGPHAATGTYEVGDADADKEKAVSTDLALRFDNGVHKGSVGVFYSRFSNYIGLLASGRHRNEEGEVVAASDDEALPEYLYSGVRADFYGVEAQDRIHLLESPYGNFDLELSGDYTRAKNKDTGEPLPRIAPLRLNTALIWELQQWQARVDVEHAASQHRVPEEELSTDGYTTLGASLGYNFDLGESRWLAFVKGTNLTNQTVRYASSILRDRVPAAGRGIEAGVKVAF

SEQ ID NO: 29433 - protein, 134 aa, Pseudomonas aeruginosa
TSCRSSRAARPSTPSPATTWTGPQPCPGACTARTSSTSSMRARSSTSITRASTTSRIASSSSSPWVVSRARSPAPSCSWSARREWARPASANPSPRASAGRSTVSASAACATRRRSRATAAPTSAPCPASWCRH

SEQ ID NO: 29434 - protein, 473 aa, Pseudomonas aeruginosa
PCISPSATATWPRCCSRPEPAADGRPVRPSAAPTLALGRQQGLCWRPFHSSRGALHVLFPLPSAAAIVHRGPGRLRRATEAGGHPGRRRRLFAAEADARPGTGADPAEQSHHRLPLGTAQPCCQRAQAPWPGGLQQFRRRQRPGWQRRRIDLALPRRRQRRRPPGTGLPAALGKGRGTGGKLFLRDPGALKPLPAADTFCTKTDVLRRGDLAYPDRPRRPEDSMLRASFVLLALSCAAPLLSLAEPLRFAGDDGCPYLCPGTPQRPGYLVEALSQVLREPPHFDSLPWPRAVQMVRDGHRDGLVGAYGLDGLRVGSEPIGWVGLAFYTRHDSDWHYSGDASLLGQRLGLAQGYVNNPRFEAWRSQAGDDDLHLQVLGGERVLPRNLQKLLLGRIDVLLEDRDIIEHYLEHHPQLAGQIRRAGELPGRQPLHVGLSPHLPEVDARLAELDEGLRQLRREGTLKVLGERYRLSFE

SEQ ID NO: 29435 - protein, 258 aa, Pseudomonas aeruginosa
PRATAACCRSSTCGSCSSSRTSPSITCRAAWCNAWKRRTVASATPSISARPTPSGSAASGRTCSTSARNGSCRAGRSRRCSSSSTTCWCTRSATANRTSIAWKTRRTRWVRCRARESTSPTSSGDSPARMGESSPRSWATLIPRLQFGPLKSRDARGHPRERVRSPVRPTPATCRRLRVQRRRGARVPRHDQALRAGLPHHRREHRRTRRAVRPAEQRALRPRLLARRGHPVAAPPRPQRRLPGDRGGQLARDDRALQ

SEQ ID NO: 29436 - protein, 348 aa, Pseudomonas aeruginosa
TAAGRRLQPGQPMVPVSQLRIDDRPAMIQHLALDALQRHLAGSPLYGWATSLPAQIAARIEEGHGDLARWWSAVQRLPQVPAPKVELAQRFALHSDHDAALQAQVKEALQGLIPWRKGPFDFFGVQVDTEWRSDWKWERVSPHVELRGKRVLDVGCGNGYYQWRMLGAGAESVVGVDPNWLFLCQFLAAKRYLPELPAWHLPLALEDLPEKLEGFDTVFSMGVLYHRRSPIDHLLALKDCLKRGGELVLETLVVEGDASTVLVPEDRYAQMRNVWFLPSVAALELWLRRAGFADARCVDVSLTSVEEQRSTEWMRFQSLPEFLDPQDRSRTVEGLPAPMRATLVARKP

SEQ ID NO: 29437 - protein, 134 aa, Pseudomonas aeruginosa
RPVCSSIAGAPTRAEASICRGSGSMNSDTSLPTAARRRTASRMRCSWPATSRPPSVVSSSRRSGTRQLCAGRISSAKASISSVTPISKFIRVCSTSLSTRTSRSWICRRSSRRCTVIPSAPASSASRAAFTGSG

SEQ ID NO: 29438 - protein, 602 aa, Pseudomonas aeruginosa
  UNSURE (496): Identity of amino acid at the above locations are unknown.
QFGALEQPGLQLRHRLQAGLWQKLVQRLRLDRAPIDVDIESETIAQLLQQAPFERAQQRFDGSPRRQQRQGRGVVGEDFRLRVFRRQQADQQLVEIETAEQRLAIEQVGNAGAFQAGHGLQFAAPAPLRFQRHEWPRQGAGLAAGAAQDRAQATQRGEEVHQGAGFLVRPAMQHVGGLGGGEGHGGSTGRERNGARLAPGCRERSEVAVAQRAQGTLVVGPAALDLDPEVEHDLGVEQYFHVLARVLADAFDPLALVADDDLLLPLALHQDQRMDMQDATFLLELLDLHGDLVGQLGAELAHDLLADQLGGQEAAAAVGDLVFGEEVLAFRQTLGDQLLQHVQVGPVLRRDRYYLGLRQLLGEPFEVRQQVGLLLDAVGLVHRDQHRATDVLHALQDHLVLFGPAGAVDHEDHHVDILQCRAGGTVHVAVEGLLAALVQAGRIDVDGLHLALGLDPEHVVTGSLRLARGDRQLLPEDVVEQGGLAHVGAAHNRHVXATAAGGDVVVHVSHGHSPRPEPPARRPRPPARRCGGCRRARGSCRSAGPLRNRRRRSGNGVRPGYPPPRSAAGRSHATAGTPAGGSWGPCWCPPGSARAVAVRARR

SEQ ID NO: 29439 - protein, 328 aa, Pseudomonas aeruginosa
RHRARPCGGVRGSESGAALGSSPASRLFSRSALPRGEPAHRSVNHADPGEVRQVAHLRIGPAHPYSEGLADDIAVRNHAQQILGDLRIVPVAAVVGVVAVVAHHEVVAGGNGPLAVGLNAIAAHFLADQVLGLAQLLLVQGHAAQGARFLADQFLRHQLAVDVQALFLGVAHGVAGQADHALDVVDVRFAGIAEHHDIAALRITDRDHLGVQHRQADTVGELVDQDEIADLEGRFHRPRGNLERLDQEGTQHQHDEQHREERLAVLHQQRFLVELLQHCRIGLVHLPFVGRDRGPPTRREQHQVDQGQGAAYSHGDDQQQREIECHGF

SEQ ID NO: 29440 - protein, 435 aa, Pseudomonas aeruginosa
SEVRQGPPGSPAMLPRKTRAEGKDRRGRRRATTGLHEFLGRPHRRPAGSGRSTRAPGHAPRRRPGAASAPGRNRHWPSRTSRYCGARSRPIPLPARSPPLAPAPRSFLGGGLGPDGQRHPLGGAQRHFADDGHHLAAVIGLQALGNHHGRAELAARVANHGTVQRLDEHRESCQAIAIGQAGDRIGGDRTATHETAGQGETWRQPFRAPGHGLLAVGLGRADDLAFGARLQLVFGRCRAGIQLGELEALEQLPLLVQQQRLQRQAGVAVQVQLEAVAMLVARSHRKDHCRAAGDTGFADQAQVVPGSQLGGIELAHRPQLGIGQLVGKAAADALGAPVDPDHFLARAVELEQALANRTIALHAMPDLMGGEAAIALVDEGALETVLAIGLGETIQPVGSVGSLSGGNRHQAAKQKQQGGGAHVSPQRFSRLAARA

SEQ ID NO: 29441 - protein, 575 aa, Pseudomonas aeruginosa
RLPMTGPQLIRRTGSGGALLCRQALLYTRAPPRGNAGMSQHYQHDVLVIGSGAAGLSLALTLPEHLRIAVLSKGGLSQGSTYWAQGGVAAVLDDTDTVESHVEDTLVAGGGLCREDAVRFTVEHSREAIQWLIEQGVPFTRDEQHNHEEGSFEYHLTREGGHSHRRIIHAADATGAAIFNTLLAQARRRPNIQLLSQRVAVDLITERKLGLPSKRCLGAYVLNRESGEVDTFRARFTVLASGGASKVYLYTSNPDGNSGDGIAMAWRAGCRVGNLEFNQFHPTCLYHPQAKSFLITEALRGEGALLRLPNGERFMPRFDPRGELAPRDIVARAIDHEMKRLGIDCVYLDISHKPAEFIKAHFPTVYERCLDFGIDITQQPIPVVPAAHYTCGGVLVDQHGHTDVPGLYAIGETTFTGLHGANRMASNSLLECFVYARSAAADMLQRLPGTPVPESLPSWDASQVTDSDEDVIIAHNWDELRRFMWDYVGIVRTNKRLQRAQHRVRLLLSEIDEFYSNYKVSRDLIELRNLALVAELIIRSAMQRRESRGLHYTLDYPDLLPEARDTILVPPIYGD

SEQ ID NO: 29442 - protein, 187 aa, Pseudomonas aeruginosa
SAGGHAGADGCRRPMHRPGYSSQGCASGPAGARAVRSARATPGCQGAIAPLASRFRRSTAASPARHGARRGRPASRAAVPGGTAPRHRRPGRPAQAAASARPAAPPAGSTAAPGPTVPGSPPAGSERPASGIRTAQSGWTRSRIIRTIRRRSASSGSPRCMNQPNMSWSSHSSSLRKRAWSSASRPG

SEQ ID NO: 29443 - protein, 327 aa, Pseudomonas aeruginosa
RRQVPPGPADLQPRLPQRRDLQPRRPLQHQGPPAIELPHPARGRRPAAGDGRRAARGPVGGPEEIRRILQGQPCRRERSLAPHRLARRQRGTARPGDRHPGGERQDRPPRRPARRRPGRRPRRAMGSGATRRGGACHAPRAQPRGAARRLAARPGARRHRPGVRRYPRAVHPTDDQPAGGRRGQLQEGLLYRPGNRRPHAVSRPPQAPPVSPGAGRRRGAGARHRAVLASPFHQRRRSGTGRPYAGEQRGIARRAAGRRRRRRPDQPRKRRRSAARPPQSALHAGQRPRNPALTVNCASPSADGPPVFPWPVHVERAPAIAFSKEMP

SEQ ID NO: 29444 - protein, 109 aa, Pseudomonas aeruginosa
TVRCCAARRKSPTCRWRSAGWASTTPATWPPAWPWSRCSRPPPTWSIARCAKSGTRAPRSPASATCWPVTTPAWRRTRRPWPDWCTRSACCRSSPTPRITTSCCRTPSA

SEQ ID NO: 29445 - protein, 494 aa, Pseudomonas aeruginosa
RKTRTSPAPWKPPPACCNRPALLHREAHPHQQAAQFALVELDLRPVRPADLADDRQPQAAAGAVAAPVEALEDPLAVGGGNSRTIVFHFQHASLQHPEDHVAALRGVRQRVVQQVAEQFVEQRRFTLDPHRPGAFQRQRGSPRIGQRRQRQAQFPGQGGQVDTLGATLGNGLGAAFDARQGEQLVGQVDQAVGVLRRGLQGRTPGFRLLLAQAQFQARLERRQRRAQLVGGIGDEVRLPLEQAAQALGEVVQRLHQRPQFMLDLEHRQRPQVVRLALFHLAAQAIQRTQRGAHRQPHQHQRADAEDAQAQQGIGHQAARHALAGAFGLRHADLRHAAHARFADRLQQAHHAYVDALVDAVVELGQGRVVVGAQGIGGCRRKILVAGDHPSVDVVDLVEDPPGAVVGEGIQCHVGDVGAQGAVLLVEPVGDRPRRGQQGPVVGGVGHLATVPVGAQAARQEHQQQEQGQPQQQPSAQAAGISHPAPPAGSRGRGR

SEQ ID NO: 29446 - protein, 443 aa, Pseudomonas aeruginosa
DQSMDGADRPPKRPAAWCSAYKNKNRRPLHVDFPAAGRKVCTFVPQHHPDHHRRRARQHRAPGQRRRLPRRQQGQPGNPQLLHEPRLPRRPRPVQARGVGARLHPQPAVRLHPGHRRLRPRRHGHARRQARLRPRPQRYRTAAEGFRRPRAGHLLETGPDRQGQGLAERAEGRHADSEVAIGTTEQRADLPADIRRRAAHLEGDQGPRLHRRAPGKDQDPRLQRLRGPRAERQERPLRRGQRRSLRPRRTGLQAHRPTHRQLSLQQPAGRLPPALRRPAAQLADRSRRTDQRPALRPQHRQRLGQGRRHRQQVAQRHVHLQPWQPCLRRGLAANERRRRLPLPGRQQPVPGQLRPGQRLRRPQGALLATALRLRLRRPRHSRPDLHDPLRQGRQCRTRRAARRRPRMGTQHRTAVRVPERRAEEPRNPLAQRDLPFQFHPRHR

SEQ ID NO: 29447 - protein, 350 aa, Pseudomonas aeruginosa
EPPDRQLYPADLVSQNKNSTGAPMMMKLSFRPLALVAAGLLLAGAAVAEPKRPECIAPASPGGGFDLTCKLAQSALVEAKLLSKPMRVTYMPGGVGAVAYNAVVAQRPGDAGTITAFSSGSLLNLAQGKFGRFDENAVKWLAAIGTSYGAIAVRTDSPYKNLDDLVKALKADPSKVVIGSGGTVGSQDWMQTALIAKAAGINPRDLRYVALEGGGEIATALLGGHIQVGSTDISDSMPHILSGDMRLLAVFSEERLPEAAMANIPTAKEQGYDIVWPVVRGFYLGPKVSDEDYAWWKNAFDQLLASEDFAKLRDQRELFPFAMTGEELDGYVKQQVQQYKQLAKDFGLIQ

SEQ ID NO: 29448 - protein, 172 aa, Pseudomonas aeruginosa
ASPRAAGPRPRHEDRPMTRSNLYQRLFAGLWLLACVGLAVAGWRYQAPFSYEPVGPRAYPLLCLALMGAGLAWLIARPTPIRHAEDEQPLGGAVLLKVLACIALLLVFAGLFETLGFILSAALVGSCMAILYGARPIPAVVTASLLGIGLYWLFDRALDVPLPLGVLDFLPL

SEQ ID NO: 29449 - protein, 464 aa, Pseudomonas aeruginosa
  UNSURE (227),(276): Identity of amino acid at the above locations are unknown.
GLRDGNLELPRPGLRRRDDADQPDHRADRHPDRHHRRPAARPRSDQRRGTADPGGIRPRPAAGNRADPARRRIPGLRIRRADQLDPAQHPRRSLDRDDHPRRLPDGTQGPGRRGPVAVGLEFVHWRFHRHLRDGPVRPAAGQVGDRLRSGGIFRADGVRHRLPRRDGRRPPAEDPAGGAARAVPVERRDRRQQRRVPLHRGQHPPRRRHPVRGPGAGPVLGQRDPHXGGEDPPRPGGGESHRTHAVQLQGGRQRIHGQHAMRSARFRHGRMARRRXDPGKRGGLYDREEAGRCQGRVRQGRHARPGRSRDRHRRLRLRRHGADADPRRARLGYHCGDDRRPDPVQHHSRPAVVPAATGHRLGPDRLAVHRQRHADHPQRADGPRIHPHPRGAELGPGAGHRDHHRDRRVRRACDHLRPVPDGRHRRDRLYPAQARLPALAAAAGLHPRWTDGAKPAPRAVDLQR

SEQ ID NO: 29450 - protein, 134 aa, Pseudomonas aeruginosa
GPGDAAPAAHRTPPAGVAACPGAGAGRCPADAGNPPPVRLRNVPSRCSRAAASRRRRHVPGPWAGPAGRRRRPRRARRHTPASRVRPGSRSTGCRPARAAACGGHAPPDSNRGPAGSRPGRADGGPGRDAGGAA

SEQ ID NO: 29451 - protein, 520 aa, Pseudomonas aeruginosa
IPRSSIPCARSSIHRRLAAGYNDSKQHPGPPGSGGDDGQGNPPTDRRRMARQPFPRAGRSHRSGDPGRPRAGAEGHRRRDRAGHRQRPARLRDLARSPGSRASAVDAALPAPAQGTPRRTRRTAGPGDRQEPRRCQGRRVARHRGGRTRRQRGQPDDGRDGGKRRPRDRHRQLDPAPRRVRRDHPVQFSGDDPAVDVPAGHRLRQHLRPQALRTGSADTQPPRRAVPRGRRAEGRAAGDSWRPRAGRCPPYPPGHPGDFLRRLGRRRPARVPHRHRAPEAGAGLRRGEEPHGDPPRREQGPGSRQPGRRQLRRRRPALHGDQRGGVRRRGARVDSRTGRADGRPAPRPLAGPGRRLWSADQPAGAPARAAPDRRRQGGRRRVPARRLAVPGRRLSQRQLARSHPVPRSDAEDGPVPRGNLRPGAGLPGGGKPGRGHRPGQRQPLWQWNKPLHPLRRRRSALPARGAGRPGGYQRTDPGTAAVLLLHRLEGFLLRRPARLRQAGGALLYRDQDRHQPLVRR

SEQ ID NO: 29452 - protein, 418 aa, Pseudomonas aeruginosa
TDDRRIVGRPEHDHPSQVTRGPMDFDLTEEQRLLVESARAFARHELAPKAADWDRDHHFPVEVIRAAAEQGYLGLYIAEEDGGLGLSRLSTSLIFEQLAAGCVATTAYISIHNMAAWMLASFGDAALKGGLAARPDRRRVARLLLPDRARCRLRRRAPAHPRPPRGRRIRAGRQQVLHFRRRQHPGADRHGAHRRGRRQGHLLLPGAGRRARHPLRPQRGQDGLARAADPHHHLRRRAHPRRQPHRPGGPGLRLCHERPRRRPPEHRQLFPGRRPGGAGAVDALRRGARAVRQAAGDLPGLAVQARRHAHRTHRQPPDGPPRRPSAGPRRRRGDPVLRNGQALRHRPLLRCLQRGLATARRLRLSQRLSAGALGTRHPRAPDPRRHQRNHAGDRRPPPAGAGRHARSPAVNAANHRIR

SEQ ID NO: 29453 - protein, 285 aa, Pseudomonas aeruginosa
CRDAPAHDPVRDFMNTAVEPYKASSFDLTHKLTVEKHGHTALITINHPPANTWDRDSLIGLRQLIEHLNRDDDIYALVVTGQGPKFFSAGADLNMFADGDKARAREMARRFGEAFEALRDFRGVSIAAINGYAMGGGLECALACDIRIAERQAQMALPEAAVGLLPCAGGTQALPWLVGEGWAKRMILCNERVDAETALRIGLVEQVVDSGEARGAALLLAAKVARQSPVAIRTIKPLIQGARERAPNTWLPEERERFVDLFDAQDTREGVNAFLEKRDPKWRNC

SEQ ID NO: 29454 - protein, 505 aa, Pseudomonas aeruginosa
TSSTWCRSAVDGLVAAGASAARSARDAVQGADVFISMLPASQHVEGLYLEEDGLLAHIAPGTLVAGMLDLRPDLGAKGPPRRPRARPGDARRAGVRRYCRRGSRHLDLHGRRRRRSPGEGPAAVRGHGSQHLPCRPRRRRPGRQGVQQPTPRGADDRYRRSHGPGRGQRPRGEGAGRDHAPQLRRQLGAGSLQPLAGGDGERSGVARLQRRLHGPVDGQGPRPGPGSRPGQRQQHADGQPGAEPVPPVAEAGLCGAGLFRGAEIVRSDTRPIDRQAGPRPGWSIRRCEEPALNALLLRYRFRLLFFSTVLFTAILGLPSSTKPRVLGSLLLLVLAGMNTLRRRSPLVYLTAFFGLFSLALYTTADFSSPYSSLPPGLLRGLSLILLYLTLFAALFRRVTQERPVTHELLYGLCALYLQMALAFALAYYMVEQMQPASFIASHGALGLDTFVYYSLVTLTTVGYGDIQAINPLARLLAGSEGVIGVLFIALAVARSLTLMSDSEEV

SEQ ID NO: 29455 - protein, 349 aa, Pseudomonas aeruginosa
LLSWANECIPLAAVYPGERRADDADRRRSAAFLERKVQHENRPDRRHRSRRPLFPQRSPATRPRGNRPGPRPEQAGGARRPRRSAGGRQRPGPGGQRRGRPRGGHQRFQRRLGQRRPPRPPRRRQPGHSRRRETLRRAAPAGSRRRREPGDRPRPAPGGQPGIPRAVEAGRPRRRRRPRPTARRATTGLGVPQPGDAPRTRPAQRQVPPRRRPGSVRRQGREPDFPGRPGGSHARRGRAAPSSSPALHRGLLKRPGAPLGRLRRQPSDFAAGVTISNQKSKSPSMPNSCPSNSGLPELFSLPSKTRRTADTSLSSSRLRSARSMLTVCPASSLCTPRRLFRCEFFSSSR

SEQ ID NO: 29456 - protein, 234 aa, Pseudomonas aeruginosa
PARRARTSPGRPWRTTENDSWEPPRFGIGRVCRANAPRGSALSTGKHDGARRRRLSLRTSVAPARCPALLALVSRTILPTVLLPALRRMPAPLRLAAALPVARMPLATMGRARFVVALLVAILLAPVVAVAIVAAWRRVVALVVVARRVVAPFAAPAIVIHAIARHFVGVAVGLAAIVAPIAVIVVVVIHRAATQAGEKQKKRDSQECAPHGSLLRPRCRPAGRPATPRGAHTT

SEQ ID NO: 29457 - protein, 383 aa, Pseudomonas aeruginosa
PQPAFLGRVRGPRTAGPAGTAQGACMQPIDRAQAQQRANDILVFQRELQRLDQEQAFRLEPAQARQLADYHLALLDSYRDRFDIDHDLRSQQLSLGMRVASFFGALAFAASVFLLFYRFWGLFPTVAQVAILIGSAFAAFFATLWVQAKDASGYFSKLAAMVAFACFVLDLTMLGQIFNVTPSDLALVPWALYALLLAYLCNARLLLAAAILCVMGFIAARVGTWGGGYWLSVGERPENFFPAAALIFAVPLCFEQRNFSGFAVIYRVFALLGLFLPMLVLANWGSGSYLALPSALIEGLYQVAGFVAAALVIWLGARRNWADVSNTGITFFVIFLYTKFFDWWWEAMPKYLFFLVLGLSALLILLVLRRLRTPLGIAARTDA

SEQ ID NO: 29458 - protein, 64 aa, Pseudomonas aeruginosa
PPCASATPSASATPSSRAGCVPGPRSTEAGRWSAATSAVPTSPRSTCHDNGTRYSPRSTNKTTG

SEQ ID NO: 29459 - protein, 275 aa, Pseudomonas aeruginosa
RHPGLLVLHHGDRCGRAGADSRRAAPPRLPLPTLRATAAARRRRLMRLDRFLANLPELSRRDAQMLIAGGRLRVDGQVVRDGTHEVRVFSRVELDERLLQAGKPARYYMLHKPMGCVSATRDPQHPTVLDLFPEDLRDDLHIGGRLDYNTTGLMLLTNDGQWSRRLTLPGSRRDKVYYVETEAPIDQRYVDAFAAGLHFRFEDLVTLPAQLEPIGPRCARLTLHEGRYHQVKRMFGHFDNKVLRLHRERMGDICLDPQLPPGAWRPLNAEEICSV

SEQ ID NO: 29460 - protein, 392 aa, Pseudomonas aeruginosa
NPAARRLSTERGRTAGVWPAVASDAKLNGICRSDSLSRMEQEKAPMKRSLAVLLLAFAVGSLHAAPASPANAPLPPADIKARLKSMKPGEYLWYPEVSPQGPVTIVVSLTEQKAYIYRNGIAIGVSTLSSGKKGRETPTGVFSILQKSVDHKSDLYNSAPMPYMQRLTWDGIALHAGNLPGYPASHGCIRLPMAFAKKLYGITGFSSTTVIISNASSAPKEVDHPGLLAPTVADGRPVTLPVEPGEIAWNDPGAERGPLSVLISRADQRAYVYRGGQRIGTAPVQLPARPQTGMAVFSLLEKPTPEEISETSPNLRWSVVQVSNPGQGLTPSEQLGKIRMDPTFVREMLGAMDVGSTLVITDWASTRDTHSDSDFTVIATETPNNPTKSLKK

SEQ ID NO: 29461 - protein, 336 aa, Pseudomonas aeruginosa
HSTVIGRRFHLPMSILYSPRQARSPRSHRTIPGGSDMRPETAIIEIHGQYRIHTEFYGNPSAQQTIILVNGSLSTTASFAQTVKYLQPHYNVVLYDQPYAGQSKPHNENRTPISKECEARILLELIERFRADVVMSFSWGGVATLLALAQRPGRIRRAVVNSFSPQLNPAMLDYLHRGLDYLAACDRTQVGNLVNETIGRYLPQLFKRYNFRHVSSLDEHEYHQMHFHIREVLRLNADSYTESFAGIEIPVLFMNGELDIYTTPHEARQFGQLIRGAEFHTIRNAGHFIDVEHKAAWQQTQDALLAFLRPQRTQPLNPIYRPQPNGASVPLAALAS

SEQ ID NO: 29462 - protein, 189 aa, Pseudomonas aeruginosa
KRGPPRGEANSLTKAQASHSGMATQAVPCRRFASFVRLPHRGTLSWLRPSPIRGLHVGDSSHPITATSSSRTRCRRLSAFAMARTRLFAQCGRVVTPMITGSTDMNVSKPEQRTLHALAQGGHIAFLRDASGKITRVECYNRDGHLLLDCTLAVFSRLKNKGLVHSRQGRPYRISMAGLKVVRPQADNR

SEQ ID NO: 29463 - protein, 178 aa, Pseudomonas aeruginosa
  UNSURE (69),(91): Identity of amino acid at the above locations are unknown.
WPSTPHSTPAAEPERQQPLCRPLVAGSIELGALLDQFHLVAVRVFEEGDHAASVLHRPGLAGDPIAQRXGPGAGDGGILDLDGQVAVAVAXGVAVPVPVVGQLQGSGRALVLVADEGQGEAAFGIVPAPQQAHVQGAGVELQRGLEIGHAEHAVQDSHGNSPWNPAASRRSGDQPSMR

SEQ ID NO: 29464 - protein, 294 aa, Pseudomonas aeruginosa
SANRSLKENDVKLSQLGFFCAVVERGTIAAAAEQLHCVPSNITTRLRELEGQLGIALFNRERNRLLVTPEGRLLYRHARRLLALADETAALFAGDQAHGALRVGALDVALANHLPQRLARYRRESPGVELHIRPEHSLLLERLLMEGELDLIVTDGPIEHPLLASRLAFRERLLRVTPADLPAPTPEDLASLELYVFGHTCHYRRQVDRWLAESGIQPRATLEIESYPSLFACIEAGLGFACVPESFVARMPSARRGFHAEPVAGLDSSDIHFVWRKQQASPLIQGFIDSIGAD

SEQ ID NO: 29465 - protein, 283 aa, Pseudomonas aeruginosa
IPLNPACGLHARAPWRDLPIEPSLMTATDRTPPPLKWLCLGNRDANDGFELFAHGIYARNGALVGSKLSLRERRQRVDLSAFLSGAPPLLAEAAVKHLLARLLCVHRHNTDLELLGKNFIPLHASSLGNAGVCERILASARQLQQHQVELCLLLAIDEQEPASAEYLASLARLRDSGVRIALHPQRIDTDARQCFAEVDAGLCDYLGLDARLLAPGPLTRNLRQRKSIEYLNRLLVAQDIQMLCLNVDNEELHQQANALPFAFRHGRHYSEPFQAWPFSSPAC

SEQ ID NO: 29466 - protein, 77 aa, Pseudomonas aeruginosa
TPTRLPAVTPGWPAIPPGATLGSFDGQGRRSWATISRAPSGASCSRNRSATRTYGWGATATTPATITGIPSTTAPAT

SEQ ID NO: 29467 - protein, 510 aa, Pseudomonas aeruginosa
TAASRPPACRSACNWSRRASPIPGCCASARPTKAGAVRSTAGPGRRLTEAGGRSSLGSRPECFSRHSERAFAMRSPTRPPAAADPASRRSVFAVVLGNAVEFFDFGVYATFAVMIGRTFFPSDSAFVSLLLSVTAFGVGFVIRPLGAILIGAYADRAGRKPAMLLTLFLMALGTGGIAVLPGYDSIGPAAPLLLVLTRLLQGLAWGGEAGPATTYILEAAPPHKRGTYACWQVVAQGIAAVAAGLMGYLLTLWLDERQLQEWGWRIPFAAGLLVLPIGLYIRLNLAETFAGRGRQASTRSLLGELFGNHRRALLLGLLILSGSTITQYFLNYMTTFALTELHLPAGIAMLSTLVAGAALALSALLGGVLCDRYGRRAVLILPRLALLAVLFPALQAMTRHPEPAVFLAVLALLSALHGMSGAALIVLLVESFPRALRSTGFSLVYATGVAAFGGTAQIVVTWLIGVTGNPLSPLGYLLLANLVCLGGAWLARETWPGRGDMGGAPLVLRD

SEQ ID NO: 29468 - protein, 327 aa, Pseudomonas aeruginosa
ELARFVQAPPACRERRWGPHSSGGPTMQFFLRYAYAPLFWSGFIGLATWQVGYRQASHAWLVALFLGALGLSFLAERRLPYQPRWNRPHADRLRDVLHASVNESLNALGILALPLLAGVLGFWPVWPQAWPLWLQLLLAIVLADLGITLVHYASHRSALLWRLHAVHHSVQRLYGFNGLMKHPLHLGLEALGGTLPLLLLGVPQTVAALLAFAIGIQLLLQHSNVDMRIGGLRHVFAWAPLHRLHHIRYGRAGDVNFALFFSVWDRLLGTALHRPDYRLDSTDMGIGDQPDYPRDYAGQLLAPFRDLPRSRHVPQPPEGLGRSAGQA

SEQ ID NO: 29469 - protein, 171 aa, Pseudomonas aeruginosa
PGTAPVQPVAPCSPGRRPAVRHRWGSPRAPCSPTPGRYAGRSAAPPHRSTSSPADAVASPGRWPVRRAPSRPVAHASSVPVRRGSRSTARGFPPAPRPAAPSVRPAPPARRRGGPPRAPRRRWQMAWQARPGPGPRRRPRAGHSRREGQARTPGHRNEMPAASAQASPSTG

SEQ ID NO: 29470 - protein, 72 aa, Pseudomonas aeruginosa
CARPSPGRRWAAPNSPPWPGSLPRPSLRRGSGRAPPAGYRVRGPPRGQRQRPPRAPRSGAPAGPAAPRPRPA

SEQ ID NO: 29471 - protein, 520 aa, Pseudomonas aeruginosa
RRQQPDALFRQAEAEAQQAQQARQTVAPAAAVAAVPGEVRVPYIPQVVRDQIRDEVKAEVMTQAKAENWAQPNAFPDWASRISFDGDVRLRYESRSFGNGNSNQITDFAELNDDGPYDVNPNTSSGLPPLLNTREDRDSLVRLRARFGLKAALSESWSAGIRIGTGSDNNPVSTTQTLGGGFGKKDLWLDQGYLTWKPSERLSLTGGRIANPFLSTDLLYSNDLNFDGVAAIFNQPLSRDVSLFGTVGAFPVEYSSDTASSNGFDKEDSDNKWMYGAQLGATWKINPQHSLTGALAYYRFDDIEGRRSSPCRPWAGDPECDTDGSRPTFMQKGNTVFLLRDIVPNPADPANTPNPQYVGLASEFNLLDLNLGWDAELPNDFKLRVAGNYVHNLGYDEGDMRKRAGGVAQIANNLGSDGDIKSGANAWMLQFTLGNALDMRDAGDWQVFAAYKYIQPDALPDGFNDSTFHLGGTNAKGYILGASYGFDKRVYGTARWLSSDEVYGAPFSIDVLQLEVNTRF

SEQ ID NO: 29472 - protein, 242 aa, Pseudomonas aeruginosa
ALLEADHEEADHEHATFLITDLGPGAARRGRLRRLRQPGGLRRQPGGTPARPVAQHHPATPGAADRTGPGHRGESRAGKPARCGAGPGQATERRAGPGQGPGRAALGPATRLARPGAADGRGEQRATGQVQAGLRRVAGHGASQGGRAAEARPGVPRARPAVAAVHREESGDVWRGQGDPRRLRERQRRRGDEDPPTVRQRCAGEIRRDGAEARRRPLQDPGREPPGGARPVKSDSKPGTRT

SEQ ID NO: 29473 - protein, 370 aa, Pseudomonas aeruginosa
SSPAASARPTCVAISNCGIACCRSSSPTCATTAAWPRSNRAWRRMPVNPSMARPEPMRPAFRCGVLAFALALLAGCGQREDGGAGQAQAALAKPSASAAAEPAVARLGALQVAPDELKALLAEVPAETRAQLSENRDALERWMRARLAEKALYEQASAQDWQQRPQVKTLIDAAARQIVLRTYLESVSTVPEDYPSDAELQAAYQANKAQLAVPALYRVSQIFIAASAAGGLAEARKRAQELYRQAADGDFAELARKHSDDPQTARNGGDIGGLLAQAQLLPAIRPALERLKVGAVSEPIQGANGFHLVKLTERRDARLATLDEVRGRLRESLRAQRQEQIAKAYLDGLVNNATLSIDGALLGKTLAELH

SEQ ID NO: 29474 - protein, 113 aa, Pseudomonas aeruginosa
WTASRRPGVGRARAAGGTCAAGCSASPSGSATNASGSGAPMPHGSTSRSSSAWAKTPKPRRGCWPSWSRGARRGSCRIPTSTCGSGSMNAAGSSVSPACAATPSRSRMNCGAH

SEQ ID NO: 29475 - protein, 287 aa, Pseudomonas aeruginosa
RKVRDDGAALAGRGLAGAGPRAVRRGQRRYPRARALCPPVAAGGDAAAGARRWPGTGGPALAGALAASPLRRSVAAVAGAVRRAAGVRQRRPASASRGRSRRARGVAGAACAAASSTARPPRRKGPGGARRATRGAGRGGKTGAQRQSFAEPTGAAVRRPGRPVGTPPGALAPPVPGLRPGLAGAQPDRGGPSRRLCRRRAPVAQRTQPARYPRRPVAAAPTPGRLNAPILPAAVGRACCVAGRGMARATGRHSRGDSQAGRRCPCRCCPGGSRDDGGRCRAGGPRR

SEQ ID NO: 29476 - protein, 125 aa, Pseudomonas aeruginosa
GKASGCPVPPTAGSGTRCSCAGAGYASAGRGQAGARPGPGNRRGRRRPRRSTGERRYRCVAGAARCARRCRVAGRGTPGTPPRRVPARRWLAAGRVRPGAAAIAWPRPGSARRPRRCPGCWHAGE

SEQ ID NO: 29477 - protein, 196 aa, Pseudomonas aeruginosa
VGSPSTTQPPAGSSRNSVSRRRTNCEPRPWRCRSGATDSGARPYQSPASPSMVTGEAAIWPITWPFASATSESVSAPARRRASTMYCSVWLLCVSLRNAASVRRAMASMSPGVSARMEIFMQALLGTPALSRRGQWKRKGVSDCPPAGARLSARPWISGRACPGGSGPGPCSSAWRTPPGCSRAAGGRRGCSTRRG

SEQ ID NO: 29478 - protein, 193 aa, Pseudomonas aeruginosa
ELPDIGRRGGRLRATLIAYLKSWRRNLRDFQARARRVEVIGRGCFPVHRRRHGHGRAWGADGFSAVAAVVPGANPEAQLDEEPQEVSEAPAYRVDDLTFLYLTHEVYLEPYVSCRPKVLGERSYVACWNETYSGRSPLNFWEYDGGDFLALNDPARVLAEGKFASEQHIGEAPLPLPLDIDLDQLERAYSLMM

SEQ ID NO: 29479 - protein, 219 aa, Pseudomonas aeruginosa
RWLAQRTALLLDALLRPTLLPGATPLRWPPRLPARAISLPAALPRIAPGPSWRAASGQLAARRPAAMARAFSATLATTRSAGSSGTPGPAGRDTSLAQLRCARKGGACGRRRAFQSKVRTLLAHLLGTLCRYRNEEVPMSHFLSFAKGALAMFWLVALVNLAYPLGELHRPILLLSGVLVLVHAAEILLLNGRLKARPAPWLERLQVLLFGVLHLRSLG

SEQ ID NO: 29480 - protein, 172 aa, Pseudomonas aeruginosa
SASCSALGLTRRSNGWPGRQKSTPGYSRSGWMRNCGSPCSSRISATKSSTASSSRRWRRVCQSSMSSTTRTRGWALEKPASASGNSRAAGKGPPPRRSSPLSRLANWLTALCSARCPASRRRACSSTSRPWAVRATPRLPRSTRVQPNCPSSAWMLRDSAGWLRFTASAARA

SEQ ID NO: 29481 - protein, 220 aa, Pseudomonas aeruginosa
TARWKRTAGGNGNAAAGRSRRAPRIVESTSLGADPPACLLALCRIEQFLHHGKVPLRIALLQQQAVQAQRQAAHRRAAGAGLGGFLGQAEVLGHQLGHEAAAVVARRRSVLHHPRPGVVDFQRPVAAGAAAHDLGQHLRLEAVGHAQGHGFCGTDHQHREELVVAHLGDLAGAVGAGMEDVATHGLEQRPGLLQGFGVSADHEGQGAGCRAGSTAGHRRV

SEQ ID NO: 29482 - protein, 322 aa, Pseudomonas aeruginosa
SPSLDHGPGRPGTIGCDGSRRSQQAIEHAALLQQAAGDDHPHDFVGAFEDLVHAGVAYPALQRIIVEIAVAAVQLQGLVADIEAAVGGEALGHCAVQGRLGVAAVQPMGAEADHLAAGGEFGEHVGELELQGLEGRQRLAELLALLDVAHRLLQRRLGGAQGTTGDVQAAAVEAFHGIDEALALRADAVAGGDAHAFEGDGAGRLRAPAHLVLVAAVADVGRVGRHQEAGDAPGAVLAGARHDDQHLGAAGAGNEALAAVQHVFVALAAGAGAQARGVGAGIGLGQAIGGERLAADQAGQPGLPSAPRRRTRRASRRPCCGC

SEQ ID NO: 29483 - protein, 843 aa, Pseudomonas aeruginosa
VLGSLEMDGHVRAGRRFVGRRFIVEPAAGDGLGLGIEAHRLLAVGVQVAVEGTLPAGEGEERQRYRDRYVDTHLADLHRVLVAPSGAAGAGEEACSIAIGVGVDQGDGLFQAFHLQAGQHRAEDFLAVQAHLRRHCAEQGGTEPVAVGIAFDLALRAVEQALGAFRLAFGDQAQHALARLRADQRTIGGVRVLPVAGAQGGHPLGQFGNPLARRADEHRRADRHAALAGGAATGADQVAENLGLVRVGEDHHVVLRPGEGLHPLQVRGAGAVHVLADGDRADEGNRPDVRVGKEGIDLLAAAMNHLQHALRRAGLEEQLGEAVGCQRILFGGLEDEGVAAGDGQREHPQRDHRRKIERGDPGAHAEGLDPTGGVDLAGDVFHRLAHHQAGHVGGVFDHLDAAPHVALGIGEVLAGLPGQQFAEFVVVFLEQVLVAQHQPRSLGSRDFAPGLEGALGAGDGLLDLVGGGLRRQREDVLGRRIGDFDQLAGTAAAPFAVDQLGDCLGHRRLRFPVDRDVVLSRYSRPQAACGLTILRKGWTILGFRLPSRAAVKRSVQTSAWPLPNQGVRFITPPRLRRALARHPLGQACYPLALGYYPEAHGHHMQRRAPDDNLLIYCRAGRGWLECAGERVEVGGGDLLVLPKGREHAYGADSQRPWSIYWVHFEGGLAEDFLRPLGSAPRLRLGMQPRLLAEFDALLALRRQGLSLPHFIHAAHLLQGLLTSLAVRPARASLKSGRVLDIDAVQALMRAHLHDSLNLDELAAQFKLSRFHFAKTYRALTGQAPIQDFIQMKMAHACRLLDEGALEVRQIAEQLGYADPYYFSRLFRKVVGMAPSHYRALHQG

SEQ ID NO: 29484 - protein, 580 aa, Pseudomonas aeruginosa
  UNSURE (569): Identity of amino acid at the above locations are unknown.
RKHGSARNSTSNSLSTCKAVTSGTESCKASAVRLSSAMPPGIMPSISDWWSRVVSQPSNSAASAAANIIHSVQTRVRLTKAGALRKKLRLKWQPRALPISHWPTPLEPAGRPICRSKPRLTPAASNSGPSSQGLGWRNFCQPSATSAPAGNSRASQCQSTGAAWCGPGWPPPSRYWNAAGTSSTTSNRRRLCAAATRLSTAPWRCPRLTISLAPPGMLAKNAVARSSPLRRMKAIASTLESVVATAPKTMITLCASTCSITAGVKCRPMPMPTIHCPHLRAPGTSASGRSARQRTSITASSEPIIHGSGQPTRLASQPPRAPTSGVAQYSLQVTRSGIGQPCRATGRAAAPGADQRQQQHYHHQRPGYQADRARPEDAQFTVGDRQRAAQVLLHQSTEDEAQQQRREREVELAQDIADHADADHQEQVEGGRMHAVHADPGDDRDGRHQGPVRHREDAGEYADHRHVEDDQHDVGDEQRGDQAPDDVRLLLEQQRAGSDVVQGQGADHHRSGTRAGHAEGQHRHHGAAGGGADGGLGSGQAAHVALAELALGTGQLLLGHIGHRACQGXPGAGPFAHDET

SEQ ID NO: 29485 - protein, 295 aa, Pseudomonas aeruginosa
  UNSURE (37): Identity of amino acid at the above locations are unknown.
QTASHVDHEYAGGLLEVEQHASGGFHRLLAVVGLLHXHEDLADREQAQHQDHELDAVGEVDAVPGEAVHAAVGVDPDARQEQPEQRRQQGLQRAVAGHPAEADDGEHHQHEIFRRTEGDRPLGQQRGEQDHPAGGDESANERTPGRQRQGHAGQALACHRVAVEGGHHGRGFAGDVEQDRADPPAVFAAQVYGGEQDQRGFRRQAEGECHRDQQCHAVDRTEAWQQAYDGADQGADQRGDQVGRRHRDAEALAEVVQGFHHEVLTAAGSRERPAAAGRPGRGRTASRGRSRAGSR

SEQ ID NO: 29486 - protein, 158 aa, Pseudomonas aeruginosa
AARRRPAVVRPRRGGSASAARSATPGRRPSAPGRAAGRRAGRPVRRKTAPGNASRRPPGRRRRAARARRTGAGTGWNGSWDDPRGAAGVRPRAGWLTGSGRSPWPVACTAGPAASRSRRVPRRSWRRGTARAGRAAWRSPRRPAVGRRRSSTRRSLRR

SEQ ID NO: 29487 - protein, 774 aa, Pseudomonas aeruginosa
GRNRRRGTPGRCIRDAWVRPRRRRPAAGRRQPRRGDEKTVSSSSVLLWSSCSGLPDRQGIADDQAVLIDVAGEIGTEGRVAPADSEVLQRAALEHVLQFGVAFPFAAFAALPGEFDIVALDVAGHEGQAGNAEADEVVVVAQLPGALLGAGEVVDLDEVDQVRVAAFQVGEGVVAVHSLPGRAEGMVAKAVGEHAVERLVVDAAGLGRAAVGAAGEAQVAGQFAGTDRPAVQQADEVLAVDVLQVAVVIAGGELVGELVVQSAEVEVIGADPGEAAVLVVQREVLGVAGVADLGLFQAPGGEAEVLDLLRGEQRAFEYLREDPPVVRLYRWQLRNQRADLQLALRDLDLGGQAQFRVGVRRAAVGILRQQSGTAAAAAGVELDAEHAHGVEAEADGALGVAGLQVEDEALRPLLALGLAGAVAEVAVHVEVAGFQAGLAVFEEAGGVAQGRDAGEHDGGGGQGGAAGRTYRPCGLRQGSRHAVVSDSCSCTPSTTLQGVLADDLRRPSTDPKTPSFRQAFSNPRWQRSHLPEGFPRYTSPLVPSSGGGEPSMRILLVEDHPQLAESVVQALKGAGWTVDLLQDGVAADLALASEEYALAILDVGLPRMDGFEVLARLRGRGKTLPVLMLTARGEVKDRVHGLNLGADDYLAKPFELSELEARVKALLRRSVLGGEQLQRCGALVYDLGTRRFSLDEQPLTLTSREQAVLEAMIARPGRVMSKEQLAAQVFGLDEEASADAIEIYVHRLRKKLEGGAVRIVTFRGLGYLLEALGD

SEQ ID NO: 29488 - protein, 219 aa, Pseudomonas aeruginosa
CRQPARKAAAVAGPAPAAGAPGERPERLLERSRGGRHRLRPDLAGLGAGDRRRALREGRHPARRRPLRGTGYLRLRQRRADLLPGQRHPRTDDLRLRESSGGTRRCPAHRRLPGPGQVLRRRLPGRRRTRGEPAATGQRTEHERHGGDPRGGDRRRPRAHGAQPDDRYPAAPGRPRRRRAGAGVAGGERRAASAGSPAPRGGRAPAGRPAAVADARGPA

SEQ ID NO: 29489 - protein, 134 aa, Pseudomonas aeruginosa
IAAAGGVAEPLHPAPAQPVRAAVALHRRCRPRVAHAAGGAQGAPGTGPARAGAGSLAFDPGDHGEEHRPPDPPGQPAALPGAHRKRRPGHCRGWRRAYRPDRPGPGTGPGAGAAGLCAGSLAGAGKRRAGVDPG

SEQ ID NO: 29490 - protein, 147 aa, Pseudomonas aeruginosa
TDAAQRIAQQPAGQRAGAHPAGRQRDPQGAGGRRAGSGRRWSGNSRRRPRAGLPALLPARRQPRQRPGAGDRRRGLPGAPGADPARPGRTGRLAGAGALPGGVGRAYCSMLVAASRALERSSSSFMSTVGSRPSLANAGIWLQSRRV

SEQ ID NO: 29491 - protein, 219 aa, Pseudomonas aeruginosa
SMARIRSCWTLSASLLMAFPLKTQWPEHALRAPAMGILAGRPRTARHSLRSALDFAVAVQRVRQIEEDERRSFGASEADPAVGDGVVLQHGEQFHAVLRRTGGQYHFADAGGMDWREQPGAGRRHLVCVQRQAIQAALEAAEILHAGDDFLAGIAALLEADPADRLQVDHLWDEQLAGSAEHLADACAHLAEQPIVERRLAAVLAERGKHRLGALRRNP

SEQ ID NO: 29492 - protein, 153 aa, Pseudomonas aeruginosa
SWTVSSRIEPFECRWRVSPILLAASLALWALALLSILLAALPVWLKPPLALVCLAYGAWGLYRQVLLRGSRAFRGVRHDERGWQLWSAGSGWQAVQLRPDSLALPWLIVLRVRLPGRWRILGCCIPADALGADSHRRLRVRLRFSRRRWAAPG

SEQ ID NO: 29493 - protein, 182 aa, Pseudomonas aeruginosa
RRPDGDRRRRSAAGHRRAGGAVHPARGRRPKMIEEQGRVVATEPGAVWVETVRRSTCSSCSANAGCGQGLMQRLGVGAGRARVRALSDLSLRVGDAVVLGIHEDLLLRASVLFYLFPLLGFFVAALLATRAGLVEPLIIVSGLAGLLAAWLLVRRHARRHADDPASQPVVLRALISGPSDSA

SEQ ID NO: 29494 - protein, 475 aa, Pseudomonas aeruginosa
SMHTLKRCMAAMVALLALSLAMTARAELPDFTPLVEQASPAVVNISTRQKLPDRAMARGQLSIPDLEGLPPMFRDFLERSIPQVPRNPRGQQREAQSLGSGFIISNDGYILTNNHVVADADEILVRLSDRSEHKAKLVGADPRSDVAVLKIEAKNLPTLKLGDSNKLKVGEWVLAIGSPFGFDHSVTAGIVSAKGRSLPNESYVPFIQTDVAINPGNSGGPLLNLQGEVVGINSQIFTRSGGFMGLSFAIPIDVALNVADQLKKAGKVSRGWLGVVIQEVNKDLAESFGLDKPSGALVAQLVEDGPAAKGGLQVGDVILSLNGQSINESADLPHLVGNMKPGDKINLDVIRNGQRKSLSMAVGSLPDDDEEIASMGAPGAERSSNRLGVTVADLTAEQRKSLDIQGGVVIKEVQDGPAAVIGLRPGDVITHLDNKAVTSTKVFADVAKALPKNRSVSMRVLRQGRASFITFKLAE

SEQ ID NO: 29495 - protein, 253 aa, Pseudomonas aeruginosa
KTRATDQQHRPGGPLRQRIPCTHAVSNSLDRLERKLGYTFKDRDLMVLALTHRSYAGRNNERLEFLGDAILNFVIGEALFHHFPQAREGQLSRLRARLVKGETLALLARGFEVGDYLRLGSGELKSGGFRRESILADAMEALIGAIYLDTGMDSARERIIAWLGPQLRELTPVDTNKDPKTRLQEFLQSRGCDLPRYEVVDIQGEPHCRTFFVDCEVALLSDKTHGHGGSRRIAEQVAAAAALVALGVENGHD

SEQ ID NO: 29496 - protein, 213 aa, Pseudomonas aeruginosa
PAVQGNQRPGGLLHPVGSPARGPARRPRQGRRPGAAIRAAGSGVARARRTEDRGPPGKRRHSQPAQWPGAVQRSLSQRAVDPPVAGGRPAAGNLRPLRRDPAAAGGGATHRTAAARVRMAPAGATGLWFRSRCRHRWAPDRAAGVVPAFARGRPGAGGATATRAVPGLRTVIHGRRRLERPRRPGGGQAPDAPGARSPSGRPAAGQPRAVHEP

SEQ ID NO: 29497 - protein, 474 aa, Pseudomonas aeruginosa
APAGGRWASDGDRARPWRIPCRSLRASPAGLPGPAAGARPAAPAGSAWRLGTGRGTASSDRPRPRFPRRRRACATGSSRCRSRRRGRVCHAVRHVARHAPISSRNAIRYRPVRRRSRTAPCARESALAALPSPALAAPHRGRCAGRSAGPVRPSVRAPGAGAGPRSTNGPGRRGLPRCARRSARAGWSPSRTAESRRGVAGGRRGRGAGSWQGDHRCEVETLEPLADPAEAGGQQPFTVFLEGVGEHDVFQRAALLRDLQLAVAVGTLEGDVQVGEQRVLLRIGEAQFLREDQRAAGQQCLADPAQQAEALVGGDELQGEVHRHQRGGLQVQGENVGLDQLDRQQLLVHGVLGMQVFTAALDHRVRVVHPDHPAAVVADVAAQRLGDRAERAAEVVEHAVRLGELRAEYADVLDDGGVARHGALDHVGEHAHHVFVEHEVGDTLLGLGEQAIGLAHAGDLGHHGFSGGRIVAEG

SEQ ID NO: 29498 - protein, 265 aa, Pseudomonas aeruginosa
APRPGSRAAAACQGTGRGSRRRLRSATVRPARAEERRRTGRAGRRRRGAWSPQGDGACQDRPGRHGAGRRSSYRMCPPRAAVSAHLDRAGKAFRRFRVLFPGPPVDQFQAVVAAGGDAEAPGRFAAAANQAAVFFGIAVDLRAKALEHAGSRVAQFPAEAGGGIARQGQHQFLALRQLQRRTVVGVVQGDHRLLLPGAAGQDHDGQWQQQTGGGKGHAALLGSNGKGASINPAGARVPRLARRTAEPVGHPPPAQAGNSTLATSP

SEQ ID NO: 29499 - protein, 105 aa, Pseudomonas aeruginosa
SGNSSKWPRLASGRISSKIFCRRAAITFSRTPPMGRTWPVRVSSPVIATPFFGTWLRARESRALAMVTPALGPSLGVAPSGTCRWTNAWSKKVGSPPYFFRCEPM

SEQ ID NO: 29500 - protein, 302 aa, Pseudomonas aeruginosa
MGPRGRVSIPVRSRMLPKVSTQHAVRGYHLRQGAGQRRASRVECAKIEQLPFMFDTRLIRLPDQSHTHAHEHHQLVMSLAGRAEFEVNGCGGEVCRMRACLVPGEAGHVFAGVGDNRMLIIDLGEDNPTPEDPDLLARLFEAPRYPTLDADFQNLLSYAGAELARYGSDPLLTRALGGVLIRALHLRLFGEQQPLAASGPLDLERLDAHIVRNLARRITVAELAQVACLSPSHFHAQFKDSVGLTPHQYLLKVRLDCAARLLRESRLPLVRIAEECGFSSQSALTTAMRRYLGLTPKSLRKG

SEQ ID NO: 29501 - protein, 205 aa, Pseudomonas aeruginosa
RRPASGSRRGRSCSRGWRRGWCSRRWRVLPPARGAARRRVRRRPAPATAATPRSARCSGAAGRCVAAVRRCPCSWLGCSPRRVPGRSCRTGFPAGGCGPAPRRRRSPRERRCRGIPAAPRHRWRRPLRLPRCDGDRWRAGRCSWRSGCRTPQRCPCARRCRSAGRGRWRPPFPCPRRHRLPRRCRWRRADRWRTARRRSVRARCS

SEQ ID NO: 29502 - protein, 516 aa, Pseudomonas aeruginosa
GSPYECQYAHADHLRDLHRGHGPDRPGGISLHQQLLRLHPRWPQPRQLRHGAVRRRLRHERLAADGPARRGVPVRPVRKLDRHRPDRRRLPQLAVRRRPPAGADRAQRQRADPARLLHQPLRGQQPPAADLLGPGDPGVLHHLLRFRHRRRCAPVREHLRPLLRDRAVGRRRGDHRLHLHRWLPRGELDRHRAGLADDLRADPHPGDRDARHRRRRADLHRHRAEGRDQLRHAQGRLLHRRDLADGLGPGLLRPAAHPGALHGRRLGEIDPGRAPHLHDLDDPLPRWRRGRGLLRHRLLPGASGAGRRGQREPRAGIHRAGQDPVQPVDRRRVAVRHPRRGHEHPELPAAGLLLGAHRGLLQGLPAQGRQPAGTGLGRSRHGAAGGGDRHLAGLQPGKPRARPGVLCLGRLRRRLRPAGAVLPAVEADDPQRRAGRHDRRRGDGDPVEEPVGLDRPVRDHPRLPLRQRRHRRLQPARQGAFDEHAQALRRCGAGVPRGAPGLRRSGNPALIEPAGG

SEQ ID NO: 29503 - protein, 673 aa, Pseudomonas aeruginosa
NTTPKVATARWRRCCSMSWRRPRRCRCTCPCRPSRAGWRSARRSSSSPTSAPAPNAGPGCCIPACAVSTAPSVATPASASVPGSNAPAWCRHWRGWPAAKRSPPSPWTAATRARQPSRPCSAGSSASRPAPFRRARSDRQEVHEAVHRRGFQRCLVAAQVEDPLAALRREARGQVGLELLLQQRDAFGAPAAMAERVLHGDLAGAAAVVEEHFHGVGDGALVCLQVFTAVARLLDDLHFLAQAIDQRVGGVEGVLVVLGHQVAEDQRHGGHVLQAMVAVGGVGQRADLGNDADRRLVGGDDDAADPLQAVLHQRMQAHGGLGGGLRVEFGGEADLEQHVFHHVAAVALGEAEAPLVLGLGRQVLAGVAEQDIVETPLRRAEHAGDAHLAAQGDVRQAHAAARRVASGPGLARAGVRCVTVGAQGLAVDEGVGEGGQQLLAVGPHQLGADGGGRDLDQQHMIEADAIERVLQGDHALDLVGHDHRFQYLAHAQRRFAVGQAFLREVVGDGEDAAEVVRGMAPLGGQPGVVVVQPADDAADVPGGLDRVEPEGGARHPRAVRDQGALDQRAEVLGAFREAQRQQAAAEGIHQAVAGGVQGLRGIDAVVQHVVGDVLQDGVVVGTLVEIDVGTHRVLQWFVSGGFPLGSGWFGDGFSCRGCKTAPAFRGGGRPGQG

SEQ ID NO: 29504 - protein, 422 aa, Pseudomonas aeruginosa
VGSEGVAGYAHPAFHEDSRAAAHDRLGHRPFAVRLAGLGAHSQGAGGMAEAYRAAFAAAGGEVHQGAGNGCGGADGHRRGTHHRVVQLAHGQRADQQVDIAGRHQLAAGGAVVAGRGDEGDLRRVLAGRGFLGGLDQAHAQGAGDADPFEARQLLRVAVDLFAQLGAAVADLLGIDEHRGNPGVDHGRLEGTDPRHLQIVHQVAGGEHGAAVLAVVGRVEELQHDLGRREGHSVQLEVAGFLDLAAAHRHVGDDGLADIGLPDAHLADAVFRYPRRIHQPGVQGEGAGPGGEVAAVAAPVDEGLVDGDLAVEVVDVMARLAALREDHALAGAGGGAAHPVDVRGIGVGTADHPHEQPVARLAGDPAGFRQVFQAEEHALAGAAAQVGGGDADLGWVGHASSSSAIEFRGSGCVRQPLPVVGG

SEQ ID NO: 29505 - protein, 207 aa, Pseudomonas aeruginosa
PGPGRRPCRRWRRAGRRGRPARSARGCHGRPPAPGTRGSRGRACARPVGAAKPPGSPGRSGAPGSRRARGRYRAAWRRHRAGSPRPPRGRRSSPGGCRGAVCGVRCSWLGLNHGVFGSVSLAPWRSPRRPFEFWVRQPSGALAFGAPDGVDQRCSSGTNARCSTPVYSALGRMMRLLARCSKTWAVQPLVREQTKIGVNSLVGMPMK

SEQ ID NO: 29506 - protein, 504 aa, Pseudomonas aeruginosa
PTSTAASRAESGRPSERLGQGREQRVDIGLVELPAVAVAFAEQAVGEGGLFLLQVLDLLFHRAAGDQPVDEHRLVLADAVGAVAGLVLHRRVPPGIVVDHGVRRGQVEADPACLQADQEHRHLAALEALYRGAAVAGLAGQQDVVDAALAQGVLDQREHRGELREQQDPATLGDQFVEHVEQVGQLARAERPAAARAVFLALQQARVAADLAQLEQRLEDHDAAARQAAPGDLLADLAVQRQAHGLVEFALRLAEFDELGELALRRQFRGHLFLGPSQQERPQARGQVTEACLVAVLLDRRAVVLGELAGVAEPAGHQEMEQRPEFAEVVLQRRAGQAQAMPCRQLAGGDGGLGGGVLDVLRLVEDQQVEPPLAQLGGVAWQQGIGGQHQVVLVDAGEVAAPAGAVQGQHAQIGGEALGLVQPVGDQAGGHHHQRRRVEPPGLLFQEHVGQRLQGLAQPHVVGQHAAAVEFAQGLHPAQAFELVGPQFGAQALRRGRRTSLETA

SEQ ID NO: 29507 - protein, 617 aa, Pseudomonas aeruginosa
RRCKALFPPGTPPHDQPGPGRRTVRHRPHPRRGPAWLRAGLCGHRLPEHLPAAAASRPGLVRQPRLLRRVGRGHRLRLRRAQRLARLLGAGAGQPGAGRPGLARPRLRSASMNLRQSMSGLHTWSGLLVSWLLFVIVFAGSLASFDKELTRWMQPDVHLPGAQSLGADQVRDWLRQRAPDAHAWWMLPPSERAPYWNAGWEPRDGSEFKVFQLDAVSGQPLPKTVGGEFFFTLHYDLHAGMVGLYIVGIAGMLMLVALVSGTIVHRRIFKDFFTLRPQAARQRAWLDAHNVLGVIGLPFHLMIAYTGLVIFIVYYMQAGLQVVYQNDGERFFHEVQGSYEREEVGRPAGPPASIDGLIVEAGKVWGDGGAPGWISVHHPYDEAATVDIRRRDASRILDDQRTVNFDASSGELLHAQPSYAPGYATYGWLTGLHMIQWGGQLVRWMYLLLGLSGAMMIFGGLQVWLAKREVRGSRGVGLVRALNLAVCGGLPLASLALLWGNRLLPTQLAGRDTWEIRVFCASWALVALWAIVRRNSGTLGRTQLRLAAVLALGLPLLGLLRSPEGNLLASLQRGDWVLAGVDLSLLGLGLLCAWLGWRRRQASSKPVRRRLNVQEVA

SEQ ID NO: 29508 - protein, 211 aa, Pseudomonas aeruginosa
CWRPARWSCCSPGGHAGHCLAPPECRCSAGCWRCCAEGRAAHPCLGGGPVQRLCWWSCFPPEVCAMHTPASNTVASVIPCLRYRDAPAAIDWLCRTFGFQRKLVVPGEDGQVLHAELTYASPNGANGMLMLGSSVRDNAYGRLMRHVDEAGGNTQSLYLVVADPDALFRSAQAAGAEIVIDIKDEDYGGRGFTCRDPEGHVWSFGSYDPWA

SEQ ID NO: 29509 - protein, 269 aa, Pseudomonas aeruginosa
SLIDFSLVRSPGLYVFRRRKARTFFEQMSPRRRECLSICFGGRLPTGQRLWAWRRRRVAGLPFHRRAQVIHAVARSHAARGLRVRLVPAGWAGPFRLHRFLRRHRPALRALAAGGGVGQRGLRTARRRRPAGAGMAPAGGVRAVHPDPLRDPGQPLHVAAPRPVPILPADAAGRSPGAAGVPPRLHPGADAGAGRGAAGTTLGAGEKKPLCGGGQWPGMPGDGGAIGPGVDRVVAALARVCMAIGELCEEVQSRAANGRTVLHAAGRSR

SEQ ID NO: 29510 - protein, 293 aa, Pseudomonas aeruginosa
PGSAFPWPAPEPHRCIDVPSYRRACGRGLSIIRKKVKTMLTIDYNSYRTTTPYGKRVRFLVLHYTALDFAASVKALTTGAASAHYLIPAPHDPSYKAAGFKGQRIFNLVAEEDRAWHAGVSGWARRDNLNDTSIGIEIVNLARDDDGVFTFPDYERSQINALKQLAKNILQRYPDMTPKNVVGHSDIAVGRKSDPGPKLPWKELYEAGIGAWYDDATRDRYREGFERDGLPPRADLLEAFRLYGYALPATVDDAYFTSLLRAFQMHFRPENYDGALDVETAAILYALNEKYPA

SEQ ID NO: 29511 - protein, 229 aa, Pseudomonas aeruginosa
RLCGMTVAPTMPIARYRAAGSLSTRGLGKNPWSTSPSSGRESSNCTAKQAKISVSNATTKASSGRWPRPIRTSTSSASPTQSKAPQASGRPNSRFRAMAVPITSARSQAMIAVLAGQPQQAAGAPASSVRGRPGPGPGRWRCPGARTAPAAASPSGWRAGLPRAAGSPVARRRRRRWPSCPGPCSPPRPGSRGRRRPAGGATSGRRRGLRPAGRDRARRPGGPGYPSRT

SEQ ID NO: 29512 - protein, 176 aa, Pseudomonas aeruginosa
PCACARRVRRCRTPGSWRSRSPRGTAGRSPGTAGVARSRTAGSRSTGRNRPGAGAGAPRRNGSWRSCAHAAPTPPRGTGRASGAPGWRCGRPGTGSSARSPRSRRPCWWSGSATRPFPAPSTAGSRAGRRGRPGWRHSRGRACAFASPARRSPAIRWPPGSSRSAHRPGAAGWRSG

SEQ ID NO: 29513 - protein, 139 aa, Pseudomonas aeruginosa
TTWWRCSTKARRCRAAWASTAKPSSSAWSLATNNWWRSARRTPPASRCSTSTACRPKRYRSSATPRNATWAGPWNRCCATAACSSSAITAPARPRGCASSPSRAWASPGCRIPWSARTSPAVAWCAPAASASTCRCATP

SEQ ID NO: 29514 - protein, 108 aa, Pseudomonas aeruginosa
SMVKKFSDLRAQMSPEAQARVEAKAQELLAEMPLNELRQARGLSQKMLSEVLHVQQPAIAKMERRTDMYISTLRSHIEAMGGQLEVIARFPDGAVKISNFADIEEAGA

SEQ ID NO: 29515 - protein, 1376 aa, Pseudomonas aeruginosa
ATLALQSALCRTRPRGTQGHRLGVVSMAGVFDRIAGASGADETELTVEPMALDDGMDDEQPLMSAAVQVDERRTPQRVREAVQEMLKYGLLEESHKPNLYRSALSNIEAVDRILEPLDLAMGVDEVRGLVFVIVRQGEVAEQDDWSHPLVRRQRLNLEQSLLIAILRQQFIAYEQESGTGASQASVVVDELIPQLQVYLGELGSEAKERNRIITLLDQLKGHGLVSALDAHDRVIIRPIITHLANPENLRALVAWLREQVEGPGDPGCRWRGGYGMKQALLWRDSETFILTSIELYNWGGFQGYHRAEIDPSGTAVIGPTGSGKTTLVDALMTLLCANPRYNLASTGGHESDRDLVSYVRGVTGPGDGGIEQSHIARQGKTVTAIAATLERDGAQVRLGAVLWFEGTSSSASDLKKLWLLSESPEQTLEHWLSQHHAGGMRALRQMEKDGTGIWPYPSKKAFLARLRDYFEVGENAFTLLNRAAGLKQLNSIDEIFRELVLDDRSAFERAAEVAGSFDDLTDIHRELETARKQQRSLQPVADGWERYQVLQEQLHDKQALEGILPVWFAEQGYRLWLAETNRLEKEYKKAELDQEQCKSQLEAQKGVVDQHRQRYLRVGGAGIDQLRERIADWVRECDKRSLKAEQYQLLAKGLGLADELSAAALKENQQHIAARLEILDQQITDARQKAFDAGLVQQELNGRLQTLQQEGAEVEKRPGSNLPGQFHAFRSDLAQALGVNESALPFVAELVQVKPEELDWRGAIERAIGSHRLRILVPQDSSQAALRWVNQRHNRLHVRLLEVQEPTSRPVFFDDGFTRKLTFKEHPYREAIKALLADNDRHCVESPEQLRHTPHAMTAQGLMSGKERFFDKQDQKRLDEDWLTGFDNRDRLAFLAEQIREVNEQLEPAKLALDAAQGDVRQLETQASLLNRVKELQFEDIDLPGAQSQLESLRTQLATLTRPDSNLAMIKVELDAAEALQESLDQQLRQLIEQYVQLKTQFDQAASATRKAYNSAEKGLNDTQRELAQAHFPTLTADDLGDIVELERKHTRELQGQLKALGEKLGDQKSELAKRMSDALKVDTGALAEVGRELVDVPRYLERLRVLTEEALPEKLKRFLEYLNRSSDDGVTQLLSYIDHEVSMIEERLDDLNSTMQRVDFQPGRYLRLVAGKVIHESLRTLQRAQRQLNSARFIDDEGESHYKALQDLVGLLKDACEHSRNQGAKALLDPRFRLEFAVSVIDRESRNVIETRTGSQGGSGGEKEIIASYVLTASLSYALCPDGSSRPLFGTIVLDEAFSRSSHAVAGRIIAALREFGLHAVFITPNKEMRLLRHHTRSAVVVHRRGLESSLVSLSWEALDEHHQQRIKAMHEVAH

SEQ ID NO: 29516 - protein, 219 aa, Pseudomonas aeruginosa
SFVITTRKIAMDRSSPDGPLMPLGRYFSDNLSAVLAVAGKERENRTVGSPGPMTATQIHRKTGVARSTLRALKSQRGESAANPDLDTLDRLAAALGVPPAFLLMRPQDWFALGQALGASGDYLAAAMKLHSAGQLDNGSPVEKVLRECKVHPDARPMGVGSSPEVARANARDEWRRRSCLKFGALMLRPGRAHQSRVALAAIAGALVSASTPNDPNIDD

SEQ ID NO: 29517 - protein, 321 aa, Pseudomonas aeruginosa
MELSMAELNVIFDVPEAIAEGLKNGVYERIGGVIRRVGDKQIVMWLQEGVLLERDTAEQLLKQGAEQVQLLRQQAEQLQLLGVQQQMIMGLQVANLAVSVAGFALTLYKLQGIENKLKHMDGKLDDIRQGVEWLDARQMIGRLAPLHASLQHLREAGLYRNTTLMHQQLGIASSQLAESHSYFGGLLQHVGERALEYLQPGEFGAAYRGWVMSAQGRVQVLARLGEMDVAAQLANDFKERHAGFGRQLQQSLSNPALRLRAGRQGETNHARLLNIAEQAVGAHEIIRGNVMQLEFMRDEQLDLPVLNSPAGYQGLAFCRVG

SEQ ID NO: 29518 - protein, 380 aa, Pseudomonas aeruginosa
GWPASLFAFLARAFMANAALPSGQLPALLARGFMESSDMDLQGHLLYIDITQICGIGCAFCMYADKHKAGISMELSTLARENLARLINAPEVKRISVSGEGEPLNNAKVFHEILGLSEGGKCFEFITSGFYPHDKMADFYDAANRIVSGNGDTCNIRLSADSHHIEKVKWRAHGFSLDYLRRRRPSGLSFSFRSIDTDRDFTREYLKSELARWGVEATIEPRSVLEDVLVAGGECFGIDYKNLVHPAPGIAPGYLDMQGYIEAIESKVNKRFTFGSLNKPPQANGLDVTVKPSGDLYLYGIENQRLGNIHFDRVDWQRLVAHVRETPLTRALYTHPLTELLARLESTDLLRSIIAKANNPYWLVKELAGHAGLLEQWEVA

SEQ ID NO: 29519 - protein, 321 aa, Pseudomonas aeruginosa
PPPSYRCTRSPCCSASTIRRTSAGRFASGPASCPATTAKRPEPTPAILGSGWMCHAWRFIEIHGALAAPTVIGVLHVDIPRADPRNLSRRAFAVQLHHHWRSADQEGHRRRSGRRPRTDPAAPRPPRPAGGQHHPYPRAPGSLPRLRRDEEAHRRQPAPAQGRPVPLGQPGDAVPTVRRALHAGAGPGPLAGRRRGTGLRLRSGTAHAGAYAGLDEFLVPPGEAADRRRHPVPPWHRPHRPVGRRLGGDPAFDQAASVQPRRGRHGGRRPWPGHHAGRRDAREPLRQGLKRIFPSIGNFATWLCSKISAAPHAGAFQYLEE

SEQ ID NO: 29520 - protein, 177 aa, Pseudomonas aeruginosa
RHQADHAGQHHLRHRFGEHRPELLRAAEQPGELVQAVQPEHHRDRRLHRQHRQPPAQHGPVPASCAERGRLPDRPGRRRHPPEHPRHGPGPADREQLHCRRSRAEPARRGQPATGSGRPGPGADPAAVLIAAWTKKPAIRRAFLWALVGALRPTPWRYRETRGAGCRATGPCAPTAG

SEQ ID NO: 29521 - protein, 417 aa, Pseudomonas aeruginosa
RRYASGLLKPCVWPRRLVGRGRRSSSVEQGQRVEGDLPLFVGRDHQYPRMPRGLDRPGDAAHAAGVGLLVEAQVEQPQVGGGLGAHQRRVLADATGEDHPVQLRQGAAHRRQGLGQAVAEHLDRQGRAGVALLALLLQGAHVVGQVGEAEQATFVVQHRVDALQAPAQGPRQVAVQVGVDVAAAGAHYQAFQRGQAHAGVEALAVDDGAGRTAVAEVGAEPTAVADRQPGHFRGAVADVAVAGAVETVAAHAMLTVEGLRQGVAVGVLRQALVEGGVEHGDVGQLGKQRHRCLDALQVGRVVQRRQRRGGPDRLDHPVVDARGMGEQLAAMHHPVADAVELAARGVLHHRQQLGEGGAVVGVGNHQAVAVAAALPAQHRIAAAQALGEAVQGKQGVGLVDQGELDRRTAAVDHQYVA

SEQ ID NO: 29522 - protein, 200 aa, Pseudomonas aeruginosa
KSITRDGARAPRSSGARSLSGLLMRTLTHSSSLSKRFRTMQIAANKAVSIDYTLTNDAGDVIDSSAGGAPLVYLHGAGNIIVGLEKALEGKNVGDELSVAIEPEDAYGEYSAELVATLTREMFEGVDELEVGMQFHASAPDGGMQIVTIRDIDGDDVTVDGNHPLAGQRLNFKVKVVDVREANAEEIAHGHIHGEGGHHH

SEQ ID NO: 29523 - protein, 134 aa, Pseudomonas aeruginosa
PLQPARAGAALLRRAAGALRPPGKARIPLLHRQPELRDGRAVAADRGQGRVDPAGFRANPPGLSGAGARGRRTGRRRGLREPGRLHRLRLAGRPGALQGRHRPRSAECFHVAPGAAAPRLIPARTSHSLSGVRP

SEQ ID NO: 29524 - protein, 344 aa, Pseudomonas aeruginosa
LQSPKRALYDRQHNNRPRNGQRSESMRIGLVVDATCDLPPEFLAAHGIRVMPIGIRLGEQRLIDRRDPDTTLSFYRDHLPKVGSKDGSQPLSAAELQQWFLDELVTDFDYVVCLTVDSLRSPIFEHATQASFGLLQHYHERRHAAGIAGPFTLRVLDSHSVFAGIACLAAEGTRLLAQGSHPNALRTRLEQLSQQTCTYLVADDLGHLRRRGFQKGDRSGFVDRVKGAALGLGSLLDVKPVFSLADGEDKPVALSPSFEKSAEKLFGYALARVQAGELLAPQLGLSYAGDPTALRDLPGFAALENACRERDIHLHLGMLSPTGGINLGAGAMSLGFIATPKAFA

SEQ ID NO: 29525 - protein, 440 aa, Pseudomonas aeruginosa
QPHFTDRLVRFEFIATAALPGIGRVRRHRHAARQAAEIADVQLQVAVALIGDRYLGPRHLRGEMQVAVELAEEAVGAVHLEGVAAVGVEQVVEFVVEGPAQFLSAFLDHRIAGHGIEARIADFPRLHLEYRSGVSLRIARQAHAVVAQGQAQLAGGDVEGQRGVQLVGHREGRALALFLAGQALGLVGPVLGTGPVELLPVGVLLARVALRDVGQVGGDLGIACALEVEQRSQVAADGTPPGRDVFLDDAEAAFEEAQHRGMVEHFGADLAALRPGRDGDQRDAVAEPDGQPAGCLDLAGGADRGKADAILPRRHRGAGVVIEAVALVVVEDEHGPGPDLGVAGQRLEHPGHVVLAERGAPPGMLAVAVGRDDPRHLRQRVLLHILAQLVDAAGEHGALPEVRIARSVLEVPEPGEGVAVIVVLLLEPVFPVGVDVQVPE

SEQ ID NO: 29526 - protein, 281 aa, Pseudomonas aeruginosa
QCRQRTPGACLFHQRLLAFLADPEQGGAGDGGGHHDQVDQRDQQRQVGHPAETHARPALAAQPGEHLVPAELVVVRRIVDVLHRHHPDAEEDPQRRGDQVDPGHEAQHQQHQRARQEVGELAHLATHGARDHRQQFGPAERREVVAAANHHLDLFREEAVERRGDDVGDHGEGEEHDHQHQQDEQRPDDVLQEAQPVGQAGHQQVDPVAELLHREADQQGEHQQVEGQGDQHEQAQAGTHDQLQAFAEVLRAAQGWHREWFSDGMRAETLADWRKPATEPV

SEQ ID NO: 29527 - protein, 192 aa, Pseudomonas aeruginosa
PRISGWRLVQAIVVALALGLVHGAVGGTDQSFGIAGMPRVESDADARGDEVDAFAIQRDRLDQRRQQAFCEALRIVFLAVLEEHGEFVAAQAVGLVRLPQGAAYPFGDGPEEGIADVVAEAVVDLLEAVQVQVQQRQFASAGAGAKQRLAELFVEGLAVAQAGQRVAVGHFQQLLLVGDLVADVADDAAVAP

SEQ ID NO: 29528 - protein, 459 aa, Pseudomonas aeruginosa
FALQVVDQRNRGLEVAEAAVGALQGDGEGLACAALHGALEGLAGTRQVVFAEQFVVGMADQRFARLAEQLAERGVDGEDHAVDVHFEVAVAHRLEDRPVARLAVFQALEHLVHLARQLSQLVVAEVAQAYRVGVASDFGDLPVEPLDPAQDPQLQGQVADQESAQRDQQGGAEEEVDGLLALDVEQAFLGDVEAQLRLAAGTQVLHRDLLDMFADEPPWAEQGLVVGTAAAAAQRLPGGVGGDVGHRLQVGLHLFAEVGQAFPVEEVAGEDRALRRRATLVVADRHADQQGRQVVDQQQLAQAVVGASAKVQRAEADGALLQCLEQGLVARRGGAEEHALVGRGRGPLLQLQVTPVVEEQDEVESQVVEHLVVEVFLFEGLVGALDEVVAGIPPGVGANDVQVALQLEVQPVVQDGGALLQALLVLSVETAQQDAFRQEPDTAETGGQQRQEQPEQACA

SEQ ID NO: 29529 - protein, 164 aa, Pseudomonas aeruginosa
SNCSSRPRIQTLHPSHDNTIEGASSMFLSPSAICLLGLIAWTLLLVFLLVSQRGLLVLGGRMAVNAFAADGSNTPGGFGQRLVRVHANCVENLPLLAGALLYAIASGQSSLTDPLAPLVLGARLFQSLMHLVSTSALFVWLRFAGFFVQLLVLAWWLLLLAGLA

SEQ ID NO: 29530 - protein, 425 aa, Pseudomonas aeruginosa
TGTRSQGFAGGLYRCADSPSRGGCLAAKTTAARSGRQSRALQQGPGVLPGHALARGVVEVPALAPAGVRVGLALVALAIGTAHYGPGVVLLQALRIVEVDLAVAARLLAAALDRQFDVDLEAVAGLAHVDLVVLRAGHRADRPVGIQHADVDQGGVLVDLLRQRQRPLLGTVGALGQGQAVTLGVAALGIEQTQGDGSTGWQVLLRAQVAQRLPGVGDGAAEAHVDAGVEGFRAVRALPDVIDHMLAGLALGQRAVHPVGAVLQLDAGDRAERRGFQVAPGQRLLGVVAVLGDVEVEVAGRVRRAGLVDELEVAAGVRRDGSAGPVAASQVQALEQCLAGAAELAVGDHRLVVAVGVALVDAIPVVQRLGAAGGDGGLAGGRLGILRTFEEAAVDPTGRRFHRAVGMGCLGQEQGEGEWQECQGG

SEQ ID NO: 29531 - protein, 407 aa, Pseudomonas aeruginosa
VFSRVRIRQFRPSLPPWVPLPSLPRGHFSPRCGSEIDCPPPASPARAGRTDPAEGAVHRHAVAVVVAQGAVETAEPLAGIGIEQADAGPRLVQLFGTEEQLDATAGAVQAPFGQRVARLADVHVVEHAAELAAEPQGVLAQVAGFGPAGAEVAGDAAGGGEGGAGPVGMQRPDAAAEVQRGKALARLAVVAPAAELQAAADRQAELAAAGMEGVFAHRHHQVHRLQVRRSSHFQRQLQRQATEVRGLAGDAQAPGLFVEAQLQAGMLEGMAGLRLVGQLAAEAEEADLRVRYRLAAVQVEEIGGAVGQVVEVGDGQREHPAGADDAPVVPALAPAEVAGDVAEHPRPGGPADRPGIEPAVAVAEVAQGRGRYGEGIGGGSVHLTHPCDRLTQACRLRKEGGKYPLQN

SEQ ID NO: 29532 - protein, 103 aa, Pseudomonas aeruginosa
FAMSMRDRIQTALQPLDPQHVEVLDESHMHSRGLETHFKVVLVSPQFAGLNAVKRHQKVYATLGGLMGEFHALALHTFTPEEWSQAAVPASPTCRGGSKHDIP

SEQ ID NO: 29533 - protein, 694 aa, Pseudomonas aeruginosa
GRSSGRSTPRVAMSPRRRCSPAWRKRWGFRASSSPRPSTAARRVTPPPPISPGSRISASPGSRPCWPNATANWRCSPTATSRLPNFHPCSAAGWNGAGMSERGDRLSWAEIRRLALRHKKALLFANLVAVLATLCTVPIPLLLPLLVDEVLLGKGDGALRFMDRLLPADWQVAFGYIGLMLAATLLLRGAALVFNVLQAKLFARLSKDIVYRIRLRLIERLRHIALGEYETLGGGSISAHLVTDLDTLDKFVGETLSRFLVALLTLLGTAAILVWMHWQLALLILLFNPLVIWSTVQLGKRVKHLKKLENDSTARFTQALTETLEAIQEVRAGNRQGYFLGRLGHRAQEVRDYAVASQWKSDAAGRASGLLFQFGIDVFRAAAMLTVLLSDLSIGQMLAVFSYLWFMIGPVEQLLGLQYAYYAAGGALQRINELLARADEPRYPPLRDPFAGRTTVGIEVRGLDFAYGEDKVLEQLDLNIGAGEKVALVGASGGGKSTLVQLLLGLYSAQRGSIRYGGVPLEEIGLDCVREHVAVVLQHPALFNDSVRANLTMGRERSDQACWRALEIAQLADGVRRLPQGLDTVVGRSGVRLSGGQRQRLAIARMILAEPKVVILDEATSALDAATEYALHQALGDFLEGRTTLIVAHRLSAVKQADRVLVFDGGHIAEDGDHQQLIAEGGLYARLYGHLQQM

SEQ ID NO: 29534 - protein, 822 aa, Pseudomonas aeruginosa
MVDGMRQNRTLDKPRLLGLVWPFIVVVLLQAMLAGGSLYVLSAVRSYVGGESLWSKGQKDAIYYLTLYADSRADEDFRRYEEAIAIPLGDREMRLALDQPDPDIEAARQGILKGGNHADDVTAIIWLYRNFHDFSYFERAIELWLVGDKYVMELIDVAGKMRAGIGAGQASAEQVQQWKTEIHAINEKVTPAAKAFSDALGEGSRALLRLLLVANLTTASVLILLAFLRTRQQLMQRQEVENALDAERERAQITLASIGDGVITADTQGGISYLNPAAEQMTNWTLDKARGLPLASLFRIVDESSREEGMLLIEQILSGEIDGGREHSKLVLRHDGSSVPVTLVGAPIHRGGEITGVVLVLHDMTRERQYMARLSWQATHDALTGLTNRREFEYRLQIALERLERNSGRHALMFLDLDQFKLVNDTCGHAAGDELLRQVCTLLQQGLREGDTLARLGGDEFGILLENCPAEKAVEIADHLRKTIQDLHFTWSGQPFNCTVSVGLVHLLPGISTLEEALRSADMACYMAKEKGRNRVQVFHQDDVELSMRFGEMTWVQRIHLALEEDRFSLYAQPIVPLGEGAEEGLHVELLLRLRDEGGRLVPPLSFIPAAERYGLMTLIDRWVVENAFRTLVERAQDPRAEPIGTCAINLSGATIGDESFLQFLTELFARYRIPPQTICFEVTETVAVANLASAIRFINELKDTGCRFSLDDFCAGMSSFIYLKHPPVDYLKIDGSFVKDMLEDPIDRAMVQVINHIGHVMGKRTIAEFVETVEVMEALREIGIDYAQGLAIGAPLPFSRQPPGAGLDAQGLWPSLGQNLR

SEQ ID NO: 29535 - protein, 157 aa, Pseudomonas aeruginosa
ARRRRPAGSGTARGYRRGRIPAPARCPRPPGRAEPSVPPPPPRRSRGPVPGAGWYRGSGRGRSSRRSDSARRRGFPPAPHRRREAGRACPPARGRRGRRYGRIAVLSSGAPCRRGDQCSHCCSRSRPRGKSCSPSCMPSRPTRAMAGGAGERKSRTA

SEQ ID NO: 29536 - protein, 138 aa, Pseudomonas aeruginosa
RSARAAAGRPPAPGCGPPGRGRVPGSGKCCASATRRRPAPHGAGPEATRPPVAAGPAGPRRASPATSSRTPHKAPGPRRARGHRRGARQDICGRPRAGAGDCRSGRVGRVVPWECRRGGKTQVNRLTPIMQRRLSSQP

SEQ ID NO: 29537 - protein, 504 aa, Pseudomonas aeruginosa
FNGRPTSAFGRAQARPEESSHPVDRPRRRHRHRPVPRLGRGAQVGGPVDDPRLRHRRLHRFHDHAPARRDDRRGAGRRLLQPLRAQVLGRLRRLPLRLELLGAVHPGRDVGTDRGRQVHPLLVAGGADLGHGGVVLRRRQRDQPNQRQGLRRSRVLVRDHQGGGDHRHDPARLLPAVQRQRRSAGFGEQPLGTRRFLPQRSERTGDGHGDHHVLLRWPGNARLHRGRGGQAEDGDPEGDQPGDLSHPDLLHRRPDRAALADALGQPAADPQRFRRCLQRQPVRADLLDDRQRHRRAPAELRGAHRRTVGVQQRHLLQRPHASRPGRAGRCPARAGQGRQARRTGMRPGGIGAGDLPRGGGELCDPAPGAGAADVAGGGGVGDQLGDDQHGAPEVPRADGPPGHPHALPRVLVSVRQLPVHGLRGVHPRRHVADPRHPGLGLCHPGLAAGDVGLLPTQGSPAADAGPAGEAGHRVIDGAPARRGEGSAPLRVPAAHKTFSRGACR

SEQ ID NO: 29538 - protein, 147 aa, Pseudomonas aeruginosa
RGRCRIPTVAAPFFLVRGISMKKALWLLLAAVPVVLVACGGSEDDKHTAQVDYLALPGDAKLDTRSVDYKCENGRKFTVQYLNKGDNSLAVVPVSDNSTLVFSNVISASGAKYAAGQYIWWTKGEEATLYGDWKGGEPTDGVACKER

SEQ ID NO: 29539 - protein, 502 aa, Pseudomonas aeruginosa
PQRGYPPPRRECAAFAGAKKSRPSQPAQGNREGSVRADLGDGLRQAVEAARVYTGDVGPAAGHQVNGVLVAQPSDLLRAQSGIGKHPALRADMGEALGQAVRRQGFDQADAQAGDARAHAFDLFLPKSLQLAVAEDRRDHLGAMRRRGRPEVSGEEGQLATQVGELLGVLRADDQRPDAVAVQAEVLRAGTGDQHLRQFAGEQAYRPGVFLETVAEALVGEVDQRQQLAATHHVEHPAPVVVAQVETGRVVAAGMQQHHVSLGNALQASKHRLDIQAVVGADVGVVGNLQAGGGEQGLVDRPGRVAQPDAAAGQAMGDEVAGQAQGAGAAGRLGGVGALLQQQRRGGAERQFRQARGEQRIAVAADVALGGFLLDQALLGEFHRAQDRGQALGILVDTDAEVQLVRARIVAVGVEQAQDRVARYAGDLGEMTHLRPSAVFATSSVRAAMMKSLRCRPLIEWLHQVTVTLPHSVSRPGWWPSASDISPTALVKARACLKFLNR

SEQ ID NO: 29540 - protein, 108 aa, Pseudomonas aeruginosa
QNLRRLGVSSGLRGKETRHKRQSLEGRDGYPVQYARVRQRRGDRQFHCRRPAPGPDDRLCLPCGGQAGGPPADPPAASHHPAHRADRSRAALPDARPADTRLHRGGRG

SEQ ID NO: 29541 - protein, 416 aa, Pseudomonas aeruginosa
PVPSQRLRPLPLAAVPGCEDPHLGRVPPRAHAGDARRGRAQPGGERWVGELSGSGGRRPSRRSHPGLSGVVGRITAWRLSADSPEPRGQRQGRYPPYRLSPTLCNSSINARRQLGSASRSRTSRLRSRIAQGSSSSMVASFIVRLWRRAADCGITPMPTPPSIIRQIASKLETWMRSDSCSPICSTRSYRKACRVVPSGRPICWNCRVSRRRTLACPASGWPWGTAITRRSVLKCRICRPVAATGPAMMPRSVEPSSTPRTMSRLRRSCRSTVTPGRAARKPARISGRNSVTAVVLAKMRICPAASLPYSVNSLFRYSTWRMISRACCSRRWPAGVSSTPRLSRYSRRLPSWPSSALTRALAAAGERKARRAPWVRLGDSAIWMNRRRSARSKCMGTPWRSANPNAPLRNCKFSKR

SEQ ID NO: 29542 - protein, 319 aa, Pseudomonas aeruginosa
VRFRPLDRSPGRNPRSIEPQPGQAHRRHLRRADPGPRRSAAAALALGVLPGPGGGRRPRRRRPPGARRFPAAGGRSQPHVGRRAPGVPPAAAGRRRGQPHLDHPPGRGEARSQRRAAVRHPAPRLPPGRPTGAERRARHRLPRTDPAQARRYRGLARGRLARGAGARSGVAVPLLGGDFQRPPHSLRLALCHRCRRLSGPGGARSADRHPGPARVLPGQSAGAPASLRLSRPAPADLSRAVRGRRPPARCRQGRGMGRQWRRPGPARRRGIRLKGPQRPSNDKNRGVTDESEQRRAERDPRGCTCPLRRIRRRLLAPHR

SEQ ID NO: 29543 - protein, 293 aa, Pseudomonas aeruginosa
PDRRGRQGLPLHPRRPQCRAHPDRRRMHRRRPLVHRQGQPLCPRPRGLRPADRAEPGRAVPHRRGAHRSGGRRPDALARLPGVRRRAQRRGQREHGQVPGGESFLGGGQRLPADPRRLRLRLRVRRRAQVPRDPPVPGGADLHQPDPVLRGRAPARTAALVLKREPPMQIDRLDHLVLTVRDIDASIDFYTRVLGMRAVTFGAGRKALAFGAQKINLHQAGGEFEPKAERPTPGSADLCFIVATPLEAVAEQLRQQAVEILEGPVQRTGAGGPILSLYLRDPDLNLIELSNPL

SEQ ID NO: 29544 - protein, 420 aa, Pseudomonas aeruginosa
SDQPNQPHLVFDGRGQGVRPMTQSHRPRPLDGITVVSLEHAIAAPFCTRQLADLGARVIKIERPGVGDFARGYDERVNGLSSHFVWTNRSKQSLSLDLKQAEALPLLEKLLAGADVLVQNLAPGAAARLGLSYEALRERFPRLIVCDISGYGEGGPYEKKKAYDLLIQSEGGFLSVTGGAGPNEMAKAGCSIADIAAGMYAYSSILSALLLRERTGEGSRIDVSMLESLVEWMGYPMYYAYQDAPPPPRAGASHSTIYPYGPFPAGDGGTVMLGLQNEREWRAFCDKVLRRPELADDERFSANFKRSANREELRALIVEAFAALPAAEVVARLEQAQIASAHVNDMAGVWAHPQLQARQRWTSIDSPAGRLPALLPPASSSAFVPRMDAVPALGGDSDALLAELGCTAADIQRLRATGTV

SEQ ID NO: 29545 - protein, 313 aa, Pseudomonas aeruginosa
GGGHEPTDRAQRAVRPGDPPGADPQGPCQRRRPGHRRPRGCGGGGAEGRGAGQSPAFPRRYAGSPGAGADQRGGASRACRRPGAVPRPRRSDRPAPAESGERRPGAPRRRGQRQAGLAHRRECPRPCRAGRDRRRRGGRAAVLRQPRPGPGPRSQQRQQRSRTDSRSRPLRTAPANAPGRPGAAAGRRLSGDPEPCRTGRGSALRSRHGLRRVAVHPSEPGRADPPDIDAESRGTGVGASGGRGRRLRCRRLRGRRRDGRRAGAGARATPAGAGRGGWLNAFDRRERGLEQWRILRTRRLRQARRYLESTTTI

SEQ ID NO: 29546 - protein, 334 aa, Pseudomonas aeruginosa
GHEMFKTMVRALLCALAIGGSCLANAAQPIVIKFSHVVAENTPKGQGALLFKKLVEQRLGGRVEVDVYPNSSLFGDGKEMEALLLGDVQMLAPSLAKFEQYTRKVQIFDLPFLFDDIQAVDRFQRSPQGRALLTSMQGKGILGLAYWHNGMKQLSANRPLLEPEDARGLKFRVQASDVLNEQFRQLRAISRKMSFAEVYQGLQTGVVNGTENTWSNYESQKVNEVQKYFTESNHGLVDYMVITNAKFWNGLPADIREELQRIMDEVTVQVNLEAERLNRDARQRILASGASEIHTLSPQQRADWRQAMQPVWQKFRGNVGADLLQAAEASNRPD

SEQ ID NO: 29547 - protein, 228 aa, Pseudomonas aeruginosa
PVRPRPAGRGIVENAAMNRLVRVWNRFEEGAIAFLLAAMTLVTFLYVVMTNVFTLFYDLGDRLPTLRAPLYSMGDAILGVAQDMSWSNALTKALFGWLIFLGIAYGVRTAGHLGVDALVRLAPRPLQRLIGILACLCCLGYAGLFMVASYDWVKTLFVAGIGAEDLDHFGILQAYIAVVVPVGFGLVLLRYLEILVNLLRGRQLGLGLADEAAEASKLAGEEAGENRP

SEQ ID NO: 29548 - protein, 679 aa, Pseudomonas aeruginosa
DHGRMVRGVCARYNWAQQKQHSRTEVKAMSAASLYPVHPEAVARTFTDEATYKTMYQQSVVNPDGFWREQAQRIDWIKPFEKVKQTSFDDHHVDIKWFADGTLNVSHNCLDRHLADRGDQVAIIWEGDDPADHQEITYRQLHEQVCRFANALRGQDVHRGDVVTIYMPMIPEAVVAMLACTRIGAIHSVVFGGFSPEALAGRIIDCKSKVVITADEGVRGGKRTPLKANVDDALTNPETSSVQKIIVCKRTGAEIKWNQHRDVWYDDLMKVAGSTCAPKEMGAEDPLFILYTSGSTGKPKGVLHTTGGYLVYASLTHERVFDYRPGEVYWCTADIGWVTGHTYIVYGPLANGATTILFEGVPNYPDVTRVAKIIDKHKVNILYTAPTAIRAMMAEGKAAVAGADGSSLRLLGSVGEPINPEAWQWYYETVGQSRCPIVDTWWQTETGACLMTPLPGAHAMKPGSAAKPFFGVVPALVDNLGNLIEGAAEGNLVILDSWPGQARTLFGDHDRFVDTYFKTFKGMYFTGDGARRDEDGYYWITGRVDDVLNVSGHRMGTAEVESAMVAHPKVAEAAVVGMQHDIKGQGIYVYVTLNSGVEPSEALRQELKQWVRREIGPIATPDVIQWAPGLPKTRSGKIMRRILRKIAAAEYDTLGDISTLADPGVVQHLIETHRSMQAA

SEQ ID NO: 29549 - protein, 306 aa, Pseudomonas aeruginosa
NAAHPSWRPVHEKAPCARAGDHAYPSAAWARFYFSCQSMPSPSKEFQMKKLALLGALALSVLSLPTFAADKPVRIGIEAAYPPFSLKTPDGQLAGFDVDIGNALCEEMKVQCKWVEQEFDGLIPALKVRKIDAILSSMTITDERKRSVDFTNKYYNTPARFVMKEGASLNDPKADLKGKKAGVLRGSTADRYASAELTPAGVEVVRYNSQQEANMDLVAGRLDAVVADSVNLEDGFLKTDAGKGYAFVGPQLTDAKYFGEGVGIAVRKGDSELAGKFNAAIDALRANGKYKQIQDKYFSFDVYGSN

SEQ ID NO: 29550 - protein, 111 aa, Pseudomonas aeruginosa
PSSWCACSSLPSAAGWPTWRRANPDPEDRMERIDHLLPWSTLGSEKRLSVFRLRLRRAQGLHPVQPARRRAAGHAHRLGAEAAGCACWRRKAACAAPSSWCRWAIRSVSGR

SEQ ID NO: 29551 - protein, 277 aa, Pseudomonas aeruginosa
AAGRNFNRDFPDLLDAVIDSVGERLGSDPAANVALVRQALRAALDALPPATSELEGMQRVLYRHACDADLVLDLHCDFEAAIHLYTLPQQWPTFASLAARLGAAVGLLAEESGGGSFDEACSVPWLRLSRLYPRAELPLACLATTVELGGQADTTVQQAEANAAAILAFLAEQGFVEGEWPAAPEACCEGLPFEGTEYVHAPHTGVVSFLRRPGEWVEAGEPLFQVIDPLADRASTVCAGVSGVLFAIERMRYAQPGLWLAKVAGRQPIRQGRLLSD

SEQ ID NO: 29552 - protein, 260 aa, Pseudomonas aeruginosa
LAENTHMYKLEVQDLHKRYGSHEVLKGVSLAAKAGDVISIIGSSGSGKSTFLRCINLLEQPHAGKILLNGEELKLVPGRDGALKAADSRQLQRMRSRLSMVFQHFNLWSHMSALENVIEAPVHVLGVSKKEAIEKAEHYLAKVGVAHRKDAYPAHMSGGEQQRVAIARALAVEPEVMLFDEPTSALDPELVGEVLKVMQDLAQEGRTMVVVTHEMGFAREVSNQLVFLHKGLVEEHGCPKEVLANPQSDRLKQFLSGSLK

SEQ ID NO: 29553 - protein, 349 aa, Pseudomonas aeruginosa
RSEGASHDRTSCYQRRPAGPDRAGAQHRHRPDHPAGQRAAPAASRQLGREGLPRRGRTRRRRLPVRPRGRRRQGRRHLRHRRSGGASRTLVQLPGRPHRERLAGTQHPSRDPHAVPGQRPDRQFRAVLAVPPRRPPQRPQRQAAVARALPVHRRIPSPVRRQADRRDARHVRRGGAFAILGKPRPALLQDGILPGRLPHRGRQQGLHRRADAEVPALYLLPLRGGARGDRPRPSEHRAGAGHAQGRGLQLPGLRRHLRRRPGDRGRDRQDPRHRREPEPGAGGGHSRRRRRALPDPQPQARRLSHHRRAGAGRRRHPGGRSADCQAPAPVGRRLGTRGAAVGAEARLKA

SEQ ID NO: 29554 - protein, 231 aa, Pseudomonas aeruginosa
LRGVQAQRADPEGRRADAQGLDPGRPAGRRAQPGPGRSRNRRRAGRPPWARRSVLHRVQSHRQPAAQPVWRPAAENPGAGDGRQQPAGGGGGRRPRRRRLHHHPVRLHLRRPALHLRPPPAGAAGRLGRRTAGAPGGGQRYPAGRSLRRTAGAVHGRGDFAERRRAPAQGPGAFDRQGRTAAAGDDPADRRRRPADPGHPRRQRGGRATGRRVLRAAVASDPLLRFRCGDP

SEQ ID NO: 29555 - protein, 539 aa, Pseudomonas aeruginosa
SQRHPVRPGRRVAVGFPRAFRAVPRGKPRRHRQLEQAAHRRRQQRAVRRYRRVRQPPAERLLRRRLLRLSGRLAGKPQRVPSCHPDSRDQPMNAHEVNFDGLVGPTHNYGGLSYGNVASQSNSQAVSNPKEAAKQGLAKMKALMEMGFKQGVLAPQARPDTAALRSLGFSGSDEEVIRRAAKEAMPLLAACSSASSMWTANAATVSPSADTADGRVHFTAANLNCKFHRSIEHPTTSRVLAAMFNDERHFAHHAALPAVSQFGDEGAANHTRFCKDYGDAGVEFFVFGRSAFDSRFPAPQRYPARQTLEACQAVARLHGLSEAGVVYAQQNPAVIDQGVFHNDVISVGNGEVLFHHEDAFLDTEKVLAELHDKLGRRGGRFRAICVPRDQVAVEDAVKSYLFNSQLLSKADGSMLLVVPEECRNNPRVWNYLDQLTGDDGPIREVKVFDLKQSMQNGGGPACLRLRVALQERELAAVNPGVIMSAGLYDTLVAWVDRHYRDRLSETDLADPQLLLECRTALDELTQILKLGSVYSFQLD

SEQ ID NO: 29556 - protein, 425 aa, Pseudomonas aeruginosa
CGPLPAIRGRQFSVEEPMKSAEIREAFLRFFEEKGHTRVASSSLIPANDPTLLFTNAGMNQFKDCFLGLEKRAYTRATTSQKCVRAGGKHNDLENVGYTARHHTFFEMLGNFSFGDYFKRDAIHYAWEFLTGEKWLNLPKEKLWVTVYATDDEAYDIWTKEVGVPAERMVRIGDNKGAPYASDNFWAMGDTGPCGPCTEIFFDHGPEIWGGPPGSPEEDGDRYIEIWNNVFMQFNRTADGVMHPLPAPSVDTGMGLERVSAVLQHVHSNYEIDLFQNLLKASAEAIGCANDDAPSLKVVADHIRSCSFLIADGVLPSNEGRGYVLRRIIRRACRHGNKLGARGTFFHKIVAALVAEMGDAFPELKQQQAHIERVLKTEEEQFAKTLEQGPEDPRTGPRRTAGQRDSRQRGVQAVRHLWLPGRPDQ

SEQ ID NO: 29557 - protein, 256 aa, Pseudomonas aeruginosa
GRHGAVRREVRRPGARTEHGRRFLRRAVRWHPRIPHRRHRPVQDHQRGWRGCRRTPYRGGHRRGGAGLPERCRGAAQGSRQPGQGQPRQPAGQARRPAGAQPLAGEGAGTAQGQGCQRGRRRPFGGGGGNQGREGTRRAPRWSGRQGAAGAGRPVEEQARPRSDPARRRAGREGRTGRRRDPGPDRPTEGRRAYEASRGGSWWQRWRTPGYGPGRRHRCSEIGRGPGPGPALRRARALMPCRPRARAMRGRAASAP

SEQ ID NO: 29558 - protein, 237 aa, Pseudomonas aeruginosa
WPGCIVPSTSRRGCSGYCWCCWSCCCRRAATWRGSCACIERTYFAPAWPAVVSAASVPVRHPSILKKEFAMSSATVRLDHAALRETLRQLFGLPAGSVIDADQLLAPPAIPFMTLRLESSSLLGKVRREFSASGEQESLLASCESIFRLTWHGPEAHQYLQDARCLLQSGNAGERLRVLKASLLRLTPIENLSVVQDGQALGQARFDLVLAHEHVLLVDLERTAPGQASGGAGGTAS

SEQ ID NO: 29559 - protein, 225 aa, Pseudomonas aeruginosa
ASCSPERLAMKKPRGAGLFRGAQTSSAQRSYSSASVMRTRTLSPGFSSSLSTNTLPSISGASAQERPTAPCSSTSSISTSISLPTLSCRRAAEIACWWAMKRSQRSCLTSSGTGSRPSSLAGAPSTGEYWKQPTRSSWASVSQSSRYWKSSSVSPGKPTMKVERMVSSGQISRHCLIRARVLSSKAGRFMALSTFGLACWKGMSRYGRSLPAAISGITSSTLGYG

SEQ ID NO: 29560 - protein, 473 aa, Pseudomonas aeruginosa
SRSGVGSVLAVADGLEHLLRQGQVVLVEVVAARQFELLADGLGLGTAAFVLFFGAIDAEHLGCRQPGHFRAGGGFLAGLAQPAFHFDLEAAGPRQRQQQHGFHLLLVLSGQAVVDRRQDVSAERVAGQDETFRAPLLAVVLHQLGEVGGALFRALVLPVVAQGVDADHRVAHAGHMLGRVLVQVAPAAVAGIEQGDDVRGLRRGDLEYRQGLGVALQLQAQLMGEHVGQRGVVVADAGFRARLLADEDCGVVVRVVVPGQQPLAVRRLVRQRGVAVALGQGNVEADRERLGLVVVLAGEPAPGGGRARADAGDQVRLAAEAGNDRFEPGLLRPAIAVFRREVLDHPGGAVVSQVQHLGVVQLLFGGGDHHHPRARLLAGFGKGGVAAVVEVQGFQFRLGRRSAPEQQGGTDDQHQGGDQKTAPVTFHDRHISVSPIQSGRRRSARRYRPGPPAGRARLARPGSGVPSRAGTCP

SEQ ID NO: 29561 - protein, 230 aa, Pseudomonas aeruginosa
SDRSAGCVVGTRESWVERDVLERERRCASATSWEFARQSMASRASSQVVAADFFCAGRRPVTGRRPPGFAGVASAKWPKAICWYSFSDGSACRGHSGGLHCPTISEGGRVTMIQAGIHVGAGVVLGVAAGWWLGDWEQSLQVKDSVARVDCLLYGALLVVLLRHDGWLRRLGLLGLGLFCGSLLVYSVNPASLFAAKESWSLARISMRAFGPLVMLVVGMACARLAHELR

SEQ ID NO: 29562 - protein, 197 aa, Pseudomonas aeruginosa
PTTSSGRWKPARWNSASISAKQVLKCTRVNGVLPSVTRPSICSSSTAWRMSSSSIRFTLRFNCSTFSICLSFPYPLPSIHRRLSLLYEYTVKCAMMRANGGRGDAVEQEGRNAKSPGAIASAGAFRMWLRELDLNQRPSGYEPDELPDCSIPRLCGRILRTLVGLSIDFSKKVFFLQMLSACPMLEFSAPGQARRGL

SEQ ID NO: 29563 - protein, 136 aa, Pseudomonas aeruginosa
AGFRWSGRPRATAARHSSGWRHAAGGPSRAKRCGRRCRGPGESPGGPPPARPAASPACRRRGRPCRRPGAALPRGRARSTGRAAAHGSCWPATGPGSVRSTSALPGPIAARRSAWSGSRPCRPAAMRASRWKAHVR

SEQ ID NO: 29564 - protein, 302 aa, Pseudomonas aeruginosa
THVSPSSQIGMADAPRPYVYPAQFSGSRKGNLHRCAQPGGFGLRRSGKIVNTGTIANQSYLAAMFPSLTPDPRLLAIEDDPTLGAHLFQHLNGSGFEVTWCRDGEEGLAAARSGGYDLILMDIMLPGRDGLEILRQLRQEQALPVILMSALGAEQDRIAGFSQGADDYLPKPFSLAELRVRIDAILRRIALERGGAPGRCAEPLARPSLQFSADVCDVSLGERFAGLTPTEYRLLETFLAAEGETLTKAFLYQHVLHRGHTQHDRSLDMHVSHLRRKLQRLGYAGHQLHTVWGKGYVLTPAP

SEQ ID NO: 29565 - protein, 744 aa, Pseudomonas aeruginosa
SRMYPQFRRGHLAAAVLFASSSLLDGQALAEDERLEELDERAESVVQLGDEVVLGTAEQELKQAPGVSIITAEDIRKRPPVNDLSEIIRTMPGVNLTGNSSSGQRGNNRQIDIRGMGPENTLILVDGKPVSSRNSVRYGWRGERDTRGDSNWVPPEEVERIEVLRGPAAARYGSGAAGGVVNIITKRPTDRLRGSMTVFTNIPESSKDGATRRANFSLSGPLTEALSFRAYGSANKTDSDDTDINLGHTVNPSRTVAGREGVRNRDLSGMLSWQVTPDQVVDFEAGFSRQGNIYAGDTQNNNGTANTQGLADEGAETNRMYRENYAITHNGTWSFGTSRFVAQYDSTRNNRLEEGLAGSVEGQIGADRSFSTSKLENYRLSGELNLPLHALFEQVLTVGAEWNKETLNDPSSLKQGFVGSDSLPGTPAAGSRSPKSKAEIRALYVEDNIELRPGTMLTPGLRLDDHSDFGLNWSPSLNASQTLGEYFTVKAGIARAFKAPNLYQSNPNYLLYTRGNGCPIQTSSGGCYLVGNENLDAETSVNKELGIEFRRDGWVAGLTYFRNDYKNKIVAPLDVMGQTGTGNNILQWSNAKKAVVEGLEGNLLVPLHEDLSWSTNLTYMLQSKDKDTGNPLSVIPEYTLNSTLDWQASERLSTQLTSTIYGRQEPPKHGTSRNTPVVSRKEVGTYGIWGVSAGYTFSENLSVRGGVSNLFDKRLYRQGNSFDAGAATYNEPGRAYYVSMTTSF

SEQ ID NO: 29566 - protein, 382 aa, Pseudomonas aeruginosa
SPRPTCFHRQAQRLSDLSLALVRHRLSNARFSLRTPLVIASHAVSGGLSAESACMTGYCGARVRPQFPGIMLSLYRQCRTSASMTVQYPTIADCVGNTPLVRLQRLPGETSNTLLVKLEGNNPAGSVKDRPALSMITRAELRGDIRPGDTLIEATSGNTGIALAMAAAIKGYKMILIMPDNSTAERKAAMTAYGAELILVSKEEGMEGARDLADKLQREGRGKVLDQFANGDNPEAHYHSTGPEIWQQTGGSITHFVSSMGTTGTIMGVSRYLKEQNPAVQIVGLQPMEGSAIPGIRRWPQEYLPKIYDASRVDRVVDMHQDEAEDIMRRLAREEGIFCGVSSGGAVAAMLRLSRELENAVLVAIICDRGDRYLSSGVYDPR

SEQ ID NO: 29567 - protein, 180 aa, Pseudomonas aeruginosa
RMSMSLRDQLLKAGLVNEKQAKQATKQKQKQQRLEHKNQVDKDDSQRQAAEQAKAEKLARDQELNRQQQEKAEKKAKAAQIKQLIEGTRLPKLESDDYYNFVDAKKVKRIAVNDLIRDKLSRGSLAIVSYDGRYEIVPRDAAVKIQERDPRRVVLLNVQSQEPDEDDPYKDYVVPDDLMW

SEQ ID NO: 29568 - protein, 494 aa, Pseudomonas aeruginosa
TRQGSPGAVHGHRSVVPGPGRSFRDRHRPCDRAPRSGCRPGVRVPGHRRPRGWRSPRGSGPAWRRPGGCRSAPAGCCRSRKSAPRHCRVSASVVFQIVQDHALGVRAAGFDATDLPGLLAGGTQDFQGFLGVALGHADDHADAAVEYAMHLGLVDVALFLQPVEYRRTVPAGDIDHGLGVVRQDARDVVQQAAAGNVSHGLDRAGLLDQLQQRLDVDAGRRHQQVGQRLAVELDLLDVGAGNLDDLADQGVAVGVRAGGGQGDKRVAGLDPGAVDDLGLFHDADAEAGQVIVFAFVHAGHFGGLAADQGTARQFATGTDAGDYGGGDVDVELAGGVVVEKEQRLGAADHQVVDAHRHQVLADAVVLVQVERQAQLGAHPVGAGYQHRLLVAGRDFAEGAEAAEAAHHFRACGALGHAFDAFHQGFAGVDVHTSVLVAQRGLLAAHKSRPIGIIRRSAGRPGVQRCLPVLKARDFIRLATQRPSRLPLDGLLFKV

SEQ ID NO: 29569 - protein, 366 aa, Pseudomonas aeruginosa
VHLRGLHSSSPPFPSVRREPSMRIARLFVLCFFLLGLPVFAATVPNLYQVHEPVSSQQPGERDAGLVRALQTLLVRLTGNPQAPQNPALAGYLKDPQQLISQYAFENGPPLALVVDFDPTATGNALRAAGLPSWGANRPAVLAWWLNESADGSSLVGDNQASAEPLKRAAQNRGLPLRLPLADLDEQIVGTPENLTAAQPDALRAASERYAADALLAVDAKEADGKWQAQWRLWMGDSREQGQAEGATPDALADSVMLAVGNRLSTRFVATPEAATGLTLQVQGATLARYAELQRLLDPFGARLVGVRGDRLDYSVKASPEQLRAQLGLAQLQEIPADSVPLDASGQPAAPSAAVPSSTQLNFRWQ

SEQ ID NO: 29570 - protein, 269 aa, Pseudomonas aeruginosa
FCLPSCSLCGLAEAYKLCSPYGDSCGVFGLSAQPGMKPIQLPLSVRLRDDATFANYYPGANAAALGYVERLCEAEAGWAESLIYLWGHDGVGRSHLLQAACLRFEQFEERTIYLPMADLVQYGPEIFDDLEQCELVCIDDLDVLVGKREWEEGLFHLFNRLRDTGRRLLLAASKSPREQQVKLPDLKSRLTMALIFQLHGLSDEDKLRALQLRASRRGLHLTDEVGRFILNRGSRSMNSLFDLLEQLDRASLQAQRKLTIPFLKETLGW

SEQ ID NO: 29571 - protein, 209 aa, Pseudomonas aeruginosa
LSGLLAAVQAGGGGEDRCRLADQAAGQPQATGTVEEVFQRGSHVTEAGRAAEGQARAVLQVLQGRVQRPLRGDVRGDRFAFGGYRGNRAYARLEAALFDATGDLPGHFRGSAMATVVQHQDVGTAQARISRTLSGGRPTTALSPATSTGRSISFGCLAIASMMASSPRLGSSRPRALYSSSPVRSNWRAGMPSLARIAFSSATLGGVSR

SEQ ID NO: 29572 - protein, 439 aa, Pseudomonas aeruginosa
PPRRPGLNPSARSTAPRGEEPARLQGEGMREHFNDGVEFARFLAHRFVTDKAPNSAAALTYTTLFAVVPMMTVMFSMLSLIPAFHGMGESIQTFIFRNFVPSAGEAVETYLKSFTTQARHLTWVGVVFLAVTAFTMLVTIEKAFNEIWRVRQPRRGVGRFLLYWAILSLGPLLLGAGFAVTTYITSLSLLHGPDALPGAETLLGLMPLAFSVAAFTLLYSAVPNARVPVRHALMGGVFTAVLFEAAKTLFGLYVSLFPGYQLIYGAFATVPIFLLWIYLSWMIVLFGAVLVCNLSSSRLWRRRSLPKLIVLLGVLRVFHQRQQLGQSLRLTHLHRAGWLLPEDEWEELLDFLEKEQFVCRAGGGEWVLCRDLGAYSLHRLLNRCPWPMPSRERMPANLDEAWYPPFQQAMERLQVEQEALFGESLAHWLADGTSGAKVT

SEQ ID NO: 29573 - protein, 92 aa, Pseudomonas aeruginosa
SLLRGSGLRRIRARGGPSGAAAQGRIAPSAPTPATARPAAPPASALPGRRQRSFPRGRWSRPCAVPAGPLAARCRDPRPGDGSCRREAAVDG

SEQ ID NO: 29574 - protein, 181 aa, Pseudomonas aeruginosa
AWKADTDWYASLAVMSVVSGGMAGHCTVPVWLRTGRRPSMMRSQQAMNAAQVQALIRMGLPMAEDIDFRVERLDERHALARIPFHGKLVRPGGTLSGPTIMALADAAMYAVILGRLGAVEMAVTSNLNINFLSKPRPEDLLAEASILKLGRRQVVCEVGVFSQSNEEDLVAHVTGTYALPL

SEQ ID NO: 29575 - protein, 656 aa, Pseudomonas aeruginosa
SPPSMRSGPGCGCFAVAVHRAAREMSFRGRTDGSGARSGPARARQWSPGSRRLHRIQDLREANHTMMRSHYCGQLNESLDGQEVTLCGWVHRRRDHGGVIFLDVRDREGLAQVVFDPDRAETFAKADRVRSEFVVKITGKVRLRPEGARNPNMASGSIEVLGYELEVLNQAETPPFPLDEYSDVGEETRLRYRFIDLRRPEMAAKLKLRARITSSIRRYLDDNGFLDVETPILGRPTPEGARDYLVPSRTYPGHFFALPQSPQLFKQLLMVAGFDRYYQIAKCFRDEDLRADRQPEFTQIDIETSFLDESDIIGITEKMVRQLFKEVLDVEFDEFPHMPFEEAMRRYGSDKPDLRIPLELVDVADQLKEVEFKVFSGPANDPKGRVAALCVPGAASMPRSQIDDYTKFVGIYGAKGLAYIKVNERAKGVEGLQSPIVKFIPEANLNVILDRVGAVDGDIVFFGADKAKIVCDALGALRIKVGHDLKLLTREWAPMWVVDFPMFEENDDGSLSALHHPFTSPKCTPAELEANPGAALSRAYDMVLNGTELGGGSIRIHDKSMQQAVFRVLGIDEAEQEEKFGFLLDALKYGAPPHGGLAFGLDRLVMLMTGASSIREVIAFPKTQSAGDVMTQAPGSVDGKALRELHIRLREQPKAE

SEQ ID NO: 29576 - protein, 249 aa, Pseudomonas aeruginosa
VMAGHSKWANIKHRKERQDAKKGKIFTKLIRELTVAARQGGGVPADNPRLRLAVDKALTANMTRDTIDRAIARGVGSNDADNMVELSYEGYAPSGVAIIVEAMTDNRNRTAAEVRHAFSKCGGNLGTDGSVAYMFERKGQISFAPGVDEEALMDAALEAGADDVVVNDDGSIDVFTTFADFISVNEALAAAGFKGDEAEVTMIPSTTATLDLETAQKVLKLIDMLEDLDDVQNVYSNADIPDDVMAQLG

SEQ ID NO: 29577 - protein, 187 aa, Pseudomonas aeruginosa
CVRTPLPAFSIQLMTLILGIDPGSRITGFGVVRETARGCEYVASGCIRTGNGPLHERLHVVFRSVREVIRTHGPTALSIEQVFMARNADSALKLGQARGAAIVAAMEEGLSVAEYTASQVKQAVVGTGGADKQQVQMMVMHLLKLTQKPQIDASDALAIALCHAHTQQSLVPHGLVGARRRGGRLRL

SEQ ID NO: 29578 - protein, 169 aa, Pseudomonas aeruginosa
RPSIGCIRLGEPVTLHTHLVVREDAHLLYGFAEKRERELFRELIRLNGVGPKLALALMSGLEVDELVRCVQAQDTSTLVKIPGVGKKTAERLLVELKDRFKAWENMPTIAPLVMEPRASATVSSAEADAVSALIALGFKPQEASRAVAAVPGEDLSSEEMIRQALKGMV

SEQ ID NO: 29579 - protein, 330 aa, Pseudomonas aeruginosa
AAGPRHSPAEAGRLHRPAQRARADGAVHPCRARPPGGARPYADLRSAGAGQDDPGEYHRPGNGRFHQEYFRAGARASRRSRRIADQPGGRRRPVRRRDPPSFAHRRRSAVSGHGRFPAGHHDRRRARGPLHQAGPAAVHPGRRDHPCRHADQSTARSLRYRPAPGVLQRRGPGDHRQSVGRHSRPGDRAAGRGGNRQARPRYAANRQSPAAPGTRLRRGPGAGRHYPGDRRQGIEPARCRRAWLRPPRPSSVADHDRQVRWRACRNRQLGCGVERGAAHDRRCTGALSDPAGLHHADTAGARGNTPCVPALWPEYSEKVGAGGDDGSVHV

SEQ ID NO: 29580 - protein, 256 aa, Pseudomonas aeruginosa
SHVLSPKRCVRLLPEARILFQQEIKVEPNVVDHTSMWSLISNASIVVQLVMLTLVAASVTSWIMIFQRGNAMRAAKKALDAFEERFWSGIDLSKLYRQAGSNPDPDSGVEQIFRAGFKEFSRLRQQPGVDPDAVMEGVARAMRVAISREEEKLEASLPFLATVGSTSPYVGLFGTVWGIMNSFRGLATVQQATLATVAPGIAEALIATAIGLFAAIPAVIAYNRFSARSEMLIGRYYTFADEFQAILHRKVHTSDD

SEQ ID NO: 29581 - protein, 407 aa, Pseudomonas aeruginosa
CRVVGTDDRCSHQDHECPSGHPGIHPRRQGGELWCGGWRHGCLAAGRCAQRRVDYRGPLILKQQFERSPSESYFWPVVLAVVLHVLIFAMLFVSWAFAPELPPSKPIVQATLYQLKSKSQATTQTNQKIAGEAKKTASKQYEVEQLEQKKLEQQKLEQQKLEQQQVAAAKAAEQKKADEARKAEAQKAAEAKKADEAKKAAEAKAAEQKKQADIAKKRAEDEAKKKAAEDAKKKAAEDAKKKAAEEAKKKAAAEAAKKKAAVEAAKKKAAAAAAAARKAAEDKKAQALAELLSDTTERQQALADEVGSEVTGSLDDLIVNLVSQQWRRPPSARNGMSVEVLIEMLPDGTITNASVSRSSGDKPFDSSAVAAVRNVGRIPEMQQLPRATFDSLYRQRRIIFKPEDLSL

SEQ ID NO: 29582 - protein, 187 aa, Pseudomonas aeruginosa
TDGRQRLQTYTLGFIRSYMMEMLKFGKFAALALAMAVAVGCSSKGGDASGEGANGGVDPNAGYGANSGAVDGSLSDEAALRAITTFYFEYDSSDLKPEAMRALDVHAKDLKGSGQRVVLEGHTDERGTREYNMALGERRAKAVQRYLVLQGVSPAQLELVSYGKERPVATGHDEHSWAHNRRVELKK

SEQ ID NO: 29583 - protein, 77 aa, Pseudomonas aeruginosa
GVVEVMERLLESIYINARPAMELRLSLTSSGRKRIVKVVDGEEVEVLSGEVQGILEAQKRDVGILADFLAKSLLARR

SEQ ID NO: 29584 - protein, 117 aa, Pseudomonas aeruginosa
RLWTTPGTIDIPGLRFEHRRKSMSIQRFTPEFKAEAVRQVIERGYSVAEIAARFGVSTHSLYKWVKAVTPDKSEKQASELLEAKSEILRLRAQMRRLEEERDILKKPSGSSHTAWRP

SEQ ID NO: 29585 - protein, 316 aa, Pseudomonas aeruginosa
PIEEVARRGPPRHRVAESGRSGKRVSPTARREAVQEMQARTGISERRACQLIGLSRSVLRYQPRASVQNTELQAQLVELAQERRRFGYRRLHILLRRAGVQVNHKRIYRLYRAAGLMVKRRRRRHGIAVERERLSLPSAPNQVWSMDFVFDALSTGRRIKCLTVVDDFTKESVGILVEHGISGFRVTRALDEMARFRGYPKAIRTDQGPEFTGKALDQWAYQRDIKLKLIQPGKPTQNAFIESFNGKFRDECLNEHWFCSLAEARIRIAAWRRDYNEHRPHSAIGNLAPAEFAASWRTRQQQLKQEKLISTPGPTN

SEQ ID NO: 29586 - protein, 218 aa, Pseudomonas aeruginosa
SSKIATLSLSKGSSIVSISMKSILAAAVASLVVGNAMAADGTINFKGEITAAACSITGGAGTTVGGAAGNQTIDVNLGKISIDSLGGTAGGSIAGGTSLNLNLDCGKTGTGLTTVKLKFNPMSGSTIDPNNESLLKTVGTATGVGIGIYGSDGKLLNLSANETIDAPLDSKVQKDGEGNDITVYSAKLNLRAAYVKSGSVAPTAGSADGSLPFTLEYN

SEQ ID NO: 29587 - protein, 256 aa, Pseudomonas aeruginosa
VLLRGRGMYIPRSMRYEFIMKYPFSSRVIWGGILLLFSTLANAGITLGGTRVVLQAPAKEAAILVRNQASKDVMIQSWVEADNGADKREVPFVITPALSRLGGNKQQTLRILFQGEGLPSDRESVFRLNVQEIPQKSASANTLQIALRQRIKVFYRPDNLSGTSAEAPGKLNWRLVRQGGKSVVEVSNDTAFHVSLASVKLKAGNAYYVVDADMVAPKSSRRFEIKGTPSGVSGNVEFQSVNDYGGLDKHSSSLSD

SEQ ID NO: 29588 - protein, 335 aa, Pseudomonas aeruginosa
SQCVQLQRTGQLQQGRRQLRQRRPGLGHVQGQVVRQLQPGARQQADQPGSKRFGSGAFGGSDLRPAGGGNVRPGGGSGGRRRRPRRLLFGSHRRPWLCRAPLHATLSLQLGEPGYQYPWKRYRDQRQHANGRADPGRRDRQAFLRGVRSAGAVRPEHGLWRKESLRCTGIRQGRAGRGNGRQPVPFAGVRYRGPGAPVHSLERWLLFRRLSVAAQEQGPDLRTSCAQLPSVLDLKCPRCSRVKSKGEDFSGEHRARGQAAAHSSSIMLNRSGVLPRVSKRSNHCLAANPPAKPVRPPEAPITLWQGATMDSGFRPLAAPTARTALGLPICTAISV

SEQ ID NO: 29589 - protein, 468 aa, Pseudomonas aeruginosa
VPAGGPRRAHYRGNWPARRAVGAWPWAESGLLAGQRRAAGALRRWLVPHRRPVRARRVGCLPSLWAGRRSVQGEWPLGGADPGRAGDLPSSAGSERGGSGSYLPAARRLASDPVRHPGHSAGRQPDPAGAAHRPASRRTDSLAHAAQPIACAAGLAAQRQRQVGARRAAPPGRHPLSRQPSGGTGMLIQAVGVNLPPSYVCLEGPLGGERPRAQGDEMLMQRLLPAVREALDEAAVKPEEIDLIVGLALSPDHLIENRDIMAPKIGHPLQKVLGANRAHVFDLTDSSLARALYVVDTLASDQGYRNVLVVRGESSQGLEVDSESGFALADGALALLCRPTGKAAFRRGALGGDPAQEWLPLSIPLNTDIRQVGDVKGHLNLPAQPGLPEAVRAGFTRLAGDFPQLNWVREEWFGQGRPDGRCLGPFELASQLRAAQRDRLDELLLISFDPFGMVVEGVTLELAGEAHA

SEQ ID NO: 29590 - protein, 223 aa, Pseudomonas aeruginosa
PGRAHQYVGRVHRRTYRRAHPLSRRAGTGGQRADGAGGTPGHRGCRAAAGGHRPVAGEHPVAGPPRPVPGLPDPAAAGPAAHPGAGYPGTVQRVAVRLADGSRADPRRAGTACPGGLRRGAVQAHGLFGPRPQPVDPARRRCRRSGGQRRREPRRRPAGPAPGRRRQLLRPADDCGAGQCLADLPRRECPARGRGRVPHARPADVRACQPDPGTDRRRNARGP

SEQ ID NO: 29591 - protein, 306 aa, Pseudomonas aeruginosa
GGEPAMLRLSAPGQLDDDLCLLGDVQVPVFLLRLGEASWALVEGGISRDAELVWADLCRWVADPSQVHYWLITHKHYDHCGLLPYLCPRLPNVQVLASERTCQAWKSESAVRVVERLNRQLLRAEQRLPEACAWDALPVRAVADGEWLELGPRHRLQVIEAHGHSDDHVVFYDVRRRRLFCGDALGEFDEAEGVWRPLVFDDMEAYLESLERLQRLPTLLQLIPGHGGLLRGRLAADGAESAYTECLRLCRRLLWRQSMGESLDELSEELHRAWGGQSVDFLPGELHLGSMRRMLEILSRQALPLD

SEQ ID NO: 29592 - protein, 537 aa, Pseudomonas aeruginosa
RRAGQSPMGARRWLVSGVGYRLEESLEYRTLVPEALSIWRMAGANRMLFDCFDVDSKAARRSVAILSSCLRIECWGRDVVLRALNSNGRALLAPLSEDCPAQVTCLRDGDTLHWRFPQEESHADEWRRLHGLSSLEALRRVLGTLGDAEGPALLGGLFSFDLAEQFEPLPAPAEPARHCPDYLFLVPELLLDIDHLARRTSLQAFVHDPAGHDRLAASLRQCADEFHGAVEEASESPVAGVRAGNYQVDLDDASFARQVERLQAHVRAGDVFQIVPSRSFSMPCADPWRAYRQLCLRNPSPYRFFLDAGDFCLFGASPESALKYDAESREVELYPIAGTRPRGRDARGAIDAELDNRLEAELRLDAKEIAEHMMLVDLARNDLARVCRSGTRQVRDMLKVDRYSHVMHLVSRVAGELHGELDALHAYRACLNMGTLVGAPKVRAMQLLRQYEDGYRGSYGGAIGILDSAGNLDTSIVIRSAEVREGIARVRAGAGVVLDSDPRLEAEETRNKALAVLTAVAAAERERGERDAHHAVG

SEQ ID NO: 29593 - protein, 299 aa, Pseudomonas aeruginosa
FRGRSGCMIAGSMVALVTPFDAQGRLDWDSLAKLVDFHLQEGTNAIVAVGTTGESATLDVEEHIQVIRRVVDQVKGRIPVIAGTGANSTREAVALTEAAKSGGADACLLVTPYYNKPTQEGMYQHFRHIAEAVAIPQILYNVPGRTSCDMLPETVERLSKVPNIIGIKEATGDLQRAKEVIERVGKDFLVYSGDDATAVELMLLGGKGNISVTANVAPRAMSDLCAAAMRGDAAAARAINDRLMPLHKALFIESNPIPVKWALHEMGLIPEGIRLPLTWLSPRCHEPLRQAMRQTGVLA

SEQ ID NO: 29594 - protein, 288 aa, Pseudomonas aeruginosa
PPSATPCRSPSTRTSTPLRRPMSRKTYWKNSRRACAMRFAVLGSGSRGNSALVSSSDTRILIDCGFPLREIIKRLARLGLSPAQLDAILVTHEHADHIHGVELLARHYQIPVYLSAGTLSGMRRPVHPAELLRAGQRLAIRGLEVQVVGVSHDAREPTQFVLSDGQRRFGMLTDLGMATAEVLECYRAVDALVVEANHDSTMLAGGPYPYFLKARVGGSRGHLNNHQSAELVKQLDWGRMQHLVLAHLSEKNNSPQLARQTFVDTLGCDPDWLQVADQHSGLDWREIA

SEQ ID NO: 29595 - protein, 382 aa, Pseudomonas aeruginosa
RMANRAYKYRFYPTSEQAQLLAQTFGCTRFVYNYVLRWRTDAFFQRQEKVGYLEANAALTRLKRSGEFPWLNEVSCVPLQQCLRHQQSAFKNFFSGRTKYPAYKSKKHRQSAEFTRSAFSYRDGKLYLAKSRTPLDIRWSRPLPSEPSTVTVSRDSAGRYYVSCLCEFEFEALPVTPKMIGIDLGLKDLFVTSDGERIGNPRHTAKYAARLAKAQRRLSKKKLGSKNRSKARLKVARIHAKISDCRMDRLHKLSRRLINENQVVCVESLAVKNMIRNPRLSKSIADVGWGEFARQLEYKGEWAGRQVVAIDRWYPSSKRCSCCGHTLVRLPLDIRSWTCQECGTEHDRDVNAAINIRAAGLAVLALGENVSGIGQVPLSSSL

SEQ ID NO: 29596 - protein, 67 aa, Pseudomonas aeruginosa
SREGREAWNEKPRSAGLDPCRLDLRDYCRGRPALSSEVKAVLYPAIIIEVFLDDIKELIVSVLEFSE

SEQ ID NO: 29597 - protein, 69 aa, Pseudomonas aeruginosa
RGSSRARTAQGEVTMRPRLTNSDYAAMANAAEELAGMGSSEWRRRYNKALSDYYRALSVRKPVAAGLRV

SEQ ID NO: 29598 - protein, 296 aa, Pseudomonas aeruginosa
RTGPNSGQRWRKSQMARARNIKPGIMANEDLAELDPLARLLFIYLWMLADREGRLEDRPKRIKAEALPYDNVDADLMLDDLAKAGFIHRYEAAGVKLIQVLNFAKHQTPHVREQASSLPGVDAEHPKREQGTTKEVPGHNQGCAEQSPRSPDSLIPDSLIPEEEHVDADASTHSAPQQAAEQEPGSGQTAQLFQIDRIPYEKIRDLYNQILGGKLKRCMGVTEAHRKHIRAAYNLKLDGGFPVRDGGLSFWEGLFNDVLDCPFMLGNNNRGWRADFEFLTTASKIQRFMEGKYDAA

SEQ ID NO: 29599 - protein, 75 aa, Pseudomonas aeruginosa
RACKGRASDMDIVDIANDYAERELAERLYSRVKYVGESLSECEDCGEEIPVARRSIIPGVRKCRDCAERAERRAV

SEQ ID NO: 29600 - protein, 140 aa, Pseudomonas aeruginosa
NSKAQATTWAFLHLEYVNMAEPSGAVAVAGLVGIGASALIPGIDANAVIGAFAGAIFFVVYAKDISAWARLGYFAASWIVGYYVAGEFIGREWARTSGLVAFGGALFCVAVGTSLLEWVQGGKTPGWLRFIADRFGGRNG

SEQ ID NO: 29601 - protein, 127 aa, Pseudomonas aeruginosa
WVFRPERDARCTPRLQTESCLPLADPGAGDPARPCLPRSGEPGPHSEGVLMDAPLLLKNTGTCLILCDANGKPLPGQLSLSVSNDGPIPTVTVTLALVNKWVRLCGEEMESRISYDSYLETIKGRRS

SEQ ID NO: 29602 - protein, 415 aa, Pseudomonas aeruginosa
PLRCTTGSTRHHQIPPRRIAMSDFEKQIGELNASLKQVGDQIKAQAEQVNTQIANFGEMSKSARADVDKLLVTQGELQARLSAAEQAMLANEKRDGGEEAPKTAGQMVAESLKEQGVTSSLRGSHRVSMPRSAITSIDSSGGALVAPDRRPGVVAAPQRRLTIRDLVAPGTTESNSVEYVRETGFVNNAAPVSEGTQKPYSDLTFELENAPVRTIAHLFKASRQILDDASALQSYIDARARYGLMLVEEGQLLYGNGTGANLHGIIPQAQAYAPPSGVVVTAEQRIDRIRLAILQAQLAEFPASGIVLNPIDWALIELTKDAENRYIIGSPQNGTTPTLWRLPVVETQAITQDEFLTGAFSLGAQIFDRMDIEVLVSTENDKDFENNMVTIRAEERLAFAVYRPEAFVTGSLTAS

SEQ ID NO: 29603 - protein, 177 aa, Pseudomonas aeruginosa
TTRSRNLAEKASPALRSGESMADGVEFSITGLEGVLEKLRTLGPRLQKNGLRKAARRAMNIVRDAAREKARLVDDPETPEKIWKNIITQESAKQGRREGGVVMKVGVRGGAGRNQYSKDASGNPGGDTRHWRYLEFGTKYSPAKPFMRPALSQNIEPVTEKFISELDGEIDKALRGR

SEQ ID NO: 29604 - protein, 91 aa, Pseudomonas aeruginosa
IGASSLPSGDNPQAQWTILFLCAVIFLNVDRATFSLSGMSIGNGDVSRSFVTVAANEVERSLNDSTTTDWVSALSPLRKPNIRMSGSSHRL

SEQ ID NO: 29605 - protein, 297 aa, Pseudomonas aeruginosa
PGSRSVRRPLEQLQAARQHQPLRRFFGGKFDRFVEVSMRISQKLQCQILAHAESVYPSEACGVLLKTDSGREYAPCGNLAVSDRENFVMDHRDYAAAEDRGEVIAVIHSHPDKAPIPSMADRVSCELHGLPWGIIGLPGGEMTWFKPSGYRAPLLGREFSHGLLDCWGACRDWYEREAGLTLPNFERKDLWWEVKDGSSLYEDNYESAGFYRVDDLRRGDMLVFQVPTPGRPCYHPNHAAIYLGADPCLRSEEAPALGGSGPFIYHHMAGRAATREIYGWSMANRVRLILRHKDFPQ

SEQ ID NO: 29606 - protein, 1287 aa, Pseudomonas aeruginosa
PLLLRATHTQCFTASERSAAPSSRAGFTRKTSSSTTAARPRFGGVSCFWRSKMSVVTKKRHQPLRGSKGGSSKPKQPHIAQNGVASLSTARIVYLLSWGPIVGPVNGLKSIKLDGTPIQAEDGTLNYPDVKWQFRPGELNQERLEGVAESSNEIAVGQTLLSTQPYIYTVTNATADAVRVRLSWPNLQAQDSSGNINGVRIEYAIDVATDGAPYQTVLSTFVDRKNVTTYYRSHRINLPAGGHWAVRVRRITPEANSSLVQDTMVLTAIAEVVDSNQEFPLTAVGCVEYDAQQFGGDFPKFSALMRGRIVRVPMNYDPETRTYFTGGPGTTNGVWDGTFKEAYSNNPAWVFYDLVLNPYYGLGERIDQSMVNRWALYRIAQYCDQLVPDGKGGQEPRFTCNLYLQKQEEAYAVLQDLAAIFHGLAFWDGSQITVNADMPQDPVYTYTTSQILNDGVVAYSGTRTRDRHSLAMVSWDNPANAFETDKEAVFDEDAIIELGGIVREVSVGALGCTSQGQAQRAGQWALMTEQLQTRGAVWKVGLDGFIPRPGQVVALADPMLAGRANGGRISAVSGRAITVDRDVDLPVGARLRVNLPSGRSEARAIQGHDGRVITVVADFSEQPSPESGWAIDYDDLALMQFYVKNVTRPSWEQFQLEVIQHEPGKFDAIDHGAIIDSRPISVLPSGVQDPPARVLISQHIAVEQGLAVTIMTIAWDAAPDAVAYDVEWRWGSREWVRVPRTGELMVEVRGVYTGQYLARVRAVNSMNVSSIPANSVLTNITGKTGAPPALAFLRTTSGPWKIGLEWGFPASGAADTAYTEIQQSVTPGGSEQNATALGLFAYPTDTHTLTSLAAGARLAFRGRLIDRTGNVGPWSAWVDGISSTDASEYNELITKEYVESALGEQFFADIDQMQVDISGLQGQIDNLSDVLAYDPTKTYAKNDIVRVGNRLYQAKQAVPLNASPPNASYWADIGQSIETANGLAQQVATNTADITELDGKVEAAASSLDVLQAAARREPATGEKADALKGWDTIARAATEVTVRANEDEAQAKRTSLLEARTVTAEGRIATVESVVASNNAVTVQRLDQLSGQVASNASAISTEQTVRANADSALGQRMDTVSARTDTNEANIQTTSQAVTSLDGNVKALYSVKLQAHANGQKYAAGWQLGFDSGTSVTTMAFQADRFLWFNSSSGQTVAPVSIVGGQMFINNAMIQEGSITNAKIGNVIQSTALGANGEPLWKLDKGGAFTMNSATSGGFMRQTAEAIKVYDGNLVLRVQIGNLDV

SEQ ID NO: 29607 - protein, 110 aa, Pseudomonas aeruginosa
QGRRHREVVLMIIKLSPYAPLPGSDERLSLSRDGDVLIVNGQAFDFTPLPDGGELPAEAIGSKWFAGPAVRRAGRLELSLRFPLADDASAAARFPEPLLIDADGPVELPR

SEQ ID NO: 29608 - protein, 344 aa, Pseudomonas aeruginosa
LQGGRILPEVRLSMPITEQQLLHILPNAGPRAGVFVGALNRGMTRFGITSPVRAAAFLAQVGHESGQLTRLVENLNYSARGLAATWPSRYLGADGQPNALAQRLARNPRAIANNAYASRNGNGDEASGDGWRYRGRGLLQITGRSNYRAAGTGAGPAAGAGTRTARAAGVGGDLGGLVVGQSRLERPGRPRRVRRHHSAHQRRAQRPGGAPGAVGAGEEGAVVISARALSVALACLVLVGLGTAGGVWLGARHYRPQLDAASADLAACRASRGELESAVAEQVRQVAALRVAGEQRARDAAQAVDRGRQQAAEQYAEAQRLVRERTAGEQCAAAEAVIDQELGL

SEQ ID NO: 29609 - protein, 135 aa, Pseudomonas aeruginosa
RRATTYRPRSARCSPNACSGSVTRRSSWLRTGPVRIRSRLRPFPTEQGMLVIRFRGWSVKLDHQVGSAGKFGIWSFHGSESSYVPDMQTILRHAAIRPAEPKEGGEVEVFICDSRMPQDEWRPVGSGVAAYESDR

SEQ ID NO: 29610 - protein, 341 aa, Pseudomonas aeruginosa
YSIPALEGAADVWPSCMARFPSDGQPGYRFVPSPGSGAGEEEMRPLVSVVCPCFNISKYLDEAIASIYAQGYPNLELIVVDDGSTDDTYERLAMLRELHGFQLYRQANRGVSDALNHGLRHARGEFVMTPDLDDIVLPGALDTRVDYLLAHPEVGCVGGFNICIDSAGNEVARDGFSEGCVERWGFDAALAETLVVMPLTALYRMDAMKRADFFDPSIRVQDFQITLRIAAQGYEIHRLPAYMGRYRRHGSGLSGRYKLNYEADMQAIEPYRAHPNYRRARQLILNKALKKAVVQDGRYAWQLFRSVPLRAWDRVTLKRFWRFLRYLPVLGLKGGTDVAGR

SEQ ID NO: 29611 - protein, 450 aa, Pseudomonas aeruginosa
SRVGSRQRPGYALRDHCQSLPRRQSQCRAGRPGRGRAHDVADRRAPEPADRHPCAGAHRRAGWCQCRGVRSPPGGTTMSAAIRGKTAIVGIGSAGVGEAPGYSAIELLGQASLKAIADAGLKLSDIDAIFAATSSHAFPTLSVAEYLGIRPKFVDGTNIGGSSFELHLLQATLALEAGLCDAALICYGSNQRTAGGRLVSMSEPQWHETPYKPRHPITAYALAASRHMHQYGTTREQLAEVAVSARQWANLNPEAFARGPLSVDDVLAARMVSDPLSAADCCLVTDGGGACVVVRAERARDLPNAPVYFLGAAGAQWHRSIVSMPDLTVTAASESAPRAMQMAGVRHADIDLVMLYDAFTINTLLFLEDLGFCAKGEGGPFVQGGRIAPGGELAVNTNGGGLSCVHPGMYGMFLIIEAVTQLRRQGRRAAVGPRPTWRCCTATAARCPAR

SEQ ID NO: 29612 - protein, 328 aa, Pseudomonas aeruginosa
  UNSURE (10),(13): Identity of amino acid at the above locations are unknown.
PRCSVPATRXRPXADRHSGRCRGGVPRARSPARRLSCRPQTNGSGEPMSANHSQQVIDAPRFASLTPLIEPRSVAVIGASSDPTRIGGRPIAYMLRHGYAGQILPVNPNRAEIQGLPAFASVAELPQAPDAAIVAVPAPQVLETVRALGRQGVRSAIVFSSGFSEVGEAGAAMQDAVVAAAREYGMRLLGPNALGAFNSNLGYYAFFSTSLERGVPLPGRVGIATQSGAYGAHLLGMARQRRLGTPICVATGNEADVTLGDSIGWLVESPEIDVVMAYAESIRNVDSFLAALEAAHRAGKPVILHKVGRSALGSRAALSHTASLAGDD

SEQ ID NO: 29613 - protein, 358 aa, Pseudomonas aeruginosa
VLDAVLGDYAVIRARTTEELMDIAYLATRAYLSGGRQPPHDHRQRRRRDHRQRCRRGSRPADAADAGHGPGAAEGTAVLRFADQPGGLHRAGPERPDAGARLYRVDGGRRWLPFAARLLHPGRHRRLHRRASGRAVPADQGGSSRASVRGLGDGRGGGAGTLRGGRLRTVRRPHPGGSGDPGHGAARRSLRPAVAPAPACRRATVARLHARRSRGQAPAGARRYRVRRRGGAGQCRRGGCLRRGHRIPGGAEARLGGHPAQVGNRRRAAWRKRCGRGTRRFPTAPAPGRREGAAGASRWRPGGAPTAGRGGVLHGDPARSAVRPGGVVRPGRDLRRSAAGRGVPPLPVRGRRSRGDDP

SEQ ID NO: 29614 - protein, 168 aa, Pseudomonas aeruginosa
TRAPTRARCSTARRCSATRSAARCWLSPAAPPSFAATAASVVPGRCRKRRIACLNGHPTCDSTCRPVRSRPCTTASTATTTRSTRSPRQRCGPASRGRSCMACAPSAWHSTRCCAGSPTTARGNWDICRCVSRLRCFPARPCVPRCGATARSALASSSAMWWCWTTAG

SEQ ID NO: 29615 - protein, 137 aa, Pseudomonas aeruginosa
CPSASEPGTAPPSSPPCRPAGPWATWWRPCWRGRSSPSSAGAPCSSPPWRRRWSAWPCGPGCRSRRPGSRPRPGASVPARLRRATPRLAAPARWDGCWAIRKRAACSCSGASPPASCCSATTAPTTGCRPTWRASWG

SEQ ID NO: 29616 - protein, 362 aa, Pseudomonas aeruginosa
FPGAAAPHGRPEDPDRTVARHGRAGRRRDRCRGVGKRAPAAGFQRTGTGLGSGSAGDPPGHPVARRHRLHRRGGHRPVPAPRHGTAQCPRLAGVPQGALRRAATAGGGLMSGLLQETRGTVRLLRFDNPARRNALSPALRMELLRALEAAECDPSIRSVLLTGGEEVFCAGGDLGDMRVTELAAGRARMQDNARLVRQMVRMGKPLIAAVEGWAVGAGLSVALACDSIVCGAGARFAAGFGKVGLLADLGQLHTLPARIGWGRARQILMFGQVVQAEEALRIGLADRLCAAGGALAMALELAGRVEQQAPLPLAMTKALLAEGLDLLLEREGELQSQLFLSADHAEGKAAFLAKRPPVFRGN

SEQ ID NO: 29617 - protein, 539 aa, Pseudomonas aeruginosa
TTRFPRDCRRASSPPTCARRNCSRARRAVTAGSPTSTSAPAGRKSAGRSAARKRPAAAASPARTPGRPTCDGRPTPSTIPASCRWHRASPSIERGAAGSRRMAMRLAAESRMGGLQQRCLWEVVTPRLSGAASLNGEQRADVCVIGAGFTGLSAALHLLEAGRSVCVLEAYEVGHGGSGRNVGLINAGTWIPPDEVVATLGAEQGEKLNAVLGRAPALVMETIERLGIDCQLRREGTLHMSHNASGVADLQRRHAQWTRRGAPLELLTGAACHEACGTRRISAALLDRRAGTLNPMAYSRGLATAVVQRGGQLYQRSPVLALERQGALWAVRSSAGAVLAEQVVIASNAYTEGEWTNLRRHFFPGYYYQVASAPLHGAAAERILPHGQGSWDTRTVLSSIRRDAQGRLLLGSLGNGANKPAWFLRQWADRIQSHYFPDLGQVNWEYSWTGCIAFTPDHLMRLFEPAEGLLAVTGYNGRGVTTGTVVGKAFADYLLSGERATLPLPFSDMKPVPAARLRSCAYEMGFSLYHAGQCLRVVL

SEQ ID NO: 29618 - protein, 132 aa, Pseudomonas aeruginosa
FVVNTHEEVVMSALIKERPSADAVLAKAVLAAREQLGLTQLELAGIVGVDRSAISRWKTQGLRVDSKTGELALLLVRVYRALYALFGGQQEDMRHFLRTPNHHLAGEPLALMGQVQGLVHVLEYLDAIRGKV

SEQ ID NO: 29619 - protein, 250 aa, Pseudomonas aeruginosa
ARSGDSARVSGISDRSQGRLVRLVESQEQVATLQLVDTLEEQALLEELLESSKPPVPADAEPLHYLLKTPFRYPPLRWGSRFGRRHEPSLFYAALKLETAMAESAYYRCVLWSGMVVPPPSGRILSEHASFEAGWKVERGIRLQAPPFSDHEAALTDIAEYRAPQELGSAMRSAGVQAFEYRSARCPERGCNVALFTPAAFTEKRPRNLTPWLCETTAGYVAFKPAHVPGSPKIFSWELFLVDGKLPHPA

SEQ ID NO: 29620 - protein, 131 aa, Pseudomonas aeruginosa
AAMSRCSARSARSPWSTARTPPRRTVSTRKTATTSGCTARNWAPPGRSTRSTALPARWPTTASTISKGGVPAPAGPGPEIRSATPTAAVRPSCRRATRCSSCATSCPTRPTRRTRRTRSTSAWPRSSICST

SEQ ID NO: 29621 - protein, 383 aa, Pseudomonas aeruginosa
TSAGMPSYPTTSSCGWPATTCTTWATTRATCASAPAVWRKSPTTSAPTATSRAGRTPGCSSSPWATPWTCATPATGRSSPPTSTSSRMPCRTVSTIPPSTLAGPTPRATSSAPAMASTSASTVPRAGSAPTRSTAHRSPSTSCNSRSTRASERSSRQTMKRQTMNTRPFSLPIWAQALLAGAAFAAYASQAAYADSLEERLRAQLRSTTQQLQALQTEQAQATAAKAALESQRDAALAQVKQLSAELARAKGQAEQLSAQQQGLHDRARQMVEASNEQLGKYKQAYDELLVMARAKEAERQKLDLAFREHDQQLQQCTAKNREMYGVAKEILGAYENVSVAEVMKIRQPFASGARVKFEEMAQKLGDDLYKTQVENRQAALAQ

SEQ ID NO: 29622 - protein, 235 aa, Pseudomonas aeruginosa
PTPFRHGTVDGRYAMTERHWQGEVWLARDHALFAGVNGDTREHAHYAHQLLLAETPLRVRVAGQVLEARRLLVPSLQAHCVEASQPLLALYAEPLAFDSDDLRQLLEDAPGEPEALLGRLARLPRRRLDRRVEKALAALDEQLAARVEAERLARSASLSLSQLERLFAVQVGLSVRRLVLWRRLYLAFALALQGRSLTEAAHHAGFADAAHLSRSVRSLLGIRAGLSLPHLRLAG

SEQ ID NO: 29623 - protein, 190 aa, Pseudomonas aeruginosa
MRSPASLATGRRRLNEPRKFSVAQHQRRASHVPATRPGLAGQPGPTQADQVGQQQVAQRRQRIAGDADQPGHHDLRGAAERGDAGRIDQGKTGGAQRPGEAFYQQHDQRRAAHAMQGREQGEDGEEDCRLGVTGHCLQCREQHREQRQARQDQHGAAPVAVAEHAAEQRRERQCGAGDQRREHRDARRQV

SEQ ID NO: 29624 - protein, 336 aa, Pseudomonas aeruginosa
LGKGEGGHVVEEVLGDGASGEDQQTEQQGSPMIAEQFAEQAPGAGLAAASGKGLGQVEADVQADRQDQQAGREGNPPAPFLQLALVEPEGEQVAHQPGGDRRDALRYDLPAGVGAALVRRCRLEDVGGRRPGLAAPGQALQQAGQHQQQRRGRADAVVAGEHRDAAGAQRHQEQGKEHRRLAPGAVGVGADKDRAEGADDEADAERGDRQEQADEGAVGGEESPSDHHREGGIDPEVEEFHGVAEDHGKDAAAAGRIGGRWGTGGGAHGEGPLGVTTETLRPGAERRAAAGFSQPAAGASRGSDRASLRRSCRCATARYRRSAARPVAGRSACRRP

SEQ ID NO: 29625 - protein, 265 aa, Pseudomonas aeruginosa
  UNSURE (202),(224): Identity of amino acid at the above locations are unknown.
KATLAWTSRSLPTPFHEERFHDLPRTGSVRRSLRQARSVRRGRPVRCQWLVAERTGHPALRGDPRREQPQPLLPRRGVRRRGGVPPALPQRNHRALLRTDRQLRLRSAFPVQGLPHRGLIPAPAARRRIPRRISMRILHSMLRVADLEAALEFYTRALDMRLLRRRDYPEGRFTLAFVGYQDERAAAALELTHNWDRDGYTXGDGYGHLAIEVEDAAVTCARAXALGYRVTREAGPMQHGRSVIAFLEDPDGYKVELIQKGTQFD

SEQ ID NO: 29626 - protein, 235 aa, Pseudomonas aeruginosa
AGAGPTANRDPGAAARAPLIAARGRTSRPLRHRWSLVRPRYGRSPGRSLRPPAKASARRHGAGRRRCTARYGCCAFRCGTRLRSGGRWRRCRRAFPHGWKYSCKHSSEPPPCPGGGNGKGRGSAIVRLRAHDFQPGHGYPVGPALAGVDQALVLQPGEHRQGAVEQQVAVAVVALDAGDLARSVAKEGDMAALGQGVKRPLFRLGNVHVGRTCNHRCDNAAALREKARASHGEGR

SEQ ID NO: 29627 - protein, 174 aa, Pseudomonas aeruginosa
RSGGYRMTTISNMQASDRGGAQPRKRAAMRQSNEAGEATARNCLRRHAAVRRLRLCEGVRLAPRRSALSLSGEAGVSMFRTALMLFMSSLAIPAVASMRCGTHLVDEGDSVEQVLERCGQPLSRIVNEPALRNNGVPKLNAARTEFWVYGPSGGVYRHLRFIDGKLVEIRLERK

SEQ ID NO: 29628 - protein, 676 aa, Pseudomonas aeruginosa
TTCRLLFKRFRRIVRCFRGDHREIGVAVGVPGRGPVGDHQGAADVHGTEHFADEGRVHADLAQLLGGCQALSRVAHLDHRPAQVRRGLADFFRGRLFQQREHRHAGLRACRQLHRCGADALAAAIDIGALVGAADQHRQRTAFRAGVVPGDFSGLHRQRHRSPVRYRRCQQAGVVDFLRRAAGVGNDYRGGAESGDAVEFLGERHGQADAAVGGGIAGQVAGVQGDAVPGQALHVGHGRAVVEVGLVVDALLQDREHSGRGLPALLAGAEGADPDGDTVAVDVGLLFGKADHDGHWSLRGNLRVPEVLAGLHALQPRLDVGRRQRRVRWAGGRRVEAADGEGQQQYGKGSFHWRFLLLHAGKAVAPTDAIQLSVARDGRPNPCGPASFGGQAAGGGVSHRTDFFSIQGAPGTRRQLRVETNIAHALAVQAQHLVVEVAEHALDLVIAAFVQGQAGAAWADRFELRGEGDQVFEAEVEAGGEGIHVALVDGRLGFHVVDLVAPAARQGQAARPLAIVGQQHQAGGVVVETTANVQVVAQVFREQVEDGRVLRVAGGADAAHRFVQHVVARRLASLEQPLVQFHPAEHPHLVGAVAHHLAVHAQASTGDQHLRVAAAEFGQVGEEAVQAHQSSASGGSSCAQRGQRQARRRSSAGIRSSTAASISVVKHQQAWVALAG

SEQ ID NO: 29629 - protein, 580 aa, Pseudomonas aeruginosa
APVGQHQHRQEQAEQGEHPVDHGEAAEVALLEAQRYGEDQRGGGEEVLRSLAYAQPVAAAPGTDARGDETHHAEDRRRQQQAGVAQVGQEQGVERPGHQRQVAGGDVEYLPEHGQVEDEAGERDHRRQLAEVARGVLGLDPERGEERGEGAADQDRHLGDGGEQAPEAIEQQEHAGGEGQGAEERGYPHAQRKLLAAQVVVDVETVAVAVQQGQVIVGELPGLGRFEAERLLLVEALQLALEHQDVVGALLCLGAVDGLHACSLSGSGGAGSPWSAHSTEKRRLRSRSGGPCRWSDSGNFRFFLRSLLQPGCNRRNRLPAPSGSCPGVVRLRSAMKENADGHAIVRAATGGLPDERLQRSGAGRLRRTGSVRRWLLRLRSRRPAPLSSGPRQERLVLSPLPFPESSRRMRASRRRRSSGRSAAGPQEAAMWRTFLRVPLLLLLASLGGCAVYDYDYDDGDWRHYRGQPYGYAYEVPRYRVYDDGWRSERRYYSTRYYDQRYYPAPRRYDGHRDYRREQYRYQQRYHESRPAHRGERHPGNWQRGGQPQWRGHSPQRWQQHGRQDRPGHQGQQGGTPRWRN

SEQ ID NO: 29630 - protein, 321 aa, Pseudomonas aeruginosa
NGVSDEPSACTPGARPAARRRRRNHRAQTAQCLHRRGPAAGRSGIALRRPRRLRARRPRPDPAPGAVTHPQPRRQRRLAARWLRLPPRRQASRQHQSQPATPGPAQSQVRLVRGCRGYLPGARLRPGQHHLHPRRQRLDRGRHPDHPGHRQGGLRTGQPRAGREADPYGDLQPRPRRSLWRRARSGRATAGRQRRGADHRSGRLHGGGDQGERPGRQRHDAPRHLPVRHATAQGAAGAGRHGHRQGIGARTAEPAGADPPDRRRGRGPGAGRRAVHLPEHAGHRVAGGDEHLAAAAEGPADGRERGRYPAQPVHPARRRGT

SEQ ID NO: 29631 - protein, 253 aa, Pseudomonas aeruginosa
SDLLAVAHQGQAAGHGEGDEQDPDHSFAAGQQARQRVDRLDVAVAHGGQGHQAVVDEGIQAECAMAGDEAGRLHLFDHVVGESEGQRHLQVERAESVEQLVGHRALLGDAAEQRGEQGQVQQDQAQPAQQAGRQAGVGTAEVRSGVQGQAEQAEEGRQVDQRAASAQGVHPGQHQQQEAAEHPWLGARRQAEDRREQHGGKEQQAETVTQQQGVQGGLLASSNRPAWARTRLPVYWPCVGSNNFCTTEKSRSA

SEQ ID NO: 29632 - protein, 253 aa, Pseudomonas aeruginosa
TLWTWRARAFLRQRAARRIRAPPADARPPRSARSAPRSPPAGSIPPAANASSVRCRDRSALRVPPRRSPDGACSSGSWRIPGGTPRPATGSAHARSAARPDARSSGSPRPGSSRHAQAAGRRRRAAPPAPARRSPGPAGRAVRPGAAGAGATGPPAVRRGPRVRGREAGCEVAPGATRSSSSAPGRRAGRPAGRREGSGRPGRGRERRGRSSAPRSGRGTGRACRAGGRGTSWRRRLGTGRCRSPASPGGWTG

SEQ ID NO: 29633 - protein, 465 aa, Pseudomonas aeruginosa
RVSGRYGCGSRGGIHRRRKRRARAGTSPGCSRQASTSLRTSPPAQKALAPLPRNSTQAMPASSAQASSFAARVSIIGRDRAFRLFSASRVAMPMRKPCRLGRSSKSTFMSGLSARAGCGAARRVRWEGSAVAPLGIALLEEGVDPFAGVLGVEQIDEALALLRQPGVRRAFAGTLDQRLDGADRHRALACHLGRQQQGGAARLAAVHHLFDQADAQGGFRIHPLVAEDHPLGPAFAHQPGQRLGPAGAGQQAHRGLRQGHLRLALGDADVAGEGALQPAAHGVAVDRRDRHPAEIAQRLEGFAEAAGHLASAGLVAVGEHVQVGAGGEELRPLAGHYQGVNIVVAVEVLDQLAEADQRVAVPGVGRRVVDGDQRGVPVLFHGELVGQVEGGSLVGFDGSVHEVPHWIMGRGVPALSDAMVRGVHSRRSSMPPCSSRRRATITRMISLVPSRIWCTRVSRTQRSSG

SEQ ID NO: 29634 - protein, 180 aa, Pseudomonas aeruginosa
  UNSURE (8),(57): Identity of amino acid at the above locations are unknown.
ATALARVXPAPGHSPMTKPSRPHRMLTMNTLAASLKLNSMRPVAFTASWPWWVFSTXMRISLTENRPSTRTTNWMPSARWMLSPVKRYTPLLASIPTLDRNSPSSAASRVFSGRSPAIPPRQTMANTISTKYSAGPKAIAHLASSGANRTIPQVAMKAPMNELQADSDRATPARPLRAIG

SEQ ID NO: 29635 - protein, 525 aa, Pseudomonas aeruginosa
FKVSITKSSQRQEVENAQRQRDVQGAVEQPVEADPEQARGDHRRDWPGAVENGHAGADQGGAEDEAERFEQAGEHQQQGDAGEHLEQHGAAQRLFVLGVADRRRPRDQPRQAGAHQRQAEQRVGARADRFVGKRRLVTPAGDRQADAGEQPEPGEQALVQVGTGHGTILVARPGSGRARAGLLDQAEVLGQLLVLLDLLLHVAVEFLAGHGEGEQLALVAQLGEVLGGQQLVEGVLPPGVVFVADLRPEVEPANHRPDDVVALFLGGGDVGHRRLWQAFFGEHREQAHVAAEDVRHGVGNVGAADLDVPAEQRGGDLAAAFQGHVAQVARIDPGGLGDQRGLHPVLAADGAAGADHHLARVGLERLHQVVEVLVGRVGAHRDGAVAGADGGQPFHRVLVEAAELALGQVQQRAAGEGGDGAGVARALGDHRVIGDRADAAGHVGDAHRLAQQLGLDQGALGQLAGEVETAAGGRRGDAFGTLGFGHGGAGQQQAGGNQGEGTKRQFHHHRCSCGVLVLAYQIGRV

SEQ ID NO: 29636 - protein, 473 aa, Pseudomonas aeruginosa
SPSAASATCWRRWVTDAGSLRGRLLLWLALLLLLVLLASGLSAYWNGREVADTAYDRTLLASARAIADGLYEKDGTLRADVPYVALDTFAYDSAGRIFYQVNDIHGRMISGYENLPAAPADALRTDDYPALAKFYDGVYQGVDVRVVSLLQPVSEPSMSGMAEIRVAETEGARERMARSLMTDTLLRLGVLGVGALVLVWLAVSAALRPLDRLRREVEERQPDDLRPLPMLEVQHELRPLVESLNHFTQRLRSLFERQSHFIADAAHELRTPLAALKARLELGLREQEPEAWRSTLETTAKNTDRLIHLANQLLSLARIESGAQAIAEGGAERIDLTALARELGLALAPLAYARGASLALESAGPVWIQGEPTLLNELLSNLLDNALAHTPQGGNVILRVLEGGVLEVEDDGPGIPAADRERVFQRFYRRGDSPGSGLGLAIVGEVCRAHRAQIQLDQGELGGLLVRVRFPVE

SEQ ID NO: 29637 - protein, 174 aa, Pseudomonas aeruginosa
QPFLKLTPPTACRLIICGMNSSRVAPNTWPMPARTWPSSQSSSGASRLCSRSVASTASARCAGTHSSTRASPRATASRSPWRAILPLSAGVSIPRARSASLASRKPMRSQAALSSARLALENTAYFFRSANWASSSSPAIASSRPSPSGRMRKLDSRRPLMLQRPPRLEVSSLR

SEQ ID NO: 29638 - protein, 403 aa, Pseudomonas aeruginosa
SYCACACRAAGASLAAVSRPMHWAPTAIGACVSACASVAVDGRHQDSVAGFGQQVRIIQRVVQAPAFAALHGRADDQFGDQCQVAQLDQVAADLVVAVELVDLAEQQAYPVLGALQALVGAHDTDVVPHETPQFVPVVRDDHVLVGVGDLAGVPARQAFRHGRAGQALEHVGGGRAGIDEAFQQRIAGHAVGAVQAGEGGFADGVEARHVGMPVLVDEHAAAGIVSGRHYRDRLLGNVDAEVQAALVDGGEVRLDELGRLVADVQVDTVDPQTLHFMVDGAGHDVPGRQLATRVEARHETLAIGQAEQGAFAAQCLGDEETLGLRVVQAGRVELVELQVADPAAGAPGHGDAVAGVAVGIAGIKVDLARATGGQHGEAGTEGIDFAAFPIQHVGAQAALARQA

SEQ ID NO: 29639 - protein, 182 aa, Pseudomonas aeruginosa
LALGDQVDRHPLRQQLDVRSPPGLGQQGIEDRGAGGVGGMDDAPVAVPAFAGQVVFEAAFLVVVLLVAGEGHPLFDQPLDRFAAMLHGEAHRILAAQAATGDQGVLDVGFHGVGIVQHGGHAALGPVGRALRQSALAEDGDAQVFRKGQGQTQAGGAAADDQYIVLIMLAHARISPWWSPSI

SEQ ID NO: 29640 - protein, 279 aa, Pseudomonas aeruginosa
THRFQSRMPEDLVRLAYPAAQRPGPEPDAIHFRGARTRCPGPHVTSEEKTRDACLEGRTFARSPSLSWQDDSLGRSKLLQVRRGAFMLTQEQDQQLVERVQRGDKRAFDLLVLKYQHKILGLIVRFVHDAQEAQDVAQEAFIKAYRALGNFRGDSAFYTWLYRIAINTAKNHLVARGRRPPDSDVTAEDAEFFEGDHALKDIESPERAMLRDEIEATVHQTIQQLPEDLRTALTLREFEGLSYEDIATVMQCPVGTVRSRIFRAREAIDKALQPLLREA

SEQ ID NO: 29641 - protein, 354 aa, Pseudomonas aeruginosa
AASADLPASARATIRRQWYRERAALRSGSQPGKPLRRDMRTTSLLLLLGSLMAVPATQAADASDWLNRLAEADRQNSFQGTFVYERNGSFSTHEIWHRVESDGAVRERLLQLDGARQEVVRVDGRTQCISGGLADQLADAQLWPVRKFDPSQLASWYDLRLVGESRVAGRPAVVLAVTPRDQHRYGFELHLDRDTGLPLKSLLLNEKGQLLERFQFTQLNTGAAPAEDQLQAGAECQVVGPAKADGEKTVAWRSEWLPPGFTLTRSFMRRSPVTPDPVACLTYGDGLARFSVFIEPLHGAMVGDARSQLGPTVVVSKRLQTDDGGQMVTVVGEVPLGTAERVALSIRPEAAAQK

SEQ ID NO: 29642 - protein, 491 aa, Pseudomonas aeruginosa
DLPAQLHRYPRPRRLHLRSQPLAGRLRGRAAGSGRRPGRRGAVRRQLLHRHRAGAGSDARAEQDGPAPGRAGAGERGNREHHRHRRHRRRGLQRQERDGRAGGAGAPGDRHPRPGRRDRGAAAGADHRLLVRQLPWRGLAGTGEERPGEEGRQDPGEVHRQGPPGGQRRGIHSEAHRDRRPEGGRGGLHHRRYQGYPRRAGGRYADPEQHAGRRGPAGLQAGQAAGLRGPVPGQLGRFRGLPRRPAETDPQRLVAAIRAGKLRSPGLRLPLRLPRHAAHGDHPGAPGARIRPGPDHHRAHGGLRDRAEEWRDHLRRQPVQAPGPGVDPGNARTDLPRHHPGAQGPPGQRDHPVHREARRAARHALPQRPGAGGLRPADERGGARLLRSPQVHQPRLCFPGLQLRSFRAVQPGSSRRADQWREGRRPRPDRPPRQRPLQGPPAGGENEGTDPAADVRRGDPGSHRWADHRPLDGQGAQEERAGQVLRWRREP

SEQ ID NO: 29643 - protein, 287 aa, Pseudomonas aeruginosa
LEPMTLNFPLLLVIAVAVCGALALVDLVLFAPRRRAAISSYEGQVNEPDPAVLEKLNKEPLLVEYGKSFFPVLFIVLVLRSFLVEPFQIPSGSMKPTLEVGDFILVNKFAYGIRLPVLDTKVIPIGDPQRGDVMVFRYPSEPNINYIKRVVGLPGDTVRYTKEKRLYVNGELVAEKLVGEEPGTLGSVTLYQEKLGQAEHLIRKEMSRYRIEPDRQWTIPAGHYFMMGDNRDNSNDSRYWNDPKIPKDLLGMVPDRNIVGKAFAVWMSWPDPKMSNLPNFSRVGVIH

SEQ ID NO: 29644 - protein, 166 aa, Pseudomonas aeruginosa
SRSGAAPEGSPAFTSANAAAGPCPMALPLAGRNNYTDMRSDMRFARSQKGMSLLGWLVVLGVVAFFASAAFKIIPHYMDYYSLEKVITSVETDKAAEVRSVPEFYSYVGKGMQINGIRNLDLEKALEVQLEDNQFRAHLKYEKREPLISNIDLVVHFDKEFRVRMP

SEQ ID NO: 29645 - protein, 336 aa, Pseudomonas aeruginosa
  UNSURE (46): Identity of amino acid at the above locations are unknown.
ATRPTGTAAAAASPSRWPRPPRWWLWAWRMAMTDMHDDIPAGSRCXYVAIVGRPNVGKSTLLNHILGQKLAITSRKPQTTRHNMLGIKTEGEVQAVYVDTPGLHKSGEKALNRYMNRTASAALKDVDVVIFVVDRTRWTEEDQMVLERVQYVSCPVLIAVNKTDRIEEKADLLPHLEWLTQQLPKAEVVPISAQHGTNLDVLEKLVAERLPESEHFFPEDQITDRSSRFLAAELVREKIMRQLGAELPYQITVEIEEFKQEGRILHIHALILVEREGQKKIIIGDKGERIKSIGQNARKDMEVLFDSKVMLNLWVKVKGGWSDDERALRSLGYGDL

SEQ ID NO: 29646 - protein, 253 aa, Pseudomonas aeruginosa
PFPAARRQPGAIPLAPGRPAMSFAAAQATYVLHSRPYKETSALVDFFTPLGRLRAVLRGARGKAGALARPFVPLEAEWRGRGELKTVARLESAGIPNLLNGQALFSGLYLNELLIRLLPAEDPQPEIFAHYAATLPLLAAGRPIEPLLRAFEWRLLEQLGYGFALDVDIDGRPIEPQALYQLLPEAGLEPVAQLQPGLFQGSELLSMADADWSAPGALAAAKRLMRQALAPHLGGRPLVSRELFMNRKESPRD

SEQ ID NO: 29647 - protein, 267 aa, Pseudomonas aeruginosa
AAAGTRGRGPRAFPRPDRQRRAWPALPQCRAGRGHRRHQRAEHRPRHRRPRPLRRLQAGGGRDESADAGRGDQALRQSRPACRRPAGRMKAKKKTIRGWAFPYSLSGLARHQRGAHRCRQAFDGSRTVLRIEEFRQRLETHPFGGALFLDAGQADVDAARVGEPGAAQPELQGCHRGQEPDVAHLRVAVLGHQHGAGVAFHHQGLQDQFAAALQAVLERQQVVDGRATVIEHAHGEYRVEAFELLRQVFQGQRQVPGRQLRQVALGG

SEQ ID NO: 29648 - protein, 212 aa, Pseudomonas aeruginosa
ELAEEQPVRIDPDHAFRAGAEHAPLVVAVAAADVEDAFATQFDMWRDTLPFPVGTPFGIDLYAEEVERPLAPGNQPLQRFLHLRLQRRIVVAVQGEALGQFDLRCGHLGQALDRAPPTGQVAVAFLDARGDLRGQAGRPAVQRRAGEVSLEGVEGEVLDHGRAIIDAKLRHWNHWLTRLKPAASSRSRCSSKVSGSMTFSSALRFCAISSSL

SEQ ID NO: 29649 - protein, 464 aa, Pseudomonas aeruginosa
TVVLGEALVALGVGVHAGVLQAGAEAEVEAVAELPFLQGEQRGAVGFRVRHEGFLAEGGEAAVGELRADHPVQRAERAVAGLDAAFVAFVLEGGAGLAILDFLVLVLGIGGVQLQRGERAFEVADLGGEGVAVLLHLQAHVVLGRRAIVAVVAAVGEAGVTVLPVIGATDGAAVLAAVAVLHPMLAGVAVDLPLAAGMGVAGNPDVVELAAGGVHVQGEVAVAGLQCAGAATGGVGAAVAQFAAAVDAVDGFAGDAVVEAVHHPADGIAAVEQGGRAAYHFQALDAVGVFRHRVVVGQRRGVERTDAVAQQADAITVHAADHRSAGARSEVGGGHPGQAVEGFAEAAFLSQGQLVAFEHAAGRGGRFVAQRVGGDHLGGQFAGAAVGAERFPRNDQAGQRQWRERPERTGREKAGRGHCGLHGHGSDFFQAKANPGPSRRKGDGVGSAYLLGCYIISFCVGRPA

SEQ ID NO: 29650 - protein, 675 aa, Pseudomonas aeruginosa
RGDRRRADPRQAVRRRLAAPSRPERQRSGQFRRLGPGDDRQGGEHRRTHRRPRPERHQPAGAALWRTGDPRRDEPGDEADGQAVRAWPDHLRSAEERSSMPRAGLHLFLRHARRGRADRRRRREMLGRLPPGHRHRRRRAAGRSGAAAVDLDQALGGASALRSGATRAGAQRAVRQCPGTGGARAQAERRHHHRRRGSRSPGAVPRTLREADARPGHRRLGRVRPGHPGLLQALPAGAGMADPARPRAWRTHPAAPGEGCLLGQRDQAVPGAGRRWLPRLHPQGRHRHFLPGLRPLPAQRAHPRGDLPAVRQPQRPHRDRHPRPGRRSQGRRRRGARLRVPAPARHGRRAVRHGDREVPPQRAHLRPGRRAQGPAAVPGPPPAGERRQLFLRAQAGGPARAGGDADPAPGYPTAPVQDAGQRPYPSAPGDLRRRAEKLPGHQHEHPEPVERAGARLQATPDPPVASRADRQRREALRPGPRSALPVRPGEAGRQRPVRVRRAGRQGPRRVAGGLAALERHPGGRACRHPRASRRPAGSPARRADGAVHPGSRQVVAGRYRRDPRGGRLLPLLRPAGPPAPGPRGTAWPDRRAQRAVLRRPRHLRLRQPVELPAGDLPRPDQRRAGGRQHCAGQAGRADQPDRRAHRRTDVRSRPAEGRYRPAAGRRRHSRRRVLP

SEQ ID NO: 29651 - protein, 199 aa, Pseudomonas aeruginosa
RAGRRGGLHRLHRHRPHHQPPTGREARRHRHPDRRDRRAERDDRRFHRFAGTGDQGCGTIRVHQRRPALLRAARDVRAAGHRRAGDRVAQGRHGRAEGRPDRRARQRRRPGDRRRGQGRPGAAHRRAEGRRQADRRDQGAGQPERSLRRSRRVRDQRHRRAEERELRPGAARGALCRAGPGKGRAGDQRHRFRPDHGGP

SEQ ID NO: 29652 - protein, 552 aa, Pseudomonas aeruginosa
GHPRFRLAPASAHGVTPQAPFCQPRARYPLLAHARARIKTSNRGVPMSVNTPTLITFVIYIAAMVLIGLAAYRSTNNFSDYILGGRSLGSFVTALSAGASDMSGWLLMGLPGAVYLSGLSESWIAIGLIVGAYLNWLFVAGRLRVQTEHNGNALTLPDYFTNRFEDNSRLLRIFSALVILVFFTIYCASGIVAGARLFESTFGLSYETALWAGAAATIAYTFIGGFLAVSWTDTVQASLMIFALILTPVIVMLATGGVEPTFTAIELKDATSFDMLKGASFIGVISLMAWGLGYFGQPHILARFMAADSVKSIPAARRISMTWMILCLGGAVAVGFFGIAYFQAHPEQAGAVSENPERVFIELAKILFNPWIAGVLLSAILAAVMSTLSCQLLVCSSALTEDFYKAFLRKGASQLELVWVGRAMVLLVAVIAIWLASNPENRVLGLVSYAWAGFGAAFGPLVLFSLLWKRMTRNGALAGMIVGAATVILWKNLLGWTGLYEIIPGFLFASVAIVVFSLLGKAPSTSMLKRFDDAEQEYREAHQGSAAPVTQR

SEQ ID NO: 29653 - protein, 274 aa, Pseudomonas aeruginosa
RAVAGAVDTDIRSVGLQQAAGDAFRNQDRTGQHQSLAGDGRLQGIVLLVVLADHRLALHPVFAGLRAPGLPAVGVEPGVVPAHADQGRLPFCGQGDLGRRAVDREAFVEQAETVEVRMVFETVADHQVDAGVLVQVEDFAVGVQAQVDLRVRGVEAAETRHQPEGGEGRGGGDRQVAYAALRTQRVDALRNFQQGPVQAAEQPFAAVGQAHFPWQALEQRNAEPGFQRTDLVGNRGWRYRKLLGGGLEARLAGRRFEGAQRGQRQGSEHWNLHG

SEQ ID NO: 29654 - protein, 224 aa, Pseudomonas aeruginosa
GHSSLAESKEIQMSRILAVHASPRGERSQSRRLAEVFLAAYREAHPQARVARREVGRVPLPAVTEAFVAAAFHPQPEQRSLAMQADLALSDQLVGELFDSDLLVISTPMYNFSVPSGLKAWIDQIVRLGVTFDFVLDNGVAQYRPLLRGKRALIVTSRGGHGFGPGGENQAMNHADPWLRTALGFIGIDEVTVVAAEGEESGGRSFEDSCAEAEQRLLALARSA

SEQ ID NO: 29655 - protein, 104 aa, Pseudomonas aeruginosa
GAAMAWFHLLVAAAFEVAFAMGMKFSNGFGRLWPSLLTVVAAIGGIYFLTLALRELPVSVAYPIWTAIGSLGTVFLGVLLLGESLTAVKLVSVGLIVAGVAGLK

SEQ ID NO: 29656 - protein, 151 aa, Pseudomonas aeruginosa
QPGRALRSADRAARPAAAAAHRGAVGRHPAIPAVDRRPVVAAAAGAAGAQRTGNQPASRPAAGPRAPGRPGRAALPGAGGVARRAACRDARRAPGMPFAGAGEGLRRDPHPGAARAGPAGLVLAGALNRYRRPICCGDNGTWQRVAVRGSR

SEQ ID NO: 29657 - protein, 81 aa, Pseudomonas aeruginosa
SVCLSSLCFGSGMSMRTLFPLLVGVVLAGFSGLAAQAAPAPFYKWQSKLDGQVACMQTSPGDGWVRLDGPYRDLRCREPLR

SEQ ID NO: 29658 - protein, 213 aa, Pseudomonas aeruginosa
ATHPPDGARRLYRRRPVPGLGEGHPDGRPGHHDLLHPRRPGDPGDHARPRRDGGTQSGGRFLQPVRQGLPGPAGGLHHRLELLVPLAGDLCRRNHRRRRLHGYLVPRRAALDLGPGGPGEHGHDQPHRGACLRRVRVLVRPDQDLHHPGDGGGRHRHDRLRLRQRRHRHRHLQPLGPRRLHAQWHPGRADVAADGDVRLPRGGNDRPHRRRSA

SEQ ID NO: 29659 - protein, 723 aa, Pseudomonas aeruginosa
PDQDHSQRDQLGVLAHPAVLCRLAVRDHVALSVERDRHPGQPLRDDLRAHGHQDRRRDHQLRGDHRRAVVLQWRHLQYRAHALQPGPASPGPGLLRQGLAQRRTAPGADPVDPGAAAGRVAELPGAGEGIRLGDFHRHLRRDLDLGDDPAGPVALPQDAQPGRVRQAAIPHVAVPGQFLPGAGVPGDGGGADGLLRGHPHRPLHRPAVHPAADRPVLRLQPGAEGACRHRLGKPRGVLSGVAPEKKRGLGRGPFFVAPISGPVHPANNAVGVIRPTQAGASARQHAQHHRRQQADVHPCMQRIGKPPDQRGRQADAEPAAAGQGGEGQQVDVADEASAQALLLVAGQDQVGKGAAKSHRQAQRVGHGGRLGHAQPAAAQQWYGHHAASDAEEGGDRTDQRSAQARLADAQRPRLALLGAAEEAATQQAVEDGDGEVGDEGQANEVAAGQADQRRAKHRADTDVRAQRPDIGAQQATGAPVAIGGEGGVDDHHAGRGGHRDLHGRLGQRVVGGATELQQVIEQRHHHEAAAKAEQHGADPGEAAAEKEQEIEHGGFPERERKASLGVPGLARFARLANTIRVSARCFDHAQRFHRAVRRHAPGRGGHGYRLSRRLPAAAPSASSRAIAVRCQRGDAGAYRRRRLGGAATARSVDSAGRRARGANARGEHPQPVHRARQRHGDAGALPGAGGVAAAAATVAGGGGHAPRIRHRRSRRRVGDAVAP

SEQ ID NO: 29660 - protein, 711 aa, Pseudomonas aeruginosa
VAGMRIWGGWAMRRRPRQSNSGAAAAFDSRCRSSADDATRRPSYQGVSPAPSGAGRLQEVLGEALQYAAGFVDGDFLVAVQAAGHRHFEPLPVAPVDDQGQVGARPASAEHVEGLAAVDPQGQAGGTRLELQRQHAHADQVGAVDALEALGDDRLHPGQAHALGCPVARRTLPVVGAGDDDQRLLALHVGLDGFPHAHHLAFRLDPRQRTLLHAAVGVAHHLVEQLRVGEGRALCGEVVAAVGGVGVEVLLGQAHFRQVLARRAVGEDRVGRRQVVGGDVVRQHRQRAHAAQGAFAGEGAFPVRRAADVSARRAPGVERVDPLALAVGDVEHRDVDLAELLGLHRRPDHRVDLLVARPEVLQADLLAVHHAEHVALDVEADGPGDGVGHHQRRRGEEGLLGVGVDAPVEVAVAGEHRGGVQVALDDLLLDRRVEGAGHAVARRTGVGHHAEAEGFQVRQQAGFAQVFGDHLGAGCQRGLHPWLADQAEAVGVARQQAGGDHVARVAGVGATGDRGDDHRAVRHQALGFLGAGPLEVAGDAFRRQFAGGDPGVRIGRAGHVAHHAGQVELQYPLVLGVDQAVGPESGGARIGLHQGDLFVVAAGEAQVVDGLLVDGEHRRGGAVFRSHVGDGRAVAEGQAGGAFAVELQVGADHLLLAQELGQGQHHVGGGDVRLATAAQLDADDVRQAHPGGAAEHHVFRFQAADADGDHA

SEQ ID NO: 29661 - protein, 491 aa, Pseudomonas aeruginosa
SPGRRRAGGRRRRAAGRSSAPVPGCRGPRRQCASRPSGGRPWESVRELPSAPAAGRAGPGASSGRRRAVACSAVRRRAAGRRLPRRSPPPPGRGRRSHGRSGRRLPGRRWTGLSDRPPGHAGRRHSVLLLQPLLSPFLNFFWMLQLGFTGFADRRSGARRARCSGVLLLREERVELLLEAVVIDAIVQLHAGLHGIDHILLGAVATDRGVDVLRRLVHGAEGRQRVEHQGHVGGGQFVGGEQRGGAELGDVGQHRHLHRGGEFLVHGQFGHGFREDHVGTGLDTGAGAVDGGLQAFHGQRVGARHDHEGVVAAGIDGGLDAVDHLLLRDDLLVRPMAAALGADLVLDMHRGGAELDHRLHRAGDVERRGAEAGVDVHQQRQVADVGDPAHVGEHVVEAADTQVRQAQGTGGDTAAGQVDGLEAGALGQQGVVGVDGADHLQRVFGGHGFAEALAGGKGRLAHHGPLRRWRKRRRASPAGVPAGARYCGATH

SEQ ID NO: 29662 - protein, 258 aa, Pseudomonas aeruginosa
PLRVAAPDRLRLRHGRRDEAAFAAGAARPWAGAGDRSGHRAQPGLLRRGEGVGDRRRRPGRANAGAGPRARGANRHPGGNGRPRAWRDPRRGGKLRHHRLHFHPLLHRRAAAGAGRDASGAEAWRRIAVLRAWARAGRLGAGLATAPDALVETAGRRLPPGPRHAGLAARGRLSHRRAGTGLPARAAADDLRLPRRRALNPGGPQSALGKGANSASISASSSFQPSPLPSLNRPSARAAFSCCRCWIFSSTVPRAISR

SEQ ID NO: 29663 - protein, 239 aa, Pseudomonas aeruginosa
PLCTWLPRVSRAYGRAGSMARLSWVSGAEGEVIRYVLRRDQPKPQTADITKLGALAQSGDGRMARRTNATGYDPHSSDPGNPWRDATWRSSGASTNANVIEIQSQTFRIDDRLATRERGVAVPARRGSDDARPCFHPGRHPMTSQALAGGLSVTGRILVAVLLGYALAYAVTACLSIYLPLPRPDRVSFGSLGCFAVWVAAIVYAFAARSAWRACWVLALASLALGGLAWLGLDYGARP

SEQ ID NO: 29664 - protein, 352 aa, Pseudomonas aeruginosa
CGTSTKPAAIPRASTWWSPIPTPCSAAPRPPAPRSSSTSRTRTTAVAASLAAIRRATSGASAAMIPGHEAPSIHHRRRCMKTLTLIDGQEVAAIGQGTWHIGEQPGERKREVAALREGIELGMTLIDTAEMYAEGGAEDVVGAAIAGRREEVFLVSKVYPHNASRKGLPAACERSLRRLGCETIDLYLLHWQGRYPLEETIEAFERLRDQGKILRWGVSNFDLGDMYELDGSACATNQVMYNLEERGIEYDLLPWCQERGMPVMAYCPVGQGGRLLRHPALGEIAARHDASSAQVALAWLLEQGVIAIPKAVTSAHIRQNAAAADLELSADDLRALDQAFPPPTRKRNLAIV

SEQ ID NO: 29665 - protein, 67 aa, Pseudomonas aeruginosa
IDIFLCSFTFTLMEQRILQMFPLRDSAKKALCRGNVLVMPAFFEKSKLAVQVLIRGSIGRKVSRPGS

SEQ ID NO: 29666 - protein, 165 aa, Pseudomonas aeruginosa
AFVSADACQPGKGYGPGVGGAWQDCRSIAAPRLSMPSPARTLLVAFVSAWFLLGGLGHFVFTDFFVGIVPPYVPWPLAAVWVSGVFELLGAAALLVPAWRRLAACGLFILTLCVTPANLYMWQHPDLFPSFPPTLLAARLALQAFLLGCILALMLARDEAPLARR

SEQ ID NO: 29667 - protein, 194 aa, Pseudomonas aeruginosa
SPFWQASHSRRQVLRRVAFAAGLGQVQAAGDAQARGQRLQQHRHQAGEQDYREQQVAQLRAAGDVGGPVARVHVAHRDQVAGAGEGQQAAPPVAAAGDFDRLGATGLGGLGGRGILRGHDEAPAGRVPALRAPFPARRGARVGRAVQGAGRRKSVRPRPPVAGAGPAGRWRSGPSPARRRGPGTGRGRIPAAGR

SEQ ID NO: 29668 - protein, 145 aa, Pseudomonas aeruginosa
RPARRGTLPGRRRGMRCASRRSPPGTAAARRTARRPAAARPGGCPWRSPAGSWRTSVTPTCCRPAAPCCSRRRRPPGTAGWSGSRWPTARRRGPARRSACRGRPPAARSSGRAARRPPAGRRSAPAAPPTPAGRSVATRVAGRSG

SEQ ID NO: 29669 - protein, 774 aa, Pseudomonas aeruginosa
PSGSAGLGSRRGRRSLDELPCEGEVGFAERMQALQRQVFAEGAFHAHALEDPFAVELGLGAVGAQFVESLAQQLAVVAERHLAVIVHRVGRVLHADPQHVDLAVRLRGIGGQPAHRAERGAGARADVERPEVLRGMLRHHRRADRDADLALAHAGFADVVLQALGALDHRAELLVGLRERQAWREAEQQDHVQLAGTAQAQARVLHGETGHGVAAHMLHPLHLVEQAELLARLDGVAVDLELGHRRGHPVVGALAGGVGLQLGLFQRRRRLVVAQVGEEGRAGGIVEVELAPLLLQLADHLQFDGRLDRHEVRTAQVQRDGAVADPLPLAEAADVLLHLAAVAAGAEAQHQVGEAVLQGAADRLVDVVVGGLFLGQRVARVIVVVAATHLVELARFVQQFARGGADGGAGADAVEQAVAGGGVVARGELGAGGGASENQGFPGSGHGRLSSIHHSIEGGAVRGGPKGCPGRRKSSVSQAGERCRWRDRYALFYERDLNRMAAAVRGAFGNARCRRHKDLAQIARRCANRRHGGATLPFAQGRSTGGALSQAILQGLAEALDLAVVGQVVRSQAQYPRQRLLAQRPAGILRADVGGVHAARVEALQPLLAAQFGGRVGHQRAGVRPLFQRRPAEPAVELLGDAFAQLAVASGDAPDIGLQQVVATGLERQAAARVELRAFGSAARHPAPAGRRRRSIARRRRPARRAGPGAPGHVRRDRARRVPLARAATCVAGTPARRSRSPPPPAATGRPHGWHRGTTARHGRGCARPRPPAR

SEQ ID NO: 29670 - protein, 369 aa, Pseudomonas aeruginosa
GTRNDDRPGDAQGLPRPLSDQELQPCGAGVPCLRVRAQPAYPDPGTVARRAGVRAPQARPRTDRGRPPVARRGAGRGARPGQPAPVDPRARRRRPAAHSFLRPAHPLLGVLPALDSAPAGGLPQRQVQRRLRLPAAMPVAPARRLGRLRGGVARRRRGGVAPPGHRQRSRVPAPGAWPRTTGGGLRAGRRRPAVVQPRPPADRSAIVPRLLRGMPPGLGPGTAAARQRPVPPAPSQLQPDRGAALLRPVAPGRRLAAAYPGPRGPRQPSPGARRRPALRRAVALHPDPSPPAATRRGRTPVDLPRRAGAPGAALRGGRRGLLSRRLGQQGAAEFTDQVVLRRTAAADHHQLALEFQRAQFDHPYPRRLA

SEQ ID NO: 29671 - protein, 457 aa, Pseudomonas aeruginosa
PQPGPGQQRHAETVLHHPRDRVDLIQLHHLAWPELLRLEEIAHQATAEGHMVVADERLRAQQFQRIRRSALRRRDQHERLALDPLRGEPARQVERRADEDRQVQFGGVHLVQQVQRDARHHLRLDVWRLFGEALEHLRQQPGLRRVHRTDAQASARAVALADAVEQREDLLGRTHRLPPDLVQVCRARRALEQLDADAAFQRADLRAHRRLRQPHLFPRRGEGAPARHGDQGAEFADHPSLEKSVAQAKYYALSIEIGTANNPGTPTEEPRHEPDALPPRHPRPRPARRPALLRRGLRPERRPLRRALGRLRLLRPPVGHPPASADRFPAPRRQQPGGRPRRAGAALRRGPRMGRLARPGRTPAAARHPLRDRALHPLQGPGRRAGHAVSLRPLRQRAGVQELPRHGPVVRQVRLPALHLTVRSPCRTPAPRSWTARPVGSMSRTLSCAPRCPAAPA

SEQ ID NO: 29672 - protein, 104 aa, Pseudomonas aeruginosa
SASHLARAAPCPGKTVTAQSPSTFIPLRRTSQCNQHPGCATLYLDCSAASEDLFDTARTRLESAIGTLSVLDLLDETEEPGESTCRITGSLLSLFEAEYARRHR

SEQ ID NO: 29673 - protein, 511 aa, Pseudomonas aeruginosa
ARAWTTFVDVAVMEESAQQCSERYVSTRSQHPAWLLLASRRAPLVLGCLRTLFERAHDGIPMEDALQALSEMLAAYASQDLYEIDPDATHIQAGRELREWIKRRLVVEREGRIYATDALESAIQFVDSLDSRIMTSTASRLSVVQREIENLETGLNPSPSGRIASLRRRIQDLEHELAQVEAGHVVVLDEAQAIESIREVYNLATSLRADFRRVEDSWREADRALRQSIISEQSHRGEIVDRLLDGQDALLNTPEGRVFESFQQQLRQSAELEVMRERLRTILRHPAVPKALNRPQQRELRWLALRLVRESQAVLQARARSERDVRGFMKTGLAAEHHRVGQLLNDFFNLALSVDWQRQAVRRSTVRLPPVGVAITGVPAIERLRFKTLDDDDTGELDLSLKPAGLEQIDDDFWDAFDGLDREALIHDTLAVLVEQGRPVSLGELASLLPPAHDLETFALWLAMAREAGTEVLTEERQLVELVDEDEQRWRFNLPYVGLDHEALKDIDWEL

SEQ ID NO: 29674 - protein, 409 aa, Pseudomonas aeruginosa
AGKLWMSIINSASRPCMKSPTDIGRSLARQWQRSSVRLDRLLNSASWPQSFNIGKPSARLFSDNIRTVLRHVENWRSVKVGKVDWEPVSYRAGLAPISLPMRWHLRSPSEWIAATDDPSVSQEYAQLEYLVEQVDSSFHALLVAQRSLWLTKPSEEVIATAQLATQLSPGCAQGRPLRLLAEHGVDTKFFERNAILLTKLLDERFEGAASEQGLTTFLDAFEETSHWVLVVPLQPELLPFKRIRLTTSELAETSLPGSRLLVVENEQCVHLLPETLPDTLAVLGAGLDLQWLASAHLAGKQIAYWGDMDTWGLLMLARARHHQPAVEALLMDRELFDQHSLGSAVVEPAKAQELAPEGLMTDEADFYRYLLAQERGRLEQEYLPRRQVEQAISKWFGESVAPAHPERTA

SEQ ID NO: 29675 - protein, 84 aa, Pseudomonas aeruginosa
RYVLLLVVGDHDPARQVGRNLFDVFGEFVGRYPHLCVDILSALAYTDTKICSIDVRPKFYFVTSLGQGVCQGQFQQSRLQREFP

SEQ ID NO: 29676 - protein, 350 aa, Pseudomonas aeruginosa
TALNMMTPEKSLLWSEVLKRPVDVQLAMFRQASAQPCADDVKTGFRAFAADLFARKLVSMAEYVSIFGGTALNCLTPAGSGLFRDMATGTDATALAGIYSRAKYGSVGDIQYLARQLIDYLCGELDRSDSQWSCLFRNAKACGDNVVMMTTGWRNVPSTANVLYEIVVEEVNVKLAHLALPTIINVKLPRIAPPCEDYASLSTEEREHVNLVQDHVIPAENFYRWSGVHVIFGDDVLVTGSTADKVLYESMNNGAKSFRAIYPVAIDPRVALGDASVEDRLNSVVVEQRLDDTVAELLSARDYQPILRTLRLLFGEGNRESLAAFLPKVPAPTWLRLGGFNRPSQHWVAE

SEQ ID NO: 29677 - protein, 60 aa, Pseudomonas aeruginosa
LSSLATISLQQRIYEFCYQLGMPLKFCYRRRILIGPKTLTGRRPVYGKGLRESNPPLINL

SEQ ID NO: 29678 - protein, 351 aa, Pseudomonas aeruginosa
IRRCVAAGRSSGFPRSSSGRRSAPGSRGCPRASGCPGCAGRGSRGRRPRAGGREPVKGWPAARAGGVIGSARTFLAGRVDRPRLAMAEAAVTPRFDWGGRDGNGAVGRLAGGIRGPRRLRRAGAPGGAGRGAAGGASATNQHPARGDPGVHPQGDRRDHGQRLAGGCAGLAADFLQVFRRQAGGAGKHLPQRRAIAAGALRRAAQRGRQRRGLVAGDGLAVLRLPPGGRSDHSHDAGGGPACRLAAGGAPAARAPEDYRAVGRAPGRPGRGPRCADLPGADLGDGGGFAGAAQCQRPAGAAAGQAGARRPAGGYALSPHPGSDEIARVTAGQSPLAPTEPRLGSQPAVAML

SEQ ID NO: 29679 - protein, 211 aa, Pseudomonas aeruginosa
GPDGDAVFHRLLPGRRAVAGRAGRLRLSAAGPCPALRRGVRGGRGVRAALALAEHAQRVPGTTDGAGQPGHGADVRAAVRGAAGHPGRPGRPADPCAPPAAGASRRLPRSRTGRPRTAHQRAQPAPAPVVVGHHLPAGPRRCAQAPGPAIPDHHPATAVRDRPAARLQRFVELPPGVSQVDRQAAQRLPRSALSRRRRSSAADGCAMLGVS

SEQ ID NO: 29680 - protein, 217 aa, Pseudomonas aeruginosa
SESCMSTSPALIRETFPVGPLQCNCTIIGDPLTRKAIVVDPGGDHELILQRLDRLGLQVVSIIHTHAHLDHFLASGEMKKRTGASLHLHKDDQFLWDNLEMQCQLFGVPYTPVPAPDRWLADDEELACGCGVALHTPGHTPGSMSFWFPRAKLLIAGDTLFRRGIGRTDLWGGDSAAIQRSIRQRLYSLDEDATVVAGHGPDTTLGEEMRENPFVRG

SEQ ID NO: 29681 - protein, 272 aa, Pseudomonas aeruginosa
KGFFRASGILPPGYALRYRPPLTQGRFSTSRSSFPMFTSRCLPLAAAVTALALLAGCANNNPYDTQSQSQGGMSKTAKYGGLGALAGAVAGAAIDHNNRGKGALIGAAVAGAAAAGYGYYADKQEAELRRQMEGTGVEVQRQGDDIKLIMPGNITFATDSANIAPSFYAPLNNLANSFKQYNQNTIEIVGYTDSTGSRQHNMDLSQRRAQSVAGYLTAQGVDGTRLSTRGMGPDQPIASNSTADGRAQNRRVEVNLRPVPGAQGPAQTQPQY

SEQ ID NO: 29682 - protein, 542 aa, Pseudomonas aeruginosa
SRPGRKSPPFGGLFYGRWSALFVLRLGVTGKLAVQAVEQLVLALPQLVDPLLEFRAVAGVLVVALADELARNLQFLEAHHDVLQASGKQAPEGRAAVRVVDGHVDQGLQLLAHGVEDEGDTAGLGLEQVAERRLLLVVLGAGETGAFEEVEHRYRDAAELGAGLARGRQVLAFLLRVPGQVGLAVALHEGEIEGPPAQADDRDPDQFLLEEEAQQRDASVQLVLQDEDVDPALVVAGDQVGVLVLQALQALDVPAGALDQVHPALVAGDPAFGDQAHDLAAQALSGGERQEQLDQGHAEQQAGPAQGAGHQQQAGQGAAQEMGEKRQHQGVLVRRRPARAGRVERGVVPPFTWHILVPGRSQCRPLGGVPSGRGLGVRLDGGEGDGVDDVFHQRAARQVVHRFAQALQHRPDADAIGAALHRLVGGVAGVQVGEDEHRGLPGHRAVRRLLAADAGDGGGIILQGSIDQQVGALLARQAGGLANLVDIHPGTGVAGGVADHRDPCRDAESLRRRGTLHGDLGQVTGRRIGIHRAIAVDQHLVR

SEQ ID NO: 29683 - protein, 191 aa, Pseudomonas aeruginosa
HDALGLGHRLDLFRLGQQHAAGDAARLADRRRLYGARLAALGQDDALAGLLRALHHLVAERRRRQAQLARRAAALLEPFEIDVPGDELGDPLGALAVVHRDFLVHPVQVGRGVVGAGGHRQHRQAALQGAAAEFHDPRVGREVAAQQQAGQGYAVHRGQAGGEDDVVAVAGGHHQHAGLEQLHGVGHGAGA

SEQ ID NO: 29684 - protein, 360 aa, Pseudomonas aeruginosa
HDLLHPALLIVAGVDHPSAEQVGDVAGARGVEFVLPGNAADQAEVVAQQRRVFGEAPGEVRHAVLGVGRVGLAADLVEDHPEHLRIARAAEQLGLDLDTVGQFGERLVFRRGDQDHLGVETLCQVEVDPRGVAGVTGRYHAFDDHHVLVGGGALVEADDLFEQFVQLAVAEHALDLGQRQRLRRIQAVGARHQFAGALRAEVAGMQLGDGFEEANLQPGAFQGAKQAEADRGEADAETGRGDEEGMHLGSLSRAFGHAAWLGGGVDPVQSSRASVSRAICRSSLVGITSTRGCPAAWIGPATPRTQRALASWSRRRSNSRRWAAVLARTSGEFSPMPPVKITPSSCGRAQLIAARDLARR

SEQ ID NO: 29685 - protein, 166 aa, Pseudomonas aeruginosa
MRKEYVMSAFHDLTLQGLDGQDLPLSPFKGKVLLVVNVASKCGLTPQYAGLENLYQTYRERGFAVLGVPCNQFAGQEPGSEADIQSFCSLNYGVSFPMSAKVEVNGSARHPLYRLLAGEGAEFPGDITWNFEKFLLGPDGRVLARFSPRTAPDDPALVQAIEKALG

SEQ ID NO: 29686 - protein, 217 aa, Pseudomonas aeruginosa
RLITAVDNAGRTRRPVIFSRSMTSNRLDKRELILAKGSEVMTRRGYHGTGVLEIVQAARIPKGSFYHYFDSKEAFAQQALEHVYAPRLARYAQALGDSRFSPRERVLRYYGELLEHFARQEKPEYHCFIGSLSFEMAELSPPIAAKVESILQASARILQDCLEQAREAGELAADEDCASLAGFIGFAWQGALARFKVGTGLAPLNAFMSRLELLLRA

SEQ ID NO: 29687 - protein, 147 aa, Pseudomonas aeruginosa
YLPEPPIPSQESVHECPRRSPVPTVPPRRPGTAHPCGDGTDDPQLFPRRRTQRQGRRVLPPARRRRRRPDRQRRHNGRPQGRQRLSERAALLWRGRPGRLEAGGRRGACRGRAHRSAALARRQRSAPGRGAGRQRARLRPDGEGQGR

SEQ ID NO: 29688 - protein, 164 aa, Pseudomonas aeruginosa
RRPGRQRVPAILRQNRRGGAAGEHRRPGGAPGQGRVRPGRGGPRAAGGSGVGGEGPRGAYRRHQAVQPRGPGQPGLKARPRRTGPAQRRQADPTPRGGIFHGRDFFRKPAVRPADFKVRNGHCMTANTTIGRETARGANPCVSAWWSTRPATCRPNSSPPTASA

SEQ ID NO: 29689 - protein, 226 aa, Pseudomonas aeruginosa
PTSTTWSASPSTACAVRSSSTPPRLPSACSSTTTSAATRPASPVPSPCAYSTATRCSPASPAWRPRARACWRRAATPTRCVRASNSSASRPAPTWSPMTWATCAGAASRRVIAAVSSTGSRARRWGWARCSTSSRCSAWPMARTNRWRSRRASRSRRRSCSAMPWRGYRRVSCWHRNWVSAMPAIRPRCATCRASPRWRMPAASATSTCTWACSALPAASTWAPGP

SEQ ID NO: 29690 - protein, 120 aa, Pseudomonas aeruginosa
ASSLRASLCGTLVRSGATWVSPAPWKSNSEVRSPQTARRQGEMFSSTTPKRRSRKRSTEVWSNTSALTLPPFDQGEMAISGTRWPSPMGSPLDASISPAVLTVERPTPSFHGGTGALAWS

SEQ ID NO: 29691 - protein, 688 aa, Pseudomonas aeruginosa
RLSCVIKLAGESRNLGWSPLGSGAEHLEGAGRAADFADLLGPEVLRVAVVPDVVMAGLGPWWNGPVDSRFRGRYTHSLPAVLSIPVIIGGNGHGCLFAILADIHHFQESLLGAQVILRMSGHESDGHLVADAITFPGLLQHVAEGLADIGIIGHYSGLEVHLAAGQVRRYRRGFHRQAFAQRHRHVDEQLLVGGLGPGAIEGRAAFVFLGGVFLAGGDVAGIGIRVAIEDHMADTGRFAGRLHRAADPHPGHHGELGGGAEQFQLADAEHLDRQHRRRPGVGFLVAGVGEDGLFRLALHQFLRRHAGEQPAKGREERIVAFLQPQRAWTVFGATGGQAGADGRGAQLARLAVGELRADRQAGEVDETEARIQFAEHFLLGLAGDLVGLGELAQTDLAGVVELVVEGTGAGLQVQVGRQVAGIGLGEGGDETALAADVVLPVIGGVALVVRGDQVIGVGHRGAVHREPTDRAGQLAVGVDEAEHAHLRVDAILVAGDVRILQVRQQRTVAAGVAQLAAAVEQAAGLQPGLGPLDGADDAVDDGVEGLFLEAEHRQVVHRVVGEAARTGVGVGGGEHHVVLVVDTGVLRLEPGQDLQVHGLEDHPQVGVDVDQATSAGRFLDHEGTRPLAHVDAGGLLFEGGVTHHADFGGFAGDVRLAQAEAVGQVVGPGRHGERQQDAGQQERGECGT

SEQ ID NO: 29692 - protein, 244 aa, Pseudomonas aeruginosa
EHRLTLSCELKFDISMHRRGWVTCAAYSSGSLASPGATQPSRSLAMSVLVNKQAPDFTAAAVLGDGSIVDAFQLSSLRGKYVVLFFWPLDFTFVCPSEIIAHNNRMDKFRELGVEVVGVSIDSQFTHHAWRSTPVEKGGIGAVEFTMVADVKHEITRAYGIEHEDGVALRASFLIDRAGVVQHQVVNNLPLGREVDEMVRLVEALQFTEEHGEVCPAGWRKGQKSMKAIAEGVASYLAENAEAL

SEQ ID NO: 29693 - protein, 536 aa, Pseudomonas aeruginosa
HSASRWQKLLRLGEPTISRMRLPSPSSGVAPVLAVSTMVAGLQHLLRPYPFVELRFVQVAQLQRRGAQGGAFGVGLLGDFGGLVVADVRVQCGDQHQAALQQVGHALGVRLQAGDAMLVEVAAAVGEQADGLQQVVDDHRLEHVELQMALAGGEGNRAVVAHDLAGQHRQRLALGRVDLAGHDRAARLVGRQLHLGEAGAWAGTEQAQVVGDLHQGHRQALQGAGEDDQRLVAGQGGELVRRGDEGQARFGGDFRGDGVGEALRRVEPGAHRGAALGQLVDRRQRRADGALGVVELGDEGREFLAEGDRRGVHQVGAPGLDQAGVPRRLFGETAGKLGDGRQQLFVHGLGGGDVHGGGEAVVGTLRAVDVVVGMHRRLAATRIAGQFVGAASDHLVDVHVGLGAAAGLPDHQREVFVVAACEDFVGGLFDQPGDFRRQFAEVVVDPRGGFLDQRQGVDHGERHALAADGEVLQRTLGLGAPVGVVGHLDGAQAIGFGPAHECSPGCVSGSLGLRSRLGFRCRRFLVGIFRRAAGRK

SEQ ID NO: 29694 - protein, 148 aa, Pseudomonas aeruginosa
GRTGLSTSPACSAWYGPSSSWCCCRPCWRAAVSTSSPRCAAMSAAKASGRRARRMPSTTSPSMPTHAPTKTSAATRRPSRSPSATARCALPWTSPTRTSRRPARASSRAATMPTTLPRSSGCTATSTTSVTSSAPSSCGWWVTSTSWN

SEQ ID NO: 29695 - protein, 614 aa, Pseudomonas aeruginosa
AHMAVGRCGDDRQATEGGQRRDRRLEPETGRIEDHLGPAGEDPFHLCRQFGRLAQQQRGDALRFQRLALLLAPHRADRFGPQGLGQRQRGLADRAVGADYQEPGAGLDLAALQGVPGGAVGHPATGGLGEAQAFRLERDAGGRQGQELRVATVAEESRLPPGAPDRLAEQSLRSLHHHPGEVAARYPGQGGIGEAAEDVLHVARIQPGGADFHPHLIGGGKRVGHVHQLEGGEVAGTVELQCFHRGLRVVAAISAATAAAGRGQGGKAVRRAACQAGRPGRWRGAPASGSRGRRRARRPAGRCRGRSGSSWRLTGTVNDGASLVGRKNMYRPIAIEYRSRLERLVMLGPVLGGRDAQLAAEHVAEGARRISQGMGDACHRTAIDQCGGGGRQLHLPPPVGKAHAQAALEQAREGPHAGPGVFSQALQADVQGGIGHHRLAQREQAPVGGVRQRYAEAGTARAAEFEHGEIGQRPIVVGVALPFLLHQADDQLAQQRADHQHQGAVLQAAGEFRAQVNVAHLQLGGDPHRMAQARRQPDRPLRRDRQGLVGRLQPHHPGHRIKHLAPGVLVGIDAVPGRISAGDPAQGPATVAQVGWGGSCHGNAVAEERRRLTA

SEQ ID NO: 29696 - protein, 382 aa, Pseudomonas aeruginosa
DEGISHVAGRLDRRRSIQQEQRGGRMNAVAKIEQHNPIGTDGFEFVEFTAPDAKGIEQLRQLFNMMGFTETAKHRSKEVFLFQQNDINIVLNGSPTGHVHEFALKHGPSACAMAFRVKNASQAAAYAESQGAKLVGSHANFGELNIPCLEGIGGSLLYLVDRYGDRSIYDVDFEFIEGRSANDNSVGLTYIDHLTHNVKRGQMDVWSGFYERIANFREIRYFDIEGKLTGLFSRAMTAPCGKIRIPINESADDTSQIEEFIREYHGEGIQHIALTTDDIYATVRKLRDNGVKFMSTPDTYYEKVDTRVAGHGEPLEQLRELNLLIDGAPGDDGILLQIFTDTVIGPIFFEIIQRKGNQGFGEGNFKALFESIEEDQIRRGVI

SEQ ID NO: 29697 - protein, 475 aa, Pseudomonas aeruginosa
DNSMDGQHPHSGELKRGLKNRHIQLIALGGAIGTGLFLGSAGVLKSAGPSMILGYAIAGFIAFMIMRQLGEMIVEEPVAGSFSHFAHKYWGGFAGFLSGWNCWVLYILVGMSELTAVGKYIHYWWPEVPTWATAALFFVVVNAINLTNVKAFGEAEFWFAIIKVVAIIGMILLGCYLLFSGSGGPQASVSNLWAHGGFFPNGVSGLVMAMAIIMFSFGGLEMLGFTAAEADKPRTVIPKAINQVIYRILIFYIGALIVLLSLTPWDSLLQTLNASGDAYSGSPFVQIFSMIGSGTAAHLLNFVVLTAALSVYNSGTYCNGRMLLGLAEQGDAPRALARVDKRGVPVCALVVSALVTFLAVVVNYVIPHQALELLMSLVVAALVINWAMISMAHLKFRAQMDRQGTRTHFRAFWYPYGNYLCMAFVVFILGVMLLIPGIQVSVYAIPVWLLVMWACYRLKGAPRPMPGLRVKPVTE

SEQ ID NO: 29698 - protein, 168 aa, Pseudomonas aeruginosa
RNPAAAGFLLACFSARQRGYAGSPVGPPCRPMLIISNAVHLPDHEIELNAIRAQGAGGQNVNKVSSAVHLRFDIQASSLPPFYKERLLALNDQRISGDGVVVIKAQQYRTQEQNREDALERLAELIRSVAKVQKARRPTKPTRGSQKRRLDGKAKRGAVKAGRGKVDF

SEQ ID NO: 29699 - protein, 988 aa, Pseudomonas aeruginosa
VRSWWESLVVACGSGARAVPVHHSTRPPRGQPRRRRFSSGRLLGREQRRVQAQAHGLVDQRHDVFLGQLEQALEVGQDEIERLQDVDAVGRAHRLQRIEGLVQRLVGEAVDGLLRRGEDAAAVDALALVGLDQAELDGHPVQAGEEHAFLLARLEAELAVGMGELGEPGVGQQWAVAEDLVEDVRLLQVVQFFRGADEGGDGELLAGQQFEEGLERNQRRNPRHAPAGGGLENPVDLVELGDPVVGQAELFDAVEVFLTGAAFDHLQLPGDQGIPDLVLGFRIVDETVVVGLAGHVLRCFHTDSMSGLWPRGLCCCRCLIDTASGRSVQPRIGTGQRGGIGVFVKFSLRIGLGRLFIGSGIVAGESNCHIFLTEISGRELKNRPRAHQNDNTGPRHAYQSALPEPCRHPPRHPQPAGRLRHQRQSRRSRRRPGQRHLPALSEHDQPPVAVAAAQAGGGAGGLRRQARRPDAQRAPAPGTQRAARRPGLPGALGGHGRADRRRQPCRRAVARRARRRGAGDSAVALCGGPRPARTGARQQGADQRAAGEGEGRRVPRRHRAAAIRARRERGAGWSGADPASRGSRRRAHLPCAQAGAAWLRQYLPEFAGNGRGGPRGAAHGAAGRAAADRGRDRHRQGAAGARLPPGQPARAVAVHGVELRRPAGIHGRDRAVRLWSGSLRGRPPGGQARPAGAYRRRHAVPRRRRRDEPAPAGQAVALPAGRLFPPGRQRRGGVPGRAGDLRHPGRPVRTLRQGRIPPGPLSPSQCALAAHPAAARVPGWPGAARRAFPRPGQPADRLRPAEAFRAGTGTSRTLPLAGQRAAIGKRAVPGGFAVRRGNGQGRAHPPAGLRRAAAAGGFFPGRRPRRHRRALREGGAGAPVPRTSEQPPVGQAPRRFAYHGGEQAAPAWRGAKRGLSGMLAGLLQAGKETVEASALVKGRQHDEAWGGQPGCSPRGGIVAAEYTMIAPDGRAAPRGAILRRSTRRSSRV

SEQ ID NO: 29700 - protein, 283 aa, Pseudomonas aeruginosa
AVEAVEATGHDHEFVVQANQPAAAQAHVRIFESSGAAQVFQAHGLGDEARAELAEALAVEAALQAFGGEPGEVAEAPVECVAQGGAAGLRQEDGADGTGAEDAQGYFQDPPQRRHESAFRVRGGWNPDHGRGVAGEYAGVAAEIAVARGAGGAQADPERQAGEEQHALLGEQGDQSDHHAEADQGSDDAVEALGQDLPALRLHDDEDRHQHRARLRQLQAIGQPQGEAGGEQGLEHEDPGDAVATRPFEQGAAQFVGAGKEREGSRWNQGETFPGGAGHCCES

SEQ ID NO: 29701 - protein, 317 aa, Pseudomonas aeruginosa
RAVMDILFNMRAFVSVAETGSFTAAAQRLDLTTAYVSRAVAKLEAHLQTRLLHRTTRRIALTEAGQRYLMRAQQILAYIEEAEAEAGDAHARPSGTLKVHAMTGIGQHYLIKAISQYCETYPEVGFDLTLANRITDILDEGYDISVVIAPELPDSGFVSKCIGQTYSILCASPGYIAAHGFPKLPAELSAHRCLRLVNSVMSLDRWLFDGPDGQELACINQTHFQVNTADAMTEAVVSGMGIGALPVYAAVNGLKDGSLVRVLPRYSLFHLNVYALYPSRQYLDAKIRTWVEFLREHMPAMLAADEHSLAESGGLAN

SEQ ID NO: 29702 - protein, 158 aa, Pseudomonas aeruginosa
PPGGCPPILRSPADNARGVIRPTGCLPPSATPRSTPAGNSAVLPGRVPAGCARGSPRARRVRWSPASSSGCGGARRTAGSRRCRRRPRSSGRSPRSWRPGCAAIAARPSAPPVRTGRRAGWCPRAGRYAGTAGCRVGVPWPVRPADGPGAPPSPGGRC

SEQ ID NO: 29703 - protein, 324 aa, Pseudomonas aeruginosa
TGAGRRDRNAWALHGVRQIRTRHCVIANSQNASILSFSSHHPLGHGKPRMSESAFAPWIGRQEETHDQLSRNLVKRIAATFGEPTPAHGEALPPLWHWAFFQDPVEAAGLGVDGHPARGGFLPPADDRNRMWAGGRLEFHQPLRVGGEASRTSTILRVEEKHGRSGALLFVTLRHDYRQDGQLALSEEHDIVYREPTPPKLGGTEALPEGDWREALEPDPVLLFRYSAVTFNGHRIHYDWPYVTDAEGYPGLVVHGPLIATLALRAFCRANPQARLRRFAYRGLRPLICPEPFEVGGRLLAAGKAEVWVGNGAGLAQRGDVEFD

SEQ ID NO: 29704 - protein, 401 aa, Pseudomonas aeruginosa
KGPSAHPTTRIEESPMNPNSEELNAIREGVRALCAEFDAAYWRRIDEQRGFPEAFVKALTDAGWLSAMIPEEYGGSGLGLAEASVILEEVNRCGGNSGTVHGQMYNMFTLLRNGSEAQKRFYLPKLASGELRLQSMGVTEPTTGTDTTKIKTTAVRKGDRYVINGQKVWISRIQHSDLMILLARTTPLAEVKRKSEGMSIFLVDLREAIGKGLTVQPIANMVNHETNELFFDNLEIPADSLIGEEGKGFRYILDGLNAERTLIAAECIGDGRWFIDKASHYARDRVVFGRPIGQNQGVQFPIAEAHIEVEAADLMRWRACQEYDAGLNAGASANMAKYLAAKASWEAANACLQTHGGFGFACEYDVERKFRETRLYQVAPISTNLILSYVAEHLLELPRSF

SEQ ID NO: 29705 - protein, 349 aa, Pseudomonas aeruginosa
RADPAQPAAQLAVFRRPGERRGFPRGGAGRPAQQLGAAPRGGGLPCCPGRGPGPRPQRRRADPRGGGRLRGRHPHRRIPRPFPLPGVPYHCHGRHPRRGSGGGQADGLRPRALRRPARQRRNPGRRALGVPPRRRRFQAVAYRQGRRRRAARRLSHRRRPERRATHPRRRAGDGRRDVQRRRPRAPGGSPRQPLGVAGNLVQVPRLVPPYPSRGRRAAGADAARRARSLADRRGHRAGPPGRHRRARPGGRAADRAPGEVLHGHRAGPDRRVRQGRPRRVPSACAERPAGRSVPRAGRDAPGPGGRCRLSAALARAGRSARSPGAAPYRRHRRTQGRSRQYPQPRRTGR

SEQ ID NO: 29706 - protein, 383 aa, Pseudomonas aeruginosa
SSKPSPPCRPPRWWRAWNRRRSPAPTSTTWPGSGRTRSYRRGNAGPPSTARPGACRRCCRRPAAAPSFRAWMRCRRWAATATRCLPNWAVPRPISSACARPERYEEADMNRQIVRSALFVPATRPERIPKALASGADRVIVDLEDAVEEGLKVEARANLRRFLVDTPEARVLVRINAAEHPGHADDLALCRDHAGVIGLLLPKVESAAQVRHAAVASGKPVWPIVESARGLAALGEIAAAAGVERLSFGSLDLALDLDLNSGSNAAEQILGHARYALLLQTRLAGLAPPLDGVYPAIQNRAGLVEAVRFARDMGFGGLLCIHPSQVEPIHQTLMPSPAELEWARRVAEAGASGAGVFVVDGEMVDAPVLGRARRLLERAGEGG

SEQ ID NO: 29707 - protein, 524 aa, Pseudomonas aeruginosa
RPCSSPASAPRTSTTSASSRPTSRWWCRSASAWCCCATWKSSSTCCAVASSGWASPTRPPRPPNWPAKRPGRTVHDRADPVPAAVPVHVHRRAHRHLPGAVRRPDDPAVQPGFGALAGDQAVRDLRGLHPAGDPVLPALRRVHDHRWRGAAPDRLRQCLRRAYPRRPGDRCGACLHAVRRAVRFVAGDSGGGRLDRCGRHGPLRLSARLRRGDHLQCRDPGHPHPAIDRDGGVRRRHRDLGGQAVRRRGGSGAAARGDPDGGDLHRRAGQEAAGAAARQLPRVAGRRTPCRLGPVVAGDHPRRHVFRAVHPHRGGGGGGGVFGLRRAVRVQGHAPARLSQGAAGVGAAEHHADVHHRQCHALRPRVDHRADPPADHRMGGAGRPDPDRLPADGQRGAAGRRQLHGALGDRADPGADLLPHRHEAGHRPDPPGHRHGGEHGDRPGTPAGRPQPVRHFGGHRHAAWGDHPRGAAVADDPAAVPDPGDLRAVDLAVAAGPAGHELRSRRRGAGRAPPLAQGYDRRGL

SEQ ID NO: 29708 - protein, 171 aa, Pseudomonas aeruginosa
LLSALSRSGKTMVVWFVGCALATTGHNRNNTHVPRLKPCLRHPCTPCTRKRWHGPSPTKPPTRRCTSSPSSTPTASGASRPSGSTGSSRSRRSSRPPSTTITWTSSGSPTAPSTCRTTASTVTSPTAATRWRSSGKATIPPTTRKSPTASSTSRSAGSPTPCAGRTCTAAT

SEQ ID NO: 29709 - protein, 236 aa, Pseudomonas aeruginosa
LHRGTVLMITGYGATIVDGAWLTLQLALLSMLLAIVLGLLGAAFRLSPVRWLAWCGDLYATVVRGIPDLVLILLIFYGGQGLLNWVAPQLGYDDYIDLNPFVSGVGTLGFIFGAYLSETFRGAFMAIPKGQGEAGYAYGMSHRQVFFRIQVPQMIRLAIPGFTNNWLVLVKATALISVVGLQDMMFKAKQASDATREPFTYYLAVAGLYLLVTSVSLLLLRLLERRYSVGVKTAEL

SEQ ID NO: 29710 - protein, 189 aa, Pseudomonas aeruginosa
STASASVSAAIRRPMSRWSARPCARRWTPCRRRPRNWRACSACSIATPATPTWCSTCIATSRPPSISIPCRNNGPPSPPWPHAWAPLSGCSPRSPAAVPSTRPARCRGCACRACIRAPSCRWPAWRPPSNSAARPTPPCSRPRPTPRRSWPSSPSRASSRANGRRRPKPAAKACPSRAPNTSTPRIPAW

SEQ ID NO: 29711 - protein, 323 aa, Pseudomonas aeruginosa
PPSGRRNTDVRSPCAGRTCRFRPVYGPQLRPRRLHSGARRGIARLGPKRPRTDRFRRRHRRDLPGPRASGAGQGAHRAGPAHLARFQRLHQRAGPAPGAQAGGRHLRRAGVPRQLRRRSQRGGLQAGSPLRQRCLRPAEVRDHRRQQQLPRAHPVHRQRRRPAEVFRWLRAQVRGYHPRSLQRPGSAEGGDLRQDLRRGAGTDPGRGRRAAGAAGLPGRGAQAVRRAQRAAGLRRGPERHGPGRRAVRLHALRRGPGHPLQRQEPGRRLPYRCDADHRRDRQAPVGRHPRHHLRRQPAGVGGGRGGAGRDQYPGSAGWREGQA

SEQ ID NO: 29712 - protein, 155 aa, Pseudomonas aeruginosa
ALQVPPAEDRPGVRHLRRDPRHGPADRCGADRRVEGQGQGCAQRRRERGGHGAPGQPGRGALRAEPGDRRRRDRRRPGALRARRGQAGPRLSEPTGPRRRPGHPMRHPGAARAGAGNRAAVRGAGSSLLDVRNRGTGRCRGPAHGCGNHRCLRKE

SEQ ID NO: 29713 - protein, 363 aa, Pseudomonas aeruginosa
SRRGPGRRRRRQRAPGSGLKEPVMIVRPVTSADLPALIELARSTGTGLTTLPANEQRLQHRVSWAEKAFRGEAERGDADYLFVLEDDAGKVVGISAIAGAVGLREPWYNYRVGLTVSASQELNIHREIPTLFLANDLTGNSELCSLFLHADHRSGLNGKLLSRARFLFIAEFRHLFGDKLIAEMRGMSDEEGRSPFWESLGRHFFKMEFSQADYLTGVGNKAFIAELMPKFPLYTCFLSEEARGVIGRVHPNTEPALAMLKAEGFSYQGYVDIFDAGPAIEAETDKIRAIAESQNLVLAVGTPGDDAEPYLIHNRKREDCRITAAPARAAAGTLVVDPLTAKRLRLSAGASVRAVPLSAQKRG

SEQ ID NO: 29714 - protein, 502 aa, Pseudomonas aeruginosa
KPDGGVPARAPEESMMSTHYIAGQWLAGQGETLESLDPVGQGVVWSGRGADVTQVDAAVRAAREAFPAWARRPLEQRIELLERFAATLKSRADELARVIGEETGKPLWESATEVTSMVNKVAISVQAFRERTGEKSGPLADATAVLRHKPHGVVAVFGPYNFPGHLPNGHIVPALLAGNCVVFKPSELTPKVAELTLKAWIQAGLPAGVLNLVQGGRETGVALAAHRGLDGLFFTGSSRTGNLLHSQFGGQPQKILALEMGGNNPLVVEEVADLDAAVYTIIQSAFISAGQRCTCARRLLVPQGAWGDALLARLVAVSATLRVGRFDEQPAPFMGAVISLSAAEHLLKAQEHLIGKGAQPLLAMTQPIDGAALLTPGILDVSAVAERPDEEFFGPLLQVIRYSDFAAAIREANATQYGLAAGLLSDSRERFEQFLVESRAGIVNWNKQLTGAASSAPFGGIGASGNHRPSAYYAADYCAYPVASLESPSVSLPATLTPGISL

SEQ ID NO: 29715 - protein, 116 aa, Pseudomonas aeruginosa
RRSLNWARFIPSNSIESLATMSDSLQLILEDTDGTQLETSCTRFAVVWQGKEVWVQQAGNGQLLIGVDVEDGDTEYTNLLLRPMATNLVSLQLEMEPIEEGDDHEHGPDCGCDHTH

SEQ ID NO: 29716 - protein, 294 aa, Pseudomonas aeruginosa
RRRPVALGRYPRQRDRAHRTARTADPQGRRWHPQACRQGPLPVRQPRSHPPRRALRRTGHEPPVQRSPRGGQRQRGLPCRRAGAPGPGVLQQDRASPPALRPAYRDPRLEDRAVRPLPLGRGPPAFPQRTGPPARRRHRGGAVAEQAGHHLQRLHLRPARRGGLYPGTGQGTSVRREPGGQPGAPGAEPGAADRRQRGTAGRLPARRPQAVQRVARGDQAQRPLPPAPRRRRGQLHRTLAGLPAGRGYRRHALGGGRGRRAHHLPQSTGEERPACRNPGGAGQALRRIGLPSRS

SEQ ID NO: 29717 - protein, 354 aa, Pseudomonas aeruginosa
DRAFPPNRGALRACHRPAQRHRHPAHRRHARSHGRGRTGRRRLWRGPHGQPPGGRTGGAPGLRRGALRTDRDHEQPARIDGPLRARRRIHRRPAGAYLQIRGRRCRGAGLDPAAADRRRGRRIAPPGQGRGGDQGRRFPLRQDPPAGPGKHHAGQGAAARLPGRGARLHSRAWPGPAPGWRAPVQRGGEAGRRRQRDHPTLRLGVGVPVQGPRCAGGLGALRQRRTDRQGPSLAQDGRRRDAPGRPVGGCRPVRPRPPGGTPGRRPRQRRAPGRRAARTGLCGGAGADQHGLCRCRRAGGRAARLPRRARGADQRGGAFAPGHPPGRFRRVHRTSTGCLRGLSSLISEKVGNRQ

SEQ ID NO: 29718 - protein, 142 aa, Pseudomonas aeruginosa
TCPRKSSGSPSTPPTTRPTTSGPRKSACPPSVWCGSATTRARPMRPTTSGRWAIPDLAVPAPRSSSTMGRRSGAARPVRRKRTATATSRSGTTCSCSSTAPRTASCTRCRRRAWTPAWAWSASARYSSTCTRTMRSTCSRTC

SEQ ID NO: 29719 - protein, 516 aa, Pseudomonas aeruginosa
RPRKNSSPRPWSKALKILEQDLAELQGSVIPGNVVFKLYDTYGFPVDLTNDIARERELTIDEDGFEREMEAQRERARASSAFGMDYNSLVKVDGETRFLGYQGVSGAGQIVALFRDGQAVERLEEGEEGVVVLDQTPFYAESGGQVGDSGYLEAAGVRFDVRDTTKAGGAHLHHGVVARGNLSVGGAVKAEVDASVRQATALNHSATHLLHAALRQVLGDHVQQKGSLVDSQRLRFDFSHFEAIKAEQLKALEDIVNAEIRRNTEVETEETDIDTAKAKGAMALFGEKYGDQVRVLSMGGDFSVELCGGTHVSRTGDIGLFKITSEGGVAAGVRRIEAVTGAAALAYLNGAEEQLKEAASLVKGSRDNLLDKLGALLERNRSLEKELEQLKAKAASAAGDDLSAAAVEIKGAKVLAARLDGLDGKALLALVDQLKNKLGRAVILLGGELDGKVVLVAGVTQDLTGQLKAGELMKQAAAAVGGKGGGRPDMAQGGGTDAAKLDEALALAQRFVEQGL

SEQ ID NO: 29720 - protein, 461 aa, Pseudomonas aeruginosa
CHAGPAPERCGAGRPAPLDARPAVRPASPGSERMWQVQKGALHGIRRFEMALIVQKFGGTSVGTVERIEQVAEKVKKFREAGDDVVVVVSAMSGETNRLIGLANQIMEQPVPRELDVMVSTGEQVTIALLSMALIKRGVPAVSYTGNQVRILTDSAHTKARILHIDDTHIRADLKAGRVVVVAGFQGVDGNGNITTLGRGGSDTTGVALAAALKADECQIYTDVDGVYTTDPRVVPQARRLDKITFEEMLEMASLGSKVLQIRAVEFAGKYNVPLRVLHSFQEGPGTLITIDDEEESMEQPIISGIAFNRDEAKLTIRGVPDTPGVAFKILGPISAANVEVDMIVQNVAHDNTTDFTFTVHRNDYLNALEILKQTAANIGAREAIGDTNIAKVSIVGVGMRSHAGVASRMFEALAKESINIQMISTSEIKVSVVIEEKYLELAVRALHTAFELDAPARQGE

SEQ ID NO: 29721 - protein, 161 aa, Pseudomonas aeruginosa
RYKFSTIEIPLAEARRCGLRPFRARLFGGPLHFRESSMSEPSSAASAASAMAGVGLAMYLPGIDGNALLGGFGGAIFFVVFARDYNALTRLGYLLVSWVGGYYAGIEALGRGLTQTSGMAAFVAATLCVTGGIGMLEWMRGGELPSWMRGLLRRRGGKSDG

SEQ ID NO: 29722 - protein, 160 aa, Pseudomonas aeruginosa
RCHPYIEERSMVMLISRRVGIVRLDAVISENLAQAAVSARGDQLITIVGSIVDHAPAGEPLPSLLPMEGGSRALNECRVRKGIAALTSLQGASETVDVQTGFHLYRGLFITRVVARRTAERGLSLTMTASQRRARRAGGRLLKTVVRLFHAGRATPCPAR

SEQ ID NO: 29723 - protein, 143 aa, Pseudomonas aeruginosa
TDGKPRRAAARASAFGAVLRGGPGRRADGLRDGHHPRGRQPGSGAALPAPPEGTARAYRQTVRGRLRRRAQGRAADQAPAGQRSGQASAGSHGHRPGDLPPGRGRLRRRPGIRALRPDFRAGGGQGRQADRSSDHRRDGRPDP

SEQ ID NO: 29724 - protein, 404 aa, Pseudomonas aeruginosa
RRRYLRLGLEVGAQPLGLAGHQPDHRLRRLAGDRPVRRLHRETGGAGRADADRCRHRWQFRQPDHHHDRPRHRARPGTADQQQSQPPAAQGAWRRAGQRPGVGRSDRRGGLLSLRQLGTGRGDDRRDDPEPAAGGDDGSADPDDPASFRTRSGDGLQRDDHCDDRQRRFLHLPRPGDDLPDVAGAPREKPPTGGFFHGGQISGETFGGDQDSTLRQRSPPLTKYSSTALVSRATKPSRRHSWSSQPPCSTRYSQPSDAAQAGQNSSRSAASSWRRPSTSTNSTRQVRWLARSRTRMVRPARSWRHSRNQGSAQGGAWSRTASSGSARSATDAQGQALEEVAQQLVAAGPVVAVAGLAKQGAQLGFGDREVDAVEDGMEVFLLEFEGDPQLLQDHVVAQRQLQRR

SEQ ID NO: 29725 - protein, 665 aa, Pseudomonas aeruginosa
CSDACRGDFGGAFQLCHRPDGRGGWSLLWGYWHQSLVYPERGLHRRLRGAGQPRWRPWRAVADLLVAGLGRFHQVRDLRPACRQPGRGRGDGAVGPGAPGGGAVRQAADLRGGCRPDRRGAVLRRQHDHPGDLGTVGGRRAGDRLRRPGALDGTAGAYRADRPVPDPEARHRADRHPVRPGHGALVRRPGGAGRLRGDPAAGSAAGDEPCMGRAFLQLASRHRCRHPRRHRTGADRRRGAVRRHGPLRSQADRPCLVPAGAAGAGAELLRPGRDHPFQRRGGAQPLLPAGAGLGAAADGGAVHPGHGDRLPGGDLRRLLPDPPGDPARLRAADDHPAHFQPRAGADLHRRGELGADGRRGPAGARLRVLGVAGGCLRRGGDRNHADHHPADGRGDLAPVEMAAVAGRPVLLRDARGGQPVLRRQPAQGDPGRRLPGHRGYRHLHPDVHLEAWPPTAGGASRRGLAAALGVHFQHARAAAAPGPGDRGVPYRAYRRGASRAAAQPVAQPGAARAGGAAHRGQRRQPTGFAGSPFRGRGLWRRVLPGDPALRLHGRARHPGCLAPVPSQRTGLQPDAHHLLPQPGDGDSIQAHRHGALARGVVRLPAEERQRQPALFQPAAQPGDRVGNPGRDLIRSAAKKRARLGAFFCAFLSAVAAASVPGCCRG

SEQ ID NO: 29726 - protein, 649 aa, Pseudomonas aeruginosa
RFTTDISAFHQSSQAAGDQRGGIGQGHQRVEPGWHGQVAGFPVGLELVLEASQPLEIVELFAPPEDQRAQALGQRRAAPWLEPGQRHHAEAEARVALGLVVEDEAEHEELHGQLRRVRVHAHQVEARQFAAVGFQQVGEGHRLALVADDGDAEEVQVRRGEAAQGEAFLAHLLAAQPGVRYRLQLVQRSLARFMELQGQAVALAAVPGVAQVFHFLALVLQVEAQQVDSRFFAELEGGQANVHVERQVLGTHLVEHRAGMVQFAEVAELPDQFGALHGRADRVVQGYHAATAAGVHEESVVALMEEQGLVAGQGQAAIRLVRVADDPRRALQLFRVRLADRRRCRAQQPAKGQGQEQQATAEGGAQGARGVGVQGELPPELVAVMHVLVGEQQQPDRGADHADAGAYVKRREGYFHQPAGTVEGAAEHGEQRGGQAQQAGFLPVEAFQQRKQGAHQQQHQGQGPGGRQPSAQTLREQEAEHADQAGDQVRGIDQAMWNEETEVFQAGVDRRCGAGKQQHDTGEEDQDRQDRCGETRGDADRLARHPQPARFEEQQQKAGQQQWQYHINQAVQEQGRGQRRGAQLAGERGQQHRLEHPDSARYVAEHAGGQGEQVDQQERREGWGFRQQQIKDGSGGGDVEGGDQQLQQR

SEQ ID NO: 29727 - protein, 365 aa, Pseudomonas aeruginosa
NSALRGRPGGACSEIPVRKIIHIDCDCFYAALEMRDDPSLRGKALAVGGSPDKRGVVATCSYEARAYGVRSAMAMRTALKLCPDLLVVRPRFDVYRAVSKQIHAIFRDYTDLIEPLSLDEAYLDVSASPHFAGSATRIAQDIRRRVAEELHITVSAGVAPNKFLAKIASDWRKPDGLFVITPEQVDGFVAELPVAKLHGVGKVTAERLARMGIRTCADLRQGSKLSLVREFGSFGERLWGLAHGIDERPVEVDSRRQSVSVECTFDRDLPDLAACLEELPTLLEELDGRLQRLDGSYRPDKPFVKLKFHNFTQTTVEQSGAGRDLESYRQLLGQAFARGNRPVRLIGVGVRLLDLQGAHEQLRLF

SEQ ID NO: 29728 - protein, 400 aa, Pseudomonas aeruginosa
SAIDEAQQVVGVPGVALPGRLRAIQHVQVLGAQVDEHAAVEGRIAETLRGIDPELVVLLPEYLHEHRRLAGLQHGVPVAAVQPVEHAEDAHLGQVAAAVVVVQADRPVGEVPQPGHVARIEHVPAERLGDDPDDVQWVRRGADLQRPERIVQVALLLEQLALGGRRLDAQASRQAADGQWQVKRIAFAGQQDRPVVAQGAERIGQAFAQGQAEEGRQQVAPGAPRERGKALAADLAGAVQQHLQAEQGQGRQACAEQGAVAAAEAGEAAGRDQQADAETVEVESVQVVEGAVGVEQYLYRRAADDGQHACQPRTEAHGKAIMEMQEQSAGEVHRDYIKEGVAQAGSDAPERQPGVVEDDPVLQAQHLPEHHQPRQQKEAVECLGAGWGEHQASPGEDAEA

SEQ ID NO: 29729 - protein, 467 aa, Pseudomonas aeruginosa
RTGCAWSEFAGVEAGGGQVGGGRGSVGQGLDGLVQLVQGRGRRRIVLLEQGFAGLAGRAQLRHATVAGGAMQPVDPLEQSGAVVVVAGLANRLAVRRQRGQQHRQHVGGEVGLAGGQAQPFLGVEHAQLAELRRTAHAGQRLAQAQSGPLQHYLGQLLLVDRLGQVVVHAGLQQCALLVGKRMCGERDHRHRADFPLGLPAADRLGGLAAVHAGHLHVHEDQVEALALHHLEGRVAAVHRGDLGAEVAEQGLHQQQVGRVVVDAEQPWRPSGNHGVGLVAARRADLKQLLQLALQLAGAGGLGLDLFVGQGRVVLRLLGGRAKHQGLAAEPFEFPERLAQLFRRMDRGRDAEHRQADRQLAGRRVAQAFLEAVEVGEFAHFQAEVGELVVQRAARQFLRFEQRHALARGPGGARLLVVVATFRQTQADPELGAFPWRTVDADLAAHLLDQALGDHQAQAGATGLSRQ

SEQ ID NO: 29730 - protein, 337 aa, Pseudomonas aeruginosa
VVGLAEGLEQGLLVLLGEADTGVLYADPQLRAVVAFVLEHGAHGDGAALGELDGVADQVGEDLLQPLRVALQLDRGIPVDQADQFQLLLVGGRSQHGQGVLDQVAEIEREVFQNQLAGLDLREIEDLVDDPQQAFRRFLDGREVFLLARAELAFLQQVCETEDAVERGADLVAHVGEELGLDPARLQGLLARQVQLDVLDLDGFQVLPYVLGGLVDVVLHFLLGALQRFRHAVDAGGQFVQLVAAHRWQAGFHAAFLELGDALADQFQRRVDRATHAQGEEGGDAEAGGDQQEAGEQAAISAQQSPVVRQFQFDPAEYALVVRLGGAGQAVVAAKNR
